United States Patent 11,640,849 (METHODS FOR HISTOLOGICAL DIAGNOSIS AND TREATMENT OF DISEASES) - sequence listing, part 76

SEQ ID NO: 2901921 - protein, 46 aa, Entamoeba invadens
RQKKREKKEMQKKELEREEIEKQKKAKLNEVKQKREEKAEINEKEA

SEQ ID NO: 2901922 - protein, 6 aa, Entamoeba invadens
RQKKTY

SEQ ID NO: 2901923 - protein, 7 aa, Entamoeba invadens
RQKRREG

SEQ ID NO: 2901924 - protein, 8 aa, Entamoeba invadens
RQKRRELR

SEQ ID NO: 2901925 - protein, 4 aa, Entamoeba invadens
RQKS

SEQ ID NO: 2901926 - protein, 9 aa, Entamoeba invadens
RQKSEELEK

SEQ ID NO: 2901927 - protein, 23 aa, Entamoeba invadens
RQKTDAERTRVEKQGGTNRSTQK

SEQ ID NO: 2901928 - protein, 8 aa, Entamoeba invadens
RQKVEGNG

SEQ ID NO: 2901929 - protein, 10 aa, Entamoeba invadens
RQKVNDEETI

SEQ ID NO: 2901930 - protein, 9 aa, Entamoeba invadens
RQKYSKGAD

SEQ ID NO: 2901931 - protein, 29 aa, Entamoeba invadens
RQLEEEKMAKEKSVEEYEKRRRENEKDFE

SEQ ID NO: 2901932 - protein, 5 aa, Entamoeba invadens
RQLEG

SEQ ID NO: 2901933 - protein, 4 aa, Entamoeba invadens
RQLG

SEQ ID NO: 2901934 - protein, 5 aa, Entamoeba invadens
RQLGE

SEQ ID NO: 2901935 - protein, 10 aa, Entamoeba invadens
RQLGKEKGEL

SEQ ID NO: 2901936 - protein, 5 aa, Entamoeba invadens
RQLKG

SEQ ID NO: 2901937 - protein, 5 aa, Entamoeba invadens
RQLNK

SEQ ID NO: 2901938 - protein, 13 aa, Entamoeba invadens
RQLPATPQTIGRK

SEQ ID NO: 2901939 - protein, 10 aa, Entamoeba invadens
RQLPWRETTD

SEQ ID NO: 2901940 - protein, 13 aa, Entamoeba invadens
RQLQEKDTEMEKR

SEQ ID NO: 2901941 - protein, 5 aa, Entamoeba invadens
RQLRA

SEQ ID NO: 2901942 - protein, 26 aa, Entamoeba invadens
RQLRSSQVNIEKNENDIINEEEKNQI

SEQ ID NO: 2901943 - protein, 7 aa, Entamoeba invadens
RQLTAET

SEQ ID NO: 2901944 - protein, 13 aa, Entamoeba invadens
RQMNETKLKTQEV

SEQ ID NO: 2901945 - protein, 19 aa, Entamoeba invadens
RQMPDPTSKRSKKRRMQEM

SEQ ID NO: 2901946 - protein, 9 aa, Entamoeba invadens
RQMRETAKR

SEQ ID NO: 2901947 - protein, 8 aa, Entamoeba invadens
RQMSGISQ

SEQ ID NO: 2901948 - protein, 8 aa, Entamoeba invadens
RQNDDDCP

SEQ ID NO: 2901949 - protein, 7 aa, Entamoeba invadens
RQNDEGV

SEQ ID NO: 2901950 - protein, 8 aa, Entamoeba invadens
RQNEEHDG

SEQ ID NO: 2901951 - protein, 10 aa, Entamoeba invadens
RQNENSENEA

SEQ ID NO: 2901952 - protein, 8 aa, Entamoeba invadens
RQNGNCEN

SEQ ID NO: 2901953 - protein, 9 aa, Entamoeba invadens
RQNIENQKK

SEQ ID NO: 2901954 - protein, 18 aa, Entamoeba invadens
RQNKTLEEQIQQKAENYC

SEQ ID NO: 2901955 - protein, 5 aa, Entamoeba invadens
RQNND

SEQ ID NO: 2901956 - protein, 9 aa, Entamoeba invadens
RQNNEIDTT

SEQ ID NO: 2901957 - protein, 5 aa, Entamoeba invadens
RQNNK

SEQ ID NO: 2901958 - protein, 7 aa, Entamoeba invadens
RQNPAKV

SEQ ID NO: 2901959 - protein, 23 aa, Entamoeba invadens
RQNPNPKESENKSQTLTDLPPVS

SEQ ID NO: 2901960 - protein, 7 aa, Entamoeba invadens
RQNSASM

SEQ ID NO: 2901961 - protein, 9 aa, Entamoeba invadens
RQNSPNGQD

SEQ ID NO: 2901962 - protein, 8 aa, Entamoeba invadens
RQNSTPLL

SEQ ID NO: 2901963 - protein, 6 aa, Entamoeba invadens
RQNTMS

SEQ ID NO: 2901964 - protein, 7 aa, Entamoeba invadens
RQNTNEY

SEQ ID NO: 2901965 - protein, 55 aa, Entamoeba invadens
RQNTPQKSKKEEKKPRPPKVEKEEKLKKSGGRKKKVKDIEKTTIQTIPSTTDMEQ

SEQ ID NO: 2901966 - protein, 5 aa, Entamoeba invadens
RQNYS

SEQ ID NO: 2901967 - protein, 8 aa, Entamoeba invadens
RQPEFSNY

SEQ ID NO: 2901968 - protein, 11 aa, Entamoeba invadens
RQPELNDNTKV

SEQ ID NO: 2901969 - protein, 12 aa, Entamoeba invadens
RQPITQPQRQQQ

SEQ ID NO: 2901970 - protein, 13 aa, Entamoeba invadens
RQPLRRQRLGLKP

SEQ ID NO: 2901971 - protein, 5 aa, Entamoeba invadens
RQPLS

SEQ ID NO: 2901972 - protein, 7 aa, Entamoeba invadens
RQPNKGN

SEQ ID NO: 2901973 - protein, 12 aa, Entamoeba invadens
RQPPKVSTKKNV

SEQ ID NO: 2901974 - protein, 10 aa, Entamoeba invadens
RQPSNMKQGY

SEQ ID NO: 2901975 - protein, 7 aa, Entamoeba invadens
RQPTLHK

SEQ ID NO: 2901976 - protein, 12 aa, Entamoeba invadens
RQPTPPLPQNDI

SEQ ID NO: 2901977 - protein, 16 aa, Entamoeba invadens
RQPTQQQAAVEPTEAN

SEQ ID NO: 2901978 - protein, 16 aa, Entamoeba invadens
RQPTQYSPQYQFPPQY

SEQ ID NO: 2901979 - protein, 8 aa, Entamoeba invadens
RQPTTVST

SEQ ID NO: 2901980 - protein, 5 aa, Entamoeba invadens
RQPVG

SEQ ID NO: 2901981 - protein, 6 aa, Entamoeba invadens
RQQESV

SEQ ID NO: 2901982 - protein, 4 aa, Entamoeba invadens
RQQG

SEQ ID NO: 2901983 - protein, 10 aa, Entamoeba invadens
RQQHQQKRVS

SEQ ID NO: 2901984 - protein, 15 aa, Entamoeba invadens
RQQKGKRHCSESGVD

SEQ ID NO: 2901985 - protein, 13 aa, Entamoeba invadens
RQQKSQQQQNTYQ

SEQ ID NO: 2901986 - protein, 4 aa, Entamoeba invadens
RQQN

SEQ ID NO: 2901987 - protein, 13 aa, Entamoeba invadens
RQQPKRAEAENAE

SEQ ID NO: 2901988 - protein, 44 aa, Entamoeba invadens
RQQQEEYKKQQAEEEKRRADIEEAERQSQLKKEEEQRAKDQAEM

SEQ ID NO: 2901989 - protein, 14 aa, Entamoeba invadens
RQQRTQQRPRTIQN

SEQ ID NO: 2901990 - protein, 6 aa, Entamoeba invadens
RQQRVE

SEQ ID NO: 2901991 - protein, 13 aa, Entamoeba invadens
RQQTNGPKKEHSQ

SEQ ID NO: 2901992 - protein, 11 aa, Entamoeba invadens
RQQTTPEKLDK

SEQ ID NO: 2901993 - protein, 11 aa, Entamoeba invadens
RQQVESDAEAV

SEQ ID NO: 2901994 - protein, 18 aa, Entamoeba invadens
RQRCEEESKKNTTRKARL

SEQ ID NO: 2901995 - protein, 51 aa, Entamoeba invadens
RQREEQLQNQNTSTQATQNEPVAAVPQAEATQQDNLQETKQTTQEPHEKSF

SEQ ID NO: 2901996 - protein, 7 aa, Entamoeba invadens
RQRESKY

SEQ ID NO: 2901997 - protein, 6 aa, Entamoeba invadens
RQRKEE

SEQ ID NO: 2901998 - protein, 16 aa, Entamoeba invadens
RQRKSSLASMQPSNPL

SEQ ID NO: 2901999 - protein, 10 aa, Entamoeba invadens
RQRNPPRPRT

SEQ ID NO: 2902000 - protein, 11 aa, Entamoeba invadens
RQRRPSEAGVE

SEQ ID NO: 2902001 - protein, 14 aa, Entamoeba invadens
RQRRSSVDETGRQK

SEQ ID NO: 2902002 - protein, 7 aa, Entamoeba invadens
RQRSCQT

SEQ ID NO: 2902003 - protein, 27 aa, Entamoeba invadens
RQSEEITSAPINASQQDLYTNPHIYIV

SEQ ID NO: 2902004 - protein, 6 aa, Entamoeba invadens
RQSEIK

SEQ ID NO: 2902005 - protein, 11 aa, Entamoeba invadens
RQSEVPKNCDE

SEQ ID NO: 2902006 - protein, 5 aa, Entamoeba invadens
RQSFE

SEQ ID NO: 2902007 - protein, 10 aa, Entamoeba invadens
RQSGFSKEEK

SEQ ID NO: 2902008 - protein, 11 aa, Entamoeba invadens
RQSGTSESDGL

SEQ ID NO: 2902009 - protein, 6 aa, Entamoeba invadens
RQSKAE

SEQ ID NO: 2902010 - protein, 10 aa, Entamoeba invadens
RQSKKEKGYN

SEQ ID NO: 2902011 - protein, 8 aa, Entamoeba invadens
RQSKKESD

SEQ ID NO: 2902012 - protein, 7 aa, Entamoeba invadens
RQSLPNE

SEQ ID NO: 2902013 - protein, 12 aa, Entamoeba invadens
RQSNGSLKGCGS

SEQ ID NO: 2902014 - protein, 8 aa, Entamoeba invadens
RQSNNQTS

SEQ ID NO: 2902015 - protein, 12 aa, Entamoeba invadens
RQSQKRENECSS

SEQ ID NO: 2902016 - protein, 10 aa, Entamoeba invadens
RQSQPRSTYF

SEQ ID NO: 2902017 - protein, 6 aa, Entamoeba invadens
RQSTDF

SEQ ID NO: 2902018 - protein, 11 aa, Entamoeba invadens
RQTASTNKITL

SEQ ID NO: 2902019 - protein, 6 aa, Entamoeba invadens
RQTDPI

SEQ ID NO: 2902020 - protein, 5 aa, Entamoeba invadens
RQTDY

SEQ ID NO: 2902021 - protein, 11 aa, Entamoeba invadens
RQTEPDKIDQL

SEQ ID NO: 2902022 - protein, 4 aa, Entamoeba invadens
RQTF

SEQ ID NO: 2902023 - protein, 5 aa, Entamoeba invadens
RQTFQ

SEQ ID NO: 2902024 - protein, 34 aa, Entamoeba invadens
RQTGYETKRMNEDSEEGSDDEMPDMDREDRKGST

SEQ ID NO: 2902025 - protein, 5 aa, Entamoeba invadens
RQTIR

SEQ ID NO: 2902026 - protein, 6 aa, Entamoeba invadens
RQTKAK

SEQ ID NO: 2902027 - protein, 12 aa, Entamoeba invadens
RQTLTKKEQAME

SEQ ID NO: 2902028 - protein, 6 aa, Entamoeba invadens
RQTNAS

SEQ ID NO: 2902029 - protein, 11 aa, Entamoeba invadens
RQTNGDDDVKN

SEQ ID NO: 2902030 - protein, 6 aa, Entamoeba invadens
RQTNPG

SEQ ID NO: 2902031 - protein, 15 aa, Entamoeba invadens
RQTNSEVFEQNADPV

SEQ ID NO: 2902032 - protein, 6 aa, Entamoeba invadens
RQTPLD

SEQ ID NO: 2902033 - protein, 19 aa, Entamoeba invadens
RQTRNGRPSFGKAGNAPAA

SEQ ID NO: 2902034 - protein, 19 aa, Entamoeba invadens
RQTRSSSTLTTSTVSRDEG

SEQ ID NO: 2902035 - protein, 6 aa, Entamoeba invadens
RQTTAN

SEQ ID NO: 2902036 - protein, 6 aa, Entamoeba invadens
RQTTMD

SEQ ID NO: 2902037 - protein, 10 aa, Entamoeba invadens
RQTTQERIEQ

SEQ ID NO: 2902038 - protein, 5 aa, Entamoeba invadens
RQVNQ

SEQ ID NO: 2902039 - protein, 14 aa, Entamoeba invadens
RQVQGTNKPLSSEQ

SEQ ID NO: 2902040 - protein, 5 aa, Entamoeba invadens
RQVTQ

SEQ ID NO: 2902041 - protein, 6 aa, Entamoeba invadens
RQVTQF

SEQ ID NO: 2902042 - protein, 13 aa, Entamoeba invadens
RQYEKSPSEPLQY

SEQ ID NO: 2902043 - protein, 10 aa, Entamoeba invadens
RQYSSKNYLP

SEQ ID NO: 2902044 - protein, 7 aa, Entamoeba invadens
RRAAPGP

SEQ ID NO: 2902045 - protein, 10 aa, Entamoeba invadens
RRADFKKGIQ

SEQ ID NO: 2902046 - protein, 8 aa, Entamoeba invadens
RRADPKNV

SEQ ID NO: 2902047 - protein, 20 aa, Entamoeba invadens
RRAGVKRRELENADQSTRDQ

SEQ ID NO: 2902048 - protein, 5 aa, Entamoeba invadens
RRAKE

SEQ ID NO: 2902049 - protein, 11 aa, Entamoeba invadens
RRAKEKKERMA

SEQ ID NO: 2902050 - protein, 20 aa, Entamoeba invadens
RRAQIGEQFDKDENTAPASE

SEQ ID NO: 2902051 - protein, 10 aa, Entamoeba invadens
RRASKSECNN

SEQ ID NO: 2902052 - protein, 4 aa, Entamoeba invadens
RRAV

SEQ ID NO: 2902053 - protein, 8 aa, Entamoeba invadens
RRAVSSEK

SEQ ID NO: 2902054 - protein, 7 aa, Entamoeba invadens
RRCDSEM

SEQ ID NO: 2902055 - protein, 8 aa, Entamoeba invadens
RRCKQPSE

SEQ ID NO: 2902056 - protein, 6 aa, Entamoeba invadens
RRCPPE

SEQ ID NO: 2902057 - protein, 5 aa, Entamoeba invadens
RRCTE

SEQ ID NO: 2902058 - protein, 7 aa, Entamoeba invadens
RRDDDLD

SEQ ID NO: 2902059 - protein, 6 aa, Entamoeba invadens
RRDDEQ

SEQ ID NO: 2902060 - protein, 6 aa, Entamoeba invadens
RRDDME

SEQ ID NO: 2902061 - protein, 9 aa, Entamoeba invadens
RRDEKLKTE

SEQ ID NO: 2902062 - protein, 8 aa, Entamoeba invadens
RRDEKTGK

SEQ ID NO: 2902063 - protein, 8 aa, Entamoeba invadens
RRDEKTGM

SEQ ID NO: 2902064 - protein, 11 aa, Entamoeba invadens
RRDENDAESIK

SEQ ID NO: 2902065 - protein, 5 aa, Entamoeba invadens
RRDGE

SEQ ID NO: 2902066 - protein, 7 aa, Entamoeba invadens
RRDGVNE

SEQ ID NO: 2902067 - protein, 5 aa, Entamoeba invadens
RRDIS

SEQ ID NO: 2902068 - protein, 4 aa, Entamoeba invadens
RRDK

SEQ ID NO: 2902069 - protein, 10 aa, Entamoeba invadens
RRDKRPNLVR

SEQ ID NO: 2902070 - protein, 21 aa, Entamoeba invadens
RRDKVGGTNDLIEGKKEGECD

SEQ ID NO: 2902071 - protein, 13 aa, Entamoeba invadens
RRDNLSERDLSAE

SEQ ID NO: 2902072 - protein, 8 aa, Entamoeba invadens
RRDNPNPM

SEQ ID NO: 2902073 - protein, 7 aa, Entamoeba invadens
RRDSCRA

SEQ ID NO: 2902074 - protein, 9 aa, Entamoeba invadens
RRDSLQQNT

SEQ ID NO: 2902075 - protein, 5 aa, Entamoeba invadens
RRDSP

SEQ ID NO: 2902076 - protein, 14 aa, Entamoeba invadens
RRDSPLETRPGKTV

SEQ ID NO: 2902077 - protein, 9 aa, Entamoeba invadens
RRDTPLTND

SEQ ID NO: 2902078 - protein, 6 aa, Entamoeba invadens
RRDTTV

SEQ ID NO: 2902079 - protein, 13 aa, Entamoeba invadens
RREANPDTFNSRN

SEQ ID NO: 2902080 - protein, 8 aa, Entamoeba invadens
RREDDTVS

SEQ ID NO: 2902081 - protein, 20 aa, Entamoeba invadens
RREDINVDEEEESSDEDGWS

SEQ ID NO: 2902082 - protein, 13 aa, Entamoeba invadens
RREEARDKTPGRY

SEQ ID NO: 2902083 - protein, 5 aa, Entamoeba invadens
RREEC

SEQ ID NO: 2902084 - protein, 11 aa, Entamoeba invadens
RREEEHEKERD

SEQ ID NO: 2902085 - protein, 5 aa, Entamoeba invadens
RREEI

SEQ ID NO: 2902086 - protein, 42 aa, Entamoeba invadens
RREEIGESSGTTDTSKSRKIEKEHPTTSPKREDKEDDESKKM

SEQ ID NO: 2902087 - protein, 13 aa, Entamoeba invadens
RREELDEDDDDAE

SEQ ID NO: 2902088 - protein, 8 aa, Entamoeba invadens
RREEQRDG

SEQ ID NO: 2902089 - protein, 7 aa, Entamoeba invadens
RREFSEK

SEQ ID NO: 2902090 - protein, 4 aa, Entamoeba invadens
RREG

SEQ ID NO: 2902091 - protein, 10 aa, Entamoeba invadens
RREIDNDRKD

SEQ ID NO: 2902092 - protein, 9 aa, Entamoeba invadens
RREKKDYES

SEQ ID NO: 2902093 - protein, 13 aa, Entamoeba invadens
RREKKYWSPEQKK

SEQ ID NO: 2902094 - protein, 21 aa, Entamoeba invadens
RRELERQQEMAKESVKRKEAL

SEQ ID NO: 2902095 - protein, 6 aa, Entamoeba invadens
RRELRE

SEQ ID NO: 2902096 - protein, 5 aa, Entamoeba invadens
RREMD

SEQ ID NO: 2902097 - protein, 7 aa, Entamoeba invadens
RRENEKV

SEQ ID NO: 2902098 - protein, 6 aa, Entamoeba invadens
RRENER

SEQ ID NO: 2902099 - protein, 27 aa, Entamoeba invadens
RRENKRQKIVDDEKQREEEERLKEEAR

SEQ ID NO: 2902100 - protein, 16 aa, Entamoeba invadens
RREQEVAEANEEFETV

SEQ ID NO: 2902101 - protein, 40 aa, Entamoeba invadens
RREQEVAEANEELETVKKDKFAKEKEAKNLKTENDEIKEK

SEQ ID NO: 2902102 - protein, 13 aa, Entamoeba invadens
RREQKEKRRQEKM

SEQ ID NO: 2902103 - protein, 5 aa, Entamoeba invadens
RRERN

SEQ ID NO: 2902104 - protein, 7 aa, Entamoeba invadens
RRERSKT

SEQ ID NO: 2902105 - protein, 7 aa, Entamoeba invadens
RRESPTN

SEQ ID NO: 2902106 - protein, 16 aa, Entamoeba invadens
RRETPSLTKIEKESHT

SEQ ID NO: 2902107 - protein, 7 aa, Entamoeba invadens
RRFDGRS

SEQ ID NO: 2902108 - protein, 6 aa, Entamoeba invadens
RRGAKK

SEQ ID NO: 2902109 - protein, 5 aa, Entamoeba invadens
RRGDD

SEQ ID NO: 2902110 - protein, 14 aa, Entamoeba invadens
RRGDYVDKNDKSDI

SEQ ID NO: 2902111 - protein, 5 aa, Entamoeba invadens
RRGGC

SEQ ID NO: 2902112 - protein, 7 aa, Entamoeba invadens
RRGKSTK

SEQ ID NO: 2902113 - protein, 4 aa, Entamoeba invadens
RRGN

SEQ ID NO: 2902114 - protein, 4 aa, Entamoeba invadens
RRGQ

SEQ ID NO: 2902115 - protein, 23 aa, Entamoeba invadens
RRGRETERVAERRRDTSEERAEM

SEQ ID NO: 2902116 - protein, 11 aa, Entamoeba invadens
RRGSFTKKGSL

SEQ ID NO: 2902117 - protein, 7 aa, Entamoeba invadens
RRGSTSA

SEQ ID NO: 2902118 - protein, 9 aa, Entamoeba invadens
RRGTSSLTF

SEQ ID NO: 2902119 - protein, 12 aa, Entamoeba invadens
RRHVATKGRSGD

SEQ ID NO: 2902120 - protein, 17 aa, Entamoeba invadens
RRIDAQKRKYVTNSRSL

SEQ ID NO: 2902121 - protein, 6 aa, Entamoeba invadens
RRIEQT

SEQ ID NO: 2902122 - protein, 16 aa, Entamoeba invadens
RRIKEDSYGSQSNSLS

SEQ ID NO: 2902123 - protein, 11 aa, Entamoeba invadens
RRIQKASEAMG

SEQ ID NO: 2902124 - protein, 12 aa, Entamoeba invadens
RRIQKENSSVGM

SEQ ID NO: 2902125 - protein, 7 aa, Entamoeba invadens
RRIQKTS

SEQ ID NO: 2902126 - protein, 6 aa, Entamoeba invadens
RRITPE

SEQ ID NO: 2902127 - protein, 10 aa, Entamoeba invadens
RRKDEASEDM

SEQ ID NO: 2902128 - protein, 10 aa, Entamoeba invadens
RRKDNPNKRR

SEQ ID NO: 2902129 - protein, 5 aa, Entamoeba invadens
RRKEA

SEQ ID NO: 2902130 - protein, 20 aa, Entamoeba invadens
RRKEEDDRRERSFRAMMNGH

SEQ ID NO: 2902131 - protein, 34 aa, Entamoeba invadens
RRKEKEESAKINENQPEKSQKSDANGETKSTRPI

SEQ ID NO: 2902132 - protein, 6 aa, Entamoeba invadens
RRKELN

SEQ ID NO: 2902133 - protein, 7 aa, Entamoeba invadens
RRKELNR

SEQ ID NO: 2902134 - protein, 10 aa, Entamoeba invadens
RRKEYERKRL

SEQ ID NO: 2902135 - protein, 20 aa, Entamoeba invadens
RRKFEKTKVEKLSRKQRPYY

SEQ ID NO: 2902136 - protein, 8 aa, Entamoeba invadens
RRKGFPDF

SEQ ID NO: 2902137 - protein, 11 aa, Entamoeba invadens
RRKGLTDDADI

SEQ ID NO: 2902138 - protein, 24 aa, Entamoeba invadens
RRKGYNKRGNNKRRYDTKPRKPSV

SEQ ID NO: 2902139 - protein, 6 aa, Entamoeba invadens
RRKHNS

SEQ ID NO: 2902140 - protein, 7 aa, Entamoeba invadens
RRKIGDE

SEQ ID NO: 2902141 - protein, 8 aa, Entamoeba invadens
RRKPRRQF

SEQ ID NO: 2902142 - protein, 9 aa, Entamoeba invadens
RRKRISRGA

SEQ ID NO: 2902143 - protein, 8 aa, Entamoeba invadens
RRKRNEIP

SEQ ID NO: 2902144 - protein, 11 aa, Entamoeba invadens
RRKRREEEREK

SEQ ID NO: 2902145 - protein, 11 aa, Entamoeba invadens
RRKSEKESQNS

SEQ ID NO: 2902146 - protein, 22 aa, Entamoeba invadens
RRKSGNFASHTQVKSDSSAFEK

SEQ ID NO: 2902147 - protein, 37 aa, Entamoeba invadens
RRKTEDEDVHPSTSKIQKLSTTISTEKDEDSNDEMNT

SEQ ID NO: 2902148 - protein, 5 aa, Entamoeba invadens
RRLAR

SEQ ID NO: 2902149 - protein, 8 aa, Entamoeba invadens
RRLEESRT

SEQ ID NO: 2902150 - protein, 10 aa, Entamoeba invadens
RRLEPEDNTD

SEQ ID NO: 2902151 - protein, 4 aa, Entamoeba invadens
RRLG

SEQ ID NO: 2902152 - protein, 12 aa, Entamoeba invadens
RRLKSENSITST

SEQ ID NO: 2902153 - protein, 9 aa, Entamoeba invadens
RRLSPSEKI

SEQ ID NO: 2902154 - protein, 7 aa, Entamoeba invadens
RRLTPRK

SEQ ID NO: 2902155 - protein, 7 aa, Entamoeba invadens
RRMQESK

SEQ ID NO: 2902156 - protein, 9 aa, Entamoeba invadens
RRNDGTKKA

SEQ ID NO: 2902157 - protein, 8 aa, Entamoeba invadens
RRNDISES

SEQ ID NO: 2902158 - protein, 50 aa, Entamoeba invadens
RRNDNNSDEENEEVDKKLANGKVGEQTLGQQHTQERKHHTRFQKKKPKFQ

SEQ ID NO: 2902159 - protein, 7 aa, Entamoeba invadens
RRNEEIK

SEQ ID NO: 2902160 - protein, 16 aa, Entamoeba invadens
RRNEFSADSRSRRGLQ

SEQ ID NO: 2902161 - protein, 183 aa, Entamoeba invadens
RRNESEGRCKKSRPIKEVEEESSDSKSIKKKKMKEEEESSSSEESYEPSSESSSSISPKRKKKVTKRRTKKTTKRVSRKSKKNKSSSSSSSSSDSSSYSSDSSSESSTSSSEEDRKKPIKKRATRKRGRKPVKRTSGISSSSSDESSSEEERPIKKSKKVTRKRKQKETSEDTSDEEHEKRNQ

SEQ ID NO: 2902162 - protein, 42 aa, Entamoeba invadens
RRNGEIEKSDVRRTRLSKNTPPPPTKEPKEIDLSYSATFRYL

SEQ ID NO: 2902163 - protein, 8 aa, Entamoeba invadens
RRNGETNW

SEQ ID NO: 2902164 - protein, 5 aa, Entamoeba invadens
RRNGK

SEQ ID NO: 2902165 - protein, 4 aa, Entamoeba invadens
RRNN

SEQ ID NO: 2902166 - protein, 13 aa, Entamoeba invadens
RRNQTEIDRHGRR

SEQ ID NO: 2902167 - protein, 14 aa, Entamoeba invadens
RRNREKSQRQNGIG

SEQ ID NO: 2902168 - protein, 8 aa, Entamoeba invadens
RRNSQRMK

SEQ ID NO: 2902169 - protein, 8 aa, Entamoeba invadens
RRNSSQFF

SEQ ID NO: 2902170 - protein, 4 aa, Entamoeba invadens
RRNT

SEQ ID NO: 2902171 - protein, 7 aa, Entamoeba invadens
RRPASGD

SEQ ID NO: 2902172 - protein, 5 aa, Entamoeba invadens
RRPDN

SEQ ID NO: 2902173 - protein, 7 aa, Entamoeba invadens
RRPDQIT

SEQ ID NO: 2902174 - protein, 10 aa, Entamoeba invadens
RRPERRSQKT

SEQ ID NO: 2902175 - protein, 6 aa, Entamoeba invadens
RRPGDV

SEQ ID NO: 2902176 - protein, 7 aa, Entamoeba invadens
RRPIDSK

SEQ ID NO: 2902177 - protein, 35 aa, Entamoeba invadens
RRPIQKKSGRVHKQLPQGAKSEKKDEEPSKEVQPE

SEQ ID NO: 2902178 - protein, 4 aa, Entamoeba invadens
RRPK

SEQ ID NO: 2902179 - protein, 10 aa, Entamoeba invadens
RRPPNGKGMY

SEQ ID NO: 2902180 - protein, 9 aa, Entamoeba invadens
RRPPPPFPS

SEQ ID NO: 2902181 - protein, 7 aa, Entamoeba invadens
RRPRRLP

SEQ ID NO: 2902182 - protein, 8 aa, Entamoeba invadens
RRPSDDKV

SEQ ID NO: 2902183 - protein, 6 aa, Entamoeba invadens
RRPSGI

SEQ ID NO: 2902184 - protein, 9 aa, Entamoeba invadens
RRPSGYVRS

SEQ ID NO: 2902185 - protein, 6 aa, Entamoeba invadens
RRPSRN

SEQ ID NO: 2902186 - protein, 5 aa, Entamoeba invadens
RRPTL

SEQ ID NO: 2902187 - protein, 6 aa, Entamoeba invadens
RRPTSR

SEQ ID NO: 2902188 - protein, 6 aa, Entamoeba invadens
RRQAAS

SEQ ID NO: 2902189 - protein, 8 aa, Entamoeba invadens
RRQAEAEV

SEQ ID NO: 2902190 - protein, 8 aa, Entamoeba invadens
RRQANPKM

SEQ ID NO: 2902191 - protein, 56 aa, Entamoeba invadens
RRQAQNSNGTAGSYEKSADGTTRSTVTNISSRNNSVGQPQFNSTPTQATPQQAQQA

SEQ ID NO: 2902192 - protein, 8 aa, Entamoeba invadens
RRQASHNS

SEQ ID NO: 2902193 - protein, 7 aa, Entamoeba invadens
RRQEAKD

SEQ ID NO: 2902194 - protein, 9 aa, Entamoeba invadens
RRQPEVKTE

SEQ ID NO: 2902195 - protein, 6 aa, Entamoeba invadens
RRQREL

SEQ ID NO: 2902196 - protein, 4 aa, Entamoeba invadens
RRQS

SEQ ID NO: 2902197 - protein, 8 aa, Entamoeba invadens
RRQSSTVK

SEQ ID NO: 2902198 - protein, 4 aa, Entamoeba invadens
RRRD

SEQ ID NO: 2902199 - protein, 12 aa, Entamoeba invadens
RRRETEKDDGKC

SEQ ID NO: 2902200 - protein, 6 aa, Entamoeba invadens
RRRRGY

SEQ ID NO: 2902201 - protein, 7 aa, Entamoeba invadens
RRRRTNR

SEQ ID NO: 2902202 - protein, 7 aa, Entamoeba invadens
RRRTYEG

SEQ ID NO: 2902203 - protein, 5 aa, Entamoeba invadens
RRRYR

SEQ ID NO: 2902204 - protein, 4 aa, Entamoeba invadens
RRSA

SEQ ID NO: 2902205 - protein, 17 aa, Entamoeba invadens
RRSADNEKRTKAKSVVD

SEQ ID NO: 2902206 - protein, 4 aa, Entamoeba invadens
RRSE

SEQ ID NO: 2902207 - protein, 8 aa, Entamoeba invadens
RRSGETIQ

SEQ ID NO: 2902208 - protein, 7 aa, Entamoeba invadens
RRSGNRY

SEQ ID NO: 2902209 - protein, 6 aa, Entamoeba invadens
RRSGSK

SEQ ID NO: 2902210 - protein, 8 aa, Entamoeba invadens
RRSKLEDD

SEQ ID NO: 2902211 - protein, 9 aa, Entamoeba invadens
RRSPSALGQ

SEQ ID NO: 2902212 - protein, 16 aa, Entamoeba invadens
RRSRRKSRASRSSKTQ

SEQ ID NO: 2902213 - protein, 28 aa, Entamoeba invadens
RRSSIHKSASKPVTEEEVHDESEEEKVE

SEQ ID NO: 2902214 - protein, 6 aa, Entamoeba invadens
RRSTDV

SEQ ID NO: 2902215 - protein, 10 aa, Entamoeba invadens
RRSTKPAKLT

SEQ ID NO: 2902216 - protein, 10 aa, Entamoeba invadens
RRSVSEQDIR

SEQ ID NO: 2902217 - protein, 7 aa, Entamoeba invadens
RRTAQEK

SEQ ID NO: 2902218 - protein, 27 aa, Entamoeba invadens
RRTDSDDDDDDVAYGGTTQENREDWQK

SEQ ID NO: 2902219 - protein, 5 aa, Entamoeba invadens
RRTED

SEQ ID NO: 2902220 - protein, 16 aa, Entamoeba invadens
RRTEDWKEAVKKTTEL

SEQ ID NO: 2902221 - protein, 13 aa, Entamoeba invadens
RRTEEPVDTTPEI

SEQ ID NO: 2902222 - protein, 8 aa, Entamoeba invadens
RRTEIKDL

SEQ ID NO: 2902223 - protein, 7 aa, Entamoeba invadens
RRTGEKK

SEQ ID NO: 2902224 - protein, 25 aa, Entamoeba invadens
RRTKEKNDREELEEKLEKKSEIVRR

SEQ ID NO: 2902225 - protein, 10 aa, Entamoeba invadens
RRTKSASRSQ

SEQ ID NO: 2902226 - protein, 17 aa, Entamoeba invadens
RRTKSSGKEKKGGACGM

SEQ ID NO: 2902227 - protein, 19 aa, Entamoeba invadens
RRTMNKQRKTQLKEKEMEK

SEQ ID NO: 2902228 - protein, 6 aa, Entamoeba invadens
RRTNGW

SEQ ID NO: 2902229 - protein, 12 aa, Entamoeba invadens
RRTNGWNIRALY

SEQ ID NO: 2902230 - protein, 4 aa, Entamoeba invadens
RRTP

SEQ ID NO: 2902231 - protein, 16 aa, Entamoeba invadens
RRTPASQRPPDIPGES

SEQ ID NO: 2902232 - protein, 5 aa, Entamoeba invadens
RRTSE

SEQ ID NO: 2902233 - protein, 7 aa, Entamoeba invadens
RRTTGYP

SEQ ID NO: 2902234 - protein, 4 aa, Entamoeba invadens
RRVD

SEQ ID NO: 2902235 - protein, 18 aa, Entamoeba invadens
RRVDESDNQRLQDEITEH

SEQ ID NO: 2902236 - protein, 8 aa, Entamoeba invadens
RRVDSGEM

SEQ ID NO: 2902237 - protein, 8 aa, Entamoeba invadens
RRVEEEKQ

SEQ ID NO: 2902238 - protein, 6 aa, Entamoeba invadens
RRVEGK

SEQ ID NO: 2902239 - protein, 12 aa, Entamoeba invadens
RRVGKTEDSTTK

SEQ ID NO: 2902240 - protein, 7 aa, Entamoeba invadens
RRVPEIT

SEQ ID NO: 2902241 - protein, 13 aa, Entamoeba invadens
RRVTSDPSSTTTD

SEQ ID NO: 2902242 - protein, 6 aa, Entamoeba invadens
RRYEEM

SEQ ID NO: 2902243 - protein, 8 aa, Entamoeba invadens
RRYGSNQA

SEQ ID NO: 2902244 - protein, 11 aa, Entamoeba invadens
RRYNQVSEKRN

SEQ ID NO: 2902245 - protein, 9 aa, Entamoeba invadens
RRYQNNKKI

SEQ ID NO: 2902246 - protein, 10 aa, Entamoeba invadens
RRYSHSVSSG

SEQ ID NO: 2902247 - protein, 7 aa, Entamoeba invadens
RRYTKSS

SEQ ID NO: 2902248 - protein, 7 aa, Entamoeba invadens
RRYTTAE

SEQ ID NO: 2902249 - protein, 4 aa, Entamoeba invadens
RSAD

SEQ ID NO: 2902250 - protein, 10 aa, Entamoeba invadens
RSADENGRQV

SEQ ID NO: 2902251 - protein, 7 aa, Entamoeba invadens
RSADEPM

SEQ ID NO: 2902252 - protein, 7 aa, Entamoeba invadens
RSADNNH

SEQ ID NO: 2902253 - protein, 8 aa, Entamoeba invadens
RSAIESTE

SEQ ID NO: 2902254 - protein, 32 aa, Entamoeba invadens
RSAKYNEQIEEKATQGIDAKATDDKSDTTKVT

SEQ ID NO: 2902255 - protein, 5 aa, Entamoeba invadens
RSAPE

SEQ ID NO: 2902256 - protein, 30 aa, Entamoeba invadens
RSAPEKRSESLKMAPKSPQTSPKEVSKRKS

SEQ ID NO: 2902257 - protein, 7 aa, Entamoeba invadens
RSAPGDV

SEQ ID NO: 2902258 - protein, 6 aa, Entamoeba invadens
RSAPQT

SEQ ID NO: 2902259 - protein, 26 aa, Entamoeba invadens
RSARREKAMKENRPAIETSSDSTYTA

SEQ ID NO: 2902260 - protein, 9 aa, Entamoeba invadens
RSASTMMSS

SEQ ID NO: 2902261 - protein, 5 aa, Entamoeba invadens
RSASV

SEQ ID NO: 2902262 - protein, 10 aa, Entamoeba invadens
RSATTLNTQK

SEQ ID NO: 2902263 - protein, 19 aa, Entamoeba invadens
RSCDGHNPVTGKKCPQDPY

SEQ ID NO: 2902264 - protein, 12 aa, Entamoeba invadens
RSCEGGTLEPEV

SEQ ID NO: 2902265 - protein, 5 aa, Entamoeba invadens
RSCPS

SEQ ID NO: 2902266 - protein, 25 aa, Entamoeba invadens
RSCTSTSTPNFTTDSPLVKTGSTDE

SEQ ID NO: 2902267 - protein, 14 aa, Entamoeba invadens
RSDCGVPTQSDGAY

SEQ ID NO: 2902268 - protein, 9 aa, Entamoeba invadens
RSDDAEPKI

SEQ ID NO: 2902269 - protein, 9 aa, Entamoeba invadens
RSDDEEEVI

SEQ ID NO: 2902270 - protein, 14 aa, Entamoeba invadens
RSDELTSVPTSNLS

SEQ ID NO: 2902271 - protein, 24 aa, Entamoeba invadens
RSDESELEVDEDEEDHALTKEGYI

SEQ ID NO: 2902272 - protein, 7 aa, Entamoeba invadens
RSDGAFK

SEQ ID NO: 2902273 - protein, 8 aa, Entamoeba invadens
RSDGIDNP

SEQ ID NO: 2902274 - protein, 12 aa, Entamoeba invadens
RSDHSMEEEKKD

SEQ ID NO: 2902275 - protein, 9 aa, Entamoeba invadens
RSDKQIPRL

SEQ ID NO: 2902276 - protein, 5 aa, Entamoeba invadens
RSDKR

SEQ ID NO: 2902277 - protein, 8 aa, Entamoeba invadens
RSDLSNEI

SEQ ID NO: 2902278 - protein, 8 aa, Entamoeba invadens
RSDNYEDQ

SEQ ID NO: 2902279 - protein, 8 aa, Entamoeba invadens
RSDQFSDQ

SEQ ID NO: 2902280 - protein, 10 aa, Entamoeba invadens
RSDQKNDEIE

SEQ ID NO: 2902281 - protein, 5 aa, Entamoeba invadens
RSDRK

SEQ ID NO: 2902282 - protein, 4 aa, Entamoeba invadens
RSDS

SEQ ID NO: 2902283 - protein, 7 aa, Entamoeba invadens
RSDSFSK

SEQ ID NO: 2902284 - protein, 7 aa, Entamoeba invadens
RSDSSFA

SEQ ID NO: 2902285 - protein, 5 aa, Entamoeba invadens
RSDTD

SEQ ID NO: 2902286 - protein, 8 aa, Entamoeba invadens
RSDTHPAL

SEQ ID NO: 2902287 - protein, 12 aa, Entamoeba invadens
RSDVKKDEYTYI

SEQ ID NO: 2902288 - protein, 11 aa, Entamoeba invadens
RSDVSKSKISA

SEQ ID NO: 2902289 - protein, 8 aa, Entamoeba invadens
RSEADARA

SEQ ID NO: 2902290 - protein, 7 aa, Entamoeba invadens
RSEAEEY

SEQ ID NO: 2902291 - protein, 9 aa, Entamoeba invadens
RSEATNRKF

SEQ ID NO: 2902292 - protein, 5 aa, Entamoeba invadens
RSEDI

SEQ ID NO: 2902293 - protein, 5 aa, Entamoeba invadens
RSEDS

SEQ ID NO: 2902294 - protein, 4 aa, Entamoeba invadens
RSEE

SEQ ID NO: 2902295 - protein, 16 aa, Entamoeba invadens
RSEEEARQLGAKARNV

SEQ ID NO: 2902296 - protein, 10 aa, Entamoeba invadens
RSEEETKAFG

SEQ ID NO: 2902297 - protein, 13 aa, Entamoeba invadens
RSEEEVELAGPTQ

SEQ ID NO: 2902298 - protein, 5 aa, Entamoeba invadens
RSEEL

SEQ ID NO: 2902299 - protein, 9 aa, Entamoeba invadens
RSEEPKALK

SEQ ID NO: 2902300 - protein, 12 aa, Entamoeba invadens
RSEERNKINATE

SEQ ID NO: 2902301 - protein, 8 aa, Entamoeba invadens
RSEESKPF

SEQ ID NO: 2902302 - protein, 31 aa, Entamoeba invadens
RSEETTKDDDTTEVKKSESDIEQDRAKAERL

SEQ ID NO: 2902303 - protein, 5 aa, Entamoeba invadens
RSEGL

SEQ ID NO: 2902304 - protein, 7 aa, Entamoeba invadens
RSEGYEN

SEQ ID NO: 2902305 - protein, 15 aa, Entamoeba invadens
RSEHPENEESDPSDN

SEQ ID NO: 2902306 - protein, 15 aa, Entamoeba invadens
RSEHPENEVSDPSDN

SEQ ID NO: 2902307 - protein, 11 aa, Entamoeba invadens
RSEIASKKCET

SEQ ID NO: 2902308 - protein, 57 aa, Entamoeba invadens
RSEKEKIEKEREKKPRRRKEKGEKGEEKEKKKKVEKSENNEKTETADGDTKVEGENI

SEQ ID NO: 2902309 - protein, 4 aa, Entamoeba invadens
RSEL

SEQ ID NO: 2902310 - protein, 6 aa, Entamoeba invadens
RSELDS

SEQ ID NO: 2902311 - protein, 9 aa, Entamoeba invadens
RSELKEQKG

SEQ ID NO: 2902312 - protein, 5 aa, Entamoeba invadens
RSEME

SEQ ID NO: 2902313 - protein, 6 aa, Entamoeba invadens
RSEMET

SEQ ID NO: 2902314 - protein, 18 aa, Entamoeba invadens
RSENLSSTACLGDSVLPS

SEQ ID NO: 2902315 - protein, 7 aa, Entamoeba invadens
RSENSAV

SEQ ID NO: 2902316 - protein, 5 aa, Entamoeba invadens
RSENT

SEQ ID NO: 2902317 - protein, 4 aa, Entamoeba invadens
RSEQ

SEQ ID NO: 2902318 - protein, 11 aa, Entamoeba invadens
RSERRERYSYG

SEQ ID NO: 2902319 - protein, 9 aa, Entamoeba invadens
RSESSPPYR

SEQ ID NO: 2902320 - protein, 9 aa, Entamoeba invadens
RSESVNASR

SEQ ID NO: 2902321 - protein, 4 aa, Entamoeba invadens
RSET

SEQ ID NO: 2902322 - protein, 14 aa, Entamoeba invadens
RSETTYANATKRQN

SEQ ID NO: 2902323 - protein, 5 aa, Entamoeba invadens
RSEVT

SEQ ID NO: 2902324 - protein, 13 aa, Entamoeba invadens
RSFASSETHPPPL

SEQ ID NO: 2902325 - protein, 21 aa, Entamoeba invadens
RSFDSSISGNFNREYGEPLTV

SEQ ID NO: 2902326 - protein, 6 aa, Entamoeba invadens
RSFPQQ

SEQ ID NO: 2902327 - protein, 17 aa, Entamoeba invadens
RSFSGEMKGETTKTEMA

SEQ ID NO: 2902328 - protein, 7 aa, Entamoeba invadens
RSFSQAK

SEQ ID NO: 2902329 - protein, 6 aa, Entamoeba invadens
RSFSTP

SEQ ID NO: 2902330 - protein, 6 aa, Entamoeba invadens
RSFTTN

SEQ ID NO: 2902331 - protein, 10 aa, Entamoeba invadens
RSGAAPFSCP

SEQ ID NO: 2902332 - protein, 4 aa, Entamoeba invadens
RSGD

SEQ ID NO: 2902333 - protein, 4 aa, Entamoeba invadens
RSGE

SEQ ID NO: 2902334 - protein, 8 aa, Entamoeba invadens
RSGEAVGG

SEQ ID NO: 2902335 - protein, 6 aa, Entamoeba invadens
RSGEDK

SEQ ID NO: 2902336 - protein, 8 aa, Entamoeba invadens
RSGETEDT

SEQ ID NO: 2902337 - protein, 13 aa, Entamoeba invadens
RSGFNPKNRQNPV

SEQ ID NO: 2902338 - protein, 6 aa, Entamoeba invadens
RSGGLG

SEQ ID NO: 2902339 - protein, 12 aa, Entamoeba invadens
RSGGSGGDSVRD

SEQ ID NO: 2902340 - protein, 4 aa, Entamoeba invadens
RSGI

SEQ ID NO: 2902341 - protein, 5 aa, Entamoeba invadens
RSGID

SEQ ID NO: 2902342 - protein, 6 aa, Entamoeba invadens
RSGKTT

SEQ ID NO: 2902343 - protein, 6 aa, Entamoeba invadens
RSGNGY

SEQ ID NO: 2902344 - protein, 6 aa, Entamoeba invadens
RSGNKN

SEQ ID NO: 2902345 - protein, 20 aa, Entamoeba invadens
RSGQYTPASAGNSPTNRPLK

SEQ ID NO: 2902346 - protein, 8 aa, Entamoeba invadens
RSGRFGRN

SEQ ID NO: 2902347 - protein, 5 aa, Entamoeba invadens
RSGRV

SEQ ID NO: 2902348 - protein, 10 aa, Entamoeba invadens
RSGSAESLNG

SEQ ID NO: 2902349 - protein, 7 aa, Entamoeba invadens
RSGSIGD

SEQ ID NO: 2902350 - protein, 9 aa, Entamoeba invadens
RSGSLTHPE

SEQ ID NO: 2902351 - protein, 5 aa, Entamoeba invadens
RSGSV

SEQ ID NO: 2902352 - protein, 8 aa, Entamoeba invadens
RSGTTLPS

SEQ ID NO: 2902353 - protein, 7 aa, Entamoeba invadens
RSGWISS

SEQ ID NO: 2902354 - protein, 7 aa, Entamoeba invadens
RSHRKEY

SEQ ID NO: 2902355 - protein, 10 aa, Entamoeba invadens
RSHTEDRLNE

SEQ ID NO: 2902356 - protein, 11 aa, Entamoeba invadens
RSHTRTPGGVE

SEQ ID NO: 2902357 - protein, 9 aa, Entamoeba invadens
RSHTSGQAF

SEQ ID NO: 2902358 - protein, 7 aa, Entamoeba invadens
RSHVTQE

SEQ ID NO: 2902359 - protein, 4 aa, Entamoeba invadens
RSIE

SEQ ID NO: 2902360 - protein, 11 aa, Entamoeba invadens
RSIEAPAGKEK

SEQ ID NO: 2902361 - protein, 5 aa, Entamoeba invadens
RSIGD

SEQ ID NO: 2902362 - protein, 6 aa, Entamoeba invadens
RSIGDE

SEQ ID NO: 2902363 - protein, 8 aa, Entamoeba invadens
RSIGDEGL

SEQ ID NO: 2902364 - protein, 5 aa, Entamoeba invadens
RSIKG

SEQ ID NO: 2902365 - protein, 7 aa, Entamoeba invadens
RSINTSI

SEQ ID NO: 2902366 - protein, 6 aa, Entamoeba invadens
RSIPQR

SEQ ID NO: 2902367 - protein, 8 aa, Entamoeba invadens
RSKDKNNI

SEQ ID NO: 2902368 - protein, 10 aa, Entamoeba invadens
RSKDSTRPSL

SEQ ID NO: 2902369 - protein, 10 aa, Entamoeba invadens
RSKEAESMAS

SEQ ID NO: 2902370 - protein, 10 aa, Entamoeba invadens
RSKEEERNKR

SEQ ID NO: 2902371 - protein, 10 aa, Entamoeba invadens
RSKEEVSDFK

SEQ ID NO: 2902372 - protein, 6 aa, Entamoeba invadens
RSKELS

SEQ ID NO: 2902373 - protein, 6 aa, Entamoeba invadens
RSKEMR

SEQ ID NO: 2902374 - protein, 30 aa, Entamoeba invadens
RSKEQAQHEFATGNTSKKTAKRRIQPTKRR

SEQ ID NO: 2902375 - protein, 6 aa, Entamoeba invadens
RSKERC

SEQ ID NO: 2902376 - protein, 15 aa, Entamoeba invadens
RSKETKLSELSGEEL

SEQ ID NO: 2902377 - protein, 4 aa, Entamoeba invadens
RSKG

SEQ ID NO: 2902378 - protein, 7 aa, Entamoeba invadens
RSKGGFS

SEQ ID NO: 2902379 - protein, 13 aa, Entamoeba invadens
RSKGVSEKTSYRR

SEQ ID NO: 2902380 - protein, 14 aa, Entamoeba invadens
RSKISKGSTSPPQI

SEQ ID NO: 2902381 - protein, 19 aa, Entamoeba invadens
RSKKDRSPSPSTDDTEQTK

SEQ ID NO: 2902382 - protein, 13 aa, Entamoeba invadens
RSKLPKSTKSKID

SEQ ID NO: 2902383 - protein, 7 aa, Entamoeba invadens
RSKNIRR

SEQ ID NO: 2902384 - protein, 10 aa, Entamoeba invadens
RSKNTSEEKR

SEQ ID NO: 2902385 - protein, 10 aa, Entamoeba invadens
RSKQEKEESL

SEQ ID NO: 2902386 - protein, 13 aa, Entamoeba invadens
RSKQKTYDGPSFP

SEQ ID NO: 2902387 - protein, 56 aa, Entamoeba invadens
RSKRGSDVSNGTIKQNTDYFPTTQQPAASIPQQQGFDQPQQSVPLPPQDKPTPVSS

SEQ ID NO: 2902388 - protein, 9 aa, Entamoeba invadens
RSKRRKINP

SEQ ID NO: 2902389 - protein, 18 aa, Entamoeba invadens
RSKRRSPVQCNSFTCVIM

SEQ ID NO: 2902390 - protein, 6 aa, Entamoeba invadens
RSKSRI

SEQ ID NO: 2902391 - protein, 10 aa, Entamoeba invadens
RSKSTNTVDT

SEQ ID NO: 2902392 - protein, 14 aa, Entamoeba invadens
RSKSVEKKDKVAEE

SEQ ID NO: 2902393 - protein, 9 aa, Entamoeba invadens
RSKTKASDT

SEQ ID NO: 2902394 - protein, 9 aa, Entamoeba invadens
RSKTLTCKN

SEQ ID NO: 2902395 - protein, 9 aa, Entamoeba invadens
RSKTSTTQS

SEQ ID NO: 2902396 - protein, 9 aa, Entamoeba invadens
RSKTSWIGS

SEQ ID NO: 2902397 - protein, 5 aa, Entamoeba invadens
RSKTT

SEQ ID NO: 2902398 - protein, 5 aa, Entamoeba invadens
RSKVT

SEQ ID NO: 2902399 - protein, 6 aa, Entamoeba invadens
RSKYSD

SEQ ID NO: 2902400 - protein, 10 aa, Entamoeba invadens
RSKYTYEDPL

SEQ ID NO: 2902401 - protein, 17 aa, Entamoeba invadens
RSLEEKSSISCKPPEIR

SEQ ID NO: 2902402 - protein, 26 aa, Entamoeba invadens
RSLGAKRVEVKGKKVVKDPTKKTDQV

SEQ ID NO: 2902403 - protein, 14 aa, Entamoeba invadens
RSLGDKQYKGKGAV

SEQ ID NO: 2902404 - protein, 12 aa, Entamoeba invadens
RSLGDKSYKGKG

SEQ ID NO: 2902405 - protein, 13 aa, Entamoeba invadens
RSLGDSTHQSANT

SEQ ID NO: 2902406 - protein, 6 aa, Entamoeba invadens
RSLGKD

SEQ ID NO: 2902407 - protein, 9 aa, Entamoeba invadens
RSLGQAKEN

SEQ ID NO: 2902408 - protein, 15 aa, Entamoeba invadens
RSLKGADFGGLSSDP

SEQ ID NO: 2902409 - protein, 7 aa, Entamoeba invadens
RSLKTGK

SEQ ID NO: 2902410 - protein, 5 aa, Entamoeba invadens
RSLPN

SEQ ID NO: 2902411 - protein, 6 aa, Entamoeba invadens
RSLPRS

SEQ ID NO: 2902412 - protein, 8 aa, Entamoeba invadens
RSLPSIPT

SEQ ID NO: 2902413 - protein, 7 aa, Entamoeba invadens
RSLQSSH

SEQ ID NO: 2902414 - protein, 5 aa, Entamoeba invadens
RSLRP

SEQ ID NO: 2902415 - protein, 13 aa, Entamoeba invadens
RSLSPENTTTTIS

SEQ ID NO: 2902416 - protein, 8 aa, Entamoeba invadens
RSLTKSQL

SEQ ID NO: 2902417 - protein, 4 aa, Entamoeba invadens
RSMG

SEQ ID NO: 2902418 - protein, 10 aa, Entamoeba invadens
RSMKDGVADM

SEQ ID NO: 2902419 - protein, 15 aa, Entamoeba invadens
RSMSASTSSIQHKEE

SEQ ID NO: 2902420 - protein, 12 aa, Entamoeba invadens
RSNAAAVKETRG

SEQ ID NO: 2902421 - protein, 61 aa, Entamoeba invadens
RSNANARKKLPAFEKKNENVKKNETEKSVQCEEDENLNQLQNSVEKDEKEGLKEKTVDTSK

SEQ ID NO: 2902422 - protein, 13 aa, Entamoeba invadens
RSNARLQYTQNGD

SEQ ID NO: 2902423 - protein, 7 aa, Entamoeba invadens
RSNEDNL

SEQ ID NO: 2902424 - protein, 8 aa, Entamoeba invadens
RSNGQEDF

SEQ ID NO: 2902425 - protein, 19 aa, Entamoeba invadens
RSNISEEKQICKNSKISFI

SEQ ID NO: 2902426 - protein, 11 aa, Entamoeba invadens
RSNNEKRMSAG

SEQ ID NO: 2902427 - protein, 6 aa, Entamoeba invadens
RSNNNA

SEQ ID NO: 2902428 - protein, 9 aa, Entamoeba invadens
RSNNSDHAN

SEQ ID NO: 2902429 - protein, 13 aa, Entamoeba invadens
RSNPIEKTDPSLK

SEQ ID NO: 2902430 - protein, 6 aa, Entamoeba invadens
RSNPQL

SEQ ID NO: 2902431 - protein, 5 aa, Entamoeba invadens
RSNPR

SEQ ID NO: 2902432 - protein, 6 aa, Entamoeba invadens
RSNQST

SEQ ID NO: 2902433 - protein, 4 aa, Entamoeba invadens
RSNR

SEQ ID NO: 2902434 - protein, 15 aa, Entamoeba invadens
RSNSTKTGAMSQSGS

SEQ ID NO: 2902435 - protein, 8 aa, Entamoeba invadens
RSNSTNEI

SEQ ID NO: 2902436 - protein, 6 aa, Entamoeba invadens
RSNTCK

SEQ ID NO: 2902437 - protein, 9 aa, Entamoeba invadens
RSNTFQDGK

SEQ ID NO: 2902438 - protein, 10 aa, Entamoeba invadens
RSNTSTTKSH

SEQ ID NO: 2902439 - protein, 5 aa, Entamoeba invadens
RSPAT

SEQ ID NO: 2902440 - protein, 4 aa, Entamoeba invadens
RSPD

SEQ ID NO: 2902441 - protein, 6 aa, Entamoeba invadens
RSPDEF

SEQ ID NO: 2902442 - protein, 12 aa, Entamoeba invadens
RSPDNDATREMT

SEQ ID NO: 2902443 - protein, 17 aa, Entamoeba invadens
RSPEKTGDAGDKFNERM

SEQ ID NO: 2902444 - protein, 9 aa, Entamoeba invadens
RSPGGDLGI

SEQ ID NO: 2902445 - protein, 18 aa, Entamoeba invadens
RSPLPHNRIKKDKNKQGV

SEQ ID NO: 2902446 - protein, 6 aa, Entamoeba invadens
RSPLSN

SEQ ID NO: 2902447 - protein, 19 aa, Entamoeba invadens
RSPNPFHSSKTNSPRPKAH

SEQ ID NO: 2902448 - protein, 7 aa, Entamoeba invadens
RSPNPLQ

SEQ ID NO: 2902449 - protein, 7 aa, Entamoeba invadens
RSPQNAL

SEQ ID NO: 2902450 - protein, 47 aa, Entamoeba invadens
RSPRDRSPPQYRRSPLNNNASFRSRSRSRSRGSNRRSSSRFRNRSPS

SEQ ID NO: 2902451 - protein, 5 aa, Entamoeba invadens
RSPRL

SEQ ID NO: 2902452 - protein, 6 aa, Entamoeba invadens
RSPRNS

SEQ ID NO: 2902453 - protein, 14 aa, Entamoeba invadens
RSPSAFSPIQNSAN

SEQ ID NO: 2902454 - protein, 5 aa, Entamoeba invadens
RSPSF

SEQ ID NO: 2902455 - protein, 6 aa, Entamoeba invadens
RSPSMS

SEQ ID NO: 2902456 - protein, 11 aa, Entamoeba invadens
RSPSPSSSRGF

SEQ ID NO: 2902457 - protein, 26 aa, Entamoeba invadens
RSPSSFTQTIADSSDLEKANAHPWNA

SEQ ID NO: 2902458 - protein, 10 aa, Entamoeba invadens
RSPSSNPLTI

SEQ ID NO: 2902459 - protein, 8 aa, Entamoeba invadens
RSPTEESP

SEQ ID NO: 2902460 - protein, 8 aa, Entamoeba invadens
RSPTGKFS

SEQ ID NO: 2902461 - protein, 6 aa, Entamoeba invadens
RSPTHG

SEQ ID NO: 2902462 - protein, 13 aa, Entamoeba invadens
RSPTNSKRSATPV

SEQ ID NO: 2902463 - protein, 6 aa, Entamoeba invadens
RSPVAV

SEQ ID NO: 2902464 - protein, 12 aa, Entamoeba invadens
RSQDETVGDGTT

SEQ ID NO: 2902465 - protein, 6 aa, Entamoeba invadens
RSQDGL

SEQ ID NO: 2902466 - protein, 9 aa, Entamoeba invadens
RSQEDIEKK

SEQ ID NO: 2902467 - protein, 5 aa, Entamoeba invadens
RSQEN

SEQ ID NO: 2902468 - protein, 10 aa, Entamoeba invadens
RSQEYSDRAP

SEQ ID NO: 2902469 - protein, 7 aa, Entamoeba invadens
RSQGDIP

SEQ ID NO: 2902470 - protein, 7 aa, Entamoeba invadens
RSQIGGL

SEQ ID NO: 2902471 - protein, 5 aa, Entamoeba invadens
RSQIQ

SEQ ID NO: 2902472 - protein, 14 aa, Entamoeba invadens
RSQISVRKGEKKTV

SEQ ID NO: 2902473 - protein, 6 aa, Entamoeba invadens
RSQKRK

SEQ ID NO: 2902474 - protein, 5 aa, Entamoeba invadens
RSQLQ

SEQ ID NO: 2902475 - protein, 4 aa, Entamoeba invadens
RSQN

SEQ ID NO: 2902476 - protein, 11 aa, Entamoeba invadens
RSQNSEHTNTP

SEQ ID NO: 2902477 - protein, 8 aa, Entamoeba invadens
RSQNTNSV

SEQ ID NO: 2902478 - protein, 8 aa, Entamoeba invadens
RSQPPPLP

SEQ ID NO: 2902479 - protein, 4 aa, Entamoeba invadens
RSQQ

SEQ ID NO: 2902480 - protein, 9 aa, Entamoeba invadens
RSQQDINNG

SEQ ID NO: 2902481 - protein, 10 aa, Entamoeba invadens
RSQQDINNGM

SEQ ID NO: 2902482 - protein, 15 aa, Entamoeba invadens
RSQQQQRDQAEQQRW

SEQ ID NO: 2902483 - protein, 16 aa, Entamoeba invadens
RSQRRTAAKDKEIETL

SEQ ID NO: 2902484 - protein, 29 aa, Entamoeba invadens
RSQSIDKNNDVSQHKSIEKKSSRSESAPW

SEQ ID NO: 2902485 - protein, 7 aa, Entamoeba invadens
RSQYDPT

SEQ ID NO: 2902486 - protein, 10 aa, Entamoeba invadens
RSRCDKNEKK

SEQ ID NO: 2902487 - protein, 8 aa, Entamoeba invadens
RSRDSDKM

SEQ ID NO: 2902488 - protein, 8 aa, Entamoeba invadens
RSRDSDVV

SEQ ID NO: 2902489 - protein, 7 aa, Entamoeba invadens
RSRDSIH

SEQ ID NO: 2902490 - protein, 5 aa, Entamoeba invadens
RSRFK

SEQ ID NO: 2902491 - protein, 9 aa, Entamoeba invadens
RSRNDKEKI

SEQ ID NO: 2902492 - protein, 7 aa, Entamoeba invadens
RSRRSEF

SEQ ID NO: 2902493 - protein, 10 aa, Entamoeba invadens
RSRSSSSPLR

SEQ ID NO: 2902494 - protein, 15 aa, Entamoeba invadens
RSSAAVKAKKQATFT

SEQ ID NO: 2902495 - protein, 7 aa, Entamoeba invadens
RSSAVDG

SEQ ID NO: 2902496 - protein, 16 aa, Entamoeba invadens
RSSCGIASTKSSDIPF

SEQ ID NO: 2902497 - protein, 7 aa, Entamoeba invadens
RSSDPGV

SEQ ID NO: 2902498 - protein, 13 aa, Entamoeba invadens
RSSEDDDAPPLGR

SEQ ID NO: 2902499 - protein, 9 aa, Entamoeba invadens
RSSETFPKV

SEQ ID NO: 2902500 - protein, 13 aa, Entamoeba invadens
RSSFKEKGEEKTV

SEQ ID NO: 2902501 - protein, 7 aa, Entamoeba invadens
RSSFSNI

SEQ ID NO: 2902502 - protein, 12 aa, Entamoeba invadens
RSSGTTSGESEW

SEQ ID NO: 2902503 - protein, 7 aa, Entamoeba invadens
RSSISEG

SEQ ID NO: 2902504 - protein, 8 aa, Entamoeba invadens
RSSKDEDM

SEQ ID NO: 2902505 - protein, 7 aa, Entamoeba invadens
RSSKKSD

SEQ ID NO: 2902506 - protein, 9 aa, Entamoeba invadens
RSSKTFEAC

SEQ ID NO: 2902507 - protein, 6 aa, Entamoeba invadens
RSSLRE

SEQ ID NO: 2902508 - protein, 4 aa, Entamoeba invadens
RSSN

SEQ ID NO: 2902509 - protein, 11 aa, Entamoeba invadens
RSSNEGRSEME

SEQ ID NO: 2902510 - protein, 7 aa, Entamoeba invadens
RSSNEIT

SEQ ID NO: 2902511 - protein, 5 aa, Entamoeba invadens
RSSNT

SEQ ID NO: 2902512 - protein, 10 aa, Entamoeba invadens
RSSPEKVKSY

SEQ ID NO: 2902513 - protein, 11 aa, Entamoeba invadens
RSSPGETDISS

SEQ ID NO: 2902514 - protein, 5 aa, Entamoeba invadens
RSSPR

SEQ ID NO: 2902515 - protein, 11 aa, Entamoeba invadens
RSSPSDYIETA

SEQ ID NO: 2902516 - protein, 14 aa, Entamoeba invadens
RSSPSQDDCPTPNI

SEQ ID NO: 2902517 - protein, 11 aa, Entamoeba invadens
RSSQASPRDKE

SEQ ID NO: 2902518 - protein, 9 aa, Entamoeba invadens
RSSQEKTLD

SEQ ID NO: 2902519 - protein, 7 aa, Entamoeba invadens
RSSQPLV

SEQ ID NO: 2902520 - protein, 16 aa, Entamoeba invadens
RSSQTSKEENTRLKEE

SEQ ID NO: 2902521 - protein, 19 aa, Entamoeba invadens
RSSREIRGRSQSRGINGRE

SEQ ID NO: 2902522 - protein, 13 aa, Entamoeba invadens
RSSRHKLTFNFNV

SEQ ID NO: 2902523 - protein, 7 aa, Entamoeba invadens
RSSRKEY

SEQ ID NO: 2902524 - protein, 66 aa, Entamoeba invadens
RSSRTTYSDLESQSTTSMSSSKADTSNSRGGRSNSRGGRSNSRERSSSRERSSSRERSSRGEGRKE

SEQ ID NO: 2902525 - protein, 4 aa, Entamoeba invadens
RSSS

SEQ ID NO: 2902526 - protein, 6 aa, Entamoeba invadens
RSSSDV

SEQ ID NO: 2902527 - protein, 8 aa, Entamoeba invadens
RSSSSASY

SEQ ID NO: 2902528 - protein, 4 aa, Entamoeba invadens
RSST

SEQ ID NO: 2902529 - protein, 5 aa, Entamoeba invadens
RSSTI

SEQ ID NO: 2902530 - protein, 5 aa, Entamoeba invadens
RSSTQ

SEQ ID NO: 2902531 - protein, 7 aa, Entamoeba invadens
RSSTSDI

SEQ ID NO: 2902532 - protein, 6 aa, Entamoeba invadens
RSSTTC

SEQ ID NO: 2902533 - protein, 7 aa, Entamoeba invadens
RSSVGKV

SEQ ID NO: 2902534 - protein, 6 aa, Entamoeba invadens
RSSVGR

SEQ ID NO: 2902535 - protein, 8 aa, Entamoeba invadens
RSSVNDAD

SEQ ID NO: 2902536 - protein, 10 aa, Entamoeba invadens
RSSYESEGFD

SEQ ID NO: 2902537 - protein, 5 aa, Entamoeba invadens
RSSYT

SEQ ID NO: 2902538 - protein, 4 aa, Entamoeba invadens
RSTA

SEQ ID NO: 2902539 - protein, 7 aa, Entamoeba invadens
RSTAKNL

SEQ ID NO: 2902540 - protein, 10 aa, Entamoeba invadens
RSTATLSGQN

SEQ ID NO: 2902541 - protein, 4 aa, Entamoeba invadens
RSTC

SEQ ID NO: 2902542 - protein, 12 aa, Entamoeba invadens
RSTEIPKESQLF

SEQ ID NO: 2902543 - protein, 6 aa, Entamoeba invadens
RSTEQS

SEQ ID NO: 2902544 - protein, 6 aa, Entamoeba invadens
RSTFEN

SEQ ID NO: 2902545 - protein, 5 aa, Entamoeba invadens
RSTIQ

SEQ ID NO: 2902546 - protein, 4 aa, Entamoeba invadens
RSTK

SEQ ID NO: 2902547 - protein, 8 aa, Entamoeba invadens
RSTKEAED

SEQ ID NO: 2902548 - protein, 5 aa, Entamoeba invadens
RSTKL

SEQ ID NO: 2902549 - protein, 5 aa, Entamoeba invadens
RSTKM

SEQ ID NO: 2902550 - protein, 10 aa, Entamoeba invadens
RSTKQLSAEP

SEQ ID NO: 2902551 - protein, 11 aa, Entamoeba invadens
RSTKSSKKTLQ

SEQ ID NO: 2902552 - protein, 20 aa, Entamoeba invadens
RSTKTTTAKPTEAPAQATAA

SEQ ID NO: 2902553 - protein, 21 aa, Entamoeba invadens
RSTKTTTAKPTEAPAQATTAP

SEQ ID NO: 2902554 - protein, 10 aa, Entamoeba invadens
RSTNEPEVSI

SEQ ID NO: 2902555 - protein, 8 aa, Entamoeba invadens
RSTNWTEN

SEQ ID NO: 2902556 - protein, 5 aa, Entamoeba invadens
RSTPQ

SEQ ID NO: 2902557 - protein, 7 aa, Entamoeba invadens
RSTPSFS

SEQ ID NO: 2902558 - protein, 29 aa, Entamoeba invadens
RSTPTPKTRRPNSPYPRRSASSESGEKEF

SEQ ID NO: 2902559 - protein, 14 aa, Entamoeba invadens
RSTSDEVAACSPPD

SEQ ID NO: 2902560 - protein, 34 aa, Entamoeba invadens
RSTSPVGIRTSQIRKQRSPSPMRTGSESPKTANI

SEQ ID NO: 2902561 - protein, 7 aa, Entamoeba invadens
RSTTEIE

SEQ ID NO: 2902562 - protein, 10 aa, Entamoeba invadens
RSTTRGVGDG

SEQ ID NO: 2902563 - protein, 7 aa, Entamoeba invadens
RSTTTTY

SEQ ID NO: 2902564 - protein, 4 aa, Entamoeba invadens
RSTV

SEQ ID NO: 2902565 - protein, 5 aa, Entamoeba invadens
RSTVR

SEQ ID NO: 2902566 - protein, 16 aa, Entamoeba invadens
RSVAETKYNAHSSRSH

SEQ ID NO: 2902567 - protein, 4 aa, Entamoeba invadens
RSVD

SEQ ID NO: 2902568 - protein, 8 aa, Entamoeba invadens
RSVDEGQT

SEQ ID NO: 2902569 - protein, 8 aa, Entamoeba invadens
RSVEDGKL

SEQ ID NO: 2902570 - protein, 5 aa, Entamoeba invadens
RSVEQ

SEQ ID NO: 2902571 - protein, 5 aa, Entamoeba invadens
RSVER

SEQ ID NO: 2902572 - protein, 11 aa, Entamoeba invadens
RSVGASKERPI

SEQ ID NO: 2902573 - protein, 5 aa, Entamoeba invadens
RSVGG

SEQ ID NO: 2902574 - protein, 11 aa, Entamoeba invadens
RSVGGPGKSSA

SEQ ID NO: 2902575 - protein, 6 aa, Entamoeba invadens
RSVGQK

SEQ ID NO: 2902576 - protein, 9 aa, Entamoeba invadens
RSVGQNKNF

SEQ ID NO: 2902577 - protein, 16 aa, Entamoeba invadens
RSVGVSEDKVKRRFDK

SEQ ID NO: 2902578 - protein, 4 aa, Entamoeba invadens
RSVK

SEQ ID NO: 2902579 - protein, 6 aa, Entamoeba invadens
RSVPKW

SEQ ID NO: 2902580 - protein, 11 aa, Entamoeba invadens
RSVQRLEAPSD

SEQ ID NO: 2902581 - protein, 23 aa, Entamoeba invadens
RSVQSQMGGPTRKIQSSNDMYPQ

SEQ ID NO: 2902582 - protein, 8 aa, Entamoeba invadens
RSVRGVKE

SEQ ID NO: 2902583 - protein, 9 aa, Entamoeba invadens
RSVSSSSLF

SEQ ID NO: 2902584 - protein, 6 aa, Entamoeba invadens
RSVTHP

SEQ ID NO: 2902585 - protein, 14 aa, Entamoeba invadens
RSVTSNTQQTTFEE

SEQ ID NO: 2902586 - protein, 8 aa, Entamoeba invadens
RSYEKTGV

SEQ ID NO: 2902587 - protein, 6 aa, Entamoeba invadens
RSYKGD

SEQ ID NO: 2902588 - protein, 6 aa, Entamoeba invadens
RSYNNT

SEQ ID NO: 2902589 - protein, 8 aa, Entamoeba invadens
RSYPNEKI

SEQ ID NO: 2902590 - protein, 5 aa, Entamoeba invadens
RSYQT

SEQ ID NO: 2902591 - protein, 8 aa, Entamoeba invadens
RTADDEVK

SEQ ID NO: 2902592 - protein, 45 aa, Entamoeba invadens
RTAERKAEREKAKQDREAKRKAEQEKKAAQRKEWAKKEAAEQKAF

SEQ ID NO: 2902593 - protein, 5 aa, Entamoeba invadens
RTAET

SEQ ID NO: 2902594 - protein, 9 aa, Entamoeba invadens
RTAKKSEPL

SEQ ID NO: 2902595 - protein, 5 aa, Entamoeba invadens
RTANL

SEQ ID NO: 2902596 - protein, 6 aa, Entamoeba invadens
RTANNI

SEQ ID NO: 2902597 - protein, 12 aa, Entamoeba invadens
RTAPSNKAKGSV

SEQ ID NO: 2902598 - protein, 4 aa, Entamoeba invadens
RTAR

SEQ ID NO: 2902599 - protein, 10 aa, Entamoeba invadens
RTARADTEGK

SEQ ID NO: 2902600 - protein, 10 aa, Entamoeba invadens
RTARAGKSGM

SEQ ID NO: 2902601 - protein, 13 aa, Entamoeba invadens
RTAVEKPQPKNYE

SEQ ID NO: 2902602 - protein, 21 aa, Entamoeba invadens
RTAVSSSINEFSNEVSQEVGV

SEQ ID NO: 2902603 - protein, 6 aa, Entamoeba invadens
RTDEPD

SEQ ID NO: 2902604 - protein, 4 aa, Entamoeba invadens
RTDF

SEQ ID NO: 2902605 - protein, 6 aa, Entamoeba invadens
RTDFSE

SEQ ID NO: 2902606 - protein, 8 aa, Entamoeba invadens
RTDGVSST

SEQ ID NO: 2902607 - protein, 4 aa, Entamoeba invadens
RTDL

SEQ ID NO: 2902608 - protein, 9 aa, Entamoeba invadens
RTDNINNEN

SEQ ID NO: 2902609 - protein, 5 aa, Entamoeba invadens
RTDPN

SEQ ID NO: 2902610 - protein, 4 aa, Entamoeba invadens
RTDR

SEQ ID NO: 2902611 - protein, 13 aa, Entamoeba invadens
RTDRKRETKCGTP

SEQ ID NO: 2902612 - protein, 6 aa, Entamoeba invadens
RTDSGH

SEQ ID NO: 2902613 - protein, 11 aa, Entamoeba invadens
RTDSTQTQQDA

SEQ ID NO: 2902614 - protein, 8 aa, Entamoeba invadens
RTDTKTDQ

SEQ ID NO: 2902615 - protein, 22 aa, Entamoeba invadens
RTDTKTKTSSKKVKDKVANPED

SEQ ID NO: 2902616 - protein, 15 aa, Entamoeba invadens
RTDVQKGEAGGITQQ

SEQ ID NO: 2902617 - protein, 10 aa, Entamoeba invadens
RTDVRSKARS

SEQ ID NO: 2902618 - protein, 4 aa, Entamoeba invadens
RTEA

SEQ ID NO: 2902619 - protein, 8 aa, Entamoeba invadens
RTEADSGD

SEQ ID NO: 2902620 - protein, 6 aa, Entamoeba invadens
RTEDNK

SEQ ID NO: 2902621 - protein, 20 aa, Entamoeba invadens
RTEFSSGLKGATEKGDMKQT

SEQ ID NO: 2902622 - protein, 10 aa, Entamoeba invadens
RTEGGKALET

SEQ ID NO: 2902623 - protein, 10 aa, Entamoeba invadens
RTEGNKEHYT

SEQ ID NO: 2902624 - protein, 4 aa, Entamoeba invadens
RTEI

SEQ ID NO: 2902625 - protein, 9 aa, Entamoeba invadens
RTEKEVDSA

SEQ ID NO: 2902626 - protein, 6 aa, Entamoeba invadens
RTEKTA

SEQ ID NO: 2902627 - protein, 9 aa, Entamoeba invadens
RTEKTTDLT

SEQ ID NO: 2902628 - protein, 15 aa, Entamoeba invadens
RTELDQEKKDHAKTQ

SEQ ID NO: 2902629 - protein, 15 aa, Entamoeba invadens
RTELDQENKDHAKTQ

SEQ ID NO: 2902630 - protein, 9 aa, Entamoeba invadens
RTELPEEAK

SEQ ID NO: 2902631 - protein, 33 aa, Entamoeba invadens
RTELPEEAKQIKRYDPNDDKKATTREADSTEVC

SEQ ID NO: 2902632 - protein, 6 aa, Entamoeba invadens
RTENEV

SEQ ID NO: 2902633 - protein, 19 aa, Entamoeba invadens
RTENNEKPRFGPKEQTNID

SEQ ID NO: 2902634 - protein, 6 aa, Entamoeba invadens
RTENRA

SEQ ID NO: 2902635 - protein, 13 aa, Entamoeba invadens
RTENYKAKKSLIG

SEQ ID NO: 2902636 - protein, 4 aa, Entamoeba invadens
RTEP

SEQ ID NO: 2902637 - protein, 24 aa, Entamoeba invadens
RTEPQLSVKRSKRATMSQQCVVIN

SEQ ID NO: 2902638 - protein, 9 aa, Entamoeba invadens
RTEPSKEVQ

SEQ ID NO: 2902639 - protein, 16 aa, Entamoeba invadens
RTEQARKLQAKFQNYL

SEQ ID NO: 2902640 - protein, 14 aa, Entamoeba invadens
RTEQFEKRKNELER

SEQ ID NO: 2902641 - protein, 16 aa, Entamoeba invadens
RTEQVPLGQVDPDEDD

SEQ ID NO: 2902642 - protein, 36 aa, Entamoeba invadens
RTETKTREENRTKKDTEEKQLREEKFKEKKKVEQRE

SEQ ID NO: 2902643 - protein, 6 aa, Entamoeba invadens
RTETTK

SEQ ID NO: 2902644 - protein, 5 aa, Entamoeba invadens
RTEVE

SEQ ID NO: 2902645 - protein, 4 aa, Entamoeba invadens
RTEY

SEQ ID NO: 2902646 - protein, 14 aa, Entamoeba invadens
RTFKRQSTTSWKNN

SEQ ID NO: 2902647 - protein, 5 aa, Entamoeba invadens
RTFSG

SEQ ID NO: 2902648 - protein, 11 aa, Entamoeba invadens
RTFSNPSSSEF

SEQ ID NO: 2902649 - protein, 9 aa, Entamoeba invadens
RTFTRNGDM

SEQ ID NO: 2902650 - protein, 6 aa, Entamoeba invadens
RTGECQ

SEQ ID NO: 2902651 - protein, 8 aa, Entamoeba invadens
RTGENGNV

SEQ ID NO: 2902652 - protein, 10 aa, Entamoeba invadens
RTGETSSNLK

SEQ ID NO: 2902653 - protein, 4 aa, Entamoeba invadens
RTGG

SEQ ID NO: 2902654 - protein, 17 aa, Entamoeba invadens
RTGGNVNAAVEILLSNY

SEQ ID NO: 2902655 - protein, 6 aa, Entamoeba invadens
RTGGRT

SEQ ID NO: 2902656 - protein, 5 aa, Entamoeba invadens
RTGKF

SEQ ID NO: 2902657 - protein, 15 aa, Entamoeba invadens
RTGKIENNKVTKNEI

SEQ ID NO: 2902658 - protein, 6 aa, Entamoeba invadens
RTGKKT

SEQ ID NO: 2902659 - protein, 6 aa, Entamoeba invadens
RTGRIG

SEQ ID NO: 2902660 - protein, 9 aa, Entamoeba invadens
RTGSGKTAA

SEQ ID NO: 2902661 - protein, 6 aa, Entamoeba invadens
RTGSTT

SEQ ID NO: 2902662 - protein, 7 aa, Entamoeba invadens
RTGTNLS

SEQ ID NO: 2902663 - protein, 15 aa, Entamoeba invadens
RTGTTMRKSTLGGQH

SEQ ID NO: 2902664 - protein, 5 aa, Entamoeba invadens
RTHNQ

SEQ ID NO: 2902665 - protein, 5 aa, Entamoeba invadens
RTHQI

SEQ ID NO: 2902666 - protein, 6 aa, Entamoeba invadens
RTIADN

SEQ ID NO: 2902667 - protein, 7 aa, Entamoeba invadens
RTIASEN

SEQ ID NO: 2902668 - protein, 6 aa, Entamoeba invadens
RTIDTP

SEQ ID NO: 2902669 - protein, 4 aa, Entamoeba invadens
RTIE

SEQ ID NO: 2902670 - protein, 21 aa, Entamoeba invadens
RTIKSKSKKNTFDIYKKAKSV

SEQ ID NO: 2902671 - protein, 10 aa, Entamoeba invadens
RTIQNENSIN

SEQ ID NO: 2902672 - protein, 4 aa, Entamoeba invadens
RTIR

SEQ ID NO: 2902673 - protein, 4 aa, Entamoeba invadens
RTIS

SEQ ID NO: 2902674 - protein, 10 aa, Entamoeba invadens
RTITQDKESH

SEQ ID NO: 2902675 - protein, 12 aa, Entamoeba invadens
RTIYGGQNIDDA

SEQ ID NO: 2902676 - protein, 7 aa, Entamoeba invadens
RTKAPKT

SEQ ID NO: 2902677 - protein, 5 aa, Entamoeba invadens
RTKAV

SEQ ID NO: 2902678 - protein, 7 aa, Entamoeba invadens
RTKDLKK

SEQ ID NO: 2902679 - protein, 7 aa, Entamoeba invadens
RTKEKTV

SEQ ID NO: 2902680 - protein, 8 aa, Entamoeba invadens
RTKGNDED

SEQ ID NO: 2902681 - protein, 4 aa, Entamoeba invadens
RTKI

SEQ ID NO: 2902682 - protein, 19 aa, Entamoeba invadens
RTKIDNIKQNRESKQNGCI

SEQ ID NO: 2902683 - protein, 9 aa, Entamoeba invadens
RTKKGENTI

SEQ ID NO: 2902684 - protein, 8 aa, Entamoeba invadens
RTKKQCKE

SEQ ID NO: 2902685 - protein, 17 aa, Entamoeba invadens
RTKKRGDQAIGPEQENP

SEQ ID NO: 2902686 - protein, 10 aa, Entamoeba invadens
RTKKSGNFTD

SEQ ID NO: 2902687 - protein, 8 aa, Entamoeba invadens
RTKKTVHT

SEQ ID NO: 2902688 - protein, 16 aa, Entamoeba invadens
RTKNKTHVLTEEDSKN

SEQ ID NO: 2902689 - protein, 6 aa, Entamoeba invadens
RTKNVD

SEQ ID NO: 2902690 - protein, 9 aa, Entamoeba invadens
RTKPENKSI

SEQ ID NO: 2902691 - protein, 10 aa, Entamoeba invadens
RTKPGEVKMP

SEQ ID NO: 2902692 - protein, 10 aa, Entamoeba invadens
RTKPNKKSDC

SEQ ID NO: 2902693 - protein, 15 aa, Entamoeba invadens
RTKPSNKSSPKSSMV

SEQ ID NO: 2902694 - protein, 8 aa, Entamoeba invadens
RTKPTHGS

SEQ ID NO: 2902695 - protein, 7 aa, Entamoeba invadens
RTKQKYQ

SEQ ID NO: 2902696 - protein, 5 aa, Entamoeba invadens
RTKQQ

SEQ ID NO: 2902697 - protein, 13 aa, Entamoeba invadens
RTKSEDSDKKRYG

SEQ ID NO: 2902698 - protein, 16 aa, Entamoeba invadens
RTKSGFEGDVSGYEQA

SEQ ID NO: 2902699 - protein, 16 aa, Entamoeba invadens
RTKSKHDSVTVTPSGV

SEQ ID NO: 2902700 - protein, 9 aa, Entamoeba invadens
RTKSKIKGK

SEQ ID NO: 2902701 - protein, 7 aa, Entamoeba invadens
RTKSPDV

SEQ ID NO: 2902702 - protein, 28 aa, Entamoeba invadens
RTKSSNGTMHKDKSLKRLKETSTPYTPE

SEQ ID NO: 2902703 - protein, 5 aa, Entamoeba invadens
RTKST

SEQ ID NO: 2902704 - protein, 9 aa, Entamoeba invadens
RTKTDGKWS

SEQ ID NO: 2902705 - protein, 7 aa, Entamoeba invadens
RTKTKTV

SEQ ID NO: 2902706 - protein, 5 aa, Entamoeba invadens
RTKTV

SEQ ID NO: 2902707 - protein, 7 aa, Entamoeba invadens
RTKVSSI

SEQ ID NO: 2902708 - protein, 17 aa, Entamoeba invadens
RTLGKSQSRTSKRCSRQ

SEQ ID NO: 2902709 - protein, 43 aa, Entamoeba invadens
RTLKKTKKDDKKENTESLISSQTEPQSHNESEPSSENKEITKE

SEQ ID NO: 2902710 - protein, 11 aa, Entamoeba invadens
RTLQSEKKECS

SEQ ID NO: 2902711 - protein, 19 aa, Entamoeba invadens
RTLSGSQYKLTKKSNTTKT

SEQ ID NO: 2902712 - protein, 5 aa, Entamoeba invadens
RTLSP

SEQ ID NO: 2902713 - protein, 7 aa, Entamoeba invadens
RTMEANR

SEQ ID NO: 2902714 - protein, 9 aa, Entamoeba invadens
RTMTDENKS

SEQ ID NO: 2902715 - protein, 6 aa, Entamoeba invadens
RTNAQI

SEQ ID NO: 2902716 - protein, 4 aa, Entamoeba invadens
RTNE

SEQ ID NO: 2902717 - protein, 5 aa, Entamoeba invadens
RTNEK

SEQ ID NO: 2902718 - protein, 6 aa, Entamoeba invadens
RTNENA

SEQ ID NO: 2902719 - protein, 12 aa, Entamoeba invadens
RTNENCPKFESN

SEQ ID NO: 2902720 - protein, 5 aa, Entamoeba invadens
RTNEY

SEQ ID NO: 2902721 - protein, 10 aa, Entamoeba invadens
RTNGNGENKT

SEQ ID NO: 2902722 - protein, 13 aa, Entamoeba invadens
RTNHDSRDVNNAE

SEQ ID NO: 2902723 - protein, 7 aa, Entamoeba invadens
RTNKATE

SEQ ID NO: 2902724 - protein, 9 aa, Entamoeba invadens
RTNKATERC

SEQ ID NO: 2902725 - protein, 20 aa, Entamoeba invadens
RTNKEEYKKKVRRCVRKSIE

SEQ ID NO: 2902726 - protein, 10 aa, Entamoeba invadens
RTNKKVADEL

SEQ ID NO: 2902727 - protein, 8 aa, Entamoeba invadens
RTNPDRQL

SEQ ID NO: 2902728 - protein, 7 aa, Entamoeba invadens
RTNPLPY

SEQ ID NO: 2902729 - protein, 6 aa, Entamoeba invadens
RTNPNP

SEQ ID NO: 2902730 - protein, 7 aa, Entamoeba invadens
RTNPRGN

SEQ ID NO: 2902731 - protein, 7 aa, Entamoeba invadens
RTNPSSA

SEQ ID NO: 2902732 - protein, 8 aa, Entamoeba invadens
RTNQHGKP

SEQ ID NO: 2902733 - protein, 7 aa, Entamoeba invadens
RTNRSKK

SEQ ID NO: 2902734 - protein, 5 aa, Entamoeba invadens
RTNST

SEQ ID NO: 2902735 - protein, 6 aa, Entamoeba invadens
RTNSTD

SEQ ID NO: 2902736 - protein, 5 aa, Entamoeba invadens
RTPDG

SEQ ID NO: 2902737 - protein, 5 aa, Entamoeba invadens
RTPEE

SEQ ID NO: 2902738 - protein, 13 aa, Entamoeba invadens
RTPESTMATPSLT

SEQ ID NO: 2902739 - protein, 10 aa, Entamoeba invadens
RTPETYDDYT

SEQ ID NO: 2902740 - protein, 6 aa, Entamoeba invadens
RTPGIK

SEQ ID NO: 2902741 - protein, 6 aa, Entamoeba invadens
RTPGIS

SEQ ID NO: 2902742 - protein, 4 aa, Entamoeba invadens
RTPH

SEQ ID NO: 2902743 - protein, 4 aa, Entamoeba invadens
RTPL

SEQ ID NO: 2902744 - protein, 8 aa, Entamoeba invadens
RTPNIEVT

SEQ ID NO: 2902745 - protein, 7 aa, Entamoeba invadens
RTPNSLK

SEQ ID NO: 2902746 - protein, 6 aa, Entamoeba invadens
RTPPIK

SEQ ID NO: 2902747 - protein, 9 aa, Entamoeba invadens
RTPQPINTM

SEQ ID NO: 2902748 - protein, 23 aa, Entamoeba invadens
RTPRQSQEVKSSLSDTSESSSDL

SEQ ID NO: 2902749 - protein, 5 aa, Entamoeba invadens
RTPRY

SEQ ID NO: 2902750 - protein, 7 aa, Entamoeba invadens
RTPSADL

SEQ ID NO: 2902751 - protein, 11 aa, Entamoeba invadens
RTPSDKYETVK

SEQ ID NO: 2902752 - protein, 6 aa, Entamoeba invadens
RTPSPL

SEQ ID NO: 2902753 - protein, 8 aa, Entamoeba invadens
RTPSPTLS

SEQ ID NO: 2902754 - protein, 6 aa, Entamoeba invadens
RTPSSE

SEQ ID NO: 2902755 - protein, 4 aa, Entamoeba invadens
RTPT

SEQ ID NO: 2902756 - protein, 8 aa, Entamoeba invadens
RTPTPSLV

SEQ ID NO: 2902757 - protein, 4 aa, Entamoeba invadens
RTPV

SEQ ID NO: 2902758 - protein, 5 aa, Entamoeba invadens
RTPVQ

SEQ ID NO: 2902759 - protein, 5 aa, Entamoeba invadens
RTPYE

SEQ ID NO: 2902760 - protein, 14 aa, Entamoeba invadens
RTQEINSDTVEDAK

SEQ ID NO: 2902761 - protein, 19 aa, Entamoeba invadens
RTQEINSETLEDAKNWTEA

SEQ ID NO: 2902762 - protein, 12 aa, Entamoeba invadens
RTQETSKVTREA

SEQ ID NO: 2902763 - protein, 9 aa, Entamoeba invadens
RTQEWKNER

SEQ ID NO: 2902764 - protein, 12 aa, Entamoeba invadens
RTQGPIASIGAP

SEQ ID NO: 2902765 - protein, 13 aa, Entamoeba invadens
RTQGPIASLGAPA

SEQ ID NO: 2902766 - protein, 8 aa, Entamoeba invadens
RTQGVSTT

SEQ ID NO: 2902767 - protein, 5 aa, Entamoeba invadens
RTQKK

SEQ ID NO: 2902768 - protein, 7 aa, Entamoeba invadens
RTQNYRR

SEQ ID NO: 2902769 - protein, 20 aa, Entamoeba invadens
RTQPKLQQTPKEHSTSEQQS

SEQ ID NO: 2902770 - protein, 16 aa, Entamoeba invadens
RTQPTQPQSQSLSQTQ

SEQ ID NO: 2902771 - protein, 10 aa, Entamoeba invadens
RTQPTQSQSQ

SEQ ID NO: 2902772 - protein, 5 aa, Entamoeba invadens
RTQSY

SEQ ID NO: 2902773 - protein, 7 aa, Entamoeba invadens
RTQTQIT

SEQ ID NO: 2902774 - protein, 7 aa, Entamoeba invadens
RTQTQPL

SEQ ID NO: 2902775 - protein, 6 aa, Entamoeba invadens
RTQVNK

SEQ ID NO: 2902776 - protein, 10 aa, Entamoeba invadens
RTREDNERLR

SEQ ID NO: 2902777 - protein, 6 aa, Entamoeba invadens
RTREKY

SEQ ID NO: 2902778 - protein, 8 aa, Entamoeba invadens
RTRGLGTK

SEQ ID NO: 2902779 - protein, 7 aa, Entamoeba invadens
RTRKQIK

SEQ ID NO: 2902780 - protein, 5 aa, Entamoeba invadens
RTRLP

SEQ ID NO: 2902781 - protein, 6 aa, Entamoeba invadens
RTRNES

SEQ ID NO: 2902782 - protein, 8 aa, Entamoeba invadens
RTRNKEGV

SEQ ID NO: 2902783 - protein, 6 aa, Entamoeba invadens
RTRNVA

SEQ ID NO: 2902784 - protein, 13 aa, Entamoeba invadens
RTRTQLKNKYKVE

SEQ ID NO: 2902785 - protein, 5 aa, Entamoeba invadens
RTRVE

SEQ ID NO: 2902786 - protein, 18 aa, Entamoeba invadens
RTSEGEYQFTSQDPKELE

SEQ ID NO: 2902787 - protein, 8 aa, Entamoeba invadens
RTSEKRKE

SEQ ID NO: 2902788 - protein, 8 aa, Entamoeba invadens
RTSEQKSV

SEQ ID NO: 2902789 - protein, 12 aa, Entamoeba invadens
RTSFDSETERYK

SEQ ID NO: 2902790 - protein, 9 aa, Entamoeba invadens
RTSFSKTVK

SEQ ID NO: 2902791 - protein, 18 aa, Entamoeba invadens
RTSGSDRLEWEKEEKGVI

SEQ ID NO: 2902792 - protein, 68 aa, Entamoeba invadens
RTSGSGPKTTPPVPAQQPSTQHVQRNSLGNASSALHPVGGSSTLKKGNLTGPQSSPTPSGSSSTSPFS

SEQ ID NO: 2902793 - protein, 11 aa, Entamoeba invadens
RTSGTYPSEST

SEQ ID NO: 2902794 - protein, 22 aa, Entamoeba invadens
RTSHSPEIVDEDKREKARDKQI

SEQ ID NO: 2902795 - protein, 16 aa, Entamoeba invadens
RTSKSKKVKTAGERVV

SEQ ID NO: 2902796 - protein, 4 aa, Entamoeba invadens
RTSL

SEQ ID NO: 2902797 - protein, 11 aa, Entamoeba invadens
RTSLPYGDRPM

SEQ ID NO: 2902798 - protein, 4 aa, Entamoeba invadens
RTSN

SEQ ID NO: 2902799 - protein, 7 aa, Entamoeba invadens
RTSNEGV

SEQ ID NO: 2902800 - protein, 9 aa, Entamoeba invadens
RTSNTITEL

SEQ ID NO: 2902801 - protein, 6 aa, Entamoeba invadens
RTSPEE

SEQ ID NO: 2902802 - protein, 7 aa, Entamoeba invadens
RTSPENR

SEQ ID NO: 2902803 - protein, 6 aa, Entamoeba invadens
RTSPEY

SEQ ID NO: 2902804 - protein, 9 aa, Entamoeba invadens
RTSQRERDS

SEQ ID NO: 2902805 - protein, 15 aa, Entamoeba invadens
RTSRDVSRKKHTRQY

SEQ ID NO: 2902806 - protein, 16 aa, Entamoeba invadens
RTSRLTQRLPSRKSSG

SEQ ID NO: 2902807 - protein, 22 aa, Entamoeba invadens
RTSRRPELGDKFSSRHGQKGVT

SEQ ID NO: 2902808 - protein, 7 aa, Entamoeba invadens
RTSSGIE

SEQ ID NO: 2902809 - protein, 4 aa, Entamoeba invadens
RTST

SEQ ID NO: 2902810 - protein, 5 aa, Entamoeba invadens
RTSTD

SEQ ID NO: 2902811 - protein, 7 aa, Entamoeba invadens
RTSTKSI

SEQ ID NO: 2902812 - protein, 7 aa, Entamoeba invadens
RTSTPEL

SEQ ID NO: 2902813 - protein, 9 aa, Entamoeba invadens
RTSYRVKNE

SEQ ID NO: 2902814 - protein, 8 aa, Entamoeba invadens
RTTAKQFT

SEQ ID NO: 2902815 - protein, 16 aa, Entamoeba invadens
RTTDEVKECPSCSKGR

SEQ ID NO: 2902816 - protein, 7 aa, Entamoeba invadens
RTTDTEM

SEQ ID NO: 2902817 - protein, 6 aa, Entamoeba invadens
RTTEKE

SEQ ID NO: 2902818 - protein, 8 aa, Entamoeba invadens
RTTENRVA

SEQ ID NO: 2902819 - protein, 30 aa, Entamoeba invadens
RTTESQNITDNSVYQKEVSTYTEEESANRI

SEQ ID NO: 2902820 - protein, 17 aa, Entamoeba invadens
RTTESTKEKKEKKNTSL

SEQ ID NO: 2902821 - protein, 7 aa, Entamoeba invadens
RTTETTA

SEQ ID NO: 2902822 - protein, 12 aa, Entamoeba invadens
RTTIERKGEINP

SEQ ID NO: 2902823 - protein, 12 aa, Entamoeba invadens
RTTIERKSEINP

SEQ ID NO: 2902824 - protein, 7 aa, Entamoeba invadens
RTTKGTL

SEQ ID NO: 2902825 - protein, 6 aa, Entamoeba invadens
RTTKKE

SEQ ID NO: 2902826 - protein, 6 aa, Entamoeba invadens
RTTKND

SEQ ID NO: 2902827 - protein, 7 aa, Entamoeba invadens
RTTPSEF

SEQ ID NO: 2902828 - protein, 7 aa, Entamoeba invadens
RTTQKEL

SEQ ID NO: 2902829 - protein, 14 aa, Entamoeba invadens
RTTQRSGSLSNSPE

SEQ ID NO: 2902830 - protein, 7 aa, Entamoeba invadens
RTTQVSR

SEQ ID NO: 2902831 - protein, 4 aa, Entamoeba invadens
RTTR

SEQ ID NO: 2902832 - protein, 19 aa, Entamoeba invadens
RTTSLNPGVQDEQPPFPYP

SEQ ID NO: 2902833 - protein, 10 aa, Entamoeba invadens
RTTTGKKGMT

SEQ ID NO: 2902834 - protein, 31 aa, Entamoeba invadens
RTTTIDTTKMSKLKTKKDELRQKIDEKTKEL

SEQ ID NO: 2902835 - protein, 13 aa, Entamoeba invadens
RTTTSTSKDQLRE

SEQ ID NO: 2902836 - protein, 8 aa, Entamoeba invadens
RTTTTPHA

SEQ ID NO: 2902837 - protein, 10 aa, Entamoeba invadens
RTTVESATGA

SEQ ID NO: 2902838 - protein, 12 aa, Entamoeba invadens
RTTYLGEGDGQN

SEQ ID NO: 2902839 - protein, 13 aa, Entamoeba invadens
RTVANKDADKLGT

SEQ ID NO: 2902840 - protein, 7 aa, Entamoeba invadens
RTVEDKK

SEQ ID NO: 2902841 - protein, 11 aa, Entamoeba invadens
RTVEGKRITTE

SEQ ID NO: 2902842 - protein, 13 aa, Entamoeba invadens
RTVEKGDGQDLAN

SEQ ID NO: 2902843 - protein, 7 aa, Entamoeba invadens
RTVGENA

SEQ ID NO: 2902844 - protein, 12 aa, Entamoeba invadens
RTVGKNSRAETI

SEQ ID NO: 2902845 - protein, 26 aa, Entamoeba invadens
RTVKSRANSDQTVSRIQNTRSGMNNT

SEQ ID NO: 2902846 - protein, 8 aa, Entamoeba invadens
RTVNKNEE

SEQ ID NO: 2902847 - protein, 11 aa, Entamoeba invadens
RTVNTGEATNE

SEQ ID NO: 2902848 - protein, 15 aa, Entamoeba invadens
RTVPNTGNVFSSKKK

SEQ ID NO: 2902849 - protein, 9 aa, Entamoeba invadens
RTVRRTTGD

SEQ ID NO: 2902850 - protein, 5 aa, Entamoeba invadens
RTVSD

SEQ ID NO: 2902851 - protein, 27 aa, Entamoeba invadens
RTYSRNSVKIPKDLTSRKKAEEREKER

SEQ ID NO: 2902852 - protein, 7 aa, Entamoeba invadens
RTYTDAD

SEQ ID NO: 2902853 - protein, 8 aa, Entamoeba invadens
RTYTSSKL

SEQ ID NO: 2902854 - protein, 16 aa, Entamoeba invadens
RVADPSVGKPRSKATI

SEQ ID NO: 2902855 - protein, 12 aa, Entamoeba invadens
RVAEGDITQEES

SEQ ID NO: 2902856 - protein, 12 aa, Entamoeba invadens
RVAEGGDNFSLG

SEQ ID NO: 2902857 - protein, 13 aa, Entamoeba invadens
RVAEKTPTPKYNE

SEQ ID NO: 2902858 - protein, 16 aa, Entamoeba invadens
RVASVKEKESIFPNER

SEQ ID NO: 2902859 - protein, 13 aa, Entamoeba invadens
RVDDGMNKNLGRK

SEQ ID NO: 2902860 - protein, 9 aa, Entamoeba invadens
RVDDSNSRV

SEQ ID NO: 2902861 - protein, 16 aa, Entamoeba invadens
RVDDTPSEKASKLTKR

SEQ ID NO: 2902862 - protein, 6 aa, Entamoeba invadens
RVDEAG

SEQ ID NO: 2902863 - protein, 15 aa, Entamoeba invadens
RVDEEFAAKDKEIEA

SEQ ID NO: 2902864 - protein, 6 aa, Entamoeba invadens
RVDEEN

SEQ ID NO: 2902865 - protein, 5 aa, Entamoeba invadens
RVDER

SEQ ID NO: 2902866 - protein, 7 aa, Entamoeba invadens
RVDETNG

SEQ ID NO: 2902867 - protein, 9 aa, Entamoeba invadens
RVDHPESKV

SEQ ID NO: 2902868 - protein, 10 aa, Entamoeba invadens
RVDNHSNPEK

SEQ ID NO: 2902869 - protein, 5 aa, Entamoeba invadens
RVDNR

SEQ ID NO: 2902870 - protein, 6 aa, Entamoeba invadens
RVDQSA

SEQ ID NO: 2902871 - protein, 7 aa, Entamoeba invadens
RVDRTNS

SEQ ID NO: 2902872 - protein, 11 aa, Entamoeba invadens
RVDSPKDQFGN

SEQ ID NO: 2902873 - protein, 21 aa, Entamoeba invadens
RVDTNGAEDEDESDEEEDDWS

SEQ ID NO: 2902874 - protein, 4 aa, Entamoeba invadens
RVDY

SEQ ID NO: 2902875 - protein, 13 aa, Entamoeba invadens
RVEDEIQKSPRVK

SEQ ID NO: 2902876 - protein, 8 aa, Entamoeba invadens
RVEEEPSL

SEQ ID NO: 2902877 - protein, 9 aa, Entamoeba invadens
RVEEKDKRV

SEQ ID NO: 2902878 - protein, 6 aa, Entamoeba invadens
RVEGDT

SEQ ID NO: 2902879 - protein, 5 aa, Entamoeba invadens
RVEGL

SEQ ID NO: 2902880 - protein, 9 aa, Entamoeba invadens
RVEKYGEKV

SEQ ID NO: 2902881 - protein, 7 aa, Entamoeba invadens
RVEQEAA

SEQ ID NO: 2902882 - protein, 7 aa, Entamoeba invadens
RVERGEN

SEQ ID NO: 2902883 - protein, 15 aa, Entamoeba invadens
RVESEEDMKKKNEFG

SEQ ID NO: 2902884 - protein, 6 aa, Entamoeba invadens
RVESKS

SEQ ID NO: 2902885 - protein, 11 aa, Entamoeba invadens
RVESLSSTNIE

SEQ ID NO: 2902886 - protein, 5 aa, Entamoeba invadens
RVETP

SEQ ID NO: 2902887 - protein, 10 aa, Entamoeba invadens
RVEVPEEAKQ

SEQ ID NO: 2902888 - protein, 34 aa, Entamoeba invadens
RVEVPEEAKQIKNYDPNDDKKATTREADSTEVYT

SEQ ID NO: 2902889 - protein, 34 aa, Entamoeba invadens
RVEVPEEAKQIKRYDPNDDKKATTREADSKEVYT

SEQ ID NO: 2902890 - protein, 35 aa, Entamoeba invadens
RVEVPEEAKQIKRYDPNDDKKATTREADSKEVYTK

SEQ ID NO: 2902891 - protein, 35 aa, Entamoeba invadens
RVEVPEEAKQIKRYDPNDDKKATTREADSKKVYTK

SEQ ID NO: 2902892 - protein, 46 aa, Entamoeba invadens
RVEVPEEAKQIKRYDTNDDKKATTREADSTEVYTKGEQVRGKDGKL

SEQ ID NO: 2902893 - protein, 11 aa, Entamoeba invadens
RVGAKQKNELV

SEQ ID NO: 2902894 - protein, 10 aa, Entamoeba invadens
RVGENYKGIG

SEQ ID NO: 2902895 - protein, 5 aa, Entamoeba invadens
RVGEP

SEQ ID NO: 2902896 - protein, 6 aa, Entamoeba invadens
RVGETP

SEQ ID NO: 2902897 - protein, 25 aa, Entamoeba invadens
RVGGATTSVAQSATGGIVISDPLRN

SEQ ID NO: 2902898 - protein, 9 aa, Entamoeba invadens
RVGKEAFSD

SEQ ID NO: 2902899 - protein, 7 aa, Entamoeba invadens
RVGKPGE

SEQ ID NO: 2902900 - protein, 6 aa, Entamoeba invadens
RVGKTS

SEQ ID NO: 2902901 - protein, 8 aa, Entamoeba invadens
RVGNENAT

SEQ ID NO: 2902902 - protein, 8 aa, Entamoeba invadens
RVGPQTYD

SEQ ID NO: 2902903 - protein, 17 aa, Entamoeba invadens
RVGPREAPKIKGSKNVR

SEQ ID NO: 2902904 - protein, 4 aa, Entamoeba invadens
RVGR

SEQ ID NO: 2902905 - protein, 7 aa, Entamoeba invadens
RVGRKYP

SEQ ID NO: 2902906 - protein, 6 aa, Entamoeba invadens
RVGTEG

SEQ ID NO: 2902907 - protein, 12 aa, Entamoeba invadens
RVHTDNSDKTVK

SEQ ID NO: 2902908 - protein, 6 aa, Entamoeba invadens
RVIENQ

SEQ ID NO: 2902909 - protein, 5 aa, Entamoeba invadens
RVKAV

SEQ ID NO: 2902910 - protein, 10 aa, Entamoeba invadens
RVKELTDKNS

SEQ ID NO: 2902911 - protein, 6 aa, Entamoeba invadens
RVKENS

SEQ ID NO: 2902912 - protein, 10 aa, Entamoeba invadens
RVKLGEDERY

SEQ ID NO: 2902913 - protein, 5 aa, Entamoeba invadens
RVKNA

SEQ ID NO: 2902914 - protein, 9 aa, Entamoeba invadens
RVKNEEKAE

SEQ ID NO: 2902915 - protein, 15 aa, Entamoeba invadens
RVKPLGKTDEFGAPL

SEQ ID NO: 2902916 - protein, 9 aa, Entamoeba invadens
RVKSGDGVE

SEQ ID NO: 2902917 - protein, 7 aa, Entamoeba invadens
RVKTDSL

SEQ ID NO: 2902918 - protein, 5 aa, Entamoeba invadens
RVKTL

SEQ ID NO: 2902919 - protein, 5 aa, Entamoeba invadens
RVKTV

SEQ ID NO: 2902920 - protein, 5 aa, Entamoeba invadens
RVLGT

SEQ ID NO: 2902921 - protein, 23 aa, Entamoeba invadens
RVNANANRVNGGGYENTNTYTKT

SEQ ID NO: 2902922 - protein, 26 aa, Entamoeba invadens
RVNKGGKSSGPKGGKGKPMGGKRGGK

SEQ ID NO: 2902923 - protein, 16 aa, Entamoeba invadens
RVNKNGNCKIETEDKM

SEQ ID NO: 2902924 - protein, 16 aa, Entamoeba invadens
RVNNTKKIESIGTQEI

SEQ ID NO: 2902925 - protein, 4 aa, Entamoeba invadens
RVNP

SEQ ID NO: 2902926 - protein, 7 aa, Entamoeba invadens
RVNPDGP

SEQ ID NO: 2902927 - protein, 8 aa, Entamoeba invadens
RVNPSGRL

SEQ ID NO: 2902928 - protein, 7 aa, Entamoeba invadens
RVNPTSV

SEQ ID NO: 2902929 - protein, 6 aa, Entamoeba invadens
RVNSDI

SEQ ID NO: 2902930 - protein, 7 aa, Entamoeba invadens
RVNSGMK

SEQ ID NO: 2902931 - protein, 4 aa, Entamoeba invadens
RVPE

SEQ ID NO: 2902932 - protein, 5 aa, Entamoeba invadens
RVPET

SEQ ID NO: 2902933 - protein, 83 aa, Entamoeba invadens
RVPGKKKVTKSTPPSTSSQNCGHQTQQIQKPNNCNQTAQVPPPVPPPHQAKSGFGAVRTGAPPKATFGQSTKPHQQPPLPQNQ

SEQ ID NO: 2902934 - protein, 15 aa, Entamoeba invadens
RVPKKGKTPSHAKTE

SEQ ID NO: 2902935 - protein, 17 aa, Entamoeba invadens
RVPNKKALKETATESVY

SEQ ID NO: 2902936 - protein, 17 aa, Entamoeba invadens
RVPNKKTLKETATESVY

SEQ ID NO: 2902937 - protein, 7 aa, Entamoeba invadens
RVPPSSI

SEQ ID NO: 2902938 - protein, 12 aa, Entamoeba invadens
RVPSRTEKIDRS

SEQ ID NO: 2902939 - protein, 6 aa, Entamoeba invadens
RVQDGK

SEQ ID NO: 2902940 - protein, 7 aa, Entamoeba invadens
RVQERNK

SEQ ID NO: 2902941 - protein, 8 aa, Entamoeba invadens
RVQESTET

SEQ ID NO: 2902942 - protein, 9 aa, Entamoeba invadens
RVRDNGRVE

SEQ ID NO: 2902943 - protein, 6 aa, Entamoeba invadens
RVRPQK

SEQ ID NO: 2902944 - protein, 10 aa, Entamoeba invadens
RVRPSIGYSE

SEQ ID NO: 2902945 - protein, 5 aa, Entamoeba invadens
RVRQS

SEQ ID NO: 2902946 - protein, 25 aa, Entamoeba invadens
RVRSTKSNSKQSVCTNETAKSSLYQ

SEQ ID NO: 2902947 - protein, 5 aa, Entamoeba invadens
RVRTS

SEQ ID NO: 2902948 - protein, 6 aa, Entamoeba invadens
RVSDDK

SEQ ID NO: 2902949 - protein, 11 aa, Entamoeba invadens
RVSEERGSKQF

SEQ ID NO: 2902950 - protein, 11 aa, Entamoeba invadens
RVSENSLKSNE

SEQ ID NO: 2902951 - protein, 7 aa, Entamoeba invadens
RVSENSQ

SEQ ID NO: 2902952 - protein, 16 aa, Entamoeba invadens
RVSESGEYQAKDDAKI

SEQ ID NO: 2902953 - protein, 5 aa, Entamoeba invadens
RVSGL

SEQ ID NO: 2902954 - protein, 5 aa, Entamoeba invadens
RVSGM

SEQ ID NO: 2902955 - protein, 4 aa, Entamoeba invadens
RVSI

SEQ ID NO: 2902956 - protein, 4 aa, Entamoeba invadens
RVSK

SEQ ID NO: 2902957 - protein, 5 aa, Entamoeba invadens
RVSNG

SEQ ID NO: 2902958 - protein, 6 aa, Entamoeba invadens
RVSNGE

SEQ ID NO: 2902959 - protein, 7 aa, Entamoeba invadens
RVSPDEM

SEQ ID NO: 2902960 - protein, 6 aa, Entamoeba invadens
RVSPED

SEQ ID NO: 2902961 - protein, 8 aa, Entamoeba invadens
RVSPTDLE

SEQ ID NO: 2902962 - protein, 9 aa, Entamoeba invadens
RVSQEDKRE

SEQ ID NO: 2902963 - protein, 7 aa, Entamoeba invadens
RVSRGRD

SEQ ID NO: 2902964 - protein, 17 aa, Entamoeba invadens
RVSRSLAAARAAPPIPT

SEQ ID NO: 2902965 - protein, 8 aa, Entamoeba invadens
RVSTDDKY

SEQ ID NO: 2902966 - protein, 8 aa, Entamoeba invadens
RVSTNISD

SEQ ID NO: 2902967 - protein, 26 aa, Entamoeba invadens
RVSTRGERPRNVRTVSDSHITLVDQK

SEQ ID NO: 2902968 - protein, 8 aa, Entamoeba invadens
RVTGKNYD

SEQ ID NO: 2902969 - protein, 6 aa, Entamoeba invadens
RVTRDI

SEQ ID NO: 2902970 - protein, 5 aa, Entamoeba invadens
RVTVT

SEQ ID NO: 2902971 - protein, 14 aa, Entamoeba invadens
RVVDEGEATQQAEN

SEQ ID NO: 2902972 - protein, 4 aa, Entamoeba invadens
RVYS

SEQ ID NO: 2902973 - protein, 6 aa, Entamoeba invadens
RVYTDE

SEQ ID NO: 2902974 - protein, 18 aa, Entamoeba invadens
RWDTNDHSLSPNAKSEGI

SEQ ID NO: 2902975 - protein, 7 aa, Entamoeba invadens
RWEQNGK

SEQ ID NO: 2902976 - protein, 9 aa, Entamoeba invadens
RWGGDTKEI

SEQ ID NO: 2902977 - protein, 4 aa, Entamoeba invadens
RWKD

SEQ ID NO: 2902978 - protein, 4 aa, Entamoeba invadens
RWKG

SEQ ID NO: 2902979 - protein, 11 aa, Entamoeba invadens
RWTGNLKDDPD

SEQ ID NO: 2902980 - protein, 4 aa, Entamoeba invadens
RWTK

SEQ ID NO: 2902981 - protein, 8 aa, Entamoeba invadens
RYADGEIK

SEQ ID NO: 2902982 - protein, 8 aa, Entamoeba invadens
RYAEDTNL

SEQ ID NO: 2902983 - protein, 5 aa, Entamoeba invadens
RYDNR

SEQ ID NO: 2902984 - protein, 7 aa, Entamoeba invadens
RYDSTTI

SEQ ID NO: 2902985 - protein, 9 aa, Entamoeba invadens
RYEEQYSKY

SEQ ID NO: 2902986 - protein, 7 aa, Entamoeba invadens
RYEESEP

SEQ ID NO: 2902987 - protein, 9 aa, Entamoeba invadens
RYEGGRDQL

SEQ ID NO: 2902988 - protein, 11 aa, Entamoeba invadens
RYEGTPMYSSP

SEQ ID NO: 2902989 - protein, 6 aa, Entamoeba invadens
RYEQEP

SEQ ID NO: 2902990 - protein, 5 aa, Entamoeba invadens
RYEQN

SEQ ID NO: 2902991 - protein, 6 aa, Entamoeba invadens
RYERTC

SEQ ID NO: 2902992 - protein, 14 aa, Entamoeba invadens
RYESEKKVLTPQNV

SEQ ID NO: 2902993 - protein, 7 aa, Entamoeba invadens
RYGEGKD

SEQ ID NO: 2902994 - protein, 5 aa, Entamoeba invadens
RYGET

SEQ ID NO: 2902995 - protein, 7 aa, Entamoeba invadens
RYGGGAS

SEQ ID NO: 2902996 - protein, 9 aa, Entamoeba invadens
RYGQHEKEK

SEQ ID NO: 2902997 - protein, 5 aa, Entamoeba invadens
RYGQS

SEQ ID NO: 2902998 - protein, 22 aa, Entamoeba invadens
RYHANDSKVDVDLSKQKAELPN

SEQ ID NO: 2902999 - protein, 13 aa, Entamoeba invadens
RYHNRRKRKGAKT

SEQ ID NO: 2903000 - protein, 10 aa, Entamoeba invadens
RYKENPSQQG

SEQ ID NO: 2903001 - protein, 8 aa, Entamoeba invadens
RYKKERKM

SEQ ID NO: 2903002 - protein, 17 aa, Entamoeba invadens
RYKNAENSRKKETAKKI

SEQ ID NO: 2903003 - protein, 8 aa, Entamoeba invadens
RYKNGGRG

SEQ ID NO: 2903004 - protein, 4 aa, Entamoeba invadens
RYKR

SEQ ID NO: 2903005 - protein, 9 aa, Entamoeba invadens
RYKTDTPIS

SEQ ID NO: 2903006 - protein, 8 aa, Entamoeba invadens
RYKTTTNE

SEQ ID NO: 2903007 - protein, 4 aa, Entamoeba invadens
RYLD

SEQ ID NO: 2903008 - protein, 6 aa, Entamoeba invadens
RYMSGN

SEQ ID NO: 2903009 - protein, 7 aa, Entamoeba invadens
RYNEDTP

SEQ ID NO: 2903010 - protein, 11 aa, Entamoeba invadens
RYNETGKESYC

SEQ ID NO: 2903011 - protein, 7 aa, Entamoeba invadens
RYNNPEE

SEQ ID NO: 2903012 - protein, 6 aa, Entamoeba invadens
RYNTPP

SEQ ID NO: 2903013 - protein, 5 aa, Entamoeba invadens
RYNTQ

SEQ ID NO: 2903014 - protein, 5 aa, Entamoeba invadens
RYPND

SEQ ID NO: 2903015 - protein, 5 aa, Entamoeba invadens
RYPNL

SEQ ID NO: 2903016 - protein, 44 aa, Entamoeba invadens
RYPPPYDRDFQPDPRLPIEGRDSRDPRVLDPRDQRNMPDPRDPR

SEQ ID NO: 2903017 - protein, 6 aa, Entamoeba invadens
RYPQDS

SEQ ID NO: 2903018 - protein, 10 aa, Entamoeba invadens
RYPRGTQSTA

SEQ ID NO: 2903019 - protein, 5 aa, Entamoeba invadens
RYPSK

SEQ ID NO: 2903020 - protein, 5 aa, Entamoeba invadens
RYPST

SEQ ID NO: 2903021 - protein, 6 aa, Entamoeba invadens
RYPTES

SEQ ID NO: 2903022 - protein, 4 aa, Entamoeba invadens
RYQA

SEQ ID NO: 2903023 - protein, 5 aa, Entamoeba invadens
RYQEH

SEQ ID NO: 2903024 - protein, 4 aa, Entamoeba invadens
RYQM

SEQ ID NO: 2903025 - protein, 8 aa, Entamoeba invadens
RYQRNSKA

SEQ ID NO: 2903026 - protein, 12 aa, Entamoeba invadens
RYQSSQQSIPKS

SEQ ID NO: 2903027 - protein, 13 aa, Entamoeba invadens
RYQSSQQSTPKSI

SEQ ID NO: 2903028 - protein, 13 aa, Entamoeba invadens
RYQTNSGKIVGDT

SEQ ID NO: 2903029 - protein, 57 aa, Entamoeba invadens
RYQYDDRRRSRSRDRYDDRYDDRYKDDHRSDNRYNDRRDTRYDDRRDDRRDYRPQNN

SEQ ID NO: 2903030 - protein, 5 aa, Entamoeba invadens
RYRGY

SEQ ID NO: 2903031 - protein, 5 aa, Entamoeba invadens
RYRNT

SEQ ID NO: 2903032 - protein, 13 aa, Entamoeba invadens
RYRQSELANQISS

SEQ ID NO: 2903033 - protein, 8 aa, Entamoeba invadens
RYSAQNTK

SEQ ID NO: 2903034 - protein, 9 aa, Entamoeba invadens
RYSDSSAPK

SEQ ID NO: 2903035 - protein, 6 aa, Entamoeba invadens
RYSEPA

SEQ ID NO: 2903036 - protein, 5 aa, Entamoeba invadens
RYSES

SEQ ID NO: 2903037 - protein, 10 aa, Entamoeba invadens
RYSNDQKQSN

SEQ ID NO: 2903038 - protein, 10 aa, Entamoeba invadens
RYSNETGIKE

SEQ ID NO: 2903039 - protein, 8 aa, Entamoeba invadens
RYSPDSPD

SEQ ID NO: 2903040 - protein, 5 aa, Entamoeba invadens
RYSQS

SEQ ID NO: 2903041 - protein, 18 aa, Entamoeba invadens
RYSSTIDKKTYSSKTLPG

SEQ ID NO: 2903042 - protein, 17 aa, Entamoeba invadens
RYSTTLNTDGNTASCDN

SEQ ID NO: 2903043 - protein, 6 aa, Entamoeba invadens
RYTEDI

SEQ ID NO: 2903044 - protein, 11 aa, Entamoeba invadens
RYTGPNGDNRM

SEQ ID NO: 2903045 - protein, 21 aa, Entamoeba invadens
RYTGTNAMKTDYTRSGKRGFK

SEQ ID NO: 2903046 - protein, 7 aa, Entamoeba invadens
RYTGVES

SEQ ID NO: 2903047 - protein, 7 aa, Entamoeba invadens
RYTPSNS

SEQ ID NO: 2903048 - protein, 5 aa, Entamoeba invadens
RYTPT

SEQ ID NO: 2903049 - protein, 16 aa, Entamoeba invadens
RYTSEDVEKHGNKIPE

SEQ ID NO: 2903050 - protein, 16 aa, Entamoeba invadens
RYTSEDVEKNGNKIPD

SEQ ID NO: 2903051 - protein, 24 aa, Entamoeba invadens
RYTTEDIEKYGSKIPEEVSQLGNY

SEQ ID NO: 2903052 - protein, 8 aa, Entamoeba invadens
RYTTQSDV

SEQ ID NO: 2903053 - protein, 9 aa, Entamoeba invadens
RYVATGGDD

SEQ ID NO: 2903054 - protein, 10 aa, Entamoeba invadens
RYVDPTQTIQ

SEQ ID NO: 2903055 - protein, 6 aa, Entamoeba invadens
RYVEGD

SEQ ID NO: 2903056 - protein, 4 aa, Entamoeba invadens
RYVQ

SEQ ID NO: 2903057 - protein, 18 aa, Entamoeba invadens
RYYDGYDNDEMKRGTKGV

SEQ ID NO: 2903058 - protein, 7 aa, Entamoeba invadens
SAAANKC

SEQ ID NO: 2903059 - protein, 10 aa, Entamoeba invadens
SAADKTTMDD

SEQ ID NO: 2903060 - protein, 7 aa, Entamoeba invadens
SAADLSQ

SEQ ID NO: 2903061 - protein, 5 aa, Entamoeba invadens
SAADY

SEQ ID NO: 2903062 - protein, 7 aa, Entamoeba invadens
SAAEDKI

SEQ ID NO: 2903063 - protein, 19 aa, Entamoeba invadens
SAAEKKKGENMNAYQSVSD

SEQ ID NO: 2903064 - protein, 6 aa, Entamoeba invadens
SAAGKT

SEQ ID NO: 2903065 - protein, 6 aa, Entamoeba invadens
SAAHNG

SEQ ID NO: 2903066 - protein, 17 aa, Entamoeba invadens
SAAISKSELFARKFWKG

SEQ ID NO: 2903067 - protein, 7 aa, Entamoeba invadens
SAAKEIT

SEQ ID NO: 2903068 - protein, 9 aa, Entamoeba invadens
SAALGDSEA

SEQ ID NO: 2903069 - protein, 7 aa, Entamoeba invadens
SAANDSK

SEQ ID NO: 2903070 - protein, 8 aa, Entamoeba invadens
SAANSDNV

SEQ ID NO: 2903071 - protein, 52 aa, Entamoeba invadens
SAAPPVVTTKTKRRQASESKKEQEKKQLEAVKQESEKQYAEQQSKKKEELTK

SEQ ID NO: 2903072 - protein, 7 aa, Entamoeba invadens
SAAPTYF

SEQ ID NO: 2903073 - protein, 9 aa, Entamoeba invadens
SAAQKYDDN

SEQ ID NO: 2903074 - protein, 7 aa, Entamoeba invadens
SAAQTVK

SEQ ID NO: 2903075 - protein, 4 aa, Entamoeba invadens
SAAR

SEQ ID NO: 2903076 - protein, 9 aa, Entamoeba invadens
SAASISKEV

SEQ ID NO: 2903077 - protein, 8 aa, Entamoeba invadens
SAATGDGV

SEQ ID NO: 2903078 - protein, 10 aa, Entamoeba invadens
SAATNIQLPQ

SEQ ID NO: 2903079 - protein, 5 aa, Entamoeba invadens
SACYR

SEQ ID NO: 2903080 - protein, 9 aa, Entamoeba invadens
SADAARRVG

SEQ ID NO: 2903081 - protein, 18 aa, Entamoeba invadens
SADANAPMSPDEPPKEKQ

SEQ ID NO: 2903082 - protein, 17 aa, Entamoeba invadens
SADANAQKILTQCEKIL

SEQ ID NO: 2903083 - protein, 5 aa, Entamoeba invadens
SADAQ

SEQ ID NO: 2903084 - protein, 13 aa, Entamoeba invadens
SADDENNFFQMKS

SEQ ID NO: 2903085 - protein, 12 aa, Entamoeba invadens
SADDNTKKEQLK

SEQ ID NO: 2903086 - protein, 7 aa, Entamoeba invadens
SADDSLS

SEQ ID NO: 2903087 - protein, 4 aa, Entamoeba invadens
SADE

SEQ ID NO: 2903088 - protein, 7 aa, Entamoeba invadens
SADEPMT

SEQ ID NO: 2903089 - protein, 6 aa, Entamoeba invadens
SADGDI

SEQ ID NO: 2903090 - protein, 9 aa, Entamoeba invadens
SADGTKRWN

SEQ ID NO: 2903091 - protein, 10 aa, Entamoeba invadens
SADKKDESSS

SEQ ID NO: 2903092 - protein, 9 aa, Entamoeba invadens
SADNFPREE

SEQ ID NO: 2903093 - protein, 15 aa, Entamoeba invadens
SADPNISDENQYSPL

SEQ ID NO: 2903094 - protein, 6 aa, Entamoeba invadens
SADSIR

SEQ ID NO: 2903095 - protein, 5 aa, Entamoeba invadens
SADSN

SEQ ID NO: 2903096 - protein, 7 aa, Entamoeba invadens
SADSPNL

SEQ ID NO: 2903097 - protein, 6 aa, Entamoeba invadens
SADSPY

SEQ ID NO: 2903098 - protein, 7 aa, Entamoeba invadens
SADSTCM

SEQ ID NO: 2903099 - protein, 7 aa, Entamoeba invadens
SADTHQR

SEQ ID NO: 2903100 - protein, 7 aa, Entamoeba invadens
SADVSKN

SEQ ID NO: 2903101 - protein, 8 aa, Entamoeba invadens
SADYPTDF

SEQ ID NO: 2903102 - protein, 10 aa, Entamoeba invadens
SAEASKDIRQ

SEQ ID NO: 2903103 - protein, 4 aa, Entamoeba invadens
SAED

SEQ ID NO: 2903104 - protein, 5 aa, Entamoeba invadens
SAEDA

SEQ ID NO: 2903105 - protein, 9 aa, Entamoeba invadens
SAEDEPRKI

SEQ ID NO: 2903106 - protein, 27 aa, Entamoeba invadens
SAEDKKSQSSTQQQAPKMNSENSALPT

SEQ ID NO: 2903107 - protein, 10 aa, Entamoeba invadens
SAEDKTQMQN

SEQ ID NO: 2903108 - protein, 6 aa, Entamoeba invadens
SAEDLS

SEQ ID NO: 2903109 - protein, 8 aa, Entamoeba invadens
SAEDRQTK

SEQ ID NO: 2903110 - protein, 41 aa, Entamoeba invadens
SAEEKDAYKPKKRTFPGRKGAKKDEEKKETTTEKKEEDEKK

SEQ ID NO: 2903111 - protein, 29 aa, Entamoeba invadens
SAEEVETAEKREKKSTSLAASPAKKRTFE

SEQ ID NO: 2903112 - protein, 8 aa, Entamoeba invadens
SAEFEDDS

SEQ ID NO: 2903113 - protein, 10 aa, Entamoeba invadens
SAEFKRKTIE

SEQ ID NO: 2903114 - protein, 8 aa, Entamoeba invadens
SAEGSRQI

SEQ ID NO: 2903115 - protein, 9 aa, Entamoeba invadens
SAEKADKGE

SEQ ID NO: 2903116 - protein, 8 aa, Entamoeba invadens
SAEKEIES

SEQ ID NO: 2903117 - protein, 6 aa, Entamoeba invadens
SAEKIE

SEQ ID NO: 2903118 - protein, 7 aa, Entamoeba invadens
SAEKNKY

SEQ ID NO: 2903119 - protein, 4 aa, Entamoeba invadens
SAEL

SEQ ID NO: 2903120 - protein, 40 aa, Entamoeba invadens
SAELSSPITPRTPRVSEDPEDKEKTTKTQEPQIKSSKSPK

SEQ ID NO: 2903121 - protein, 17 aa, Entamoeba invadens
SAENINKHYNEQTKGEI

SEQ ID NO: 2903122 - protein, 40 aa, Entamoeba invadens
SAENVRNKENEEHSKRDELRKLKGERENMKPMEGRTQAKR

SEQ ID NO: 2903123 - protein, 4 aa, Entamoeba invadens
SAEQ

SEQ ID NO: 2903124 - protein, 21 aa, Entamoeba invadens
SAEQQKKAVAEVNGTEIDGRK

SEQ ID NO: 2903125 - protein, 14 aa, Entamoeba invadens
SAERRQVSKEKSSV

SEQ ID NO: 2903126 - protein, 16 aa, Entamoeba invadens
SAESATGNVGERGDKV

SEQ ID NO: 2903127 - protein, 11 aa, Entamoeba invadens
SAESEKTISPY

SEQ ID NO: 2903128 - protein, 22 aa, Entamoeba invadens
SAESPAATKTASVSRSSTEVAV

SEQ ID NO: 2903129 - protein, 12 aa, Entamoeba invadens
SAESSPAKENLG

SEQ ID NO: 2903130 - protein, 7 aa, Entamoeba invadens
SAETFGN

SEQ ID NO: 2903131 - protein, 7 aa, Entamoeba invadens
SAETHNA

SEQ ID NO: 2903132 - protein, 18 aa, Entamoeba invadens
SAETNKIEPIKGSPYTPE

SEQ ID NO: 2903133 - protein, 30 aa, Entamoeba invadens
SAETPFLDDGEKSPKNRSRSPSTHEGEDPM

SEQ ID NO: 2903134 - protein, 6 aa, Entamoeba invadens
SAETQG

SEQ ID NO: 2903135 - protein, 7 aa, Entamoeba invadens
SAEVKKT

SEQ ID NO: 2903136 - protein, 8 aa, Entamoeba invadens
SAFDEDKL

SEQ ID NO: 2903137 - protein, 7 aa, Entamoeba invadens
SAFEGTA

SEQ ID NO: 2903138 - protein, 8 aa, Entamoeba invadens
SAFEKATS

SEQ ID NO: 2903139 - protein, 7 aa, Entamoeba invadens
SAFEKGE

SEQ ID NO: 2903140 - protein, 9 aa, Entamoeba invadens
SAFKGEKEE

SEQ ID NO: 2903141 - protein, 8 aa, Entamoeba invadens
SAFNKGDR

SEQ ID NO: 2903142 - protein, 22 aa, Entamoeba invadens
SAFNKGDRIEYPNKLSRDLMAY

SEQ ID NO: 2903143 - protein, 22 aa, Entamoeba invadens
SAFNKGDRIEYRNKLSRDLMAY

SEQ ID NO: 2903144 - protein, 9 aa, Entamoeba invadens
SAFQGASLT

SEQ ID NO: 2903145 - protein, 7 aa, Entamoeba invadens
SAFSGCK

SEQ ID NO: 2903146 - protein, 5 aa, Entamoeba invadens
SAFSS

SEQ ID NO: 2903147 - protein, 5 aa, Entamoeba invadens
SAFST

SEQ ID NO: 2903148 - protein, 8 aa, Entamoeba invadens
SAFTTSSI

SEQ ID NO: 2903149 - protein, 7 aa, Entamoeba invadens
SAGAGSI

SEQ ID NO: 2903150 - protein, 5 aa, Entamoeba invadens
SAGDI

SEQ ID NO: 2903151 - protein, 13 aa, Entamoeba invadens
SAGEGCIYPHPSL

SEQ ID NO: 2903152 - protein, 7 aa, Entamoeba invadens
SAGEGRE

SEQ ID NO: 2903153 - protein, 8 aa, Entamoeba invadens
SAGFDQET

SEQ ID NO: 2903154 - protein, 9 aa, Entamoeba invadens
SAGKPDPYY

SEQ ID NO: 2903155 - protein, 9 aa, Entamoeba invadens
SAGKSKTPF

SEQ ID NO: 2903156 - protein, 6 aa, Entamoeba invadens
SAGKST

SEQ ID NO: 2903157 - protein, 9 aa, Entamoeba invadens
SAGKTATAE

SEQ ID NO: 2903158 - protein, 9 aa, Entamoeba invadens
SAGKTSEGI

SEQ ID NO: 2903159 - protein, 6 aa, Entamoeba invadens
SAGKTT

SEQ ID NO: 2903160 - protein, 4 aa, Entamoeba invadens
SAGL

SEQ ID NO: 2903161 - protein, 6 aa, Entamoeba invadens
SAGLPI

SEQ ID NO: 2903162 - protein, 7 aa, Entamoeba invadens
SAGLTSE

SEQ ID NO: 2903163 - protein, 5 aa, Entamoeba invadens
SAGND

SEQ ID NO: 2903164 - protein, 10 aa, Entamoeba invadens
SAGNVDASKV

SEQ ID NO: 2903165 - protein, 5 aa, Entamoeba invadens
SAGQR

SEQ ID NO: 2903166 - protein, 5 aa, Entamoeba invadens
SAGRD

SEQ ID NO: 2903167 - protein, 7 aa, Entamoeba invadens
SAGRTRN

SEQ ID NO: 2903168 - protein, 6 aa, Entamoeba invadens
SAGRYK

SEQ ID NO: 2903169 - protein, 8 aa, Entamoeba invadens
SAGSEEEC

SEQ ID NO: 2903170 - protein, 14 aa, Entamoeba invadens
SAGTAQYTAVDETY

SEQ ID NO: 2903171 - protein, 14 aa, Entamoeba invadens
SAGTTIEPQYNTDY

SEQ ID NO: 2903172 - protein, 5 aa, Entamoeba invadens
SAGTY

SEQ ID NO: 2903173 - protein, 7 aa, Entamoeba invadens
SAHDDRT

SEQ ID NO: 2903174 - protein, 16 aa, Entamoeba invadens
SAHESASDSPVQQPKA

SEQ ID NO: 2903175 - protein, 8 aa, Entamoeba invadens
SAHPNNCY

SEQ ID NO: 2903176 - protein, 13 aa, Entamoeba invadens
SAHQRKESATKFK

SEQ ID NO: 2903177 - protein, 5 aa, Entamoeba invadens
SAHSH

SEQ ID NO: 2903178 - protein, 8 aa, Entamoeba invadens
SAIDYPNE

SEQ ID NO: 2903179 - protein, 9 aa, Entamoeba invadens
SAIGERREK

SEQ ID NO: 2903180 - protein, 13 aa, Entamoeba invadens
SAIGSYKDKQFKS

SEQ ID NO: 2903181 - protein, 10 aa, Entamoeba invadens
SAIKEKQLTS

SEQ ID NO: 2903182 - protein, 8 aa, Entamoeba invadens
SAINTQKV

SEQ ID NO: 2903183 - protein, 4 aa, Entamoeba invadens
SAIP

SEQ ID NO: 2903184 - protein, 9 aa, Entamoeba invadens
SAIPDSRNI

SEQ ID NO: 2903185 - protein, 10 aa, Entamoeba invadens
SAIPETDEIG

SEQ ID NO: 2903186 - protein, 22 aa, Entamoeba invadens
SAIPLDKKETPNWVTGEGKVSG

SEQ ID NO: 2903187 - protein, 10 aa, Entamoeba invadens
SAISGSGATG

SEQ ID NO: 2903188 - protein, 4 aa, Entamoeba invadens
SAIT

SEQ ID NO: 2903189 - protein, 4 aa, Entamoeba invadens
SAIY

SEQ ID NO: 2903190 - protein, 8 aa, Entamoeba invadens
SAKAGGVS

SEQ ID NO: 2903191 - protein, 4 aa, Entamoeba invadens
SAKC

SEQ ID NO: 2903192 - protein, 9 aa, Entamoeba invadens
SAKDENSPR

SEQ ID NO: 2903193 - protein, 9 aa, Entamoeba invadens
SAKDGSGID

SEQ ID NO: 2903194 - protein, 10 aa, Entamoeba invadens
SAKDSQQGVV

SEQ ID NO: 2903195 - protein, 8 aa, Entamoeba invadens
SAKEEERK

SEQ ID NO: 2903196 - protein, 11 aa, Entamoeba invadens
SAKENDPTSVA

SEQ ID NO: 2903197 - protein, 7 aa, Entamoeba invadens
SAKERHE

SEQ ID NO: 2903198 - protein, 9 aa, Entamoeba invadens
SAKETSPHL

SEQ ID NO: 2903199 - protein, 11 aa, Entamoeba invadens
SAKFESTTARY

SEQ ID NO: 2903200 - protein, 6 aa, Entamoeba invadens
SAKGEY

SEQ ID NO: 2903201 - protein, 6 aa, Entamoeba invadens
SAKGGL

SEQ ID NO: 2903202 - protein, 8 aa, Entamoeba invadens
SAKGNQEQ

SEQ ID NO: 2903203 - protein, 9 aa, Entamoeba invadens
SAKGTSSKI

SEQ ID NO: 2903204 - protein, 10 aa, Entamoeba invadens
SAKKAFDGVS

SEQ ID NO: 2903205 - protein, 9 aa, Entamoeba invadens
SAKKDTETQ

SEQ ID NO: 2903206 - protein, 103 aa, Entamoeba invadens
SAKKQQDEEVEEQQTKEVQKEHSESSEETSEDEKKSKKSANKDFIKPTPKKKVASSDSESDDKKTPSKTSSKSPENFASPAIPESPMPDQNPGSFDNTEPPIS

SEQ ID NO: 2903207 - protein, 9 aa, Entamoeba invadens
SAKKRTNVD

SEQ ID NO: 2903208 - protein, 5 aa, Entamoeba invadens
SAKKS

SEQ ID NO: 2903209 - protein, 8 aa, Entamoeba invadens
SAKKTLQM

SEQ ID NO: 2903210 - protein, 16 aa, Entamoeba invadens
SAKKYSTRYTSAIIHM

SEQ ID NO: 2903211 - protein, 7 aa, Entamoeba invadens
SAKLQPL

SEQ ID NO: 2903212 - protein, 14 aa, Entamoeba invadens
SAKLTTKKKTKSDV

SEQ ID NO: 2903213 - protein, 7 aa, Entamoeba invadens
SAKNDIN

SEQ ID NO: 2903214 - protein, 7 aa, Entamoeba invadens
SAKNEIQ

SEQ ID NO: 2903215 - protein, 9 aa, Entamoeba invadens
SAKNGKTSL

SEQ ID NO: 2903216 - protein, 8 aa, Entamoeba invadens
SAKNKINI

SEQ ID NO: 2903217 - protein, 11 aa, Entamoeba invadens
SAKNKTNITET

SEQ ID NO: 2903218 - protein, 13 aa, Entamoeba invadens
SAKNNLIDRDPST

SEQ ID NO: 2903219 - protein, 7 aa, Entamoeba invadens
SAKNNTN

SEQ ID NO: 2903220 - protein, 8 aa, Entamoeba invadens
SAKNNTNI

SEQ ID NO: 2903221 - protein, 9 aa, Entamoeba invadens
SAKNPKSYM

SEQ ID NO: 2903222 - protein, 8 aa, Entamoeba invadens
SAKPGDRV

SEQ ID NO: 2903223 - protein, 15 aa, Entamoeba invadens
SAKPQPIRPSGVESD

SEQ ID NO: 2903224 - protein, 12 aa, Entamoeba invadens
SAKQLDPKGPNI

SEQ ID NO: 2903225 - protein, 18 aa, Entamoeba invadens
SAKQSLNSFTTTIISIQL

SEQ ID NO: 2903226 - protein, 8 aa, Entamoeba invadens
SAKQYYDR

SEQ ID NO: 2903227 - protein, 8 aa, Entamoeba invadens
SAKRKADG

SEQ ID NO: 2903228 - protein, 5 aa, Entamoeba invadens
SAKRN

SEQ ID NO: 2903229 - protein, 6 aa, Entamoeba invadens
SAKRNI

SEQ ID NO: 2903230 - protein, 4 aa, Entamoeba invadens
SAKS

SEQ ID NO: 2903231 - protein, 19 aa, Entamoeba invadens
SAKSDKAERVKTTVEKGTL

SEQ ID NO: 2903232 - protein, 29 aa, Entamoeba invadens
SAKSFVPKSKKDAAPKHSTIQPPKGFPPQ

SEQ ID NO: 2903233 - protein, 11 aa, Entamoeba invadens
SAKSGKNVTES

SEQ ID NO: 2903234 - protein, 7 aa, Entamoeba invadens
SAKSGVN

SEQ ID NO: 2903235 - protein, 8 aa, Entamoeba invadens
SAKSNTNI

SEQ ID NO: 2903236 - protein, 9 aa, Entamoeba invadens
SAKSPKDAV

SEQ ID NO: 2903237 - protein, 10 aa, Entamoeba invadens
SAKTEEIDGR

SEQ ID NO: 2903238 - protein, 10 aa, Entamoeba invadens
SAKTGDGAKE

SEQ ID NO: 2903239 - protein, 9 aa, Entamoeba invadens
SAKTGDGIN

SEQ ID NO: 2903240 - protein, 11 aa, Entamoeba invadens
SAKTGDKCEEA

SEQ ID NO: 2903241 - protein, 8 aa, Entamoeba invadens
SAKTGDNI

SEQ ID NO: 2903242 - protein, 8 aa, Entamoeba invadens
SAKTGEGI

SEQ ID NO: 2903243 - protein, 10 aa, Entamoeba invadens
SAKTGEGVTE

SEQ ID NO: 2903244 - protein, 8 aa, Entamoeba invadens
SAKTGENI

SEQ ID NO: 2903245 - protein, 8 aa, Entamoeba invadens
SAKTGENL

SEQ ID NO: 2903246 - protein, 8 aa, Entamoeba invadens
SAKTGKRV

SEQ ID NO: 2903247 - protein, 7 aa, Entamoeba invadens
SAKTGNN

SEQ ID NO: 2903248 - protein, 9 aa, Entamoeba invadens
SAKTGSGVK

SEQ ID NO: 2903249 - protein, 9 aa, Entamoeba invadens
SAKTGTGVE

SEQ ID NO: 2903250 - protein, 8 aa, Entamoeba invadens
SAKTTKNI

SEQ ID NO: 2903251 - protein, 7 aa, Entamoeba invadens
SAKTYTE

SEQ ID NO: 2903252 - protein, 11 aa, Entamoeba invadens
SAKYKNDLTCG

SEQ ID NO: 2903253 - protein, 18 aa, Entamoeba invadens
SALAENKKKTRESEEAMT

SEQ ID NO: 2903254 - protein, 16 aa, Entamoeba invadens
SALEQKKLKQDQASDA

SEQ ID NO: 2903255 - protein, 13 aa, Entamoeba invadens
SALGAAAATAAAV

SEQ ID NO: 2903256 - protein, 14 aa, Entamoeba invadens
SALGDESVSIGANK

SEQ ID NO: 2903257 - protein, 12 aa, Entamoeba invadens
SALGKKESETIF

SEQ ID NO: 2903258 - protein, 9 aa, Entamoeba invadens
SALGQSTVN

SEQ ID NO: 2903259 - protein, 7 aa, Entamoeba invadens
SALKERQ

SEQ ID NO: 2903260 - protein, 6 aa, Entamoeba invadens
SALKGV

SEQ ID NO: 2903261 - protein, 9 aa, Entamoeba invadens
SALLSGDGQ

SEQ ID NO: 2903262 - protein, 7 aa, Entamoeba invadens
SALNETD

SEQ ID NO: 2903263 - protein, 9 aa, Entamoeba invadens
SALNSPDER

SEQ ID NO: 2903264 - protein, 8 aa, Entamoeba invadens
SALNTENE

SEQ ID NO: 2903265 - protein, 8 aa, Entamoeba invadens
SALPPTSY

SEQ ID NO: 2903266 - protein, 7 aa, Entamoeba invadens
SALPQNM

SEQ ID NO: 2903267 - protein, 22 aa, Entamoeba invadens
SALQDTDEDEEVRRSMTPNSFK

SEQ ID NO: 2903268 - protein, 9 aa, Entamoeba invadens
SALQEEERN

SEQ ID NO: 2903269 - protein, 8 aa, Entamoeba invadens
SALRESGY

SEQ ID NO: 2903270 - protein, 26 aa, Entamoeba invadens
SALRNGTCDGTISDRGSHMDYSQDNA

SEQ ID NO: 2903271 - protein, 11 aa, Entamoeba invadens
SALSRNEEERV

SEQ ID NO: 2903272 - protein, 7 aa, Entamoeba invadens
SALTPKA

SEQ ID NO: 2903273 - protein, 14 aa, Entamoeba invadens
SAMDSDSDGKVDLE

SEQ ID NO: 2903274 - protein, 4 aa, Entamoeba invadens
SAME

SEQ ID NO: 2903275 - protein, 5 aa, Entamoeba invadens
SAMEQ

SEQ ID NO: 2903276 - protein, 6 aa, Entamoeba invadens
SAMEQK

SEQ ID NO: 2903277 - protein, 4 aa, Entamoeba invadens
SAMS

SEQ ID NO: 2903278 - protein, 4 aa, Entamoeba invadens
SAND

SEQ ID NO: 2903279 - protein, 8 aa, Entamoeba invadens
SANDEPNW

SEQ ID NO: 2903280 - protein, 18 aa, Entamoeba invadens
SANDKKADLDKEKSENTV

SEQ ID NO: 2903281 - protein, 7 aa, Entamoeba invadens
SANDQYV

SEQ ID NO: 2903282 - protein, 8 aa, Entamoeba invadens
SANERYSK

SEQ ID NO: 2903283 - protein, 8 aa, Entamoeba invadens
SANFTEEH

SEQ ID NO: 2903284 - protein, 9 aa, Entamoeba invadens
SANFTEEHN

SEQ ID NO: 2903285 - protein, 9 aa, Entamoeba invadens
SANKSELDK

SEQ ID NO: 2903286 - protein, 9 aa, Entamoeba invadens
SANKTPRRK

SEQ ID NO: 2903287 - protein, 8 aa, Entamoeba invadens
SANNDEEI

SEQ ID NO: 2903288 - protein, 10 aa, Entamoeba invadens
SANNEIDAET

SEQ ID NO: 2903289 - protein, 12 aa, Entamoeba invadens
SANNSEGDKPHG

SEQ ID NO: 2903290 - protein, 12 aa, Entamoeba invadens
SANPKESRYNPK

SEQ ID NO: 2903291 - protein, 10 aa, Entamoeba invadens
SANQSELDKK

SEQ ID NO: 2903292 - protein, 9 aa, Entamoeba invadens
SANQSLDKP

SEQ ID NO: 2903293 - protein, 6 aa, Entamoeba invadens
SANQTI

SEQ ID NO: 2903294 - protein, 4 aa, Entamoeba invadens
SANS

SEQ ID NO: 2903295 - protein, 6 aa, Entamoeba invadens
SANSLD

SEQ ID NO: 2903296 - protein, 21 aa, Entamoeba invadens
SANSTQSQRSPRKQKVSKDDS

SEQ ID NO: 2903297 - protein, 8 aa, Entamoeba invadens
SANSYQTQ

SEQ ID NO: 2903298 - protein, 4 aa, Entamoeba invadens
SANT

SEQ ID NO: 2903299 - protein, 9 aa, Entamoeba invadens
SANVPDNYG

SEQ ID NO: 2903300 - protein, 9 aa, Entamoeba invadens
SANVQTEQC

SEQ ID NO: 2903301 - protein, 9 aa, Entamoeba invadens
SAPAEDGDY

SEQ ID NO: 2903302 - protein, 13 aa, Entamoeba invadens
SAPASVAQEEEKN

SEQ ID NO: 2903303 - protein, 23 aa, Entamoeba invadens
SAPASVAQEEEKNMLNARIAEIQ

SEQ ID NO: 2903304 - protein, 13 aa, Entamoeba invadens
SAPASVVQEEEKN

SEQ ID NO: 2903305 - protein, 6 aa, Entamoeba invadens
SAPDLT

SEQ ID NO: 2903306 - protein, 9 aa, Entamoeba invadens
SAPDNTSER

SEQ ID NO: 2903307 - protein, 6 aa, Entamoeba invadens
SAPEVT

SEQ ID NO: 2903308 - protein, 9 aa, Entamoeba invadens
SAPGGKSTH

SEQ ID NO: 2903309 - protein, 8 aa, Entamoeba invadens
SAPGPGVV

SEQ ID NO: 2903310 - protein, 5 aa, Entamoeba invadens
SAPHS

SEQ ID NO: 2903311 - protein, 4 aa, Entamoeba invadens
SAPL

SEQ ID NO: 2903312 - protein, 6 aa, Entamoeba invadens
SAPLSR

SEQ ID NO: 2903313 - protein, 7 aa, Entamoeba invadens
SAPLTSE

SEQ ID NO: 2903314 - protein, 4 aa, Entamoeba invadens
SAPM

SEQ ID NO: 2903315 - protein, 6 aa, Entamoeba invadens
SAPMPQ

SEQ ID NO: 2903316 - protein, 10 aa, Entamoeba invadens
SAPNPIPSPL

SEQ ID NO: 2903317 - protein, 34 aa, Entamoeba invadens
SAPNSTKNTLAKPVKKTVSPAQRPDQRINEKPKL

SEQ ID NO: 2903318 - protein, 6 aa, Entamoeba invadens
SAPPEY

SEQ ID NO: 2903319 - protein, 7 aa, Entamoeba invadens
SAPPQIN

SEQ ID NO: 2903320 - protein, 9 aa, Entamoeba invadens
SAPQFEENS

SEQ ID NO: 2903321 - protein, 5 aa, Entamoeba invadens
SAPQI

SEQ ID NO: 2903322 - protein, 6 aa, Entamoeba invadens
SAPQIS

SEQ ID NO: 2903323 - protein, 11 aa, Entamoeba invadens
SAPQTQSDVIG

SEQ ID NO: 2903324 - protein, 5 aa, Entamoeba invadens
SAPRE

SEQ ID NO: 2903325 - protein, 13 aa, Entamoeba invadens
SAPRNSKNAHEIQ

SEQ ID NO: 2903326 - protein, 8 aa, Entamoeba invadens
SAPTAKTK

SEQ ID NO: 2903327 - protein, 7 aa, Entamoeba invadens
SAPTEDE

SEQ ID NO: 2903328 - protein, 9 aa, Entamoeba invadens
SAPTSAGKT

SEQ ID NO: 2903329 - protein, 4 aa, Entamoeba invadens
SAPV

SEQ ID NO: 2903330 - protein, 5 aa, Entamoeba invadens
SAPVA

SEQ ID NO: 2903331 - protein, 5 aa, Entamoeba invadens
SAPYD

SEQ ID NO: 2903332 - protein, 7 aa, Entamoeba invadens
SAPYMSP

SEQ ID NO: 2903333 - protein, 7 aa, Entamoeba invadens
SAQDPSE

SEQ ID NO: 2903334 - protein, 4 aa, Entamoeba invadens
SAQE

SEQ ID NO: 2903335 - protein, 12 aa, Entamoeba invadens
SAQEHNQLRTSN

SEQ ID NO: 2903336 - protein, 10 aa, Entamoeba invadens
SAQEKSAQSE

SEQ ID NO: 2903337 - protein, 7 aa, Entamoeba invadens
SAQGEFP

SEQ ID NO: 2903338 - protein, 15 aa, Entamoeba invadens
SAQGTTLGGDDGTGV

SEQ ID NO: 2903339 - protein, 27 aa, Entamoeba invadens
SAQHRSASSNSTRPPIFTTSQKKRAVF

SEQ ID NO: 2903340 - protein, 5 aa, Entamoeba invadens
SAQIA

SEQ ID NO: 2903341 - protein, 4 aa, Entamoeba invadens
SAQK

SEQ ID NO: 2903342 - protein, 16 aa, Entamoeba invadens
SAQKPSFQKLSESYGK

SEQ ID NO: 2903343 - protein, 7 aa, Entamoeba invadens
SAQLTPM

SEQ ID NO: 2903344 - protein, 47 aa, Entamoeba invadens
SAQNESAPNQVNVGTSAVDGVGKVQRDLTNDTNPQNEQTRVQPKIEK

SEQ ID NO: 2903345 - protein, 6 aa, Entamoeba invadens
SAQNNI

SEQ ID NO: 2903346 - protein, 8 aa, Entamoeba invadens
SAQNNTNV

SEQ ID NO: 2903347 - protein, 8 aa, Entamoeba invadens
SAQPNGTV

SEQ ID NO: 2903348 - protein, 17 aa, Entamoeba invadens
SAQPPQRQNEGSTISSE

SEQ ID NO: 2903349 - protein, 6 aa, Entamoeba invadens
SAQPSL

SEQ ID NO: 2903350 - protein, 16 aa, Entamoeba invadens
SAQRAVEVKDSKGRRG

SEQ ID NO: 2903351 - protein, 10 aa, Entamoeba invadens
SAQSASSENL

SEQ ID NO: 2903352 - protein, 6 aa, Entamoeba invadens
SAQSEF

SEQ ID NO: 2903353 - protein, 9 aa, Entamoeba invadens
SAQSIEPET

SEQ ID NO: 2903354 - protein, 9 aa, Entamoeba invadens
SAQSTPRDS

SEQ ID NO: 2903355 - protein, 5 aa, Entamoeba invadens
SAQVQ

SEQ ID NO: 2903356 - protein, 19 aa, Entamoeba invadens
SAQVYQGSLPTQIKNKCSQ

SEQ ID NO: 2903357 - protein, 4 aa, Entamoeba invadens
SARA

SEQ ID NO: 2903358 - protein, 5 aa, Entamoeba invadens
SARDL

SEQ ID NO: 2903359 - protein, 7 aa, Entamoeba invadens
SAREIED

SEQ ID NO: 2903360 - protein, 10 aa, Entamoeba invadens
SAREKGEDNL

SEQ ID NO: 2903361 - protein, 7 aa, Entamoeba invadens
SARFGRK

SEQ ID NO: 2903362 - protein, 5 aa, Entamoeba invadens
SARGT

SEQ ID NO: 2903363 - protein, 5 aa, Entamoeba invadens
SARHS

SEQ ID NO: 2903364 - protein, 4 aa, Entamoeba invadens
SARK

SEQ ID NO: 2903365 - protein, 9 aa, Entamoeba invadens
SARKEEDVE

SEQ ID NO: 2903366 - protein, 5 aa, Entamoeba invadens
SARPE

SEQ ID NO: 2903367 - protein, 18 aa, Entamoeba invadens
SARQSLKLSKTSKSLCTQ

SEQ ID NO: 2903368 - protein, 9 aa, Entamoeba invadens
SARSAMKNK

SEQ ID NO: 2903369 - protein, 14 aa, Entamoeba invadens
SARSETEHESSRRL

SEQ ID NO: 2903370 - protein, 8 aa, Entamoeba invadens
SARSGKNV

SEQ ID NO: 2903371 - protein, 15 aa, Entamoeba invadens
SARSRLKSENSITST

SEQ ID NO: 2903372 - protein, 6 aa, Entamoeba invadens
SARTDF

SEQ ID NO: 2903373 - protein, 20 aa, Entamoeba invadens
SARYGGKVDDLNNQKKSLEN

SEQ ID NO: 2903374 - protein, 6 aa, Entamoeba invadens
SASAYY

SEQ ID NO: 2903375 - protein, 6 aa, Entamoeba invadens
SASDEA

SEQ ID NO: 2903376 - protein, 10 aa, Entamoeba invadens
SASDEPRKAE

SEQ ID NO: 2903377 - protein, 12 aa, Entamoeba invadens
SASDNKKEPIRE

SEQ ID NO: 2903378 - protein, 10 aa, Entamoeba invadens
SASDSNILPS

SEQ ID NO: 2903379 - protein, 8 aa, Entamoeba invadens
SASEDSTV

SEQ ID NO: 2903380 - protein, 7 aa, Entamoeba invadens
SASEEQL

SEQ ID NO: 2903381 - protein, 7 aa, Entamoeba invadens
SASEKTL

SEQ ID NO: 2903382 - protein, 11 aa, Entamoeba invadens
SASELKKKCSS

SEQ ID NO: 2903383 - protein, 10 aa, Entamoeba invadens
SASENAVNTI

SEQ ID NO: 2903384 - protein, 6 aa, Entamoeba invadens
SASENS

SEQ ID NO: 2903385 - protein, 6 aa, Entamoeba invadens
SASERN

SEQ ID NO: 2903386 - protein, 5 aa, Entamoeba invadens
SASES

SEQ ID NO: 2903387 - protein, 25 aa, Entamoeba invadens
SASFDKKDILDDKRSYELSNVTEPK

SEQ ID NO: 2903388 - protein, 7 aa, Entamoeba invadens
SASFRNK

SEQ ID NO: 2903389 - protein, 13 aa, Entamoeba invadens
SASGKKIGGSRGR

SEQ ID NO: 2903390 - protein, 6 aa, Entamoeba invadens
SASGNT

SEQ ID NO: 2903391 - protein, 8 aa, Entamoeba invadens
SASGSEIA

SEQ ID NO: 2903392 - protein, 30 aa, Entamoeba invadens
SASGTTRQAATMSSREMRKSQEVERKAQKK

SEQ ID NO: 2903393 - protein, 8 aa, Entamoeba invadens
SASKEDQT

SEQ ID NO: 2903394 - protein, 6 aa, Entamoeba invadens
SASKPD

SEQ ID NO: 2903395 - protein, 8 aa, Entamoeba invadens
SASLPKAT

SEQ ID NO: 2903396 - protein, 7 aa, Entamoeba invadens
SASNDVN

SEQ ID NO: 2903397 - protein, 7 aa, Entamoeba invadens
SASNISA

SEQ ID NO: 2903398 - protein, 7 aa, Entamoeba invadens
SASNNLN

SEQ ID NO: 2903399 - protein, 6 aa, Entamoeba invadens
SASNSM

SEQ ID NO: 2903400 - protein, 4 aa, Entamoeba invadens
SASP

SEQ ID NO: 2903401 - protein, 13 aa, Entamoeba invadens
SASPSFGKNRQFG

SEQ ID NO: 2903402 - protein, 9 aa, Entamoeba invadens
SASPTKTRK

SEQ ID NO: 2903403 - protein, 13 aa, Entamoeba invadens
SASPTQKELLKEL

SEQ ID NO: 2903404 - protein, 6 aa, Entamoeba invadens
SASPVV

SEQ ID NO: 2903405 - protein, 5 aa, Entamoeba invadens
SASQD

SEQ ID NO: 2903406 - protein, 8 aa, Entamoeba invadens
SASQSPTL

SEQ ID NO: 2903407 - protein, 4 aa, Entamoeba invadens
SASR

SEQ ID NO: 2903408 - protein, 7 aa, Entamoeba invadens
SASSDGH

SEQ ID NO: 2903409 - protein, 7 aa, Entamoeba invadens
SASSDIT

SEQ ID NO: 2903410 - protein, 7 aa, Entamoeba invadens
SASSDQK

SEQ ID NO: 2903411 - protein, 6 aa, Entamoeba invadens
SASSEM

SEQ ID NO: 2903412 - protein, 5 aa, Entamoeba invadens
SASSL

SEQ ID NO: 2903413 - protein, 8 aa, Entamoeba invadens
SASSNNAV

SEQ ID NO: 2903414 - protein, 10 aa, Entamoeba invadens
SASSQKEKSV

SEQ ID NO: 2903415 - protein, 19 aa, Entamoeba invadens
SASSSAVKSGHAKQIPQVD

SEQ ID NO: 2903416 - protein, 9 aa, Entamoeba invadens
SASSSYKIG

SEQ ID NO: 2903417 - protein, 13 aa, Entamoeba invadens
SASTAKKGYAGTA

SEQ ID NO: 2903418 - protein, 7 aa, Entamoeba invadens
SASTDRK

SEQ ID NO: 2903419 - protein, 5 aa, Entamoeba invadens
SASTG

SEQ ID NO: 2903420 - protein, 7 aa, Entamoeba invadens
SASTLDL

SEQ ID NO: 2903421 - protein, 8 aa, Entamoeba invadens
SASTNQRI

SEQ ID NO: 2903422 - protein, 9 aa, Entamoeba invadens
SASTYCNEE

SEQ ID NO: 2903423 - protein, 10 aa, Entamoeba invadens
SASYKDTGRV

SEQ ID NO: 2903424 - protein, 5 aa, Entamoeba invadens
SATAR

SEQ ID NO: 2903425 - protein, 5 aa, Entamoeba invadens
SATAS

SEQ ID NO: 2903426 - protein, 5 aa, Entamoeba invadens
SATAY

SEQ ID NO: 2903427 - protein, 7 aa, Entamoeba invadens
SATDKEK

SEQ ID NO: 2903428 - protein, 16 aa, Entamoeba invadens
SATDKLKTETKTTELE

SEQ ID NO: 2903429 - protein, 7 aa, Entamoeba invadens
SATDQPL

SEQ ID NO: 2903430 - protein, 7 aa, Entamoeba invadens
SATENGK

SEQ ID NO: 2903431 - protein, 5 aa, Entamoeba invadens
SATEV

SEQ ID NO: 2903432 - protein, 12 aa, Entamoeba invadens
SATGVPPELSKR

SEQ ID NO: 2903433 - protein, 10 aa, Entamoeba invadens
SATIEKNRGC

SEQ ID NO: 2903434 - protein, 4 aa, Entamoeba invadens
SATK

SEQ ID NO: 2903435 - protein, 9 aa, Entamoeba invadens
SATKANPKC

SEQ ID NO: 2903436 - protein, 11 aa, Entamoeba invadens
SATKFGKNTFK

SEQ ID NO: 2903437 - protein, 12 aa, Entamoeba invadens
SATKFGKNTFKD

SEQ ID NO: 2903438 - protein, 7 aa, Entamoeba invadens
SATKGEG

SEQ ID NO: 2903439 - protein, 8 aa, Entamoeba invadens
SATKRRYV

SEQ ID NO: 2903440 - protein, 14 aa, Entamoeba invadens
SATKTQLGLSQKEP

SEQ ID NO: 2903441 - protein, 6 aa, Entamoeba invadens
SATLGS

SEQ ID NO: 2903442 - protein, 8 aa, Entamoeba invadens
SATMNSET

SEQ ID NO: 2903443 - protein, 6 aa, Entamoeba invadens
SATNKT

SEQ ID NO: 2903444 - protein, 8 aa, Entamoeba invadens
SATPKTMK

SEQ ID NO: 2903445 - protein, 5 aa, Entamoeba invadens
SATPL

SEQ ID NO: 2903446 - protein, 6 aa, Entamoeba invadens
SATPRK

SEQ ID NO: 2903447 - protein, 7 aa, Entamoeba invadens
SATQDVS

SEQ ID NO: 2903448 - protein, 6 aa, Entamoeba invadens
SATQKC

SEQ ID NO: 2903449 - protein, 7 aa, Entamoeba invadens
SATQKEV

SEQ ID NO: 2903450 - protein, 4 aa, Entamoeba invadens
SATR

SEQ ID NO: 2903451 - protein, 9 aa, Entamoeba invadens
SATRGPQVQ

SEQ ID NO: 2903452 - protein, 5 aa, Entamoeba invadens
SATRN

SEQ ID NO: 2903453 - protein, 10 aa, Entamoeba invadens
SATRYERTTQ

SEQ ID NO: 2903454 - protein, 7 aa, Entamoeba invadens
SATSCPN

SEQ ID NO: 2903455 - protein, 10 aa, Entamoeba invadens
SATSEQDREE

SEQ ID NO: 2903456 - protein, 10 aa, Entamoeba invadens
SATSTGKNEL

SEQ ID NO: 2903457 - protein, 5 aa, Entamoeba invadens
SATTA

SEQ ID NO: 2903458 - protein, 12 aa, Entamoeba invadens
SATTKLTTRLDP

SEQ ID NO: 2903459 - protein, 7 aa, Entamoeba invadens
SATTPIE

SEQ ID NO: 2903460 - protein, 9 aa, Entamoeba invadens
SATVASPEL

SEQ ID NO: 2903461 - protein, 7 aa, Entamoeba invadens
SATWKKE

SEQ ID NO: 2903462 - protein, 4 aa, Entamoeba invadens
SATY

SEQ ID NO: 2903463 - protein, 8 aa, Entamoeba invadens
SATYPNAT

SEQ ID NO: 2903464 - protein, 6 aa, Entamoeba invadens
SATYYS

SEQ ID NO: 2903465 - protein, 13 aa, Entamoeba invadens
SATYYSENRYSDQ

SEQ ID NO: 2903466 - protein, 7 aa, Entamoeba invadens
SAVAGMS

SEQ ID NO: 2903467 - protein, 8 aa, Entamoeba invadens
SAVDNNGD

SEQ ID NO: 2903468 - protein, 8 aa, Entamoeba invadens
SAVEKSSE

SEQ ID NO: 2903469 - protein, 8 aa, Entamoeba invadens
SAVGESDN

SEQ ID NO: 2903470 - protein, 7 aa, Entamoeba invadens
SAVGKTS

SEQ ID NO: 2903471 - protein, 7 aa, Entamoeba invadens
SAVITSE

SEQ ID NO: 2903472 - protein, 33 aa, Entamoeba invadens
SAVKKVSSKVSKVAKKATSVAKKVGKTAVKAGV

SEQ ID NO: 2903473 - protein, 8 aa, Entamoeba invadens
SAVKNEQL

SEQ ID NO: 2903474 - protein, 13 aa, Entamoeba invadens
SAVKSDLKEGATS

SEQ ID NO: 2903475 - protein, 7 aa, Entamoeba invadens
SAVKTKK

SEQ ID NO: 2903476 - protein, 13 aa, Entamoeba invadens
SAVNETKRTMEQK

SEQ ID NO: 2903477 - protein, 5 aa, Entamoeba invadens
SAVNS

SEQ ID NO: 2903478 - protein, 4 aa, Entamoeba invadens
SAVP

SEQ ID NO: 2903479 - protein, 8 aa, Entamoeba invadens
SAVRQNVE

SEQ ID NO: 2903480 - protein, 17 aa, Entamoeba invadens
SAVSGEENLHDSLNEPK

SEQ ID NO: 2903481 - protein, 7 aa, Entamoeba invadens
SAVSGSV

SEQ ID NO: 2903482 - protein, 9 aa, Entamoeba invadens
SAVSKATES

SEQ ID NO: 2903483 - protein, 30 aa, Entamoeba invadens
SAVSRSSDDSLEKHSSPSPMSSSQTNKQWN

SEQ ID NO: 2903484 - protein, 10 aa, Entamoeba invadens
SAVVGGNNFD

SEQ ID NO: 2903485 - protein, 4 aa, Entamoeba invadens
SAVY

SEQ ID NO: 2903486 - protein, 4 aa, Entamoeba invadens
SAWR

SEQ ID NO: 2903487 - protein, 64 aa, Entamoeba invadens
SAWSKKSGKKTVKEEGKQDVPKEVSQDEKPLEKDKEMKIEKAASQKEVVETTEDVVKEDDKVEV

SEQ ID NO: 2903488 - protein, 8 aa, Entamoeba invadens
SAYGGGKY

SEQ ID NO: 2903489 - protein, 13 aa, Entamoeba invadens
SAYGGGMDGPESV

SEQ ID NO: 2903490 - protein, 9 aa, Entamoeba invadens
SAYKENEFK

SEQ ID NO: 2903491 - protein, 8 aa, Entamoeba invadens
SAYLDSEQ

SEQ ID NO: 2903492 - protein, 4 aa, Entamoeba invadens
SAYN

SEQ ID NO: 2903493 - protein, 9 aa, Entamoeba invadens
SAYNENKER

SEQ ID NO: 2903494 - protein, 15 aa, Entamoeba invadens
SAYPDVENHNEKAFE

SEQ ID NO: 2903495 - protein, 7 aa, Entamoeba invadens
SAYPQAV

SEQ ID NO: 2903496 - protein, 5 aa, Entamoeba invadens
SAYSH

SEQ ID NO: 2903497 - protein, 14 aa, Entamoeba invadens
SAYSIKKGGPMERI

SEQ ID NO: 2903498 - protein, 7 aa, Entamoeba invadens
SCAEPQK

SEQ ID NO: 2903499 - protein, 18 aa, Entamoeba invadens
SCANGCSISTGDCITCID

SEQ ID NO: 2903500 - protein, 19 aa, Entamoeba invadens
SCATSSSAKPTCKGCSSGY

SEQ ID NO: 2903501 - protein, 9 aa, Entamoeba invadens
SCATSSSEN

SEQ ID NO: 2903502 - protein, 9 aa, Entamoeba invadens
SCDDSYTKT

SEQ ID NO: 2903503 - protein, 9 aa, Entamoeba invadens
SCDERPKYR

SEQ ID NO: 2903504 - protein, 9 aa, Entamoeba invadens
SCDGNQYID

SEQ ID NO: 2903505 - protein, 6 aa, Entamoeba invadens
SCDKNS

SEQ ID NO: 2903506 - protein, 6 aa, Entamoeba invadens
SCDSEE

SEQ ID NO: 2903507 - protein, 7 aa, Entamoeba invadens
SCDSTKG

SEQ ID NO: 2903508 - protein, 14 aa, Entamoeba invadens
SCDTEPEVKMIESI

SEQ ID NO: 2903509 - protein, 8 aa, Entamoeba invadens
SCEGGEPL

SEQ ID NO: 2903510 - protein, 25 aa, Entamoeba invadens
SCEGSSFKNANKKFDGSSSIDKAAF

SEQ ID NO: 2903511 - protein, 7 aa, Entamoeba invadens
SCENGKY

SEQ ID NO: 2903512 - protein, 8 aa, Entamoeba invadens
SCENSSIR

SEQ ID NO: 2903513 - protein, 4 aa, Entamoeba invadens
SCES

SEQ ID NO: 2903514 - protein, 6 aa, Entamoeba invadens
SCETNR

SEQ ID NO: 2903515 - protein, 8 aa, Entamoeba invadens
SCETPRRL

SEQ ID NO: 2903516 - protein, 5 aa, Entamoeba invadens
SCGDG

SEQ ID NO: 2903517 - protein, 11 aa, Entamoeba invadens
SCGDVTQRLNE

SEQ ID NO: 2903518 - protein, 6 aa, Entamoeba invadens
SCGGDD

SEQ ID NO: 2903519 - protein, 11 aa, Entamoeba invadens
SCGGQCDTTNG

SEQ ID NO: 2903520 - protein, 9 aa, Entamoeba invadens
SCGGSCSGV

SEQ ID NO: 2903521 - protein, 8 aa, Entamoeba invadens
SCGKTSER

SEQ ID NO: 2903522 - protein, 4 aa, Entamoeba invadens
SCGN

SEQ ID NO: 2903523 - protein, 5 aa, Entamoeba invadens
SCGNG

SEQ ID NO: 2903524 - protein, 4 aa, Entamoeba invadens
SCGP

SEQ ID NO: 2903525 - protein, 7 aa, Entamoeba invadens
SCGPRGF

SEQ ID NO: 2903526 - protein, 21 aa, Entamoeba invadens
SCGSVSSSASNSKQRRTRHKN

SEQ ID NO: 2903527 - protein, 12 aa, Entamoeba invadens
SCGTCNGTNPNN

SEQ ID NO: 2903528 - protein, 13 aa, Entamoeba invadens
SCHVEKTKNKKEV

SEQ ID NO: 2903529 - protein, 9 aa, Entamoeba invadens
SCIDESTTE

SEQ ID NO: 2903530 - protein, 5 aa, Entamoeba invadens
SCKDA

SEQ ID NO: 2903531 - protein, 10 aa, Entamoeba invadens
SCKEQGNETV

SEQ ID NO: 2903532 - protein, 10 aa, Entamoeba invadens
SCKESPPNTT

SEQ ID NO: 2903533 - protein, 9 aa, Entamoeba invadens
SCKETSETE

SEQ ID NO: 2903534 - protein, 5 aa, Entamoeba invadens
SCKPL

SEQ ID NO: 2903535 - protein, 9 aa, Entamoeba invadens
SCKPMSSKK

SEQ ID NO: 2903536 - protein, 14 aa, Entamoeba invadens
SCKPTFKPSQSGKC

SEQ ID NO: 2903537 - protein, 14 aa, Entamoeba invadens
SCNDGKTKKAPNYE

SEQ ID NO: 2903538 - protein, 4 aa, Entamoeba invadens
SCNE

SEQ ID NO: 2903539 - protein, 4 aa, Entamoeba invadens
SCNG

SEQ ID NO: 2903540 - protein, 11 aa, Entamoeba invadens
SCNGQCNTSNG

SEQ ID NO: 2903541 - protein, 12 aa, Entamoeba invadens
SCNGQCNTSTGV

SEQ ID NO: 2903542 - protein, 9 aa, Entamoeba invadens
SCNNCSNKY

SEQ ID NO: 2903543 - protein, 8 aa, Entamoeba invadens
SCNSRENK

SEQ ID NO: 2903544 - protein, 13 aa, Entamoeba invadens
SCPPKRLENTSTS

SEQ ID NO: 2903545 - protein, 8 aa, Entamoeba invadens
SCPPSSTV

SEQ ID NO: 2903546 - protein, 6 aa, Entamoeba invadens
SCPYSL

SEQ ID NO: 2903547 - protein, 4 aa, Entamoeba invadens
SCQS

SEQ ID NO: 2903548 - protein, 5 aa, Entamoeba invadens
SCRDG

SEQ ID NO: 2903549 - protein, 7 aa, Entamoeba invadens
SCRTCNG

SEQ ID NO: 2903550 - protein, 5 aa, Entamoeba invadens
SCSDT

SEQ ID NO: 2903551 - protein, 7 aa, Entamoeba invadens
SCSGSGI

SEQ ID NO: 2903552 - protein, 19 aa, Entamoeba invadens
SCSNPPAIKDTASNDGTHK

SEQ ID NO: 2903553 - protein, 6 aa, Entamoeba invadens
SCSNVS

SEQ ID NO: 2903554 - protein, 7 aa, Entamoeba invadens
SCSPDEA

SEQ ID NO: 2903555 - protein, 5 aa, Entamoeba invadens
SCSPE

SEQ ID NO: 2903556 - protein, 8 aa, Entamoeba invadens
SCSSDITT

SEQ ID NO: 2903557 - protein, 9 aa, Entamoeba invadens
SCSSDNKKC

SEQ ID NO: 2903558 - protein, 9 aa, Entamoeba invadens
SCSSDSEKC

SEQ ID NO: 2903559 - protein, 9 aa, Entamoeba invadens
SCSSDSKKC

SEQ ID NO: 2903560 - protein, 6 aa, Entamoeba invadens
SCSSKQ

SEQ ID NO: 2903561 - protein, 5 aa, Entamoeba invadens
SCSST

SEQ ID NO: 2903562 - protein, 9 aa, Entamoeba invadens
SCSSTTGKC

SEQ ID NO: 2903563 - protein, 5 aa, Entamoeba invadens
SCSYT

SEQ ID NO: 2903564 - protein, 12 aa, Entamoeba invadens
SCTDYRPDDHSK

SEQ ID NO: 2903565 - protein, 12 aa, Entamoeba invadens
SCTDYRPSDYSK

SEQ ID NO: 2903566 - protein, 7 aa, Entamoeba invadens
SCTKPPF

SEQ ID NO: 2903567 - protein, 5 aa, Entamoeba invadens
SCTND

SEQ ID NO: 2903568 - protein, 7 aa, Entamoeba invadens
SCTNEQL

SEQ ID NO: 2903569 - protein, 6 aa, Entamoeba invadens
SCTNET

SEQ ID NO: 2903570 - protein, 6 aa, Entamoeba invadens
SCTNSA

SEQ ID NO: 2903571 - protein, 6 aa, Entamoeba invadens
SCTSQT

SEQ ID NO: 2903572 - protein, 11 aa, Entamoeba invadens
SCTTSCDGSTG

SEQ ID NO: 2903573 - protein, 7 aa, Entamoeba invadens
SCTTTQS

SEQ ID NO: 2903574 - protein, 8 aa, Entamoeba invadens
SCVESDTK

SEQ ID NO: 2903575 - protein, 14 aa, Entamoeba invadens
SCVKTSQNNNSTNC

SEQ ID NO: 2903576 - protein, 4 aa, Entamoeba invadens
SCVN

SEQ ID NO: 2903577 - protein, 5 aa, Entamoeba invadens
SCVSQ

SEQ ID NO: 2903578 - protein, 5 aa, Entamoeba invadens
SCVST

SEQ ID NO: 2903579 - protein, 12 aa, Entamoeba invadens
SCVTGERKCTKC

SEQ ID NO: 2903580 - protein, 22 aa, Entamoeba invadens
SCVTGERKCTKCSTPNMYPDDT

SEQ ID NO: 2903581 - protein, 6 aa, Entamoeba invadens
SCYSTK

SEQ ID NO: 2903582 - protein, 7 aa, Entamoeba invadens
SDADVEP

SEQ ID NO: 2903583 - protein, 4 aa, Entamoeba invadens
SDAE

SEQ ID NO: 2903584 - protein, 11 aa, Entamoeba invadens
SDAEESGKREV

SEQ ID NO: 2903585 - protein, 5 aa, Entamoeba invadens
SDAEN

SEQ ID NO: 2903586 - protein, 18 aa, Entamoeba invadens
SDAFTTKEPFADLNKGSL

SEQ ID NO: 2903587 - protein, 4 aa, Entamoeba invadens
SDAG

SEQ ID NO: 2903588 - protein, 6 aa, Entamoeba invadens
SDAHRH

SEQ ID NO: 2903589 - protein, 6 aa, Entamoeba invadens
SDAIDI

SEQ ID NO: 2903590 - protein, 17 aa, Entamoeba invadens
SDAIDKTTPVVENRSEK

SEQ ID NO: 2903591 - protein, 15 aa, Entamoeba invadens
SDAIRKKDTFSANFG

SEQ ID NO: 2903592 - protein, 5 aa, Entamoeba invadens
SDAKE

SEQ ID NO: 2903593 - protein, 13 aa, Entamoeba invadens
SDAKEHKGVFSDN

SEQ ID NO: 2903594 - protein, 12 aa, Entamoeba invadens
SDAKTKQETINQ

SEQ ID NO: 2903595 - protein, 13 aa, Entamoeba invadens
SDAKTKQETINQL

SEQ ID NO: 2903596 - protein, 8 aa, Entamoeba invadens
SDALQTDS

SEQ ID NO: 2903597 - protein, 7 aa, Entamoeba invadens
SDAMQTP

SEQ ID NO: 2903598 - protein, 12 aa, Entamoeba invadens
SDANKDEEIAGT

SEQ ID NO: 2903599 - protein, 11 aa, Entamoeba invadens
SDANQFVTSTN

SEQ ID NO: 2903600 - protein, 9 aa, Entamoeba invadens
SDANTKKQL

SEQ ID NO: 2903601 - protein, 6 aa, Entamoeba invadens
SDAPLG

SEQ ID NO: 2903602 - protein, 13 aa, Entamoeba invadens
SDAQGRVSNRDIE

SEQ ID NO: 2903603 - protein, 6 aa, Entamoeba invadens
SDAQTL

SEQ ID NO: 2903604 - protein, 8 aa, Entamoeba invadens
SDARGRRE

SEQ ID NO: 2903605 - protein, 6 aa, Entamoeba invadens
SDARNR

SEQ ID NO: 2903606 - protein, 4 aa, Entamoeba invadens
SDAS

SEQ ID NO: 2903607 - protein, 14 aa, Entamoeba invadens
SDASAMKKEKLTPL

SEQ ID NO: 2903608 - protein, 7 aa, Entamoeba invadens
SDASPGM

SEQ ID NO: 2903609 - protein, 5 aa, Entamoeba invadens
SDATA

SEQ ID NO: 2903610 - protein, 5 aa, Entamoeba invadens
SDATI

SEQ ID NO: 2903611 - protein, 8 aa, Entamoeba invadens
SDATRDEW

SEQ ID NO: 2903612 - protein, 6 aa, Entamoeba invadens
SDATRN

SEQ ID NO: 2903613 - protein, 7 aa, Entamoeba invadens
SDATRSE

SEQ ID NO: 2903614 - protein, 4 aa, Entamoeba invadens
SDAV

SEQ ID NO: 2903615 - protein, 4 aa, Entamoeba invadens
SDAY

SEQ ID NO: 2903616 - protein, 9 aa, Entamoeba invadens
SDCEKKEMM

SEQ ID NO: 2903617 - protein, 4 aa, Entamoeba invadens
SDCF

SEQ ID NO: 2903618 - protein, 14 aa, Entamoeba invadens
SDCKRKTCCGTPDY

SEQ ID NO: 2903619 - protein, 7 aa, Entamoeba invadens
SDCQNQS

SEQ ID NO: 2903620 - protein, 4 aa, Entamoeba invadens
SDCT

SEQ ID NO: 2903621 - protein, 9 aa, Entamoeba invadens
SDCTSQPSM

SEQ ID NO: 2903622 - protein, 9 aa, Entamoeba invadens
SDCYNGSPM

SEQ ID NO: 2903623 - protein, 9 aa, Entamoeba invadens
SDDARNNLT

SEQ ID NO: 2903624 - protein, 5 aa, Entamoeba invadens
SDDDA

SEQ ID NO: 2903625 - protein, 18 aa, Entamoeba invadens
SDDDEPIKKGPQEDVGPS

SEQ ID NO: 2903626 - protein, 10 aa, Entamoeba invadens
SDDDGLSSYS

SEQ ID NO: 2903627 - protein, 8 aa, Entamoeba invadens
SDDDGNGF

SEQ ID NO: 2903628 - protein, 8 aa, Entamoeba invadens
SDDDMSEL

SEQ ID NO: 2903629 - protein, 8 aa, Entamoeba invadens
SDDDTRLG

SEQ ID NO: 2903630 - protein, 16 aa, Entamoeba invadens
SDDEEEKRDKKETFTQ

SEQ ID NO: 2903631 - protein, 16 aa, Entamoeba invadens
SDDEKPIPKRVVASMF

SEQ ID NO: 2903632 - protein, 11 aa, Entamoeba invadens
SDDEKSDSEDD

SEQ ID NO: 2903633 - protein, 7 aa, Entamoeba invadens
SDDEKYA

SEQ ID NO: 2903634 - protein, 7 aa, Entamoeba invadens
SDDETEF

SEQ ID NO: 2903635 - protein, 4 aa, Entamoeba invadens
SDDF

SEQ ID NO: 2903636 - protein, 5 aa, Entamoeba invadens
SDDFE

SEQ ID NO: 2903637 - protein, 25 aa, Entamoeba invadens
SDDFPSQNSDQMENKSSSNDSNENA

SEQ ID NO: 2903638 - protein, 7 aa, Entamoeba invadens
SDDGCRA

SEQ ID NO: 2903639 - protein, 9 aa, Entamoeba invadens
SDDGDMRVD

SEQ ID NO: 2903640 - protein, 6 aa, Entamoeba invadens
SDDGKL

SEQ ID NO: 2903641 - protein, 5 aa, Entamoeba invadens
SDDGN

SEQ ID NO: 2903642 - protein, 6 aa, Entamoeba invadens
SDDGNI

SEQ ID NO: 2903643 - protein, 7 aa, Entamoeba invadens
SDDGYDG

SEQ ID NO: 2903644 - protein, 21 aa, Entamoeba invadens
SDDHSLSKTSEKQIDDEIKKD

SEQ ID NO: 2903645 - protein, 4 aa, Entamoeba invadens
SDDI

SEQ ID NO: 2903646 - protein, 7 aa, Entamoeba invadens
SDDIDEW

SEQ ID NO: 2903647 - protein, 12 aa, Entamoeba invadens
SDDIEKQEEEIR

SEQ ID NO: 2903648 - protein, 15 aa, Entamoeba invadens
SDDINTDNPLGTGGK

SEQ ID NO: 2903649 - protein, 7 aa, Entamoeba invadens
SDDISHS

SEQ ID NO: 2903650 - protein, 10 aa, Entamoeba invadens
SDDKEEVKQN

SEQ ID NO: 2903651 - protein, 9 aa, Entamoeba invadens
SDDKEFDGF

SEQ ID NO: 2903652 - protein, 9 aa, Entamoeba invadens
SDDKGAVKI

SEQ ID NO: 2903653 - protein, 5 aa, Entamoeba invadens
SDDKS

SEQ ID NO: 2903654 - protein, 26 aa, Entamoeba invadens
SDDLEEDDETLYGGNVPHKAESQIEG

SEQ ID NO: 2903655 - protein, 15 aa, Entamoeba invadens
SDDNEATSNDRIGTF

SEQ ID NO: 2903656 - protein, 6 aa, Entamoeba invadens
SDDNEE

SEQ ID NO: 2903657 - protein, 8 aa, Entamoeba invadens
SDDNETDL

SEQ ID NO: 2903658 - protein, 11 aa, Entamoeba invadens
SDDNLARKRSH

SEQ ID NO: 2903659 - protein, 5 aa, Entamoeba invadens
SDDPD

SEQ ID NO: 2903660 - protein, 6 aa, Entamoeba invadens
SDDPEF

SEQ ID NO: 2903661 - protein, 5 aa, Entamoeba invadens
SDDPL

SEQ ID NO: 2903662 - protein, 9 aa, Entamoeba invadens
SDDPNVQNV

SEQ ID NO: 2903663 - protein, 8 aa, Entamoeba invadens
SDDPQSQA

SEQ ID NO: 2903664 - protein, 9 aa, Entamoeba invadens
SDDPSKKGE

SEQ ID NO: 2903665 - protein, 46 aa, Entamoeba invadens
SDDQTSGDENGCDDSGGSDSDTSSSSSGSSDSSTQSSSDSSLEEPQ

SEQ ID NO: 2903666 - protein, 15 aa, Entamoeba invadens
SDDRLGSKGGAPEIK

SEQ ID NO: 2903667 - protein, 11 aa, Entamoeba invadens
SDDRPERKKEE

SEQ ID NO: 2903668 - protein, 5 aa, Entamoeba invadens
SDDRT

SEQ ID NO: 2903669 - protein, 17 aa, Entamoeba invadens
SDDSANARLNPKCPGMS

SEQ ID NO: 2903670 - protein, 58 aa, Entamoeba invadens
SDDSENLLDTSNHTNSPTPSDSSDEEKPKNHKGKSTQKIDTKNKTESARVVAGDAKEI

SEQ ID NO: 2903671 - protein, 9 aa, Entamoeba invadens
SDDSKEGFV

SEQ ID NO: 2903672 - protein, 10 aa, Entamoeba invadens
SDDSLSSHDH

SEQ ID NO: 2903673 - protein, 17 aa, Entamoeba invadens
SDDSSNSKQNKDEFSTD

SEQ ID NO: 2903674 - protein, 8 aa, Entamoeba invadens
SDDTEQDL

SEQ ID NO: 2903675 - protein, 10 aa, Entamoeba invadens
SDDTPNTEKK

SEQ ID NO: 2903676 - protein, 16 aa, Entamoeba invadens
SDDTQHTENEKKEIED

SEQ ID NO: 2903677 - protein, 12 aa, Entamoeba invadens
SDDTTAKKEIEA

SEQ ID NO: 2903678 - protein, 4 aa, Entamoeba invadens
SDDV

SEQ ID NO: 2903679 - protein, 4 aa, Entamoeba invadens
SDDY

SEQ ID NO: 2903680 - protein, 32 aa, Entamoeba invadens
SDDYDDKYSNVEDEDDCDEIGDDLQKYIFTEC

SEQ ID NO: 2903681 - protein, 8 aa, Entamoeba invadens
SDDYVPAK

SEQ ID NO: 2903682 - protein, 11 aa, Entamoeba invadens
SDEAKEGGLEK

SEQ ID NO: 2903683 - protein, 12 aa, Entamoeba invadens
SDEAQRKEAETY

SEQ ID NO: 2903684 - protein, 9 aa, Entamoeba invadens
SDEATKKDQ

SEQ ID NO: 2903685 - protein, 9 aa, Entamoeba invadens
SDEAVDRAV

SEQ ID NO: 2903686 - protein, 8 aa, Entamoeba invadens
SDEAVNRA

SEQ ID NO: 2903687 - protein, 6 aa, Entamoeba invadens
SDECQS

SEQ ID NO: 2903688 - protein, 5 aa, Entamoeba invadens
SDEDD

SEQ ID NO: 2903689 - protein, 7 aa, Entamoeba invadens
SDEDGNG

SEQ ID NO: 2903690 - protein, 19 aa, Entamoeba invadens
SDEDKNNETNHEEDSDTLI

SEQ ID NO: 2903691 - protein, 9 aa, Entamoeba invadens
SDEDLENAR

SEQ ID NO: 2903692 - protein, 11 aa, Entamoeba invadens
SDEDSLSAKNL

SEQ ID NO: 2903693 - protein, 10 aa, Entamoeba invadens
SDEEEASMNG

SEQ ID NO: 2903694 - protein, 15 aa, Entamoeba invadens
SDEEEDDEDEEQQQV

SEQ ID NO: 2903695 - protein, 9 aa, Entamoeba invadens
SDEEIRKVE

SEQ ID NO: 2903696 - protein, 10 aa, Entamoeba invadens
SDEEKSPQWD

SEQ ID NO: 2903697 - protein, 25 aa, Entamoeba invadens
SDEELSESSEDKCKIENSLPPSINT

SEQ ID NO: 2903698 - protein, 8 aa, Entamoeba invadens
SDEEMNER

SEQ ID NO: 2903699 - protein, 5 aa, Entamoeba invadens
SDEEQ

SEQ ID NO: 2903700 - protein, 5 aa, Entamoeba invadens
SDEEY

SEQ ID NO: 2903701 - protein, 17 aa, Entamoeba invadens
SDEEYNEALKKTDPSNV

SEQ ID NO: 2903702 - protein, 4 aa, Entamoeba invadens
SDEF

SEQ ID NO: 2903703 - protein, 6 aa, Entamoeba invadens
SDEFAQ

SEQ ID NO: 2903704 - protein, 14 aa, Entamoeba invadens
SDEFGETDDPVMDS

SEQ ID NO: 2903705 - protein, 5 aa, Entamoeba invadens
SDEFS

SEQ ID NO: 2903706 - protein, 6 aa, Entamoeba invadens
SDEGSF

SEQ ID NO: 2903707 - protein, 24 aa, Entamoeba invadens
SDEHETVQTKTSENDEGNETNERL

SEQ ID NO: 2903708 - protein, 7 aa, Entamoeba invadens
SDEIANQ

SEQ ID NO: 2903709 - protein, 13 aa, Entamoeba invadens
SDEIEDVETSSHV

SEQ ID NO: 2903710 - protein, 5 aa, Entamoeba invadens
SDEIT

SEQ ID NO: 2903711 - protein, 13 aa, Entamoeba invadens
SDEKKTQKAQSIE

SEQ ID NO: 2903712 - protein, 5 aa, Entamoeba invadens
SDEKS

SEQ ID NO: 2903713 - protein, 8 aa, Entamoeba invadens
SDEKTNRK

SEQ ID NO: 2903714 - protein, 9 aa, Entamoeba invadens
SDEKVNAKM

SEQ ID NO: 2903715 - protein, 8 aa, Entamoeba invadens
SDEKYIND

SEQ ID NO: 2903716 - protein, 8 aa, Entamoeba invadens
SDEMDKAT

SEQ ID NO: 2903717 - protein, 4 aa, Entamoeba invadens
SDEN

SEQ ID NO: 2903718 - protein, 6 aa, Entamoeba invadens
SDENFG

SEQ ID NO: 2903719 - protein, 6 aa, Entamoeba invadens
SDENGS

SEQ ID NO: 2903720 - protein, 8 aa, Entamoeba invadens
SDENKVRE

SEQ ID NO: 2903721 - protein, 9 aa, Entamoeba invadens
SDENMKPRN

SEQ ID NO: 2903722 - protein, 6 aa, Entamoeba invadens
SDENQS

SEQ ID NO: 2903723 - protein, 7 aa, Entamoeba invadens
SDENRLK

SEQ ID NO: 2903724 - protein, 6 aa, Entamoeba invadens
SDEPFN

SEQ ID NO: 2903725 - protein, 9 aa, Entamoeba invadens
SDEPPTQVD

SEQ ID NO: 2903726 - protein, 8 aa, Entamoeba invadens
SDEPTTDL

SEQ ID NO: 2903727 - protein, 6 aa, Entamoeba invadens
SDEQCK

SEQ ID NO: 2903728 - protein, 5 aa, Entamoeba invadens
SDEQT

SEQ ID NO: 2903729 - protein, 4 aa, Entamoeba invadens
SDER

SEQ ID NO: 2903730 - protein, 5 aa, Entamoeba invadens
SDERI

SEQ ID NO: 2903731 - protein, 38 aa, Entamoeba invadens
SDESEKINSQKKLLEKKEKKTAKVETTTCKTTPKQIEK

SEQ ID NO: 2903732 - protein, 9 aa, Entamoeba invadens
SDESGQNGF

SEQ ID NO: 2903733 - protein, 8 aa, Entamoeba invadens
SDESNSRY

SEQ ID NO: 2903734 - protein, 27 aa, Entamoeba invadens
SDESSQINATQCSSTSGYQPQRRTPMY

SEQ ID NO: 2903735 - protein, 8 aa, Entamoeba invadens
SDESTTTL

SEQ ID NO: 2903736 - protein, 5 aa, Entamoeba invadens
SDETL

SEQ ID NO: 2903737 - protein, 5 aa, Entamoeba invadens
SDETT

SEQ ID NO: 2903738 - protein, 15 aa, Entamoeba invadens
SDETYIQKGTDEIRQ

SEQ ID NO: 2903739 - protein, 23 aa, Entamoeba invadens
SDEVEGKEKRVTGAGFKRPNGGF

SEQ ID NO: 2903740 - protein, 9 aa, Entamoeba invadens
SDEVQDALD

SEQ ID NO: 2903741 - protein, 9 aa, Entamoeba invadens
SDEWEKQRK

SEQ ID NO: 2903742 - protein, 7 aa, Entamoeba invadens
SDEYDAT

SEQ ID NO: 2903743 - protein, 6 aa, Entamoeba invadens
SDEYSC

SEQ ID NO: 2903744 - protein, 7 aa, Entamoeba invadens
SDEYSTS

SEQ ID NO: 2903745 - protein, 6 aa, Entamoeba invadens
SDFAEK

SEQ ID NO: 2903746 - protein, 6 aa, Entamoeba invadens
SDFDGT

SEQ ID NO: 2903747 - protein, 12 aa, Entamoeba invadens
SDFDKYGSNIPN

SEQ ID NO: 2903748 - protein, 14 aa, Entamoeba invadens
SDFDKYGSNIPNNE

SEQ ID NO: 2903749 - protein, 8 aa, Entamoeba invadens
SDFEEERK

SEQ ID NO: 2903750 - protein, 11 aa, Entamoeba invadens
SDFKDQGENTV

SEQ ID NO: 2903751 - protein, 6 aa, Entamoeba invadens
SDFNAT

SEQ ID NO: 2903752 - protein, 12 aa, Entamoeba invadens
SDFNSPSGKECV

SEQ ID NO: 2903753 - protein, 5 aa, Entamoeba invadens
SDFSD

SEQ ID NO: 2903754 - protein, 6 aa, Entamoeba invadens
SDFSDG

SEQ ID NO: 2903755 - protein, 28 aa, Entamoeba invadens
SDFSDSEEKSNNETDSLDSENSEEEELG

SEQ ID NO: 2903756 - protein, 5 aa, Entamoeba invadens
SDGCA

SEQ ID NO: 2903757 - protein, 8 aa, Entamoeba invadens
SDGDAEVS

SEQ ID NO: 2903758 - protein, 7 aa, Entamoeba invadens
SDGDGIE

SEQ ID NO: 2903759 - protein, 16 aa, Entamoeba invadens
SDGEGYSHGYNTTKEV

SEQ ID NO: 2903760 - protein, 5 aa, Entamoeba invadens
SDGEP

SEQ ID NO: 2903761 - protein, 7 aa, Entamoeba invadens
SDGETSV

SEQ ID NO: 2903762 - protein, 7 aa, Entamoeba invadens
SDGFHDN

SEQ ID NO: 2903763 - protein, 5 aa, Entamoeba invadens
SDGFI

SEQ ID NO: 2903764 - protein, 10 aa, Entamoeba invadens
SDGGDEWSHD

SEQ ID NO: 2903765 - protein, 6 aa, Entamoeba invadens
SDGIAS

SEQ ID NO: 2903766 - protein, 14 aa, Entamoeba invadens
SDGIASWSGLNGSV

SEQ ID NO: 2903767 - protein, 4 aa, Entamoeba invadens
SDGK

SEQ ID NO: 2903768 - protein, 13 aa, Entamoeba invadens
SDGKDEKKSQQKI

SEQ ID NO: 2903769 - protein, 8 aa, Entamoeba invadens
SDGKTSIQ

SEQ ID NO: 2903770 - protein, 8 aa, Entamoeba invadens
SDGKTSLQ

SEQ ID NO: 2903771 - protein, 6 aa, Entamoeba invadens
SDGLNG

SEQ ID NO: 2903772 - protein, 4 aa, Entamoeba invadens
SDGM

SEQ ID NO: 2903773 - protein, 8 aa, Entamoeba invadens
SDGNNTTY

SEQ ID NO: 2903774 - protein, 9 aa, Entamoeba invadens
SDGNRFEGT

SEQ ID NO: 2903775 - protein, 5 aa, Entamoeba invadens
SDGNS

SEQ ID NO: 2903776 - protein, 15 aa, Entamoeba invadens
SDGQYSLNTKETSEY

SEQ ID NO: 2903777 - protein, 7 aa, Entamoeba invadens
SDGRSVS

SEQ ID NO: 2903778 - protein, 7 aa, Entamoeba invadens
SDGSGGV

SEQ ID NO: 2903779 - protein, 5 aa, Entamoeba invadens
SDGSL

SEQ ID NO: 2903780 - protein, 8 aa, Entamoeba invadens
SDGSNAFS

SEQ ID NO: 2903781 - protein, 22 aa, Entamoeba invadens
SDGSSDNIVSSPITRVPSAPFQ

SEQ ID NO: 2903782 - protein, 7 aa, Entamoeba invadens
SDGSVKI

SEQ ID NO: 2903783 - protein, 6 aa, Entamoeba invadens
SDGSVS

SEQ ID NO: 2903784 - protein, 10 aa, Entamoeba invadens
SDGSYEMGAE

SEQ ID NO: 2903785 - protein, 4 aa, Entamoeba invadens
SDGT

SEQ ID NO: 2903786 - protein, 10 aa, Entamoeba invadens
SDGTCNLGKT

SEQ ID NO: 2903787 - protein, 12 aa, Entamoeba invadens
SDGTKLASASLD

SEQ ID NO: 2903788 - protein, 8 aa, Entamoeba invadens
SDGTYEKD

SEQ ID NO: 2903789 - protein, 9 aa, Entamoeba invadens
SDHEEEENV

SEQ ID NO: 2903790 - protein, 6 aa, Entamoeba invadens
SDHSGF

SEQ ID NO: 2903791 - protein, 12 aa, Entamoeba invadens
SDHTTKKVRNGV

SEQ ID NO: 2903792 - protein, 21 aa, Entamoeba invadens
SDHYYSEADELREEEREKRIR

SEQ ID NO: 2903793 - protein, 4 aa, Entamoeba invadens
SDID

SEQ ID NO: 2903794 - protein, 5 aa, Entamoeba invadens
SDIDK

SEQ ID NO: 2903795 - protein, 8 aa, Entamoeba invadens
SDIDPSTI

SEQ ID NO: 2903796 - protein, 19 aa, Entamoeba invadens
SDIEKGKRQRKTGFPWKED

SEQ ID NO: 2903797 - protein, 23 aa, Entamoeba invadens
SDIETSAHEHSADYSLKSALEDK

SEQ ID NO: 2903798 - protein, 5 aa, Entamoeba invadens
SDIGG

SEQ ID NO: 2903799 - protein, 10 aa, Entamoeba invadens
SDIGQVNTTK

SEQ ID NO: 2903800 - protein, 9 aa, Entamoeba invadens
SDIGSKRRH

SEQ ID NO: 2903801 - protein, 15 aa, Entamoeba invadens
SDIGVEEDLDHESTI

SEQ ID NO: 2903802 - protein, 14 aa, Entamoeba invadens
SDIKSDNETTRKRV

SEQ ID NO: 2903803 - protein, 4 aa, Entamoeba invadens
SDIP

SEQ ID NO: 2903804 - protein, 11 aa, Entamoeba invadens
SDIPANAPQVA

SEQ ID NO: 2903805 - protein, 31 aa, Entamoeba invadens
SDIPDDIVDPEKVPPIPKSIATDPDVDAPKA

SEQ ID NO: 2903806 - protein, 6 aa, Entamoeba invadens
SDIPEI

SEQ ID NO: 2903807 - protein, 6 aa, Entamoeba invadens
SDIPND

SEQ ID NO: 2903808 - protein, 5 aa, Entamoeba invadens
SDIQQ

SEQ ID NO: 2903809 - protein, 6 aa, Entamoeba invadens
SDIQSD

SEQ ID NO: 2903810 - protein, 8 aa, Entamoeba invadens
SDISPVED

SEQ ID NO: 2903811 - protein, 8 aa, Entamoeba invadens
SDISTTEH

SEQ ID NO: 2903812 - protein, 6 aa, Entamoeba invadens
SDISTV

SEQ ID NO: 2903813 - protein, 6 aa, Entamoeba invadens
SDITNC

SEQ ID NO: 2903814 - protein, 9 aa, Entamoeba invadens
SDITNTKTL

SEQ ID NO: 2903815 - protein, 6 aa, Entamoeba invadens
SDKAIT

SEQ ID NO: 2903816 - protein, 6 aa, Entamoeba invadens
SDKAKE

SEQ ID NO: 2903817 - protein, 6 aa, Entamoeba invadens
SDKANW

SEQ ID NO: 2903818 - protein, 13 aa, Entamoeba invadens
SDKCSDQSQDNSL

SEQ ID NO: 2903819 - protein, 9 aa, Entamoeba invadens
SDKDECVPE

SEQ ID NO: 2903820 - protein, 22 aa, Entamoeba invadens
SDKDGRLHNSLRTSDTLREPTG

SEQ ID NO: 2903821 - protein, 9 aa, Entamoeba invadens
SDKDLNGTN

SEQ ID NO: 2903822 - protein, 7 aa, Entamoeba invadens
SDKDPYT

SEQ ID NO: 2903823 - protein, 11 aa, Entamoeba invadens
SDKEDTDNIKQ

SEQ ID NO: 2903824 - protein, 11 aa, Entamoeba invadens
SDKEDWSKNSS

SEQ ID NO: 2903825 - protein, 9 aa, Entamoeba invadens
SDKEKDPSF

SEQ ID NO: 2903826 - protein, 9 aa, Entamoeba invadens
SDKEKGGIF

SEQ ID NO: 2903827 - protein, 8 aa, Entamoeba invadens
SDKERKEE

SEQ ID NO: 2903828 - protein, 6 aa, Entamoeba invadens
SDKERR

SEQ ID NO: 2903829 - protein, 15 aa, Entamoeba invadens
SDKESYELSQRTEPK

SEQ ID NO: 2903830 - protein, 6 aa, Entamoeba invadens
SDKEVA

SEQ ID NO: 2903831 - protein, 4 aa, Entamoeba invadens
SDKF

SEQ ID NO: 2903832 - protein, 8 aa, Entamoeba invadens
SDKFGSRY

SEQ ID NO: 2903833 - protein, 10 aa, Entamoeba invadens
SDKGKENDKI

SEQ ID NO: 2903834 - protein, 20 aa, Entamoeba invadens
SDKHLGKQDETTVSNSHKNS

SEQ ID NO: 2903835 - protein, 70 aa, Entamoeba invadens
SDKIEEKDLKPQSENHNDVDKANTSLENSASSTVKDSNEKVESQEEKTDENVKEKKEEKSAEVNASKETL

SEQ ID NO: 2903836 - protein, 6 aa, Entamoeba invadens
SDKIPT

SEQ ID NO: 2903837 - protein, 4 aa, Entamoeba invadens
SDKK

SEQ ID NO: 2903838 - protein, 9 aa, Entamoeba invadens
SDKKDKVGE

SEQ ID NO: 2903839 - protein, 13 aa, Entamoeba invadens
SDKKGPKKEIKTQ

SEQ ID NO: 2903840 - protein, 7 aa, Entamoeba invadens
SDKKIPG

SEQ ID NO: 2903841 - protein, 15 aa, Entamoeba invadens
SDKKNKSVVKPSEKM

SEQ ID NO: 2903842 - protein, 11 aa, Entamoeba invadens
SDKKPDTPLTN

SEQ ID NO: 2903843 - protein, 9 aa, Entamoeba invadens
SDKKQMREA

SEQ ID NO: 2903844 - protein, 8 aa, Entamoeba invadens
SDKKRENL

SEQ ID NO: 2903845 - protein, 9 aa, Entamoeba invadens
SDKKSEFKA

SEQ ID NO: 2903846 - protein, 5 aa, Entamoeba invadens
SDKKY

SEQ ID NO: 2903847 - protein, 9 aa, Entamoeba invadens
SDKLPTVES

SEQ ID NO: 2903848 - protein, 10 aa, Entamoeba invadens
SDKLQSEYTT

SEQ ID NO: 2903849 - protein, 13 aa, Entamoeba invadens
SDKLTKDAQNALR

SEQ ID NO: 2903850 - protein, 6 aa, Entamoeba invadens
SDKMGQ

SEQ ID NO: 2903851 - protein, 23 aa, Entamoeba invadens
SDKNEEEVQKRPLQNDTITPVTT

SEQ ID NO: 2903852 - protein, 8 aa, Entamoeba invadens
SDKNLGKQ

SEQ ID NO: 2903853 - protein, 9 aa, Entamoeba invadens
SDKNNSAQL

SEQ ID NO: 2903854 - protein, 7 aa, Entamoeba invadens
SDKNVTH

SEQ ID NO: 2903855 - protein, 14 aa, Entamoeba invadens
SDKPRVVSAEEGRL

SEQ ID NO: 2903856 - protein, 6 aa, Entamoeba invadens
SDKQFG

SEQ ID NO: 2903857 - protein, 9 aa, Entamoeba invadens
SDKQQVDSH

SEQ ID NO: 2903858 - protein, 15 aa, Entamoeba invadens
SDKRGDEMKEQINDE

SEQ ID NO: 2903859 - protein, 8 aa, Entamoeba invadens
SDKRITKE

SEQ ID NO: 2903860 - protein, 10 aa, Entamoeba invadens
SDKRNSQVSE

SEQ ID NO: 2903861 - protein, 4 aa, Entamoeba invadens
SDKS

SEQ ID NO: 2903862 - protein, 11 aa, Entamoeba invadens
SDKSLKTPSKI

SEQ ID NO: 2903863 - protein, 6 aa, Entamoeba invadens
SDKSSI

SEQ ID NO: 2903864 - protein, 12 aa, Entamoeba invadens
SDKSVSPTGYES

SEQ ID NO: 2903865 - protein, 4 aa, Entamoeba invadens
SDKT

SEQ ID NO: 2903866 - protein, 10 aa, Entamoeba invadens
SDKTKTSKNI

SEQ ID NO: 2903867 - protein, 8 aa, Entamoeba invadens
SDKTPEDM

SEQ ID NO: 2903868 - protein, 19 aa, Entamoeba invadens
SDKTRSTADQVEQDTEEAR

SEQ ID NO: 2903869 - protein, 19 aa, Entamoeba invadens
SDKTSGKNSSNGEKGDVEE

SEQ ID NO: 2903870 - protein, 18 aa, Entamoeba invadens
SDKTSTPHTSYPEIDNSE

SEQ ID NO: 2903871 - protein, 5 aa, Entamoeba invadens
SDKTT

SEQ ID NO: 2903872 - protein, 8 aa, Entamoeba invadens
SDKVESPL

SEQ ID NO: 2903873 - protein, 9 aa, Entamoeba invadens
SDKVQREVD

SEQ ID NO: 2903874 - protein, 4 aa, Entamoeba invadens
SDKW

SEQ ID NO: 2903875 - protein, 14 aa, Entamoeba invadens
SDKYKTLPKTSFTE

SEQ ID NO: 2903876 - protein, 7 aa, Entamoeba invadens
SDKYPEK

SEQ ID NO: 2903877 - protein, 8 aa, Entamoeba invadens
SDKYSNVK

SEQ ID NO: 2903878 - protein, 6 aa, Entamoeba invadens
SDKYTD

SEQ ID NO: 2903879 - protein, 6 aa, Entamoeba invadens
SDKYVP

SEQ ID NO: 2903880 - protein, 4 aa, Entamoeba invadens
SDLA

SEQ ID NO: 2903881 - protein, 11 aa, Entamoeba invadens
SDLEDGTTHEQ

SEQ ID NO: 2903882 - protein, 34 aa, Entamoeba invadens
SDLEDVEKELEETKTELVSKDNELKKALSSNDEL

SEQ ID NO: 2903883 - protein, 19 aa, Entamoeba invadens
SDLEEQRQITSEEGESFAN

SEQ ID NO: 2903884 - protein, 50 aa, Entamoeba invadens
SDLEGDGDEAVEEDNYTEFRNEPQDKTEHLKTSDNSINTSKNTSTQGIKE

SEQ ID NO: 2903885 - protein, 5 aa, Entamoeba invadens
SDLEI

SEQ ID NO: 2903886 - protein, 7 aa, Entamoeba invadens
SDLENER

SEQ ID NO: 2903887 - protein, 7 aa, Entamoeba invadens
SDLEREI

SEQ ID NO: 2903888 - protein, 18 aa, Entamoeba invadens
SDLESESEESGENPEIAE

SEQ ID NO: 2903889 - protein, 6 aa, Entamoeba invadens
SDLETR

SEQ ID NO: 2903890 - protein, 4 aa, Entamoeba invadens
SDLH

SEQ ID NO: 2903891 - protein, 12 aa, Entamoeba invadens
SDLIGTSTRVPK

SEQ ID NO: 2903892 - protein, 4 aa, Entamoeba invadens
SDLK

SEQ ID NO: 2903893 - protein, 12 aa, Entamoeba invadens
SDLKRNNDTRAI

SEQ ID NO: 2903894 - protein, 12 aa, Entamoeba invadens
SDLKTRNAIGET

SEQ ID NO: 2903895 - protein, 4 aa, Entamoeba invadens
SDLL

SEQ ID NO: 2903896 - protein, 6 aa, Entamoeba invadens
SDLLDE

SEQ ID NO: 2903897 - protein, 14 aa, Entamoeba invadens
SDLLNEKELTNVEN

SEQ ID NO: 2903898 - protein, 5 aa, Entamoeba invadens
SDLNK

SEQ ID NO: 2903899 - protein, 8 aa, Entamoeba invadens
SDLNSETI

SEQ ID NO: 2903900 - protein, 5 aa, Entamoeba invadens
SDLPA

SEQ ID NO: 2903901 - protein, 21 aa, Entamoeba invadens
SDLPAEEEPSTATAQNPPPTA

SEQ ID NO: 2903902 - protein, 16 aa, Entamoeba invadens
SDLPFPQHSNNSVDHP

SEQ ID NO: 2903903 - protein, 18 aa, Entamoeba invadens
SDLPGSDDGSSATEGSLE

SEQ ID NO: 2903904 - protein, 10 aa, Entamoeba invadens
SDLPKIQEQL

SEQ ID NO: 2903905 - protein, 8 aa, Entamoeba invadens
SDLPKKMT

SEQ ID NO: 2903906 - protein, 8 aa, Entamoeba invadens
SDLQQSYE

SEQ ID NO: 2903907 - protein, 7 aa, Entamoeba invadens
SDLRGER

SEQ ID NO: 2903908 - protein, 8 aa, Entamoeba invadens
SDLRGGKV

SEQ ID NO: 2903909 - protein, 15 aa, Entamoeba invadens
SDLRNQTYSVPPPSV

SEQ ID NO: 2903910 - protein, 9 aa, Entamoeba invadens
SDLSEREID

SEQ ID NO: 2903911 - protein, 10 aa, Entamoeba invadens
SDLSTEESRM

SEQ ID NO: 2903912 - protein, 4 aa, Entamoeba invadens
SDLT

SEQ ID NO: 2903913 - protein, 11 aa, Entamoeba invadens
SDLTHEVTTEE

SEQ ID NO: 2903914 - protein, 9 aa, Entamoeba invadens
SDLTLDDKS

SEQ ID NO: 2903915 - protein, 5 aa, Entamoeba invadens
SDLTR

SEQ ID NO: 2903916 - protein, 6 aa, Entamoeba invadens
SDLTRN

SEQ ID NO: 2903917 - protein, 6 aa, Entamoeba invadens
SDMATT

SEQ ID NO: 2903918 - protein, 5 aa, Entamoeba invadens
SDMMN

SEQ ID NO: 2903919 - protein, 5 aa, Entamoeba invadens
SDMNG

SEQ ID NO: 2903920 - protein, 11 aa, Entamoeba invadens
SDMQSNFNNRV

SEQ ID NO: 2903921 - protein, 59 aa, Entamoeba invadens
SDMRETIKKKREDYEKDKSAKEELEKKIKEAEEYSNGAETKLKTMKSEKEKAEMEKERI

SEQ ID NO: 2903922 - protein, 12 aa, Entamoeba invadens
SDMSSKHPTAEI

SEQ ID NO: 2903923 - protein, 10 aa, Entamoeba invadens
SDMTDERRET

SEQ ID NO: 2903924 - protein, 12 aa, Entamoeba invadens
SDNCSGNTNSEP

SEQ ID NO: 2903925 - protein, 9 aa, Entamoeba invadens
SDNDNKMTK

SEQ ID NO: 2903926 - protein, 8 aa, Entamoeba invadens
SDNDSERR

SEQ ID NO: 2903927 - protein, 4 aa, Entamoeba invadens
SDNE

SEQ ID NO: 2903928 - protein, 8 aa, Entamoeba invadens
SDNEEATE

SEQ ID NO: 2903929 - protein, 11 aa, Entamoeba invadens
SDNERVEESRD

SEQ ID NO: 2903930 - protein, 6 aa, Entamoeba invadens
SDNESG

SEQ ID NO: 2903931 - protein, 6 aa, Entamoeba invadens
SDNEVL

SEQ ID NO: 2903932 - protein, 11 aa, Entamoeba invadens
SDNFQRDTNMD

SEQ ID NO: 2903933 - protein, 7 aa, Entamoeba invadens
SDNGAMK

SEQ ID NO: 2903934 - protein, 8 aa, Entamoeba invadens
SDNGGSGD

SEQ ID NO: 2903935 - protein, 6 aa, Entamoeba invadens
SDNHIP

SEQ ID NO: 2903936 - protein, 7 aa, Entamoeba invadens
SDNIKTV

SEQ ID NO: 2903937 - protein, 5 aa, Entamoeba invadens
SDNKH

SEQ ID NO: 2903938 - protein, 9 aa, Entamoeba invadens
SDNKPTSTF

SEQ ID NO: 2903939 - protein, 14 aa, Entamoeba invadens
SDNKTLMSDDTQLG

SEQ ID NO: 2903940 - protein, 14 aa, Entamoeba invadens
SDNLPTSPRLASRG

SEQ ID NO: 2903941 - protein, 4 aa, Entamoeba invadens
SDNM

SEQ ID NO: 2903942 - protein, 4 aa, Entamoeba invadens
SDNN

SEQ ID NO: 2903943 - protein, 7 aa, Entamoeba invadens
SDNNSNL

SEQ ID NO: 2903944 - protein, 5 aa, Entamoeba invadens
SDNNV

SEQ ID NO: 2903945 - protein, 6 aa, Entamoeba invadens
SDNNVF

SEQ ID NO: 2903946 - protein, 4 aa, Entamoeba invadens
SDNP

SEQ ID NO: 2903947 - protein, 10 aa, Entamoeba invadens
SDNPETVEYT

SEQ ID NO: 2903948 - protein, 5 aa, Entamoeba invadens
SDNPF

SEQ ID NO: 2903949 - protein, 7 aa, Entamoeba invadens
SDNPKAT

SEQ ID NO: 2903950 - protein, 9 aa, Entamoeba invadens
SDNPPTGEL

SEQ ID NO: 2903951 - protein, 8 aa, Entamoeba invadens
SDNPQTSY

SEQ ID NO: 2903952 - protein, 12 aa, Entamoeba invadens
SDNQPSSKTSGI

SEQ ID NO: 2903953 - protein, 5 aa, Entamoeba invadens
SDNQR

SEQ ID NO: 2903954 - protein, 8 aa, Entamoeba invadens
SDNSGVIE

SEQ ID NO: 2903955 - protein, 10 aa, Entamoeba invadens
SDNSKPLPTV

SEQ ID NO: 2903956 - protein, 9 aa, Entamoeba invadens
SDNSKTRVN

SEQ ID NO: 2903957 - protein, 10 aa, Entamoeba invadens
SDNSYNKCSS

SEQ ID NO: 2903958 - protein, 8 aa, Entamoeba invadens
SDNTERNV

SEQ ID NO: 2903959 - protein, 6 aa, Entamoeba invadens
SDNTLE

SEQ ID NO: 2903960 - protein, 9 aa, Entamoeba invadens
SDNVNIKNA

SEQ ID NO: 2903961 - protein, 10 aa, Entamoeba invadens
SDNYTTKEPF

SEQ ID NO: 2903962 - protein, 8 aa, Entamoeba invadens
SDPAEKNF

SEQ ID NO: 2903963 - protein, 8 aa, Entamoeba invadens
SDPAGSVA

SEQ ID NO: 2903964 - protein, 9 aa, Entamoeba invadens
SDPDDSLRR

SEQ ID NO: 2903965 - protein, 12 aa, Entamoeba invadens
SDPDESAPKDRD

SEQ ID NO: 2903966 - protein, 12 aa, Entamoeba invadens
SDPDFDSKEYSK

SEQ ID NO: 2903967 - protein, 9 aa, Entamoeba invadens
SDPDTTNDL

SEQ ID NO: 2903968 - protein, 33 aa, Entamoeba invadens
SDPEIQSEAETERKKRDKEKNSQQRNKDKSVQS

SEQ ID NO: 2903969 - protein, 5 aa, Entamoeba invadens
SDPFL

SEQ ID NO: 2903970 - protein, 15 aa, Entamoeba invadens
SDPFPNSPQEPPQGS

SEQ ID NO: 2903971 - protein, 10 aa, Entamoeba invadens
SDPHISEFPN

SEQ ID NO: 2903972 - protein, 5 aa, Entamoeba invadens
SDPIA

SEQ ID NO: 2903973 - protein, 5 aa, Entamoeba invadens
SDPIK

SEQ ID NO: 2903974 - protein, 7 aa, Entamoeba invadens
SDPKKYA

SEQ ID NO: 2903975 - protein, 7 aa, Entamoeba invadens
SDPKLEG

SEQ ID NO: 2903976 - protein, 13 aa, Entamoeba invadens
SDPKNQKNENAVK

SEQ ID NO: 2903977 - protein, 9 aa, Entamoeba invadens
SDPKSDRGV

SEQ ID NO: 2903978 - protein, 18 aa, Entamoeba invadens
SDPKYTAKKRENKSFEAY

SEQ ID NO: 2903979 - protein, 4 aa, Entamoeba invadens
SDPL

SEQ ID NO: 2903980 - protein, 6 aa, Entamoeba invadens
SDPLAT

SEQ ID NO: 2903981 - protein, 6 aa, Entamoeba invadens
SDPLPL

SEQ ID NO: 2903982 - protein, 7 aa, Entamoeba invadens
SDPLPTK

SEQ ID NO: 2903983 - protein, 5 aa, Entamoeba invadens
SDPMP

SEQ ID NO: 2903984 - protein, 6 aa, Entamoeba invadens
SDPNFN

SEQ ID NO: 2903985 - protein, 7 aa, Entamoeba invadens
SDPNLYE

SEQ ID NO: 2903986 - protein, 5 aa, Entamoeba invadens
SDPNM

SEQ ID NO: 2903987 - protein, 8 aa, Entamoeba invadens
SDPNNHPA

SEQ ID NO: 2903988 - protein, 6 aa, Entamoeba invadens
SDPNTS

SEQ ID NO: 2903989 - protein, 17 aa, Entamoeba invadens
SDPPDDEIKKQKKAYKV

SEQ ID NO: 2903990 - protein, 6 aa, Entamoeba invadens
SDPPQF

SEQ ID NO: 2903991 - protein, 9 aa, Entamoeba invadens
SDPREKELK

SEQ ID NO: 2903992 - protein, 7 aa, Entamoeba invadens
SDPRITK

SEQ ID NO: 2903993 - protein, 7 aa, Entamoeba invadens
SDPRNTP

SEQ ID NO: 2903994 - protein, 5 aa, Entamoeba invadens
SDPSK

SEQ ID NO: 2903995 - protein, 33 aa, Entamoeba invadens
SDPSKSNKKKPQNHPKKTESSEDEQIQPKKERK

SEQ ID NO: 2903996 - protein, 17 aa, Entamoeba invadens
SDPSRNARLQKKEKKDQ

SEQ ID NO: 2903997 - protein, 14 aa, Entamoeba invadens
SDPTEDSKQGHEGD

SEQ ID NO: 2903998 - protein, 14 aa, Entamoeba invadens
SDPTPSKKSFIPNY

SEQ ID NO: 2903999 - protein, 9 aa, Entamoeba invadens
SDPTRDSLP

SEQ ID NO: 2904000 - protein, 14 aa, Entamoeba invadens
SDPTTDEEEKSTVR

SEQ ID NO: 2904001 - protein, 14 aa, Entamoeba invadens
SDPYDEDVRSIASE

SEQ ID NO: 2904002 - protein, 5 aa, Entamoeba invadens
SDPYL

SEQ ID NO: 2904003 - protein, 4 aa, Entamoeba invadens
SDQD

SEQ ID NO: 2904004 - protein, 11 aa, Entamoeba invadens
SDQDGGNGKLG

SEQ ID NO: 2904005 - protein, 5 aa, Entamoeba invadens
SDQDN

SEQ ID NO: 2904006 - protein, 5 aa, Entamoeba invadens
SDQEE

SEQ ID NO: 2904007 - protein, 5 aa, Entamoeba invadens
SDQEG

SEQ ID NO: 2904008 - protein, 5 aa, Entamoeba invadens
SDQFE

SEQ ID NO: 2904009 - protein, 6 aa, Entamoeba invadens
SDQHRL

SEQ ID NO: 2904010 - protein, 4 aa, Entamoeba invadens
SDQI

SEQ ID NO: 2904011 - protein, 5 aa, Entamoeba invadens
SDQIQ

SEQ ID NO: 2904012 - protein, 8 aa, Entamoeba invadens
SDQIYDDG

SEQ ID NO: 2904013 - protein, 20 aa, Entamoeba invadens
SDQKEKKNKAFAYTPTPRGV

SEQ ID NO: 2904014 - protein, 16 aa, Entamoeba invadens
SDQKPVGIEKTEEINY

SEQ ID NO: 2904015 - protein, 10 aa, Entamoeba invadens
SDQKQPTENL

SEQ ID NO: 2904016 - protein, 4 aa, Entamoeba invadens
SDQN

SEQ ID NO: 2904017 - protein, 5 aa, Entamoeba invadens
SDQNE

SEQ ID NO: 2904018 - protein, 6 aa, Entamoeba invadens
SDQNIA

SEQ ID NO: 2904019 - protein, 8 aa, Entamoeba invadens
SDQPQKPI

SEQ ID NO: 2904020 - protein, 7 aa, Entamoeba invadens
SDQPQQL

SEQ ID NO: 2904021 - protein, 5 aa, Entamoeba invadens
SDQQK

SEQ ID NO: 2904022 - protein, 9 aa, Entamoeba invadens
SDQQNTQGK

SEQ ID NO: 2904023 - protein, 5 aa, Entamoeba invadens
SDQQV

SEQ ID NO: 2904024 - protein, 5 aa, Entamoeba invadens
SDQQW

SEQ ID NO: 2904025 - protein, 9 aa, Entamoeba invadens
SDQRDFEDS

SEQ ID NO: 2904026 - protein, 8 aa, Entamoeba invadens
SDQSDYSI

SEQ ID NO: 2904027 - protein, 22 aa, Entamoeba invadens
SDQSHAREECNTNYYPDTSTDF

SEQ ID NO: 2904028 - protein, 10 aa, Entamoeba invadens
SDQSNELSND

SEQ ID NO: 2904029 - protein, 15 aa, Entamoeba invadens
SDQSQIGPVTTADGL

SEQ ID NO: 2904030 - protein, 4 aa, Entamoeba invadens
SDQT

SEQ ID NO: 2904031 - protein, 45 aa, Entamoeba invadens
SDQTKISIESDTETISSTNTPIPSTNLNDINKNDTLNNESDESEI

SEQ ID NO: 2904032 - protein, 9 aa, Entamoeba invadens
SDRAEMESE

SEQ ID NO: 2904033 - protein, 9 aa, Entamoeba invadens
SDRDDPKTF

SEQ ID NO: 2904034 - protein, 7 aa, Entamoeba invadens
SDRDEMQ

SEQ ID NO: 2904035 - protein, 5 aa, Entamoeba invadens
SDRDN

SEQ ID NO: 2904036 - protein, 6 aa, Entamoeba invadens
SDRFEG

SEQ ID NO: 2904037 - protein, 20 aa, Entamoeba invadens
SDRFEGASGSDNAEEAETNL

SEQ ID NO: 2904038 - protein, 4 aa, Entamoeba invadens
SDRG

SEQ ID NO: 2904039 - protein, 6 aa, Entamoeba invadens
SDRGRD

SEQ ID NO: 2904040 - protein, 6 aa, Entamoeba invadens
SDRKSL

SEQ ID NO: 2904041 - protein, 9 aa, Entamoeba invadens
SDRNIESPS

SEQ ID NO: 2904042 - protein, 10 aa, Entamoeba invadens
SDRNNANCQN

SEQ ID NO: 2904043 - protein, 8 aa, Entamoeba invadens
SDRNTVAE

SEQ ID NO: 2904044 - protein, 9 aa, Entamoeba invadens
SDRRDYEDS

SEQ ID NO: 2904045 - protein, 5 aa, Entamoeba invadens
SDRRE

SEQ ID NO: 2904046 - protein, 7 aa, Entamoeba invadens
SDRSKLE

SEQ ID NO: 2904047 - protein, 16 aa, Entamoeba invadens
SDRSRNLGSNGVSESA

SEQ ID NO: 2904048 - protein, 32 aa, Entamoeba invadens
SDRTRQSEDKIEKLSRSEKSQRQLEEDENNKM

SEQ ID NO: 2904049 - protein, 36 aa, Entamoeba invadens
SDRTRQSGVKGEKMSSVDKNEKLSRSEKSQRQLEED

SEQ ID NO: 2904050 - protein, 5 aa, Entamoeba invadens
SDSAM

SEQ ID NO: 2904051 - protein, 8 aa, Entamoeba invadens
SDSCSEEL

SEQ ID NO: 2904052 - protein, 4 aa, Entamoeba invadens
SDSD

SEQ ID NO: 2904053 - protein, 6 aa, Entamoeba invadens
SDSDGD

SEQ ID NO: 2904054 - protein, 24 aa, Entamoeba invadens
SDSDKREVYDKYGKKGLEEGGMGG

SEQ ID NO: 2904055 - protein, 510 aa, Entamoeba invadens
SDSDSDLDFKPKKTSSKKFDLSDSDDDLLSGKPAAKKPASKKIDLSDSDDDDLDIKPTKKASAKKINLSDSDDDLDIKPKKTASKKIDLSDSDDDDLLDTKPTKKAAAKKMDLSDSDSDDDLDIKPKKTATKKISLSDSDDDDLLDKKPAAKAPSKKLDLSDSDDDLDLKPKKTATKKIDLSDSDDDDLLDKKPTKKAVAKKDSLDLSDSDDDIKPAKKTATKKISLSDSDDDDLLDKKPAAKTAAKKDSLDLSDSDDDIKPAKKTAAKKIDLSDSDDDDLLDKKPAAKAPAKKVDLSDSDDDLDVKPKKTAAKKIDLSDSDDDDDLLDKKPAKKAATKKMDLSDSDDDLSPKKPAAKKDSLDLSDSDDDIKPAKKATAKKVDLSDSDDDDLLDKKPAAKAPAKKDSLDLSDSDDDIKPAKKTATKKIDLSDSDDDNLSPKKPAAKTAAKKDSLDLSDSDDDIKPKKAAPKKIDLSDSDDDDVPTKKTDTKTAAKKDSLDSDNDLSDDDL

SEQ ID NO: 2904056 - protein, 8 aa, Entamoeba invadens
SDSDSPTK

SEQ ID NO: 2904057 - protein, 9 aa, Entamoeba invadens
SDSDSTNYK

SEQ ID NO: 2904058 - protein, 9 aa, Entamoeba invadens
SDSDVKRQD

SEQ ID NO: 2904059 - protein, 4 aa, Entamoeba invadens
SDSE

SEQ ID NO: 2904060 - protein, 8 aa, Entamoeba invadens
SDSEEKPV

SEQ ID NO: 2904061 - protein, 5 aa, Entamoeba invadens
SDSEK

SEQ ID NO: 2904062 - protein, 7 aa, Entamoeba invadens
SDSEKAC

SEQ ID NO: 2904063 - protein, 8 aa, Entamoeba invadens
SDSEPYYT

SEQ ID NO: 2904064 - protein, 7 aa, Entamoeba invadens
SDSERKT

SEQ ID NO: 2904065 - protein, 5 aa, Entamoeba invadens
SDSES

SEQ ID NO: 2904066 - protein, 8 aa, Entamoeba invadens
SDSEYPMS

SEQ ID NO: 2904067 - protein, 18 aa, Entamoeba invadens
SDSFDTRVSREKRIRKQG

SEQ ID NO: 2904068 - protein, 27 aa, Entamoeba invadens
SDSFEKEQNVQKRREAEMPSQPPQKIE

SEQ ID NO: 2904069 - protein, 7 aa, Entamoeba invadens
SDSFNPD

SEQ ID NO: 2904070 - protein, 8 aa, Entamoeba invadens
SDSGHEGD

SEQ ID NO: 2904071 - protein, 9 aa, Entamoeba invadens
SDSGLTGFP

SEQ ID NO: 2904072 - protein, 12 aa, Entamoeba invadens
SDSGNNSEDSVD

SEQ ID NO: 2904073 - protein, 9 aa, Entamoeba invadens
SDSGRKPFP

SEQ ID NO: 2904074 - protein, 156 aa, Entamoeba invadens
SDSGSKASQNESSDDNRFDNKSDRTQKEDERKKAKEEEKRAKEEEKKNQKEDAKRMKEEEKRVKEEEAKRIKEEAKEAKKAKEDEKKAKAEEAKRIKEENKKLKSSISEDSQTSSPPPIPAPRVPKPTKEELNLPTPAALQNEDEEEEYGPRKVTR

SEQ ID NO: 2904075 - protein, 10 aa, Entamoeba invadens
SDSGSSAMTD

SEQ ID NO: 2904076 - protein, 14 aa, Entamoeba invadens
SDSIHNATQPEEID

SEQ ID NO: 2904077 - protein, 5 aa, Entamoeba invadens
SDSIN

SEQ ID NO: 2904078 - protein, 8 aa, Entamoeba invadens
SDSIPALP

SEQ ID NO: 2904079 - protein, 7 aa, Entamoeba invadens
SDSKELQ

SEQ ID NO: 2904080 - protein, 8 aa, Entamoeba invadens
SDSKGSHA

SEQ ID NO: 2904081 - protein, 8 aa, Entamoeba invadens
SDSKKYDV

SEQ ID NO: 2904082 - protein, 17 aa, Entamoeba invadens
SDSKTSLKEATDCGGRI

SEQ ID NO: 2904083 - protein, 7 aa, Entamoeba invadens
SDSLNAE

SEQ ID NO: 2904084 - protein, 4 aa, Entamoeba invadens
SDSM

SEQ ID NO: 2904085 - protein, 13 aa, Entamoeba invadens
SDSMTERLGERRK

SEQ ID NO: 2904086 - protein, 4 aa, Entamoeba invadens
SDSN

SEQ ID NO: 2904087 - protein, 8 aa, Entamoeba invadens
SDSNDGVY

SEQ ID NO: 2904088 - protein, 6 aa, Entamoeba invadens
SDSNEQ

SEQ ID NO: 2904089 - protein, 11 aa, Entamoeba invadens
SDSNRFSTTNN

SEQ ID NO: 2904090 - protein, 11 aa, Entamoeba invadens
SDSNVAQGGRT

SEQ ID NO: 2904091 - protein, 7 aa, Entamoeba invadens
SDSPNIR

SEQ ID NO: 2904092 - protein, 18 aa, Entamoeba invadens
SDSQDDDSEDSENGNMEY

SEQ ID NO: 2904093 - protein, 10 aa, Entamoeba invadens
SDSQDGPALN

SEQ ID NO: 2904094 - protein, 6 aa, Entamoeba invadens
SDSQGN

SEQ ID NO: 2904095 - protein, 8 aa, Entamoeba invadens
SDSQNCKK

SEQ ID NO: 2904096 - protein, 4 aa, Entamoeba invadens
SDSS

SEQ ID NO: 2904097 - protein, 14 aa, Entamoeba invadens
SDSSDDQKRNRSPI

SEQ ID NO: 2904098 - protein, 8 aa, Entamoeba invadens
SDSSKNQT

SEQ ID NO: 2904099 - protein, 9 aa, Entamoeba invadens
SDSSLDESV

SEQ ID NO: 2904100 - protein, 9 aa, Entamoeba invadens
SDSSYAQAK

SEQ ID NO: 2904101 - protein, 8 aa, Entamoeba invadens
SDSTAITS

SEQ ID NO: 2904102 - protein, 5 aa, Entamoeba invadens
SDSTD

SEQ ID NO: 2904103 - protein, 6 aa, Entamoeba invadens
SDSTHE

SEQ ID NO: 2904104 - protein, 6 aa, Entamoeba invadens
SDSTQN

SEQ ID NO: 2904105 - protein, 8 aa, Entamoeba invadens
SDSTTLYS

SEQ ID NO: 2904106 - protein, 8 aa, Entamoeba invadens
SDSTYKQT

SEQ ID NO: 2904107 - protein, 8 aa, Entamoeba invadens
SDSVLSGK

SEQ ID NO: 2904108 - protein, 15 aa, Entamoeba invadens
SDSVQTSMGEKGREL

SEQ ID NO: 2904109 - protein, 7 aa, Entamoeba invadens
SDSYRFS

SEQ ID NO: 2904110 - protein, 14 aa, Entamoeba invadens
SDSYYNKKHQKAIS

SEQ ID NO: 2904111 - protein, 12 aa, Entamoeba invadens
SDTAEWSPKEYS

SEQ ID NO: 2904112 - protein, 16 aa, Entamoeba invadens
SDTANVNSSVRASAPL

SEQ ID NO: 2904113 - protein, 6 aa, Entamoeba invadens
SDTDND

SEQ ID NO: 2904114 - protein, 5 aa, Entamoeba invadens
SDTEA

SEQ ID NO: 2904115 - protein, 17 aa, Entamoeba invadens
SDTEMETAKNALDKQKQ

SEQ ID NO: 2904116 - protein, 67 aa, Entamoeba invadens
SDTEMETAKNALDKQKQRNSKKSQHKHKHKHNKKTHNKSIKDDEKETNKIASPTDSKDDQKIDKENF

SEQ ID NO: 2904117 - protein, 120 aa, Entamoeba invadens
SDTEMETAKNALDKQKQRNSKKSQHKHKHKHNKKTHNKSIKDENKIETLDPSSDKDKKTESQSKSVNSEGDKKAEDISKEEDTQNEDKNDLKIEKQEEHEATNNDVKQQAEDSQQTEEQI

SEQ ID NO: 2904118 - protein, 6 aa, Entamoeba invadens
SDTEPD

SEQ ID NO: 2904119 - protein, 8 aa, Entamoeba invadens
SDTEQNQG

SEQ ID NO: 2904120 - protein, 7 aa, Entamoeba invadens
SDTERIN

SEQ ID NO: 2904121 - protein, 36 aa, Entamoeba invadens
SDTETFSSTNTPIPSTNLNEINKNDTLNKESDESEI

SEQ ID NO: 2904122 - protein, 13 aa, Entamoeba invadens
SDTEYFDEQKTCE

SEQ ID NO: 2904123 - protein, 6 aa, Entamoeba invadens
SDTFDS

SEQ ID NO: 2904124 - protein, 14 aa, Entamoeba invadens
SDTFRQGSSTSSRF

SEQ ID NO: 2904125 - protein, 4 aa, Entamoeba invadens
SDTG

SEQ ID NO: 2904126 - protein, 7 aa, Entamoeba invadens
SDTGEYS

SEQ ID NO: 2904127 - protein, 7 aa, Entamoeba invadens
SDTIESM

SEQ ID NO: 2904128 - protein, 16 aa, Entamoeba invadens
SDTKDFNQTRVRVFQL

SEQ ID NO: 2904129 - protein, 16 aa, Entamoeba invadens
SDTKEEREKMADATLN

SEQ ID NO: 2904130 - protein, 11 aa, Entamoeba invadens
SDTKETPEKQH

SEQ ID NO: 2904131 - protein, 10 aa, Entamoeba invadens
SDTLAPGEGR

SEQ ID NO: 2904132 - protein, 5 aa, Entamoeba invadens
SDTLT

SEQ ID NO: 2904133 - protein, 4 aa, Entamoeba invadens
SDTN

SEQ ID NO: 2904134 - protein, 6 aa, Entamoeba invadens
SDTNNQ

SEQ ID NO: 2904135 - protein, 6 aa, Entamoeba invadens
SDTNRW

SEQ ID NO: 2904136 - protein, 6 aa, Entamoeba invadens
SDTNTK

SEQ ID NO: 2904137 - protein, 10 aa, Entamoeba invadens
SDTNVTTENQ

SEQ ID NO: 2904138 - protein, 9 aa, Entamoeba invadens
SDTPDKMNK

SEQ ID NO: 2904139 - protein, 9 aa, Entamoeba invadens
SDTPEGESC

SEQ ID NO: 2904140 - protein, 7 aa, Entamoeba invadens
SDTPHEI

SEQ ID NO: 2904141 - protein, 28 aa, Entamoeba invadens
SDTPIEKQEVKSDVKLEASPKPQPPSDG

SEQ ID NO: 2904142 - protein, 9 aa, Entamoeba invadens
SDTPTSSFT

SEQ ID NO: 2904143 - protein, 4 aa, Entamoeba invadens
SDTQ

SEQ ID NO: 2904144 - protein, 11 aa, Entamoeba invadens
SDTQPTTPQPL

SEQ ID NO: 2904145 - protein, 8 aa, Entamoeba invadens
SDTQTNTF

SEQ ID NO: 2904146 - protein, 20 aa, Entamoeba invadens
SDTQTTDKPISCDKTKKELT

SEQ ID NO: 2904147 - protein, 13 aa, Entamoeba invadens
SDTRISKYADDKL

SEQ ID NO: 2904148 - protein, 6 aa, Entamoeba invadens
SDTSEL

SEQ ID NO: 2904149 - protein, 7 aa, Entamoeba invadens
SDTSIER

SEQ ID NO: 2904150 - protein, 6 aa, Entamoeba invadens
SDTSNV

SEQ ID NO: 2904151 - protein, 11 aa, Entamoeba invadens
SDTSTKAEERK

SEQ ID NO: 2904152 - protein, 5 aa, Entamoeba invadens
SDTTG

SEQ ID NO: 2904153 - protein, 7 aa, Entamoeba invadens
SDTTGIP

SEQ ID NO: 2904154 - protein, 8 aa, Entamoeba invadens
SDTTKSQV

SEQ ID NO: 2904155 - protein, 6 aa, Entamoeba invadens
SDTTRD

SEQ ID NO: 2904156 - protein, 9 aa, Entamoeba invadens
SDTTSDTST

SEQ ID NO: 2904157 - protein, 42 aa, Entamoeba invadens
SDTTSQTNQLPTKGEKPIKKAQQRRKKEKKDKKQTKIQRDKS

SEQ ID NO: 2904158 - protein, 7 aa, Entamoeba invadens
SDTVEDV

SEQ ID NO: 2904159 - protein, 13 aa, Entamoeba invadens
SDTVEEGVSEDGV

SEQ ID NO: 2904160 - protein, 6 aa, Entamoeba invadens
SDTVSF

SEQ ID NO: 2904161 - protein, 8 aa, Entamoeba invadens
SDVAQEID

SEQ ID NO: 2904162 - protein, 6 aa, Entamoeba invadens
SDVDGN

SEQ ID NO: 2904163 - protein, 7 aa, Entamoeba invadens
SDVDKGN

SEQ ID NO: 2904164 - protein, 4 aa, Entamoeba invadens
SDVE

SEQ ID NO: 2904165 - protein, 12 aa, Entamoeba invadens
SDVEKRPTETQL

SEQ ID NO: 2904166 - protein, 13 aa, Entamoeba invadens
SDVEKSIPPKEET

SEQ ID NO: 2904167 - protein, 9 aa, Entamoeba invadens
SDVINATQE

SEQ ID NO: 2904168 - protein, 5 aa, Entamoeba invadens
SDVKI

SEQ ID NO: 2904169 - protein, 10 aa, Entamoeba invadens
SDVKKRPDIN

SEQ ID NO: 2904170 - protein, 13 aa, Entamoeba invadens
SDVKNKKARSYKN

SEQ ID NO: 2904171 - protein, 5 aa, Entamoeba invadens
SDVKS

SEQ ID NO: 2904172 - protein, 11 aa, Entamoeba invadens
SDVKSDKPNYT

SEQ ID NO: 2904173 - protein, 22 aa, Entamoeba invadens
SDVLQEREIESQEGEDLAKSMK

SEQ ID NO: 2904174 - protein, 4 aa, Entamoeba invadens
SDVN

SEQ ID NO: 2904175 - protein, 15 aa, Entamoeba invadens
SDVNAQKENSGATQL

SEQ ID NO: 2904176 - protein, 4 aa, Entamoeba invadens
SDVP

SEQ ID NO: 2904177 - protein, 12 aa, Entamoeba invadens
SDVPPYLSGPTL

SEQ ID NO: 2904178 - protein, 8 aa, Entamoeba invadens
SDVSSVRR

SEQ ID NO: 2904179 - protein, 5 aa, Entamoeba invadens
SDVTS

SEQ ID NO: 2904180 - protein, 22 aa, Entamoeba invadens
SDVTTQKKKTELKPNTKNFEVP

SEQ ID NO: 2904181 - protein, 17 aa, Entamoeba invadens
SDVTTQPGHKTVKEKVS

SEQ ID NO: 2904182 - protein, 13 aa, Entamoeba invadens
SDWRPNNTERQKV

SEQ ID NO: 2904183 - protein, 12 aa, Entamoeba invadens
SDWSGDKLESKY

SEQ ID NO: 2904184 - protein, 9 aa, Entamoeba invadens
SDYDTRDGT

SEQ ID NO: 2904185 - protein, 5 aa, Entamoeba invadens
SDYHD

SEQ ID NO: 2904186 - protein, 12 aa, Entamoeba invadens
SDYHKDFLDRFV

SEQ ID NO: 2904187 - protein, 5 aa, Entamoeba invadens
SDYIT

SEQ ID NO: 2904188 - protein, 8 aa, Entamoeba invadens
SDYNTEVE

SEQ ID NO: 2904189 - protein, 7 aa, Entamoeba invadens
SDYPTTL

SEQ ID NO: 2904190 - protein, 6 aa, Entamoeba invadens
SDYPVN

SEQ ID NO: 2904191 - protein, 7 aa, Entamoeba invadens
SDYQEGG

SEQ ID NO: 2904192 - protein, 10 aa, Entamoeba invadens
SDYQESNKSK

SEQ ID NO: 2904193 - protein, 6 aa, Entamoeba invadens
SDYSPK

SEQ ID NO: 2904194 - protein, 7 aa, Entamoeba invadens
SDYYGNK

SEQ ID NO: 2904195 - protein, 6 aa, Entamoeba invadens
SEADKM

SEQ ID NO: 2904196 - protein, 5 aa, Entamoeba invadens
SEADP

SEQ ID NO: 2904197 - protein, 9 aa, Entamoeba invadens
SEADSTTLK

SEQ ID NO: 2904198 - protein, 13 aa, Entamoeba invadens
SEADVESDRTVYG

SEQ ID NO: 2904199 - protein, 9 aa, Entamoeba invadens
SEAEEKHGH

SEQ ID NO: 2904200 - protein, 14 aa, Entamoeba invadens
SEAEGRDTTQQEVN

SEQ ID NO: 2904201 - protein, 9 aa, Entamoeba invadens
SEAEKTKQK

SEQ ID NO: 2904202 - protein, 14 aa, Entamoeba invadens
SEAEQQKKAEETQE

SEQ ID NO: 2904203 - protein, 4 aa, Entamoeba invadens
SEAF

SEQ ID NO: 2904204 - protein, 10 aa, Entamoeba invadens
SEAGAAGAVH

SEQ ID NO: 2904205 - protein, 9 aa, Entamoeba invadens
SEAGVTNNS

SEQ ID NO: 2904206 - protein, 6 aa, Entamoeba invadens
SEAKKI

SEQ ID NO: 2904207 - protein, 4 aa, Entamoeba invadens
SEAN

SEQ ID NO: 2904208 - protein, 5 aa, Entamoeba invadens
SEANV

SEQ ID NO: 2904209 - protein, 4 aa, Entamoeba invadens
SEAP

SEQ ID NO: 2904210 - protein, 8 aa, Entamoeba invadens
SEAPYSND

SEQ ID NO: 2904211 - protein, 10 aa, Entamoeba invadens
SEAQGTQYRS

SEQ ID NO: 2904212 - protein, 24 aa, Entamoeba invadens
SEAREDEVEKVKEELKNDDQLQNL

SEQ ID NO: 2904213 - protein, 10 aa, Entamoeba invadens
SEARNRKKPT

SEQ ID NO: 2904214 - protein, 5 aa, Entamoeba invadens
SEASE

SEQ ID NO: 2904215 - protein, 6 aa, Entamoeba invadens
SEATEL

SEQ ID NO: 2904216 - protein, 9 aa, Entamoeba invadens
SEATNNFPN

SEQ ID NO: 2904217 - protein, 7 aa, Entamoeba invadens
SEAYQTL

SEQ ID NO: 2904218 - protein, 13 aa, Entamoeba invadens
SECDQTKAECTKC

SEQ ID NO: 2904219 - protein, 20 aa, Entamoeba invadens
SECDSSEEDMKKKRRNLDAL

SEQ ID NO: 2904220 - protein, 5 aa, Entamoeba invadens
SECDT

SEQ ID NO: 2904221 - protein, 6 aa, Entamoeba invadens
SECENY

SEQ ID NO: 2904222 - protein, 13 aa, Entamoeba invadens
SECGSWSNNYSTA

SEQ ID NO: 2904223 - protein, 7 aa, Entamoeba invadens
SECKTNV

SEQ ID NO: 2904224 - protein, 4 aa, Entamoeba invadens
SECN

SEQ ID NO: 2904225 - protein, 4 aa, Entamoeba invadens
SECP

SEQ ID NO: 2904226 - protein, 6 aa, Entamoeba invadens
SECREK

SEQ ID NO: 2904227 - protein, 8 aa, Entamoeba invadens
SECSAKTK

SEQ ID NO: 2904228 - protein, 14 aa, Entamoeba invadens
SECSSEDFDYSNRE

SEQ ID NO: 2904229 - protein, 12 aa, Entamoeba invadens
SEDAKKLSEIPD

SEQ ID NO: 2904230 - protein, 5 aa, Entamoeba invadens
SEDDK

SEQ ID NO: 2904231 - protein, 5 aa, Entamoeba invadens
SEDDL

SEQ ID NO: 2904232 - protein, 4 aa, Entamoeba invadens
SEDE

SEQ ID NO: 2904233 - protein, 7 aa, Entamoeba invadens
SEDEEQI

SEQ ID NO: 2904234 - protein, 5 aa, Entamoeba invadens
SEDEI

SEQ ID NO: 2904235 - protein, 10 aa, Entamoeba invadens
SEDEKEVPQD

SEQ ID NO: 2904236 - protein, 12 aa, Entamoeba invadens
SEDEKNGVFDKK

SEQ ID NO: 2904237 - protein, 7 aa, Entamoeba invadens
SEDEREM

SEQ ID NO: 2904238 - protein, 37 aa, Entamoeba invadens
SEDEVTKDNRNLNDQNTAQHLTSDDISKMKSEGLAGE

SEQ ID NO: 2904239 - protein, 8 aa, Entamoeba invadens
SEDEYSIG

SEQ ID NO: 2904240 - protein, 8 aa, Entamoeba invadens
SEDEYTDY

SEQ ID NO: 2904241 - protein, 4 aa, Entamoeba invadens
SEDF

SEQ ID NO: 2904242 - protein, 9 aa, Entamoeba invadens
SEDGDFEAD

SEQ ID NO: 2904243 - protein, 24 aa, Entamoeba invadens
SEDGGEKKVSPKKPVKSPSPFPDI

SEQ ID NO: 2904244 - protein, 6 aa, Entamoeba invadens
SEDGSY

SEQ ID NO: 2904245 - protein, 14 aa, Entamoeba invadens
SEDGTAKTWEPRTC

SEQ ID NO: 2904246 - protein, 7 aa, Entamoeba invadens
SEDGVGG

SEQ ID NO: 2904247 - protein, 7 aa, Entamoeba invadens
SEDHEKT

SEQ ID NO: 2904248 - protein, 4 aa, Entamoeba invadens
SEDI

SEQ ID NO: 2904249 - protein, 8 aa, Entamoeba invadens
SEDIDGVE

SEQ ID NO: 2904250 - protein, 6 aa, Entamoeba invadens
SEDITG

SEQ ID NO: 2904251 - protein, 18 aa, Entamoeba invadens
SEDITKGDITLTDEEKDV

SEQ ID NO: 2904252 - protein, 9 aa, Entamoeba invadens
SEDKGIRKE

SEQ ID NO: 2904253 - protein, 5 aa, Entamoeba invadens
SEDKH

SEQ ID NO: 2904254 - protein, 6 aa, Entamoeba invadens
SEDKKA

SEQ ID NO: 2904255 - protein, 11 aa, Entamoeba invadens
SEDKLQNEDPM

SEQ ID NO: 2904256 - protein, 5 aa, Entamoeba invadens
SEDLE

SEQ ID NO: 2904257 - protein, 7 aa, Entamoeba invadens
SEDLSQY

SEQ ID NO: 2904258 - protein, 33 aa, Entamoeba invadens
SEDNDDSHEDKKEIQDSKMPKTPNPENEQKIEN

SEQ ID NO: 2904259 - protein, 7 aa, Entamoeba invadens
SEDNGNI

SEQ ID NO: 2904260 - protein, 8 aa, Entamoeba invadens
SEDNKHDF

SEQ ID NO: 2904261 - protein, 7 aa, Entamoeba invadens
SEDNRFG

SEQ ID NO: 2904262 - protein, 10 aa, Entamoeba invadens
SEDNSPSPMT

SEQ ID NO: 2904263 - protein, 8 aa, Entamoeba invadens
SEDPELAR

SEQ ID NO: 2904264 - protein, 6 aa, Entamoeba invadens
SEDPIE

SEQ ID NO: 2904265 - protein, 15 aa, Entamoeba invadens
SEDPKKTINKRKVIY

SEQ ID NO: 2904266 - protein, 10 aa, Entamoeba invadens
SEDPKQPLKK

SEQ ID NO: 2904267 - protein, 5 aa, Entamoeba invadens
SEDPM

SEQ ID NO: 2904268 - protein, 11 aa, Entamoeba invadens
SEDPNKYNKDF

SEQ ID NO: 2904269 - protein, 4 aa, Entamoeba invadens
SEDQ

SEQ ID NO: 2904270 - protein, 18 aa, Entamoeba invadens
SEDQKKGLKDVLNTVNSW

SEQ ID NO: 2904271 - protein, 8 aa, Entamoeba invadens
SEDRASKL

SEQ ID NO: 2904272 - protein, 9 aa, Entamoeba invadens
SEDRQDAEF

SEQ ID NO: 2904273 - protein, 27 aa, Entamoeba invadens
SEDRTRKEKYCESTKNCLSTEKSEENV

SEQ ID NO: 2904274 - protein, 4 aa, Entamoeba invadens
SEDS

SEQ ID NO: 2904275 - protein, 10 aa, Entamoeba invadens
SEDSAVKSEE

SEQ ID NO: 2904276 - protein, 14 aa, Entamoeba invadens
SEDSKTFITSSADK

SEQ ID NO: 2904277 - protein, 6 aa, Entamoeba invadens
SEDSPL

SEQ ID NO: 2904278 - protein, 8 aa, Entamoeba invadens
SEDSSTEH

SEQ ID NO: 2904279 - protein, 9 aa, Entamoeba invadens
SEDTDTTTE

SEQ ID NO: 2904280 - protein, 8 aa, Entamoeba invadens
SEDTLKDL

SEQ ID NO: 2904281 - protein, 10 aa, Entamoeba invadens
SEDTSLGNVD

SEQ ID NO: 2904282 - protein, 9 aa, Entamoeba invadens
SEDTTDKVY

SEQ ID NO: 2904283 - protein, 4 aa, Entamoeba invadens
SEDV

SEQ ID NO: 2904284 - protein, 12 aa, Entamoeba invadens
SEDVKAAKSDLE

SEQ ID NO: 2904285 - protein, 12 aa, Entamoeba invadens
SEDVSSANTPLT

SEQ ID NO: 2904286 - protein, 5 aa, Entamoeba invadens
SEDVT

SEQ ID NO: 2904287 - protein, 4 aa, Entamoeba invadens
SEDW

SEQ ID NO: 2904288 - protein, 6 aa, Entamoeba invadens
SEDWGE

SEQ ID NO: 2904289 - protein, 7 aa, Entamoeba invadens
SEDYEGV

SEQ ID NO: 2904290 - protein, 15 aa, Entamoeba invadens
SEDYESCVDDDGEHF

SEQ ID NO: 2904291 - protein, 5 aa, Entamoeba invadens
SEEAG

SEQ ID NO: 2904292 - protein, 5 aa, Entamoeba invadens
SEEAL

SEQ ID NO: 2904293 - protein, 14 aa, Entamoeba invadens
SEEAREITEKYFCD

SEQ ID NO: 2904294 - protein, 6 aa, Entamoeba invadens
SEECKA

SEQ ID NO: 2904295 - protein, 7 aa, Entamoeba invadens
SEEDDCF

SEQ ID NO: 2904296 - protein, 11 aa, Entamoeba invadens
SEEDEKKTQTQ

SEQ ID NO: 2904297 - protein, 5 aa, Entamoeba invadens
SEEDG

SEQ ID NO: 2904298 - protein, 7 aa, Entamoeba invadens
SEEDIKG

SEQ ID NO: 2904299 - protein, 6 aa, Entamoeba invadens
SEEDNG

SEQ ID NO: 2904300 - protein, 16 aa, Entamoeba invadens
SEEDTFDASLEGNRKD

SEQ ID NO: 2904301 - protein, 7 aa, Entamoeba invadens
SEEDTLA

SEQ ID NO: 2904302 - protein, 10 aa, Entamoeba invadens
SEEDYKEETV

SEQ ID NO: 2904303 - protein, 4 aa, Entamoeba invadens
SEEE

SEQ ID NO: 2904304 - protein, 6 aa, Entamoeba invadens
SEEECK

SEQ ID NO: 2904305 - protein, 15 aa, Entamoeba invadens
SEEEDGTDKNDSSVI

SEQ ID NO: 2904306 - protein, 16 aa, Entamoeba invadens
SEEEEDGNDKNDSSVI

SEQ ID NO: 2904307 - protein, 7 aa, Entamoeba invadens
SEEEEKA

SEQ ID NO: 2904308 - protein, 8 aa, Entamoeba invadens
SEEEGKPN

SEQ ID NO: 2904309 - protein, 5 aa, Entamoeba invadens
SEEEI

SEQ ID NO: 2904310 - protein, 6 aa, Entamoeba invadens
SEEENI

SEQ ID NO: 2904311 - protein, 8 aa, Entamoeba invadens
SEEENKIA

SEQ ID NO: 2904312 - protein, 7 aa, Entamoeba invadens
SEEESKL

SEQ ID NO: 2904313 - protein, 9 aa, Entamoeba invadens
SEEESLPRN

SEQ ID NO: 2904314 - protein, 13 aa, Entamoeba invadens
SEEETQKVTDHTL

SEQ ID NO: 2904315 - protein, 6 aa, Entamoeba invadens
SEEETR

SEQ ID NO: 2904316 - protein, 6 aa, Entamoeba invadens
SEEEVP

SEQ ID NO: 2904317 - protein, 5 aa, Entamoeba invadens
SEEEY

SEQ ID NO: 2904318 - protein, 8 aa, Entamoeba invadens
SEEEYTNS

SEQ ID NO: 2904319 - protein, 4 aa, Entamoeba invadens
SEEF

SEQ ID NO: 2904320 - protein, 7 aa, Entamoeba invadens
SEEFTDD

SEQ ID NO: 2904321 - protein, 4 aa, Entamoeba invadens
SEEG

SEQ ID NO: 2904322 - protein, 8 aa, Entamoeba invadens
SEEGPVKQ

SEQ ID NO: 2904323 - protein, 5 aa, Entamoeba invadens
SEEHS

SEQ ID NO: 2904324 - protein, 9 aa, Entamoeba invadens
SEEIDRKRA

SEQ ID NO: 2904325 - protein, 6 aa, Entamoeba invadens
SEEIED

SEQ ID NO: 2904326 - protein, 10 aa, Entamoeba invadens
SEEITKRDKH

SEQ ID NO: 2904327 - protein, 6 aa, Entamoeba invadens
SEEITQ

SEQ ID NO: 2904328 - protein, 8 aa, Entamoeba invadens
SEEKEKIQ

SEQ ID NO: 2904329 - protein, 10 aa, Entamoeba invadens
SEEKKTPVEM

SEQ ID NO: 2904330 - protein, 6 aa, Entamoeba invadens
SEEKLE

SEQ ID NO: 2904331 - protein, 5 aa, Entamoeba invadens
SEEKM

SEQ ID NO: 2904332 - protein, 34 aa, Entamoeba invadens
SEEKSYAIKRKKSKKSKKNEKIDKHGKVKKRSKS

SEQ ID NO: 2904333 - protein, 4 aa, Entamoeba invadens
SEEL

SEQ ID NO: 2904334 - protein, 15 aa, Entamoeba invadens
SEELAKKRSWKEQQE

SEQ ID NO: 2904335 - protein, 5 aa, Entamoeba invadens
SEELG

SEQ ID NO: 2904336 - protein, 34 aa, Entamoeba invadens
SEELGKEKEKRESAERENNTLKEENDKMNKDKEN

SEQ ID NO: 2904337 - protein, 6 aa, Entamoeba invadens
SEELKQ

SEQ ID NO: 2904338 - protein, 10 aa, Entamoeba invadens
SEELRKNGRI

SEQ ID NO: 2904339 - protein, 4 aa, Entamoeba invadens
SEEN

SEQ ID NO: 2904340 - protein, 7 aa, Entamoeba invadens
SEENADL

SEQ ID NO: 2904341 - protein, 14 aa, Entamoeba invadens
SEENKKEENKTAEI

SEQ ID NO: 2904342 - protein, 8 aa, Entamoeba invadens
SEENTETL

SEQ ID NO: 2904343 - protein, 10 aa, Entamoeba invadens
SEENTRKRHS

SEQ ID NO: 2904344 - protein, 8 aa, Entamoeba invadens
SEENTTIY

SEQ ID NO: 2904345 - protein, 10 aa, Entamoeba invadens
SEENTYTTDN

SEQ ID NO: 2904346 - protein, 8 aa, Entamoeba invadens
SEEPPAIP

SEQ ID NO: 2904347 - protein, 17 aa, Entamoeba invadens
SEEPTKEEKTHNSCCVV

SEQ ID NO: 2904348 - protein, 9 aa, Entamoeba invadens
SEEQKIGKT

SEQ ID NO: 2904349 - protein, 8 aa, Entamoeba invadens
SEEQKREW

SEQ ID NO: 2904350 - protein, 32 aa, Entamoeba invadens
SEEQLKESLESLQTQLNKSRNEEEETKEHMTQ

SEQ ID NO: 2904351 - protein, 12 aa, Entamoeba invadens
SEEQLRKDARIK

SEQ ID NO: 2904352 - protein, 8 aa, Entamoeba invadens
SEEQQDEK

SEQ ID NO: 2904353 - protein, 7 aa, Entamoeba invadens
SEEQRRN

SEQ ID NO: 2904354 - protein, 11 aa, Entamoeba invadens
SEERQSAECDE

SEQ ID NO: 2904355 - protein, 6 aa, Entamoeba invadens
SEERRV

SEQ ID NO: 2904356 - protein, 4 aa, Entamoeba invadens
SEES

SEQ ID NO: 2904357 - protein, 8 aa, Entamoeba invadens
SEESEKAV

SEQ ID NO: 2904358 - protein, 7 aa, Entamoeba invadens
SEESFQG

SEQ ID NO: 2904359 - protein, 6 aa, Entamoeba invadens
SEESGY

SEQ ID NO: 2904360 - protein, 22 aa, Entamoeba invadens
SEESMALDPDDLKKDKKLGEGS

SEQ ID NO: 2904361 - protein, 21 aa, Entamoeba invadens
SEESNDVQEITAPDTKASGIS

SEQ ID NO: 2904362 - protein, 7 aa, Entamoeba invadens
SEESNGY

SEQ ID NO: 2904363 - protein, 8 aa, Entamoeba invadens
SEESPLSS

SEQ ID NO: 2904364 - protein, 25 aa, Entamoeba invadens
SEESSGENNKNHKNEKPKDNQKDEI

SEQ ID NO: 2904365 - protein, 8 aa, Entamoeba invadens
SEESSTII

SEQ ID NO: 2904366 - protein, 4 aa, Entamoeba invadens
SEET

SEQ ID NO: 2904367 - protein, 7 aa, Entamoeba invadens
SEETETL

SEQ ID NO: 2904368 - protein, 14 aa, Entamoeba invadens
SEETGIDVSTTPTF

SEQ ID NO: 2904369 - protein, 6 aa, Entamoeba invadens
SEETGK

SEQ ID NO: 2904370 - protein, 6 aa, Entamoeba invadens
SEETIK

SEQ ID NO: 2904371 - protein, 5 aa, Entamoeba invadens
SEETK

SEQ ID NO: 2904372 - protein, 6 aa, Entamoeba invadens
SEEVSA

SEQ ID NO: 2904373 - protein, 9 aa, Entamoeba invadens
SEEVSESSE

SEQ ID NO: 2904374 - protein, 9 aa, Entamoeba invadens
SEEVTTNLR

SEQ ID NO: 2904375 - protein, 4 aa, Entamoeba invadens
SEEY

SEQ ID NO: 2904376 - protein, 17 aa, Entamoeba invadens
SEEYDESDSRSNEDQWN

SEQ ID NO: 2904377 - protein, 12 aa, Entamoeba invadens
SEEYDKEEENHQ

SEQ ID NO: 2904378 - protein, 4 aa, Entamoeba invadens
SEFD

SEQ ID NO: 2904379 - protein, 8 aa, Entamoeba invadens
SEFDSESH

SEQ ID NO: 2904380 - protein, 8 aa, Entamoeba invadens
SEFKESGE

SEQ ID NO: 2904381 - protein, 12 aa, Entamoeba invadens
SEFKGEKKNRLC

SEQ ID NO: 2904382 - protein, 12 aa, Entamoeba invadens
SEFKPSDESKDL

SEQ ID NO: 2904383 - protein, 5 aa, Entamoeba invadens
SEFKS

SEQ ID NO: 2904384 - protein, 6 aa, Entamoeba invadens
SEFNGV

SEQ ID NO: 2904385 - protein, 6 aa, Entamoeba invadens
SEFTDS

SEQ ID NO: 2904386 - protein, 7 aa, Entamoeba invadens
SEFYNNK

SEQ ID NO: 2904387 - protein, 6 aa, Entamoeba invadens
SEGAEI

SEQ ID NO: 2904388 - protein, 7 aa, Entamoeba invadens
SEGAEVT

SEQ ID NO: 2904389 - protein, 5 aa, Entamoeba invadens
SEGAV

SEQ ID NO: 2904390 - protein, 8 aa, Entamoeba invadens
SEGAVKES

SEQ ID NO: 2904391 - protein, 11 aa, Entamoeba invadens
SEGEFASENSL

SEQ ID NO: 2904392 - protein, 8 aa, Entamoeba invadens
SEGEIKYG

SEQ ID NO: 2904393 - protein, 9 aa, Entamoeba invadens
SEGEPGASH

SEQ ID NO: 2904394 - protein, 12 aa, Entamoeba invadens
SEGEPGASHDTR

SEQ ID NO: 2904395 - protein, 7 aa, Entamoeba invadens
SEGEVQK

SEQ ID NO: 2904396 - protein, 11 aa, Entamoeba invadens
SEGFEKATEPI

SEQ ID NO: 2904397 - protein, 4 aa, Entamoeba invadens
SEGG

SEQ ID NO: 2904398 - protein, 6 aa, Entamoeba invadens
SEGGFV

SEQ ID NO: 2904399 - protein, 9 aa, Entamoeba invadens
SEGGFVDQS

SEQ ID NO: 2904400 - protein, 5 aa, Entamoeba invadens
SEGGK

SEQ ID NO: 2904401 - protein, 8 aa, Entamoeba invadens
SEGGVGYD

SEQ ID NO: 2904402 - protein, 4 aa, Entamoeba invadens
SEGI

SEQ ID NO: 2904403 - protein, 5 aa, Entamoeba invadens
SEGID

SEQ ID NO: 2904404 - protein, 14 aa, Entamoeba invadens
SEGIEDDNQMTTNE

SEQ ID NO: 2904405 - protein, 4 aa, Entamoeba invadens
SEGK

SEQ ID NO: 2904406 - protein, 15 aa, Entamoeba invadens
SEGKANQSESTGRFG

SEQ ID NO: 2904407 - protein, 9 aa, Entamoeba invadens
SEGKKSKAC

SEQ ID NO: 2904408 - protein, 7 aa, Entamoeba invadens
SEGKPPV

SEQ ID NO: 2904409 - protein, 7 aa, Entamoeba invadens
SEGKQEV

SEQ ID NO: 2904410 - protein, 32 aa, Entamoeba invadens
SEGKREKVTKPKLRQKKVQPAHLPQQSADVGE

SEQ ID NO: 2904411 - protein, 17 aa, Entamoeba invadens
SEGKSYIGSASGEQLQR

SEQ ID NO: 2904412 - protein, 6 aa, Entamoeba invadens
SEGKTD

SEQ ID NO: 2904413 - protein, 8 aa, Entamoeba invadens
SEGKTINH

SEQ ID NO: 2904414 - protein, 4 aa, Entamoeba invadens
SEGL

SEQ ID NO: 2904415 - protein, 13 aa, Entamoeba invadens
SEGMEKETDEEEM

SEQ ID NO: 2904416 - protein, 5 aa, Entamoeba invadens
SEGMS

SEQ ID NO: 2904417 - protein, 6 aa, Entamoeba invadens
SEGNNL

SEQ ID NO: 2904418 - protein, 13 aa, Entamoeba invadens
SEGNTIVKGGDDI

SEQ ID NO: 2904419 - protein, 6 aa, Entamoeba invadens
SEGNVR

SEQ ID NO: 2904420 - protein, 7 aa, Entamoeba invadens
SEGPRHV

SEQ ID NO: 2904421 - protein, 7 aa, Entamoeba invadens
SEGQFES

SEQ ID NO: 2904422 - protein, 5 aa, Entamoeba invadens
SEGQH

SEQ ID NO: 2904423 - protein, 20 aa, Entamoeba invadens
SEGRDALGTDGKGKGAAGIK

SEQ ID NO: 2904424 - protein, 7 aa, Entamoeba invadens
SEGRDNT

SEQ ID NO: 2904425 - protein, 5 aa, Entamoeba invadens
SEGRE

SEQ ID NO: 2904426 - protein, 7 aa, Entamoeba invadens
SEGRSTQ

SEQ ID NO: 2904427 - protein, 6 aa, Entamoeba invadens
SEGRYI

SEQ ID NO: 2904428 - protein, 36 aa, Entamoeba invadens
SEGSSSDSESSEEVKKEVKPAPPQVNKKQEKKKEVV

SEQ ID NO: 2904429 - protein, 9 aa, Entamoeba invadens
SEGSVDGVR

SEQ ID NO: 2904430 - protein, 4 aa, Entamoeba invadens
SEGT

SEQ ID NO: 2904431 - protein, 7 aa, Entamoeba invadens
SEGTPED

SEQ ID NO: 2904432 - protein, 10 aa, Entamoeba invadens
SEGTQKYPEL

SEQ ID NO: 2904433 - protein, 10 aa, Entamoeba invadens
SEGTYPNRVG

SEQ ID NO: 2904434 - protein, 8 aa, Entamoeba invadens
SEGTYPSG

SEQ ID NO: 2904435 - protein, 7 aa, Entamoeba invadens
SEGVKSQ

SEQ ID NO: 2904436 - protein, 6 aa, Entamoeba invadens
SEHDTN

SEQ ID NO: 2904437 - protein, 14 aa, Entamoeba invadens
SEHEDETNNLNGSI

SEQ ID NO: 2904438 - protein, 17 aa, Entamoeba invadens
SEHEGVDKKKKKKEQTI

SEQ ID NO: 2904439 - protein, 9 aa, Entamoeba invadens
SEHEPSREY

SEQ ID NO: 2904440 - protein, 5 aa, Entamoeba invadens
SEHHP

SEQ ID NO: 2904441 - protein, 12 aa, Entamoeba invadens
SEHNEKYDKMSE

SEQ ID NO: 2904442 - protein, 15 aa, Entamoeba invadens
SEHPDYPAQNSTFTR

SEQ ID NO: 2904443 - protein, 5 aa, Entamoeba invadens
SEHPT

SEQ ID NO: 2904444 - protein, 7 aa, Entamoeba invadens
SEHQKEI

SEQ ID NO: 2904445 - protein, 14 aa, Entamoeba invadens
SEHSQGGVYTTKSD

SEQ ID NO: 2904446 - protein, 5 aa, Entamoeba invadens
SEHTQ

SEQ ID NO: 2904447 - protein, 8 aa, Entamoeba invadens
SEHTSDGH

SEQ ID NO: 2904448 - protein, 6 aa, Entamoeba invadens
SEHVGH

SEQ ID NO: 2904449 - protein, 6 aa, Entamoeba invadens
SEIAKQ

SEQ ID NO: 2904450 - protein, 13 aa, Entamoeba invadens
SEIASDEDETKKH

SEQ ID NO: 2904451 - protein, 8 aa, Entamoeba invadens
SEIDEDEY

SEQ ID NO: 2904452 - protein, 5 aa, Entamoeba invadens
SEIDR

SEQ ID NO: 2904453 - protein, 4 aa, Entamoeba invadens
SEIE

SEQ ID NO: 2904454 - protein, 6 aa, Entamoeba invadens
SEIEAR

SEQ ID NO: 2904455 - protein, 13 aa, Entamoeba invadens
SEIEDDEDAYPEV

SEQ ID NO: 2904456 - protein, 9 aa, Entamoeba invadens
SEIEGQPEA

SEQ ID NO: 2904457 - protein, 7 aa, Entamoeba invadens
SEIENSS

SEQ ID NO: 2904458 - protein, 16 aa, Entamoeba invadens
SEIERKQNESSKKRFE

SEQ ID NO: 2904459 - protein, 37 aa, Entamoeba invadens
SEIERMKKEQEDVETTHKTQIEELNSQNEQQQKSIDE

SEQ ID NO: 2904460 - protein, 5 aa, Entamoeba invadens
SEIGE

SEQ ID NO: 2904461 - protein, 14 aa, Entamoeba invadens
SEIGKNENSDSQNV

SEQ ID NO: 2904462 - protein, 7 aa, Entamoeba invadens
SEIGNNA

SEQ ID NO: 2904463 - protein, 4 aa, Entamoeba invadens
SEIK

SEQ ID NO: 2904464 - protein, 22 aa, Entamoeba invadens
SEIKAPPLEEIPRSPRNGRPIY

SEQ ID NO: 2904465 - protein, 10 aa, Entamoeba invadens
SEIKNTPIGP

SEQ ID NO: 2904466 - protein, 5 aa, Entamoeba invadens
SEIKS

SEQ ID NO: 2904467 - protein, 20 aa, Entamoeba invadens
SEIKSEKEKVEKKPKRYSFR

SEQ ID NO: 2904468 - protein, 4 aa, Entamoeba invadens
SEIL

SEQ ID NO: 2904469 - protein, 15 aa, Entamoeba invadens
SEINCDTAQPTTKKV

SEQ ID NO: 2904470 - protein, 12 aa, Entamoeba invadens
SEINDDDEKDVD

SEQ ID NO: 2904471 - protein, 8 aa, Entamoeba invadens
SEINDKKS

SEQ ID NO: 2904472 - protein, 14 aa, Entamoeba invadens
SEINKTNALGTQGK

SEQ ID NO: 2904473 - protein, 6 aa, Entamoeba invadens
SEINST

SEQ ID NO: 2904474 - protein, 5 aa, Entamoeba invadens
SEINY

SEQ ID NO: 2904475 - protein, 6 aa, Entamoeba invadens
SEIPEN

SEQ ID NO: 2904476 - protein, 10 aa, Entamoeba invadens
SEIPGISKSD

SEQ ID NO: 2904477 - protein, 10 aa, Entamoeba invadens
SEIPNPVKST

SEQ ID NO: 2904478 - protein, 21 aa, Entamoeba invadens
SEIRGEDEKVDLSRYGETAYE

SEQ ID NO: 2904479 - protein, 7 aa, Entamoeba invadens
SEIRGGL

SEQ ID NO: 2904480 - protein, 13 aa, Entamoeba invadens
SEIRNNGEKESSC

SEQ ID NO: 2904481 - protein, 13 aa, Entamoeba invadens
SEIRSDEEKESSC

SEQ ID NO: 2904482 - protein, 5 aa, Entamoeba invadens
SEISF

SEQ ID NO: 2904483 - protein, 5 aa, Entamoeba invadens
SEISN

SEQ ID NO: 2904484 - protein, 6 aa, Entamoeba invadens
SEISPP

SEQ ID NO: 2904485 - protein, 4 aa, Entamoeba invadens
SEIT

SEQ ID NO: 2904486 - protein, 5 aa, Entamoeba invadens
SEITK

SEQ ID NO: 2904487 - protein, 5 aa, Entamoeba invadens
SEITR

SEQ ID NO: 2904488 - protein, 14 aa, Entamoeba invadens
SEITSNEKNIGTKS

SEQ ID NO: 2904489 - protein, 17 aa, Entamoeba invadens
SEITSNGKELTRGQRDA

SEQ ID NO: 2904490 - protein, 12 aa, Entamoeba invadens
SEITTKPTDASI

SEQ ID NO: 2904491 - protein, 19 aa, Entamoeba invadens
SEITTSSDSTTSKAKTLPF

SEQ ID NO: 2904492 - protein, 12 aa, Entamoeba invadens
SEKAGDMDGDDF

SEQ ID NO: 2904493 - protein, 14 aa, Entamoeba invadens
SEKAKELSVGDESI

SEQ ID NO: 2904494 - protein, 6 aa, Entamoeba invadens
SEKAKN

SEQ ID NO: 2904495 - protein, 9 aa, Entamoeba invadens
SEKATCPQR

SEQ ID NO: 2904496 - protein, 8 aa, Entamoeba invadens
SEKAVRKP

SEQ ID NO: 2904497 - protein, 15 aa, Entamoeba invadens
SEKCEAGYYQSGVDC

SEQ ID NO: 2904498 - protein, 4 aa, Entamoeba invadens
SEKD

SEQ ID NO: 2904499 - protein, 16 aa, Entamoeba invadens
SEKDDWAQGSSEFDDK

SEQ ID NO: 2904500 - protein, 12 aa, Entamoeba invadens
SEKDELEDKNRK

SEQ ID NO: 2904501 - protein, 13 aa, Entamoeba invadens
SEKDELEDKNRKL

SEQ ID NO: 2904502 - protein, 17 aa, Entamoeba invadens
SEKDGQVEEDIRENSGK

SEQ ID NO: 2904503 - protein, 7 aa, Entamoeba invadens
SEKDGSV

SEQ ID NO: 2904504 - protein, 9 aa, Entamoeba invadens
SEKDHEVKE

SEQ ID NO: 2904505 - protein, 8 aa, Entamoeba invadens
SEKDKDPE

SEQ ID NO: 2904506 - protein, 6 aa, Entamoeba invadens
SEKDNP

SEQ ID NO: 2904507 - protein, 16 aa, Entamoeba invadens
SEKDPSGKKGKTFGER

SEQ ID NO: 2904508 - protein, 8 aa, Entamoeba invadens
SEKDPTNA

SEQ ID NO: 2904509 - protein, 15 aa, Entamoeba invadens
SEKDQRNSSEKEFSS

SEQ ID NO: 2904510 - protein, 9 aa, Entamoeba invadens
SEKDQTIKN

SEQ ID NO: 2904511 - protein, 6 aa, Entamoeba invadens
SEKDSG

SEQ ID NO: 2904512 - protein, 10 aa, Entamoeba invadens
SEKDTIKRGT

SEQ ID NO: 2904513 - protein, 10 aa, Entamoeba invadens
SEKEAESQIS

SEQ ID NO: 2904514 - protein, 7 aa, Entamoeba invadens
SEKEAVE

SEQ ID NO: 2904515 - protein, 12 aa, Entamoeba invadens
SEKEAVNSKDGK

SEQ ID NO: 2904516 - protein, 21 aa, Entamoeba invadens
SEKECPDCRGRGEHVDEKDRC

SEQ ID NO: 2904517 - protein, 7 aa, Entamoeba invadens
SEKEENY

SEQ ID NO: 2904518 - protein, 8 aa, Entamoeba invadens
SEKEGSLN

SEQ ID NO: 2904519 - protein, 7 aa, Entamoeba invadens
SEKEKIE

SEQ ID NO: 2904520 - protein, 18 aa, Entamoeba invadens
SEKEKKKIEEESTANASE

SEQ ID NO: 2904521 - protein, 6 aa, Entamoeba invadens
SEKEKL

SEQ ID NO: 2904522 - protein, 7 aa, Entamoeba invadens
SEKEKNE

SEQ ID NO: 2904523 - protein, 6 aa, Entamoeba invadens
SEKELT

SEQ ID NO: 2904524 - protein, 8 aa, Entamoeba invadens
SEKEPSAA

SEQ ID NO: 2904525 - protein, 7 aa, Entamoeba invadens
SEKESCQ

SEQ ID NO: 2904526 - protein, 8 aa, Entamoeba invadens
SEKESEPF

SEQ ID NO: 2904527 - protein, 9 aa, Entamoeba invadens
SEKETERMT

SEQ ID NO: 2904528 - protein, 6 aa, Entamoeba invadens
SEKETQ

SEQ ID NO: 2904529 - protein, 6 aa, Entamoeba invadens
SEKFPG

SEQ ID NO: 2904530 - protein, 7 aa, Entamoeba invadens
SEKFSKE

SEQ ID NO: 2904531 - protein, 7 aa, Entamoeba invadens
SEKGKYY

SEQ ID NO: 2904532 - protein, 5 aa, Entamoeba invadens
SEKGL

SEQ ID NO: 2904533 - protein, 5 aa, Entamoeba invadens
SEKGP

SEQ ID NO: 2904534 - protein, 7 aa, Entamoeba invadens
SEKGWDT

SEQ ID NO: 2904535 - protein, 8 aa, Entamoeba invadens
SEKGYAQA

SEQ ID NO: 2904536 - protein, 5 aa, Entamoeba invadens
SEKHK

SEQ ID NO: 2904537 - protein, 5 aa, Entamoeba invadens
SEKHS

SEQ ID NO: 2904538 - protein, 8 aa, Entamoeba invadens
SEKIGEGS

SEQ ID NO: 2904539 - protein, 10 aa, Entamoeba invadens
SEKKAQSVES

SEQ ID NO: 2904540 - protein, 7 aa, Entamoeba invadens
SEKKELE

SEQ ID NO: 2904541 - protein, 17 aa, Entamoeba invadens
SEKKEVKHQEKETLQKD

SEQ ID NO: 2904542 - protein, 11 aa, Entamoeba invadens
SEKKKRKAEDK

SEQ ID NO: 2904543 - protein, 14 aa, Entamoeba invadens
SEKKQPSSSEDVQL

SEQ ID NO: 2904544 - protein, 7 aa, Entamoeba invadens
SEKKRKT

SEQ ID NO: 2904545 - protein, 6 aa, Entamoeba invadens
SEKKSE

SEQ ID NO: 2904546 - protein, 4 aa, Entamoeba invadens
SEKL

SEQ ID NO: 2904547 - protein, 11 aa, Entamoeba invadens
SEKLNSSFTQS

SEQ ID NO: 2904548 - protein, 7 aa, Entamoeba invadens
SEKLPNE

SEQ ID NO: 2904549 - protein, 5 aa, Entamoeba invadens
SEKLT

SEQ ID NO: 2904550 - protein, 13 aa, Entamoeba invadens
SEKMEKDKQLNTR

SEQ ID NO: 2904551 - protein, 8 aa, Entamoeba invadens
SEKNNLMG

SEQ ID NO: 2904552 - protein, 12 aa, Entamoeba invadens
SEKNSTTNVDST

SEQ ID NO: 2904553 - protein, 16 aa, Entamoeba invadens
SEKNTEDVNESQKSEE

SEQ ID NO: 2904554 - protein, 10 aa, Entamoeba invadens
SEKNYPRRRT

SEQ ID NO: 2904555 - protein, 9 aa, Entamoeba invadens
SEKPIAEGA

SEQ ID NO: 2904556 - protein, 6 aa, Entamoeba invadens
SEKPLP

SEQ ID NO: 2904557 - protein, 6 aa, Entamoeba invadens
SEKQCP

SEQ ID NO: 2904558 - protein, 7 aa, Entamoeba invadens
SEKQCPD

SEQ ID NO: 2904559 - protein, 6 aa, Entamoeba invadens
SEKQIW

SEQ ID NO: 2904560 - protein, 5 aa, Entamoeba invadens
SEKQR

SEQ ID NO: 2904561 - protein, 5 aa, Entamoeba invadens
SEKRL

SEQ ID NO: 2904562 - protein, 5 aa, Entamoeba invadens
SEKRQ

SEQ ID NO: 2904563 - protein, 4 aa, Entamoeba invadens
SEKS

SEQ ID NO: 2904564 - protein, 18 aa, Entamoeba invadens
SEKSHQIEKDKKNKNDER

SEQ ID NO: 2904565 - protein, 8 aa, Entamoeba invadens
SEKSHVGV

SEQ ID NO: 2904566 - protein, 7 aa, Entamoeba invadens
SEKSKAD

SEQ ID NO: 2904567 - protein, 17 aa, Entamoeba invadens
SEKSLNASNYLLPKRYG

SEQ ID NO: 2904568 - protein, 5 aa, Entamoeba invadens
SEKSN

SEQ ID NO: 2904569 - protein, 36 aa, Entamoeba invadens
SEKSQKAEKEKQEDTNEKKSVKKPKLRDDTDDEFKR

SEQ ID NO: 2904570 - protein, 37 aa, Entamoeba invadens
SEKSQKAEKEKQEDTNEKKSVKKPKLRDDTDDEFKRI

SEQ ID NO: 2904571 - protein, 7 aa, Entamoeba invadens
SEKSQKE

SEQ ID NO: 2904572 - protein, 9 aa, Entamoeba invadens
SEKSQKKPL

SEQ ID NO: 2904573 - protein, 8 aa, Entamoeba invadens
SEKSSVKF

SEQ ID NO: 2904574 - protein, 7 aa, Entamoeba invadens
SEKSVRD

SEQ ID NO: 2904575 - protein, 4 aa, Entamoeba invadens
SEKT

SEQ ID NO: 2904576 - protein, 7 aa, Entamoeba invadens
SEKTDGV

SEQ ID NO: 2904577 - protein, 15 aa, Entamoeba invadens
SEKTGEVQTSLNEQA

SEQ ID NO: 2904578 - protein, 5 aa, Entamoeba invadens
SEKTK

SEQ ID NO: 2904579 - protein, 12 aa, Entamoeba invadens
SEKTKKVVNESE

SEQ ID NO: 2904580 - protein, 10 aa, Entamoeba invadens
SEKTKSGRTG

SEQ ID NO: 2904581 - protein, 7 aa, Entamoeba invadens
SEKTQMK

SEQ ID NO: 2904582 - protein, 5 aa, Entamoeba invadens
SEKTS

SEQ ID NO: 2904583 - protein, 8 aa, Entamoeba invadens
SEKTTGLS

SEQ ID NO: 2904584 - protein, 16 aa, Entamoeba invadens
SEKTTSSFNDISPTRT

SEQ ID NO: 2904585 - protein, 4 aa, Entamoeba invadens
SEKV

SEQ ID NO: 2904586 - protein, 6 aa, Entamoeba invadens
SEKVGM

SEQ ID NO: 2904587 - protein, 6 aa, Entamoeba invadens
SEKYDV

SEQ ID NO: 2904588 - protein, 8 aa, Entamoeba invadens
SEKYEKEK

SEQ ID NO: 2904589 - protein, 4 aa, Entamoeba invadens
SELC

SEQ ID NO: 2904590 - protein, 14 aa, Entamoeba invadens
SELDQEKKDHAKTQ

SEQ ID NO: 2904591 - protein, 6 aa, Entamoeba invadens
SELDSA

SEQ ID NO: 2904592 - protein, 19 aa, Entamoeba invadens
SELEKAESVTPNVTEHSDD

SEQ ID NO: 2904593 - protein, 6 aa, Entamoeba invadens
SELGDG

SEQ ID NO: 2904594 - protein, 10 aa, Entamoeba invadens
SELGRKKSQM

SEQ ID NO: 2904595 - protein, 4 aa, Entamoeba invadens
SELH

SEQ ID NO: 2904596 - protein, 4 aa, Entamoeba invadens
SELI

SEQ ID NO: 2904597 - protein, 17 aa, Entamoeba invadens
SELIDTKSQLEKTTRRC

SEQ ID NO: 2904598 - protein, 7 aa, Entamoeba invadens
SELKGDD

SEQ ID NO: 2904599 - protein, 35 aa, Entamoeba invadens
SELKKASSSGTPSPLPTTTSPLPPSSPLPTATPPV

SEQ ID NO: 2904600 - protein, 6 aa, Entamoeba invadens
SELKKE

SEQ ID NO: 2904601 - protein, 25 aa, Entamoeba invadens
SELKRELEKTKKELDALSKRQKYYG

SEQ ID NO: 2904602 - protein, 10 aa, Entamoeba invadens
SELKTSKYKV

SEQ ID NO: 2904603 - protein, 7 aa, Entamoeba invadens
SELKTTM

SEQ ID NO: 2904604 - protein, 17 aa, Entamoeba invadens
SELLTNEQRSQAENSLK

SEQ ID NO: 2904605 - protein, 6 aa, Entamoeba invadens
SELNPT

SEQ ID NO: 2904606 - protein, 7 aa, Entamoeba invadens
SELPDEE

SEQ ID NO: 2904607 - protein, 11 aa, Entamoeba invadens
SELPQQEKSEL

SEQ ID NO: 2904608 - protein, 12 aa, Entamoeba invadens
SELPSADSMEEV

SEQ ID NO: 2904609 - protein, 6 aa, Entamoeba invadens
SELPSP

SEQ ID NO: 2904610 - protein, 8 aa, Entamoeba invadens
SELPTEDD

SEQ ID NO: 2904611 - protein, 10 aa, Entamoeba invadens
SELSDSPSGF

SEQ ID NO: 2904612 - protein, 46 aa, Entamoeba invadens
SELSENIESSEDHRIEQEEKDVKDEKESDNELEKRIEDAEESSEAY

SEQ ID NO: 2904613 - protein, 11 aa, Entamoeba invadens
SELSGGEQQRV

SEQ ID NO: 2904614 - protein, 6 aa, Entamoeba invadens
SELSRD

SEQ ID NO: 2904615 - protein, 4 aa, Entamoeba invadens
SELT

SEQ ID NO: 2904616 - protein, 9 aa, Entamoeba invadens
SELTERSED

SEQ ID NO: 2904617 - protein, 6 aa, Entamoeba invadens
SELTQK

SEQ ID NO: 2904618 - protein, 6 aa, Entamoeba invadens
SEMDTS

SEQ ID NO: 2904619 - protein, 28 aa, Entamoeba invadens
SEMEKEDEEAEQGDNANNVEEAQNEEEQ

SEQ ID NO: 2904620 - protein, 11 aa, Entamoeba invadens
SEMEKSNNINV

SEQ ID NO: 2904621 - protein, 8 aa, Entamoeba invadens
SEMETKTK

SEQ ID NO: 2904622 - protein, 10 aa, Entamoeba invadens
SEMKKADSPL

SEQ ID NO: 2904623 - protein, 18 aa, Entamoeba invadens
SEMKSTTYIPQRDCTTPV

SEQ ID NO: 2904624 - protein, 4 aa, Entamoeba invadens
SEMN

SEQ ID NO: 2904625 - protein, 8 aa, Entamoeba invadens
SEMNGRDQ

SEQ ID NO: 2904626 - protein, 4 aa, Entamoeba invadens
SEMP

SEQ ID NO: 2904627 - protein, 10 aa, Entamoeba invadens
SEMPDTQKNL

SEQ ID NO: 2904628 - protein, 9 aa, Entamoeba invadens
SEMPKTQNV

SEQ ID NO: 2904629 - protein, 13 aa, Entamoeba invadens
SEMPRSMSPHNES

SEQ ID NO: 2904630 - protein, 6 aa, Entamoeba invadens
SEMPSF

SEQ ID NO: 2904631 - protein, 13 aa, Entamoeba invadens
SEMSVNDTNTPQI

SEQ ID NO: 2904632 - protein, 14 aa, Entamoeba invadens
SEMTETYATTEREL

SEQ ID NO: 2904633 - protein, 6 aa, Entamoeba invadens
SEMTTT

SEQ ID NO: 2904634 - protein, 8 aa, Entamoeba invadens
SENAESLK

SEQ ID NO: 2904635 - protein, 5 aa, Entamoeba invadens
SENAF

SEQ ID NO: 2904636 - protein, 61 aa, Entamoeba invadens
SENAPLSPQENSIEKSPNNSTKNSKPIRPPQTEIKENAKTQKKEKKETKRKKIPKWTTDED

SEQ ID NO: 2904637 - protein, 4 aa, Entamoeba invadens
SEND

SEQ ID NO: 2904638 - protein, 19 aa, Entamoeba invadens
SENDELTARGVDSKITGKT

SEQ ID NO: 2904639 - protein, 7 aa, Entamoeba invadens
SENDENN

SEQ ID NO: 2904640 - protein, 8 aa, Entamoeba invadens
SENDKLRR

SEQ ID NO: 2904641 - protein, 16 aa, Entamoeba invadens
SENDKRKLRELGQKTR

SEQ ID NO: 2904642 - protein, 11 aa, Entamoeba invadens
SENDKRKLREV

SEQ ID NO: 2904643 - protein, 9 aa, Entamoeba invadens
SENDTDGPM

SEQ ID NO: 2904644 - protein, 4 aa, Entamoeba invadens
SENE

SEQ ID NO: 2904645 - protein, 13 aa, Entamoeba invadens
SENEEIEDNTNFN

SEQ ID NO: 2904646 - protein, 6 aa, Entamoeba invadens
SENEIE

SEQ ID NO: 2904647 - protein, 16 aa, Entamoeba invadens
SENEKCENNEDENSMS

SEQ ID NO: 2904648 - protein, 8 aa, Entamoeba invadens
SENEKNEI

SEQ ID NO: 2904649 - protein, 5 aa, Entamoeba invadens
SENER

SEQ ID NO: 2904650 - protein, 8 aa, Entamoeba invadens
SENESTSR

SEQ ID NO: 2904651 - protein, 7 aa, Entamoeba invadens
SENETPV

SEQ ID NO: 2904652 - protein, 4 aa, Entamoeba invadens
SENF

SEQ ID NO: 2904653 - protein, 8 aa, Entamoeba invadens
SENFGNQK

SEQ ID NO: 2904654 - protein, 10 aa, Entamoeba invadens
SENGENDELG

SEQ ID NO: 2904655 - protein, 8 aa, Entamoeba invadens
SENGGALA

SEQ ID NO: 2904656 - protein, 7 aa, Entamoeba invadens
SENGIAE

SEQ ID NO: 2904657 - protein, 5 aa, Entamoeba invadens
SENGK

SEQ ID NO: 2904658 - protein, 8 aa, Entamoeba invadens
SENGNGTA

SEQ ID NO: 2904659 - protein, 9 aa, Entamoeba invadens
SENGTTHTI

SEQ ID NO: 2904660 - protein, 12 aa, Entamoeba invadens
SENIGEKLTINW

SEQ ID NO: 2904661 - protein, 7 aa, Entamoeba invadens
SENIPEK

SEQ ID NO: 2904662 - protein, 13 aa, Entamoeba invadens
SENIPVKEYQPEH

SEQ ID NO: 2904663 - protein, 7 aa, Entamoeba invadens
SENKDDW

SEQ ID NO: 2904664 - protein, 8 aa, Entamoeba invadens
SENKDNWK

SEQ ID NO: 2904665 - protein, 7 aa, Entamoeba invadens
SENKEFE

SEQ ID NO: 2904666 - protein, 12 aa, Entamoeba invadens
SENKRKAKEAEM

SEQ ID NO: 2904667 - protein, 19 aa, Entamoeba invadens
SENKSTQPHQTDPSRKKRI

SEQ ID NO: 2904668 - protein, 9 aa, Entamoeba invadens
SENLQGTSE

SEQ ID NO: 2904669 - protein, 9 aa, Entamoeba invadens
SENLRKGKY

SEQ ID NO: 2904670 - protein, 6 aa, Entamoeba invadens
SENNDW

SEQ ID NO: 2904671 - protein, 10 aa, Entamoeba invadens
SENNEVNESK

SEQ ID NO: 2904672 - protein, 16 aa, Entamoeba invadens
SENNSVEKIEAEKSAT

SEQ ID NO: 2904673 - protein, 9 aa, Entamoeba invadens
SENPCGDAR

SEQ ID NO: 2904674 - protein, 5 aa, Entamoeba invadens
SENPE

SEQ ID NO: 2904675 - protein, 19 aa, Entamoeba invadens
SENPEKFKKTAKEWTKLYA

SEQ ID NO: 2904676 - protein, 16 aa, Entamoeba invadens
SENPFPFSTQDKERDI

SEQ ID NO: 2904677 - protein, 8 aa, Entamoeba invadens
SENPKCQK

SEQ ID NO: 2904678 - protein, 27 aa, Entamoeba invadens
SENPVDKKEEKEEKVVEKKEELPTRVG

SEQ ID NO: 2904679 - protein, 11 aa, Entamoeba invadens
SENQEASFQNY

SEQ ID NO: 2904680 - protein, 12 aa, Entamoeba invadens
SENQMDGKGISA

SEQ ID NO: 2904681 - protein, 7 aa, Entamoeba invadens
SENQNVN

SEQ ID NO: 2904682 - protein, 5 aa, Entamoeba invadens
SENQS

SEQ ID NO: 2904683 - protein, 5 aa, Entamoeba invadens
SENQT

SEQ ID NO: 2904684 - protein, 9 aa, Entamoeba invadens
SENRASPNI

SEQ ID NO: 2904685 - protein, 6 aa, Entamoeba invadens
SENRTF

SEQ ID NO: 2904686 - protein, 16 aa, Entamoeba invadens
SENSDNKEVNEEDPVL

SEQ ID NO: 2904687 - protein, 8 aa, Entamoeba invadens
SENSELKV

SEQ ID NO: 2904688 - protein, 5 aa, Entamoeba invadens
SENSF

SEQ ID NO: 2904689 - protein, 14 aa, Entamoeba invadens
SENSITSSFSDEKN

SEQ ID NO: 2904690 - protein, 10 aa, Entamoeba invadens
SENSLREKMS

SEQ ID NO: 2904691 - protein, 20 aa, Entamoeba invadens
SENSPKFSDIATQNDETKVK

SEQ ID NO: 2904692 - protein, 7 aa, Entamoeba invadens
SENSYYR

SEQ ID NO: 2904693 - protein, 12 aa, Entamoeba invadens
SENTEKGKLEEV

SEQ ID NO: 2904694 - protein, 7 aa, Entamoeba invadens
SENTGGL

SEQ ID NO: 2904695 - protein, 5 aa, Entamoeba invadens
SENTI

SEQ ID NO: 2904696 - protein, 8 aa, Entamoeba invadens
SENTPTTQ

SEQ ID NO: 2904697 - protein, 6 aa, Entamoeba invadens
SENTQE

SEQ ID NO: 2904698 - protein, 9 aa, Entamoeba invadens
SENTSVEPK

SEQ ID NO: 2904699 - protein, 6 aa, Entamoeba invadens
SENTTV

SEQ ID NO: 2904700 - protein, 5 aa, Entamoeba invadens
SENVT

SEQ ID NO: 2904701 - protein, 18 aa, Entamoeba invadens
SEPDVQPQYDNQMTGFEQ

SEQ ID NO: 2904702 - protein, 4 aa, Entamoeba invadens
SEPF

SEQ ID NO: 2904703 - protein, 7 aa, Entamoeba invadens
SEPFQNS

SEQ ID NO: 2904704 - protein, 9 aa, Entamoeba invadens
SEPGNETSL

SEQ ID NO: 2904705 - protein, 7 aa, Entamoeba invadens
SEPINST

SEQ ID NO: 2904706 - protein, 8 aa, Entamoeba invadens
SEPIREPQ

SEQ ID NO: 2904707 - protein, 4 aa, Entamoeba invadens
SEPK

SEQ ID NO: 2904708 - protein, 6 aa, Entamoeba invadens
SEPKEL

SEQ ID NO: 2904709 - protein, 6 aa, Entamoeba invadens
SEPKIA

SEQ ID NO: 2904710 - protein, 5 aa, Entamoeba invadens
SEPKK

SEQ ID NO: 2904711 - protein, 17 aa, Entamoeba invadens
SEPLDIKESTNYREETE

SEQ ID NO: 2904712 - protein, 74 aa, Entamoeba invadens
SEPLPASVTPKAQRPLPPRPGTPPSPSRQHRPFTPPSPLQHRPGGRQRLGSDYEDPDEVNRQRAQMAGSSQEDI

SEQ ID NO: 2904713 - protein, 5 aa, Entamoeba invadens
SEPNP

SEQ ID NO: 2904714 - protein, 4 aa, Entamoeba invadens
SEPP

SEQ ID NO: 2904715 - protein, 8 aa, Entamoeba invadens
SEPPIPNK

SEQ ID NO: 2904716 - protein, 9 aa, Entamoeba invadens
SEPSGEFGS

SEQ ID NO: 2904717 - protein, 4 aa, Entamoeba invadens
SEPT

SEQ ID NO: 2904718 - protein, 6 aa, Entamoeba invadens
SEPTAQ

SEQ ID NO: 2904719 - protein, 6 aa, Entamoeba invadens
SEPTEY

SEQ ID NO: 2904720 - protein, 16 aa, Entamoeba invadens
SEPTKPKESPQTNTIS

SEQ ID NO: 2904721 - protein, 6 aa, Entamoeba invadens
SEPTPL

SEQ ID NO: 2904722 - protein, 6 aa, Entamoeba invadens
SEPTRL

SEQ ID NO: 2904723 - protein, 4 aa, Entamoeba invadens
SEPV

SEQ ID NO: 2904724 - protein, 14 aa, Entamoeba invadens
SEPYRNNGKDNAGY

SEQ ID NO: 2904725 - protein, 5 aa, Entamoeba invadens
SEQDA

SEQ ID NO: 2904726 - protein, 6 aa, Entamoeba invadens
SEQDCN

SEQ ID NO: 2904727 - protein, 5 aa, Entamoeba invadens
SEQDI

SEQ ID NO: 2904728 - protein, 18 aa, Entamoeba invadens
SEQDNRNSTTSGSPTKLE

SEQ ID NO: 2904729 - protein, 21 aa, Entamoeba invadens
SEQERQSEYLREGPYVSSEEG

SEQ ID NO: 2904730 - protein, 4 aa, Entamoeba invadens
SEQG

SEQ ID NO: 2904731 - protein, 11 aa, Entamoeba invadens
SEQGASQFSQN

SEQ ID NO: 2904732 - protein, 9 aa, Entamoeba invadens
SEQGKTIDS

SEQ ID NO: 2904733 - protein, 11 aa, Entamoeba invadens
SEQGMTGGEHS

SEQ ID NO: 2904734 - protein, 4 aa, Entamoeba invadens
SEQH

SEQ ID NO: 2904735 - protein, 6 aa, Entamoeba invadens
SEQKNI

SEQ ID NO: 2904736 - protein, 7 aa, Entamoeba invadens
SEQKSDQ

SEQ ID NO: 2904737 - protein, 7 aa, Entamoeba invadens
SEQKTNY

SEQ ID NO: 2904738 - protein, 11 aa, Entamoeba invadens
SEQKYKEKGFT

SEQ ID NO: 2904739 - protein, 11 aa, Entamoeba invadens
SEQLKKRSSRI

SEQ ID NO: 2904740 - protein, 11 aa, Entamoeba invadens
SEQLSEKNNEY

SEQ ID NO: 2904741 - protein, 10 aa, Entamoeba invadens
SEQMPKHKEN

SEQ ID NO: 2904742 - protein, 18 aa, Entamoeba invadens
SEQMSNEEHHQTFHPIYM

SEQ ID NO: 2904743 - protein, 5 aa, Entamoeba invadens
SEQND

SEQ ID NO: 2904744 - protein, 13 aa, Entamoeba invadens
SEQNEINKMTTRN

SEQ ID NO: 2904745 - protein, 8 aa, Entamoeba invadens
SEQNELDA

SEQ ID NO: 2904746 - protein, 8 aa, Entamoeba invadens
SEQNESMR

SEQ ID NO: 2904747 - protein, 6 aa, Entamoeba invadens
SEQPLT

SEQ ID NO: 2904748 - protein, 7 aa, Entamoeba invadens
SEQPTNG

SEQ ID NO: 2904749 - protein, 5 aa, Entamoeba invadens
SEQQM

SEQ ID NO: 2904750 - protein, 12 aa, Entamoeba invadens
SEQQVDDALSRK

SEQ ID NO: 2904751 - protein, 13 aa, Entamoeba invadens
SEQTQLNVSQQTY

SEQ ID NO: 2904752 - protein, 7 aa, Entamoeba invadens
SEQTSNN

SEQ ID NO: 2904753 - protein, 6 aa, Entamoeba invadens
SEQTYH

SEQ ID NO: 2904754 - protein, 6 aa, Entamoeba invadens
SERANI

SEQ ID NO: 2904755 - protein, 15 aa, Entamoeba invadens
SERDARGTPLESPTR

SEQ ID NO: 2904756 - protein, 6 aa, Entamoeba invadens
SERDKT

SEQ ID NO: 2904757 - protein, 4 aa, Entamoeba invadens
SERE

SEQ ID NO: 2904758 - protein, 17 aa, Entamoeba invadens
SEREELSQDEKNRSDGL

SEQ ID NO: 2904759 - protein, 4 aa, Entamoeba invadens
SERF

SEQ ID NO: 2904760 - protein, 5 aa, Entamoeba invadens
SERFK

SEQ ID NO: 2904761 - protein, 4 aa, Entamoeba invadens
SERG

SEQ ID NO: 2904762 - protein, 4 aa, Entamoeba invadens
SERH

SEQ ID NO: 2904763 - protein, 19 aa, Entamoeba invadens
SERHENESQLLESPNKEIE

SEQ ID NO: 2904764 - protein, 10 aa, Entamoeba invadens
SERKGIVQTK

SEQ ID NO: 2904765 - protein, 9 aa, Entamoeba invadens
SERKGMVQT

SEQ ID NO: 2904766 - protein, 9 aa, Entamoeba invadens
SERKKNDEL

SEQ ID NO: 2904767 - protein, 7 aa, Entamoeba invadens
SERKKQV

SEQ ID NO: 2904768 - protein, 8 aa, Entamoeba invadens
SERKNSVD

SEQ ID NO: 2904769 - protein, 6 aa, Entamoeba invadens
SERKQF

SEQ ID NO: 2904770 - protein, 10 aa, Entamoeba invadens
SERKRASSLS

SEQ ID NO: 2904771 - protein, 9 aa, Entamoeba invadens
SERKRGFSL

SEQ ID NO: 2904772 - protein, 4 aa, Entamoeba invadens
SERL

SEQ ID NO: 2904773 - protein, 6 aa, Entamoeba invadens
SERLDG

SEQ ID NO: 2904774 - protein, 19 aa, Entamoeba invadens
SERLETKARLAGKLSSAKI

SEQ ID NO: 2904775 - protein, 5 aa, Entamoeba invadens
SERLN

SEQ ID NO: 2904776 - protein, 19 aa, Entamoeba invadens
SERLTASKSNITEDITNNE

SEQ ID NO: 2904777 - protein, 15 aa, Entamoeba invadens
SERLYSSEDFDDERV

SEQ ID NO: 2904778 - protein, 10 aa, Entamoeba invadens
SERNKQVTTQ

SEQ ID NO: 2904779 - protein, 4 aa, Entamoeba invadens
SERP

SEQ ID NO: 2904780 - protein, 6 aa, Entamoeba invadens
SERPRM

SEQ ID NO: 2904781 - protein, 12 aa, Entamoeba invadens
SERPTGRTSATD

SEQ ID NO: 2904782 - protein, 14 aa, Entamoeba invadens
SERQLEQHAETVTS

SEQ ID NO: 2904783 - protein, 14 aa, Entamoeba invadens
SERRNNDLSWNPQK

SEQ ID NO: 2904784 - protein, 6 aa, Entamoeba invadens
SERRSF

SEQ ID NO: 2904785 - protein, 4 aa, Entamoeba invadens
SERS

SEQ ID NO: 2904786 - protein, 10 aa, Entamoeba invadens
SERSAFSGCE

SEQ ID NO: 2904787 - protein, 6 aa, Entamoeba invadens
SERSGM

SEQ ID NO: 2904788 - protein, 6 aa, Entamoeba invadens
SERSIQ

SEQ ID NO: 2904789 - protein, 10 aa, Entamoeba invadens
SERSRLDTQP

SEQ ID NO: 2904790 - protein, 17 aa, Entamoeba invadens
SERSSPSDLSNSTSPRL

SEQ ID NO: 2904791 - protein, 9 aa, Entamoeba invadens
SERTGKTKR

SEQ ID NO: 2904792 - protein, 5 aa, Entamoeba invadens
SERVG

SEQ ID NO: 2904793 - protein, 11 aa, Entamoeba invadens
SERYSDKYGRL

SEQ ID NO: 2904794 - protein, 7 aa, Entamoeba invadens
SESAKFN

SEQ ID NO: 2904795 - protein, 8 aa, Entamoeba invadens
SESAQKSA

SEQ ID NO: 2904796 - protein, 26 aa, Entamoeba invadens
SESDDDSPGPIATAASKTVESLKGGL

SEQ ID NO: 2904797 - protein, 6 aa, Entamoeba invadens
SESDDL

SEQ ID NO: 2904798 - protein, 8 aa, Entamoeba invadens
SESDEEIR

SEQ ID NO: 2904799 - protein, 6 aa, Entamoeba invadens
SESDEL

SEQ ID NO: 2904800 - protein, 5 aa, Entamoeba invadens
SESDG

SEQ ID NO: 2904801 - protein, 12 aa, Entamoeba invadens
SESDISKATIPS

SEQ ID NO: 2904802 - protein, 12 aa, Entamoeba invadens
SESDKKIKQDTA

SEQ ID NO: 2904803 - protein, 6 aa, Entamoeba invadens
SESDQI

SEQ ID NO: 2904804 - protein, 11 aa, Entamoeba invadens
SESDVSAYEIS

SEQ ID NO: 2904805 - protein, 9 aa, Entamoeba invadens
SESEDIRET

SEQ ID NO: 2904806 - protein, 10 aa, Entamoeba invadens
SESEEEEDVK

SEQ ID NO: 2904807 - protein, 7 aa, Entamoeba invadens
SESEIKE

SEQ ID NO: 2904808 - protein, 8 aa, Entamoeba invadens
SESEISKY

SEQ ID NO: 2904809 - protein, 5 aa, Entamoeba invadens
SESEL

SEQ ID NO: 2904810 - protein, 4 aa, Entamoeba invadens
SESF

SEQ ID NO: 2904811 - protein, 14 aa, Entamoeba invadens
SESFRGGSKMANEK

SEQ ID NO: 2904812 - protein, 6 aa, Entamoeba invadens
SESGPF

SEQ ID NO: 2904813 - protein, 22 aa, Entamoeba invadens
SESGSGAKRDKIGKSPRDTISQ

SEQ ID NO: 2904814 - protein, 5 aa, Entamoeba invadens
SESHL

SEQ ID NO: 2904815 - protein, 9 aa, Entamoeba invadens
SESIDDEDD

SEQ ID NO: 2904816 - protein, 8 aa, Entamoeba invadens
SESKEDAD

SEQ ID NO: 2904817 - protein, 7 aa, Entamoeba invadens
SESKEMT

SEQ ID NO: 2904818 - protein, 30 aa, Entamoeba invadens
SESKKDDNDDNNNDTKLQRPLSASVSSGVA

SEQ ID NO: 2904819 - protein, 12 aa, Entamoeba invadens
SESKRIEKMNNT

SEQ ID NO: 2904820 - protein, 4 aa, Entamoeba invadens
SESL

SEQ ID NO: 2904821 - protein, 6 aa, Entamoeba invadens
SESLEP

SEQ ID NO: 2904822 - protein, 13 aa, Entamoeba invadens
SESLEVSEKLKEN

SEQ ID NO: 2904823 - protein, 9 aa, Entamoeba invadens
SESLQTKHQ

SEQ ID NO: 2904824 - protein, 32 aa, Entamoeba invadens
SESLSDPQTSPHNTPGPRTPRGISTHNSSSSM

SEQ ID NO: 2904825 - protein, 5 aa, Entamoeba invadens
SESMG

SEQ ID NO: 2904826 - protein, 7 aa, Entamoeba invadens
SESMQHG

SEQ ID NO: 2904827 - protein, 4 aa, Entamoeba invadens
SESN

SEQ ID NO: 2904828 - protein, 9 aa, Entamoeba invadens
SESNEISSD

SEQ ID NO: 2904829 - protein, 8 aa, Entamoeba invadens
SESNGIKE

SEQ ID NO: 2904830 - protein, 8 aa, Entamoeba invadens
SESNGVCS

SEQ ID NO: 2904831 - protein, 9 aa, Entamoeba invadens
SESNGVCSE

SEQ ID NO: 2904832 - protein, 8 aa, Entamoeba invadens
SESPDLDE

SEQ ID NO: 2904833 - protein, 8 aa, Entamoeba invadens
SESPEKNL

SEQ ID NO: 2904834 - protein, 5 aa, Entamoeba invadens
SESPF

SEQ ID NO: 2904835 - protein, 13 aa, Entamoeba invadens
SESPNNNGAARVK

SEQ ID NO: 2904836 - protein, 8 aa, Entamoeba invadens
SESQEKVD

SEQ ID NO: 2904837 - protein, 5 aa, Entamoeba invadens
SESQG

SEQ ID NO: 2904838 - protein, 21 aa, Entamoeba invadens
SESQIPTPALGRSIGEEIKPK

SEQ ID NO: 2904839 - protein, 14 aa, Entamoeba invadens
SESQKLKKSVEEME

SEQ ID NO: 2904840 - protein, 11 aa, Entamoeba invadens
SESQKNRANFP

SEQ ID NO: 2904841 - protein, 10 aa, Entamoeba invadens
SESQNARFGK

SEQ ID NO: 2904842 - protein, 10 aa, Entamoeba invadens
SESQSSSVPA

SEQ ID NO: 2904843 - protein, 5 aa, Entamoeba invadens
SESQT

SEQ ID NO: 2904844 - protein, 8 aa, Entamoeba invadens
SESQYRTK

SEQ ID NO: 2904845 - protein, 7 aa, Entamoeba invadens
SESREIS

SEQ ID NO: 2904846 - protein, 7 aa, Entamoeba invadens
SESRIEE

SEQ ID NO: 2904847 - protein, 10 aa, Entamoeba invadens
SESRNDSTIN

SEQ ID NO: 2904848 - protein, 5 aa, Entamoeba invadens
SESSA

SEQ ID NO: 2904849 - protein, 8 aa, Entamoeba invadens
SESSENVM

SEQ ID NO: 2904850 - protein, 25 aa, Entamoeba invadens
SESSMSSSLRGSSRSIASKKSDQQI

SEQ ID NO: 2904851 - protein, 27 aa, Entamoeba invadens
SESSNTDSSDSSDLSDSKPKTRKIPDS

SEQ ID NO: 2904852 - protein, 8 aa, Entamoeba invadens
SESSNTLY

SEQ ID NO: 2904853 - protein, 8 aa, Entamoeba invadens
SESSPRRL

SEQ ID NO: 2904854 - protein, 8 aa, Entamoeba invadens
SESSRYDS

SEQ ID NO: 2904855 - protein, 10 aa, Entamoeba invadens
SESSTTEAGL

SEQ ID NO: 2904856 - protein, 5 aa, Entamoeba invadens
SESSV

SEQ ID NO: 2904857 - protein, 6 aa, Entamoeba invadens
SESTCG

SEQ ID NO: 2904858 - protein, 8 aa, Entamoeba invadens
SESTNDDM

SEQ ID NO: 2904859 - protein, 7 aa, Entamoeba invadens
SESTQEV

SEQ ID NO: 2904860 - protein, 10 aa, Entamoeba invadens
SESTSEDDQL

SEQ ID NO: 2904861 - protein, 4 aa, Entamoeba invadens
SESV

SEQ ID NO: 2904862 - protein, 19 aa, Entamoeba invadens
SESVKTITESYTKGKIYPP

SEQ ID NO: 2904863 - protein, 16 aa, Entamoeba invadens
SESVSEASSSRQSMEG

SEQ ID NO: 2904864 - protein, 5 aa, Entamoeba invadens
SESVT

SEQ ID NO: 2904865 - protein, 11 aa, Entamoeba invadens
SESYSKMRPIR

SEQ ID NO: 2904866 - protein, 5 aa, Entamoeba invadens
SETAA

SEQ ID NO: 2904867 - protein, 9 aa, Entamoeba invadens
SETCPKQTH

SEQ ID NO: 2904868 - protein, 9 aa, Entamoeba invadens
SETDDFDAN

SEQ ID NO: 2904869 - protein, 5 aa, Entamoeba invadens
SETDI

SEQ ID NO: 2904870 - protein, 11 aa, Entamoeba invadens
SETDSKVSKAK

SEQ ID NO: 2904871 - protein, 12 aa, Entamoeba invadens
SETDSSDDDDDA

SEQ ID NO: 2904872 - protein, 5 aa, Entamoeba invadens
SETDT

SEQ ID NO: 2904873 - protein, 12 aa, Entamoeba invadens
SETEDLICGIPF

SEQ ID NO: 2904874 - protein, 8 aa, Entamoeba invadens
SETEKTQL

SEQ ID NO: 2904875 - protein, 6 aa, Entamoeba invadens
SETEVS

SEQ ID NO: 2904876 - protein, 8 aa, Entamoeba invadens
SETFDKDI

SEQ ID NO: 2904877 - protein, 11 aa, Entamoeba invadens
SETFEEDQKED

SEQ ID NO: 2904878 - protein, 4 aa, Entamoeba invadens
SETG

SEQ ID NO: 2904879 - protein, 8 aa, Entamoeba invadens
SETGDSKL

SEQ ID NO: 2904880 - protein, 7 aa, Entamoeba invadens
SETGGNF

SEQ ID NO: 2904881 - protein, 8 aa, Entamoeba invadens
SETGRGNI

SEQ ID NO: 2904882 - protein, 8 aa, Entamoeba invadens
SETIASGI

SEQ ID NO: 2904883 - protein, 10 aa, Entamoeba invadens
SETIDGYEGS

SEQ ID NO: 2904884 - protein, 10 aa, Entamoeba invadens
SETIDSATGN

SEQ ID NO: 2904885 - protein, 15 aa, Entamoeba invadens
SETIDTKKPKTTKNV

SEQ ID NO: 2904886 - protein, 5 aa, Entamoeba invadens
SETIK

SEQ ID NO: 2904887 - protein, 8 aa, Entamoeba invadens
SETIQENK

SEQ ID NO: 2904888 - protein, 5 aa, Entamoeba invadens
SETIT

SEQ ID NO: 2904889 - protein, 5 aa, Entamoeba invadens
SETKQ

SEQ ID NO: 2904890 - protein, 8 aa, Entamoeba invadens
SETKQLTT

SEQ ID NO: 2904891 - protein, 20 aa, Entamoeba invadens
SETKTTTDSADVSKDPTYPK

SEQ ID NO: 2904892 - protein, 5 aa, Entamoeba invadens
SETLG

SEQ ID NO: 2904893 - protein, 5 aa, Entamoeba invadens
SETLN

SEQ ID NO: 2904894 - protein, 8 aa, Entamoeba invadens
SETLSTPL

SEQ ID NO: 2904895 - protein, 6 aa, Entamoeba invadens
SETMPS

SEQ ID NO: 2904896 - protein, 5 aa, Entamoeba invadens
SETND

SEQ ID NO: 2904897 - protein, 8 aa, Entamoeba invadens
SETNGLSE

SEQ ID NO: 2904898 - protein, 7 aa, Entamoeba invadens
SETNGNI

SEQ ID NO: 2904899 - protein, 7 aa, Entamoeba invadens
SETNKAR

SEQ ID NO: 2904900 - protein, 11 aa, Entamoeba invadens
SETNSTSKARL

SEQ ID NO: 2904901 - protein, 6 aa, Entamoeba invadens
SETNTF

SEQ ID NO: 2904902 - protein, 10 aa, Entamoeba invadens
SETPITTNEV

SEQ ID NO: 2904903 - protein, 6 aa, Entamoeba invadens
SETPMP

SEQ ID NO: 2904904 - protein, 4 aa, Entamoeba invadens
SETQ

SEQ ID NO: 2904905 - protein, 9 aa, Entamoeba invadens
SETQKEMKI

SEQ ID NO: 2904906 - protein, 5 aa, Entamoeba invadens
SETRE

SEQ ID NO: 2904907 - protein, 5 aa, Entamoeba invadens
SETRG

SEQ ID NO: 2904908 - protein, 8 aa, Entamoeba invadens
SETRYKGW

SEQ ID NO: 2904909 - protein, 9 aa, Entamoeba invadens
SETSDSQLQ

SEQ ID NO: 2904910 - protein, 5 aa, Entamoeba invadens
SETSF

SEQ ID NO: 2904911 - protein, 10 aa, Entamoeba invadens
SETSSSEVGK

SEQ ID NO: 2904912 - protein, 9 aa, Entamoeba invadens
SETSTRNFS

SEQ ID NO: 2904913 - protein, 26 aa, Entamoeba invadens
SETTDVPGKKDNYQSLDELGKGSFGA

SEQ ID NO: 2904914 - protein, 14 aa, Entamoeba invadens
SETTGREQQITRGS

SEQ ID NO: 2904915 - protein, 5 aa, Entamoeba invadens
SETTR

SEQ ID NO: 2904916 - protein, 6 aa, Entamoeba invadens
SETTTV

SEQ ID NO: 2904917 - protein, 23 aa, Entamoeba invadens
SETVTQSEIDISKEKKPKKSLED

SEQ ID NO: 2904918 - protein, 23 aa, Entamoeba invadens
SETVTQSELDISKEKKPKKNLED

SEQ ID NO: 2904919 - protein, 23 aa, Entamoeba invadens
SETVTQSELDISKEKKPKKSLED

SEQ ID NO: 2904920 - protein, 11 aa, Entamoeba invadens
SETYGEDCETC

SEQ ID NO: 2904921 - protein, 7 aa, Entamoeba invadens
SETYGKE

SEQ ID NO: 2904922 - protein, 16 aa, Entamoeba invadens
SEVAKDVNESIKESER

SEQ ID NO: 2904923 - protein, 17 aa, Entamoeba invadens
SEVDDATTSSSHNSSQI

SEQ ID NO: 2904924 - protein, 5 aa, Entamoeba invadens
SEVDR

SEQ ID NO: 2904925 - protein, 6 aa, Entamoeba invadens
SEVEEK

SEQ ID NO: 2904926 - protein, 8 aa, Entamoeba invadens
SEVENCGD

SEQ ID NO: 2904927 - protein, 6 aa, Entamoeba invadens
SEVENR

SEQ ID NO: 2904928 - protein, 16 aa, Entamoeba invadens
SEVEQGKKKEEELKEQ

SEQ ID NO: 2904929 - protein, 10 aa, Entamoeba invadens
SEVEQKENEL

SEQ ID NO: 2904930 - protein, 12 aa, Entamoeba invadens
SEVGEVNEEGNT

SEQ ID NO: 2904931 - protein, 15 aa, Entamoeba invadens
SEVGISKSQTESVSV

SEQ ID NO: 2904932 - protein, 16 aa, Entamoeba invadens
SEVGPNRRAIEEASKY

SEQ ID NO: 2904933 - protein, 9 aa, Entamoeba invadens
SEVKQTQTV

SEQ ID NO: 2904934 - protein, 11 aa, Entamoeba invadens
SEVKSIENKDT

SEQ ID NO: 2904935 - protein, 6 aa, Entamoeba invadens
SEVNGE

SEQ ID NO: 2904936 - protein, 12 aa, Entamoeba invadens
SEVNGSDGKIEE

SEQ ID NO: 2904937 - protein, 9 aa, Entamoeba invadens
SEVNGSGKH

SEQ ID NO: 2904938 - protein, 8 aa, Entamoeba invadens
SEVNRSNV

SEQ ID NO: 2904939 - protein, 26 aa, Entamoeba invadens
SEVNSSNIVQPNQGIQNTQVTQSPRI

SEQ ID NO: 2904940 - protein, 10 aa, Entamoeba invadens
SEVPNGKTDY

SEQ ID NO: 2904941 - protein, 5 aa, Entamoeba invadens
SEVQE

SEQ ID NO: 2904942 - protein, 8 aa, Entamoeba invadens
SEVQGSTE

SEQ ID NO: 2904943 - protein, 4 aa, Entamoeba invadens
SEVR

SEQ ID NO: 2904944 - protein, 4 aa, Entamoeba invadens
SEVS

SEQ ID NO: 2904945 - protein, 13 aa, Entamoeba invadens
SEVSDTEKNKLNC

SEQ ID NO: 2904946 - protein, 16 aa, Entamoeba invadens
SEVSESDSDVSTLQPL

SEQ ID NO: 2904947 - protein, 8 aa, Entamoeba invadens
SEVSNGKF

SEQ ID NO: 2904948 - protein, 21 aa, Entamoeba invadens
SEVTKERVSREMGGESVVSAT

SEQ ID NO: 2904949 - protein, 6 aa, Entamoeba invadens
SEVTTD

SEQ ID NO: 2904950 - protein, 22 aa, Entamoeba invadens
SEVVGGNAADLYQSSENDISET

SEQ ID NO: 2904951 - protein, 14 aa, Entamoeba invadens
SEVVTKAKESEGNM

SEQ ID NO: 2904952 - protein, 10 aa, Entamoeba invadens
SEWDAEKKKS

SEQ ID NO: 2904953 - protein, 10 aa, Entamoeba invadens
SEWDPDSPEW

SEQ ID NO: 2904954 - protein, 7 aa, Entamoeba invadens
SEYDPEK

SEQ ID NO: 2904955 - protein, 13 aa, Entamoeba invadens
SEYDQAPIPTENL

SEQ ID NO: 2904956 - protein, 9 aa, Entamoeba invadens
SEYEDVSKR

SEQ ID NO: 2904957 - protein, 18 aa, Entamoeba invadens
SEYIGNSGSSFGNVSESK

SEQ ID NO: 2904958 - protein, 6 aa, Entamoeba invadens
SEYITQ

SEQ ID NO: 2904959 - protein, 10 aa, Entamoeba invadens
SEYKEPSEPP

SEQ ID NO: 2904960 - protein, 5 aa, Entamoeba invadens
SEYKI

SEQ ID NO: 2904961 - protein, 11 aa, Entamoeba invadens
SEYKKKSSQYE

SEQ ID NO: 2904962 - protein, 11 aa, Entamoeba invadens
SEYKSETSKNL

SEQ ID NO: 2904963 - protein, 5 aa, Entamoeba invadens
SEYNT

SEQ ID NO: 2904964 - protein, 6 aa, Entamoeba invadens
SEYQAN

SEQ ID NO: 2904965 - protein, 10 aa, Entamoeba invadens
SEYRKEVGDN

SEQ ID NO: 2904966 - protein, 4 aa, Entamoeba invadens
SEYT

SEQ ID NO: 2904967 - protein, 23 aa, Entamoeba invadens
SEYTEPMSQNDTDSVAQNSKSDL

SEQ ID NO: 2904968 - protein, 6 aa, Entamoeba invadens
SEYTGT

SEQ ID NO: 2904969 - protein, 6 aa, Entamoeba invadens
SEYTSA

SEQ ID NO: 2904970 - protein, 7 aa, Entamoeba invadens
SEYTSQI

SEQ ID NO: 2904971 - protein, 5 aa, Entamoeba invadens
SFAAQ

SEQ ID NO: 2904972 - protein, 4 aa, Entamoeba invadens
SFAE

SEQ ID NO: 2904973 - protein, 5 aa, Entamoeba invadens
SFAER

SEQ ID NO: 2904974 - protein, 4 aa, Entamoeba invadens
SFAG

SEQ ID NO: 2904975 - protein, 5 aa, Entamoeba invadens
SFAGG

SEQ ID NO: 2904976 - protein, 21 aa, Entamoeba invadens
SFAGPDKFGRKNKKNFRKKIK

SEQ ID NO: 2904977 - protein, 10 aa, Entamoeba invadens
SFAKYATDKM

SEQ ID NO: 2904978 - protein, 29 aa, Entamoeba invadens
SFAPNTDSPSLSKSPTNSITTNNSTSKPK

SEQ ID NO: 2904979 - protein, 12 aa, Entamoeba invadens
SFASAGGYIAAD

SEQ ID NO: 2904980 - protein, 16 aa, Entamoeba invadens
SFASAGGYIASDKKTI

SEQ ID NO: 2904981 - protein, 9 aa, Entamoeba invadens
SFASPTQGQ

SEQ ID NO: 2904982 - protein, 6 aa, Entamoeba invadens
SFDDKD

SEQ ID NO: 2904983 - protein, 20 aa, Entamoeba invadens
SFDDNVRKTLSEELPNLKII

SEQ ID NO: 2904984 - protein, 9 aa, Entamoeba invadens
SFDDPDPWE

SEQ ID NO: 2904985 - protein, 9 aa, Entamoeba invadens
SFDGDNSRN

SEQ ID NO: 2904986 - protein, 4 aa, Entamoeba invadens
SFDK

SEQ ID NO: 2904987 - protein, 6 aa, Entamoeba invadens
SFDNNK

SEQ ID NO: 2904988 - protein, 15 aa, Entamoeba invadens
SFDPKKDKLGSGSFG

SEQ ID NO: 2904989 - protein, 9 aa, Entamoeba invadens
SFDPRYSES

SEQ ID NO: 2904990 - protein, 12 aa, Entamoeba invadens
SFDTKGDESVYS

SEQ ID NO: 2904991 - protein, 6 aa, Entamoeba invadens
SFDTKT

SEQ ID NO: 2904992 - protein, 18 aa, Entamoeba invadens
SFDTTAVRETLEETGITI

SEQ ID NO: 2904993 - protein, 12 aa, Entamoeba invadens
SFEAQQQNACVI

SEQ ID NO: 2904994 - protein, 13 aa, Entamoeba invadens
SFEDAEKKTTTVD

SEQ ID NO: 2904995 - protein, 12 aa, Entamoeba invadens
SFEDDDSIVPDY

SEQ ID NO: 2904996 - protein, 12 aa, Entamoeba invadens
SFEDDKKTRSYE

SEQ ID NO: 2904997 - protein, 15 aa, Entamoeba invadens
SFEDEKEDKEVEIGN

SEQ ID NO: 2904998 - protein, 5 aa, Entamoeba invadens
SFEEI

SEQ ID NO: 2904999 - protein, 10 aa, Entamoeba invadens
SFEEKPHRAV

SEQ ID NO: 2905000 - protein, 5 aa, Entamoeba invadens
SFEES

SEQ ID NO: 2905001 - protein, 13 aa, Entamoeba invadens
SFEESDDQELKAE

SEQ ID NO: 2905002 - protein, 5 aa, Entamoeba invadens
SFEGD

SEQ ID NO: 2905003 - protein, 6 aa, Entamoeba invadens
SFEGKT

SEQ ID NO: 2905004 - protein, 6 aa, Entamoeba invadens
SFEKIE

SEQ ID NO: 2905005 - protein, 5 aa, Entamoeba invadens
SFENC

SEQ ID NO: 2905006 - protein, 5 aa, Entamoeba invadens
SFENG

SEQ ID NO: 2905007 - protein, 22 aa, Entamoeba invadens
SFEPEDTSFERQKAVQRSQEIK

SEQ ID NO: 2905008 - protein, 6 aa, Entamoeba invadens
SFEPNC

SEQ ID NO: 2905009 - protein, 8 aa, Entamoeba invadens
SFEPNSWK

SEQ ID NO: 2905010 - protein, 7 aa, Entamoeba invadens
SFEPTKV

SEQ ID NO: 2905011 - protein, 17 aa, Entamoeba invadens
SFEQPVDVAQTKNKERC

SEQ ID NO: 2905012 - protein, 7 aa, Entamoeba invadens
SFEQSNL

SEQ ID NO: 2905013 - protein, 15 aa, Entamoeba invadens
SFEQTSEKSKAVNYE

SEQ ID NO: 2905014 - protein, 13 aa, Entamoeba invadens
SFERKEDDQKYTL

SEQ ID NO: 2905015 - protein, 8 aa, Entamoeba invadens
SFERREKE

SEQ ID NO: 2905016 - protein, 9 aa, Entamoeba invadens
SFESSSSCS

SEQ ID NO: 2905017 - protein, 6 aa, Entamoeba invadens
SFESTR

SEQ ID NO: 2905018 - protein, 10 aa, Entamoeba invadens
SFESTTDKKR

SEQ ID NO: 2905019 - protein, 6 aa, Entamoeba invadens
SFETEG

SEQ ID NO: 2905020 - protein, 5 aa, Entamoeba invadens
SFETR

SEQ ID NO: 2905021 - protein, 6 aa, Entamoeba invadens
SFGESS

SEQ ID NO: 2905022 - protein, 6 aa, Entamoeba invadens
SFGGEE

SEQ ID NO: 2905023 - protein, 5 aa, Entamoeba invadens
SFGGK

SEQ ID NO: 2905024 - protein, 10 aa, Entamoeba invadens
SFGGPTSPRI

SEQ ID NO: 2905025 - protein, 12 aa, Entamoeba invadens
SFGKNSLENTAI

SEQ ID NO: 2905026 - protein, 7 aa, Entamoeba invadens
SFGPDRE

SEQ ID NO: 2905027 - protein, 5 aa, Entamoeba invadens
SFGPI

SEQ ID NO: 2905028 - protein, 7 aa, Entamoeba invadens
SFGQQKV

SEQ ID NO: 2905029 - protein, 12 aa, Entamoeba invadens
SFGSGGRFDPTK

SEQ ID NO: 2905030 - protein, 6 aa, Entamoeba invadens
SFGTGQ

SEQ ID NO: 2905031 - protein, 11 aa, Entamoeba invadens
SFGTKKHKVSQ

SEQ ID NO: 2905032 - protein, 4 aa, Entamoeba invadens
SFGY

SEQ ID NO: 2905033 - protein, 12 aa, Entamoeba invadens
SFHTPDGPTSEE

SEQ ID NO: 2905034 - protein, 8 aa, Entamoeba invadens
SFKDGYKE

SEQ ID NO: 2905035 - protein, 4 aa, Entamoeba invadens
SFKE

SEQ ID NO: 2905036 - protein, 5 aa, Entamoeba invadens
SFKEE

SEQ ID NO: 2905037 - protein, 26 aa, Entamoeba invadens
SFKEKKKLRTNSAGASDIGARPTNED

SEQ ID NO: 2905038 - protein, 14 aa, Entamoeba invadens
SFKGGDNNIIIEYV

SEQ ID NO: 2905039 - protein, 12 aa, Entamoeba invadens
SFKGGNDETELN

SEQ ID NO: 2905040 - protein, 18 aa, Entamoeba invadens
SFKHTNTSKENSPSVSPA

SEQ ID NO: 2905041 - protein, 92 aa, Entamoeba invadens
SFKKDKQVSHKKKEEKKVEEEEPEVADVSSKEEEKSSQSTQSEEKSKETSEEAPKEVEEKEADDDSSSEAPQDLQTDDKKEVNEEEKKEESF

SEQ ID NO: 2905042 - protein, 8 aa, Entamoeba invadens
SFKNEAKE

SEQ ID NO: 2905043 - protein, 7 aa, Entamoeba invadens
SFKPARE

SEQ ID NO: 2905044 - protein, 5 aa, Entamoeba invadens
SFKRS

SEQ ID NO: 2905045 - protein, 6 aa, Entamoeba invadens
SFKSKG

SEQ ID NO: 2905046 - protein, 7 aa, Entamoeba invadens
SFKSNEG

SEQ ID NO: 2905047 - protein, 9 aa, Entamoeba invadens
SFKTAEKSV

SEQ ID NO: 2905048 - protein, 19 aa, Entamoeba invadens
SFKTGRSKAASAFHNRSQR

SEQ ID NO: 2905049 - protein, 11 aa, Entamoeba invadens
SFKTQKNSKTV

SEQ ID NO: 2905050 - protein, 14 aa, Entamoeba invadens
SFKTSYKNTPKGGV

SEQ ID NO: 2905051 - protein, 6 aa, Entamoeba invadens
SFKTTP

SEQ ID NO: 2905052 - protein, 20 aa, Entamoeba invadens
SFNESVTSYNSDDSSSDDFE

SEQ ID NO: 2905053 - protein, 5 aa, Entamoeba invadens
SFNGC

SEQ ID NO: 2905054 - protein, 13 aa, Entamoeba invadens
SFNSTFGGVSDTH

SEQ ID NO: 2905055 - protein, 6 aa, Entamoeba invadens
SFNTDK

SEQ ID NO: 2905056 - protein, 9 aa, Entamoeba invadens
SFPAGQNAH

SEQ ID NO: 2905057 - protein, 5 aa, Entamoeba invadens
SFPDK

SEQ ID NO: 2905058 - protein, 7 aa, Entamoeba invadens
SFPEKRN

SEQ ID NO: 2905059 - protein, 18 aa, Entamoeba invadens
SFPELTKKQESDRNSITQ

SEQ ID NO: 2905060 - protein, 19 aa, Entamoeba invadens
SFPESTQQNALEESLNQYK

SEQ ID NO: 2905061 - protein, 13 aa, Entamoeba invadens
SFPGESDQAPGII

SEQ ID NO: 2905062 - protein, 10 aa, Entamoeba invadens
SFPKKEDIQG

SEQ ID NO: 2905063 - protein, 5 aa, Entamoeba invadens
SFPLS

SEQ ID NO: 2905064 - protein, 7 aa, Entamoeba invadens
SFPQNTR

SEQ ID NO: 2905065 - protein, 5 aa, Entamoeba invadens
SFPQT

SEQ ID NO: 2905066 - protein, 7 aa, Entamoeba invadens
SFPSKNF

SEQ ID NO: 2905067 - protein, 5 aa, Entamoeba invadens
SFPSN

SEQ ID NO: 2905068 - protein, 5 aa, Entamoeba invadens
SFPST

SEQ ID NO: 2905069 - protein, 5 aa, Entamoeba invadens
SFPTD

SEQ ID NO: 2905070 - protein, 8 aa, Entamoeba invadens
SFPTPKDY

SEQ ID NO: 2905071 - protein, 14 aa, Entamoeba invadens
SFPTQAPPQFPTTT

SEQ ID NO: 2905072 - protein, 12 aa, Entamoeba invadens
SFPTSNFPTFPK

SEQ ID NO: 2905073 - protein, 5 aa, Entamoeba invadens
SFQAD

SEQ ID NO: 2905074 - protein, 5 aa, Entamoeba invadens
SFQAP

SEQ ID NO: 2905075 - protein, 4 aa, Entamoeba invadens
SFQD

SEQ ID NO: 2905076 - protein, 7 aa, Entamoeba invadens
SFQDNNA

SEQ ID NO: 2905077 - protein, 8 aa, Entamoeba invadens
SFQDRPRS

SEQ ID NO: 2905078 - protein, 5 aa, Entamoeba invadens
SFQGD

SEQ ID NO: 2905079 - protein, 14 aa, Entamoeba invadens
SFQGKRPSNEDAEL

SEQ ID NO: 2905080 - protein, 6 aa, Entamoeba invadens
SFQGRE

SEQ ID NO: 2905081 - protein, 5 aa, Entamoeba invadens
SFQHP

SEQ ID NO: 2905082 - protein, 4 aa, Entamoeba invadens
SFQK

SEQ ID NO: 2905083 - protein, 8 aa, Entamoeba invadens
SFQKEDSY

SEQ ID NO: 2905084 - protein, 47 aa, Entamoeba invadens
SFQQKPDSYHDNEPIDYGKPGSYKDNAPQQTTSSQQPPQSQSPKFQF

SEQ ID NO: 2905085 - protein, 8 aa, Entamoeba invadens
SFQQPRYD

SEQ ID NO: 2905086 - protein, 6 aa, Entamoeba invadens
SFQSGQ

SEQ ID NO: 2905087 - protein, 5 aa, Entamoeba invadens
SFQYG

SEQ ID NO: 2905088 - protein, 10 aa, Entamoeba invadens
SFQYTNGGDL

SEQ ID NO: 2905089 - protein, 9 aa, Entamoeba invadens
SFRAPTEIT

SEQ ID NO: 2905090 - protein, 9 aa, Entamoeba invadens
SFRASKAMQ

SEQ ID NO: 2905091 - protein, 11 aa, Entamoeba invadens
SFRDEKDDFDK

SEQ ID NO: 2905092 - protein, 5 aa, Entamoeba invadens
SFRNT

SEQ ID NO: 2905093 - protein, 5 aa, Entamoeba invadens
SFRQV

SEQ ID NO: 2905094 - protein, 14 aa, Entamoeba invadens
SFSANDSKKSPEEI

SEQ ID NO: 2905095 - protein, 13 aa, Entamoeba invadens
SFSARQKRESEIA

SEQ ID NO: 2905096 - protein, 24 aa, Entamoeba invadens
SFSDTTLAQAQTRENEVLTTETQH

SEQ ID NO: 2905097 - protein, 5 aa, Entamoeba invadens
SFSEC

SEQ ID NO: 2905098 - protein, 7 aa, Entamoeba invadens
SFSEERT

SEQ ID NO: 2905099 - protein, 5 aa, Entamoeba invadens
SFSEK

SEQ ID NO: 2905100 - protein, 5 aa, Entamoeba invadens
SFSEL

SEQ ID NO: 2905101 - protein, 13 aa, Entamoeba invadens
SFSETEDDTQNTE

SEQ ID NO: 2905102 - protein, 7 aa, Entamoeba invadens
SFSGSGK

SEQ ID NO: 2905103 - protein, 5 aa, Entamoeba invadens
SFSGT

SEQ ID NO: 2905104 - protein, 11 aa, Entamoeba invadens
SFSIKDEAAQK

SEQ ID NO: 2905105 - protein, 8 aa, Entamoeba invadens
SFSKEGNS

SEQ ID NO: 2905106 - protein, 13 aa, Entamoeba invadens
SFSKEKSSQPTLH

SEQ ID NO: 2905107 - protein, 10 aa, Entamoeba invadens
SFSKPQPREF

SEQ ID NO: 2905108 - protein, 8 aa, Entamoeba invadens
SFSKSGVD

SEQ ID NO: 2905109 - protein, 12 aa, Entamoeba invadens
SFSMRTTEEESV

SEQ ID NO: 2905110 - protein, 19 aa, Entamoeba invadens
SFSNESSSMSESLNEEEEL

SEQ ID NO: 2905111 - protein, 9 aa, Entamoeba invadens
SFSNNQLKT

SEQ ID NO: 2905112 - protein, 18 aa, Entamoeba invadens
SFSPATTNVAAASDAVDE

SEQ ID NO: 2905113 - protein, 10 aa, Entamoeba invadens
SFSPQSRVAP

SEQ ID NO: 2905114 - protein, 10 aa, Entamoeba invadens
SFSQANEEDD

SEQ ID NO: 2905115 - protein, 8 aa, Entamoeba invadens
SFSQSHQN

SEQ ID NO: 2905116 - protein, 4 aa, Entamoeba invadens
SFSS

SEQ ID NO: 2905117 - protein, 7 aa, Entamoeba invadens
SFSSKSK

SEQ ID NO: 2905118 - protein, 39 aa, Entamoeba invadens
SFSSPKQTSGLRQEFPSAPQTPIPDTPATTDQKVTRKRR

SEQ ID NO: 2905119 - protein, 12 aa, Entamoeba invadens
SFSSTNDVTDII

SEQ ID NO: 2905120 - protein, 8 aa, Entamoeba invadens
SFTDSASF

SEQ ID NO: 2905121 - protein, 4 aa, Entamoeba invadens
SFTG

SEQ ID NO: 2905122 - protein, 15 aa, Entamoeba invadens
SFTGGEGFGDDSNEF

SEQ ID NO: 2905123 - protein, 5 aa, Entamoeba invadens
SFTGS

SEQ ID NO: 2905124 - protein, 26 aa, Entamoeba invadens
SFTKSHKKIRTGSLKSKKSSTPKNLS

SEQ ID NO: 2905125 - protein, 13 aa, Entamoeba invadens
SFTKSSSADSLKS

SEQ ID NO: 2905126 - protein, 4 aa, Entamoeba invadens
SFTL

SEQ ID NO: 2905127 - protein, 5 aa, Entamoeba invadens
SFTNN

SEQ ID NO: 2905128 - protein, 16 aa, Entamoeba invadens
SFTPEKIKTFIEVLAK

SEQ ID NO: 2905129 - protein, 22 aa, Entamoeba invadens
SFTPQPSRTPSQLYRSETPTFY

SEQ ID NO: 2905130 - protein, 7 aa, Entamoeba invadens
SFTPTTK

SEQ ID NO: 2905131 - protein, 8 aa, Entamoeba invadens
SFTQPDST

SEQ ID NO: 2905132 - protein, 14 aa, Entamoeba invadens
SFTRDQSDRNRTSP

SEQ ID NO: 2905133 - protein, 4 aa, Entamoeba invadens
SFTS

SEQ ID NO: 2905134 - protein, 8 aa, Entamoeba invadens
SFTSNKID

SEQ ID NO: 2905135 - protein, 9 aa, Entamoeba invadens
SFTTNGTLQ

SEQ ID NO: 2905136 - protein, 16 aa, Entamoeba invadens
SFVGEGKTLGKEVGQN

SEQ ID NO: 2905137 - protein, 6 aa, Entamoeba invadens
SFVQGE

SEQ ID NO: 2905138 - protein, 14 aa, Entamoeba invadens
SFYSQTSQIDLPES

SEQ ID NO: 2905139 - protein, 6 aa, Entamoeba invadens
SGADGR

SEQ ID NO: 2905140 - protein, 8 aa, Entamoeba invadens
SGADNGEL

SEQ ID NO: 2905141 - protein, 5 aa, Entamoeba invadens
SGADV

SEQ ID NO: 2905142 - protein, 16 aa, Entamoeba invadens
SGAEDLAQTNLSPNKR

SEQ ID NO: 2905143 - protein, 24 aa, Entamoeba invadens
SGAETSQVQKKKTKKKEGGYEDVE

SEQ ID NO: 2905144 - protein, 6 aa, Entamoeba invadens
SGAGHV

SEQ ID NO: 2905145 - protein, 19 aa, Entamoeba invadens
SGAGNNWAKGYYSEGAELA

SEQ ID NO: 2905146 - protein, 8 aa, Entamoeba invadens
SGAKERLS

SEQ ID NO: 2905147 - protein, 6 aa, Entamoeba invadens
SGAKPI

SEQ ID NO: 2905148 - protein, 10 aa, Entamoeba invadens
SGAQTIPQQD

SEQ ID NO: 2905149 - protein, 5 aa, Entamoeba invadens
SGASF

SEQ ID NO: 2905150 - protein, 17 aa, Entamoeba invadens
SGASPTSLNKATQESPL

SEQ ID NO: 2905151 - protein, 6 aa, Entamoeba invadens
SGATGA

SEQ ID NO: 2905152 - protein, 7 aa, Entamoeba invadens
SGCEPTK

SEQ ID NO: 2905153 - protein, 5 aa, Entamoeba invadens
SGCET

SEQ ID NO: 2905154 - protein, 7 aa, Entamoeba invadens
SGCETNT

SEQ ID NO: 2905155 - protein, 4 aa, Entamoeba invadens
SGCH

SEQ ID NO: 2905156 - protein, 4 aa, Entamoeba invadens
SGCS

SEQ ID NO: 2905157 - protein, 8 aa, Entamoeba invadens
SGCSSKKA

SEQ ID NO: 2905158 - protein, 13 aa, Entamoeba invadens
SGCTNEEEESLKN

SEQ ID NO: 2905159 - protein, 7 aa, Entamoeba invadens
SGDAESH

SEQ ID NO: 2905160 - protein, 6 aa, Entamoeba invadens
SGDANG

SEQ ID NO: 2905161 - protein, 18 aa, Entamoeba invadens
SGDATCNGKCDQTTGKCN

SEQ ID NO: 2905162 - protein, 6 aa, Entamoeba invadens
SGDCTS

SEQ ID NO: 2905163 - protein, 6 aa, Entamoeba invadens
SGDDKR

SEQ ID NO: 2905164 - protein, 19 aa, Entamoeba invadens
SGDDVTPVAQSNDTFNENT

SEQ ID NO: 2905165 - protein, 4 aa, Entamoeba invadens
SGDE

SEQ ID NO: 2905166 - protein, 5 aa, Entamoeba invadens
SGDEL

SEQ ID NO: 2905167 - protein, 9 aa, Entamoeba invadens
SGDELNSEN

SEQ ID NO: 2905168 - protein, 8 aa, Entamoeba invadens
SGDESGEI

SEQ ID NO: 2905169 - protein, 7 aa, Entamoeba invadens
SGDFDSK

SEQ ID NO: 2905170 - protein, 6 aa, Entamoeba invadens
SGDFET

SEQ ID NO: 2905171 - protein, 9 aa, Entamoeba invadens
SGDFTNEKD

SEQ ID NO: 2905172 - protein, 6 aa, Entamoeba invadens
SGDGTT

SEQ ID NO: 2905173 - protein, 6 aa, Entamoeba invadens
SGDGVK

SEQ ID NO: 2905174 - protein, 6 aa, Entamoeba invadens
SGDGVT

SEQ ID NO: 2905175 - protein, 5 aa, Entamoeba invadens
SGDIE

SEQ ID NO: 2905176 - protein, 9 aa, Entamoeba invadens
SGDIKEAEE

SEQ ID NO: 2905177 - protein, 7 aa, Entamoeba invadens
SGDLATN

SEQ ID NO: 2905178 - protein, 12 aa, Entamoeba invadens
SGDLQNNCSYKE

SEQ ID NO: 2905179 - protein, 6 aa, Entamoeba invadens
SGDNRT

SEQ ID NO: 2905180 - protein, 5 aa, Entamoeba invadens
SGDPV

SEQ ID NO: 2905181 - protein, 10 aa, Entamoeba invadens
SGDQKDSYEA

SEQ ID NO: 2905182 - protein, 8 aa, Entamoeba invadens
SGDQPNNA

SEQ ID NO: 2905183 - protein, 8 aa, Entamoeba invadens
SGDQSHVS

SEQ ID NO: 2905184 - protein, 10 aa, Entamoeba invadens
SGDQTGEDYE

SEQ ID NO: 2905185 - protein, 4 aa, Entamoeba invadens
SGDS

SEQ ID NO: 2905186 - protein, 7 aa, Entamoeba invadens
SGDSCTE

SEQ ID NO: 2905187 - protein, 8 aa, Entamoeba invadens
SGDSDNIQ

SEQ ID NO: 2905188 - protein, 10 aa, Entamoeba invadens
SGDSETEALK

SEQ ID NO: 2905189 - protein, 8 aa, Entamoeba invadens
SGDSIKKI

SEQ ID NO: 2905190 - protein, 9 aa, Entamoeba invadens
SGDSNHSAF

SEQ ID NO: 2905191 - protein, 7 aa, Entamoeba invadens
SGDSNND

SEQ ID NO: 2905192 - protein, 7 aa, Entamoeba invadens
SGDSPYI

SEQ ID NO: 2905193 - protein, 6 aa, Entamoeba invadens
SGDSRM

SEQ ID NO: 2905194 - protein, 19 aa, Entamoeba invadens
SGDSSSKNDEEKICDISKN

SEQ ID NO: 2905195 - protein, 7 aa, Entamoeba invadens
SGDSTTS

SEQ ID NO: 2905196 - protein, 7 aa, Entamoeba invadens
SGDTEME

SEQ ID NO: 2905197 - protein, 18 aa, Entamoeba invadens
SGDTETTLENKQNSNDFL

SEQ ID NO: 2905198 - protein, 9 aa, Entamoeba invadens
SGDTTPLKN

SEQ ID NO: 2905199 - protein, 8 aa, Entamoeba invadens
SGDTTPLP

SEQ ID NO: 2905200 - protein, 4 aa, Entamoeba invadens
SGDV

SEQ ID NO: 2905201 - protein, 6 aa, Entamoeba invadens
SGDVYS

SEQ ID NO: 2905202 - protein, 11 aa, Entamoeba invadens
SGDYKRGRSVH

SEQ ID NO: 2905203 - protein, 5 aa, Entamoeba invadens
SGEAC

SEQ ID NO: 2905204 - protein, 5 aa, Entamoeba invadens
SGEAD

SEQ ID NO: 2905205 - protein, 5 aa, Entamoeba invadens
SGEAM

SEQ ID NO: 2905206 - protein, 6 aa, Entamoeba invadens
SGEANV

SEQ ID NO: 2905207 - protein, 5 aa, Entamoeba invadens
SGEDA

SEQ ID NO: 2905208 - protein, 5 aa, Entamoeba invadens
SGEDE

SEQ ID NO: 2905209 - protein, 8 aa, Entamoeba invadens
SGEEDKYD

SEQ ID NO: 2905210 - protein, 7 aa, Entamoeba invadens
SGEEELR

SEQ ID NO: 2905211 - protein, 8 aa, Entamoeba invadens
SGEELRKK

SEQ ID NO: 2905212 - protein, 5 aa, Entamoeba invadens
SGEES

SEQ ID NO: 2905213 - protein, 4 aa, Entamoeba invadens
SGEG

SEQ ID NO: 2905214 - protein, 4 aa, Entamoeba invadens
SGEI

SEQ ID NO: 2905215 - protein, 5 aa, Entamoeba invadens
SGEIG

SEQ ID NO: 2905216 - protein, 4 aa, Entamoeba invadens
SGEK

SEQ ID NO: 2905217 - protein, 5 aa, Entamoeba invadens
SGEKA

SEQ ID NO: 2905218 - protein, 7 aa, Entamoeba invadens
SGEKDLS

SEQ ID NO: 2905219 - protein, 9 aa, Entamoeba invadens
SGEKGESLK

SEQ ID NO: 2905220 - protein, 11 aa, Entamoeba invadens
SGEKTQPEGLP

SEQ ID NO: 2905221 - protein, 9 aa, Entamoeba invadens
SGEKYNKGI

SEQ ID NO: 2905222 - protein, 4 aa, Entamoeba invadens
SGEL

SEQ ID NO: 2905223 - protein, 12 aa, Entamoeba invadens
SGELKKASKRCY

SEQ ID NO: 2905224 - protein, 10 aa, Entamoeba invadens
SGELKKTALT

SEQ ID NO: 2905225 - protein, 12 aa, Entamoeba invadens
SGELQKASKRCY

SEQ ID NO: 2905226 - protein, 8 aa, Entamoeba invadens
SGELSDYQ

SEQ ID NO: 2905227 - protein, 4 aa, Entamoeba invadens
SGEN

SEQ ID NO: 2905228 - protein, 17 aa, Entamoeba invadens
SGENAETRDSVYSATKE

SEQ ID NO: 2905229 - protein, 8 aa, Entamoeba invadens
SGENEKSF

SEQ ID NO: 2905230 - protein, 10 aa, Entamoeba invadens
SGENGGITTK

SEQ ID NO: 2905231 - protein, 16 aa, Entamoeba invadens
SGENKKIKKEKETLEM

SEQ ID NO: 2905232 - protein, 13 aa, Entamoeba invadens
SGENVQTLDTNTS

SEQ ID NO: 2905233 - protein, 7 aa, Entamoeba invadens
SGEPIQT

SEQ ID NO: 2905234 - protein, 7 aa, Entamoeba invadens
SGEPMER

SEQ ID NO: 2905235 - protein, 15 aa, Entamoeba invadens
SGEQMKETVNPFKTN

SEQ ID NO: 2905236 - protein, 5 aa, Entamoeba invadens
SGESF

SEQ ID NO: 2905237 - protein, 10 aa, Entamoeba invadens
SGESGKSTIA

SEQ ID NO: 2905238 - protein, 7 aa, Entamoeba invadens
SGESLPR

SEQ ID NO: 2905239 - protein, 4 aa, Entamoeba invadens
SGET

SEQ ID NO: 2905240 - protein, 5 aa, Entamoeba invadens
SGETF

SEQ ID NO: 2905241 - protein, 19 aa, Entamoeba invadens
SGETGTNPFSDQPSATALK

SEQ ID NO: 2905242 - protein, 8 aa, Entamoeba invadens
SGETPKDY

SEQ ID NO: 2905243 - protein, 9 aa, Entamoeba invadens
SGETPNKSR

SEQ ID NO: 2905244 - protein, 10 aa, Entamoeba invadens
SGETTQTKKN

SEQ ID NO: 2905245 - protein, 5 aa, Entamoeba invadens
SGEVC

SEQ ID NO: 2905246 - protein, 10 aa, Entamoeba invadens
SGEVERKGED

SEQ ID NO: 2905247 - protein, 15 aa, Entamoeba invadens
SGEVGKNTQQTPTLS

SEQ ID NO: 2905248 - protein, 10 aa, Entamoeba invadens
SGEVSSAVRV

SEQ ID NO: 2905249 - protein, 5 aa, Entamoeba invadens
SGEWK

SEQ ID NO: 2905250 - protein, 4 aa, Entamoeba invadens
SGEY

SEQ ID NO: 2905251 - protein, 6 aa, Entamoeba invadens
SGEYHR

SEQ ID NO: 2905252 - protein, 12 aa, Entamoeba invadens
SGEYNTKSVENS

SEQ ID NO: 2905253 - protein, 7 aa, Entamoeba invadens
SGEYRSR

SEQ ID NO: 2905254 - protein, 9 aa, Entamoeba invadens
SGEYSPHTI

SEQ ID NO: 2905255 - protein, 8 aa, Entamoeba invadens
SGEYSPYT

SEQ ID NO: 2905256 - protein, 4 aa, Entamoeba invadens
SGFD

SEQ ID NO: 2905257 - protein, 7 aa, Entamoeba invadens
SGFDAPM

SEQ ID NO: 2905258 - protein, 6 aa, Entamoeba invadens
SGFDSR

SEQ ID NO: 2905259 - protein, 4 aa, Entamoeba invadens
SGFE

SEQ ID NO: 2905260 - protein, 5 aa, Entamoeba invadens
SGFEK

SEQ ID NO: 2905261 - protein, 10 aa, Entamoeba invadens
SGFEQKEGTY

SEQ ID NO: 2905262 - protein, 6 aa, Entamoeba invadens
SGFGSS

SEQ ID NO: 2905263 - protein, 4 aa, Entamoeba invadens
SGFN

SEQ ID NO: 2905264 - protein, 6 aa, Entamoeba invadens
SGFNKT

SEQ ID NO: 2905265 - protein, 7 aa, Entamoeba invadens
SGFQSSM

SEQ ID NO: 2905266 - protein, 4 aa, Entamoeba invadens
SGFR

SEQ ID NO: 2905267 - protein, 8 aa, Entamoeba invadens
SGFTEEEK

SEQ ID NO: 2905268 - protein, 14 aa, Entamoeba invadens
SGFTKAGSYTDSLP

SEQ ID NO: 2905269 - protein, 5 aa, Entamoeba invadens
SGFTP

SEQ ID NO: 2905270 - protein, 9 aa, Entamoeba invadens
SGGADFNDD

SEQ ID NO: 2905271 - protein, 7 aa, Entamoeba invadens
SGGAPRK

SEQ ID NO: 2905272 - protein, 9 aa, Entamoeba invadens
SGGARMQEG

SEQ ID NO: 2905273 - protein, 7 aa, Entamoeba invadens
SGGAYGD

SEQ ID NO: 2905274 - protein, 4 aa, Entamoeba invadens
SGGC

SEQ ID NO: 2905275 - protein, 7 aa, Entamoeba invadens
SGGDDGR

SEQ ID NO: 2905276 - protein, 14 aa, Entamoeba invadens
SGGDDNQLRVWRYA

SEQ ID NO: 2905277 - protein, 7 aa, Entamoeba invadens
SGGDPDV

SEQ ID NO: 2905278 - protein, 7 aa, Entamoeba invadens
SGGDPMM

SEQ ID NO: 2905279 - protein, 21 aa, Entamoeba invadens
SGGDQNVEIRTSETKFAERGK

SEQ ID NO: 2905280 - protein, 5 aa, Entamoeba invadens
SGGDV

SEQ ID NO: 2905281 - protein, 8 aa, Entamoeba invadens
SGGDYSEE

SEQ ID NO: 2905282 - protein, 7 aa, Entamoeba invadens
SGGEDRS

SEQ ID NO: 2905283 - protein, 13 aa, Entamoeba invadens
SGGEKVKEFQRGL

SEQ ID NO: 2905284 - protein, 5 aa, Entamoeba invadens
SGGEN

SEQ ID NO: 2905285 - protein, 13 aa, Entamoeba invadens
SGGERKKSTLKSR

SEQ ID NO: 2905286 - protein, 9 aa, Entamoeba invadens
SGGESRTFG

SEQ ID NO: 2905287 - protein, 11 aa, Entamoeba invadens
SGGGAIKPIKR

SEQ ID NO: 2905288 - protein, 8 aa, Entamoeba invadens
SGGGEVQT

SEQ ID NO: 2905289 - protein, 9 aa, Entamoeba invadens
SGGGRKDLS

SEQ ID NO: 2905290 - protein, 7 aa, Entamoeba invadens
SGGGVTD

SEQ ID NO: 2905291 - protein, 7 aa, Entamoeba invadens
SGGIGQC

SEQ ID NO: 2905292 - protein, 9 aa, Entamoeba invadens
SGGKPENIE

SEQ ID NO: 2905293 - protein, 15 aa, Entamoeba invadens
SGGKRRECQNGMNTK

SEQ ID NO: 2905294 - protein, 13 aa, Entamoeba invadens
SGGLDTKQNLTGE

SEQ ID NO: 2905295 - protein, 11 aa, Entamoeba invadens
SGGNPSDPETF

SEQ ID NO: 2905296 - protein, 20 aa, Entamoeba invadens
SGGNTYTKYVKEGNKAKVYG

SEQ ID NO: 2905297 - protein, 6 aa, Entamoeba invadens
SGGQDG

SEQ ID NO: 2905298 - protein, 5 aa, Entamoeba invadens
SGGQW

SEQ ID NO: 2905299 - protein, 5 aa, Entamoeba invadens
SGGRE

SEQ ID NO: 2905300 - protein, 17 aa, Entamoeba invadens
SGGRISKELSELNEGWK

SEQ ID NO: 2905301 - protein, 6 aa, Entamoeba invadens
SGGRPI

SEQ ID NO: 2905302 - protein, 4 aa, Entamoeba invadens
SGGS

SEQ ID NO: 2905303 - protein, 8 aa, Entamoeba invadens
SGGSASNC

SEQ ID NO: 2905304 - protein, 5 aa, Entamoeba invadens
SGGSL

SEQ ID NO: 2905305 - protein, 6 aa, Entamoeba invadens
SGGSNI

SEQ ID NO: 2905306 - protein, 15 aa, Entamoeba invadens
SGGSNIFGKTGGVSE

SEQ ID NO: 2905307 - protein, 7 aa, Entamoeba invadens
SGGSSDV

SEQ ID NO: 2905308 - protein, 6 aa, Entamoeba invadens
SGGSVG

SEQ ID NO: 2905309 - protein, 28 aa, Entamoeba invadens
SGGTDEHKSDKCHGKRVGKSLREEESEF

SEQ ID NO: 2905310 - protein, 7 aa, Entamoeba invadens
SGGTGLK

SEQ ID NO: 2905311 - protein, 14 aa, Entamoeba invadens
SGGTNKPKKNGPSF

SEQ ID NO: 2905312 - protein, 19 aa, Entamoeba invadens
SGGTQPAIPSAPSQPITSF

SEQ ID NO: 2905313 - protein, 6 aa, Entamoeba invadens
SGGTTI

SEQ ID NO: 2905314 - protein, 8 aa, Entamoeba invadens
SGGVPSAI

SEQ ID NO: 2905315 - protein, 5 aa, Entamoeba invadens
SGGYR

SEQ ID NO: 2905316 - protein, 13 aa, Entamoeba invadens
SGHEDEINNLNGS

SEQ ID NO: 2905317 - protein, 14 aa, Entamoeba invadens
SGHEDETNKLNGSI

SEQ ID NO: 2905318 - protein, 11 aa, Entamoeba invadens
SGHEDETNNLN

SEQ ID NO: 2905319 - protein, 25 aa, Entamoeba invadens
SGHEDETNNLNDRTTKDKKKIADLE

SEQ ID NO: 2905320 - protein, 11 aa, Entamoeba invadens
SGHINSENGPI

SEQ ID NO: 2905321 - protein, 5 aa, Entamoeba invadens
SGHPL

SEQ ID NO: 2905322 - protein, 5 aa, Entamoeba invadens
SGHQR

SEQ ID NO: 2905323 - protein, 10 aa, Entamoeba invadens
SGIENTPDIT

SEQ ID NO: 2905324 - protein, 5 aa, Entamoeba invadens
SGIER

SEQ ID NO: 2905325 - protein, 11 aa, Entamoeba invadens
SGIGKTEIAKT

SEQ ID NO: 2905326 - protein, 13 aa, Entamoeba invadens
SGIKSLADGTFSG

SEQ ID NO: 2905327 - protein, 6 aa, Entamoeba invadens
SGILPE

SEQ ID NO: 2905328 - protein, 6 aa, Entamoeba invadens
SGINEK

SEQ ID NO: 2905329 - protein, 7 aa, Entamoeba invadens
SGINNEQ

SEQ ID NO: 2905330 - protein, 10 aa, Entamoeba invadens
SGIPPLQGNW

SEQ ID NO: 2905331 - protein, 16 aa, Entamoeba invadens
SGIPTEDSYNYPNGFD

SEQ ID NO: 2905332 - protein, 9 aa, Entamoeba invadens
SGIRSNSLG

SEQ ID NO: 2905333 - protein, 4 aa, Entamoeba invadens
SGIS

SEQ ID NO: 2905334 - protein, 5 aa, Entamoeba invadens
SGISK

SEQ ID NO: 2905335 - protein, 6 aa, Entamoeba invadens
SGISTV

SEQ ID NO: 2905336 - protein, 6 aa, Entamoeba invadens
SGITED

SEQ ID NO: 2905337 - protein, 7 aa, Entamoeba invadens
SGITGEG

SEQ ID NO: 2905338 - protein, 16 aa, Entamoeba invadens
SGITPQNTANKDEENL

SEQ ID NO: 2905339 - protein, 5 aa, Entamoeba invadens
SGIYK

SEQ ID NO: 2905340 - protein, 19 aa, Entamoeba invadens
SGKALDKSSKNYNKYNKRN

SEQ ID NO: 2905341 - protein, 23 aa, Entamoeba invadens
SGKALEHKVEKPKEDVDPQGLYP

SEQ ID NO: 2905342 - protein, 11 aa, Entamoeba invadens
SGKASSAAGLT

SEQ ID NO: 2905343 - protein, 26 aa, Entamoeba invadens
SGKATLETFNEAQSVKTLPKADDKSD

SEQ ID NO: 2905344 - protein, 11 aa, Entamoeba invadens
SGKAYDEKTDV

SEQ ID NO: 2905345 - protein, 9 aa, Entamoeba invadens
SGKDDRESV

SEQ ID NO: 2905346 - protein, 7 aa, Entamoeba invadens
SGKDERD

SEQ ID NO: 2905347 - protein, 8 aa, Entamoeba invadens
SGKDREDY

SEQ ID NO: 2905348 - protein, 7 aa, Entamoeba invadens
SGKEGCN

SEQ ID NO: 2905349 - protein, 10 aa, Entamoeba invadens
SGKEKTGINH

SEQ ID NO: 2905350 - protein, 8 aa, Entamoeba invadens
SGKEPRVC

SEQ ID NO: 2905351 - protein, 9 aa, Entamoeba invadens
SGKESAHPD

SEQ ID NO: 2905352 - protein, 7 aa, Entamoeba invadens
SGKETIE

SEQ ID NO: 2905353 - protein, 8 aa, Entamoeba invadens
SGKETSLG

SEQ ID NO: 2905354 - protein, 21 aa, Entamoeba invadens
SGKEVQLEGAVSTSKWLKVLG

SEQ ID NO: 2905355 - protein, 4 aa, Entamoeba invadens
SGKG

SEQ ID NO: 2905356 - protein, 8 aa, Entamoeba invadens
SGKGENVV

SEQ ID NO: 2905357 - protein, 13 aa, Entamoeba invadens
SGKGESTKKKAEK

SEQ ID NO: 2905358 - protein, 20 aa, Entamoeba invadens
SGKGHAKSNEVRGSKPCSGE

SEQ ID NO: 2905359 - protein, 10 aa, Entamoeba invadens
SGKGKYEVPN

SEQ ID NO: 2905360 - protein, 7 aa, Entamoeba invadens
SGKGLKN

SEQ ID NO: 2905361 - protein, 9 aa, Entamoeba invadens
SGKGNEASA

SEQ ID NO: 2905362 - protein, 5 aa, Entamoeba invadens
SGKGQ

SEQ ID NO: 2905363 - protein, 6 aa, Entamoeba invadens
SGKGQL

SEQ ID NO: 2905364 - protein, 14 aa, Entamoeba invadens
SGKGTQIKAGQVEK

SEQ ID NO: 2905365 - protein, 4 aa, Entamoeba invadens
SGKH

SEQ ID NO: 2905366 - protein, 15 aa, Entamoeba invadens
SGKHLEKNQNIGNEE

SEQ ID NO: 2905367 - protein, 6 aa, Entamoeba invadens
SGKIPV

SEQ ID NO: 2905368 - protein, 9 aa, Entamoeba invadens
SGKKAENEI

SEQ ID NO: 2905369 - protein, 7 aa, Entamoeba invadens
SGKKALR

SEQ ID NO: 2905370 - protein, 12 aa, Entamoeba invadens
SGKKIEDVKKGG

SEQ ID NO: 2905371 - protein, 5 aa, Entamoeba invadens
SGKLI

SEQ ID NO: 2905372 - protein, 5 aa, Entamoeba invadens
SGKLP

SEQ ID NO: 2905373 - protein, 5 aa, Entamoeba invadens
SGKLT

SEQ ID NO: 2905374 - protein, 13 aa, Entamoeba invadens
SGKLVKSKEVKNV

SEQ ID NO: 2905375 - protein, 13 aa, Entamoeba invadens
SGKLVKSKEVRSV

SEQ ID NO: 2905376 - protein, 9 aa, Entamoeba invadens
SGKNNTPKM

SEQ ID NO: 2905377 - protein, 8 aa, Entamoeba invadens
SGKNTIHN

SEQ ID NO: 2905378 - protein, 6 aa, Entamoeba invadens
SGKNYE

SEQ ID NO: 2905379 - protein, 6 aa, Entamoeba invadens
SGKPID

SEQ ID NO: 2905380 - protein, 7 aa, Entamoeba invadens
SGKPLKV

SEQ ID NO: 2905381 - protein, 9 aa, Entamoeba invadens
SGKPPQFVP

SEQ ID NO: 2905382 - protein, 8 aa, Entamoeba invadens
SGKPSDKI

SEQ ID NO: 2905383 - protein, 18 aa, Entamoeba invadens
SGKQEANNNEAATNNMGS

SEQ ID NO: 2905384 - protein, 4 aa, Entamoeba invadens
SGKR

SEQ ID NO: 2905385 - protein, 13 aa, Entamoeba invadens
SGKRIEKGNKMSP

SEQ ID NO: 2905386 - protein, 14 aa, Entamoeba invadens
SGKRKTEKTEINKM

SEQ ID NO: 2905387 - protein, 8 aa, Entamoeba invadens
SGKRLARS

SEQ ID NO: 2905388 - protein, 5 aa, Entamoeba invadens
SGKRM

SEQ ID NO: 2905389 - protein, 10 aa, Entamoeba invadens
SGKSAKSEKR

SEQ ID NO: 2905390 - protein, 11 aa, Entamoeba invadens
SGKSQEHEETV

SEQ ID NO: 2905391 - protein, 6 aa, Entamoeba invadens
SGKSSI

SEQ ID NO: 2905392 - protein, 9 aa, Entamoeba invadens
SGKSTMNKT

SEQ ID NO: 2905393 - protein, 8 aa, Entamoeba invadens
SGKSTVHN

SEQ ID NO: 2905394 - protein, 12 aa, Entamoeba invadens
SGKSYGNSQEKE

SEQ ID NO: 2905395 - protein, 4 aa, Entamoeba invadens
SGKT

SEQ ID NO: 2905396 - protein, 13 aa, Entamoeba invadens
SGKTARETTMGKE

SEQ ID NO: 2905397 - protein, 11 aa, Entamoeba invadens
SGKTKSLEEQI

SEQ ID NO: 2905398 - protein, 5 aa, Entamoeba invadens
SGKTL

SEQ ID NO: 2905399 - protein, 9 aa, Entamoeba invadens
SGKTNHLSE

SEQ ID NO: 2905400 - protein, 14 aa, Entamoeba invadens
SGKTPSSQATEGVR

SEQ ID NO: 2905401 - protein, 6 aa, Entamoeba invadens
SGKTSI

SEQ ID NO: 2905402 - protein, 8 aa, Entamoeba invadens
SGKTSSMT

SEQ ID NO: 2905403 - protein, 6 aa, Entamoeba invadens
SGKTTF

SEQ ID NO: 2905404 - protein, 9 aa, Entamoeba invadens
SGKTTLAKQ

SEQ ID NO: 2905405 - protein, 5 aa, Entamoeba invadens
SGKTV

SEQ ID NO: 2905406 - protein, 9 aa, Entamoeba invadens
SGKTYDGTK

SEQ ID NO: 2905407 - protein, 5 aa, Entamoeba invadens
SGKVK

SEQ ID NO: 2905408 - protein, 12 aa, Entamoeba invadens
SGKVKELDKNKK

SEQ ID NO: 2905409 - protein, 7 aa, Entamoeba invadens
SGKVKQA

SEQ ID NO: 2905410 - protein, 14 aa, Entamoeba invadens
SGKVTKSKETKYST

SEQ ID NO: 2905411 - protein, 4 aa, Entamoeba invadens
SGKY

SEQ ID NO: 2905412 - protein, 10 aa, Entamoeba invadens
SGKYSPSKIK

SEQ ID NO: 2905413 - protein, 8 aa, Entamoeba invadens
SGLDERPL

SEQ ID NO: 2905414 - protein, 6 aa, Entamoeba invadens
SGLDGG

SEQ ID NO: 2905415 - protein, 10 aa, Entamoeba invadens
SGLDGQKENE

SEQ ID NO: 2905416 - protein, 13 aa, Entamoeba invadens
SGLDTKKESVKET

SEQ ID NO: 2905417 - protein, 7 aa, Entamoeba invadens
SGLEEYN

SEQ ID NO: 2905418 - protein, 11 aa, Entamoeba invadens
SGLIGENPRGI

SEQ ID NO: 2905419 - protein, 12 aa, Entamoeba invadens
SGLIGESPLGFP

SEQ ID NO: 2905420 - protein, 10 aa, Entamoeba invadens
SGLKDIPDGP

SEQ ID NO: 2905421 - protein, 16 aa, Entamoeba invadens
SGLKNASNAPKVPQRK

SEQ ID NO: 2905422 - protein, 5 aa, Entamoeba invadens
SGLLP

SEQ ID NO: 2905423 - protein, 11 aa, Entamoeba invadens
SGLNANESNEI

SEQ ID NO: 2905424 - protein, 7 aa, Entamoeba invadens
SGLNEDD

SEQ ID NO: 2905425 - protein, 7 aa, Entamoeba invadens
SGLNKSL

SEQ ID NO: 2905426 - protein, 7 aa, Entamoeba invadens
SGLPEDL

SEQ ID NO: 2905427 - protein, 24 aa, Entamoeba invadens
SGLPKDLTSALDASSKKQTTIQPI

SEQ ID NO: 2905428 - protein, 8 aa, Entamoeba invadens
SGLPNPRE

SEQ ID NO: 2905429 - protein, 7 aa, Entamoeba invadens
SGLPNSQ

SEQ ID NO: 2905430 - protein, 5 aa, Entamoeba invadens
SGLPP

SEQ ID NO: 2905431 - protein, 10 aa, Entamoeba invadens
SGLPPTVPKE

SEQ ID NO: 2905432 - protein, 17 aa, Entamoeba invadens
SGLPQSTYRDVGESPTA

SEQ ID NO: 2905433 - protein, 6 aa, Entamoeba invadens
SGLPTS

SEQ ID NO: 2905434 - protein, 6 aa, Entamoeba invadens
SGLQGS

SEQ ID NO: 2905435 - protein, 6 aa, Entamoeba invadens
SGLRGR

SEQ ID NO: 2905436 - protein, 7 aa, Entamoeba invadens
SGLRNDY

SEQ ID NO: 2905437 - protein, 7 aa, Entamoeba invadens
SGLRPQN

SEQ ID NO: 2905438 - protein, 11 aa, Entamoeba invadens
SGLRRGKKGLI

SEQ ID NO: 2905439 - protein, 7 aa, Entamoeba invadens
SGLSGVE

SEQ ID NO: 2905440 - protein, 12 aa, Entamoeba invadens
SGLSNENKDTAT

SEQ ID NO: 2905441 - protein, 6 aa, Entamoeba invadens
SGLSSC

SEQ ID NO: 2905442 - protein, 7 aa, Entamoeba invadens
SGLSSFG

SEQ ID NO: 2905443 - protein, 7 aa, Entamoeba invadens
SGLSTEI

SEQ ID NO: 2905444 - protein, 8 aa, Entamoeba invadens
SGLTADAR

SEQ ID NO: 2905445 - protein, 20 aa, Entamoeba invadens
SGLTKKGDKSGTDSQKTRFA

SEQ ID NO: 2905446 - protein, 6 aa, Entamoeba invadens
SGMDQR

SEQ ID NO: 2905447 - protein, 7 aa, Entamoeba invadens
SGMDQRE

SEQ ID NO: 2905448 - protein, 6 aa, Entamoeba invadens
SGMEEN

SEQ ID NO: 2905449 - protein, 7 aa, Entamoeba invadens
SGMETPQ

SEQ ID NO: 2905450 - protein, 7 aa, Entamoeba invadens
SGMGPDA

SEQ ID NO: 2905451 - protein, 14 aa, Entamoeba invadens
SGMPTPASALEKTP

SEQ ID NO: 2905452 - protein, 5 aa, Entamoeba invadens
SGMRA

SEQ ID NO: 2905453 - protein, 4 aa, Entamoeba invadens
SGMS

SEQ ID NO: 2905454 - protein, 19 aa, Entamoeba invadens
SGMSAGNEYLKSTNQQHSL

SEQ ID NO: 2905455 - protein, 10 aa, Entamoeba invadens
SGMSKSSGAL

SEQ ID NO: 2905456 - protein, 10 aa, Entamoeba invadens
SGMYPSDSTY

SEQ ID NO: 2905457 - protein, 9 aa, Entamoeba invadens
SGNANEKDL

SEQ ID NO: 2905458 - protein, 11 aa, Entamoeba invadens
SGNASKRPTIE

SEQ ID NO: 2905459 - protein, 6 aa, Entamoeba invadens
SGNDFN

SEQ ID NO: 2905460 - protein, 17 aa, Entamoeba invadens
SGNDLKAKKVEKDREDV

SEQ ID NO: 2905461 - protein, 7 aa, Entamoeba invadens
SGNEGMG

SEQ ID NO: 2905462 - protein, 13 aa, Entamoeba invadens
SGNEKITNSEDSL

SEQ ID NO: 2905463 - protein, 7 aa, Entamoeba invadens
SGNENDG

SEQ ID NO: 2905464 - protein, 6 aa, Entamoeba invadens
SGNERT

SEQ ID NO: 2905465 - protein, 13 aa, Entamoeba invadens
SGNETALYPHPST

SEQ ID NO: 2905466 - protein, 6 aa, Entamoeba invadens
SGNGEI

SEQ ID NO: 2905467 - protein, 9 aa, Entamoeba invadens
SGNGNTTYP

SEQ ID NO: 2905468 - protein, 7 aa, Entamoeba invadens
SGNKDKV

SEQ ID NO: 2905469 - protein, 19 aa, Entamoeba invadens
SGNKKPGVLTHSGGNPVLN

SEQ ID NO: 2905470 - protein, 5 aa, Entamoeba invadens
SGNKL

SEQ ID NO: 2905471 - protein, 14 aa, Entamoeba invadens
SGNKLQVKENASEM

SEQ ID NO: 2905472 - protein, 14 aa, Entamoeba invadens
SGNKLTTPFTDGDT

SEQ ID NO: 2905473 - protein, 8 aa, Entamoeba invadens
SGNKPDDP

SEQ ID NO: 2905474 - protein, 6 aa, Entamoeba invadens
SGNLCE

SEQ ID NO: 2905475 - protein, 17 aa, Entamoeba invadens
SGNLNKTEMKEKQVQED

SEQ ID NO: 2905476 - protein, 8 aa, Entamoeba invadens
SGNNAPTV

SEQ ID NO: 2905477 - protein, 9 aa, Entamoeba invadens
SGNNGGDGL

SEQ ID NO: 2905478 - protein, 6 aa, Entamoeba invadens
SGNNNL

SEQ ID NO: 2905479 - protein, 6 aa, Entamoeba invadens
SGNNVS

SEQ ID NO: 2905480 - protein, 4 aa, Entamoeba invadens
SGNP

SEQ ID NO: 2905481 - protein, 11 aa, Entamoeba invadens
SGNRMDKPENM

SEQ ID NO: 2905482 - protein, 6 aa, Entamoeba invadens
SGNSKL

SEQ ID NO: 2905483 - protein, 6 aa, Entamoeba invadens
SGNSRF

SEQ ID NO: 2905484 - protein, 11 aa, Entamoeba invadens
SGNSRYAMSST

SEQ ID NO: 2905485 - protein, 4 aa, Entamoeba invadens
SGNT

SEQ ID NO: 2905486 - protein, 6 aa, Entamoeba invadens
SGNTEM

SEQ ID NO: 2905487 - protein, 8 aa, Entamoeba invadens
SGNTFEAT

SEQ ID NO: 2905488 - protein, 6 aa, Entamoeba invadens
SGNVDG

SEQ ID NO: 2905489 - protein, 8 aa, Entamoeba invadens
SGNVGDST

SEQ ID NO: 2905490 - protein, 8 aa, Entamoeba invadens
SGNVTQNT

SEQ ID NO: 2905491 - protein, 6 aa, Entamoeba invadens
SGNVYS

SEQ ID NO: 2905492 - protein, 23 aa, Entamoeba invadens
SGNYKCQSCSSTCGGACNGNNGI

SEQ ID NO: 2905493 - protein, 5 aa, Entamoeba invadens
SGNYP

SEQ ID NO: 2905494 - protein, 7 aa, Entamoeba invadens
SGPAAHT

SEQ ID NO: 2905495 - protein, 6 aa, Entamoeba invadens
SGPDDL

SEQ ID NO: 2905496 - protein, 37 aa, Entamoeba invadens
SGPEKETKFAKEKKPRKSTKKSVQSDLKKIFDDMCQN

SEQ ID NO: 2905497 - protein, 6 aa, Entamoeba invadens
SGPEQL

SEQ ID NO: 2905498 - protein, 8 aa, Entamoeba invadens
SGPETEVG

SEQ ID NO: 2905499 - protein, 5 aa, Entamoeba invadens
SGPFP

SEQ ID NO: 2905500 - protein, 15 aa, Entamoeba invadens
SGPGVDGGDELDDCN

SEQ ID NO: 2905501 - protein, 15 aa, Entamoeba invadens
SGPGVDGGEELDDCN

SEQ ID NO: 2905502 - protein, 8 aa, Entamoeba invadens
SGPKITDK

SEQ ID NO: 2905503 - protein, 14 aa, Entamoeba invadens
SGPMEGKRRNHDSA

SEQ ID NO: 2905504 - protein, 4 aa, Entamoeba invadens
SGPS

SEQ ID NO: 2905505 - protein, 7 aa, Entamoeba invadens
SGPSDEV

SEQ ID NO: 2905506 - protein, 8 aa, Entamoeba invadens
SGPSNNAV

SEQ ID NO: 2905507 - protein, 4 aa, Entamoeba invadens
SGPT

SEQ ID NO: 2905508 - protein, 7 aa, Entamoeba invadens
SGPTDDI

SEQ ID NO: 2905509 - protein, 5 aa, Entamoeba invadens
SGPTS

SEQ ID NO: 2905510 - protein, 6 aa, Entamoeba invadens
SGPTSL

SEQ ID NO: 2905511 - protein, 4 aa, Entamoeba invadens
SGPY

SEQ ID NO: 2905512 - protein, 6 aa, Entamoeba invadens
SGPYKE

SEQ ID NO: 2905513 - protein, 5 aa, Entamoeba invadens
SGQER

SEQ ID NO: 2905514 - protein, 6 aa, Entamoeba invadens
SGQEVV

SEQ ID NO: 2905515 - protein, 7 aa, Entamoeba invadens
SGQHDIP

SEQ ID NO: 2905516 - protein, 13 aa, Entamoeba invadens
SGQISQKRDAETY

SEQ ID NO: 2905517 - protein, 19 aa, Entamoeba invadens
SGQKETLPDDFEFPDVILR

SEQ ID NO: 2905518 - protein, 7 aa, Entamoeba invadens
SGQKNPF

SEQ ID NO: 2905519 - protein, 8 aa, Entamoeba invadens
SGQKSTEK

SEQ ID NO: 2905520 - protein, 4 aa, Entamoeba invadens
SGQL

SEQ ID NO: 2905521 - protein, 4 aa, Entamoeba invadens
SGQN

SEQ ID NO: 2905522 - protein, 13 aa, Entamoeba invadens
SGQNVAPNNVITR

SEQ ID NO: 2905523 - protein, 4 aa, Entamoeba invadens
SGQP

SEQ ID NO: 2905524 - protein, 9 aa, Entamoeba invadens
SGQPYNGSK

SEQ ID NO: 2905525 - protein, 7 aa, Entamoeba invadens
SGQSASL

SEQ ID NO: 2905526 - protein, 8 aa, Entamoeba invadens
SGQSENYE

SEQ ID NO: 2905527 - protein, 10 aa, Entamoeba invadens
SGQVEDSTVY

SEQ ID NO: 2905528 - protein, 7 aa, Entamoeba invadens
SGQVSDC

SEQ ID NO: 2905529 - protein, 6 aa, Entamoeba invadens
SGQYDI

SEQ ID NO: 2905530 - protein, 10 aa, Entamoeba invadens
SGQYNKKEKS

SEQ ID NO: 2905531 - protein, 8 aa, Entamoeba invadens
SGRAKERL

SEQ ID NO: 2905532 - protein, 5 aa, Entamoeba invadens
SGRDL

SEQ ID NO: 2905533 - protein, 8 aa, Entamoeba invadens
SGRDTENM

SEQ ID NO: 2905534 - protein, 25 aa, Entamoeba invadens
SGRERYAPFDSPRGSPLPDERQEEI

SEQ ID NO: 2905535 - protein, 13 aa, Entamoeba invadens
SGRGELSERQQKL

SEQ ID NO: 2905536 - protein, 9 aa, Entamoeba invadens
SGRHKQDTE

SEQ ID NO: 2905537 - protein, 6 aa, Entamoeba invadens
SGRHRE

SEQ ID NO: 2905538 - protein, 5 aa, Entamoeba invadens
SGRIT

SEQ ID NO: 2905539 - protein, 8 aa, Entamoeba invadens
SGRKGRGI

SEQ ID NO: 2905540 - protein, 5 aa, Entamoeba invadens
SGRLV

SEQ ID NO: 2905541 - protein, 8 aa, Entamoeba invadens
SGRNESGF

SEQ ID NO: 2905542 - protein, 9 aa, Entamoeba invadens
SGRNPNDIT

SEQ ID NO: 2905543 - protein, 6 aa, Entamoeba invadens
SGRPSG

SEQ ID NO: 2905544 - protein, 7 aa, Entamoeba invadens
SGRQTVE

SEQ ID NO: 2905545 - protein, 4 aa, Entamoeba invadens
SGRR

SEQ ID NO: 2905546 - protein, 5 aa, Entamoeba invadens
SGRRC

SEQ ID NO: 2905547 - protein, 10 aa, Entamoeba invadens
SGRREKEAYR

SEQ ID NO: 2905548 - protein, 13 aa, Entamoeba invadens
SGRRNNPPQKKGN

SEQ ID NO: 2905549 - protein, 12 aa, Entamoeba invadens
SGRRNNPPQTKG

SEQ ID NO: 2905550 - protein, 8 aa, Entamoeba invadens
SGRRRDEE

SEQ ID NO: 2905551 - protein, 11 aa, Entamoeba invadens
SGRRYENSTKV

SEQ ID NO: 2905552 - protein, 4 aa, Entamoeba invadens
SGRS

SEQ ID NO: 2905553 - protein, 23 aa, Entamoeba invadens
SGRSKTEAKEEETCLRLKWGIKM

SEQ ID NO: 2905554 - protein, 11 aa, Entamoeba invadens
SGRSQLNTQGT

SEQ ID NO: 2905555 - protein, 11 aa, Entamoeba invadens
SGRTARAGRKG

SEQ ID NO: 2905556 - protein, 7 aa, Entamoeba invadens
SGRTKEM

SEQ ID NO: 2905557 - protein, 28 aa, Entamoeba invadens
SGRTNEHLDAPKKDEKVLGNEQNSANGV

SEQ ID NO: 2905558 - protein, 6 aa, Entamoeba invadens
SGRTTG

SEQ ID NO: 2905559 - protein, 7 aa, Entamoeba invadens
SGRYNSK

SEQ ID NO: 2905560 - protein, 6 aa, Entamoeba invadens
SGSALT

SEQ ID NO: 2905561 - protein, 10 aa, Entamoeba invadens
SGSAPTQESD

SEQ ID NO: 2905562 - protein, 9 aa, Entamoeba invadens
SGSATDLNA

SEQ ID NO: 2905563 - protein, 12 aa, Entamoeba invadens
SGSDANHQTNSG

SEQ ID NO: 2905564 - protein, 8 aa, Entamoeba invadens
SGSDDLKD

SEQ ID NO: 2905565 - protein, 8 aa, Entamoeba invadens
SGSDDTYC

SEQ ID NO: 2905566 - protein, 9 aa, Entamoeba invadens
SGSDDVSEK

SEQ ID NO: 2905567 - protein, 8 aa, Entamoeba invadens
SGSDSPND

SEQ ID NO: 2905568 - protein, 7 aa, Entamoeba invadens
SGSDTQF

SEQ ID NO: 2905569 - protein, 4 aa, Entamoeba invadens
SGSE

SEQ ID NO: 2905570 - protein, 16 aa, Entamoeba invadens
SGSEDEVVEGNEEKTM

SEQ ID NO: 2905571 - protein, 6 aa, Entamoeba invadens
SGSENK

SEQ ID NO: 2905572 - protein, 14 aa, Entamoeba invadens
SGSENQQDKYNENI

SEQ ID NO: 2905573 - protein, 7 aa, Entamoeba invadens
SGSFNGC

SEQ ID NO: 2905574 - protein, 7 aa, Entamoeba invadens
SGSFPTQ

SEQ ID NO: 2905575 - protein, 19 aa, Entamoeba invadens
SGSFQHTTTYEGNKSKAVD

SEQ ID NO: 2905576 - protein, 9 aa, Entamoeba invadens
SGSGINEEV

SEQ ID NO: 2905577 - protein, 9 aa, Entamoeba invadens
SGSGPNISN

SEQ ID NO: 2905578 - protein, 39 aa, Entamoeba invadens
SGSGSGSGMTDTDDNNGGNFSPNEENDESYDISDMGSDL

SEQ ID NO: 2905579 - protein, 9 aa, Entamoeba invadens
SGSGTEVTP

SEQ ID NO: 2905580 - protein, 6 aa, Entamoeba invadens
SGSGVD

SEQ ID NO: 2905581 - protein, 4 aa, Entamoeba invadens
SGSI

SEQ ID NO: 2905582 - protein, 7 aa, Entamoeba invadens
SGSIGGN

SEQ ID NO: 2905583 - protein, 21 aa, Entamoeba invadens
SGSIGSSDSNTPQEGSSPVQD

SEQ ID NO: 2905584 - protein, 14 aa, Entamoeba invadens
SGSISRGDPSPDYY

SEQ ID NO: 2905585 - protein, 6 aa, Entamoeba invadens
SGSKEK

SEQ ID NO: 2905586 - protein, 19 aa, Entamoeba invadens
SGSKNKNKNVCNGGCGPTS

SEQ ID NO: 2905587 - protein, 7 aa, Entamoeba invadens
SGSKNTT

SEQ ID NO: 2905588 - protein, 6 aa, Entamoeba invadens
SGSKSK

SEQ ID NO: 2905589 - protein, 21 aa, Entamoeba invadens
SGSLDSGTSHQVEQSQQQDLK

SEQ ID NO: 2905590 - protein, 19 aa, Entamoeba invadens
SGSLTARTHYSPEKTPSLA

SEQ ID NO: 2905591 - protein, 17 aa, Entamoeba invadens
SGSMAAQQIQGTESSSH

SEQ ID NO: 2905592 - protein, 9 aa, Entamoeba invadens
SGSMDGEGI

SEQ ID NO: 2905593 - protein, 7 aa, Entamoeba invadens
SGSMEGV

SEQ ID NO: 2905594 - protein, 9 aa, Entamoeba invadens
SGSMSGNRI

SEQ ID NO: 2905595 - protein, 6 aa, Entamoeba invadens
SGSNFA

SEQ ID NO: 2905596 - protein, 7 aa, Entamoeba invadens
SGSQKEV

SEQ ID NO: 2905597 - protein, 13 aa, Entamoeba invadens
SGSRDGSIIYTSF

SEQ ID NO: 2905598 - protein, 6 aa, Entamoeba invadens
SGSRDK

SEQ ID NO: 2905599 - protein, 7 aa, Entamoeba invadens
SGSRDKT

SEQ ID NO: 2905600 - protein, 10 aa, Entamoeba invadens
SGSSATKTGL

SEQ ID NO: 2905601 - protein, 7 aa, Entamoeba invadens
SGSSDRA

SEQ ID NO: 2905602 - protein, 7 aa, Entamoeba invadens
SGSSDRK

SEQ ID NO: 2905603 - protein, 8 aa, Entamoeba invadens
SGSSDRKV

SEQ ID NO: 2905604 - protein, 7 aa, Entamoeba invadens
SGSSDRT

SEQ ID NO: 2905605 - protein, 8 aa, Entamoeba invadens
SGSSEQIV

SEQ ID NO: 2905606 - protein, 8 aa, Entamoeba invadens
SGSSNTEP

SEQ ID NO: 2905607 - protein, 8 aa, Entamoeba invadens
SGSSSEYT

SEQ ID NO: 2905608 - protein, 9 aa, Entamoeba invadens
SGSSTPLLP

SEQ ID NO: 2905609 - protein, 22 aa, Entamoeba invadens
SGSTEPKVGKTREKTAFKGEKK

SEQ ID NO: 2905610 - protein, 8 aa, Entamoeba invadens
SGSTGEPK

SEQ ID NO: 2905611 - protein, 5 aa, Entamoeba invadens
SGSTP

SEQ ID NO: 2905612 - protein, 9 aa, Entamoeba invadens
SGSTSREYT

SEQ ID NO: 2905613 - protein, 4 aa, Entamoeba invadens
SGSV

SEQ ID NO: 2905614 - protein, 8 aa, Entamoeba invadens
SGSVGKSA

SEQ ID NO: 2905615 - protein, 11 aa, Entamoeba invadens
SGSVGKSAIAA

SEQ ID NO: 2905616 - protein, 11 aa, Entamoeba invadens
SGSVGKSAIAT

SEQ ID NO: 2905617 - protein, 6 aa, Entamoeba invadens
SGSVRA

SEQ ID NO: 2905618 - protein, 4 aa, Entamoeba invadens
SGSY

SEQ ID NO: 2905619 - protein, 6 aa, Entamoeba invadens
SGSYDD

SEQ ID NO: 2905620 - protein, 8 aa, Entamoeba invadens
SGTAFPTI

SEQ ID NO: 2905621 - protein, 4 aa, Entamoeba invadens
SGTC

SEQ ID NO: 2905622 - protein, 6 aa, Entamoeba invadens
SGTDLN

SEQ ID NO: 2905623 - protein, 8 aa, Entamoeba invadens
SGTDPKTI

SEQ ID NO: 2905624 - protein, 5 aa, Entamoeba invadens
SGTDV

SEQ ID NO: 2905625 - protein, 4 aa, Entamoeba invadens
SGTF

SEQ ID NO: 2905626 - protein, 12 aa, Entamoeba invadens
SGTGASKPIRIA

SEQ ID NO: 2905627 - protein, 5 aa, Entamoeba invadens
SGTIK

SEQ ID NO: 2905628 - protein, 18 aa, Entamoeba invadens
SGTKCPYKYDKNPKTKFS

SEQ ID NO: 2905629 - protein, 9 aa, Entamoeba invadens
SGTLSKTTA

SEQ ID NO: 2905630 - protein, 4 aa, Entamoeba invadens
SGTN

SEQ ID NO: 2905631 - protein, 10 aa, Entamoeba invadens
SGTNTEHTTK

SEQ ID NO: 2905632 - protein, 9 aa, Entamoeba invadens
SGTPETYNL

SEQ ID NO: 2905633 - protein, 9 aa, Entamoeba invadens
SGTPEYSAP

SEQ ID NO: 2905634 - protein, 11 aa, Entamoeba invadens
SGTPHGDAKDV

SEQ ID NO: 2905635 - protein, 7 aa, Entamoeba invadens
SGTPKPF

SEQ ID NO: 2905636 - protein, 28 aa, Entamoeba invadens
SGTPPICTSKSGACGDGYYGEAGNCQKC

SEQ ID NO: 2905637 - protein, 28 aa, Entamoeba invadens
SGTPPTCTSKNGACGDGYYGEAGNCQKC

SEQ ID NO: 2905638 - protein, 6 aa, Entamoeba invadens
SGTQKS

SEQ ID NO: 2905639 - protein, 11 aa, Entamoeba invadens
SGTQMKTEPKV

SEQ ID NO: 2905640 - protein, 38 aa, Entamoeba invadens
SGTREGAQIEEKKQNMEPQKTPQQVEREKDTPKEMTGE

SEQ ID NO: 2905641 - protein, 6 aa, Entamoeba invadens
SGTRRG

SEQ ID NO: 2905642 - protein, 15 aa, Entamoeba invadens
SGTRRKDTLSKPFGR

SEQ ID NO: 2905643 - protein, 7 aa, Entamoeba invadens
SGTSAAT

SEQ ID NO: 2905644 - protein, 10 aa, Entamoeba invadens
SGTSGKPKGV

SEQ ID NO: 2905645 - protein, 9 aa, Entamoeba invadens
SGTSGKSKG

SEQ ID NO: 2905646 - protein, 10 aa, Entamoeba invadens
SGTSGNPKGV

SEQ ID NO: 2905647 - protein, 10 aa, Entamoeba invadens
SGTSGTPKGV

SEQ ID NO: 2905648 - protein, 10 aa, Entamoeba invadens
SGTSGVPKGA

SEQ ID NO: 2905649 - protein, 10 aa, Entamoeba invadens
SGTSVPNSRY

SEQ ID NO: 2905650 - protein, 4 aa, Entamoeba invadens
SGTT

SEQ ID NO: 2905651 - protein, 5 aa, Entamoeba invadens
SGTTK

SEQ ID NO: 2905652 - protein, 4 aa, Entamoeba invadens
SGTV

SEQ ID NO: 2905653 - protein, 5 aa, Entamoeba invadens
SGTVE

SEQ ID NO: 2905654 - protein, 17 aa, Entamoeba invadens
SGTVGNTTLPGGDPAKL

SEQ ID NO: 2905655 - protein, 7 aa, Entamoeba invadens
SGTYNGT

SEQ ID NO: 2905656 - protein, 8 aa, Entamoeba invadens
SGTYNGTQ

SEQ ID NO: 2905657 - protein, 8 aa, Entamoeba invadens
SGVDDPNR

SEQ ID NO: 2905658 - protein, 5 aa, Entamoeba invadens
SGVEG

SEQ ID NO: 2905659 - protein, 7 aa, Entamoeba invadens
SGVGKSS

SEQ ID NO: 2905660 - protein, 9 aa, Entamoeba invadens
SGVGKTALT

SEQ ID NO: 2905661 - protein, 6 aa, Entamoeba invadens
SGVKEH

SEQ ID NO: 2905662 - protein, 11 aa, Entamoeba invadens
SGVKELGSTSL

SEQ ID NO: 2905663 - protein, 6 aa, Entamoeba invadens
SGVKQS

SEQ ID NO: 2905664 - protein, 12 aa, Entamoeba invadens
SGVNAQNKNTGA

SEQ ID NO: 2905665 - protein, 16 aa, Entamoeba invadens
SGVPEKTAMRRYQNNK

SEQ ID NO: 2905666 - protein, 5 aa, Entamoeba invadens
SGVPS

SEQ ID NO: 2905667 - protein, 5 aa, Entamoeba invadens
SGVSD

SEQ ID NO: 2905668 - protein, 10 aa, Entamoeba invadens
SGVSDSSSSI

SEQ ID NO: 2905669 - protein, 7 aa, Entamoeba invadens
SGVSGVN

SEQ ID NO: 2905670 - protein, 8 aa, Entamoeba invadens
SGVSPLPV

SEQ ID NO: 2905671 - protein, 6 aa, Entamoeba invadens
SGVSSI

SEQ ID NO: 2905672 - protein, 4 aa, Entamoeba invadens
SGVT

SEQ ID NO: 2905673 - protein, 4 aa, Entamoeba invadens
SGVY

SEQ ID NO: 2905674 - protein, 5 aa, Entamoeba invadens
SGWGE

SEQ ID NO: 2905675 - protein, 4 aa, Entamoeba invadens
SGWK

SEQ ID NO: 2905676 - protein, 4 aa, Entamoeba invadens
SGYD

SEQ ID NO: 2905677 - protein, 5 aa, Entamoeba invadens
SGYDT

SEQ ID NO: 2905678 - protein, 6 aa, Entamoeba invadens
SGYEDA

SEQ ID NO: 2905679 - protein, 13 aa, Entamoeba invadens
SGYEINEKTSKCE

SEQ ID NO: 2905680 - protein, 5 aa, Entamoeba invadens
SGYMQ

SEQ ID NO: 2905681 - protein, 6 aa, Entamoeba invadens
SGYPNT

SEQ ID NO: 2905682 - protein, 6 aa, Entamoeba invadens
SGYPNV

SEQ ID NO: 2905683 - protein, 9 aa, Entamoeba invadens
SGYQQHDSQ

SEQ ID NO: 2905684 - protein, 10 aa, Entamoeba invadens
SGYQQQDSQE

SEQ ID NO: 2905685 - protein, 6 aa, Entamoeba invadens
SGYRAE

SEQ ID NO: 2905686 - protein, 6 aa, Entamoeba invadens
SGYSTP

SEQ ID NO: 2905687 - protein, 7 aa, Entamoeba invadens
SGYTSSR

SEQ ID NO: 2905688 - protein, 17 aa, Entamoeba invadens
SGYVPSNPISKTCQSCT

SEQ ID NO: 2905689 - protein, 10 aa, Entamoeba invadens
SGYVPTSPIT

SEQ ID NO: 2905690 - protein, 28 aa, Entamoeba invadens
SHAEEFNAQDTSPKMEEDSDSEITFNKK

SEQ ID NO: 2905691 - protein, 4 aa, Entamoeba invadens
SHAK

SEQ ID NO: 2905692 - protein, 5 aa, Entamoeba invadens
SHANS

SEQ ID NO: 2905693 - protein, 8 aa, Entamoeba invadens
SHAPPKRM

SEQ ID NO: 2905694 - protein, 14 aa, Entamoeba invadens
SHASKKPPGKYRGC

SEQ ID NO: 2905695 - protein, 12 aa, Entamoeba invadens
SHCDSSEDIKTS

SEQ ID NO: 2905696 - protein, 5 aa, Entamoeba invadens
SHDQI

SEQ ID NO: 2905697 - protein, 6 aa, Entamoeba invadens
SHDQLR

SEQ ID NO: 2905698 - protein, 8 aa, Entamoeba invadens
SHDTGKPL

SEQ ID NO: 2905699 - protein, 6 aa, Entamoeba invadens
SHDTTS

SEQ ID NO: 2905700 - protein, 8 aa, Entamoeba invadens
SHDVSDKL

SEQ ID NO: 2905701 - protein, 5 aa, Entamoeba invadens
SHDYS

SEQ ID NO: 2905702 - protein, 13 aa, Entamoeba invadens
SHEEEAESASSNV

SEQ ID NO: 2905703 - protein, 7 aa, Entamoeba invadens
SHEEGQT

SEQ ID NO: 2905704 - protein, 8 aa, Entamoeba invadens
SHEHQDIS

SEQ ID NO: 2905705 - protein, 15 aa, Entamoeba invadens
SHEKIEKVEESQPNY

SEQ ID NO: 2905706 - protein, 7 aa, Entamoeba invadens
SHEKPTD

SEQ ID NO: 2905707 - protein, 12 aa, Entamoeba invadens
SHEKSSANKSIP

SEQ ID NO: 2905708 - protein, 11 aa, Entamoeba invadens
SHEMSIGEKTE

SEQ ID NO: 2905709 - protein, 4 aa, Entamoeba invadens
SHEN

SEQ ID NO: 2905710 - protein, 5 aa, Entamoeba invadens
SHENN

SEQ ID NO: 2905711 - protein, 8 aa, Entamoeba invadens
SHEQNNDA

SEQ ID NO: 2905712 - protein, 6 aa, Entamoeba invadens
SHETKE

SEQ ID NO: 2905713 - protein, 10 aa, Entamoeba invadens
SHETPNGEIE

SEQ ID NO: 2905714 - protein, 12 aa, Entamoeba invadens
SHFGPNVSDEEM

SEQ ID NO: 2905715 - protein, 6 aa, Entamoeba invadens
SHFNSN

SEQ ID NO: 2905716 - protein, 12 aa, Entamoeba invadens
SHFTNDNLNGTA

SEQ ID NO: 2905717 - protein, 9 aa, Entamoeba invadens
SHGAEQEGS

SEQ ID NO: 2905718 - protein, 11 aa, Entamoeba invadens
SHGKPSKLNSP

SEQ ID NO: 2905719 - protein, 8 aa, Entamoeba invadens
SHGNQTPQ

SEQ ID NO: 2905720 - protein, 5 aa, Entamoeba invadens
SHGNY

SEQ ID NO: 2905721 - protein, 21 aa, Entamoeba invadens
SHGRVNKDKKCSRSDEQHGRK

SEQ ID NO: 2905722 - protein, 9 aa, Entamoeba invadens
SHGSIEYTT

SEQ ID NO: 2905723 - protein, 7 aa, Entamoeba invadens
SHGSLTI

SEQ ID NO: 2905724 - protein, 4 aa, Entamoeba invadens
SHGT

SEQ ID NO: 2905725 - protein, 9 aa, Entamoeba invadens
SHHPGDGEV

SEQ ID NO: 2905726 - protein, 6 aa, Entamoeba invadens
SHHPPI

SEQ ID NO: 2905727 - protein, 19 aa, Entamoeba invadens
SHHSLHSSSSKTRKLSRRR

SEQ ID NO: 2905728 - protein, 20 aa, Entamoeba invadens
SHHTTRDLNKQTNSNEQLKQ

SEQ ID NO: 2905729 - protein, 5 aa, Entamoeba invadens
SHIHR

SEQ ID NO: 2905730 - protein, 7 aa, Entamoeba invadens
SHKEEMC

SEQ ID NO: 2905731 - protein, 16 aa, Entamoeba invadens
SHKGSCGGGSAGPDIE

SEQ ID NO: 2905732 - protein, 8 aa, Entamoeba invadens
SHKKNSTC

SEQ ID NO: 2905733 - protein, 6 aa, Entamoeba invadens
SHKQKD

SEQ ID NO: 2905734 - protein, 8 aa, Entamoeba invadens
SHKSESNL

SEQ ID NO: 2905735 - protein, 12 aa, Entamoeba invadens
SHKTKGKSEVYT

SEQ ID NO: 2905736 - protein, 11 aa, Entamoeba invadens
SHKTNDPSEEK

SEQ ID NO: 2905737 - protein, 5 aa, Entamoeba invadens
SHLES

SEQ ID NO: 2905738 - protein, 61 aa, Entamoeba invadens
SHLKTERQQEDRKEAYPYRNEKETLNELRDEHQKTEERKRQQDREDAKLYKKTEETPEKAK

SEQ ID NO: 2905739 - protein, 7 aa, Entamoeba invadens
SHNATKT

SEQ ID NO: 2905740 - protein, 5 aa, Entamoeba invadens
SHNDK

SEQ ID NO: 2905741 - protein, 7 aa, Entamoeba invadens
SHNERYP

SEQ ID NO: 2905742 - protein, 7 aa, Entamoeba invadens
SHNHSEQ

SEQ ID NO: 2905743 - protein, 5 aa, Entamoeba invadens
SHNIN

SEQ ID NO: 2905744 - protein, 5 aa, Entamoeba invadens
SHNIP

SEQ ID NO: 2905745 - protein, 25 aa, Entamoeba invadens
SHNKKGNKANQISLQTRGRTRDELQ

SEQ ID NO: 2905746 - protein, 7 aa, Entamoeba invadens
SHNLPKS

SEQ ID NO: 2905747 - protein, 10 aa, Entamoeba invadens
SHNPKADNGY

SEQ ID NO: 2905748 - protein, 11 aa, Entamoeba invadens
SHNPKLSKPHK

SEQ ID NO: 2905749 - protein, 5 aa, Entamoeba invadens
SHNPN

SEQ ID NO: 2905750 - protein, 5 aa, Entamoeba invadens
SHNTG

SEQ ID NO: 2905751 - protein, 20 aa, Entamoeba invadens
SHNTNGTPRFVESDSSQSSL

SEQ ID NO: 2905752 - protein, 7 aa, Entamoeba invadens
SHPESYY

SEQ ID NO: 2905753 - protein, 5 aa, Entamoeba invadens
SHPFM

SEQ ID NO: 2905754 - protein, 9 aa, Entamoeba invadens
SHPKGGVNA

SEQ ID NO: 2905755 - protein, 6 aa, Entamoeba invadens
SHPKHS

SEQ ID NO: 2905756 - protein, 5 aa, Entamoeba invadens
SHPNS

SEQ ID NO: 2905757 - protein, 4 aa, Entamoeba invadens
SHPQ

SEQ ID NO: 2905758 - protein, 6 aa, Entamoeba invadens
SHPRLV

SEQ ID NO: 2905759 - protein, 6 aa, Entamoeba invadens
SHPSAN

SEQ ID NO: 2905760 - protein, 8 aa, Entamoeba invadens
SHPSSESP

SEQ ID NO: 2905761 - protein, 6 aa, Entamoeba invadens
SHPSSH

SEQ ID NO: 2905762 - protein, 4 aa, Entamoeba invadens
SHPT

SEQ ID NO: 2905763 - protein, 6 aa, Entamoeba invadens
SHPTDD

SEQ ID NO: 2905764 - protein, 7 aa, Entamoeba invadens
SHPTDPM

SEQ ID NO: 2905765 - protein, 6 aa, Entamoeba invadens
SHPTPE

SEQ ID NO: 2905766 - protein, 5 aa, Entamoeba invadens
SHPYL

SEQ ID NO: 2905767 - protein, 7 aa, Entamoeba invadens
SHQDGIP

SEQ ID NO: 2905768 - protein, 7 aa, Entamoeba invadens
SHQPKLK

SEQ ID NO: 2905769 - protein, 10 aa, Entamoeba invadens
SHQRGDKGRV

SEQ ID NO: 2905770 - protein, 17 aa, Entamoeba invadens
SHQSHDAEAKNEAKERL

SEQ ID NO: 2905771 - protein, 8 aa, Entamoeba invadens
SHQSPSAL

SEQ ID NO: 2905772 - protein, 9 aa, Entamoeba invadens
SHQTQSEKT

SEQ ID NO: 2905773 - protein, 7 aa, Entamoeba invadens
SHQWSGR

SEQ ID NO: 2905774 - protein, 8 aa, Entamoeba invadens
SHQYDKTH

SEQ ID NO: 2905775 - protein, 7 aa, Entamoeba invadens
SHRASSN

SEQ ID NO: 2905776 - protein, 7 aa, Entamoeba invadens
SHRGTGF

SEQ ID NO: 2905777 - protein, 5 aa, Entamoeba invadens
SHRGY

SEQ ID NO: 2905778 - protein, 5 aa, Entamoeba invadens
SHRPQ

SEQ ID NO: 2905779 - protein, 4 aa, Entamoeba invadens
SHRT

SEQ ID NO: 2905780 - protein, 11 aa, Entamoeba invadens
SHRVKKGDKPV

SEQ ID NO: 2905781 - protein, 8 aa, Entamoeba invadens
SHSEYSDG

SEQ ID NO: 2905782 - protein, 4 aa, Entamoeba invadens
SHSF

SEQ ID NO: 2905783 - protein, 15 aa, Entamoeba invadens
SHSFPGNPRDNPNEV

SEQ ID NO: 2905784 - protein, 5 aa, Entamoeba invadens
SHSFQ

SEQ ID NO: 2905785 - protein, 7 aa, Entamoeba invadens
SHSGPVT

SEQ ID NO: 2905786 - protein, 9 aa, Entamoeba invadens
SHSLKGQKF

SEQ ID NO: 2905787 - protein, 5 aa, Entamoeba invadens
SHSQM

SEQ ID NO: 2905788 - protein, 4 aa, Entamoeba invadens
SHSR

SEQ ID NO: 2905789 - protein, 21 aa, Entamoeba invadens
SHSSNASYYEVSNKTGSGIKQ

SEQ ID NO: 2905790 - protein, 9 aa, Entamoeba invadens
SHSSPPQKQ

SEQ ID NO: 2905791 - protein, 6 aa, Entamoeba invadens
SHSSSA

SEQ ID NO: 2905792 - protein, 5 aa, Entamoeba invadens
SHSTA

SEQ ID NO: 2905793 - protein, 7 aa, Entamoeba invadens
SHSTEPY

SEQ ID NO: 2905794 - protein, 7 aa, Entamoeba invadens
SHSTNLE

SEQ ID NO: 2905795 - protein, 9 aa, Entamoeba invadens
SHSTPTHPL

SEQ ID NO: 2905796 - protein, 32 aa, Entamoeba invadens
SHSTTVTMGQKRSSGSFAKEKDDKKISHSVGQ

SEQ ID NO: 2905797 - protein, 20 aa, Entamoeba invadens
SHTDSPSLKLKPNPFDKSNE

SEQ ID NO: 2905798 - protein, 4 aa, Entamoeba invadens
SHTG

SEQ ID NO: 2905799 - protein, 34 aa, Entamoeba invadens
SHTLPEAKAYDDKSEASTHRATKSYTQSLSSQQL

SEQ ID NO: 2905800 - protein, 13 aa, Entamoeba invadens
SHTLQAQKKDMEN

SEQ ID NO: 2905801 - protein, 9 aa, Entamoeba invadens
SHTPQTRNK

SEQ ID NO: 2905802 - protein, 5 aa, Entamoeba invadens
SHTQE

SEQ ID NO: 2905803 - protein, 5 aa, Entamoeba invadens
SHTQI

SEQ ID NO: 2905804 - protein, 11 aa, Entamoeba invadens
SHVKVNSQKLR

SEQ ID NO: 2905805 - protein, 5 aa, Entamoeba invadens
SHVRK

SEQ ID NO: 2905806 - protein, 8 aa, Entamoeba invadens
SHVSDTID

SEQ ID NO: 2905807 - protein, 7 aa, Entamoeba invadens
SHYAKTN

SEQ ID NO: 2905808 - protein, 5 aa, Entamoeba invadens
SHYQR

SEQ ID NO: 2905809 - protein, 9 aa, Entamoeba invadens
SIADEERRR

SEQ ID NO: 2905810 - protein, 6 aa, Entamoeba invadens
SIAENA

SEQ ID NO: 2905811 - protein, 5 aa, Entamoeba invadens
SIAGK

SEQ ID NO: 2905812 - protein, 11 aa, Entamoeba invadens
SIAKLQDPRTV

SEQ ID NO: 2905813 - protein, 15 aa, Entamoeba invadens
SIAPKRDKAQGEVEK

SEQ ID NO: 2905814 - protein, 15 aa, Entamoeba invadens
SIAPKRDKTGGEVER

SEQ ID NO: 2905815 - protein, 15 aa, Entamoeba invadens
SIAPTESRFNAEQQD

SEQ ID NO: 2905816 - protein, 17 aa, Entamoeba invadens
SIAQDKEKTEEKKRNRV

SEQ ID NO: 2905817 - protein, 7 aa, Entamoeba invadens
SIARPKE

SEQ ID NO: 2905818 - protein, 10 aa, Entamoeba invadens
SIASKTPSTF

SEQ ID NO: 2905819 - protein, 6 aa, Entamoeba invadens
SIATNS

SEQ ID NO: 2905820 - protein, 4 aa, Entamoeba invadens
SIDE

SEQ ID NO: 2905821 - protein, 12 aa, Entamoeba invadens
SIDESSHITFQS

SEQ ID NO: 2905822 - protein, 16 aa, Entamoeba invadens
SIDGEIANTQPVTAKD

SEQ ID NO: 2905823 - protein, 14 aa, Entamoeba invadens
SIDKGDEDCDPDEV

SEQ ID NO: 2905824 - protein, 22 aa, Entamoeba invadens
SIDKTPKEDVAKSKPSKEIEKK

SEQ ID NO: 2905825 - protein, 5 aa, Entamoeba invadens
SIDMN

SEQ ID NO: 2905826 - protein, 11 aa, Entamoeba invadens
SIDPEDFGGSQ

SEQ ID NO: 2905827 - protein, 10 aa, Entamoeba invadens
SIDPFPPSNF

SEQ ID NO: 2905828 - protein, 5 aa, Entamoeba invadens
SIDPN

SEQ ID NO: 2905829 - protein, 38 aa, Entamoeba invadens
SIDPNDKPIRPIKQQPTGKAPLQTLSQQTKASEDNSVN

SEQ ID NO: 2905830 - protein, 7 aa, Entamoeba invadens
SIDPNTS

SEQ ID NO: 2905831 - protein, 11 aa, Entamoeba invadens
SIDPSARTNAA

SEQ ID NO: 2905832 - protein, 5 aa, Entamoeba invadens
SIDPV

SEQ ID NO: 2905833 - protein, 5 aa, Entamoeba invadens
SIDRG

SEQ ID NO: 2905834 - protein, 14 aa, Entamoeba invadens
SIDRNTSVNRERLS

SEQ ID NO: 2905835 - protein, 6 aa, Entamoeba invadens
SIDSDM

SEQ ID NO: 2905836 - protein, 10 aa, Entamoeba invadens
SIDSENESFP

SEQ ID NO: 2905837 - protein, 6 aa, Entamoeba invadens
SIDSQN

SEQ ID NO: 2905838 - protein, 5 aa, Entamoeba invadens
SIDTT

SEQ ID NO: 2905839 - protein, 9 aa, Entamoeba invadens
SIEANARNV

SEQ ID NO: 2905840 - protein, 7 aa, Entamoeba invadens
SIEATEM

SEQ ID NO: 2905841 - protein, 13 aa, Entamoeba invadens
SIEDDHKTKGFNP

SEQ ID NO: 2905842 - protein, 13 aa, Entamoeba invadens
SIEDNDPSQVPYP

SEQ ID NO: 2905843 - protein, 17 aa, Entamoeba invadens
SIEDPINNGFTQTYPNH

SEQ ID NO: 2905844 - protein, 7 aa, Entamoeba invadens
SIEDSRC

SEQ ID NO: 2905845 - protein, 18 aa, Entamoeba invadens
SIEDTSNTEATTVQSFEE

SEQ ID NO: 2905846 - protein, 5 aa, Entamoeba invadens
SIEDY

SEQ ID NO: 2905847 - protein, 23 aa, Entamoeba invadens
SIEEDISNAKEIVENDTKEEFKG

SEQ ID NO: 2905848 - protein, 6 aa, Entamoeba invadens
SIEEFK

SEQ ID NO: 2905849 - protein, 19 aa, Entamoeba invadens
SIEETAERIKTEEDNYHNE

SEQ ID NO: 2905850 - protein, 4 aa, Entamoeba invadens
SIEG

SEQ ID NO: 2905851 - protein, 10 aa, Entamoeba invadens
SIEGEIENTT

SEQ ID NO: 2905852 - protein, 8 aa, Entamoeba invadens
SIEGPDAE

SEQ ID NO: 2905853 - protein, 10 aa, Entamoeba invadens
SIEGPENGKL

SEQ ID NO: 2905854 - protein, 10 aa, Entamoeba invadens
SIEGPESTKL

SEQ ID NO: 2905855 - protein, 15 aa, Entamoeba invadens
SIEKDNTLATNNHIQ

SEQ ID NO: 2905856 - protein, 13 aa, Entamoeba invadens
SIEKGEEKVEEKI

SEQ ID NO: 2905857 - protein, 8 aa, Entamoeba invadens
SIEKQKTQ

SEQ ID NO: 2905858 - protein, 4 aa, Entamoeba invadens
SIEM

SEQ ID NO: 2905859 - protein, 4 aa, Entamoeba invadens
SIEN

SEQ ID NO: 2905860 - protein, 5 aa, Entamoeba invadens
SIENN

SEQ ID NO: 2905861 - protein, 8 aa, Entamoeba invadens
SIEPRQSA

SEQ ID NO: 2905862 - protein, 11 aa, Entamoeba invadens
SIEQGASLAES

SEQ ID NO: 2905863 - protein, 6 aa, Entamoeba invadens
SIEQTT

SEQ ID NO: 2905864 - protein, 13 aa, Entamoeba invadens
SIERGFGHGSQYK

SEQ ID NO: 2905865 - protein, 12 aa, Entamoeba invadens
SIESEDITVEDE

SEQ ID NO: 2905866 - protein, 9 aa, Entamoeba invadens
SIESEGGKA

SEQ ID NO: 2905867 - protein, 11 aa, Entamoeba invadens
SIESGDETVNN

SEQ ID NO: 2905868 - protein, 6 aa, Entamoeba invadens
SIESID

SEQ ID NO: 2905869 - protein, 13 aa, Entamoeba invadens
SIETDSDSIQVGS

SEQ ID NO: 2905870 - protein, 28 aa, Entamoeba invadens
SIETRKGNFLGSSSSTRFTTSRFIVIQF

SEQ ID NO: 2905871 - protein, 12 aa, Entamoeba invadens
SIETTEDNYQPE

SEQ ID NO: 2905872 - protein, 5 aa, Entamoeba invadens
SIEWE

SEQ ID NO: 2905873 - protein, 7 aa, Entamoeba invadens
SIFDPEK

SEQ ID NO: 2905874 - protein, 11 aa, Entamoeba invadens
SIGATEKGQVQ

SEQ ID NO: 2905875 - protein, 4 aa, Entamoeba invadens
SIGD

SEQ ID NO: 2905876 - protein, 6 aa, Entamoeba invadens
SIGDGN

SEQ ID NO: 2905877 - protein, 4 aa, Entamoeba invadens
SIGE

SEQ ID NO: 2905878 - protein, 6 aa, Entamoeba invadens
SIGEEP

SEQ ID NO: 2905879 - protein, 6 aa, Entamoeba invadens
SIGEGS

SEQ ID NO: 2905880 - protein, 6 aa, Entamoeba invadens
SIGERV

SEQ ID NO: 2905881 - protein, 6 aa, Entamoeba invadens
SIGESA

SEQ ID NO: 2905882 - protein, 7 aa, Entamoeba invadens
SIGESAF

SEQ ID NO: 2905883 - protein, 7 aa, Entamoeba invadens
SIGESEY

SEQ ID NO: 2905884 - protein, 10 aa, Entamoeba invadens
SIGGNNTLTA

SEQ ID NO: 2905885 - protein, 6 aa, Entamoeba invadens
SIGGNS

SEQ ID NO: 2905886 - protein, 6 aa, Entamoeba invadens
SIGGYE

SEQ ID NO: 2905887 - protein, 8 aa, Entamoeba invadens
SIGKGGFG

SEQ ID NO: 2905888 - protein, 13 aa, Entamoeba invadens
SIGKPLKKSSVTR

SEQ ID NO: 2905889 - protein, 9 aa, Entamoeba invadens
SIGKSQDKL

SEQ ID NO: 2905890 - protein, 5 aa, Entamoeba invadens
SIGKY

SEQ ID NO: 2905891 - protein, 7 aa, Entamoeba invadens
SIGNTNV

SEQ ID NO: 2905892 - protein, 5 aa, Entamoeba invadens
SIGPK

SEQ ID NO: 2905893 - protein, 7 aa, Entamoeba invadens
SIGQDST

SEQ ID NO: 2905894 - protein, 5 aa, Entamoeba invadens
SIGQV

SEQ ID NO: 2905895 - protein, 6 aa, Entamoeba invadens
SIGRGA

SEQ ID NO: 2905896 - protein, 18 aa, Entamoeba invadens
SIGSTRVEGNNGGDSEVQ

SEQ ID NO: 2905897 - protein, 4 aa, Entamoeba invadens
SIGT

SEQ ID NO: 2905898 - protein, 11 aa, Entamoeba invadens
SIGTSINPLTR

SEQ ID NO: 2905899 - protein, 5 aa, Entamoeba invadens
SIGVG

SEQ ID NO: 2905900 - protein, 33 aa, Entamoeba invadens
SIHQEFSGDSGMVPPPQRSPIDIKEQNGNDLPS

SEQ ID NO: 2905901 - protein, 4 aa, Entamoeba invadens
SIIE

SEQ ID NO: 2905902 - protein, 13 aa, Entamoeba invadens
SIKAGTAEDEAPT

SEQ ID NO: 2905903 - protein, 10 aa, Entamoeba invadens
SIKDGTKTIY

SEQ ID NO: 2905904 - protein, 10 aa, Entamoeba invadens
SIKDPKTNEY

SEQ ID NO: 2905905 - protein, 12 aa, Entamoeba invadens
SIKEQKTNTRRK

SEQ ID NO: 2905906 - protein, 8 aa, Entamoeba invadens
SIKGGEHV

SEQ ID NO: 2905907 - protein, 21 aa, Entamoeba invadens
SIKKAEEKKKNIGNDGKLEQE

SEQ ID NO: 2905908 - protein, 13 aa, Entamoeba invadens
SIKKERIEPSSSK

SEQ ID NO: 2905909 - protein, 9 aa, Entamoeba invadens
SIKKKFPTY

SEQ ID NO: 2905910 - protein, 12 aa, Entamoeba invadens
SIKKNEAKVGEL

SEQ ID NO: 2905911 - protein, 13 aa, Entamoeba invadens
SIKKSKTKGITPF

SEQ ID NO: 2905912 - protein, 52 aa, Entamoeba invadens
SIKNEANEIKEKKKRAKDEKREKKERKKLKNKETTEKDTSTVSSNSDEVTFS

SEQ ID NO: 2905913 - protein, 10 aa, Entamoeba invadens
SIKNGEPAKI

SEQ ID NO: 2905914 - protein, 8 aa, Entamoeba invadens
SIKQETPS

SEQ ID NO: 2905915 - protein, 8 aa, Entamoeba invadens
SIKQTSSM

SEQ ID NO: 2905916 - protein, 5 aa, Entamoeba invadens
SIKSI

SEQ ID NO: 2905917 - protein, 6 aa, Entamoeba invadens
SIKSIQ

SEQ ID NO: 2905918 - protein, 5 aa, Entamoeba invadens
SIKSL

SEQ ID NO: 2905919 - protein, 9 aa, Entamoeba invadens
SIKSLGSSL

SEQ ID NO: 2905920 - protein, 5 aa, Entamoeba invadens
SIKSQ

SEQ ID NO: 2905921 - protein, 9 aa, Entamoeba invadens
SIKSSSTAI

SEQ ID NO: 2905922 - protein, 5 aa, Entamoeba invadens
SIKTS

SEQ ID NO: 2905923 - protein, 8 aa, Entamoeba invadens
SILPPPQH

SEQ ID NO: 2905924 - protein, 6 aa, Entamoeba invadens
SILSED

SEQ ID NO: 2905925 - protein, 20 aa, Entamoeba invadens
SINDRKNVTSIGNNSFRECS

SEQ ID NO: 2905926 - protein, 9 aa, Entamoeba invadens
SINENYDPT

SEQ ID NO: 2905927 - protein, 13 aa, Entamoeba invadens
SINESISPNNPVN

SEQ ID NO: 2905928 - protein, 10 aa, Entamoeba invadens
SINETTTFET

SEQ ID NO: 2905929 - protein, 6 aa, Entamoeba invadens
SINGSK

SEQ ID NO: 2905930 - protein, 5 aa, Entamoeba invadens
SINGT

SEQ ID NO: 2905931 - protein, 7 aa, Entamoeba invadens
SINNNKN

SEQ ID NO: 2905932 - protein, 5 aa, Entamoeba invadens
SINNY

SEQ ID NO: 2905933 - protein, 4 aa, Entamoeba invadens
SINP

SEQ ID NO: 2905934 - protein, 13 aa, Entamoeba invadens
SINPGNITNEEFQ

SEQ ID NO: 2905935 - protein, 4 aa, Entamoeba invadens
SINQ

SEQ ID NO: 2905936 - protein, 7 aa, Entamoeba invadens
SINQDSG

SEQ ID NO: 2905937 - protein, 5 aa, Entamoeba invadens
SINTK

SEQ ID NO: 2905938 - protein, 5 aa, Entamoeba invadens
SIPDA

SEQ ID NO: 2905939 - protein, 7 aa, Entamoeba invadens
SIPDEKM

SEQ ID NO: 2905940 - protein, 7 aa, Entamoeba invadens
SIPDEVQ

SEQ ID NO: 2905941 - protein, 9 aa, Entamoeba invadens
SIPDSVTSI

SEQ ID NO: 2905942 - protein, 5 aa, Entamoeba invadens
SIPEE

SEQ ID NO: 2905943 - protein, 7 aa, Entamoeba invadens
SIPEQKT

SEQ ID NO: 2905944 - protein, 19 aa, Entamoeba invadens
SIPERERTKSECIKPTKIE

SEQ ID NO: 2905945 - protein, 8 aa, Entamoeba invadens
SIPETSQY

SEQ ID NO: 2905946 - protein, 5 aa, Entamoeba invadens
SIPGD

SEQ ID NO: 2905947 - protein, 34 aa, Entamoeba invadens
SIPGIQQPQPKTQKPLPPPPPPKPNTKSTNPFDD

SEQ ID NO: 2905948 - protein, 9 aa, Entamoeba invadens
SIPHATEQE

SEQ ID NO: 2905949 - protein, 4 aa, Entamoeba invadens
SIPK

SEQ ID NO: 2905950 - protein, 9 aa, Entamoeba invadens
SIPKDQQND

SEQ ID NO: 2905951 - protein, 11 aa, Entamoeba invadens
SIPKEYRRRPK

SEQ ID NO: 2905952 - protein, 16 aa, Entamoeba invadens
SIPKIEPGTTTQQKMN

SEQ ID NO: 2905953 - protein, 12 aa, Entamoeba invadens
SIPKNDEVSTKY

SEQ ID NO: 2905954 - protein, 6 aa, Entamoeba invadens
SIPLPS

SEQ ID NO: 2905955 - protein, 7 aa, Entamoeba invadens
SIPNEEV

SEQ ID NO: 2905956 - protein, 14 aa, Entamoeba invadens
SIPNPPTQGSKTFH

SEQ ID NO: 2905957 - protein, 7 aa, Entamoeba invadens
SIPNTSS

SEQ ID NO: 2905958 - protein, 7 aa, Entamoeba invadens
SIPPEWK

SEQ ID NO: 2905959 - protein, 6 aa, Entamoeba invadens
SIPPGP

SEQ ID NO: 2905960 - protein, 12 aa, Entamoeba invadens
SIPPLTGIPKNT

SEQ ID NO: 2905961 - protein, 5 aa, Entamoeba invadens
SIPPS

SEQ ID NO: 2905962 - protein, 7 aa, Entamoeba invadens
SIPPSVR

SEQ ID NO: 2905963 - protein, 15 aa, Entamoeba invadens
SIPPSVSSIGNSTFE

SEQ ID NO: 2905964 - protein, 4 aa, Entamoeba invadens
SIPQ

SEQ ID NO: 2905965 - protein, 23 aa, Entamoeba invadens
SIPQPKTSAVQRQSTTTYPQGYQ

SEQ ID NO: 2905966 - protein, 9 aa, Entamoeba invadens
SIPQPTLPQ

SEQ ID NO: 2905967 - protein, 17 aa, Entamoeba invadens
SIPQSKLKKSKSGNALI

SEQ ID NO: 2905968 - protein, 5 aa, Entamoeba invadens
SIPRN

SEQ ID NO: 2905969 - protein, 4 aa, Entamoeba invadens
SIPS

SEQ ID NO: 2905970 - protein, 11 aa, Entamoeba invadens
SIPSGKSYTPY

SEQ ID NO: 2905971 - protein, 9 aa, Entamoeba invadens
SIPSNAPNT

SEQ ID NO: 2905972 - protein, 7 aa, Entamoeba invadens
SIPSRES

SEQ ID NO: 2905973 - protein, 7 aa, Entamoeba invadens
SIPSSVK

SEQ ID NO: 2905974 - protein, 4 aa, Entamoeba invadens
SIPT

SEQ ID NO: 2905975 - protein, 7 aa, Entamoeba invadens
SIPTSKA

SEQ ID NO: 2905976 - protein, 5 aa, Entamoeba invadens
SIPTT

SEQ ID NO: 2905977 - protein, 6 aa, Entamoeba invadens
SIPTTP

SEQ ID NO: 2905978 - protein, 5 aa, Entamoeba invadens
SIPTY

SEQ ID NO: 2905979 - protein, 4 aa, Entamoeba invadens
SIPV

SEQ ID NO: 2905980 - protein, 4 aa, Entamoeba invadens
SIQD

SEQ ID NO: 2905981 - protein, 8 aa, Entamoeba invadens
SIQDSTQD

SEQ ID NO: 2905982 - protein, 5 aa, Entamoeba invadens
SIQED

SEQ ID NO: 2905983 - protein, 5 aa, Entamoeba invadens
SIQES

SEQ ID NO: 2905984 - protein, 5 aa, Entamoeba invadens
SIQEY

SEQ ID NO: 2905985 - protein, 21 aa, Entamoeba invadens
SIQGNGDGLSVSGCGSDTTIK

SEQ ID NO: 2905986 - protein, 5 aa, Entamoeba invadens
SIQHE

SEQ ID NO: 2905987 - protein, 5 aa, Entamoeba invadens
SIQNE

SEQ ID NO: 2905988 - protein, 11 aa, Entamoeba invadens
SIQNISKSAFS

SEQ ID NO: 2905989 - protein, 8 aa, Entamoeba invadens
SIQPSPTQ

SEQ ID NO: 2905990 - protein, 11 aa, Entamoeba invadens
SIQQEKNKIEE

SEQ ID NO: 2905991 - protein, 19 aa, Entamoeba invadens
SIQRRNNSRCSCCVVSTKT

SEQ ID NO: 2905992 - protein, 12 aa, Entamoeba invadens
SIQSEQPSRRQV

SEQ ID NO: 2905993 - protein, 9 aa, Entamoeba invadens
SIQSGKGIC

SEQ ID NO: 2905994 - protein, 11 aa, Entamoeba invadens
SIQSGKGVYKT

SEQ ID NO: 2905995 - protein, 12 aa, Entamoeba invadens
SIQSGKSKISLA

SEQ ID NO: 2905996 - protein, 16 aa, Entamoeba invadens
SIQTATSITVTKDSFI

SEQ ID NO: 2905997 - protein, 9 aa, Entamoeba invadens
SIREKPMEH

SEQ ID NO: 2905998 - protein, 5 aa, Entamoeba invadens
SIRGA

SEQ ID NO: 2905999 - protein, 14 aa, Entamoeba invadens
SIRGKKNEGYGTLD

SEQ ID NO: 2906000 - protein, 5 aa, Entamoeba invadens
SIRNR

SEQ ID NO: 2906001 - protein, 5 aa, Entamoeba invadens
SIRPE

SEQ ID NO: 2906002 - protein, 22 aa, Entamoeba invadens
SIRQKEIQEGVNQSTATRRIEK

SEQ ID NO: 2906003 - protein, 6 aa, Entamoeba invadens
SIRSDT

SEQ ID NO: 2906004 - protein, 13 aa, Entamoeba invadens
SIRSKKRNLLLKE

SEQ ID NO: 2906005 - protein, 6 aa, Entamoeba invadens
SIRSRE

SEQ ID NO: 2906006 - protein, 16 aa, Entamoeba invadens
SIRTPRKINGERKKRN

SEQ ID NO: 2906007 - protein, 6 aa, Entamoeba invadens
SISDDD

SEQ ID NO: 2906008 - protein, 7 aa, Entamoeba invadens
SISDSQN

SEQ ID NO: 2906009 - protein, 9 aa, Entamoeba invadens
SISEGKSRD

SEQ ID NO: 2906010 - protein, 15 aa, Entamoeba invadens
SISETATEVQTDDET

SEQ ID NO: 2906011 - protein, 10 aa, Entamoeba invadens
SISGEVEEQT

SEQ ID NO: 2906012 - protein, 4 aa, Entamoeba invadens
SISI

SEQ ID NO: 2906013 - protein, 5 aa, Entamoeba invadens
SISIP

SEQ ID NO: 2906014 - protein, 10 aa, Entamoeba invadens
SISIPSSVTS

SEQ ID NO: 2906015 - protein, 20 aa, Entamoeba invadens
SISISEKKSDKSQKNIKKRS

SEQ ID NO: 2906016 - protein, 11 aa, Entamoeba invadens
SISKEKASKYN

SEQ ID NO: 2906017 - protein, 12 aa, Entamoeba invadens
SISKMNNGDIHR

SEQ ID NO: 2906018 - protein, 4 aa, Entamoeba invadens
SISL

SEQ ID NO: 2906019 - protein, 4 aa, Entamoeba invadens
SISN

SEQ ID NO: 2906020 - protein, 8 aa, Entamoeba invadens
SISNDTTI

SEQ ID NO: 2906021 - protein, 10 aa, Entamoeba invadens
SISNEGTVSD

SEQ ID NO: 2906022 - protein, 14 aa, Entamoeba invadens
SISNKTTIASAKTP

SEQ ID NO: 2906023 - protein, 7 aa, Entamoeba invadens
SISNTPR

SEQ ID NO: 2906024 - protein, 13 aa, Entamoeba invadens
SISPHQIPSNTIK

SEQ ID NO: 2906025 - protein, 25 aa, Entamoeba invadens
SISPQGFEKSSFSDHSFTPSPKDRI

SEQ ID NO: 2906026 - protein, 17 aa, Entamoeba invadens
SISQELAQDTSDEEYPL

SEQ ID NO: 2906027 - protein, 13 aa, Entamoeba invadens
SISQPTSPQPVNE

SEQ ID NO: 2906028 - protein, 7 aa, Entamoeba invadens
SISRGTG

SEQ ID NO: 2906029 - protein, 10 aa, Entamoeba invadens
SISRNPSKVA

SEQ ID NO: 2906030 - protein, 5 aa, Entamoeba invadens
SISSF

SEQ ID NO: 2906031 - protein, 9 aa, Entamoeba invadens
SISSTDLDD

SEQ ID NO: 2906032 - protein, 7 aa, Entamoeba invadens
SISSTEV

SEQ ID NO: 2906033 - protein, 8 aa, Entamoeba invadens
SISTDGEK

SEQ ID NO: 2906034 - protein, 25 aa, Entamoeba invadens
SISTPSGTPSTQQDKPVQYRPRRST

SEQ ID NO: 2906035 - protein, 11 aa, Entamoeba invadens
SISTPTDKGRQ

SEQ ID NO: 2906036 - protein, 5 aa, Entamoeba invadens
SISVP

SEQ ID NO: 2906037 - protein, 7 aa, Entamoeba invadens
SISYNTK

SEQ ID NO: 2906038 - protein, 21 aa, Entamoeba invadens
SITDDELKKKGKILLDIFNGK

SEQ ID NO: 2906039 - protein, 8 aa, Entamoeba invadens
SITDKEAT

SEQ ID NO: 2906040 - protein, 11 aa, Entamoeba invadens
SITEDKDQLFS

SEQ ID NO: 2906041 - protein, 5 aa, Entamoeba invadens
SITEE

SEQ ID NO: 2906042 - protein, 13 aa, Entamoeba invadens
SITEEKKKSSVVP

SEQ ID NO: 2906043 - protein, 6 aa, Entamoeba invadens
SITEGN

SEQ ID NO: 2906044 - protein, 18 aa, Entamoeba invadens
SITEKKSQDKQNTLSPEI

SEQ ID NO: 2906045 - protein, 5 aa, Entamoeba invadens
SITEM

SEQ ID NO: 2906046 - protein, 17 aa, Entamoeba invadens
SITETKEISSLPQDEGV

SEQ ID NO: 2906047 - protein, 5 aa, Entamoeba invadens
SITGE

SEQ ID NO: 2906048 - protein, 35 aa, Entamoeba invadens
SITGTEQKEEKQESTKKSMESDKMTKKESTAPIPD

SEQ ID NO: 2906049 - protein, 10 aa, Entamoeba invadens
SITHKKTTYP

SEQ ID NO: 2906050 - protein, 12 aa, Entamoeba invadens
SITIPKSVILIG

SEQ ID NO: 2906051 - protein, 9 aa, Entamoeba invadens
SITIPSSVT

SEQ ID NO: 2906052 - protein, 4 aa, Entamoeba invadens
SITK

SEQ ID NO: 2906053 - protein, 5 aa, Entamoeba invadens
SITKF

SEQ ID NO: 2906054 - protein, 9 aa, Entamoeba invadens
SITKNDTKI

SEQ ID NO: 2906055 - protein, 15 aa, Entamoeba invadens
SITLRGKAKKVAKKF

SEQ ID NO: 2906056 - protein, 4 aa, Entamoeba invadens
SITN

SEQ ID NO: 2906057 - protein, 20 aa, Entamoeba invadens
SITNENRISNDNTKDNDKTF

SEQ ID NO: 2906058 - protein, 14 aa, Entamoeba invadens
SITNFETDSSKFRS

SEQ ID NO: 2906059 - protein, 9 aa, Entamoeba invadens
SITNNDAQI

SEQ ID NO: 2906060 - protein, 4 aa, Entamoeba invadens
SITQ

SEQ ID NO: 2906061 - protein, 6 aa, Entamoeba invadens
SITQEE

SEQ ID NO: 2906062 - protein, 7 aa, Entamoeba invadens
SITQQQL

SEQ ID NO: 2906063 - protein, 9 aa, Entamoeba invadens
SITRNEKKS

SEQ ID NO: 2906064 - protein, 7 aa, Entamoeba invadens
SITSDFE

SEQ ID NO: 2906065 - protein, 13 aa, Entamoeba invadens
SITSEEKNENDLV

SEQ ID NO: 2906066 - protein, 5 aa, Entamoeba invadens
SITSI

SEQ ID NO: 2906067 - protein, 12 aa, Entamoeba invadens
SITSKTVGGSNG

SEQ ID NO: 2906068 - protein, 12 aa, Entamoeba invadens
SITSNVTHSKPY

SEQ ID NO: 2906069 - protein, 6 aa, Entamoeba invadens
SITSSL

SEQ ID NO: 2906070 - protein, 4 aa, Entamoeba invadens
SITT

SEQ ID NO: 2906071 - protein, 6 aa, Entamoeba invadens
SITTIR

SEQ ID NO: 2906072 - protein, 7 aa, Entamoeba invadens
SITTKKK

SEQ ID NO: 2906073 - protein, 5 aa, Entamoeba invadens
SITTT

SEQ ID NO: 2906074 - protein, 37 aa, Entamoeba invadens
SIVEGNATQTYEEKKKEIKQKREEIQEKLDRNKDKME

SEQ ID NO: 2906075 - protein, 16 aa, Entamoeba invadens
SIVSREKSKIEEEMKT

SEQ ID NO: 2906076 - protein, 11 aa, Entamoeba invadens
SIYKSEKSYLG

SEQ ID NO: 2906077 - protein, 4 aa, Entamoeba invadens
SIYN

SEQ ID NO: 2906078 - protein, 10 aa, Entamoeba invadens
SIYPKDDVEE

SEQ ID NO: 2906079 - protein, 10 aa, Entamoeba invadens
SIYSSGGKPI

SEQ ID NO: 2906080 - protein, 9 aa, Entamoeba invadens
SKAAKQVQK

SEQ ID NO: 2906081 - protein, 14 aa, Entamoeba invadens
SKAAVTSLKNLDGN

SEQ ID NO: 2906082 - protein, 4 aa, Entamoeba invadens
SKAC

SEQ ID NO: 2906083 - protein, 9 aa, Entamoeba invadens
SKADSISGV

SEQ ID NO: 2906084 - protein, 7 aa, Entamoeba invadens
SKADSSY

SEQ ID NO: 2906085 - protein, 12 aa, Entamoeba invadens
SKAENQTKDKVS

SEQ ID NO: 2906086 - protein, 8 aa, Entamoeba invadens
SKAFQKNT

SEQ ID NO: 2906087 - protein, 8 aa, Entamoeba invadens
SKAGAIQR

SEQ ID NO: 2906088 - protein, 7 aa, Entamoeba invadens
SKAGGVG

SEQ ID NO: 2906089 - protein, 6 aa, Entamoeba invadens
SKAIPQ

SEQ ID NO: 2906090 - protein, 6 aa, Entamoeba invadens
SKAISD

SEQ ID NO: 2906091 - protein, 7 aa, Entamoeba invadens
SKAISKR

SEQ ID NO: 2906092 - protein, 18 aa, Entamoeba invadens
SKAITADTNFENTQPPVP

SEQ ID NO: 2906093 - protein, 9 aa, Entamoeba invadens
SKAKSDVLR

SEQ ID NO: 2906094 - protein, 6 aa, Entamoeba invadens
SKAKTF

SEQ ID NO: 2906095 - protein, 19 aa, Entamoeba invadens
SKALETLSKYNDKYENGKS

SEQ ID NO: 2906096 - protein, 7 aa, Entamoeba invadens
SKALGSD

SEQ ID NO: 2906097 - protein, 10 aa, Entamoeba invadens
SKAMDNTVKE

SEQ ID NO: 2906098 - protein, 8 aa, Entamoeba invadens
SKANEKET

SEQ ID NO: 2906099 - protein, 5 aa, Entamoeba invadens
SKANV

SEQ ID NO: 2906100 - protein, 6 aa, Entamoeba invadens
SKAPLK

SEQ ID NO: 2906101 - protein, 9 aa, Entamoeba invadens
SKARESDGL

SEQ ID NO: 2906102 - protein, 9 aa, Entamoeba invadens
SKARGKPIE

SEQ ID NO: 2906103 - protein, 7 aa, Entamoeba invadens
SKARYTN

SEQ ID NO: 2906104 - protein, 17 aa, Entamoeba invadens
SKASADQRAGRAGRVSP

SEQ ID NO: 2906105 - protein, 11 aa, Entamoeba invadens
SKASGASGRGL

SEQ ID NO: 2906106 - protein, 5 aa, Entamoeba invadens
SKASI

SEQ ID NO: 2906107 - protein, 11 aa, Entamoeba invadens
SKASIPINPKE

SEQ ID NO: 2906108 - protein, 85 aa, Entamoeba invadens
SKASKQKRLDTYSPRSSSSDNEDEKPRRRKSRSRSKSKDKKKDQETSPPFSDKDSQNSANSAEIERTTKKEEKDGKRDVKNTKRQ

SEQ ID NO: 2906109 - protein, 9 aa, Entamoeba invadens
SKASQVGNT

SEQ ID NO: 2906110 - protein, 5 aa, Entamoeba invadens
SKASV

SEQ ID NO: 2906111 - protein, 4 aa, Entamoeba invadens
SKAV

SEQ ID NO: 2906112 - protein, 10 aa, Entamoeba invadens
SKAYKKDQNY

SEQ ID NO: 2906113 - protein, 17 aa, Entamoeba invadens
SKAYTTLQQKTNAIDTR

SEQ ID NO: 2906114 - protein, 9 aa, Entamoeba invadens
SKCANTDTE

SEQ ID NO: 2906115 - protein, 4 aa, Entamoeba invadens
SKCC

SEQ ID NO: 2906116 - protein, 6 aa, Entamoeba invadens
SKCDEE

SEQ ID NO: 2906117 - protein, 14 aa, Entamoeba invadens
SKCENCKKSNTLQI

SEQ ID NO: 2906118 - protein, 6 aa, Entamoeba invadens
SKCISS

SEQ ID NO: 2906119 - protein, 9 aa, Entamoeba invadens
SKCKDQPNV

SEQ ID NO: 2906120 - protein, 9 aa, Entamoeba invadens
SKCKEDTIL

SEQ ID NO: 2906121 - protein, 9 aa, Entamoeba invadens
SKCKENTIL

SEQ ID NO: 2906122 - protein, 39 aa, Entamoeba invadens
SKCKIEDDAPKISQKDKDKEIKDKDKKDKEKAVAKNKKT

SEQ ID NO: 2906123 - protein, 22 aa, Entamoeba invadens
SKCQDEINSLQQTQKNPKPLRT

SEQ ID NO: 2906124 - protein, 6 aa, Entamoeba invadens
SKCTEG

SEQ ID NO: 2906125 - protein, 6 aa, Entamoeba invadens
SKCTSQ

SEQ ID NO: 2906126 - protein, 10 aa, Entamoeba invadens
SKDADSASVA

SEQ ID NO: 2906127 - protein, 8 aa, Entamoeba invadens
SKDAGGNV

SEQ ID NO: 2906128 - protein, 7 aa, Entamoeba invadens
SKDASKI

SEQ ID NO: 2906129 - protein, 13 aa, Entamoeba invadens
SKDCPDAWKFTNT

SEQ ID NO: 2906130 - protein, 9 aa, Entamoeba invadens
SKDCPPTKF

SEQ ID NO: 2906131 - protein, 32 aa, Entamoeba invadens
SKDCPTKIEEEKEVKKAEDKIEEQNEPKKVEK

SEQ ID NO: 2906132 - protein, 4 aa, Entamoeba invadens
SKDD

SEQ ID NO: 2906133 - protein, 6 aa, Entamoeba invadens
SKDDEE

SEQ ID NO: 2906134 - protein, 8 aa, Entamoeba invadens
SKDDHKNY

SEQ ID NO: 2906135 - protein, 10 aa, Entamoeba invadens
SKDDPTTSSL

SEQ ID NO: 2906136 - protein, 4 aa, Entamoeba invadens
SKDE

SEQ ID NO: 2906137 - protein, 7 aa, Entamoeba invadens
SKDEFKQ

SEQ ID NO: 2906138 - protein, 6 aa, Entamoeba invadens
SKDEKL

SEQ ID NO: 2906139 - protein, 19 aa, Entamoeba invadens
SKDEKSESSESKSKHDNRA

SEQ ID NO: 2906140 - protein, 5 aa, Entamoeba invadens
SKDEP

SEQ ID NO: 2906141 - protein, 16 aa, Entamoeba invadens
SKDESSSKTIDLKAGT

SEQ ID NO: 2906142 - protein, 6 aa, Entamoeba invadens
SKDEYA

SEQ ID NO: 2906143 - protein, 14 aa, Entamoeba invadens
SKDFPESNNEKTTI

SEQ ID NO: 2906144 - protein, 4 aa, Entamoeba invadens
SKDG

SEQ ID NO: 2906145 - protein, 24 aa, Entamoeba invadens
SKDGATREEQLNSTVTRLTSENEC

SEQ ID NO: 2906146 - protein, 8 aa, Entamoeba invadens
SKDGGTGF

SEQ ID NO: 2906147 - protein, 11 aa, Entamoeba invadens
SKDGNNSYPVH

SEQ ID NO: 2906148 - protein, 10 aa, Entamoeba invadens
SKDGSAKADL

SEQ ID NO: 2906149 - protein, 12 aa, Entamoeba invadens
SKDHQYDPNTDS

SEQ ID NO: 2906150 - protein, 4 aa, Entamoeba invadens
SKDI

SEQ ID NO: 2906151 - protein, 13 aa, Entamoeba invadens
SKDIDGKNANPYR

SEQ ID NO: 2906152 - protein, 5 aa, Entamoeba invadens
SKDIE

SEQ ID NO: 2906153 - protein, 8 aa, Entamoeba invadens
SKDIERDD

SEQ ID NO: 2906154 - protein, 8 aa, Entamoeba invadens
SKDISKTK

SEQ ID NO: 2906155 - protein, 7 aa, Entamoeba invadens
SKDKDKV

SEQ ID NO: 2906156 - protein, 24 aa, Entamoeba invadens
SKDKEDTTKVEPLEEDQEEEYSED

SEQ ID NO: 2906157 - protein, 23 aa, Entamoeba invadens
SKDKERKEKEIVRSKRSEPEMTA

SEQ ID NO: 2906158 - protein, 9 aa, Entamoeba invadens
SKDKSNYSV

SEQ ID NO: 2906159 - protein, 9 aa, Entamoeba invadens
SKDKTKKSE

SEQ ID NO: 2906160 - protein, 6 aa, Entamoeba invadens
SKDKTR

SEQ ID NO: 2906161 - protein, 12 aa, Entamoeba invadens
SKDLDGKVVSGR

SEQ ID NO: 2906162 - protein, 16 aa, Entamoeba invadens
SKDLSDKISSFRCSSL

SEQ ID NO: 2906163 - protein, 21 aa, Entamoeba invadens
SKDLSKENSKEKSKEKVSPVV

SEQ ID NO: 2906164 - protein, 11 aa, Entamoeba invadens
SKDLSTISQQI

SEQ ID NO: 2906165 - protein, 7 aa, Entamoeba invadens
SKDLSTY

SEQ ID NO: 2906166 - protein, 9 aa, Entamoeba invadens
SKDLTDKFN

SEQ ID NO: 2906167 - protein, 9 aa, Entamoeba invadens
SKDNSSDVV

SEQ ID NO: 2906168 - protein, 9 aa, Entamoeba invadens
SKDPLETIN

SEQ ID NO: 2906169 - protein, 15 aa, Entamoeba invadens
SKDPNKQFKTLGPSL

SEQ ID NO: 2906170 - protein, 7 aa, Entamoeba invadens
SKDPNKV

SEQ ID NO: 2906171 - protein, 6 aa, Entamoeba invadens
SKDPNQ

SEQ ID NO: 2906172 - protein, 8 aa, Entamoeba invadens
SKDPVSVS

SEQ ID NO: 2906173 - protein, 4 aa, Entamoeba invadens
SKDQ

SEQ ID NO: 2906174 - protein, 5 aa, Entamoeba invadens
SKDQI

SEQ ID NO: 2906175 - protein, 6 aa, Entamoeba invadens
SKDQII

SEQ ID NO: 2906176 - protein, 7 aa, Entamoeba invadens
SKDQKIT

SEQ ID NO: 2906177 - protein, 5 aa, Entamoeba invadens
SKDQN

SEQ ID NO: 2906178 - protein, 7 aa, Entamoeba invadens
SKDQYAT

SEQ ID NO: 2906179 - protein, 6 aa, Entamoeba invadens
SKDQYG

SEQ ID NO: 2906180 - protein, 9 aa, Entamoeba invadens
SKDRDASKS

SEQ ID NO: 2906181 - protein, 12 aa, Entamoeba invadens
SKDRPRQEYQYR

SEQ ID NO: 2906182 - protein, 5 aa, Entamoeba invadens
SKDRT

SEQ ID NO: 2906183 - protein, 8 aa, Entamoeba invadens
SKDSGHSF

SEQ ID NO: 2906184 - protein, 20 aa, Entamoeba invadens
SKDSHRNSTPVKGTALPPRR

SEQ ID NO: 2906185 - protein, 6 aa, Entamoeba invadens
SKDSIE

SEQ ID NO: 2906186 - protein, 76 aa, Entamoeba invadens
SKDTDSTPGNFNASVSSYSAPAQQQQAYQAPVQQQAPAQQAYQAPQQQQQAAAPVKKSPPMPPRAAPPPPKPKLPQ

SEQ ID NO: 2906187 - protein, 8 aa, Entamoeba invadens
SKDTEYQN

SEQ ID NO: 2906188 - protein, 7 aa, Entamoeba invadens
SKDTHEE

SEQ ID NO: 2906189 - protein, 24 aa, Entamoeba invadens
SKDTQQAQTQTGMDEDVIENVLEW

SEQ ID NO: 2906190 - protein, 7 aa, Entamoeba invadens
SKDTRQL

SEQ ID NO: 2906191 - protein, 6 aa, Entamoeba invadens
SKDTSL

SEQ ID NO: 2906192 - protein, 6 aa, Entamoeba invadens
SKDVKD

SEQ ID NO: 2906193 - protein, 22 aa, Entamoeba invadens
SKDVSNYSDTPNADDFKNDANR

SEQ ID NO: 2906194 - protein, 5 aa, Entamoeba invadens
SKDYH

SEQ ID NO: 2906195 - protein, 4 aa, Entamoeba invadens
SKEA

SEQ ID NO: 2906196 - protein, 12 aa, Entamoeba invadens
SKEAAKTLHDDL

SEQ ID NO: 2906197 - protein, 21 aa, Entamoeba invadens
SKEAPKTNGDPPETKLAAGSL

SEQ ID NO: 2906198 - protein, 12 aa, Entamoeba invadens
SKEARNKLKGSD

SEQ ID NO: 2906199 - protein, 10 aa, Entamoeba invadens
SKEDITKTCY

SEQ ID NO: 2906200 - protein, 17 aa, Entamoeba invadens
SKEDLPPPQEYYPPNEY

SEQ ID NO: 2906201 - protein, 21 aa, Entamoeba invadens
SKEDLPPPQEYYPSNENMKSN

SEQ ID NO: 2906202 - protein, 6 aa, Entamoeba invadens
SKEDMD

SEQ ID NO: 2906203 - protein, 8 aa, Entamoeba invadens
SKEDPNYK

SEQ ID NO: 2906204 - protein, 10 aa, Entamoeba invadens
SKEDPYDRTP

SEQ ID NO: 2906205 - protein, 20 aa, Entamoeba invadens
SKEDVEQLKAEGEKKRILNE

SEQ ID NO: 2906206 - protein, 14 aa, Entamoeba invadens
SKEEAQSQLDGRVD

SEQ ID NO: 2906207 - protein, 6 aa, Entamoeba invadens
SKEEAY

SEQ ID NO: 2906208 - protein, 11 aa, Entamoeba invadens
SKEEDGCSYIP

SEQ ID NO: 2906209 - protein, 7 aa, Entamoeba invadens
SKEEFTS

SEQ ID NO: 2906210 - protein, 6 aa, Entamoeba invadens
SKEEHG

SEQ ID NO: 2906211 - protein, 8 aa, Entamoeba invadens
SKEEKEKW

SEQ ID NO: 2906212 - protein, 8 aa, Entamoeba invadens
SKEEKEYF

SEQ ID NO: 2906213 - protein, 27 aa, Entamoeba invadens
SKEELGAAIKNNGIKAPDSGNDLSDPV

SEQ ID NO: 2906214 - protein, 5 aa, Entamoeba invadens
SKEEM

SEQ ID NO: 2906215 - protein, 8 aa, Entamoeba invadens
SKEEMNAQ

SEQ ID NO: 2906216 - protein, 6 aa, Entamoeba invadens
SKEENK

SEQ ID NO: 2906217 - protein, 11 aa, Entamoeba invadens
SKEENKDKDME

SEQ ID NO: 2906218 - protein, 9 aa, Entamoeba invadens
SKEERIQEN

SEQ ID NO: 2906219 - protein, 9 aa, Entamoeba invadens
SKEETLHKP

SEQ ID NO: 2906220 - protein, 8 aa, Entamoeba invadens
SKEFHEGD

SEQ ID NO: 2906221 - protein, 11 aa, Entamoeba invadens
SKEFNKPLSKT

SEQ ID NO: 2906222 - protein, 4 aa, Entamoeba invadens
SKEG

SEQ ID NO: 2906223 - protein, 12 aa, Entamoeba invadens
SKEGGQKQSLSS

SEQ ID NO: 2906224 - protein, 5 aa, Entamoeba invadens
SKEGR

SEQ ID NO: 2906225 - protein, 6 aa, Entamoeba invadens
SKEGRG

SEQ ID NO: 2906226 - protein, 6 aa, Entamoeba invadens
SKEIDA

SEQ ID NO: 2906227 - protein, 9 aa, Entamoeba invadens
SKEIGESEQ

SEQ ID NO: 2906228 - protein, 10 aa, Entamoeba invadens
SKEIKERRNG

SEQ ID NO: 2906229 - protein, 9 aa, Entamoeba invadens
SKEIQGPNT

SEQ ID NO: 2906230 - protein, 7 aa, Entamoeba invadens
SKEITNN

SEQ ID NO: 2906231 - protein, 4 aa, Entamoeba invadens
SKEK

SEQ ID NO: 2906232 - protein, 16 aa, Entamoeba invadens
SKEKAKVSDSRRNELY

SEQ ID NO: 2906233 - protein, 19 aa, Entamoeba invadens
SKEKEFGKVEKEKEASRKI

SEQ ID NO: 2906234 - protein, 5 aa, Entamoeba invadens
SKEKF

SEQ ID NO: 2906235 - protein, 9 aa, Entamoeba invadens
SKEKFPANP

SEQ ID NO: 2906236 - protein, 9 aa, Entamoeba invadens
SKEKGEKVD

SEQ ID NO: 2906237 - protein, 7 aa, Entamoeba invadens
SKEKGIV

SEQ ID NO: 2906238 - protein, 9 aa, Entamoeba invadens
SKEKKDGWD

SEQ ID NO: 2906239 - protein, 9 aa, Entamoeba invadens
SKEKKDGWN

SEQ ID NO: 2906240 - protein, 7 aa, Entamoeba invadens
SKEKPAF

SEQ ID NO: 2906241 - protein, 7 aa, Entamoeba invadens
SKEKQQL

SEQ ID NO: 2906242 - protein, 9 aa, Entamoeba invadens
SKEKSPQFY

SEQ ID NO: 2906243 - protein, 7 aa, Entamoeba invadens
SKEKTQY

SEQ ID NO: 2906244 - protein, 25 aa, Entamoeba invadens
SKEKTYKKNADGVTIEDSEYSETFV

SEQ ID NO: 2906245 - protein, 17 aa, Entamoeba invadens
SKEKYDETGPSIINRIC

SEQ ID NO: 2906246 - protein, 8 aa, Entamoeba invadens
SKEKYSLY

SEQ ID NO: 2906247 - protein, 11 aa, Entamoeba invadens
SKELGGDLTND

SEQ ID NO: 2906248 - protein, 15 aa, Entamoeba invadens
SKELGKKNAEISETL

SEQ ID NO: 2906249 - protein, 6 aa, Entamoeba invadens
SKELSE

SEQ ID NO: 2906250 - protein, 4 aa, Entamoeba invadens
SKEM

SEQ ID NO: 2906251 - protein, 21 aa, Entamoeba invadens
SKEMEKESGTKESDIPQEATD

SEQ ID NO: 2906252 - protein, 5 aa, Entamoeba invadens
SKEMV

SEQ ID NO: 2906253 - protein, 5 aa, Entamoeba invadens
SKENE

SEQ ID NO: 2906254 - protein, 6 aa, Entamoeba invadens
SKENFG

SEQ ID NO: 2906255 - protein, 10 aa, Entamoeba invadens
SKENGMDPQR

SEQ ID NO: 2906256 - protein, 7 aa, Entamoeba invadens
SKENKGI

SEQ ID NO: 2906257 - protein, 7 aa, Entamoeba invadens
SKENKVI

SEQ ID NO: 2906258 - protein, 15 aa, Entamoeba invadens
SKENPTSKNDEEPAH

SEQ ID NO: 2906259 - protein, 5 aa, Entamoeba invadens
SKENQ

SEQ ID NO: 2906260 - protein, 6 aa, Entamoeba invadens
SKENRQ

SEQ ID NO: 2906261 - protein, 15 aa, Entamoeba invadens
SKENVKSDDRSETFC

SEQ ID NO: 2906262 - protein, 17 aa, Entamoeba invadens
SKENYDETGPSNINRVC

SEQ ID NO: 2906263 - protein, 16 aa, Entamoeba invadens
SKEPELDRKEVKKTFD

SEQ ID NO: 2906264 - protein, 8 aa, Entamoeba invadens
SKEPIEET

SEQ ID NO: 2906265 - protein, 11 aa, Entamoeba invadens
SKEPLKKSNLV

SEQ ID NO: 2906266 - protein, 7 aa, Entamoeba invadens
SKEPQNL

SEQ ID NO: 2906267 - protein, 11 aa, Entamoeba invadens
SKEPSPKNTEI

SEQ ID NO: 2906268 - protein, 9 aa, Entamoeba invadens
SKEPWTAEE

SEQ ID NO: 2906269 - protein, 10 aa, Entamoeba invadens
SKEPYSKPGF

SEQ ID NO: 2906270 - protein, 35 aa, Entamoeba invadens
SKEQDTLQRKEITPKVPPKIPAKPRPKEEPQLSHQ

SEQ ID NO: 2906271 - protein, 7 aa, Entamoeba invadens
SKEQEHL

SEQ ID NO: 2906272 - protein, 5 aa, Entamoeba invadens
SKEQF

SEQ ID NO: 2906273 - protein, 5 aa, Entamoeba invadens
SKEQG

SEQ ID NO: 2906274 - protein, 6 aa, Entamoeba invadens
SKEQQI

SEQ ID NO: 2906275 - protein, 13 aa, Entamoeba invadens
SKEQSKKEKHIKE

SEQ ID NO: 2906276 - protein, 4 aa, Entamoeba invadens
SKER

SEQ ID NO: 2906277 - protein, 5 aa, Entamoeba invadens
SKERI

SEQ ID NO: 2906278 - protein, 13 aa, Entamoeba invadens
SKERNSSDDDLSD

SEQ ID NO: 2906279 - protein, 6 aa, Entamoeba invadens
SKERQK

SEQ ID NO: 2906280 - protein, 9 aa, Entamoeba invadens
SKERRQCED

SEQ ID NO: 2906281 - protein, 7 aa, Entamoeba invadens
SKERSRN

SEQ ID NO: 2906282 - protein, 7 aa, Entamoeba invadens
SKERSSL

SEQ ID NO: 2906283 - protein, 15 aa, Entamoeba invadens
SKESAALEKEGSSDD

SEQ ID NO: 2906284 - protein, 9 aa, Entamoeba invadens
SKESENTVK

SEQ ID NO: 2906285 - protein, 5 aa, Entamoeba invadens
SKESF

SEQ ID NO: 2906286 - protein, 6 aa, Entamoeba invadens
SKESFE

SEQ ID NO: 2906287 - protein, 7 aa, Entamoeba invadens
SKESFED

SEQ ID NO: 2906288 - protein, 5 aa, Entamoeba invadens
SKESL

SEQ ID NO: 2906289 - protein, 7 aa, Entamoeba invadens
SKESPFP

SEQ ID NO: 2906290 - protein, 20 aa, Entamoeba invadens
SKESSRKVKVEKKRIDETRY

SEQ ID NO: 2906291 - protein, 11 aa, Entamoeba invadens
SKESSSSEERL

SEQ ID NO: 2906292 - protein, 6 aa, Entamoeba invadens
SKESYN

SEQ ID NO: 2906293 - protein, 8 aa, Entamoeba invadens
SKETADDF

SEQ ID NO: 2906294 - protein, 5 aa, Entamoeba invadens
SKETL

SEQ ID NO: 2906295 - protein, 6 aa, Entamoeba invadens
SKETSN

SEQ ID NO: 2906296 - protein, 17 aa, Entamoeba invadens
SKETTENCKNAIPGTSL

SEQ ID NO: 2906297 - protein, 24 aa, Entamoeba invadens
SKEVAEETRIQYGGSVNNANCDEL

SEQ ID NO: 2906298 - protein, 7 aa, Entamoeba invadens
SKEVENA

SEQ ID NO: 2906299 - protein, 10 aa, Entamoeba invadens
SKEVESLKTQ

SEQ ID NO: 2906300 - protein, 11 aa, Entamoeba invadens
SKEVKNTPDPI

SEQ ID NO: 2906301 - protein, 12 aa, Entamoeba invadens
SKEVNPSITDDW

SEQ ID NO: 2906302 - protein, 8 aa, Entamoeba invadens
SKEVSNDI

SEQ ID NO: 2906303 - protein, 5 aa, Entamoeba invadens
SKEVT

SEQ ID NO: 2906304 - protein, 7 aa, Entamoeba invadens
SKEWENA

SEQ ID NO: 2906305 - protein, 4 aa, Entamoeba invadens
SKEY

SEQ ID NO: 2906306 - protein, 7 aa, Entamoeba invadens
SKEYDGY

SEQ ID NO: 2906307 - protein, 22 aa, Entamoeba invadens
SKEYDYKSNNVVEDAASLQCIQ

SEQ ID NO: 2906308 - protein, 11 aa, Entamoeba invadens
SKEYESNKTAW

SEQ ID NO: 2906309 - protein, 10 aa, Entamoeba invadens
SKEYNEEKTL

SEQ ID NO: 2906310 - protein, 7 aa, Entamoeba invadens
SKEYPSL

SEQ ID NO: 2906311 - protein, 8 aa, Entamoeba invadens
SKEYSNNV

SEQ ID NO: 2906312 - protein, 16 aa, Entamoeba invadens
SKFAELTKKDTATPTE

SEQ ID NO: 2906313 - protein, 7 aa, Entamoeba invadens
SKFAQAE

SEQ ID NO: 2906314 - protein, 4 aa, Entamoeba invadens
SKFD

SEQ ID NO: 2906315 - protein, 17 aa, Entamoeba invadens
SKFENNEGIEGKRESVP

SEQ ID NO: 2906316 - protein, 5 aa, Entamoeba invadens
SKFGD

SEQ ID NO: 2906317 - protein, 5 aa, Entamoeba invadens
SKFGE

SEQ ID NO: 2906318 - protein, 7 aa, Entamoeba invadens
SKFGNVD

SEQ ID NO: 2906319 - protein, 4 aa, Entamoeba invadens
SKFK

SEQ ID NO: 2906320 - protein, 6 aa, Entamoeba invadens
SKFKDT

SEQ ID NO: 2906321 - protein, 6 aa, Entamoeba invadens
SKFKEA

SEQ ID NO: 2906322 - protein, 13 aa, Entamoeba invadens
SKFKETKSHYGNH

SEQ ID NO: 2906323 - protein, 7 aa, Entamoeba invadens
SKFKNES

SEQ ID NO: 2906324 - protein, 11 aa, Entamoeba invadens
SKFPSKSIQQI

SEQ ID NO: 2906325 - protein, 10 aa, Entamoeba invadens
SKFRNQANTV

SEQ ID NO: 2906326 - protein, 4 aa, Entamoeba invadens
SKFT

SEQ ID NO: 2906327 - protein, 6 aa, Entamoeba invadens
SKFTPG

SEQ ID NO: 2906328 - protein, 9 aa, Entamoeba invadens
SKFTPTPPL

SEQ ID NO: 2906329 - protein, 16 aa, Entamoeba invadens
SKGACSQQQPTPDTCS

SEQ ID NO: 2906330 - protein, 7 aa, Entamoeba invadens
SKGAELT

SEQ ID NO: 2906331 - protein, 12 aa, Entamoeba invadens
SKGAKLDDGIKE

SEQ ID NO: 2906332 - protein, 7 aa, Entamoeba invadens
SKGDART

SEQ ID NO: 2906333 - protein, 9 aa, Entamoeba invadens
SKGDDTVTK

SEQ ID NO: 2906334 - protein, 8 aa, Entamoeba invadens
SKGDHSGA

SEQ ID NO: 2906335 - protein, 9 aa, Entamoeba invadens
SKGDYDDDM

SEQ ID NO: 2906336 - protein, 4 aa, Entamoeba invadens
SKGE

SEQ ID NO: 2906337 - protein, 9 aa, Entamoeba invadens
SKGEDENNL

SEQ ID NO: 2906338 - protein, 7 aa, Entamoeba invadens
SKGEDMA

SEQ ID NO: 2906339 - protein, 6 aa, Entamoeba invadens
SKGEKF

SEQ ID NO: 2906340 - protein, 12 aa, Entamoeba invadens
SKGEKKARKALE

SEQ ID NO: 2906341 - protein, 5 aa, Entamoeba invadens
SKGEY

SEQ ID NO: 2906342 - protein, 7 aa, Entamoeba invadens
SKGEYPI

SEQ ID NO: 2906343 - protein, 8 aa, Entamoeba invadens
SKGFEEKP

SEQ ID NO: 2906344 - protein, 7 aa, Entamoeba invadens
SKGFKTS

SEQ ID NO: 2906345 - protein, 5 aa, Entamoeba invadens
SKGFR

SEQ ID NO: 2906346 - protein, 8 aa, Entamoeba invadens
SKGGRNAC

SEQ ID NO: 2906347 - protein, 106 aa, Entamoeba invadens
SKGIANKEDEKNAEESSSESFSSYSSNSNDEDSSFTTSSVSNFTESDNDTESSEPVTKKKTKKAKTTKKTTKKSTKKSTKKTTKKATKKDEQSETETKSEANDKPF

SEQ ID NO: 2906348 - protein, 6 aa, Entamoeba invadens
SKGIFN

SEQ ID NO: 2906349 - protein, 18 aa, Entamoeba invadens
SKGITEKTAKRRVESNRV

SEQ ID NO: 2906350 - protein, 17 aa, Entamoeba invadens
SKGKASGKSRNYNLDEN

SEQ ID NO: 2906351 - protein, 18 aa, Entamoeba invadens
SKGKIKLAEKNGSYGILW

SEQ ID NO: 2906352 - protein, 7 aa, Entamoeba invadens
SKGKITV

SEQ ID NO: 2906353 - protein, 8 aa, Entamoeba invadens
SKGKSGTM

SEQ ID NO: 2906354 - protein, 5 aa, Entamoeba invadens
SKGKV

SEQ ID NO: 2906355 - protein, 9 aa, Entamoeba invadens
SKGPSLMTP

SEQ ID NO: 2906356 - protein, 22 aa, Entamoeba invadens
SKGPVQGNIEQYKQAEQSYNAL

SEQ ID NO: 2906357 - protein, 7 aa, Entamoeba invadens
SKGQDAS

SEQ ID NO: 2906358 - protein, 7 aa, Entamoeba invadens
SKGQQPV

SEQ ID NO: 2906359 - protein, 11 aa, Entamoeba invadens
SKGRQNEGNDD

SEQ ID NO: 2906360 - protein, 7 aa, Entamoeba invadens
SKGSQIY

SEQ ID NO: 2906361 - protein, 14 aa, Entamoeba invadens
SKGSTDNITVIVIK

SEQ ID NO: 2906362 - protein, 5 aa, Entamoeba invadens
SKGSV

SEQ ID NO: 2906363 - protein, 14 aa, Entamoeba invadens
SKGTAYRRSMDAKR

SEQ ID NO: 2906364 - protein, 9 aa, Entamoeba invadens
SKGTDAVQK

SEQ ID NO: 2906365 - protein, 22 aa, Entamoeba invadens
SKGTDEPTISLSKGAEELSPTE

SEQ ID NO: 2906366 - protein, 16 aa, Entamoeba invadens
SKGTTPHSHKKQETTC

SEQ ID NO: 2906367 - protein, 8 aa, Entamoeba invadens
SKGVGKTS

SEQ ID NO: 2906368 - protein, 18 aa, Entamoeba invadens
SKGVVNNKKSNKKELNTQ

SEQ ID NO: 2906369 - protein, 13 aa, Entamoeba invadens
SKGYADLSPIGGG

SEQ ID NO: 2906370 - protein, 5 aa, Entamoeba invadens
SKGYD

SEQ ID NO: 2906371 - protein, 6 aa, Entamoeba invadens
SKGYDE

SEQ ID NO: 2906372 - protein, 7 aa, Entamoeba invadens
SKHEKIE

SEQ ID NO: 2906373 - protein, 8 aa, Entamoeba invadens
SKHGNEVD

SEQ ID NO: 2906374 - protein, 6 aa, Entamoeba invadens
SKHHNE

SEQ ID NO: 2906375 - protein, 5 aa, Entamoeba invadens
SKHIP

SEQ ID NO: 2906376 - protein, 6 aa, Entamoeba invadens
SKHKHK

SEQ ID NO: 2906377 - protein, 12 aa, Entamoeba invadens
SKHKIKQEEYRD

SEQ ID NO: 2906378 - protein, 12 aa, Entamoeba invadens
SKHKNIKMNSEA

SEQ ID NO: 2906379 - protein, 8 aa, Entamoeba invadens
SKHNNKDE

SEQ ID NO: 2906380 - protein, 6 aa, Entamoeba invadens
SKHPNY

SEQ ID NO: 2906381 - protein, 4 aa, Entamoeba invadens
SKHR

SEQ ID NO: 2906382 - protein, 8 aa, Entamoeba invadens
SKHSEACK

SEQ ID NO: 2906383 - protein, 6 aa, Entamoeba invadens
SKHTTY

SEQ ID NO: 2906384 - protein, 7 aa, Entamoeba invadens
SKIADNY

SEQ ID NO: 2906385 - protein, 8 aa, Entamoeba invadens
SKIDEIDN

SEQ ID NO: 2906386 - protein, 12 aa, Entamoeba invadens
SKIDEKSGELKS

SEQ ID NO: 2906387 - protein, 7 aa, Entamoeba invadens
SKIDGAT

SEQ ID NO: 2906388 - protein, 6 aa, Entamoeba invadens
SKIDST

SEQ ID NO: 2906389 - protein, 4 aa, Entamoeba invadens
SKIE

SEQ ID NO: 2906390 - protein, 10 aa, Entamoeba invadens
SKIEETQTYT

SEQ ID NO: 2906391 - protein, 17 aa, Entamoeba invadens
SKIEKDIQKNQNPNSPM

SEQ ID NO: 2906392 - protein, 6 aa, Entamoeba invadens
SKIEKG

SEQ ID NO: 2906393 - protein, 16 aa, Entamoeba invadens
SKIEKVEKSSPDISAD

SEQ ID NO: 2906394 - protein, 5 aa, Entamoeba invadens
SKIEN

SEQ ID NO: 2906395 - protein, 13 aa, Entamoeba invadens
SKIEQQQNKENEW

SEQ ID NO: 2906396 - protein, 13 aa, Entamoeba invadens
SKIESPTGPSRKE

SEQ ID NO: 2906397 - protein, 4 aa, Entamoeba invadens
SKIG

SEQ ID NO: 2906398 - protein, 5 aa, Entamoeba invadens
SKIGD

SEQ ID NO: 2906399 - protein, 6 aa, Entamoeba invadens
SKIGGK

SEQ ID NO: 2906400 - protein, 6 aa, Entamoeba invadens
SKIKDV

SEQ ID NO: 2906401 - protein, 9 aa, Entamoeba invadens
SKIKESLKT

SEQ ID NO: 2906402 - protein, 10 aa, Entamoeba invadens
SKILSNSPEL

SEQ ID NO: 2906403 - protein, 5 aa, Entamoeba invadens
SKINK

SEQ ID NO: 2906404 - protein, 4 aa, Entamoeba invadens
SKIP

SEQ ID NO: 2906405 - protein, 10 aa, Entamoeba invadens
SKIPDDGSPF

SEQ ID NO: 2906406 - protein, 6 aa, Entamoeba invadens
SKIPDQ

SEQ ID NO: 2906407 - protein, 7 aa, Entamoeba invadens
SKIPGKS

SEQ ID NO: 2906408 - protein, 23 aa, Entamoeba invadens
SKIPNSSTIEQNPISKEQRSAED

SEQ ID NO: 2906409 - protein, 5 aa, Entamoeba invadens
SKIPR

SEQ ID NO: 2906410 - protein, 38 aa, Entamoeba invadens
SKIQSTQNSIDGATTVQNTKQQEVDDLDEKKKKLEEVV

SEQ ID NO: 2906411 - protein, 6 aa, Entamoeba invadens
SKIRLS

SEQ ID NO: 2906412 - protein, 9 aa, Entamoeba invadens
SKIRVSRSQ

SEQ ID NO: 2906413 - protein, 4 aa, Entamoeba invadens
SKIS

SEQ ID NO: 2906414 - protein, 6 aa, Entamoeba invadens
SKISED

SEQ ID NO: 2906415 - protein, 10 aa, Entamoeba invadens
SKISEGDDYR

SEQ ID NO: 2906416 - protein, 7 aa, Entamoeba invadens
SKISGRK

SEQ ID NO: 2906417 - protein, 8 aa, Entamoeba invadens
SKISSETD

SEQ ID NO: 2906418 - protein, 12 aa, Entamoeba invadens
SKITKQQYQDNE

SEQ ID NO: 2906419 - protein, 6 aa, Entamoeba invadens
SKITTP

SEQ ID NO: 2906420 - protein, 7 aa, Entamoeba invadens
SKITTPP

SEQ ID NO: 2906421 - protein, 5 aa, Entamoeba invadens
SKKAA

SEQ ID NO: 2906422 - protein, 10 aa, Entamoeba invadens
SKKAIGKESD

SEQ ID NO: 2906423 - protein, 7 aa, Entamoeba invadens
SKKAPNI

SEQ ID NO: 2906424 - protein, 8 aa, Entamoeba invadens
SKKARTDC

SEQ ID NO: 2906425 - protein, 13 aa, Entamoeba invadens
SKKAVASNRSPLR

SEQ ID NO: 2906426 - protein, 4 aa, Entamoeba invadens
SKKC

SEQ ID NO: 2906427 - protein, 6 aa, Entamoeba invadens
SKKCNS

SEQ ID NO: 2906428 - protein, 13 aa, Entamoeba invadens
SKKDEGSNKTFNT

SEQ ID NO: 2906429 - protein, 9 aa, Entamoeba invadens
SKKDGKNNT

SEQ ID NO: 2906430 - protein, 6 aa, Entamoeba invadens
SKKDGN

SEQ ID NO: 2906431 - protein, 10 aa, Entamoeba invadens
SKKDKKVKKV

SEQ ID NO: 2906432 - protein, 4 aa, Entamoeba invadens
SKKE

SEQ ID NO: 2906433 - protein, 6 aa, Entamoeba invadens
SKKEED

SEQ ID NO: 2906434 - protein, 6 aa, Entamoeba invadens
SKKEHQ

SEQ ID NO: 2906435 - protein, 7 aa, Entamoeba invadens
SKKEITH

SEQ ID NO: 2906436 - protein, 17 aa, Entamoeba invadens
SKKEKDVLNKQNSTNSR

SEQ ID NO: 2906437 - protein, 16 aa, Entamoeba invadens
SKKEMKGEKNKTYYEK

SEQ ID NO: 2906438 - protein, 9 aa, Entamoeba invadens
SKKEPSTKI

SEQ ID NO: 2906439 - protein, 7 aa, Entamoeba invadens
SKKERGD

SEQ ID NO: 2906440 - protein, 10 aa, Entamoeba invadens
SKKFGGKPIH

SEQ ID NO: 2906441 - protein, 11 aa, Entamoeba invadens
SKKGEKSSRCI

SEQ ID NO: 2906442 - protein, 7 aa, Entamoeba invadens
SKKGFIQ

SEQ ID NO: 2906443 - protein, 7 aa, Entamoeba invadens
SKKGLRP

SEQ ID NO: 2906444 - protein, 10 aa, Entamoeba invadens
SKKGRASLPA

SEQ ID NO: 2906445 - protein, 8 aa, Entamoeba invadens
SKKHPEYN

SEQ ID NO: 2906446 - protein, 4 aa, Entamoeba invadens
SKKI

SEQ ID NO: 2906447 - protein, 8 aa, Entamoeba invadens
SKKIQTPI

SEQ ID NO: 2906448 - protein, 7 aa, Entamoeba invadens
SKKISDD

SEQ ID NO: 2906449 - protein, 8 aa, Entamoeba invadens
SKKISSAI

SEQ ID NO: 2906450 - protein, 10 aa, Entamoeba invadens
SKKISYKGET

SEQ ID NO: 2906451 - protein, 8 aa, Entamoeba invadens
SKKITSGY

SEQ ID NO: 2906452 - protein, 10 aa, Entamoeba invadens
SKKKADSRVF

SEQ ID NO: 2906453 - protein, 8 aa, Entamoeba invadens
SKKKDQVI

SEQ ID NO: 2906454 - protein, 19 aa, Entamoeba invadens
SKKKKGSSKGKKGKVAGEV

SEQ ID NO: 2906455 - protein, 8 aa, Entamoeba invadens
SKKKSGTL

SEQ ID NO: 2906456 - protein, 9 aa, Entamoeba invadens
SKKKSTLKG

SEQ ID NO: 2906457 - protein, 7 aa, Entamoeba invadens
SKKKTEV

SEQ ID NO: 2906458 - protein, 8 aa, Entamoeba invadens
SKKKTPKY

SEQ ID NO: 2906459 - protein, 9 aa, Entamoeba invadens
SKKKVGDVT

SEQ ID NO: 2906460 - protein, 9 aa, Entamoeba invadens
SKKLADATK

SEQ ID NO: 2906461 - protein, 7 aa, Entamoeba invadens
SKKLATE

SEQ ID NO: 2906462 - protein, 22 aa, Entamoeba invadens
SKKLESYKKDNDFSNMDNDEKI

SEQ ID NO: 2906463 - protein, 20 aa, Entamoeba invadens
SKKLKQKDTKIVKAPKGEVI

SEQ ID NO: 2906464 - protein, 18 aa, Entamoeba invadens
SKKLKSSERKRSKEEAEI

SEQ ID NO: 2906465 - protein, 7 aa, Entamoeba invadens
SKKLPTV

SEQ ID NO: 2906466 - protein, 14 aa, Entamoeba invadens
SKKMDTKTSLPQQI

SEQ ID NO: 2906467 - protein, 9 aa, Entamoeba invadens
SKKMSVDGN

SEQ ID NO: 2906468 - protein, 13 aa, Entamoeba invadens
SKKNEKIEKPERF

SEQ ID NO: 2906469 - protein, 7 aa, Entamoeba invadens
SKKNGNF

SEQ ID NO: 2906470 - protein, 51 aa, Entamoeba invadens
SKKNNDVADGSYEPSEFENSTPSSAARTSTSSGKRAPPPPPTRGPKKEQVK

SEQ ID NO: 2906471 - protein, 8 aa, Entamoeba invadens
SKKNPKWH

SEQ ID NO: 2906472 - protein, 9 aa, Entamoeba invadens
SKKNQFTRK

SEQ ID NO: 2906473 - protein, 10 aa, Entamoeba invadens
SKKNSTEKVS

SEQ ID NO: 2906474 - protein, 14 aa, Entamoeba invadens
SKKPDWYRSFFSTM

SEQ ID NO: 2906475 - protein, 20 aa, Entamoeba invadens
SKKPPGKQTGLAESQNKYNV

SEQ ID NO: 2906476 - protein, 6 aa, Entamoeba invadens
SKKPTS

SEQ ID NO: 2906477 - protein, 7 aa, Entamoeba invadens
SKKQALK

SEQ ID NO: 2906478 - protein, 8 aa, Entamoeba invadens
SKKQLTKT

SEQ ID NO: 2906479 - protein, 6 aa, Entamoeba invadens
SKKQRK

SEQ ID NO: 2906480 - protein, 25 aa, Entamoeba invadens
SKKRARKSKKAKKEDEEVEKVPKKR

SEQ ID NO: 2906481 - protein, 11 aa, Entamoeba invadens
SKKRSVKLPSR

SEQ ID NO: 2906482 - protein, 9 aa, Entamoeba invadens
SKKSDVNKM

SEQ ID NO: 2906483 - protein, 14 aa, Entamoeba invadens
SKKSDVNKMNPENL

SEQ ID NO: 2906484 - protein, 14 aa, Entamoeba invadens
SKKSGDFSRLSTQD

SEQ ID NO: 2906485 - protein, 58 aa, Entamoeba invadens
SKKSGDVSSGTYEPSEFEKSPQTSTPMQSSVPKSANGTPQRRAAPPPPQRGGPKKERV

SEQ ID NO: 2906486 - protein, 5 aa, Entamoeba invadens
SKKSL

SEQ ID NO: 2906487 - protein, 10 aa, Entamoeba invadens
SKKSQNPVKG

SEQ ID NO: 2906488 - protein, 13 aa, Entamoeba invadens
SKKSQVDTAKDKH

SEQ ID NO: 2906489 - protein, 16 aa, Entamoeba invadens
SKKSTRNFHQQQQPEK

SEQ ID NO: 2906490 - protein, 35 aa, Entamoeba invadens
SKKSTSTDKSEEKKEEKDVKKDDEKENKGVSDEDR

SEQ ID NO: 2906491 - protein, 14 aa, Entamoeba invadens
SKKSTTTPSDTFPR

SEQ ID NO: 2906492 - protein, 4 aa, Entamoeba invadens
SKKT

SEQ ID NO: 2906493 - protein, 5 aa, Entamoeba invadens
SKKTD

SEQ ID NO: 2906494 - protein, 15 aa, Entamoeba invadens
SKKTEKTATTVEKGC

SEQ ID NO: 2906495 - protein, 8 aa, Entamoeba invadens
SKKTEMKS

SEQ ID NO: 2906496 - protein, 6 aa, Entamoeba invadens
SKKTGV

SEQ ID NO: 2906497 - protein, 10 aa, Entamoeba invadens
SKKTKDYEEL

SEQ ID NO: 2906498 - protein, 7 aa, Entamoeba invadens
SKKTKEL

SEQ ID NO: 2906499 - protein, 8 aa, Entamoeba invadens
SKKTPDLY

SEQ ID NO: 2906500 - protein, 7 aa, Entamoeba invadens
SKKVASS

SEQ ID NO: 2906501 - protein, 7 aa, Entamoeba invadens
SKKVGDV

SEQ ID NO: 2906502 - protein, 9 aa, Entamoeba invadens
SKKVSDKKA

SEQ ID NO: 2906503 - protein, 8 aa, Entamoeba invadens
SKKVVETS

SEQ ID NO: 2906504 - protein, 8 aa, Entamoeba invadens
SKKYEENK

SEQ ID NO: 2906505 - protein, 13 aa, Entamoeba invadens
SKKYEGKPCEGYD

SEQ ID NO: 2906506 - protein, 7 aa, Entamoeba invadens
SKKYGYF

SEQ ID NO: 2906507 - protein, 7 aa, Entamoeba invadens
SKKYSPL

SEQ ID NO: 2906508 - protein, 8 aa, Entamoeba invadens
SKLDDGNK

SEQ ID NO: 2906509 - protein, 6 aa, Entamoeba invadens
SKLDHS

SEQ ID NO: 2906510 - protein, 14 aa, Entamoeba invadens
SKLDKSKTHEIASK

SEQ ID NO: 2906511 - protein, 26 aa, Entamoeba invadens
SKLEADSPKPPMSTRENSVSSKKDQP

SEQ ID NO: 2906512 - protein, 7 aa, Entamoeba invadens
SKLENYK

SEQ ID NO: 2906513 - protein, 13 aa, Entamoeba invadens
SKLEQQQNKENEW

SEQ ID NO: 2906514 - protein, 25 aa, Entamoeba invadens
SKLESKKKPKFDSLKSNNEKRIRPS

SEQ ID NO: 2906515 - protein, 23 aa, Entamoeba invadens
SKLETTDQNYNSQQDTGLLSPRG

SEQ ID NO: 2906516 - protein, 4 aa, Entamoeba invadens
SKLG

SEQ ID NO: 2906517 - protein, 8 aa, Entamoeba invadens
SKLGANPK

SEQ ID NO: 2906518 - protein, 8 aa, Entamoeba invadens
SKLGEQGG

SEQ ID NO: 2906519 - protein, 7 aa, Entamoeba invadens
SKLNETI

SEQ ID NO: 2906520 - protein, 9 aa, Entamoeba invadens
SKLNSARQE

SEQ ID NO: 2906521 - protein, 10 aa, Entamoeba invadens
SKLNTSETEA

SEQ ID NO: 2906522 - protein, 14 aa, Entamoeba invadens
SKLPKKTLPSLPPK

SEQ ID NO: 2906523 - protein, 11 aa, Entamoeba invadens
SKLPKNELGKA

SEQ ID NO: 2906524 - protein, 6 aa, Entamoeba invadens
SKLPNQ

SEQ ID NO: 2906525 - protein, 6 aa, Entamoeba invadens
SKLQEA

SEQ ID NO: 2906526 - protein, 43 aa, Entamoeba invadens
SKLRGKKTEDSQVSVTSTLEATDQDLESQIDKENSEDYLPKST

SEQ ID NO: 2906527 - protein, 9 aa, Entamoeba invadens
SKLRGVPSE

SEQ ID NO: 2906528 - protein, 19 aa, Entamoeba invadens
SKLRKEGHAAIKKYVKFYS

SEQ ID NO: 2906529 - protein, 28 aa, Entamoeba invadens
SKLSEEISKIGNDAKPQKLEIPATSKTI

SEQ ID NO: 2906530 - protein, 19 aa, Entamoeba invadens
SKLSELRGQFNTADTQLRK

SEQ ID NO: 2906531 - protein, 18 aa, Entamoeba invadens
SKLSEYTTTKYATEGISM

SEQ ID NO: 2906532 - protein, 6 aa, Entamoeba invadens
SKLSPD

SEQ ID NO: 2906533 - protein, 6 aa, Entamoeba invadens
SKLSPK

SEQ ID NO: 2906534 - protein, 7 aa, Entamoeba invadens
SKLSSIG

SEQ ID NO: 2906535 - protein, 4 aa, Entamoeba invadens
SKLT

SEQ ID NO: 2906536 - protein, 10 aa, Entamoeba invadens
SKLTDFGSRR

SEQ ID NO: 2906537 - protein, 11 aa, Entamoeba invadens
SKLTDFGSSRN

SEQ ID NO: 2906538 - protein, 11 aa, Entamoeba invadens
SKLTSSHQISA

SEQ ID NO: 2906539 - protein, 7 aa, Entamoeba invadens
SKLTTTG

SEQ ID NO: 2906540 - protein, 5 aa, Entamoeba invadens
SKMDN

SEQ ID NO: 2906541 - protein, 8 aa, Entamoeba invadens
SKMDPNEY

SEQ ID NO: 2906542 - protein, 10 aa, Entamoeba invadens
SKMEEAKQKT

SEQ ID NO: 2906543 - protein, 15 aa, Entamoeba invadens
SKMEEEALPQPTNDW

SEQ ID NO: 2906544 - protein, 8 aa, Entamoeba invadens
SKMEEKKK

SEQ ID NO: 2906545 - protein, 13 aa, Entamoeba invadens
SKMENDKKAHPKL

SEQ ID NO: 2906546 - protein, 5 aa, Entamoeba invadens
SKMET

SEQ ID NO: 2906547 - protein, 6 aa, Entamoeba invadens
SKMETE

SEQ ID NO: 2906548 - protein, 8 aa, Entamoeba invadens
SKMGTNIN

SEQ ID NO: 2906549 - protein, 8 aa, Entamoeba invadens
SKMKDKYG

SEQ ID NO: 2906550 - protein, 8 aa, Entamoeba invadens
SKMNGKKE

SEQ ID NO: 2906551 - protein, 4 aa, Entamoeba invadens
SKMR

SEQ ID NO: 2906552 - protein, 4 aa, Entamoeba invadens
SKMS

SEQ ID NO: 2906553 - protein, 10 aa, Entamoeba invadens
SKMSDTKTYV

SEQ ID NO: 2906554 - protein, 13 aa, Entamoeba invadens
SKNAESKNSETLE

SEQ ID NO: 2906555 - protein, 6 aa, Entamoeba invadens
SKNANS

SEQ ID NO: 2906556 - protein, 19 aa, Entamoeba invadens
SKNAQEKKDNGKIAAYGGV

SEQ ID NO: 2906557 - protein, 12 aa, Entamoeba invadens
SKNASCTIHQNQ

SEQ ID NO: 2906558 - protein, 5 aa, Entamoeba invadens
SKNDH

SEQ ID NO: 2906559 - protein, 49 aa, Entamoeba invadens
SKNDIKQKKKEQAKKSVKSKKRVKTTKKGVKKKSVPKRKKEDSKNIKTP

SEQ ID NO: 2906560 - protein, 19 aa, Entamoeba invadens
SKNDRYKASSDSEQYEDVN

SEQ ID NO: 2906561 - protein, 9 aa, Entamoeba invadens
SKNDYMAED

SEQ ID NO: 2906562 - protein, 5 aa, Entamoeba invadens
SKNEA

SEQ ID NO: 2906563 - protein, 5 aa, Entamoeba invadens
SKNEE

SEQ ID NO: 2906564 - protein, 7 aa, Entamoeba invadens
SKNEIED

SEQ ID NO: 2906565 - protein, 8 aa, Entamoeba invadens
SKNEIYNK

SEQ ID NO: 2906566 - protein, 8 aa, Entamoeba invadens
SKNELETV

SEQ ID NO: 2906567 - protein, 7 aa, Entamoeba invadens
SKNELTP

SEQ ID NO: 2906568 - protein, 10 aa, Entamoeba invadens
SKNENGLPEV

SEQ ID NO: 2906569 - protein, 8 aa, Entamoeba invadens
SKNETSLG

SEQ ID NO: 2906570 - protein, 44 aa, Entamoeba invadens
SKNFNQSETIDKQNDMNKQKNTHDNLSDKNTLKNKDEDKHEKKT

SEQ ID NO: 2906571 - protein, 4 aa, Entamoeba invadens
SKNG

SEQ ID NO: 2906572 - protein, 8 aa, Entamoeba invadens
SKNGCAQC

SEQ ID NO: 2906573 - protein, 9 aa, Entamoeba invadens
SKNGEVRER

SEQ ID NO: 2906574 - protein, 8 aa, Entamoeba invadens
SKNGIKTL

SEQ ID NO: 2906575 - protein, 8 aa, Entamoeba invadens
SKNGNQAF

SEQ ID NO: 2906576 - protein, 7 aa, Entamoeba invadens
SKNGQLT

SEQ ID NO: 2906577 - protein, 5 aa, Entamoeba invadens
SKNGT

SEQ ID NO: 2906578 - protein, 7 aa, Entamoeba invadens
SKNGTFL

SEQ ID NO: 2906579 - protein, 4 aa, Entamoeba invadens
SKNI

SEQ ID NO: 2906580 - protein, 13 aa, Entamoeba invadens
SKNIGGDTYGYRG

SEQ ID NO: 2906581 - protein, 12 aa, Entamoeba invadens
SKNKASLNFQNA

SEQ ID NO: 2906582 - protein, 9 aa, Entamoeba invadens
SKNKDKPYV

SEQ ID NO: 2906583 - protein, 7 aa, Entamoeba invadens
SKNKDMA

SEQ ID NO: 2906584 - protein, 16 aa, Entamoeba invadens
SKNKESLASSRKDEVS

SEQ ID NO: 2906585 - protein, 30 aa, Entamoeba invadens
SKNKNKDEEQLEDKRERGGSFSKSRLRLFS

SEQ ID NO: 2906586 - protein, 8 aa, Entamoeba invadens
SKNKSEAV

SEQ ID NO: 2906587 - protein, 7 aa, Entamoeba invadens
SKNLGTN

SEQ ID NO: 2906588 - protein, 7 aa, Entamoeba invadens
SKNLKTQ

SEQ ID NO: 2906589 - protein, 23 aa, Entamoeba invadens
SKNLRNYKKPEIPDKDEFPAKGE

SEQ ID NO: 2906590 - protein, 5 aa, Entamoeba invadens
SKNNE

SEQ ID NO: 2906591 - protein, 5 aa, Entamoeba invadens
SKNNK

SEQ ID NO: 2906592 - protein, 8 aa, Entamoeba invadens
SKNNLTKE

SEQ ID NO: 2906593 - protein, 6 aa, Entamoeba invadens
SKNNNL

SEQ ID NO: 2906594 - protein, 11 aa, Entamoeba invadens
SKNNSTTKSSG

SEQ ID NO: 2906595 - protein, 5 aa, Entamoeba invadens
SKNNT

SEQ ID NO: 2906596 - protein, 13 aa, Entamoeba invadens
SKNNTSTKNIKTS

SEQ ID NO: 2906597 - protein, 8 aa, Entamoeba invadens
SKNPRYLQ

SEQ ID NO: 2906598 - protein, 8 aa, Entamoeba invadens
SKNPTSSK

SEQ ID NO: 2906599 - protein, 13 aa, Entamoeba invadens
SKNQKYLDKEKEE

SEQ ID NO: 2906600 - protein, 8 aa, Entamoeba invadens
SKNQRAQW

SEQ ID NO: 2906601 - protein, 10 aa, Entamoeba invadens
SKNQTPSQDI

SEQ ID NO: 2906602 - protein, 28 aa, Entamoeba invadens
SKNRFDDEVSKITNTKVSTSKVCEGDIS

SEQ ID NO: 2906603 - protein, 13 aa, Entamoeba invadens
SKNRIQKKSATGM

SEQ ID NO: 2906604 - protein, 6 aa, Entamoeba invadens
SKNSDM

SEQ ID NO: 2906605 - protein, 16 aa, Entamoeba invadens
SKNSEESTNQIASTTE

SEQ ID NO: 2906606 - protein, 6 aa, Entamoeba invadens
SKNSFN

SEQ ID NO: 2906607 - protein, 8 aa, Entamoeba invadens
SKNSITEY

SEQ ID NO: 2906608 - protein, 13 aa, Entamoeba invadens
SKNSKSVETVSDG

SEQ ID NO: 2906609 - protein, 5 aa, Entamoeba invadens
SKNSL

SEQ ID NO: 2906610 - protein, 6 aa, Entamoeba invadens
SKNSLV

SEQ ID NO: 2906611 - protein, 15 aa, Entamoeba invadens
SKNSPPPEGNETNQH

SEQ ID NO: 2906612 - protein, 9 aa, Entamoeba invadens
SKNSQVEST

SEQ ID NO: 2906613 - protein, 7 aa, Entamoeba invadens
SKNSRKA

SEQ ID NO: 2906614 - protein, 9 aa, Entamoeba invadens
SKNSSEPDL

SEQ ID NO: 2906615 - protein, 9 aa, Entamoeba invadens
SKNSTGIVD

SEQ ID NO: 2906616 - protein, 18 aa, Entamoeba invadens
SKNTDRKRKFTEKPKPLA

SEQ ID NO: 2906617 - protein, 6 aa, Entamoeba invadens
SKNTIG

SEQ ID NO: 2906618 - protein, 8 aa, Entamoeba invadens
SKNTNELA

SEQ ID NO: 2906619 - protein, 6 aa, Entamoeba invadens
SKNTNI

SEQ ID NO: 2906620 - protein, 5 aa, Entamoeba invadens
SKNVH

SEQ ID NO: 2906621 - protein, 5 aa, Entamoeba invadens
SKNVL

SEQ ID NO: 2906622 - protein, 6 aa, Entamoeba invadens
SKNVTE

SEQ ID NO: 2906623 - protein, 6 aa, Entamoeba invadens
SKNYHV

SEQ ID NO: 2906624 - protein, 8 aa, Entamoeba invadens
SKPAETYR

SEQ ID NO: 2906625 - protein, 4 aa, Entamoeba invadens
SKPD

SEQ ID NO: 2906626 - protein, 5 aa, Entamoeba invadens
SKPED

SEQ ID NO: 2906627 - protein, 5 aa, Entamoeba invadens
SKPEI

SEQ ID NO: 2906628 - protein, 11 aa, Entamoeba invadens
SKPEKKEDDVN

SEQ ID NO: 2906629 - protein, 6 aa, Entamoeba invadens
SKPEPR

SEQ ID NO: 2906630 - protein, 38 aa, Entamoeba invadens
SKPESNVRSPQKSTEEETESMTSDHKKSLERKEEEAKV

SEQ ID NO: 2906631 - protein, 25 aa, Entamoeba invadens
SKPETTEESLKKEMKEKEKASQRVT

SEQ ID NO: 2906632 - protein, 6 aa, Entamoeba invadens
SKPGLY

SEQ ID NO: 2906633 - protein, 18 aa, Entamoeba invadens
SKPGNSQRPYQKKYYDQY

SEQ ID NO: 2906634 - protein, 16 aa, Entamoeba invadens
SKPGRYGIKFWVCSIF

SEQ ID NO: 2906635 - protein, 5 aa, Entamoeba invadens
SKPGV

SEQ ID NO: 2906636 - protein, 6 aa, Entamoeba invadens
SKPHEI

SEQ ID NO: 2906637 - protein, 21 aa, Entamoeba invadens
SKPHPKQQKASTETVSKSQSV

SEQ ID NO: 2906638 - protein, 22 aa, Entamoeba invadens
SKPIQSKNVSGRPWKQTHQKRS

SEQ ID NO: 2906639 - protein, 33 aa, Entamoeba invadens
SKPISVPTEKKEKVVEKKEEKPIEKKKEEKLNV

SEQ ID NO: 2906640 - protein, 11 aa, Entamoeba invadens
SKPKGGETKMN

SEQ ID NO: 2906641 - protein, 11 aa, Entamoeba invadens
SKPKKGSKALP

SEQ ID NO: 2906642 - protein, 7 aa, Entamoeba invadens
SKPKKKT

SEQ ID NO: 2906643 - protein, 72 aa, Entamoeba invadens
SKPKLKEKKPLIDEPPTQTVYDNSKSGIITEDTPIQNQLPSKNTITSDDDNNPFLNTPKDSVESQLDSGTFD

SEQ ID NO: 2906644 - protein, 32 aa, Entamoeba invadens
SKPKQTSTQPSAKDKEKDKVTVQDRVNHYQSN

SEQ ID NO: 2906645 - protein, 9 aa, Entamoeba invadens
SKPKTKIAP

SEQ ID NO: 2906646 - protein, 26 aa, Entamoeba invadens
SKPKVLSSMKTEDANDANCQEGEYQK

SEQ ID NO: 2906647 - protein, 7 aa, Entamoeba invadens
SKPLDNL

SEQ ID NO: 2906648 - protein, 7 aa, Entamoeba invadens
SKPLEEF

SEQ ID NO: 2906649 - protein, 5 aa, Entamoeba invadens
SKPLL

SEQ ID NO: 2906650 - protein, 10 aa, Entamoeba invadens
SKPLNEKVEK

SEQ ID NO: 2906651 - protein, 7 aa, Entamoeba invadens
SKPLTVN

SEQ ID NO: 2906652 - protein, 14 aa, Entamoeba invadens
SKPMDPKKTKIYDN

SEQ ID NO: 2906653 - protein, 10 aa, Entamoeba invadens
SKPMKNQNDR

SEQ ID NO: 2906654 - protein, 5 aa, Entamoeba invadens
SKPNI

SEQ ID NO: 2906655 - protein, 11 aa, Entamoeba invadens
SKPNKKSSVTS

SEQ ID NO: 2906656 - protein, 16 aa, Entamoeba invadens
SKPNNTEKYNNQANIT

SEQ ID NO: 2906657 - protein, 8 aa, Entamoeba invadens
SKPNYLSK

SEQ ID NO: 2906658 - protein, 46 aa, Entamoeba invadens
SKPPIVKKKTDENKSPNPSEKHTSEFKKKKSSKTKTQETQPLLGTP

SEQ ID NO: 2906659 - protein, 10 aa, Entamoeba invadens
SKPPKKTSST

SEQ ID NO: 2906660 - protein, 9 aa, Entamoeba invadens
SKPPTFGEN

SEQ ID NO: 2906661 - protein, 7 aa, Entamoeba invadens
SKPPTNF

SEQ ID NO: 2906662 - protein, 6 aa, Entamoeba invadens
SKPQAL

SEQ ID NO: 2906663 - protein, 12 aa, Entamoeba invadens
SKPQLKTEKVGR

SEQ ID NO: 2906664 - protein, 15 aa, Entamoeba invadens
SKPQRYGIKFCFLFL

SEQ ID NO: 2906665 - protein, 14 aa, Entamoeba invadens
SKPQRYGIKFWVFL

SEQ ID NO: 2906666 - protein, 5 aa, Entamoeba invadens
SKPQV

SEQ ID NO: 2906667 - protein, 9 aa, Entamoeba invadens
SKPRPVPAQ

SEQ ID NO: 2906668 - protein, 6 aa, Entamoeba invadens
SKPRRY

SEQ ID NO: 2906669 - protein, 10 aa, Entamoeba invadens
SKPSFNTSDE

SEQ ID NO: 2906670 - protein, 7 aa, Entamoeba invadens
SKPSPVI

SEQ ID NO: 2906671 - protein, 15 aa, Entamoeba invadens
SKPSRKSKKSKQIER

SEQ ID NO: 2906672 - protein, 12 aa, Entamoeba invadens
SKPSRKSQKSLQ

SEQ ID NO: 2906673 - protein, 18 aa, Entamoeba invadens
SKPSRQLTPTERKKFAAD

SEQ ID NO: 2906674 - protein, 6 aa, Entamoeba invadens
SKPSTV

SEQ ID NO: 2906675 - protein, 13 aa, Entamoeba invadens
SKPTEANNTIPKV

SEQ ID NO: 2906676 - protein, 17 aa, Entamoeba invadens
SKPTFRGKENEKRKAAE

SEQ ID NO: 2906677 - protein, 5 aa, Entamoeba invadens
SKPTI

SEQ ID NO: 2906678 - protein, 9 aa, Entamoeba invadens
SKPTKRNSI

SEQ ID NO: 2906679 - protein, 6 aa, Entamoeba invadens
SKPTLS

SEQ ID NO: 2906680 - protein, 8 aa, Entamoeba invadens
SKPTQRKQ

SEQ ID NO: 2906681 - protein, 4 aa, Entamoeba invadens
SKPV

SEQ ID NO: 2906682 - protein, 5 aa, Entamoeba invadens
SKPVE

SEQ ID NO: 2906683 - protein, 37 aa, Entamoeba invadens
SKPVIQNTQHTVQATQTNVQSINKQSDLSKQSAQQRV

SEQ ID NO: 2906684 - protein, 9 aa, Entamoeba invadens
SKPYSSQVN

SEQ ID NO: 2906685 - protein, 9 aa, Entamoeba invadens
SKQDRGPKY

SEQ ID NO: 2906686 - protein, 9 aa, Entamoeba invadens
SKQEKPEGL

SEQ ID NO: 2906687 - protein, 9 aa, Entamoeba invadens
SKQEKSVDK

SEQ ID NO: 2906688 - protein, 11 aa, Entamoeba invadens
SKQELKKDWKT

SEQ ID NO: 2906689 - protein, 4 aa, Entamoeba invadens
SKQF

SEQ ID NO: 2906690 - protein, 6 aa, Entamoeba invadens
SKQHNK

SEQ ID NO: 2906691 - protein, 7 aa, Entamoeba invadens
SKQHNKV

SEQ ID NO: 2906692 - protein, 16 aa, Entamoeba invadens
SKQHSKYIKNSKEDDN

SEQ ID NO: 2906693 - protein, 5 aa, Entamoeba invadens
SKQHV

SEQ ID NO: 2906694 - protein, 13 aa, Entamoeba invadens
SKQIEETKKRIEE

SEQ ID NO: 2906695 - protein, 19 aa, Entamoeba invadens
SKQIKEKATSIAKDKVEEV

SEQ ID NO: 2906696 - protein, 10 aa, Entamoeba invadens
SKQIQEKGHK

SEQ ID NO: 2906697 - protein, 7 aa, Entamoeba invadens
SKQIQHS

SEQ ID NO: 2906698 - protein, 13 aa, Entamoeba invadens
SKQIQPKDEGASC

SEQ ID NO: 2906699 - protein, 6 aa, Entamoeba invadens
SKQKEL

SEQ ID NO: 2906700 - protein, 9 aa, Entamoeba invadens
SKQKNDLFS

SEQ ID NO: 2906701 - protein, 19 aa, Entamoeba invadens
SKQLSKDTTLTEPSEAEEK

SEQ ID NO: 2906702 - protein, 5 aa, Entamoeba invadens
SKQMT

SEQ ID NO: 2906703 - protein, 9 aa, Entamoeba invadens
SKQNEEPPF

SEQ ID NO: 2906704 - protein, 7 aa, Entamoeba invadens
SKQNGYL

SEQ ID NO: 2906705 - protein, 10 aa, Entamoeba invadens
SKQNNTVSDM

SEQ ID NO: 2906706 - protein, 7 aa, Entamoeba invadens
SKQNPDV

SEQ ID NO: 2906707 - protein, 7 aa, Entamoeba invadens
SKQNSSQ

SEQ ID NO: 2906708 - protein, 7 aa, Entamoeba invadens
SKQNSYQ

SEQ ID NO: 2906709 - protein, 10 aa, Entamoeba invadens
SKQNTDKNGC

SEQ ID NO: 2906710 - protein, 8 aa, Entamoeba invadens
SKQNTPSR

SEQ ID NO: 2906711 - protein, 9 aa, Entamoeba invadens
SKQNTTYDK

SEQ ID NO: 2906712 - protein, 11 aa, Entamoeba invadens
SKQNVNQKSCS

SEQ ID NO: 2906713 - protein, 4 aa, Entamoeba invadens
SKQP

SEQ ID NO: 2906714 - protein, 12 aa, Entamoeba invadens
SKQPKGNKTRVK

SEQ ID NO: 2906715 - protein, 6 aa, Entamoeba invadens
SKQRDV

SEQ ID NO: 2906716 - protein, 14 aa, Entamoeba invadens
SKQRKNKRFWSPEE

SEQ ID NO: 2906717 - protein, 12 aa, Entamoeba invadens
SKQRKTPPVASQ

SEQ ID NO: 2906718 - protein, 7 aa, Entamoeba invadens
SKQRPAC

SEQ ID NO: 2906719 - protein, 11 aa, Entamoeba invadens
SKQSAKSAMTE

SEQ ID NO: 2906720 - protein, 13 aa, Entamoeba invadens
SKQSFSSLNAKTL

SEQ ID NO: 2906721 - protein, 9 aa, Entamoeba invadens
SKQSLSSGG

SEQ ID NO: 2906722 - protein, 8 aa, Entamoeba invadens
SKQSSAFL

SEQ ID NO: 2906723 - protein, 8 aa, Entamoeba invadens
SKQSTSFG

SEQ ID NO: 2906724 - protein, 60 aa, Entamoeba invadens
SKQTANTGKEPQNVQQKNVEQKVPLKSNRLPNTSKEQEKTKLTESGSPPFVQPKKDENPV

SEQ ID NO: 2906725 - protein, 7 aa, Entamoeba invadens
SKQTNTV

SEQ ID NO: 2906726 - protein, 10 aa, Entamoeba invadens
SKQTQKNEMN

SEQ ID NO: 2906727 - protein, 9 aa, Entamoeba invadens
SKQTTQYLQ

SEQ ID NO: 2906728 - protein, 9 aa, Entamoeba invadens
SKQVSGNDK

SEQ ID NO: 2906729 - protein, 9 aa, Entamoeba invadens
SKRAHPLPN

SEQ ID NO: 2906730 - protein, 6 aa, Entamoeba invadens
SKRAIS

SEQ ID NO: 2906731 - protein, 6 aa, Entamoeba invadens
SKRDGV

SEQ ID NO: 2906732 - protein, 5 aa, Entamoeba invadens
SKRDM

SEQ ID NO: 2906733 - protein, 11 aa, Entamoeba invadens
SKRENGTTVNS

SEQ ID NO: 2906734 - protein, 8 aa, Entamoeba invadens
SKRESTTL

SEQ ID NO: 2906735 - protein, 9 aa, Entamoeba invadens
SKRGEDNIY

SEQ ID NO: 2906736 - protein, 9 aa, Entamoeba invadens
SKRGFRGRG

SEQ ID NO: 2906737 - protein, 8 aa, Entamoeba invadens
SKRHTTKR

SEQ ID NO: 2906738 - protein, 10 aa, Entamoeba invadens
SKRIKKEPGY

SEQ ID NO: 2906739 - protein, 21 aa, Entamoeba invadens
SKRIPQNETKEQSSKLPEDVM

SEQ ID NO: 2906740 - protein, 8 aa, Entamoeba invadens
SKRKDQVI

SEQ ID NO: 2906741 - protein, 9 aa, Entamoeba invadens
SKRKGCGIG

SEQ ID NO: 2906742 - protein, 14 aa, Entamoeba invadens
SKRKSANKDSAQQS

SEQ ID NO: 2906743 - protein, 8 aa, Entamoeba invadens
SKRMEDEK

SEQ ID NO: 2906744 - protein, 7 aa, Entamoeba invadens
SKRNDKK

SEQ ID NO: 2906745 - protein, 11 aa, Entamoeba invadens
SKRNGKNDPDA

SEQ ID NO: 2906746 - protein, 6 aa, Entamoeba invadens
SKRPLP

SEQ ID NO: 2906747 - protein, 9 aa, Entamoeba invadens
SKRPNTTYK

SEQ ID NO: 2906748 - protein, 7 aa, Entamoeba invadens
SKRQSHY

SEQ ID NO: 2906749 - protein, 9 aa, Entamoeba invadens
SKRRATSLT

SEQ ID NO: 2906750 - protein, 6 aa, Entamoeba invadens
SKRREE

SEQ ID NO: 2906751 - protein, 7 aa, Entamoeba invadens
SKRRPKK

SEQ ID NO: 2906752 - protein, 9 aa, Entamoeba invadens
SKRRRYPQY

SEQ ID NO: 2906753 - protein, 4 aa, Entamoeba invadens
SKRS

SEQ ID NO: 2906754 - protein, 8 aa, Entamoeba invadens
SKRSAPSK

SEQ ID NO: 2906755 - protein, 11 aa, Entamoeba invadens
SKRSEGRTTHT

SEQ ID NO: 2906756 - protein, 6 aa, Entamoeba invadens
SKRSHL

SEQ ID NO: 2906757 - protein, 13 aa, Entamoeba invadens
SKRSKPQGYDTSK

SEQ ID NO: 2906758 - protein, 8 aa, Entamoeba invadens
SKRSQEKI

SEQ ID NO: 2906759 - protein, 5 aa, Entamoeba invadens
SKRTD

SEQ ID NO: 2906760 - protein, 16 aa, Entamoeba invadens
SKRTDGKTVHTRISKK

SEQ ID NO: 2906761 - protein, 9 aa, Entamoeba invadens
SKRTDITDV

SEQ ID NO: 2906762 - protein, 9 aa, Entamoeba invadens
SKRTDKPLR

SEQ ID NO: 2906763 - protein, 8 aa, Entamoeba invadens
SKRTKSPV

SEQ ID NO: 2906764 - protein, 11 aa, Entamoeba invadens
SKRTQRRIRKQ

SEQ ID NO: 2906765 - protein, 10 aa, Entamoeba invadens
SKRTRGKTTH

SEQ ID NO: 2906766 - protein, 10 aa, Entamoeba invadens
SKRTTGSGIR

SEQ ID NO: 2906767 - protein, 8 aa, Entamoeba invadens
SKRTYEPP

SEQ ID NO: 2906768 - protein, 9 aa, Entamoeba invadens
SKSANLAET

SEQ ID NO: 2906769 - protein, 22 aa, Entamoeba invadens
SKSAQDVTKCNPLNTDKTEEVS

SEQ ID NO: 2906770 - protein, 10 aa, Entamoeba invadens
SKSATPTTRF

SEQ ID NO: 2906771 - protein, 7 aa, Entamoeba invadens
SKSAVPS

SEQ ID NO: 2906772 - protein, 5 aa, Entamoeba invadens
SKSCT

SEQ ID NO: 2906773 - protein, 8 aa, Entamoeba invadens
SKSDEGNV

SEQ ID NO: 2906774 - protein, 36 aa, Entamoeba invadens
SKSDELRTRSANDRKSSSCKNSPKEKERKVDKDRKT

SEQ ID NO: 2906775 - protein, 6 aa, Entamoeba invadens
SKSDGL

SEQ ID NO: 2906776 - protein, 7 aa, Entamoeba invadens
SKSDITK

SEQ ID NO: 2906777 - protein, 28 aa, Entamoeba invadens
SKSDKSEKKTSMEFETPTDHNENSEQNP

SEQ ID NO: 2906778 - protein, 21 aa, Entamoeba invadens
SKSDLYNSDIPTYYKSNSTNG

SEQ ID NO: 2906779 - protein, 13 aa, Entamoeba invadens
SKSDRVKYGDKIP

SEQ ID NO: 2906780 - protein, 10 aa, Entamoeba invadens
SKSDSIEEAS

SEQ ID NO: 2906781 - protein, 9 aa, Entamoeba invadens
SKSDVTSRD

SEQ ID NO: 2906782 - protein, 10 aa, Entamoeba invadens
SKSEEAVSTP

SEQ ID NO: 2906783 - protein, 6 aa, Entamoeba invadens
SKSEEC

SEQ ID NO: 2906784 - protein, 11 aa, Entamoeba invadens
SKSEEDDGTIK

SEQ ID NO: 2906785 - protein, 8 aa, Entamoeba invadens
SKSEGSRP

SEQ ID NO: 2906786 - protein, 7 aa, Entamoeba invadens
SKSEHGR

SEQ ID NO: 2906787 - protein, 6 aa, Entamoeba invadens
SKSEKD

SEQ ID NO: 2906788 - protein, 9 aa, Entamoeba invadens
SKSEKDLPK

SEQ ID NO: 2906789 - protein, 13 aa, Entamoeba invadens
SKSESATSPHNRQ

SEQ ID NO: 2906790 - protein, 7 aa, Entamoeba invadens
SKSESTY

SEQ ID NO: 2906791 - protein, 7 aa, Entamoeba invadens
SKSEVYG

SEQ ID NO: 2906792 - protein, 7 aa, Entamoeba invadens
SKSFEPI

SEQ ID NO: 2906793 - protein, 6 aa, Entamoeba invadens
SKSGEV

SEQ ID NO: 2906794 - protein, 16 aa, Entamoeba invadens
SKSGNDKSDLTKTSFD

SEQ ID NO: 2906795 - protein, 6 aa, Entamoeba invadens
SKSGPV

SEQ ID NO: 2906796 - protein, 7 aa, Entamoeba invadens
SKSGRGR

SEQ ID NO: 2906797 - protein, 8 aa, Entamoeba invadens
SKSIKRET

SEQ ID NO: 2906798 - protein, 9 aa, Entamoeba invadens
SKSIQGVRK

SEQ ID NO: 2906799 - protein, 8 aa, Entamoeba invadens
SKSISSIN

SEQ ID NO: 2906800 - protein, 13 aa, Entamoeba invadens
SKSIVTKTSLEPV

SEQ ID NO: 2906801 - protein, 9 aa, Entamoeba invadens
SKSKEYGDI

SEQ ID NO: 2906802 - protein, 8 aa, Entamoeba invadens
SKSKVADI

SEQ ID NO: 2906803 - protein, 20 aa, Entamoeba invadens
SKSLEDAKYDRSHATAPFKG

SEQ ID NO: 2906804 - protein, 6 aa, Entamoeba invadens
SKSLPE

SEQ ID NO: 2906805 - protein, 8 aa, Entamoeba invadens
SKSLQSGV

SEQ ID NO: 2906806 - protein, 9 aa, Entamoeba invadens
SKSLQSGVE

SEQ ID NO: 2906807 - protein, 11 aa, Entamoeba invadens
SKSLSQANSTF

SEQ ID NO: 2906808 - protein, 7 aa, Entamoeba invadens
SKSLTPD

SEQ ID NO: 2906809 - protein, 5 aa, Entamoeba invadens
SKSMT

SEQ ID NO: 2906810 - protein, 8 aa, Entamoeba invadens
SKSNDEVK

SEQ ID NO: 2906811 - protein, 20 aa, Entamoeba invadens
SKSNFDAKFPPNAKQQTKNY

SEQ ID NO: 2906812 - protein, 9 aa, Entamoeba invadens
SKSNGSITP

SEQ ID NO: 2906813 - protein, 50 aa, Entamoeba invadens
SKSNHEVKKEKVIKDDISEKEESPDPEKAKERAEKERLEREKEDKEEQEL

SEQ ID NO: 2906814 - protein, 11 aa, Entamoeba invadens
SKSNITKKVTG

SEQ ID NO: 2906815 - protein, 5 aa, Entamoeba invadens
SKSNL

SEQ ID NO: 2906816 - protein, 16 aa, Entamoeba invadens
SKSNVSQCTKVDNSKC

SEQ ID NO: 2906817 - protein, 49 aa, Entamoeba invadens
SKSPAPFSNTIPTTVEARSKTPNVESNSPHVSPEKSQSKGPTPVPSPRK

SEQ ID NO: 2906818 - protein, 5 aa, Entamoeba invadens
SKSPD

SEQ ID NO: 2906819 - protein, 7 aa, Entamoeba invadens
SKSPEAP

SEQ ID NO: 2906820 - protein, 7 aa, Entamoeba invadens
SKSPEIV

SEQ ID NO: 2906821 - protein, 10 aa, Entamoeba invadens
SKSPESSKEV

SEQ ID NO: 2906822 - protein, 10 aa, Entamoeba invadens
SKSPKYPENS

SEQ ID NO: 2906823 - protein, 6 aa, Entamoeba invadens
SKSPLK

SEQ ID NO: 2906824 - protein, 18 aa, Entamoeba invadens
SKSPMKQKTTKQAIESSE

SEQ ID NO: 2906825 - protein, 10 aa, Entamoeba invadens
SKSPSSPVET

SEQ ID NO: 2906826 - protein, 15 aa, Entamoeba invadens
SKSQDIEAGDGTTTV

SEQ ID NO: 2906827 - protein, 6 aa, Entamoeba invadens
SKSQLR

SEQ ID NO: 2906828 - protein, 34 aa, Entamoeba invadens
SKSQQQQDVQQHNDYNAQQNVQEVNQEQQEHPTQ

SEQ ID NO: 2906829 - protein, 6 aa, Entamoeba invadens
SKSRAS

SEQ ID NO: 2906830 - protein, 14 aa, Entamoeba invadens
SKSRIGKRTFDGCS

SEQ ID NO: 2906831 - protein, 6 aa, Entamoeba invadens
SKSRIN

SEQ ID NO: 2906832 - protein, 6 aa, Entamoeba invadens
SKSSFN

SEQ ID NO: 2906833 - protein, 8 aa, Entamoeba invadens
SKSSGGLF

SEQ ID NO: 2906834 - protein, 50 aa, Entamoeba invadens
SKSSKNYFEKKTPEIIEEKGSSQSLSESSRADSINGKKTYKSDSDPQSTK

SEQ ID NO: 2906835 - protein, 40 aa, Entamoeba invadens
SKSSLGADPPPPLAGGEPHPRPHSTDKESGFNGDAQTVAE

SEQ ID NO: 2906836 - protein, 8 aa, Entamoeba invadens
SKSSQKTI

SEQ ID NO: 2906837 - protein, 7 aa, Entamoeba invadens
SKSSQRM

SEQ ID NO: 2906838 - protein, 9 aa, Entamoeba invadens
SKSSRASSV

SEQ ID NO: 2906839 - protein, 7 aa, Entamoeba invadens
SKSSSIS

SEQ ID NO: 2906840 - protein, 7 aa, Entamoeba invadens
SKSSVMS

SEQ ID NO: 2906841 - protein, 8 aa, Entamoeba invadens
SKSSYQPF

SEQ ID NO: 2906842 - protein, 7 aa, Entamoeba invadens
SKSTDTT

SEQ ID NO: 2906843 - protein, 31 aa, Entamoeba invadens
SKSTEENKPMKSQETESQKMNQFATKSPLPK

SEQ ID NO: 2906844 - protein, 24 aa, Entamoeba invadens
SKSTGYPLRPRSANSARSSPAISK

SEQ ID NO: 2906845 - protein, 9 aa, Entamoeba invadens
SKSTLERKT

SEQ ID NO: 2906846 - protein, 8 aa, Entamoeba invadens
SKSTPQHY

SEQ ID NO: 2906847 - protein, 8 aa, Entamoeba invadens
SKSTSVVQ

SEQ ID NO: 2906848 - protein, 13 aa, Entamoeba invadens
SKSYEECGTFLFE

SEQ ID NO: 2906849 - protein, 6 aa, Entamoeba invadens
SKSYNI

SEQ ID NO: 2906850 - protein, 5 aa, Entamoeba invadens
SKSYR

SEQ ID NO: 2906851 - protein, 6 aa, Entamoeba invadens
SKTAQH

SEQ ID NO: 2906852 - protein, 5 aa, Entamoeba invadens
SKTAY

SEQ ID NO: 2906853 - protein, 6 aa, Entamoeba invadens
SKTDCT

SEQ ID NO: 2906854 - protein, 5 aa, Entamoeba invadens
SKTDE

SEQ ID NO: 2906855 - protein, 7 aa, Entamoeba invadens
SKTDFQE

SEQ ID NO: 2906856 - protein, 7 aa, Entamoeba invadens
SKTDIKD

SEQ ID NO: 2906857 - protein, 25 aa, Entamoeba invadens
SKTDKLRAELEYKDEKKPREIRRDG

SEQ ID NO: 2906858 - protein, 19 aa, Entamoeba invadens
SKTDKTKDQQQEGEKEETQ

SEQ ID NO: 2906859 - protein, 8 aa, Entamoeba invadens
SKTDLTDL

SEQ ID NO: 2906860 - protein, 7 aa, Entamoeba invadens
SKTDPSI

SEQ ID NO: 2906861 - protein, 13 aa, Entamoeba invadens
SKTDREKYGNTIP

SEQ ID NO: 2906862 - protein, 6 aa, Entamoeba invadens
SKTEDL

SEQ ID NO: 2906863 - protein, 5 aa, Entamoeba invadens
SKTEF

SEQ ID NO: 2906864 - protein, 5 aa, Entamoeba invadens
SKTEI

SEQ ID NO: 2906865 - protein, 7 aa, Entamoeba invadens
SKTEIGK

SEQ ID NO: 2906866 - protein, 37 aa, Entamoeba invadens
SKTEIGKSTKESDSQSAASEMTRSTKVRIDKSKRKAI

SEQ ID NO: 2906867 - protein, 32 aa, Entamoeba invadens
SKTEKKKKKKKHSKKAKSETPRRKEKPKEIKT

SEQ ID NO: 2906868 - protein, 9 aa, Entamoeba invadens
SKTEPTKEN

SEQ ID NO: 2906869 - protein, 16 aa, Entamoeba invadens
SKTEQNADKVDFPEPS

SEQ ID NO: 2906870 - protein, 12 aa, Entamoeba invadens
SKTEQTKDPKKF

SEQ ID NO: 2906871 - protein, 22 aa, Entamoeba invadens
SKTERNSPCTLTKREKGKTVNS

SEQ ID NO: 2906872 - protein, 6 aa, Entamoeba invadens
SKTFEK

SEQ ID NO: 2906873 - protein, 5 aa, Entamoeba invadens
SKTFK

SEQ ID NO: 2906874 - protein, 5 aa, Entamoeba invadens
SKTGE

SEQ ID NO: 2906875 - protein, 6 aa, Entamoeba invadens
SKTGEV

SEQ ID NO: 2906876 - protein, 16 aa, Entamoeba invadens
SKTGMKEGGDKTGTFC

SEQ ID NO: 2906877 - protein, 8 aa, Entamoeba invadens
SKTGSGFE

SEQ ID NO: 2906878 - protein, 11 aa, Entamoeba invadens
SKTGTSENTDV

SEQ ID NO: 2906879 - protein, 6 aa, Entamoeba invadens
SKTGTV

SEQ ID NO: 2906880 - protein, 8 aa, Entamoeba invadens
SKTHEDYS

SEQ ID NO: 2906881 - protein, 8 aa, Entamoeba invadens
SKTIDEDV

SEQ ID NO: 2906882 - protein, 6 aa, Entamoeba invadens
SKTIEP

SEQ ID NO: 2906883 - protein, 7 aa, Entamoeba invadens
SKTISTD

SEQ ID NO: 2906884 - protein, 6 aa, Entamoeba invadens
SKTITY

SEQ ID NO: 2906885 - protein, 10 aa, Entamoeba invadens
SKTKEMEDSY

SEQ ID NO: 2906886 - protein, 8 aa, Entamoeba invadens
SKTKETYS

SEQ ID NO: 2906887 - protein, 5 aa, Entamoeba invadens
SKTKH

SEQ ID NO: 2906888 - protein, 9 aa, Entamoeba invadens
SKTKKSGSV

SEQ ID NO: 2906889 - protein, 9 aa, Entamoeba invadens
SKTKKVPKE

SEQ ID NO: 2906890 - protein, 11 aa, Entamoeba invadens
SKTKKVTTYPY

SEQ ID NO: 2906891 - protein, 7 aa, Entamoeba invadens
SKTKNCR

SEQ ID NO: 2906892 - protein, 7 aa, Entamoeba invadens
SKTKSDV

SEQ ID NO: 2906893 - protein, 6 aa, Entamoeba invadens
SKTKSP

SEQ ID NO: 2906894 - protein, 11 aa, Entamoeba invadens
SKTKTQKSKII

SEQ ID NO: 2906895 - protein, 4 aa, Entamoeba invadens
SKTL

SEQ ID NO: 2906896 - protein, 10 aa, Entamoeba invadens
SKTLAPGEGR

SEQ ID NO: 2906897 - protein, 10 aa, Entamoeba invadens
SKTMSSEGRL

SEQ ID NO: 2906898 - protein, 9 aa, Entamoeba invadens
SKTNEEVKT

SEQ ID NO: 2906899 - protein, 9 aa, Entamoeba invadens
SKTNEGVKE

SEQ ID NO: 2906900 - protein, 8 aa, Entamoeba invadens
SKTNESYN

SEQ ID NO: 2906901 - protein, 10 aa, Entamoeba invadens
SKTNHEVQKE

SEQ ID NO: 2906902 - protein, 6 aa, Entamoeba invadens
SKTNIN

SEQ ID NO: 2906903 - protein, 9 aa, Entamoeba invadens
SKTNPTKKQ

SEQ ID NO: 2906904 - protein, 10 aa, Entamoeba invadens
SKTNSDEKSF

SEQ ID NO: 2906905 - protein, 24 aa, Entamoeba invadens
SKTNSFENESRKKRKSPTSWSESE

SEQ ID NO: 2906906 - protein, 5 aa, Entamoeba invadens
SKTNY

SEQ ID NO: 2906907 - protein, 21 aa, Entamoeba invadens
SKTPADAGKKGGKGGKGKCAM

SEQ ID NO: 2906908 - protein, 7 aa, Entamoeba invadens
SKTPGII

SEQ ID NO: 2906909 - protein, 5 aa, Entamoeba invadens
SKTPI

SEQ ID NO: 2906910 - protein, 13 aa, Entamoeba invadens
SKTPKKVDVPRDL

SEQ ID NO: 2906911 - protein, 9 aa, Entamoeba invadens
SKTPQPSLR

SEQ ID NO: 2906912 - protein, 11 aa, Entamoeba invadens
SKTPSACKADS

SEQ ID NO: 2906913 - protein, 25 aa, Entamoeba invadens
SKTPSNASNGCSPLTSPKQIAENSP

SEQ ID NO: 2906914 - protein, 4 aa, Entamoeba invadens
SKTQ

SEQ ID NO: 2906915 - protein, 6 aa, Entamoeba invadens
SKTQAT

SEQ ID NO: 2906916 - protein, 21 aa, Entamoeba invadens
SKTQHGRSESCRGISDNSADF

SEQ ID NO: 2906917 - protein, 5 aa, Entamoeba invadens
SKTQN

SEQ ID NO: 2906918 - protein, 9 aa, Entamoeba invadens
SKTQPIKGD

SEQ ID NO: 2906919 - protein, 11 aa, Entamoeba invadens
SKTQRATSKAK

SEQ ID NO: 2906920 - protein, 5 aa, Entamoeba invadens
SKTQS

SEQ ID NO: 2906921 - protein, 7 aa, Entamoeba invadens
SKTQSGI

SEQ ID NO: 2906922 - protein, 6 aa, Entamoeba invadens
SKTQSL

SEQ ID NO: 2906923 - protein, 18 aa, Entamoeba invadens
SKTQTFSRQSQTTQMEEQ

SEQ ID NO: 2906924 - protein, 7 aa, Entamoeba invadens
SKTRDPQ

SEQ ID NO: 2906925 - protein, 8 aa, Entamoeba invadens
SKTRGEIS

SEQ ID NO: 2906926 - protein, 8 aa, Entamoeba invadens
SKTRKLRG

SEQ ID NO: 2906927 - protein, 8 aa, Entamoeba invadens
SKTRKSDT

SEQ ID NO: 2906928 - protein, 9 aa, Entamoeba invadens
SKTRNGIDK

SEQ ID NO: 2906929 - protein, 8 aa, Entamoeba invadens
SKTRNGKS

SEQ ID NO: 2906930 - protein, 10 aa, Entamoeba invadens
SKTRTRPKLT

SEQ ID NO: 2906931 - protein, 12 aa, Entamoeba invadens
SKTSDFNSQTFG

SEQ ID NO: 2906932 - protein, 10 aa, Entamoeba invadens
SKTSIKDKGL

SEQ ID NO: 2906933 - protein, 11 aa, Entamoeba invadens
SKTSKNAREAC

SEQ ID NO: 2906934 - protein, 7 aa, Entamoeba invadens
SKTSNNK

SEQ ID NO: 2906935 - protein, 30 aa, Entamoeba invadens
SKTSNSPRGIQSKANNLARSVATTEPTQHE

SEQ ID NO: 2906936 - protein, 7 aa, Entamoeba invadens
SKTSNVL

SEQ ID NO: 2906937 - protein, 30 aa, Entamoeba invadens
SKTSRGSCKSCGQTIEQGELKYGKEVKSRF

SEQ ID NO: 2906938 - protein, 9 aa, Entamoeba invadens
SKTSSATFH

SEQ ID NO: 2906939 - protein, 8 aa, Entamoeba invadens
SKTSTATL

SEQ ID NO: 2906940 - protein, 9 aa, Entamoeba invadens
SKTSTQIRD

SEQ ID NO: 2906941 - protein, 9 aa, Entamoeba invadens
SKTSTYPSH

SEQ ID NO: 2906942 - protein, 8 aa, Entamoeba invadens
SKTSYGNY

SEQ ID NO: 2906943 - protein, 10 aa, Entamoeba invadens
SKTSYSSYRK

SEQ ID NO: 2906944 - protein, 4 aa, Entamoeba invadens
SKTT

SEQ ID NO: 2906945 - protein, 15 aa, Entamoeba invadens
SKTTDEEVGDGTTSV

SEQ ID NO: 2906946 - protein, 7 aa, Entamoeba invadens
SKTTENL

SEQ ID NO: 2906947 - protein, 7 aa, Entamoeba invadens
SKTTEVE

SEQ ID NO: 2906948 - protein, 6 aa, Entamoeba invadens
SKTTFA

SEQ ID NO: 2906949 - protein, 11 aa, Entamoeba invadens
SKTTGVKSFSN

SEQ ID NO: 2906950 - protein, 52 aa, Entamoeba invadens
SKTTHTSQQNSLQNSAQNSFSTQASQSTSQRDSITTSERNSQSRQGGSPRAT

SEQ ID NO: 2906951 - protein, 5 aa, Entamoeba invadens
SKTTK

SEQ ID NO: 2906952 - protein, 7 aa, Entamoeba invadens
SKTTKQE

SEQ ID NO: 2906953 - protein, 9 aa, Entamoeba invadens
SKTTKQKTD

SEQ ID NO: 2906954 - protein, 5 aa, Entamoeba invadens
SKTTL

SEQ ID NO: 2906955 - protein, 10 aa, Entamoeba invadens
SKTTNETNQV

SEQ ID NO: 2906956 - protein, 10 aa, Entamoeba invadens
SKTTTGNKGI

SEQ ID NO: 2906957 - protein, 7 aa, Entamoeba invadens
SKTTTPQ

SEQ ID NO: 2906958 - protein, 25 aa, Entamoeba invadens
SKTTVGSPSFATTTFSGSPSTQKIN

SEQ ID NO: 2906959 - protein, 7 aa, Entamoeba invadens
SKTTYLK

SEQ ID NO: 2906960 - protein, 9 aa, Entamoeba invadens
SKTVRGGSF

SEQ ID NO: 2906961 - protein, 7 aa, Entamoeba invadens
SKTYNIP

SEQ ID NO: 2906962 - protein, 9 aa, Entamoeba invadens
SKVAQTLSQ

SEQ ID NO: 2906963 - protein, 8 aa, Entamoeba invadens
SKVDGSEI

SEQ ID NO: 2906964 - protein, 12 aa, Entamoeba invadens
SKVDIKSKEGEM

SEQ ID NO: 2906965 - protein, 6 aa, Entamoeba invadens
SKVEGL

SEQ ID NO: 2906966 - protein, 7 aa, Entamoeba invadens
SKVEPVE

SEQ ID NO: 2906967 - protein, 9 aa, Entamoeba invadens
SKVGDEQSE

SEQ ID NO: 2906968 - protein, 7 aa, Entamoeba invadens
SKVGKTQ

SEQ ID NO: 2906969 - protein, 21 aa, Entamoeba invadens
SKVGTSKVTPPLYSNQNENFR

SEQ ID NO: 2906970 - protein, 14 aa, Entamoeba invadens
SKVKKQKKAKNCVI

SEQ ID NO: 2906971 - protein, 11 aa, Entamoeba invadens
SKVNQKYLPPK

SEQ ID NO: 2906972 - protein, 11 aa, Entamoeba invadens
SKVNSSISATW

SEQ ID NO: 2906973 - protein, 8 aa, Entamoeba invadens
SKVPKMGG

SEQ ID NO: 2906974 - protein, 13 aa, Entamoeba invadens
SKVPTTKNEEAGF

SEQ ID NO: 2906975 - protein, 7 aa, Entamoeba invadens
SKVPTTL

SEQ ID NO: 2906976 - protein, 8 aa, Entamoeba invadens
SKVQPEES

SEQ ID NO: 2906977 - protein, 7 aa, Entamoeba invadens
SKVQTKS

SEQ ID NO: 2906978 - protein, 5 aa, Entamoeba invadens
SKVQV

SEQ ID NO: 2906979 - protein, 9 aa, Entamoeba invadens
SKVQVASKE

SEQ ID NO: 2906980 - protein, 4 aa, Entamoeba invadens
SKVS

SEQ ID NO: 2906981 - protein, 10 aa, Entamoeba invadens
SKVSLERDGN

SEQ ID NO: 2906982 - protein, 4 aa, Entamoeba invadens
SKVT

SEQ ID NO: 2906983 - protein, 44 aa, Entamoeba invadens
SKVTEPKECPSALSAQSPLSTGMKEETKEEMKDDYSEENNDKIR

SEQ ID NO: 2906984 - protein, 5 aa, Entamoeba invadens
SKVTY

SEQ ID NO: 2906985 - protein, 6 aa, Entamoeba invadens
SKVVED

SEQ ID NO: 2906986 - protein, 5 aa, Entamoeba invadens
SKWEP

SEQ ID NO: 2906987 - protein, 11 aa, Entamoeba invadens
SKYAIPNTPMN

SEQ ID NO: 2906988 - protein, 13 aa, Entamoeba invadens
SKYAQDKLQMDGQ

SEQ ID NO: 2906989 - protein, 4 aa, Entamoeba invadens
SKYE

SEQ ID NO: 2906990 - protein, 9 aa, Entamoeba invadens
SKYEETITE

SEQ ID NO: 2906991 - protein, 14 aa, Entamoeba invadens
SKYEPMRREKPNEW

SEQ ID NO: 2906992 - protein, 6 aa, Entamoeba invadens
SKYETL

SEQ ID NO: 2906993 - protein, 4 aa, Entamoeba invadens
SKYG

SEQ ID NO: 2906994 - protein, 9 aa, Entamoeba invadens
SKYGEEGGK

SEQ ID NO: 2906995 - protein, 7 aa, Entamoeba invadens
SKYGKDG

SEQ ID NO: 2906996 - protein, 4 aa, Entamoeba invadens
SKYK

SEQ ID NO: 2906997 - protein, 9 aa, Entamoeba invadens
SKYKKPADV

SEQ ID NO: 2906998 - protein, 8 aa, Entamoeba invadens
SKYNGYEA

SEQ ID NO: 2906999 - protein, 5 aa, Entamoeba invadens
SKYPF

SEQ ID NO: 2907000 - protein, 6 aa, Entamoeba invadens
SKYPFN

SEQ ID NO: 2907001 - protein, 6 aa, Entamoeba invadens
SKYPKE

SEQ ID NO: 2907002 - protein, 8 aa, Entamoeba invadens
SKYPTSNE

SEQ ID NO: 2907003 - protein, 12 aa, Entamoeba invadens
SKYQKNSKAGSI

SEQ ID NO: 2907004 - protein, 6 aa, Entamoeba invadens
SKYSNS

SEQ ID NO: 2907005 - protein, 8 aa, Entamoeba invadens
SKYSTPTQ

SEQ ID NO: 2907006 - protein, 6 aa, Entamoeba invadens
SKYSYD

SEQ ID NO: 2907007 - protein, 16 aa, Entamoeba invadens
SKYTEGKIGTNKQESI

SEQ ID NO: 2907008 - protein, 17 aa, Entamoeba invadens
SKYTEGKVGTNKQESIK

SEQ ID NO: 2907009 - protein, 14 aa, Entamoeba invadens
SKYTKYVKGGKMTE

SEQ ID NO: 2907010 - protein, 7 aa, Entamoeba invadens
SKYTNTV

SEQ ID NO: 2907011 - protein, 6 aa, Entamoeba invadens
SLADQK

SEQ ID NO: 2907012 - protein, 10 aa, Entamoeba invadens
SLADQKGDAS

SEQ ID NO: 2907013 - protein, 27 aa, Entamoeba invadens
SLAEKRRKVEADTIKQQIEEEKALKKA

SEQ ID NO: 2907014 - protein, 23 aa, Entamoeba invadens
SLAESPKHIKQKKPRKERVDRPT

SEQ ID NO: 2907015 - protein, 12 aa, Entamoeba invadens
SLAEYNKNGFNQ

SEQ ID NO: 2907016 - protein, 10 aa, Entamoeba invadens
SLAGNTPIRT

SEQ ID NO: 2907017 - protein, 6 aa, Entamoeba invadens
SLANGD

SEQ ID NO: 2907018 - protein, 6 aa, Entamoeba invadens
SLANHA

SEQ ID NO: 2907019 - protein, 9 aa, Entamoeba invadens
SLANKEQVE

SEQ ID NO: 2907020 - protein, 9 aa, Entamoeba invadens
SLAPEKTVI

SEQ ID NO: 2907021 - protein, 6 aa, Entamoeba invadens
SLASGS

SEQ ID NO: 2907022 - protein, 10 aa, Entamoeba invadens
SLASKNEKIE

SEQ ID NO: 2907023 - protein, 13 aa, Entamoeba invadens
SLASTEGKAVTAG

SEQ ID NO: 2907024 - protein, 8 aa, Entamoeba invadens
SLASTSQI

SEQ ID NO: 2907025 - protein, 20 aa, Entamoeba invadens
SLATETPKVGEKEQEKQTHE

SEQ ID NO: 2907026 - protein, 9 aa, Entamoeba invadens
SLATPLQNM

SEQ ID NO: 2907027 - protein, 6 aa, Entamoeba invadens
SLATSG

SEQ ID NO: 2907028 - protein, 4 aa, Entamoeba invadens
SLAY

SEQ ID NO: 2907029 - protein, 9 aa, Entamoeba invadens
SLDADLGEA

SEQ ID NO: 2907030 - protein, 12 aa, Entamoeba invadens
SLDAEDQKTIQE

SEQ ID NO: 2907031 - protein, 9 aa, Entamoeba invadens
SLDAEKKKK

SEQ ID NO: 2907032 - protein, 16 aa, Entamoeba invadens
SLDAKGMGDNKPVSIN

SEQ ID NO: 2907033 - protein, 5 aa, Entamoeba invadens
SLDDN

SEQ ID NO: 2907034 - protein, 8 aa, Entamoeba invadens
SLDDPAAF

SEQ ID NO: 2907035 - protein, 13 aa, Entamoeba invadens
SLDEKMGTTSPEI

SEQ ID NO: 2907036 - protein, 8 aa, Entamoeba invadens
SLDEPEAK

SEQ ID NO: 2907037 - protein, 8 aa, Entamoeba invadens
SLDESEYK

SEQ ID NO: 2907038 - protein, 12 aa, Entamoeba invadens
SLDETTLNGKTI

SEQ ID NO: 2907039 - protein, 4 aa, Entamoeba invadens
SLDG

SEQ ID NO: 2907040 - protein, 10 aa, Entamoeba invadens
SLDGAKPDVL

SEQ ID NO: 2907041 - protein, 13 aa, Entamoeba invadens
SLDGKMPKNYENM

SEQ ID NO: 2907042 - protein, 12 aa, Entamoeba invadens
SLDGKPIRARSE

SEQ ID NO: 2907043 - protein, 7 aa, Entamoeba invadens
SLDGNKL

SEQ ID NO: 2907044 - protein, 5 aa, Entamoeba invadens
SLDGP

SEQ ID NO: 2907045 - protein, 5 aa, Entamoeba invadens
SLDGT

SEQ ID NO: 2907046 - protein, 4 aa, Entamoeba invadens
SLDK

SEQ ID NO: 2907047 - protein, 9 aa, Entamoeba invadens
SLDLDEKTK

SEQ ID NO: 2907048 - protein, 6 aa, Entamoeba invadens
SLDNNK

SEQ ID NO: 2907049 - protein, 13 aa, Entamoeba invadens
SLDNPIERDKPHL

SEQ ID NO: 2907050 - protein, 6 aa, Entamoeba invadens
SLDNSE

SEQ ID NO: 2907051 - protein, 15 aa, Entamoeba invadens
SLDNTNKPIKTGKVK

SEQ ID NO: 2907052 - protein, 18 aa, Entamoeba invadens
SLDNTNKPIKTGKVKTKY

SEQ ID NO: 2907053 - protein, 6 aa, Entamoeba invadens
SLDPDE

SEQ ID NO: 2907054 - protein, 16 aa, Entamoeba invadens
SLDPKEYEEQINALEF

SEQ ID NO: 2907055 - protein, 50 aa, Entamoeba invadens
  misc_feature (16)..(17): Xaa can be any naturally occurring amino acid
SLDPTNEVYLSTKQDXXVEQPQTEQREEPSPQNTQQNIPNPQQNQQGGLS

SEQ ID NO: 2907056 - protein, 44 aa, Entamoeba invadens
SLDRKGVDINESESETASTAAKDDTKSSKNGSDKRSLDENKKRM

SEQ ID NO: 2907057 - protein, 16 aa, Entamoeba invadens
SLDSENAEERRLKGQY

SEQ ID NO: 2907058 - protein, 7 aa, Entamoeba invadens
SLDSTYT

SEQ ID NO: 2907059 - protein, 26 aa, Entamoeba invadens
SLDTETVKSYANKDGSYSKESEEDIR

SEQ ID NO: 2907060 - protein, 8 aa, Entamoeba invadens
SLDTTGVT

SEQ ID NO: 2907061 - protein, 8 aa, Entamoeba invadens
SLEDQNEK

SEQ ID NO: 2907062 - protein, 7 aa, Entamoeba invadens
SLEEASR

SEQ ID NO: 2907063 - protein, 6 aa, Entamoeba invadens
SLEECR

SEQ ID NO: 2907064 - protein, 5 aa, Entamoeba invadens
SLEEI

SEQ ID NO: 2907065 - protein, 15 aa, Entamoeba invadens
SLEEKYDRKIHEENE

SEQ ID NO: 2907066 - protein, 9 aa, Entamoeba invadens
SLEEVPDCG

SEQ ID NO: 2907067 - protein, 5 aa, Entamoeba invadens
SLEGD

SEQ ID NO: 2907068 - protein, 13 aa, Entamoeba invadens
SLEGDDLSDISEV

SEQ ID NO: 2907069 - protein, 10 aa, Entamoeba invadens
SLEGPDCSMN

SEQ ID NO: 2907070 - protein, 10 aa, Entamoeba invadens
SLEGSESTQL

SEQ ID NO: 2907071 - protein, 15 aa, Entamoeba invadens
SLEGSEYSDEQKAAL

SEQ ID NO: 2907072 - protein, 4 aa, Entamoeba invadens
SLEH

SEQ ID NO: 2907073 - protein, 4 aa, Entamoeba invadens
SLEK

SEQ ID NO: 2907074 - protein, 11 aa, Entamoeba invadens
SLEKAGKQSVL

SEQ ID NO: 2907075 - protein, 16 aa, Entamoeba invadens
SLEKEIKAEDDKIESK

SEQ ID NO: 2907076 - protein, 8 aa, Entamoeba invadens
SLEKNYNR

SEQ ID NO: 2907077 - protein, 13 aa, Entamoeba invadens
SLEKSDIKSPDDE

SEQ ID NO: 2907078 - protein, 11 aa, Entamoeba invadens
SLEKTQNSEDV

SEQ ID NO: 2907079 - protein, 5 aa, Entamoeba invadens
SLEND

SEQ ID NO: 2907080 - protein, 8 aa, Entamoeba invadens
SLENERKK

SEQ ID NO: 2907081 - protein, 7 aa, Entamoeba invadens
SLENGKV

SEQ ID NO: 2907082 - protein, 8 aa, Entamoeba invadens
SLENKDDV

SEQ ID NO: 2907083 - protein, 10 aa, Entamoeba invadens
SLENNDRSRT

SEQ ID NO: 2907084 - protein, 11 aa, Entamoeba invadens
SLENNSDTKKS

SEQ ID NO: 2907085 - protein, 12 aa, Entamoeba invadens
SLENPPPPKPRR

SEQ ID NO: 2907086 - protein, 13 aa, Entamoeba invadens
SLENQESPDFTTD

SEQ ID NO: 2907087 - protein, 4 aa, Entamoeba invadens
SLEP

SEQ ID NO: 2907088 - protein, 13 aa, Entamoeba invadens
SLEQPSNPQQDDF

SEQ ID NO: 2907089 - protein, 8 aa, Entamoeba invadens
SLERSPKK

SEQ ID NO: 2907090 - protein, 9 aa, Entamoeba invadens
SLESATNQI

SEQ ID NO: 2907091 - protein, 5 aa, Entamoeba invadens
SLESE

SEQ ID NO: 2907092 - protein, 5 aa, Entamoeba invadens
SLESG

SEQ ID NO: 2907093 - protein, 5 aa, Entamoeba invadens
SLESL

SEQ ID NO: 2907094 - protein, 9 aa, Entamoeba invadens
SLESPDNAD

SEQ ID NO: 2907095 - protein, 6 aa, Entamoeba invadens
SLESPQ

SEQ ID NO: 2907096 - protein, 12 aa, Entamoeba invadens
SLETDISKNSTD

SEQ ID NO: 2907097 - protein, 11 aa, Entamoeba invadens
SLETEKEEKIA

SEQ ID NO: 2907098 - protein, 33 aa, Entamoeba invadens
SLETEKEEKIAKYSLDKDEKEEFSSSQDEDDNF

SEQ ID NO: 2907099 - protein, 5 aa, Entamoeba invadens
SLETL

SEQ ID NO: 2907100 - protein, 4 aa, Entamoeba invadens
SLEV

SEQ ID NO: 2907101 - protein, 22 aa, Entamoeba invadens
SLEVKNGDNTTNTKTPTVQKQI

SEQ ID NO: 2907102 - protein, 14 aa, Entamoeba invadens
SLEVTQAASSDCAS

SEQ ID NO: 2907103 - protein, 14 aa, Entamoeba invadens
SLFGNNSTNAMGGN

SEQ ID NO: 2907104 - protein, 7 aa, Entamoeba invadens
SLFNEDQ

SEQ ID NO: 2907105 - protein, 4 aa, Entamoeba invadens
SLFP

SEQ ID NO: 2907106 - protein, 6 aa, Entamoeba invadens
SLFPGT

SEQ ID NO: 2907107 - protein, 17 aa, Entamoeba invadens
SLGDTSLSTKPNEQLHP

SEQ ID NO: 2907108 - protein, 4 aa, Entamoeba invadens
SLGE

SEQ ID NO: 2907109 - protein, 11 aa, Entamoeba invadens
SLGEEKDEKVV

SEQ ID NO: 2907110 - protein, 11 aa, Entamoeba invadens
SLGENDKAKEV

SEQ ID NO: 2907111 - protein, 11 aa, Entamoeba invadens
SLGGGTGSGLG

SEQ ID NO: 2907112 - protein, 5 aa, Entamoeba invadens
SLGGN

SEQ ID NO: 2907113 - protein, 5 aa, Entamoeba invadens
SLGGS

SEQ ID NO: 2907114 - protein, 9 aa, Entamoeba invadens
SLGHPTKDY

SEQ ID NO: 2907115 - protein, 14 aa, Entamoeba invadens
SLGHQTQKSLGTSL

SEQ ID NO: 2907116 - protein, 5 aa, Entamoeba invadens
SLGKE

SEQ ID NO: 2907117 - protein, 5 aa, Entamoeba invadens
SLGKS

SEQ ID NO: 2907118 - protein, 19 aa, Entamoeba invadens
SLGNSSPRNTDTGKFKAAG

SEQ ID NO: 2907119 - protein, 7 aa, Entamoeba invadens
SLGPKGM

SEQ ID NO: 2907120 - protein, 5 aa, Entamoeba invadens
SLGQN

SEQ ID NO: 2907121 - protein, 10 aa, Entamoeba invadens
SLGQTGSIGF

SEQ ID NO: 2907122 - protein, 5 aa, Entamoeba invadens
SLGRN

SEQ ID NO: 2907123 - protein, 9 aa, Entamoeba invadens
SLGSKEPEN

SEQ ID NO: 2907124 - protein, 15 aa, Entamoeba invadens
SLGSTDNISCIVCKF

SEQ ID NO: 2907125 - protein, 5 aa, Entamoeba invadens
SLGTK

SEQ ID NO: 2907126 - protein, 9 aa, Entamoeba invadens
SLGTNNEYE

SEQ ID NO: 2907127 - protein, 7 aa, Entamoeba invadens
SLHNHTK

SEQ ID NO: 2907128 - protein, 14 aa, Entamoeba invadens
SLHPSTETFAPSTS

SEQ ID NO: 2907129 - protein, 14 aa, Entamoeba invadens
SLHSNTKTEEFKSI

SEQ ID NO: 2907130 - protein, 51 aa, Entamoeba invadens
SLHTPTQGMPRYSYSATPRKQRAGSTDYSLNPTLAPEGTPNEKKRHDSVQQ

SEQ ID NO: 2907131 - protein, 9 aa, Entamoeba invadens
SLIKTDEKV

SEQ ID NO: 2907132 - protein, 17 aa, Entamoeba invadens
SLINTDKESSKGEKTKN

SEQ ID NO: 2907133 - protein, 23 aa, Entamoeba invadens
SLINTSERVTISESKGIEEMNNT

SEQ ID NO: 2907134 - protein, 7 aa, Entamoeba invadens
SLKDVGS

SEQ ID NO: 2907135 - protein, 13 aa, Entamoeba invadens
SLKEESELSCSQK

SEQ ID NO: 2907136 - protein, 11 aa, Entamoeba invadens
SLKENEKINTE

SEQ ID NO: 2907137 - protein, 14 aa, Entamoeba invadens
SLKENSPESAGGLT

SEQ ID NO: 2907138 - protein, 5 aa, Entamoeba invadens
SLKER

SEQ ID NO: 2907139 - protein, 6 aa, Entamoeba invadens
SLKERS

SEQ ID NO: 2907140 - protein, 29 aa, Entamoeba invadens
SLKESQSIKNTPLESEKCSLNDSGNSILI

SEQ ID NO: 2907141 - protein, 12 aa, Entamoeba invadens
SLKGKKTFETLN

SEQ ID NO: 2907142 - protein, 5 aa, Entamoeba invadens
SLKKD

SEQ ID NO: 2907143 - protein, 11 aa, Entamoeba invadens
SLKKDRNNEIS

SEQ ID NO: 2907144 - protein, 10 aa, Entamoeba invadens
SLKKTEDKKR

SEQ ID NO: 2907145 - protein, 9 aa, Entamoeba invadens
SLKNRGNEV

SEQ ID NO: 2907146 - protein, 8 aa, Entamoeba invadens
SLKNTEKN

SEQ ID NO: 2907147 - protein, 8 aa, Entamoeba invadens
SLKPENVF

SEQ ID NO: 2907148 - protein, 8 aa, Entamoeba invadens
SLKPLPPR

SEQ ID NO: 2907149 - protein, 17 aa, Entamoeba invadens
SLKQSRKTNLQKKRRQR

SEQ ID NO: 2907150 - protein, 10 aa, Entamoeba invadens
SLKRKGREQK

SEQ ID NO: 2907151 - protein, 5 aa, Entamoeba invadens
SLKRN

SEQ ID NO: 2907152 - protein, 7 aa, Entamoeba invadens
SLKSIQA

SEQ ID NO: 2907153 - protein, 12 aa, Entamoeba invadens
SLKSPDELSSVD

SEQ ID NO: 2907154 - protein, 12 aa, Entamoeba invadens
SLKSTKGGFANA

SEQ ID NO: 2907155 - protein, 16 aa, Entamoeba invadens
SLKSVKKGRWSKDEKI

SEQ ID NO: 2907156 - protein, 4 aa, Entamoeba invadens
SLKT

SEQ ID NO: 2907157 - protein, 9 aa, Entamoeba invadens
SLKTPEQIA

SEQ ID NO: 2907158 - protein, 7 aa, Entamoeba invadens
SLKTPTL

SEQ ID NO: 2907159 - protein, 15 aa, Entamoeba invadens
SLKTQRDFIIQLQTK

SEQ ID NO: 2907160 - protein, 9 aa, Entamoeba invadens
SLKTRTPGR

SEQ ID NO: 2907161 - protein, 6 aa, Entamoeba invadens
SLKTTK

SEQ ID NO: 2907162 - protein, 10 aa, Entamoeba invadens
SLKTTPKLSS

SEQ ID NO: 2907163 - protein, 8 aa, Entamoeba invadens
SLLKPTKY

SEQ ID NO: 2907164 - protein, 4 aa, Entamoeba invadens
SLLT

SEQ ID NO: 2907165 - protein, 15 aa, Entamoeba invadens
SLMPNPTQNAPPMNV

SEQ ID NO: 2907166 - protein, 11 aa, Entamoeba invadens
SLMSERQKKAV

SEQ ID NO: 2907167 - protein, 6 aa, Entamoeba invadens
SLNADD

SEQ ID NO: 2907168 - protein, 7 aa, Entamoeba invadens
SLNAGFG

SEQ ID NO: 2907169 - protein, 5 aa, Entamoeba invadens
SLNDE

SEQ ID NO: 2907170 - protein, 12 aa, Entamoeba invadens
SLNDGGISQEGY

SEQ ID NO: 2907171 - protein, 5 aa, Entamoeba invadens
SLNDS

SEQ ID NO: 2907172 - protein, 9 aa, Entamoeba invadens
SLNGQATEI

SEQ ID NO: 2907173 - protein, 5 aa, Entamoeba invadens
SLNGT

SEQ ID NO: 2907174 - protein, 9 aa, Entamoeba invadens
SLNKMEEEK

SEQ ID NO: 2907175 - protein, 9 aa, Entamoeba invadens
SLNNADNEV

SEQ ID NO: 2907176 - protein, 9 aa, Entamoeba invadens
SLNNEEEVK

SEQ ID NO: 2907177 - protein, 13 aa, Entamoeba invadens
SLNNKTKSDKSEV

SEQ ID NO: 2907178 - protein, 23 aa, Entamoeba invadens
SLNNNEIKKESEMTEQENKELQS

SEQ ID NO: 2907179 - protein, 21 aa, Entamoeba invadens
SLNNSQPTSGSQPSDDYKNEI

SEQ ID NO: 2907180 - protein, 5 aa, Entamoeba invadens
SLNPA

SEQ ID NO: 2907181 - protein, 9 aa, Entamoeba invadens
SLNPQQRAA

SEQ ID NO: 2907182 - protein, 4 aa, Entamoeba invadens
SLNQ

SEQ ID NO: 2907183 - protein, 5 aa, Entamoeba invadens
SLNQT

SEQ ID NO: 2907184 - protein, 6 aa, Entamoeba invadens
SLNQTE

SEQ ID NO: 2907185 - protein, 6 aa, Entamoeba invadens
SLNRTS

SEQ ID NO: 2907186 - protein, 8 aa, Entamoeba invadens
SLNSEDYT

SEQ ID NO: 2907187 - protein, 8 aa, Entamoeba invadens
SLNSEETN

SEQ ID NO: 2907188 - protein, 20 aa, Entamoeba invadens
SLNSETDKVQYEKNQTLKRK

SEQ ID NO: 2907189 - protein, 6 aa, Entamoeba invadens
SLNSGD

SEQ ID NO: 2907190 - protein, 6 aa, Entamoeba invadens
SLNSKN

SEQ ID NO: 2907191 - protein, 6 aa, Entamoeba invadens
SLNSSI

SEQ ID NO: 2907192 - protein, 30 aa, Entamoeba invadens
SLNTELEKNENDRKKQQRKMEGDREGELRE

SEQ ID NO: 2907193 - protein, 9 aa, Entamoeba invadens
SLNTESSKK

SEQ ID NO: 2907194 - protein, 5 aa, Entamoeba invadens
SLNTG

SEQ ID NO: 2907195 - protein, 10 aa, Entamoeba invadens
SLPDGYTPLS

SEQ ID NO: 2907196 - protein, 6 aa, Entamoeba invadens
SLPEDS

SEQ ID NO: 2907197 - protein, 8 aa, Entamoeba invadens
SLPEDYAQ

SEQ ID NO: 2907198 - protein, 5 aa, Entamoeba invadens
SLPEE

SEQ ID NO: 2907199 - protein, 9 aa, Entamoeba invadens
SLPENGEAL

SEQ ID NO: 2907200 - protein, 9 aa, Entamoeba invadens
SLPESTVSI

SEQ ID NO: 2907201 - protein, 7 aa, Entamoeba invadens
SLPGLSE

SEQ ID NO: 2907202 - protein, 6 aa, Entamoeba invadens
SLPGNV

SEQ ID NO: 2907203 - protein, 19 aa, Entamoeba invadens
SLPGRGPSAMSTSNGSFQG

SEQ ID NO: 2907204 - protein, 14 aa, Entamoeba invadens
SLPGSTPNTQNNSL

SEQ ID NO: 2907205 - protein, 6 aa, Entamoeba invadens
SLPIKN

SEQ ID NO: 2907206 - protein, 9 aa, Entamoeba invadens
SLPKEKHLD

SEQ ID NO: 2907207 - protein, 7 aa, Entamoeba invadens
SLPKETS

SEQ ID NO: 2907208 - protein, 6 aa, Entamoeba invadens
SLPKGI

SEQ ID NO: 2907209 - protein, 12 aa, Entamoeba invadens
SLPKPVEHNPPI

SEQ ID NO: 2907210 - protein, 5 aa, Entamoeba invadens
SLPKS

SEQ ID NO: 2907211 - protein, 18 aa, Entamoeba invadens
SLPKSQPLRSRKYNPGDS

SEQ ID NO: 2907212 - protein, 5 aa, Entamoeba invadens
SLPLE

SEQ ID NO: 2907213 - protein, 12 aa, Entamoeba invadens
SLPLESGKSYRI

SEQ ID NO: 2907214 - protein, 6 aa, Entamoeba invadens
SLPLKS

SEQ ID NO: 2907215 - protein, 11 aa, Entamoeba invadens
SLPMKKDVPSD

SEQ ID NO: 2907216 - protein, 9 aa, Entamoeba invadens
SLPNHGPEL

SEQ ID NO: 2907217 - protein, 5 aa, Entamoeba invadens
SLPNN

SEQ ID NO: 2907218 - protein, 6 aa, Entamoeba invadens
SLPNND

SEQ ID NO: 2907219 - protein, 4 aa, Entamoeba invadens
SLPP

SEQ ID NO: 2907220 - protein, 6 aa, Entamoeba invadens
SLPPEY

SEQ ID NO: 2907221 - protein, 5 aa, Entamoeba invadens
SLPPK

SEQ ID NO: 2907222 - protein, 5 aa, Entamoeba invadens
SLPPN

SEQ ID NO: 2907223 - protein, 7 aa, Entamoeba invadens
SLPPNKK

SEQ ID NO: 2907224 - protein, 6 aa, Entamoeba invadens
SLPPQA

SEQ ID NO: 2907225 - protein, 11 aa, Entamoeba invadens
SLPPQSNISHQ

SEQ ID NO: 2907226 - protein, 7 aa, Entamoeba invadens
SLPPRNK

SEQ ID NO: 2907227 - protein, 6 aa, Entamoeba invadens
SLPPSC

SEQ ID NO: 2907228 - protein, 13 aa, Entamoeba invadens
SLPQDNKQKTPEI

SEQ ID NO: 2907229 - protein, 6 aa, Entamoeba invadens
SLPQKF

SEQ ID NO: 2907230 - protein, 6 aa, Entamoeba invadens
SLPQKY

SEQ ID NO: 2907231 - protein, 13 aa, Entamoeba invadens
SLPQNATTENVKV

SEQ ID NO: 2907232 - protein, 4 aa, Entamoeba invadens
SLPS

SEQ ID NO: 2907233 - protein, 14 aa, Entamoeba invadens
SLPSEAFDNAEKWT

SEQ ID NO: 2907234 - protein, 6 aa, Entamoeba invadens
SLPSER

SEQ ID NO: 2907235 - protein, 6 aa, Entamoeba invadens
SLPSFP

SEQ ID NO: 2907236 - protein, 6 aa, Entamoeba invadens
SLPSGQ

SEQ ID NO: 2907237 - protein, 11 aa, Entamoeba invadens
SLPSKYKNSRF

SEQ ID NO: 2907238 - protein, 6 aa, Entamoeba invadens
SLPSSD

SEQ ID NO: 2907239 - protein, 14 aa, Entamoeba invadens
SLPSSLESSPSKEF

SEQ ID NO: 2907240 - protein, 5 aa, Entamoeba invadens
SLPST

SEQ ID NO: 2907241 - protein, 6 aa, Entamoeba invadens
SLPSTV

SEQ ID NO: 2907242 - protein, 12 aa, Entamoeba invadens
SLPTAQSLQECK

SEQ ID NO: 2907243 - protein, 6 aa, Entamoeba invadens
SLPTDY

SEQ ID NO: 2907244 - protein, 30 aa, Entamoeba invadens
SLPTGIPSQPFSSLNSKRKLTQPVNDDVKR

SEQ ID NO: 2907245 - protein, 5 aa, Entamoeba invadens
SLPTP

SEQ ID NO: 2907246 - protein, 7 aa, Entamoeba invadens
SLPTPTI

SEQ ID NO: 2907247 - protein, 10 aa, Entamoeba invadens
SLPTQNENST

SEQ ID NO: 2907248 - protein, 8 aa, Entamoeba invadens
SLPTRGTI

SEQ ID NO: 2907249 - protein, 14 aa, Entamoeba invadens
SLPTRVEKKESNPL

SEQ ID NO: 2907250 - protein, 16 aa, Entamoeba invadens
SLPVGKEDLPTVYQQK

SEQ ID NO: 2907251 - protein, 4 aa, Entamoeba invadens
SLPW

SEQ ID NO: 2907252 - protein, 6 aa, Entamoeba invadens
SLQATH

SEQ ID NO: 2907253 - protein, 5 aa, Entamoeba invadens
SLQDD

SEQ ID NO: 2907254 - protein, 15 aa, Entamoeba invadens
SLQDEEACTKDYYTN

SEQ ID NO: 2907255 - protein, 5 aa, Entamoeba invadens
SLQEI

SEQ ID NO: 2907256 - protein, 15 aa, Entamoeba invadens
SLQENGTNATPSNYN

SEQ ID NO: 2907257 - protein, 6 aa, Entamoeba invadens
SLQERE

SEQ ID NO: 2907258 - protein, 12 aa, Entamoeba invadens
SLQGNTSPKIDD

SEQ ID NO: 2907259 - protein, 5 aa, Entamoeba invadens
SLQKI

SEQ ID NO: 2907260 - protein, 5 aa, Entamoeba invadens
SLQNE

SEQ ID NO: 2907261 - protein, 13 aa, Entamoeba invadens
SLQPDKKFSPATS

SEQ ID NO: 2907262 - protein, 9 aa, Entamoeba invadens
SLQPNETTI

SEQ ID NO: 2907263 - protein, 19 aa, Entamoeba invadens
SLQPSQFSGWGTKQGGKWK

SEQ ID NO: 2907264 - protein, 5 aa, Entamoeba invadens
SLQQA

SEQ ID NO: 2907265 - protein, 5 aa, Entamoeba invadens
SLQQK

SEQ ID NO: 2907266 - protein, 14 aa, Entamoeba invadens
SLQQPSSPNLQSQS

SEQ ID NO: 2907267 - protein, 5 aa, Entamoeba invadens
SLQRN

SEQ ID NO: 2907268 - protein, 8 aa, Entamoeba invadens
SLQRPGTQ

SEQ ID NO: 2907269 - protein, 5 aa, Entamoeba invadens
SLQSA

SEQ ID NO: 2907270 - protein, 11 aa, Entamoeba invadens
SLQSDSQLNKV

SEQ ID NO: 2907271 - protein, 7 aa, Entamoeba invadens
SLQSGEH

SEQ ID NO: 2907272 - protein, 11 aa, Entamoeba invadens
SLQSGKESFDD

SEQ ID NO: 2907273 - protein, 11 aa, Entamoeba invadens
SLQSSSQDQYS

SEQ ID NO: 2907274 - protein, 8 aa, Entamoeba invadens
SLQTEKQN

SEQ ID NO: 2907275 - protein, 5 aa, Entamoeba invadens
SLQTI

SEQ ID NO: 2907276 - protein, 18 aa, Entamoeba invadens
SLREDDEDSEADSLEDLQ

SEQ ID NO: 2907277 - protein, 6 aa, Entamoeba invadens
SLREGN

SEQ ID NO: 2907278 - protein, 8 aa, Entamoeba invadens
SLRGSDED

SEQ ID NO: 2907279 - protein, 15 aa, Entamoeba invadens
SLRGTKVRSGKTWSG

SEQ ID NO: 2907280 - protein, 4 aa, Entamoeba invadens
SLRK

SEQ ID NO: 2907281 - protein, 13 aa, Entamoeba invadens
SLRKEAEKMTDGE

SEQ ID NO: 2907282 - protein, 16 aa, Entamoeba invadens
SLRKEATSHEFSQSHR

SEQ ID NO: 2907283 - protein, 10 aa, Entamoeba invadens
SLRKSTGPLA

SEQ ID NO: 2907284 - protein, 11 aa, Entamoeba invadens
SLRSPAPDSIT

SEQ ID NO: 2907285 - protein, 6 aa, Entamoeba invadens
SLRSSG

SEQ ID NO: 2907286 - protein, 9 aa, Entamoeba invadens
SLRTANDER

SEQ ID NO: 2907287 - protein, 6 aa, Entamoeba invadens
SLRTEV

SEQ ID NO: 2907288 - protein, 7 aa, Entamoeba invadens
SLRTKTE

SEQ ID NO: 2907289 - protein, 4 aa, Entamoeba invadens
SLSA

SEQ ID NO: 2907290 - protein, 6 aa, Entamoeba invadens
SLSANA

SEQ ID NO: 2907291 - protein, 12 aa, Entamoeba invadens
SLSASNTTVGTN

SEQ ID NO: 2907292 - protein, 10 aa, Entamoeba invadens
SLSATSDNDF

SEQ ID NO: 2907293 - protein, 19 aa, Entamoeba invadens
SLSCSTCKSNTNKYYDKDM

SEQ ID NO: 2907294 - protein, 9 aa, Entamoeba invadens
SLSDESEQI

SEQ ID NO: 2907295 - protein, 21 aa, Entamoeba invadens
SLSDIPSPYSPSTPRNSQRAL

SEQ ID NO: 2907296 - protein, 5 aa, Entamoeba invadens
SLSDL

SEQ ID NO: 2907297 - protein, 7 aa, Entamoeba invadens
SLSDNLK

SEQ ID NO: 2907298 - protein, 9 aa, Entamoeba invadens
SLSDSNGMS

SEQ ID NO: 2907299 - protein, 9 aa, Entamoeba invadens
SLSEEDKEL

SEQ ID NO: 2907300 - protein, 12 aa, Entamoeba invadens
SLSEQSQRTNEV

SEQ ID NO: 2907301 - protein, 6 aa, Entamoeba invadens
SLSGLD

SEQ ID NO: 2907302 - protein, 12 aa, Entamoeba invadens
SLSGQNGAQTTA

SEQ ID NO: 2907303 - protein, 33 aa, Entamoeba invadens
SLSGSTLGSLNNGMSGTTLGGIGGSVGGQAGVS

SEQ ID NO: 2907304 - protein, 5 aa, Entamoeba invadens
SLSGT

SEQ ID NO: 2907305 - protein, 7 aa, Entamoeba invadens
SLSHQGK

SEQ ID NO: 2907306 - protein, 24 aa, Entamoeba invadens
SLSHTSGSPTPKTPSPSRSPNNTN

SEQ ID NO: 2907307 - protein, 9 aa, Entamoeba invadens
SLSIDSDST

SEQ ID NO: 2907308 - protein, 26 aa, Entamoeba invadens
SLSKESPNEQERNTPEIKSVRDNSHS

SEQ ID NO: 2907309 - protein, 17 aa, Entamoeba invadens
SLSKPRHKHHPLTQESV

SEQ ID NO: 2907310 - protein, 5 aa, Entamoeba invadens
SLSKS

SEQ ID NO: 2907311 - protein, 5 aa, Entamoeba invadens
SLSLQ

SEQ ID NO: 2907312 - protein, 5 aa, Entamoeba invadens
SLSNL

SEQ ID NO: 2907313 - protein, 11 aa, Entamoeba invadens
SLSPEAAANLN

SEQ ID NO: 2907314 - protein, 7 aa, Entamoeba invadens
SLSPESN

SEQ ID NO: 2907315 - protein, 5 aa, Entamoeba invadens
SLSPF

SEQ ID NO: 2907316 - protein, 10 aa, Entamoeba invadens
SLSPNGNGGV

SEQ ID NO: 2907317 - protein, 20 aa, Entamoeba invadens
SLSPRGVESKQSGDSKKQSH

SEQ ID NO: 2907318 - protein, 4 aa, Entamoeba invadens
SLSQ

SEQ ID NO: 2907319 - protein, 11 aa, Entamoeba invadens
SLSQRSVGRQI

SEQ ID NO: 2907320 - protein, 9 aa, Entamoeba invadens
SLSRPNSAL

SEQ ID NO: 2907321 - protein, 8 aa, Entamoeba invadens
SLSRYEDP

SEQ ID NO: 2907322 - protein, 4 aa, Entamoeba invadens
SLSS

SEQ ID NO: 2907323 - protein, 9 aa, Entamoeba invadens
SLSSDDTGV

SEQ ID NO: 2907324 - protein, 27 aa, Entamoeba invadens
SLSSEAPKAGPPPPPTSWEQRLLKCKI

SEQ ID NO: 2907325 - protein, 5 aa, Entamoeba invadens
SLSSL

SEQ ID NO: 2907326 - protein, 14 aa, Entamoeba invadens
SLSSNHTAQTLLAN

SEQ ID NO: 2907327 - protein, 12 aa, Entamoeba invadens
SLSSNTKKDKSD

SEQ ID NO: 2907328 - protein, 14 aa, Entamoeba invadens
SLSSVNISSSVTSI

SEQ ID NO: 2907329 - protein, 18 aa, Entamoeba invadens
SLSTNPWSEYSDDKSDLT

SEQ ID NO: 2907330 - protein, 13 aa, Entamoeba invadens
SLSTQNTKTASLT

SEQ ID NO: 2907331 - protein, 9 aa, Entamoeba invadens
SLSTQWKPS

SEQ ID NO: 2907332 - protein, 5 aa, Entamoeba invadens
SLSTS

SEQ ID NO: 2907333 - protein, 6 aa, Entamoeba invadens
SLSVPS

SEQ ID NO: 2907334 - protein, 4 aa, Entamoeba invadens
SLTA

SEQ ID NO: 2907335 - protein, 6 aa, Entamoeba invadens
SLTAKK

SEQ ID NO: 2907336 - protein, 8 aa, Entamoeba invadens
SLTARSEE

SEQ ID NO: 2907337 - protein, 5 aa, Entamoeba invadens
SLTDD

SEQ ID NO: 2907338 - protein, 12 aa, Entamoeba invadens
SLTDGKEGLPTG

SEQ ID NO: 2907339 - protein, 10 aa, Entamoeba invadens
SLTDTAKTAQ

SEQ ID NO: 2907340 - protein, 5 aa, Entamoeba invadens
SLTED

SEQ ID NO: 2907341 - protein, 5 aa, Entamoeba invadens
SLTEL

SEQ ID NO: 2907342 - protein, 6 aa, Entamoeba invadens
SLTEQL

SEQ ID NO: 2907343 - protein, 12 aa, Entamoeba invadens
SLTERPPTPFTP

SEQ ID NO: 2907344 - protein, 7 aa, Entamoeba invadens
SLTESDY

SEQ ID NO: 2907345 - protein, 12 aa, Entamoeba invadens
SLTGEKEPSPFP

SEQ ID NO: 2907346 - protein, 8 aa, Entamoeba invadens
SLTKDTDE

SEQ ID NO: 2907347 - protein, 10 aa, Entamoeba invadens
SLTKKEPNTI

SEQ ID NO: 2907348 - protein, 35 aa, Entamoeba invadens
SLTKKTAQSKNGKAGTVSENTMDAEGRTNNDIEKL

SEQ ID NO: 2907349 - protein, 21 aa, Entamoeba invadens
SLTKNGLSERCDQSTNENTEF

SEQ ID NO: 2907350 - protein, 22 aa, Entamoeba invadens
SLTKNSSSANTQVAQPKYSAQV

SEQ ID NO: 2907351 - protein, 5 aa, Entamoeba invadens
SLTLP

SEQ ID NO: 2907352 - protein, 7 aa, Entamoeba invadens
SLTNGRK

SEQ ID NO: 2907353 - protein, 9 aa, Entamoeba invadens
SLTNKMSEE

SEQ ID NO: 2907354 - protein, 7 aa, Entamoeba invadens
SLTNSRK

SEQ ID NO: 2907355 - protein, 4 aa, Entamoeba invadens
SLTP

SEQ ID NO: 2907356 - protein, 11 aa, Entamoeba invadens
SLTPETKEEVK

SEQ ID NO: 2907357 - protein, 23 aa, Entamoeba invadens
SLTPPKAASVTYRHNTTAPPIPP

SEQ ID NO: 2907358 - protein, 25 aa, Entamoeba invadens
SLTPPKNIAQTPRRPVTISGTPIQQ

SEQ ID NO: 2907359 - protein, 12 aa, Entamoeba invadens
SLTPQEVSEAQA

SEQ ID NO: 2907360 - protein, 30 aa, Entamoeba invadens
SLTPSAFQTTSRPKMPSKNSIKSKSSESIT

SEQ ID NO: 2907361 - protein, 5 aa, Entamoeba invadens
SLTPT

SEQ ID NO: 2907362 - protein, 4 aa, Entamoeba invadens
SLTQ

SEQ ID NO: 2907363 - protein, 16 aa, Entamoeba invadens
SLTQDEALSAKEDPEE

SEQ ID NO: 2907364 - protein, 7 aa, Entamoeba invadens
SLTQDEI

SEQ ID NO: 2907365 - protein, 9 aa, Entamoeba invadens
SLTQTQPKR

SEQ ID NO: 2907366 - protein, 13 aa, Entamoeba invadens
SLTSASLGGSFSK

SEQ ID NO: 2907367 - protein, 6 aa, Entamoeba invadens
SLTSGL

SEQ ID NO: 2907368 - protein, 6 aa, Entamoeba invadens
SLTSKM

SEQ ID NO: 2907369 - protein, 12 aa, Entamoeba invadens
SLTSNAATPFDD

SEQ ID NO: 2907370 - protein, 5 aa, Entamoeba invadens
SLTTA

SEQ ID NO: 2907371 - protein, 12 aa, Entamoeba invadens
SLTTGPRVSEAM

SEQ ID NO: 2907372 - protein, 9 aa, Entamoeba invadens
SLTTNNSAL

SEQ ID NO: 2907373 - protein, 8 aa, Entamoeba invadens
SLTTQQPV

SEQ ID NO: 2907374 - protein, 9 aa, Entamoeba invadens
SLTTTNDKL

SEQ ID NO: 2907375 - protein, 6 aa, Entamoeba invadens
SLVNGS

SEQ ID NO: 2907376 - protein, 8 aa, Entamoeba invadens
SLVPPTAR

SEQ ID NO: 2907377 - protein, 12 aa, Entamoeba invadens
SLVSGDDSPNVG

SEQ ID NO: 2907378 - protein, 12 aa, Entamoeba invadens
SLVTENKAKIPK

SEQ ID NO: 2907379 - protein, 5 aa, Entamoeba invadens
SLYGD

SEQ ID NO: 2907380 - protein, 8 aa, Entamoeba invadens
SLYKETKG

SEQ ID NO: 2907381 - protein, 28 aa, Entamoeba invadens
SLYQKRDFSKPTQPTHNKHNTQKSKAYV

SEQ ID NO: 2907382 - protein, 12 aa, Entamoeba invadens
SLYSKKGSITTN

SEQ ID NO: 2907383 - protein, 12 aa, Entamoeba invadens
SLYSSNSLTENA

SEQ ID NO: 2907384 - protein, 14 aa, Entamoeba invadens
SLYTKAGYAGEESP

SEQ ID NO: 2907385 - protein, 5 aa, Entamoeba invadens
SMAES

SEQ ID NO: 2907386 - protein, 5 aa, Entamoeba invadens
SMATK

SEQ ID NO: 2907387 - protein, 73 aa, Entamoeba invadens
SMDCPENKDKEVEQKEKTEKHKKNSKKEMEEKSDDESGSKSDEEEHSEESSEESSEESKGKIYKSDKPKFNRN

SEQ ID NO: 2907388 - protein, 10 aa, Entamoeba invadens
SMDRKTNGPN

SEQ ID NO: 2907389 - protein, 9 aa, Entamoeba invadens
SMDSGDGTY

SEQ ID NO: 2907390 - protein, 6 aa, Entamoeba invadens
SMDTDT

SEQ ID NO: 2907391 - protein, 10 aa, Entamoeba invadens
SMEASDNDTI

SEQ ID NO: 2907392 - protein, 17 aa, Entamoeba invadens
SMEEETDNASTMSDVDQ

SEQ ID NO: 2907393 - protein, 5 aa, Entamoeba invadens
SMEEF

SEQ ID NO: 2907394 - protein, 9 aa, Entamoeba invadens
SMGDTLQPQ

SEQ ID NO: 2907395 - protein, 18 aa, Entamoeba invadens
SMGEKYTEDKEHGFVNVQ

SEQ ID NO: 2907396 - protein, 6 aa, Entamoeba invadens
SMGGID

SEQ ID NO: 2907397 - protein, 6 aa, Entamoeba invadens
SMGKSS

SEQ ID NO: 2907398 - protein, 5 aa, Entamoeba invadens
SMGPS

SEQ ID NO: 2907399 - protein, 5 aa, Entamoeba invadens
SMGQK

SEQ ID NO: 2907400 - protein, 6 aa, Entamoeba invadens
SMGTTT

SEQ ID NO: 2907401 - protein, 10 aa, Entamoeba invadens
SMHKSQEKNM

SEQ ID NO: 2907402 - protein, 8 aa, Entamoeba invadens
SMKADKSL

SEQ ID NO: 2907403 - protein, 6 aa, Entamoeba invadens
SMKKDN

SEQ ID NO: 2907404 - protein, 5 aa, Entamoeba invadens
SMKND

SEQ ID NO: 2907405 - protein, 9 aa, Entamoeba invadens
SMKNTDEYF

SEQ ID NO: 2907406 - protein, 9 aa, Entamoeba invadens
SMKSKDGQE

SEQ ID NO: 2907407 - protein, 40 aa, Entamoeba invadens
SMKSQSSKSVESTQPVGSYSQKQNEQISQPSLTTLPPPPY

SEQ ID NO: 2907408 - protein, 14 aa, Entamoeba invadens
SMKTKDDMKGFEQK

SEQ ID NO: 2907409 - protein, 15 aa, Entamoeba invadens
SMKVTGKERTGKSSL

SEQ ID NO: 2907410 - protein, 6 aa, Entamoeba invadens
SMNDSN

SEQ ID NO: 2907411 - protein, 8 aa, Entamoeba invadens
SMNEAATE

SEQ ID NO: 2907412 - protein, 7 aa, Entamoeba invadens
SMNGEIS

SEQ ID NO: 2907413 - protein, 8 aa, Entamoeba invadens
SMNKETRL

SEQ ID NO: 2907414 - protein, 9 aa, Entamoeba invadens
SMNKLPDKL

SEQ ID NO: 2907415 - protein, 12 aa, Entamoeba invadens
SMNRPASDKDRI

SEQ ID NO: 2907416 - protein, 9 aa, Entamoeba invadens
SMNRSSPLK

SEQ ID NO: 2907417 - protein, 15 aa, Entamoeba invadens
SMNTTGTFSSSFQTS

SEQ ID NO: 2907418 - protein, 10 aa, Entamoeba invadens
SMPDGSERSL

SEQ ID NO: 2907419 - protein, 7 aa, Entamoeba invadens
SMPEDNY

SEQ ID NO: 2907420 - protein, 10 aa, Entamoeba invadens
SMPEEKGDAY

SEQ ID NO: 2907421 - protein, 6 aa, Entamoeba invadens
SMPPDY

SEQ ID NO: 2907422 - protein, 7 aa, Entamoeba invadens
SMPQPMT

SEQ ID NO: 2907423 - protein, 12 aa, Entamoeba invadens
SMPQPPNDETQD

SEQ ID NO: 2907424 - protein, 6 aa, Entamoeba invadens
SMQDNE

SEQ ID NO: 2907425 - protein, 14 aa, Entamoeba invadens
SMQTTSTGSMKDAA

SEQ ID NO: 2907426 - protein, 4 aa, Entamoeba invadens
SMQV

SEQ ID NO: 2907427 - protein, 22 aa, Entamoeba invadens
SMQVGSYDRAKSKIEEALKILE

SEQ ID NO: 2907428 - protein, 9 aa, Entamoeba invadens
SMRGSDENA

SEQ ID NO: 2907429 - protein, 6 aa, Entamoeba invadens
SMRRKD

SEQ ID NO: 2907430 - protein, 35 aa, Entamoeba invadens
SMRTQQPRVRDQRDNTQTSSQQLPQQAEQQQPITQ

SEQ ID NO: 2907431 - protein, 6 aa, Entamoeba invadens
SMSDAQ

SEQ ID NO: 2907432 - protein, 9 aa, Entamoeba invadens
SMSDVNSMT

SEQ ID NO: 2907433 - protein, 6 aa, Entamoeba invadens
SMSDYN

SEQ ID NO: 2907434 - protein, 10 aa, Entamoeba invadens
SMSEDSEDSV

SEQ ID NO: 2907435 - protein, 7 aa, Entamoeba invadens
SMSEEDK

SEQ ID NO: 2907436 - protein, 11 aa, Entamoeba invadens
SMSEGKKCAQC

SEQ ID NO: 2907437 - protein, 10 aa, Entamoeba invadens
SMSGNKKNKI

SEQ ID NO: 2907438 - protein, 29 aa, Entamoeba invadens
SMSNEYKKRGKKKKGMQQNPNNPFFKGME

SEQ ID NO: 2907439 - protein, 6 aa, Entamoeba invadens
SMSPQS

SEQ ID NO: 2907440 - protein, 11 aa, Entamoeba invadens
SMSQNSEETMN

SEQ ID NO: 2907441 - protein, 29 aa, Entamoeba invadens
SMSQTPKSQPAGGPYIRTNQRTASNFEET

SEQ ID NO: 2907442 - protein, 13 aa, Entamoeba invadens
SMSRDQIGEKCEG

SEQ ID NO: 2907443 - protein, 8 aa, Entamoeba invadens
SMSSNDRF

SEQ ID NO: 2907444 - protein, 4 aa, Entamoeba invadens
SMST

SEQ ID NO: 2907445 - protein, 12 aa, Entamoeba invadens
SMTDEIKKKEDV

SEQ ID NO: 2907446 - protein, 4 aa, Entamoeba invadens
SMTK

SEQ ID NO: 2907447 - protein, 19 aa, Entamoeba invadens
SMTPNVQQTIAQNGVQTNP

SEQ ID NO: 2907448 - protein, 10 aa, Entamoeba invadens
SMVATSPSIP

SEQ ID NO: 2907449 - protein, 7 aa, Entamoeba invadens
SMVPPAQ

SEQ ID NO: 2907450 - protein, 16 aa, Entamoeba invadens
SMVPQSSQYTQSSQFS

SEQ ID NO: 2907451 - protein, 5 aa, Entamoeba invadens
SMVTE

SEQ ID NO: 2907452 - protein, 12 aa, Entamoeba invadens
SNAEKKEVSPMS

SEQ ID NO: 2907453 - protein, 11 aa, Entamoeba invadens
SNAESKNPPNL

SEQ ID NO: 2907454 - protein, 7 aa, Entamoeba invadens
SNAEYPV

SEQ ID NO: 2907455 - protein, 5 aa, Entamoeba invadens
SNAFD

SEQ ID NO: 2907456 - protein, 16 aa, Entamoeba invadens
SNAFGSNAFGTTTNGA

SEQ ID NO: 2907457 - protein, 6 aa, Entamoeba invadens
SNAKTT

SEQ ID NO: 2907458 - protein, 4 aa, Entamoeba invadens
SNAL

SEQ ID NO: 2907459 - protein, 11 aa, Entamoeba invadens
SNALSGNNTDI

SEQ ID NO: 2907460 - protein, 8 aa, Entamoeba invadens
SNANDCQE

SEQ ID NO: 2907461 - protein, 7 aa, Entamoeba invadens
SNANSKI

SEQ ID NO: 2907462 - protein, 5 aa, Entamoeba invadens
SNANT

SEQ ID NO: 2907463 - protein, 11 aa, Entamoeba invadens
SNANTDLKTPT

SEQ ID NO: 2907464 - protein, 5 aa, Entamoeba invadens
SNAPA

SEQ ID NO: 2907465 - protein, 5 aa, Entamoeba invadens
SNAPE

SEQ ID NO: 2907466 - protein, 15 aa, Entamoeba invadens
SNAPHKLESSQYNER

SEQ ID NO: 2907467 - protein, 29 aa, Entamoeba invadens
SNAPHTPKHRSYKLSDTRKWSSTNALPSP

SEQ ID NO: 2907468 - protein, 6 aa, Entamoeba invadens
SNAPKF

SEQ ID NO: 2907469 - protein, 7 aa, Entamoeba invadens
SNAPQKK

SEQ ID NO: 2907470 - protein, 9 aa, Entamoeba invadens
SNAPSSTYD

SEQ ID NO: 2907471 - protein, 8 aa, Entamoeba invadens
SNAQFSRY

SEQ ID NO: 2907472 - protein, 10 aa, Entamoeba invadens
SNAQNRNKNI

SEQ ID NO: 2907473 - protein, 4 aa, Entamoeba invadens
SNAS

SEQ ID NO: 2907474 - protein, 9 aa, Entamoeba invadens
SNASQTKTI

SEQ ID NO: 2907475 - protein, 4 aa, Entamoeba invadens
SNAT

SEQ ID NO: 2907476 - protein, 8 aa, Entamoeba invadens
SNATEGNY

SEQ ID NO: 2907477 - protein, 10 aa, Entamoeba invadens
SNATEHSQPI

SEQ ID NO: 2907478 - protein, 5 aa, Entamoeba invadens
SNATF

SEQ ID NO: 2907479 - protein, 50 aa, Entamoeba invadens
SNATPEQQRAMNKSYQQSGGTSLSTNWGDIGKKDLKCEPLEGAEVKQWGK

SEQ ID NO: 2907480 - protein, 6 aa, Entamoeba invadens
SNATRR

SEQ ID NO: 2907481 - protein, 15 aa, Entamoeba invadens
SNATTKLTASSQGKK

SEQ ID NO: 2907482 - protein, 6 aa, Entamoeba invadens
SNATTV

SEQ ID NO: 2907483 - protein, 4 aa, Entamoeba invadens
SNCD

SEQ ID NO: 2907484 - protein, 5 aa, Entamoeba invadens
SNCDD

SEQ ID NO: 2907485 - protein, 8 aa, Entamoeba invadens
SNCENGDI

SEQ ID NO: 2907486 - protein, 12 aa, Entamoeba invadens
SNCSSSRNHHKD

SEQ ID NO: 2907487 - protein, 7 aa, Entamoeba invadens
SNCTSLG

SEQ ID NO: 2907488 - protein, 14 aa, Entamoeba invadens
SNDALGESNLLKYI

SEQ ID NO: 2907489 - protein, 7 aa, Entamoeba invadens
SNDATSR

SEQ ID NO: 2907490 - protein, 6 aa, Entamoeba invadens
SNDAWT

SEQ ID NO: 2907491 - protein, 12 aa, Entamoeba invadens
SNDCTGDPEKVE

SEQ ID NO: 2907492 - protein, 4 aa, Entamoeba invadens
SNDD

SEQ ID NO: 2907493 - protein, 29 aa, Entamoeba invadens
SNDDERTPFKNGPKLFPEDSATEPEESNF

SEQ ID NO: 2907494 - protein, 6 aa, Entamoeba invadens
SNDDHK

SEQ ID NO: 2907495 - protein, 16 aa, Entamoeba invadens
SNDDSIVYPHPSTLNA

SEQ ID NO: 2907496 - protein, 9 aa, Entamoeba invadens
SNDEHEKED

SEQ ID NO: 2907497 - protein, 9 aa, Entamoeba invadens
SNDEIGDYY

SEQ ID NO: 2907498 - protein, 6 aa, Entamoeba invadens
SNDELT

SEQ ID NO: 2907499 - protein, 7 aa, Entamoeba invadens
SNDENSP

SEQ ID NO: 2907500 - protein, 8 aa, Entamoeba invadens
SNDFPSDY

SEQ ID NO: 2907501 - protein, 6 aa, Entamoeba invadens
SNDFSE

SEQ ID NO: 2907502 - protein, 8 aa, Entamoeba invadens
SNDFSNIQ

SEQ ID NO: 2907503 - protein, 20 aa, Entamoeba invadens
SNDGSTVATASYDHTIKIWR

SEQ ID NO: 2907504 - protein, 5 aa, Entamoeba invadens
SNDGT

SEQ ID NO: 2907505 - protein, 14 aa, Entamoeba invadens
SNDGVEKEKNYSRN

SEQ ID NO: 2907506 - protein, 5 aa, Entamoeba invadens
SNDGY

SEQ ID NO: 2907507 - protein, 9 aa, Entamoeba invadens
SNDHNHSFG

SEQ ID NO: 2907508 - protein, 5 aa, Entamoeba invadens
SNDIE

SEQ ID NO: 2907509 - protein, 6 aa, Entamoeba invadens
SNDIYT

SEQ ID NO: 2907510 - protein, 20 aa, Entamoeba invadens
SNDKAGVARYTDTRPDEQER

SEQ ID NO: 2907511 - protein, 5 aa, Entamoeba invadens
SNDKH

SEQ ID NO: 2907512 - protein, 11 aa, Entamoeba invadens
SNDKQTTATTT

SEQ ID NO: 2907513 - protein, 5 aa, Entamoeba invadens
SNDNI

SEQ ID NO: 2907514 - protein, 9 aa, Entamoeba invadens
SNDQSRSKL

SEQ ID NO: 2907515 - protein, 4 aa, Entamoeba invadens
SNDS

SEQ ID NO: 2907516 - protein, 6 aa, Entamoeba invadens
SNDSES

SEQ ID NO: 2907517 - protein, 9 aa, Entamoeba invadens
SNDSGLTTA

SEQ ID NO: 2907518 - protein, 7 aa, Entamoeba invadens
SNDSNHP

SEQ ID NO: 2907519 - protein, 8 aa, Entamoeba invadens
SNDTTVPR

SEQ ID NO: 2907520 - protein, 4 aa, Entamoeba invadens
SNDY

SEQ ID NO: 2907521 - protein, 9 aa, Entamoeba invadens
SNEADKKKP

SEQ ID NO: 2907522 - protein, 8 aa, Entamoeba invadens
SNEAEPQY

SEQ ID NO: 2907523 - protein, 9 aa, Entamoeba invadens
SNEAKNSFE

SEQ ID NO: 2907524 - protein, 6 aa, Entamoeba invadens
SNEALD

SEQ ID NO: 2907525 - protein, 7 aa, Entamoeba invadens
SNEANPV

SEQ ID NO: 2907526 - protein, 7 aa, Entamoeba invadens
SNEARDP

SEQ ID NO: 2907527 - protein, 9 aa, Entamoeba invadens
SNECKESGI

SEQ ID NO: 2907528 - protein, 4 aa, Entamoeba invadens
SNED

SEQ ID NO: 2907529 - protein, 8 aa, Entamoeba invadens
SNEDEQPQ

SEQ ID NO: 2907530 - protein, 5 aa, Entamoeba invadens
SNEDK

SEQ ID NO: 2907531 - protein, 15 aa, Entamoeba invadens
SNEDNKEISVNEESR

SEQ ID NO: 2907532 - protein, 5 aa, Entamoeba invadens
SNEDP

SEQ ID NO: 2907533 - protein, 6 aa, Entamoeba invadens
SNEDPY

SEQ ID NO: 2907534 - protein, 18 aa, Entamoeba invadens
SNEDTQRDFEERSKRQIK

SEQ ID NO: 2907535 - protein, 7 aa, Entamoeba invadens
SNEEAED

SEQ ID NO: 2907536 - protein, 7 aa, Entamoeba invadens
SNEEDIE

SEQ ID NO: 2907537 - protein, 8 aa, Entamoeba invadens
SNEEHENE

SEQ ID NO: 2907538 - protein, 6 aa, Entamoeba invadens
SNEELG

SEQ ID NO: 2907539 - protein, 7 aa, Entamoeba invadens
SNEEMST

SEQ ID NO: 2907540 - protein, 11 aa, Entamoeba invadens
SNEETKKYENR

SEQ ID NO: 2907541 - protein, 6 aa, Entamoeba invadens
SNEEYD

SEQ ID NO: 2907542 - protein, 4 aa, Entamoeba invadens
SNEG

SEQ ID NO: 2907543 - protein, 7 aa, Entamoeba invadens
SNEGASR

SEQ ID NO: 2907544 - protein, 11 aa, Entamoeba invadens
SNEGDYTTNTV

SEQ ID NO: 2907545 - protein, 9 aa, Entamoeba invadens
SNEGVLGEK

SEQ ID NO: 2907546 - protein, 7 aa, Entamoeba invadens
SNEHLTT

SEQ ID NO: 2907547 - protein, 20 aa, Entamoeba invadens
SNEHTNATQNIQNIEKTDRQ

SEQ ID NO: 2907548 - protein, 10 aa, Entamoeba invadens
SNEISTNPSR

SEQ ID NO: 2907549 - protein, 4 aa, Entamoeba invadens
SNEK

SEQ ID NO: 2907550 - protein, 13 aa, Entamoeba invadens
SNEKATKPSSSID

SEQ ID NO: 2907551 - protein, 5 aa, Entamoeba invadens
SNEKI

SEQ ID NO: 2907552 - protein, 16 aa, Entamoeba invadens
SNEKIGKDSESKRNEV

SEQ ID NO: 2907553 - protein, 10 aa, Entamoeba invadens
SNEKMQKVNK

SEQ ID NO: 2907554 - protein, 24 aa, Entamoeba invadens
SNEKNELENEKKQIENKLADAEAR

SEQ ID NO: 2907555 - protein, 7 aa, Entamoeba invadens
SNEKNVD

SEQ ID NO: 2907556 - protein, 9 aa, Entamoeba invadens
SNEKNVPKD

SEQ ID NO: 2907557 - protein, 8 aa, Entamoeba invadens
SNEKSKYV

SEQ ID NO: 2907558 - protein, 16 aa, Entamoeba invadens
SNEKTPPHVRRSSRIR

SEQ ID NO: 2907559 - protein, 20 aa, Entamoeba invadens
SNELKRRQSIEDTPQQKASI

SEQ ID NO: 2907560 - protein, 12 aa, Entamoeba invadens
SNELSELSSSFR

SEQ ID NO: 2907561 - protein, 4 aa, Entamoeba invadens
SNEM

SEQ ID NO: 2907562 - protein, 6 aa, Entamoeba invadens
SNENEC

SEQ ID NO: 2907563 - protein, 7 aa, Entamoeba invadens
SNENEQL

SEQ ID NO: 2907564 - protein, 7 aa, Entamoeba invadens
SNENRGI

SEQ ID NO: 2907565 - protein, 6 aa, Entamoeba invadens
SNENSE

SEQ ID NO: 2907566 - protein, 4 aa, Entamoeba invadens
SNEP

SEQ ID NO: 2907567 - protein, 6 aa, Entamoeba invadens
SNEPMN

SEQ ID NO: 2907568 - protein, 53 aa, Entamoeba invadens
SNEPSQEDCDDDDDDISDSESDSEDSSDDSDESEEDDTSEEEEIENDEEDIKE

SEQ ID NO: 2907569 - protein, 10 aa, Entamoeba invadens
SNEPTQVTSE

SEQ ID NO: 2907570 - protein, 7 aa, Entamoeba invadens
SNEQQGI

SEQ ID NO: 2907571 - protein, 29 aa, Entamoeba invadens
SNEQQQRIPLNEPKNNILRTKGANKPRIS

SEQ ID NO: 2907572 - protein, 4 aa, Entamoeba invadens
SNER

SEQ ID NO: 2907573 - protein, 7 aa, Entamoeba invadens
SNERTQS

SEQ ID NO: 2907574 - protein, 7 aa, Entamoeba invadens
SNESDLE

SEQ ID NO: 2907575 - protein, 8 aa, Entamoeba invadens
SNESIRDA

SEQ ID NO: 2907576 - protein, 7 aa, Entamoeba invadens
SNESKKL

SEQ ID NO: 2907577 - protein, 8 aa, Entamoeba invadens
SNESNGID

SEQ ID NO: 2907578 - protein, 9 aa, Entamoeba invadens
SNESNKEPL

SEQ ID NO: 2907579 - protein, 10 aa, Entamoeba invadens
SNESNKEPPC

SEQ ID NO: 2907580 - protein, 37 aa, Entamoeba invadens
SNESSGDLSPKSPRSANAPGSPRGGWASKRPKTIQSL

SEQ ID NO: 2907581 - protein, 5 aa, Entamoeba invadens
SNESV

SEQ ID NO: 2907582 - protein, 8 aa, Entamoeba invadens
SNESVSKG

SEQ ID NO: 2907583 - protein, 15 aa, Entamoeba invadens
SNESYPNGDSPFQKA

SEQ ID NO: 2907584 - protein, 4 aa, Entamoeba invadens
SNET

SEQ ID NO: 2907585 - protein, 11 aa, Entamoeba invadens
SNETDGLNTNV

SEQ ID NO: 2907586 - protein, 8 aa, Entamoeba invadens
SNETESGV

SEQ ID NO: 2907587 - protein, 21 aa, Entamoeba invadens
SNETGTGSFNDPPQKQRAYAK

SEQ ID NO: 2907588 - protein, 10 aa, Entamoeba invadens
SNETNKTTTL

SEQ ID NO: 2907589 - protein, 8 aa, Entamoeba invadens
SNETNSVV

SEQ ID NO: 2907590 - protein, 8 aa, Entamoeba invadens
SNETTEEI

SEQ ID NO: 2907591 - protein, 9 aa, Entamoeba invadens
SNETTTPTY

SEQ ID NO: 2907592 - protein, 7 aa, Entamoeba invadens
SNETTVD

SEQ ID NO: 2907593 - protein, 22 aa, Entamoeba invadens
SNETVLKSDTNKVEKQKDDIDA

SEQ ID NO: 2907594 - protein, 12 aa, Entamoeba invadens
SNEVNGKVGLGQ

SEQ ID NO: 2907595 - protein, 6 aa, Entamoeba invadens
SNEVPI

SEQ ID NO: 2907596 - protein, 14 aa, Entamoeba invadens
SNFAPEKLKSECKE

SEQ ID NO: 2907597 - protein, 13 aa, Entamoeba invadens
SNFDGTKITGIDP

SEQ ID NO: 2907598 - protein, 59 aa, Entamoeba invadens
SNFEQHEPTNKMEEEPKKAEEPKKEEPKKEEVKMEEEETPEAKAKKEALVEKQKGNEFY

SEQ ID NO: 2907599 - protein, 5 aa, Entamoeba invadens
SNFGD

SEQ ID NO: 2907600 - protein, 6 aa, Entamoeba invadens
SNFGTS

SEQ ID NO: 2907601 - protein, 4 aa, Entamoeba invadens
SNFK

SEQ ID NO: 2907602 - protein, 8 aa, Entamoeba invadens
SNFNATEK

SEQ ID NO: 2907603 - protein, 15 aa, Entamoeba invadens
SNFSTYKRDDRETTV

SEQ ID NO: 2907604 - protein, 7 aa, Entamoeba invadens
SNGAPYT

SEQ ID NO: 2907605 - protein, 32 aa, Entamoeba invadens
  misc_feature (13)..(14): Xaa can be any naturally occurring amino acid
SNGCESCTYGYYXXKNLKIYSENESETSNPDN

SEQ ID NO: 2907606 - protein, 4 aa, Entamoeba invadens
SNGD

SEQ ID NO: 2907607 - protein, 5 aa, Entamoeba invadens
SNGDV

SEQ ID NO: 2907608 - protein, 5 aa, Entamoeba invadens
SNGEH

SEQ ID NO: 2907609 - protein, 14 aa, Entamoeba invadens
SNGERRTKTLETQI

SEQ ID NO: 2907610 - protein, 8 aa, Entamoeba invadens
SNGETERF

SEQ ID NO: 2907611 - protein, 14 aa, Entamoeba invadens
SNGGAHISSCVRTR

SEQ ID NO: 2907612 - protein, 11 aa, Entamoeba invadens
SNGGSQLDSTG

SEQ ID NO: 2907613 - protein, 24 aa, Entamoeba invadens
SNGIDDKKEGDGIKEDEKIEAKSC

SEQ ID NO: 2907614 - protein, 10 aa, Entamoeba invadens
SNGISSRYDD

SEQ ID NO: 2907615 - protein, 17 aa, Entamoeba invadens
SNGKRPDDKCLSDDEKS

SEQ ID NO: 2907616 - protein, 8 aa, Entamoeba invadens
SNGKSMKE

SEQ ID NO: 2907617 - protein, 9 aa, Entamoeba invadens
SNGKTENKL

SEQ ID NO: 2907618 - protein, 27 aa, Entamoeba invadens
SNGKTQKEYTKPKKVLNPVNKANKRIE

SEQ ID NO: 2907619 - protein, 14 aa, Entamoeba invadens
SNGKYPKPSDNYKC

SEQ ID NO: 2907620 - protein, 5 aa, Entamoeba invadens
SNGMG

SEQ ID NO: 2907621 - protein, 7 aa, Entamoeba invadens
SNGMNEK

SEQ ID NO: 2907622 - protein, 10 aa, Entamoeba invadens
SNGNNDVESL

SEQ ID NO: 2907623 - protein, 7 aa, Entamoeba invadens
SNGNQTG

SEQ ID NO: 2907624 - protein, 16 aa, Entamoeba invadens
SNGPEDLEMSENGSIV

SEQ ID NO: 2907625 - protein, 8 aa, Entamoeba invadens
SNGQTPNI

SEQ ID NO: 2907626 - protein, 7 aa, Entamoeba invadens
SNGRING

SEQ ID NO: 2907627 - protein, 7 aa, Entamoeba invadens
SNGRMNK

SEQ ID NO: 2907628 - protein, 8 aa, Entamoeba invadens
SNGRPNAT

SEQ ID NO: 2907629 - protein, 9 aa, Entamoeba invadens
SNGRTEGME

SEQ ID NO: 2907630 - protein, 6 aa, Entamoeba invadens
SNGRVA

SEQ ID NO: 2907631 - protein, 20 aa, Entamoeba invadens
SNGRVDSPKRWIPRSDKPST

SEQ ID NO: 2907632 - protein, 8 aa, Entamoeba invadens
SNGRYSEP

SEQ ID NO: 2907633 - protein, 38 aa, Entamoeba invadens
SNGSDLSSKLNEKIQNEKNRNTKLENEIQTQNDKINEL

SEQ ID NO: 2907634 - protein, 6 aa, Entamoeba invadens
SNGSKI

SEQ ID NO: 2907635 - protein, 5 aa, Entamoeba invadens
SNGSM

SEQ ID NO: 2907636 - protein, 13 aa, Entamoeba invadens
SNGSRLNVVLVRL

SEQ ID NO: 2907637 - protein, 7 aa, Entamoeba invadens
SNGTDKS

SEQ ID NO: 2907638 - protein, 5 aa, Entamoeba invadens
SNGTE

SEQ ID NO: 2907639 - protein, 14 aa, Entamoeba invadens
SNGVGAAKQAIDNG

SEQ ID NO: 2907640 - protein, 5 aa, Entamoeba invadens
SNGVK

SEQ ID NO: 2907641 - protein, 21 aa, Entamoeba invadens
SNGVPKSTPVEPQNAEHKPSL

SEQ ID NO: 2907642 - protein, 12 aa, Entamoeba invadens
SNHFRNGKCKQY

SEQ ID NO: 2907643 - protein, 5 aa, Entamoeba invadens
SNHPN

SEQ ID NO: 2907644 - protein, 53 aa, Entamoeba invadens
SNHRCPNKDGKKKEEEEHEEEKKMEKSNQMSESDKEDENSEPQVNKDASVEDD

SEQ ID NO: 2907645 - protein, 5 aa, Entamoeba invadens
SNHRK

SEQ ID NO: 2907646 - protein, 7 aa, Entamoeba invadens
SNHRKQL

SEQ ID NO: 2907647 - protein, 4 aa, Entamoeba invadens
SNHS

SEQ ID NO: 2907648 - protein, 19 aa, Entamoeba invadens
SNHTKNGDEEKTPEFQRPD

SEQ ID NO: 2907649 - protein, 16 aa, Entamoeba invadens
SNHTSPRIKTEKCQRR

SEQ ID NO: 2907650 - protein, 15 aa, Entamoeba invadens
SNHWSTNTTGCRQFT

SEQ ID NO: 2907651 - protein, 6 aa, Entamoeba invadens
SNIADD

SEQ ID NO: 2907652 - protein, 8 aa, Entamoeba invadens
SNIDKGEK

SEQ ID NO: 2907653 - protein, 8 aa, Entamoeba invadens
SNIDTASA

SEQ ID NO: 2907654 - protein, 19 aa, Entamoeba invadens
SNIEKIQKSSIKSGTKTDW

SEQ ID NO: 2907655 - protein, 19 aa, Entamoeba invadens
SNIEKIQKSTIKSETKTDW

SEQ ID NO: 2907656 - protein, 6 aa, Entamoeba invadens
SNIGGQ

SEQ ID NO: 2907657 - protein, 5 aa, Entamoeba invadens
SNIGI

SEQ ID NO: 2907658 - protein, 5 aa, Entamoeba invadens
SNIGK

SEQ ID NO: 2907659 - protein, 12 aa, Entamoeba invadens
SNIHKRKTELAA

SEQ ID NO: 2907660 - protein, 5 aa, Entamoeba invadens
SNIHQ

SEQ ID NO: 2907661 - protein, 8 aa, Entamoeba invadens
SNIKEVPQ

SEQ ID NO: 2907662 - protein, 9 aa, Entamoeba invadens
SNIKKETTE

SEQ ID NO: 2907663 - protein, 4 aa, Entamoeba invadens
SNIM

SEQ ID NO: 2907664 - protein, 4 aa, Entamoeba invadens
SNIP

SEQ ID NO: 2907665 - protein, 32 aa, Entamoeba invadens
SNIPTPDSTSQHSSFSKYSLPSSKFTSSPPVH

SEQ ID NO: 2907666 - protein, 7 aa, Entamoeba invadens
SNIQSTT

SEQ ID NO: 2907667 - protein, 4 aa, Entamoeba invadens
SNIS

SEQ ID NO: 2907668 - protein, 11 aa, Entamoeba invadens
SNISESGKHSS

SEQ ID NO: 2907669 - protein, 8 aa, Entamoeba invadens
SNISSSIP

SEQ ID NO: 2907670 - protein, 66 aa, Entamoeba invadens
SNISTDTKVPETIAPPPELAPPGGLAPPPGLEPPGMLPPPGLEPPGGMLPPPGLAPPGLEPPGGLM

SEQ ID NO: 2907671 - protein, 14 aa, Entamoeba invadens
SNITPQSSSAFLNS

SEQ ID NO: 2907672 - protein, 6 aa, Entamoeba invadens
SNIVTS

SEQ ID NO: 2907673 - protein, 12 aa, Entamoeba invadens
SNKADDDQFERN

SEQ ID NO: 2907674 - protein, 9 aa, Entamoeba invadens
SNKAIQDTF

SEQ ID NO: 2907675 - protein, 17 aa, Entamoeba invadens
SNKASTRLEPSLQNKVK

SEQ ID NO: 2907676 - protein, 6 aa, Entamoeba invadens
SNKCTD

SEQ ID NO: 2907677 - protein, 7 aa, Entamoeba invadens
SNKDAPE

SEQ ID NO: 2907678 - protein, 22 aa, Entamoeba invadens
SNKDGMTSRDGEKPKKYTKKDK

SEQ ID NO: 2907679 - protein, 9 aa, Entamoeba invadens
SNKDIENGL

SEQ ID NO: 2907680 - protein, 4 aa, Entamoeba invadens
SNKE

SEQ ID NO: 2907681 - protein, 14 aa, Entamoeba invadens
SNKEALKELQQPKS

SEQ ID NO: 2907682 - protein, 6 aa, Entamoeba invadens
SNKEDE

SEQ ID NO: 2907683 - protein, 7 aa, Entamoeba invadens
SNKEEFS

SEQ ID NO: 2907684 - protein, 9 aa, Entamoeba invadens
SNKEEKESW

SEQ ID NO: 2907685 - protein, 5 aa, Entamoeba invadens
SNKEI

SEQ ID NO: 2907686 - protein, 8 aa, Entamoeba invadens
SNKEKRVN

SEQ ID NO: 2907687 - protein, 13 aa, Entamoeba invadens
SNKEKTTGKPCKE

SEQ ID NO: 2907688 - protein, 7 aa, Entamoeba invadens
SNKEQSY

SEQ ID NO: 2907689 - protein, 8 aa, Entamoeba invadens
SNKESYHP

SEQ ID NO: 2907690 - protein, 6 aa, Entamoeba invadens
SNKETA

SEQ ID NO: 2907691 - protein, 6 aa, Entamoeba invadens
SNKFNG

SEQ ID NO: 2907692 - protein, 11 aa, Entamoeba invadens
SNKGLDPTFNK

SEQ ID NO: 2907693 - protein, 10 aa, Entamoeba invadens
SNKGQHRGVK

SEQ ID NO: 2907694 - protein, 10 aa, Entamoeba invadens
SNKIDSLQRE

SEQ ID NO: 2907695 - protein, 7 aa, Entamoeba invadens
SNKKSEW

SEQ ID NO: 2907696 - protein, 8 aa, Entamoeba invadens
SNKKSGEI

SEQ ID NO: 2907697 - protein, 9 aa, Entamoeba invadens
SNKKTKILR

SEQ ID NO: 2907698 - protein, 12 aa, Entamoeba invadens
SNKLEEVEGVKQ

SEQ ID NO: 2907699 - protein, 10 aa, Entamoeba invadens
SNKMEEEKTD

SEQ ID NO: 2907700 - protein, 9 aa, Entamoeba invadens
SNKNATIVT

SEQ ID NO: 2907701 - protein, 6 aa, Entamoeba invadens
SNKNEV

SEQ ID NO: 2907702 - protein, 7 aa, Entamoeba invadens
SNKNLEE

SEQ ID NO: 2907703 - protein, 6 aa, Entamoeba invadens
SNKNSE

SEQ ID NO: 2907704 - protein, 7 aa, Entamoeba invadens
SNKPKMI

SEQ ID NO: 2907705 - protein, 5 aa, Entamoeba invadens
SNKPV

SEQ ID NO: 2907706 - protein, 8 aa, Entamoeba invadens
SNKPVIAT

SEQ ID NO: 2907707 - protein, 9 aa, Entamoeba invadens
SNKQQGIGE

SEQ ID NO: 2907708 - protein, 7 aa, Entamoeba invadens
SNKSNRV

SEQ ID NO: 2907709 - protein, 9 aa, Entamoeba invadens
SNKSSKTDG

SEQ ID NO: 2907710 - protein, 4 aa, Entamoeba invadens
SNKT

SEQ ID NO: 2907711 - protein, 9 aa, Entamoeba invadens
SNKTGSGIN

SEQ ID NO: 2907712 - protein, 6 aa, Entamoeba invadens
SNKTIE

SEQ ID NO: 2907713 - protein, 7 aa, Entamoeba invadens
SNKTNTV

SEQ ID NO: 2907714 - protein, 7 aa, Entamoeba invadens
SNKTPLD

SEQ ID NO: 2907715 - protein, 10 aa, Entamoeba invadens
SNKTQGSYGA

SEQ ID NO: 2907716 - protein, 12 aa, Entamoeba invadens
SNKTQSDLEKEF

SEQ ID NO: 2907717 - protein, 6 aa, Entamoeba invadens
SNKTSL

SEQ ID NO: 2907718 - protein, 8 aa, Entamoeba invadens
SNKTTKIQ

SEQ ID NO: 2907719 - protein, 11 aa, Entamoeba invadens
SNKTTQIEQKV

SEQ ID NO: 2907720 - protein, 6 aa, Entamoeba invadens
SNKTVA

SEQ ID NO: 2907721 - protein, 22 aa, Entamoeba invadens
SNKVAQDAEEGEERNKKEKQKY

SEQ ID NO: 2907722 - protein, 21 aa, Entamoeba invadens
SNLAPKGIAAPSTGKDVSNVS

SEQ ID NO: 2907723 - protein, 11 aa, Entamoeba invadens
SNLDKEANDQM

SEQ ID NO: 2907724 - protein, 6 aa, Entamoeba invadens
SNLDYT

SEQ ID NO: 2907725 - protein, 4 aa, Entamoeba invadens
SNLE

SEQ ID NO: 2907726 - protein, 12 aa, Entamoeba invadens
SNLEDFDDSIFD

SEQ ID NO: 2907727 - protein, 6 aa, Entamoeba invadens
SNLERD

SEQ ID NO: 2907728 - protein, 6 aa, Entamoeba invadens
SNLGGE

SEQ ID NO: 2907729 - protein, 7 aa, Entamoeba invadens
SNLGNDE

SEQ ID NO: 2907730 - protein, 42 aa, Entamoeba invadens
SNLKKSPSPQSAKSEPTNLEKKDESINSTQQNKTVSQIRENE

SEQ ID NO: 2907731 - protein, 8 aa, Entamoeba invadens
SNLKNGGE

SEQ ID NO: 2907732 - protein, 20 aa, Entamoeba invadens
SNLKTVATKKIQNAVQEMSQ

SEQ ID NO: 2907733 - protein, 10 aa, Entamoeba invadens
SNLPDAKTQC

SEQ ID NO: 2907734 - protein, 6 aa, Entamoeba invadens
SNLPEN

SEQ ID NO: 2907735 - protein, 12 aa, Entamoeba invadens
SNLPGDDENEES

SEQ ID NO: 2907736 - protein, 24 aa, Entamoeba invadens
SNLPGSASCTPCSEGYYTNTTATT

SEQ ID NO: 2907737 - protein, 7 aa, Entamoeba invadens
SNLPRKA

SEQ ID NO: 2907738 - protein, 7 aa, Entamoeba invadens
SNLQKPG

SEQ ID NO: 2907739 - protein, 15 aa, Entamoeba invadens
SNLQQNGDIPEFGKP

SEQ ID NO: 2907740 - protein, 8 aa, Entamoeba invadens
SNLRKNEN

SEQ ID NO: 2907741 - protein, 4 aa, Entamoeba invadens
SNLS

SEQ ID NO: 2907742 - protein, 6 aa, Entamoeba invadens
SNLSQG

SEQ ID NO: 2907743 - protein, 4 aa, Entamoeba invadens
SNLT

SEQ ID NO: 2907744 - protein, 14 aa, Entamoeba invadens
SNLVSESETNNSNY

SEQ ID NO: 2907745 - protein, 15 aa, Entamoeba invadens
SNMENPDNEQYEDVN

SEQ ID NO: 2907746 - protein, 10 aa, Entamoeba invadens
SNMKQEQAGM

SEQ ID NO: 2907747 - protein, 29 aa, Entamoeba invadens
SNMNQKDKDKLEADAENMNRKKDAQEKQL

SEQ ID NO: 2907748 - protein, 6 aa, Entamoeba invadens
SNMSTG

SEQ ID NO: 2907749 - protein, 5 aa, Entamoeba invadens
SNNCD

SEQ ID NO: 2907750 - protein, 4 aa, Entamoeba invadens
SNNE

SEQ ID NO: 2907751 - protein, 9 aa, Entamoeba invadens
SNNEKATVT

SEQ ID NO: 2907752 - protein, 4 aa, Entamoeba invadens
SNNG

SEQ ID NO: 2907753 - protein, 14 aa, Entamoeba invadens
SNNGNRQLLSPPKR

SEQ ID NO: 2907754 - protein, 4 aa, Entamoeba invadens
SNNH

SEQ ID NO: 2907755 - protein, 9 aa, Entamoeba invadens
SNNKEASNK

SEQ ID NO: 2907756 - protein, 9 aa, Entamoeba invadens
SNNKGAGHY

SEQ ID NO: 2907757 - protein, 13 aa, Entamoeba invadens
SNNKNEAPFDTTL

SEQ ID NO: 2907758 - protein, 6 aa, Entamoeba invadens
SNNKSG

SEQ ID NO: 2907759 - protein, 6 aa, Entamoeba invadens
SNNLGT

SEQ ID NO: 2907760 - protein, 17 aa, Entamoeba invadens
SNNLTKPAMATGAQKKQ

SEQ ID NO: 2907761 - protein, 9 aa, Entamoeba invadens
SNNNDNRRV

SEQ ID NO: 2907762 - protein, 28 aa, Entamoeba invadens
SNNNEKKKLETKEVVTSHGKSLSEGNEM

SEQ ID NO: 2907763 - protein, 8 aa, Entamoeba invadens
SNNNGELG

SEQ ID NO: 2907764 - protein, 5 aa, Entamoeba invadens
SNNNK

SEQ ID NO: 2907765 - protein, 47 aa, Entamoeba invadens
SNNNKEKESSNNNMTNADAAKNAEKDDEKKEVSKKEEEQIQKKEEKY

SEQ ID NO: 2907766 - protein, 11 aa, Entamoeba invadens
SNNNSNQTEQF

SEQ ID NO: 2907767 - protein, 8 aa, Entamoeba invadens
SNNPITDD

SEQ ID NO: 2907768 - protein, 10 aa, Entamoeba invadens
SNNPNATEQD

SEQ ID NO: 2907769 - protein, 15 aa, Entamoeba invadens
SNNPVAHDESFFNTA

SEQ ID NO: 2907770 - protein, 11 aa, Entamoeba invadens
SNNSGKINKKE

SEQ ID NO: 2907771 - protein, 5 aa, Entamoeba invadens
SNNSK

SEQ ID NO: 2907772 - protein, 13 aa, Entamoeba invadens
SNNSLNSDESLIT

SEQ ID NO: 2907773 - protein, 10 aa, Entamoeba invadens
SNNSQNSPRV

SEQ ID NO: 2907774 - protein, 7 aa, Entamoeba invadens
SNNTDRE

SEQ ID NO: 2907775 - protein, 7 aa, Entamoeba invadens
SNNTEIE

SEQ ID NO: 2907776 - protein, 6 aa, Entamoeba invadens
SNNTLE

SEQ ID NO: 2907777 - protein, 6 aa, Entamoeba invadens
SNNTNE

SEQ ID NO: 2907778 - protein, 11 aa, Entamoeba invadens
SNNTNPRGLMP

SEQ ID NO: 2907779 - protein, 9 aa, Entamoeba invadens
SNNTNSPIA

SEQ ID NO: 2907780 - protein, 8 aa, Entamoeba invadens
SNNTRTPF

SEQ ID NO: 2907781 - protein, 7 aa, Entamoeba invadens
SNNTVKD

SEQ ID NO: 2907782 - protein, 14 aa, Entamoeba invadens
SNNTYNEKYAQLNK

SEQ ID NO: 2907783 - protein, 7 aa, Entamoeba invadens
SNNVDTS

SEQ ID NO: 2907784 - protein, 5 aa, Entamoeba invadens
SNNVG

SEQ ID NO: 2907785 - protein, 6 aa, Entamoeba invadens
SNNVKN

SEQ ID NO: 2907786 - protein, 5 aa, Entamoeba invadens
SNNVS

SEQ ID NO: 2907787 - protein, 14 aa, Entamoeba invadens
SNNYQTPCNTTECE

SEQ ID NO: 2907788 - protein, 7 aa, Entamoeba invadens
SNPCSEE

SEQ ID NO: 2907789 - protein, 14 aa, Entamoeba invadens
SNPDTLKNTKNQLG

SEQ ID NO: 2907790 - protein, 9 aa, Entamoeba invadens
SNPEDGLET

SEQ ID NO: 2907791 - protein, 10 aa, Entamoeba invadens
SNPESKMDGY

SEQ ID NO: 2907792 - protein, 6 aa, Entamoeba invadens
SNPFKS

SEQ ID NO: 2907793 - protein, 7 aa, Entamoeba invadens
SNPFTEI

SEQ ID NO: 2907794 - protein, 22 aa, Entamoeba invadens
SNPHNDTVQKQTTTLPKLSDLF

SEQ ID NO: 2907795 - protein, 6 aa, Entamoeba invadens
SNPIPL

SEQ ID NO: 2907796 - protein, 12 aa, Entamoeba invadens
SNPLQKLTEDET

SEQ ID NO: 2907797 - protein, 16 aa, Entamoeba invadens
SNPLSSSVGNTEQMTH

SEQ ID NO: 2907798 - protein, 8 aa, Entamoeba invadens
SNPLTTTS

SEQ ID NO: 2907799 - protein, 5 aa, Entamoeba invadens
SNPME

SEQ ID NO: 2907800 - protein, 8 aa, Entamoeba invadens
SNPNCQRP

SEQ ID NO: 2907801 - protein, 10 aa, Entamoeba invadens
SNPNDSKQNK

SEQ ID NO: 2907802 - protein, 7 aa, Entamoeba invadens
SNPNTPE

SEQ ID NO: 2907803 - protein, 8 aa, Entamoeba invadens
SNPNTQTL

SEQ ID NO: 2907804 - protein, 54 aa, Entamoeba invadens
SNPNYDGTQQPQQPTKQQEPIPPQPPLPEKTYQQPKPEVPKKEEPIPQQPVQPE

SEQ ID NO: 2907805 - protein, 14 aa, Entamoeba invadens
SNPNYYKTADLGTS

SEQ ID NO: 2907806 - protein, 6 aa, Entamoeba invadens
SNPPQE

SEQ ID NO: 2907807 - protein, 8 aa, Entamoeba invadens
SNPPSSSC

SEQ ID NO: 2907808 - protein, 30 aa, Entamoeba invadens
SNPPSTDPLENTTTDYKPSFKKAKRQVKKV

SEQ ID NO: 2907809 - protein, 9 aa, Entamoeba invadens
SNPPSTLSQ

SEQ ID NO: 2907810 - protein, 7 aa, Entamoeba invadens
SNPPTEA

SEQ ID NO: 2907811 - protein, 5 aa, Entamoeba invadens
SNPQI

SEQ ID NO: 2907812 - protein, 10 aa, Entamoeba invadens
SNPQKQGDFE

SEQ ID NO: 2907813 - protein, 22 aa, Entamoeba invadens
SNPQKQLQNIEKRGREGEKNYN

SEQ ID NO: 2907814 - protein, 6 aa, Entamoeba invadens
SNPRNE

SEQ ID NO: 2907815 - protein, 6 aa, Entamoeba invadens
SNPRTQ

SEQ ID NO: 2907816 - protein, 6 aa, Entamoeba invadens
SNPSCE

SEQ ID NO: 2907817 - protein, 8 aa, Entamoeba invadens
SNPSFTPV

SEQ ID NO: 2907818 - protein, 11 aa, Entamoeba invadens
SNPSKFEINSD

SEQ ID NO: 2907819 - protein, 6 aa, Entamoeba invadens
SNPSQE

SEQ ID NO: 2907820 - protein, 7 aa, Entamoeba invadens
SNPSVEQ

SEQ ID NO: 2907821 - protein, 7 aa, Entamoeba invadens
SNPSYGH

SEQ ID NO: 2907822 - protein, 9 aa, Entamoeba invadens
SNPTGPKRM

SEQ ID NO: 2907823 - protein, 18 aa, Entamoeba invadens
SNPTSPVVKHTTHLRNNR

SEQ ID NO: 2907824 - protein, 20 aa, Entamoeba invadens
SNPTTAVPRRNPPPPPRPQF

SEQ ID NO: 2907825 - protein, 27 aa, Entamoeba invadens
SNPVKGHKEDFKPIPPKPTKTPPSPRK

SEQ ID NO: 2907826 - protein, 7 aa, Entamoeba invadens
SNPVPLT

SEQ ID NO: 2907827 - protein, 6 aa, Entamoeba invadens
SNQAIT

SEQ ID NO: 2907828 - protein, 8 aa, Entamoeba invadens
SNQDESPN

SEQ ID NO: 2907829 - protein, 49 aa, Entamoeba invadens
SNQEDGTAQHLRQEKAEEKQETEIKEDSHLGTEKTVPLSDSSKSSISVP

SEQ ID NO: 2907830 - protein, 22 aa, Entamoeba invadens
SNQFDSNELTHRNGEKADQEDL

SEQ ID NO: 2907831 - protein, 16 aa, Entamoeba invadens
SNQKEKPIEQKKAETK

SEQ ID NO: 2907832 - protein, 5 aa, Entamoeba invadens
SNQKF

SEQ ID NO: 2907833 - protein, 9 aa, Entamoeba invadens
SNQKTTTKT

SEQ ID NO: 2907834 - protein, 4 aa, Entamoeba invadens
SNQN

SEQ ID NO: 2907835 - protein, 8 aa, Entamoeba invadens
SNQNKLAA

SEQ ID NO: 2907836 - protein, 9 aa, Entamoeba invadens
SNQNRSTCA

SEQ ID NO: 2907837 - protein, 8 aa, Entamoeba invadens
SNQPELTI

SEQ ID NO: 2907838 - protein, 6 aa, Entamoeba invadens
SNQPPV

SEQ ID NO: 2907839 - protein, 10 aa, Entamoeba invadens
SNQQEQAKKS

SEQ ID NO: 2907840 - protein, 6 aa, Entamoeba invadens
SNQQQA

SEQ ID NO: 2907841 - protein, 11 aa, Entamoeba invadens
SNQRSKQELGE

SEQ ID NO: 2907842 - protein, 9 aa, Entamoeba invadens
SNQSATRDY

SEQ ID NO: 2907843 - protein, 9 aa, Entamoeba invadens
SNQSNEDEM

SEQ ID NO: 2907844 - protein, 16 aa, Entamoeba invadens
SNQTMENSVVPKKITI

SEQ ID NO: 2907845 - protein, 6 aa, Entamoeba invadens
SNQTMT

SEQ ID NO: 2907846 - protein, 14 aa, Entamoeba invadens
SNRAEIKEQQQKEL

SEQ ID NO: 2907847 - protein, 13 aa, Entamoeba invadens
SNRAKSSPERLGK

SEQ ID NO: 2907848 - protein, 4 aa, Entamoeba invadens
SNRC

SEQ ID NO: 2907849 - protein, 6 aa, Entamoeba invadens
SNRCPQ

SEQ ID NO: 2907850 - protein, 7 aa, Entamoeba invadens
SNREEMQ

SEQ ID NO: 2907851 - protein, 7 aa, Entamoeba invadens
SNRHTEL

SEQ ID NO: 2907852 - protein, 5 aa, Entamoeba invadens
SNRIS

SEQ ID NO: 2907853 - protein, 9 aa, Entamoeba invadens
SNRISSNDF

SEQ ID NO: 2907854 - protein, 10 aa, Entamoeba invadens
SNRKDKPLRI

SEQ ID NO: 2907855 - protein, 6 aa, Entamoeba invadens
SNRKDL

SEQ ID NO: 2907856 - protein, 15 aa, Entamoeba invadens
SNRKSYEKRRRQEEI

SEQ ID NO: 2907857 - protein, 6 aa, Entamoeba invadens
SNRLET

SEQ ID NO: 2907858 - protein, 7 aa, Entamoeba invadens
SNRNLPR

SEQ ID NO: 2907859 - protein, 41 aa, Entamoeba invadens
SNRNSHTKNEKKTQETTQSRSDKSSQSETQSDQDKETVNGT

SEQ ID NO: 2907860 - protein, 9 aa, Entamoeba invadens
SNRNTSDVT

SEQ ID NO: 2907861 - protein, 9 aa, Entamoeba invadens
SNRPTDTAT

SEQ ID NO: 2907862 - protein, 6 aa, Entamoeba invadens
SNRPVM

SEQ ID NO: 2907863 - protein, 19 aa, Entamoeba invadens
SNRRIGAPFSETSKANPVF

SEQ ID NO: 2907864 - protein, 7 aa, Entamoeba invadens
SNRSSYR

SEQ ID NO: 2907865 - protein, 8 aa, Entamoeba invadens
SNRTTNKP

SEQ ID NO: 2907866 - protein, 5 aa, Entamoeba invadens
SNSAS

SEQ ID NO: 2907867 - protein, 7 aa, Entamoeba invadens
SNSATDV

SEQ ID NO: 2907868 - protein, 17 aa, Entamoeba invadens
SNSAYPPSNNPYGFYNP

SEQ ID NO: 2907869 - protein, 13 aa, Entamoeba invadens
SNSDDWAKSSSVF

SEQ ID NO: 2907870 - protein, 7 aa, Entamoeba invadens
SNSDELN

SEQ ID NO: 2907871 - protein, 8 aa, Entamoeba invadens
SNSDLENV

SEQ ID NO: 2907872 - protein, 7 aa, Entamoeba invadens
SNSEDRT

SEQ ID NO: 2907873 - protein, 7 aa, Entamoeba invadens
SNSEGAL

SEQ ID NO: 2907874 - protein, 6 aa, Entamoeba invadens
SNSFVN

SEQ ID NO: 2907875 - protein, 5 aa, Entamoeba invadens
SNSGF

SEQ ID NO: 2907876 - protein, 6 aa, Entamoeba invadens
SNSGNK

SEQ ID NO: 2907877 - protein, 5 aa, Entamoeba invadens
SNSHE

SEQ ID NO: 2907878 - protein, 6 aa, Entamoeba invadens
SNSHNN

SEQ ID NO: 2907879 - protein, 6 aa, Entamoeba invadens
SNSIEE

SEQ ID NO: 2907880 - protein, 28 aa, Entamoeba invadens
SNSIGGTPSLTNTTATTTPTVPAPTVDL

SEQ ID NO: 2907881 - protein, 7 aa, Entamoeba invadens
SNSISGR

SEQ ID NO: 2907882 - protein, 6 aa, Entamoeba invadens
SNSKEI

SEQ ID NO: 2907883 - protein, 8 aa, Entamoeba invadens
SNSKEYSI

SEQ ID NO: 2907884 - protein, 7 aa, Entamoeba invadens
SNSKGGI

SEQ ID NO: 2907885 - protein, 7 aa, Entamoeba invadens
SNSKLNE

SEQ ID NO: 2907886 - protein, 10 aa, Entamoeba invadens
SNSKNLKAAY

SEQ ID NO: 2907887 - protein, 8 aa, Entamoeba invadens
SNSKTTSE

SEQ ID NO: 2907888 - protein, 17 aa, Entamoeba invadens
SNSLARSETLSESTRRR

SEQ ID NO: 2907889 - protein, 7 aa, Entamoeba invadens
SNSLGTN

SEQ ID NO: 2907890 - protein, 12 aa, Entamoeba invadens
SNSLPSLGTGYG

SEQ ID NO: 2907891 - protein, 31 aa, Entamoeba invadens
SNSLRSKEKVIQDNKENKRLRNKKKRERKEA

SEQ ID NO: 2907892 - protein, 6 aa, Entamoeba invadens
SNSNNL

SEQ ID NO: 2907893 - protein, 5 aa, Entamoeba invadens
SNSNV

SEQ ID NO: 2907894 - protein, 9 aa, Entamoeba invadens
SNSPATGTT

SEQ ID NO: 2907895 - protein, 10 aa, Entamoeba invadens
SNSPDENALN

SEQ ID NO: 2907896 - protein, 6 aa, Entamoeba invadens
SNSPHF

SEQ ID NO: 2907897 - protein, 7 aa, Entamoeba invadens
SNSPPMP

SEQ ID NO: 2907898 - protein, 9 aa, Entamoeba invadens
SNSPRQDER

SEQ ID NO: 2907899 - protein, 6 aa, Entamoeba invadens
SNSQLQ

SEQ ID NO: 2907900 - protein, 10 aa, Entamoeba invadens
SNSQQNRNVS

SEQ ID NO: 2907901 - protein, 18 aa, Entamoeba invadens
SNSQSSSDDAEDEKQDEE

SEQ ID NO: 2907902 - protein, 6 aa, Entamoeba invadens
SNSQYS

SEQ ID NO: 2907903 - protein, 11 aa, Entamoeba invadens
SNSRTKNAKAE

SEQ ID NO: 2907904 - protein, 8 aa, Entamoeba invadens
SNSSEQVQ

SEQ ID NO: 2907905 - protein, 13 aa, Entamoeba invadens
SNSSKFSEEEQRQ

SEQ ID NO: 2907906 - protein, 14 aa, Entamoeba invadens
SNSSKPDGKTRDIL

SEQ ID NO: 2907907 - protein, 22 aa, Entamoeba invadens
SNSSTQQESREKNSHSPTSGFE

SEQ ID NO: 2907908 - protein, 7 aa, Entamoeba invadens
SNSSVVG

SEQ ID NO: 2907909 - protein, 9 aa, Entamoeba invadens
SNSTEGNNT

SEQ ID NO: 2907910 - protein, 10 aa, Entamoeba invadens
SNSTKLNGEN

SEQ ID NO: 2907911 - protein, 8 aa, Entamoeba invadens
SNSTNQKV

SEQ ID NO: 2907912 - protein, 11 aa, Entamoeba invadens
SNSTSPNSSLV

SEQ ID NO: 2907913 - protein, 5 aa, Entamoeba invadens
SNSTT

SEQ ID NO: 2907914 - protein, 8 aa, Entamoeba invadens
SNSVTKKD

SEQ ID NO: 2907915 - protein, 11 aa, Entamoeba invadens
SNSYGETPDAT

SEQ ID NO: 2907916 - protein, 5 aa, Entamoeba invadens
SNTCR

SEQ ID NO: 2907917 - protein, 6 aa, Entamoeba invadens
SNTDEL

SEQ ID NO: 2907918 - protein, 6 aa, Entamoeba invadens
SNTDIA

SEQ ID NO: 2907919 - protein, 4 aa, Entamoeba invadens
SNTE

SEQ ID NO: 2907920 - protein, 12 aa, Entamoeba invadens
SNTEISTVEGTN

SEQ ID NO: 2907921 - protein, 10 aa, Entamoeba invadens
SNTETMSSEK

SEQ ID NO: 2907922 - protein, 7 aa, Entamoeba invadens
SNTETYA

SEQ ID NO: 2907923 - protein, 4 aa, Entamoeba invadens
SNTF

SEQ ID NO: 2907924 - protein, 7 aa, Entamoeba invadens
SNTFNQT

SEQ ID NO: 2907925 - protein, 4 aa, Entamoeba invadens
SNTG

SEQ ID NO: 2907926 - protein, 7 aa, Entamoeba invadens
SNTGEGI

SEQ ID NO: 2907927 - protein, 16 aa, Entamoeba invadens
SNTGGHHSKATPEGAI

SEQ ID NO: 2907928 - protein, 5 aa, Entamoeba invadens
SNTGL

SEQ ID NO: 2907929 - protein, 18 aa, Entamoeba invadens
SNTGLTQPPPPPRQNQTV

SEQ ID NO: 2907930 - protein, 15 aa, Entamoeba invadens
SNTGMSEEQKQFDTT

SEQ ID NO: 2907931 - protein, 19 aa, Entamoeba invadens
SNTGSGTALNVKKSSANPR

SEQ ID NO: 2907932 - protein, 21 aa, Entamoeba invadens
SNTGTMGQPNTLGTPQNTSFF

SEQ ID NO: 2907933 - protein, 7 aa, Entamoeba invadens
SNTHDTV

SEQ ID NO: 2907934 - protein, 14 aa, Entamoeba invadens
SNTHEVTKQKNSKV

SEQ ID NO: 2907935 - protein, 4 aa, Entamoeba invadens
SNTI

SEQ ID NO: 2907936 - protein, 10 aa, Entamoeba invadens
SNTKATDTDV

SEQ ID NO: 2907937 - protein, 8 aa, Entamoeba invadens
SNTKDKNF

SEQ ID NO: 2907938 - protein, 6 aa, Entamoeba invadens
SNTKKI

SEQ ID NO: 2907939 - protein, 8 aa, Entamoeba invadens
SNTKKSRQ

SEQ ID NO: 2907940 - protein, 9 aa, Entamoeba invadens
SNTLGETSN

SEQ ID NO: 2907941 - protein, 16 aa, Entamoeba invadens
SNTLSSPNSPGLSNTM

SEQ ID NO: 2907942 - protein, 4 aa, Entamoeba invadens
SNTM

SEQ ID NO: 2907943 - protein, 8 aa, Entamoeba invadens
SNTNETQI

SEQ ID NO: 2907944 - protein, 7 aa, Entamoeba invadens
SNTNPDT

SEQ ID NO: 2907945 - protein, 8 aa, Entamoeba invadens
SNTNTSYE

SEQ ID NO: 2907946 - protein, 5 aa, Entamoeba invadens
SNTNV

SEQ ID NO: 2907947 - protein, 7 aa, Entamoeba invadens
SNTNVSP

SEQ ID NO: 2907948 - protein, 4 aa, Entamoeba invadens
SNTP

SEQ ID NO: 2907949 - protein, 5 aa, Entamoeba invadens
SNTPF

SEQ ID NO: 2907950 - protein, 13 aa, Entamoeba invadens
SNTPNNTKKTQQI

SEQ ID NO: 2907951 - protein, 11 aa, Entamoeba invadens
SNTPNSNDKFG

SEQ ID NO: 2907952 - protein, 20 aa, Entamoeba invadens
SNTPPSGPQFAEGNKSKYIG

SEQ ID NO: 2907953 - protein, 13 aa, Entamoeba invadens
SNTPSENDADRIE

SEQ ID NO: 2907954 - protein, 33 aa, Entamoeba invadens
SNTPTPNIDDRSPRFKGTKTPKPRSSKISTPSL

SEQ ID NO: 2907955 - protein, 5 aa, Entamoeba invadens
SNTQE

SEQ ID NO: 2907956 - protein, 11 aa, Entamoeba invadens
SNTQESCTETN

SEQ ID NO: 2907957 - protein, 8 aa, Entamoeba invadens
SNTQPGEE

SEQ ID NO: 2907958 - protein, 10 aa, Entamoeba invadens
SNTQQCATND

SEQ ID NO: 2907959 - protein, 9 aa, Entamoeba invadens
SNTQTNRHS

SEQ ID NO: 2907960 - protein, 24 aa, Entamoeba invadens
SNTRDELKSTVEGLEKTAEEKKSE

SEQ ID NO: 2907961 - protein, 12 aa, Entamoeba invadens
SNTRKETAFSAT

SEQ ID NO: 2907962 - protein, 7 aa, Entamoeba invadens
SNTRKSI

SEQ ID NO: 2907963 - protein, 7 aa, Entamoeba invadens
SNTRPLH

SEQ ID NO: 2907964 - protein, 9 aa, Entamoeba invadens
SNTSDVTKQ

SEQ ID NO: 2907965 - protein, 12 aa, Entamoeba invadens
SNTSEKGKNELN

SEQ ID NO: 2907966 - protein, 6 aa, Entamoeba invadens
SNTSER

SEQ ID NO: 2907967 - protein, 13 aa, Entamoeba invadens
SNTSFSNSNYDTY

SEQ ID NO: 2907968 - protein, 7 aa, Entamoeba invadens
SNTSNDV

SEQ ID NO: 2907969 - protein, 8 aa, Entamoeba invadens
SNTSNPDS

SEQ ID NO: 2907970 - protein, 11 aa, Entamoeba invadens
SNTTSKPDLEI

SEQ ID NO: 2907971 - protein, 15 aa, Entamoeba invadens
SNTTTIKNKGEITTE

SEQ ID NO: 2907972 - protein, 7 aa, Entamoeba invadens
SNTTVTP

SEQ ID NO: 2907973 - protein, 28 aa, Entamoeba invadens
SNTVKRKESTTSSHSKTSLKEGSKNEGI

SEQ ID NO: 2907974 - protein, 8 aa, Entamoeba invadens
SNTVTSKI

SEQ ID NO: 2907975 - protein, 6 aa, Entamoeba invadens
SNTYGE

SEQ ID NO: 2907976 - protein, 24 aa, Entamoeba invadens
SNVDKTTQKVLDDREEDFSESCGD

SEQ ID NO: 2907977 - protein, 7 aa, Entamoeba invadens
SNVDSKL

SEQ ID NO: 2907978 - protein, 4 aa, Entamoeba invadens
SNVE

SEQ ID NO: 2907979 - protein, 9 aa, Entamoeba invadens
SNVEEPDDE

SEQ ID NO: 2907980 - protein, 12 aa, Entamoeba invadens
SNVEKKKQQEDY

SEQ ID NO: 2907981 - protein, 10 aa, Entamoeba invadens
SNVEKTQSFQ

SEQ ID NO: 2907982 - protein, 6 aa, Entamoeba invadens
SNVENF

SEQ ID NO: 2907983 - protein, 5 aa, Entamoeba invadens
SNVEV

SEQ ID NO: 2907984 - protein, 10 aa, Entamoeba invadens
SNVFNPDKPF

SEQ ID NO: 2907985 - protein, 7 aa, Entamoeba invadens
SNVGKTS

SEQ ID NO: 2907986 - protein, 10 aa, Entamoeba invadens
SNVKDDELKS

SEQ ID NO: 2907987 - protein, 6 aa, Entamoeba invadens
SNVKNP

SEQ ID NO: 2907988 - protein, 4 aa, Entamoeba invadens
SNVN

SEQ ID NO: 2907989 - protein, 8 aa, Entamoeba invadens
SNVNSEQC

SEQ ID NO: 2907990 - protein, 9 aa, Entamoeba invadens
SNVNSEQCD

SEQ ID NO: 2907991 - protein, 9 aa, Entamoeba invadens
SNVPEKENK

SEQ ID NO: 2907992 - protein, 7 aa, Entamoeba invadens
SNVPPTA

SEQ ID NO: 2907993 - protein, 8 aa, Entamoeba invadens
SNVPTEIQ

SEQ ID NO: 2907994 - protein, 5 aa, Entamoeba invadens
SNVQT

SEQ ID NO: 2907995 - protein, 7 aa, Entamoeba invadens
SNVQTGN

SEQ ID NO: 2907996 - protein, 7 aa, Entamoeba invadens
SNVRDED

SEQ ID NO: 2907997 - protein, 6 aa, Entamoeba invadens
SNVSNK

SEQ ID NO: 2907998 - protein, 12 aa, Entamoeba invadens
SNVSRSKFKNGL

SEQ ID NO: 2907999 - protein, 6 aa, Entamoeba invadens
SNVSTI

SEQ ID NO: 2908000 - protein, 12 aa, Entamoeba invadens
SNVTELEDSAFE

SEQ ID NO: 2908001 - protein, 19 aa, Entamoeba invadens
SNVTMKQGTFQSKAVGTRE

SEQ ID NO: 2908002 - protein, 7 aa, Entamoeba invadens
SNVTSIG

SEQ ID NO: 2908003 - protein, 11 aa, Entamoeba invadens
SNVTVNDKVPS

SEQ ID NO: 2908004 - protein, 5 aa, Entamoeba invadens
SNWES

SEQ ID NO: 2908005 - protein, 14 aa, Entamoeba invadens
SNWVRKEKTKGCFL

SEQ ID NO: 2908006 - protein, 6 aa, Entamoeba invadens
SNYENL

SEQ ID NO: 2908007 - protein, 4 aa, Entamoeba invadens
SNYG

SEQ ID NO: 2908008 - protein, 12 aa, Entamoeba invadens
SNYIKDDNTTFN

SEQ ID NO: 2908009 - protein, 4 aa, Entamoeba invadens
SNYK

SEQ ID NO: 2908010 - protein, 6 aa, Entamoeba invadens
SNYKNT

SEQ ID NO: 2908011 - protein, 6 aa, Entamoeba invadens
SNYLSE

SEQ ID NO: 2908012 - protein, 4 aa, Entamoeba invadens
SNYN

SEQ ID NO: 2908013 - protein, 5 aa, Entamoeba invadens
SNYND

SEQ ID NO: 2908014 - protein, 24 aa, Entamoeba invadens
SNYNVRGDRDASMSISSNNTTPLT

SEQ ID NO: 2908015 - protein, 4 aa, Entamoeba invadens
SNYP

SEQ ID NO: 2908016 - protein, 25 aa, Entamoeba invadens
SNYPKGIAEDDIDDKSASNKPAKRV

SEQ ID NO: 2908017 - protein, 4 aa, Entamoeba invadens
SNYS

SEQ ID NO: 2908018 - protein, 4 aa, Entamoeba invadens
SNYT

SEQ ID NO: 2908019 - protein, 4 aa, Entamoeba invadens
SNYW

SEQ ID NO: 2908020 - protein, 18 aa, Entamoeba invadens
SPAAGATKSSGKKQGCAL

SEQ ID NO: 2908021 - protein, 5 aa, Entamoeba invadens
SPAAL

SEQ ID NO: 2908022 - protein, 5 aa, Entamoeba invadens
SPAEN

SEQ ID NO: 2908023 - protein, 7 aa, Entamoeba invadens
SPAESES

SEQ ID NO: 2908024 - protein, 22 aa, Entamoeba invadens
SPAFKKQEKKAEEVAAPAKDVK

SEQ ID NO: 2908025 - protein, 6 aa, Entamoeba invadens
SPAGTT

SEQ ID NO: 2908026 - protein, 17 aa, Entamoeba invadens
SPAKYGSVKYCKATPKI

SEQ ID NO: 2908027 - protein, 65 aa, Entamoeba invadens
SPALEKKEEKTEKTASEDFADSDEKDFKDDEDSQKSSSDESVSNDSDDIGMATGHSETDKISGLN

SEQ ID NO: 2908028 - protein, 4 aa, Entamoeba invadens
SPAN

SEQ ID NO: 2908029 - protein, 7 aa, Entamoeba invadens
SPANDRY

SEQ ID NO: 2908030 - protein, 8 aa, Entamoeba invadens
SPANIKNS

SEQ ID NO: 2908031 - protein, 9 aa, Entamoeba invadens
SPANPTNKV

SEQ ID NO: 2908032 - protein, 20 aa, Entamoeba invadens
SPAPVQDDMQNTKHVPSFLF

SEQ ID NO: 2908033 - protein, 7 aa, Entamoeba invadens
SPAQLQD

SEQ ID NO: 2908034 - protein, 15 aa, Entamoeba invadens
SPARYSDTPNKNTVE

SEQ ID NO: 2908035 - protein, 9 aa, Entamoeba invadens
SPASGKSSF

SEQ ID NO: 2908036 - protein, 6 aa, Entamoeba invadens
SPASPR

SEQ ID NO: 2908037 - protein, 14 aa, Entamoeba invadens
SPATERDIDKNKPH

SEQ ID NO: 2908038 - protein, 12 aa, Entamoeba invadens
SPATKDQEKYIN

SEQ ID NO: 2908039 - protein, 7 aa, Entamoeba invadens
SPATPVA

SEQ ID NO: 2908040 - protein, 5 aa, Entamoeba invadens
SPCGA

SEQ ID NO: 2908041 - protein, 8 aa, Entamoeba invadens
SPCSDYGK

SEQ ID NO: 2908042 - protein, 13 aa, Entamoeba invadens
SPDAELATSLHAS

SEQ ID NO: 2908043 - protein, 6 aa, Entamoeba invadens
SPDAPD

SEQ ID NO: 2908044 - protein, 8 aa, Entamoeba invadens
SPDAPPEK

SEQ ID NO: 2908045 - protein, 16 aa, Entamoeba invadens
SPDAVTRREKLKEEMR

SEQ ID NO: 2908046 - protein, 13 aa, Entamoeba invadens
SPDCSPREIEKRK

SEQ ID NO: 2908047 - protein, 4 aa, Entamoeba invadens
SPDD

SEQ ID NO: 2908048 - protein, 8 aa, Entamoeba invadens
SPDDKGHF

SEQ ID NO: 2908049 - protein, 6 aa, Entamoeba invadens
SPDDMK

SEQ ID NO: 2908050 - protein, 7 aa, Entamoeba invadens
SPDDSIS

SEQ ID NO: 2908051 - protein, 5 aa, Entamoeba invadens
SPDDY

SEQ ID NO: 2908052 - protein, 5 aa, Entamoeba invadens
SPDEF

SEQ ID NO: 2908053 - protein, 5 aa, Entamoeba invadens
SPDEQ

SEQ ID NO: 2908054 - protein, 6 aa, Entamoeba invadens
SPDERD

SEQ ID NO: 2908055 - protein, 7 aa, Entamoeba invadens
SPDETRT

SEQ ID NO: 2908056 - protein, 8 aa, Entamoeba invadens
SPDFDPEE

SEQ ID NO: 2908057 - protein, 20 aa, Entamoeba invadens
SPDFPEPVAKSVSDGSKCVV

SEQ ID NO: 2908058 - protein, 6 aa, Entamoeba invadens
SPDGNY

SEQ ID NO: 2908059 - protein, 7 aa, Entamoeba invadens
SPDIESP

SEQ ID NO: 2908060 - protein, 4 aa, Entamoeba invadens
SPDK

SEQ ID NO: 2908061 - protein, 9 aa, Entamoeba invadens
SPDKKVPVE

SEQ ID NO: 2908062 - protein, 4 aa, Entamoeba invadens
SPDL

SEQ ID NO: 2908063 - protein, 4 aa, Entamoeba invadens
SPDM

SEQ ID NO: 2908064 - protein, 22 aa, Entamoeba invadens
SPDNNENEVNEIKNRRRRESNI

SEQ ID NO: 2908065 - protein, 6 aa, Entamoeba invadens
SPDNQY

SEQ ID NO: 2908066 - protein, 13 aa, Entamoeba invadens
SPDNTIRKNAEQL

SEQ ID NO: 2908067 - protein, 7 aa, Entamoeba invadens
SPDQRTW

SEQ ID NO: 2908068 - protein, 4 aa, Entamoeba invadens
SPDR

SEQ ID NO: 2908069 - protein, 5 aa, Entamoeba invadens
SPDSR

SEQ ID NO: 2908070 - protein, 29 aa, Entamoeba invadens
SPDSSCPQKETKAKDIQQTSIPSNKNKIH

SEQ ID NO: 2908071 - protein, 9 aa, Entamoeba invadens
SPDVDKSVE

SEQ ID NO: 2908072 - protein, 5 aa, Entamoeba invadens
SPDVE

SEQ ID NO: 2908073 - protein, 8 aa, Entamoeba invadens
SPDVSPQI

SEQ ID NO: 2908074 - protein, 13 aa, Entamoeba invadens
SPEAVSCTNSNSF

SEQ ID NO: 2908075 - protein, 12 aa, Entamoeba invadens
SPEDAKKSSPFM

SEQ ID NO: 2908076 - protein, 18 aa, Entamoeba invadens
SPEDKAEAMKENEAIDRN

SEQ ID NO: 2908077 - protein, 8 aa, Entamoeba invadens
SPEDQTCN

SEQ ID NO: 2908078 - protein, 4 aa, Entamoeba invadens
SPEE

SEQ ID NO: 2908079 - protein, 5 aa, Entamoeba invadens
SPEEK

SEQ ID NO: 2908080 - protein, 6 aa, Entamoeba invadens
SPEEKR

SEQ ID NO: 2908081 - protein, 7 aa, Entamoeba invadens
SPEEVTR

SEQ ID NO: 2908082 - protein, 4 aa, Entamoeba invadens
SPEF

SEQ ID NO: 2908083 - protein, 5 aa, Entamoeba invadens
SPEFA

SEQ ID NO: 2908084 - protein, 8 aa, Entamoeba invadens
SPEGQLKT

SEQ ID NO: 2908085 - protein, 5 aa, Entamoeba invadens
SPEGS

SEQ ID NO: 2908086 - protein, 4 aa, Entamoeba invadens
SPEI

SEQ ID NO: 2908087 - protein, 4 aa, Entamoeba invadens
SPEK

SEQ ID NO: 2908088 - protein, 10 aa, Entamoeba invadens
SPEKHGKEMN

SEQ ID NO: 2908089 - protein, 9 aa, Entamoeba invadens
SPEKYGKEM

SEQ ID NO: 2908090 - protein, 5 aa, Entamoeba invadens
SPELK

SEQ ID NO: 2908091 - protein, 7 aa, Entamoeba invadens
SPELSSG

SEQ ID NO: 2908092 - protein, 4 aa, Entamoeba invadens
SPEM

SEQ ID NO: 2908093 - protein, 11 aa, Entamoeba invadens
SPENKECKINK

SEQ ID NO: 2908094 - protein, 9 aa, Entamoeba invadens
SPENNWSSY

SEQ ID NO: 2908095 - protein, 6 aa, Entamoeba invadens
SPENQK

SEQ ID NO: 2908096 - protein, 7 aa, Entamoeba invadens
SPEPTIP

SEQ ID NO: 2908097 - protein, 5 aa, Entamoeba invadens
SPEQG

SEQ ID NO: 2908098 - protein, 17 aa, Entamoeba invadens
SPEQSPAQVSKLREESI

SEQ ID NO: 2908099 - protein, 5 aa, Entamoeba invadens
SPERA

SEQ ID NO: 2908100 - protein, 9 aa, Entamoeba invadens
SPERKETPV

SEQ ID NO: 2908101 - protein, 7 aa, Entamoeba invadens
SPERNIE

SEQ ID NO: 2908102 - protein, 5 aa, Entamoeba invadens
SPESL

SEQ ID NO: 2908103 - protein, 46 aa, Entamoeba invadens
SPESNNTQKTQITSEIPSSSSEKGLSKDLRRKPLKSKTKKGKAETT

SEQ ID NO: 2908104 - protein, 15 aa, Entamoeba invadens
SPETCELQSVAIYQF

SEQ ID NO: 2908105 - protein, 4 aa, Entamoeba invadens
SPEV

SEQ ID NO: 2908106 - protein, 13 aa, Entamoeba invadens
SPEVEDEEETLSS

SEQ ID NO: 2908107 - protein, 11 aa, Entamoeba invadens
SPEYPAAPPRC

SEQ ID NO: 2908108 - protein, 11 aa, Entamoeba invadens
SPEYSSTVTTS

SEQ ID NO: 2908109 - protein, 6 aa, Entamoeba invadens
SPFASP

SEQ ID NO: 2908110 - protein, 5 aa, Entamoeba invadens
SPFDD

SEQ ID NO: 2908111 - protein, 5 aa, Entamoeba invadens
SPFDS

SEQ ID NO: 2908112 - protein, 7 aa, Entamoeba invadens
SPFDTSN

SEQ ID NO: 2908113 - protein, 9 aa, Entamoeba invadens
SPFESEEDA

SEQ ID NO: 2908114 - protein, 12 aa, Entamoeba invadens
SPFHTTTVSGSN

SEQ ID NO: 2908115 - protein, 8 aa, Entamoeba invadens
SPFKARAE

SEQ ID NO: 2908116 - protein, 5 aa, Entamoeba invadens
SPFKG

SEQ ID NO: 2908117 - protein, 13 aa, Entamoeba invadens
SPFKKDNKTFSTI

SEQ ID NO: 2908118 - protein, 5 aa, Entamoeba invadens
SPFKT

SEQ ID NO: 2908119 - protein, 6 aa, Entamoeba invadens
SPFNAI

SEQ ID NO: 2908120 - protein, 4 aa, Entamoeba invadens
SPFP

SEQ ID NO: 2908121 - protein, 6 aa, Entamoeba invadens
SPFQGK

SEQ ID NO: 2908122 - protein, 11 aa, Entamoeba invadens
SPFQRSESDKY

SEQ ID NO: 2908123 - protein, 4 aa, Entamoeba invadens
SPFT

SEQ ID NO: 2908124 - protein, 9 aa, Entamoeba invadens
SPFTSPTLR

SEQ ID NO: 2908125 - protein, 9 aa, Entamoeba invadens
SPFTTEKSV

SEQ ID NO: 2908126 - protein, 5 aa, Entamoeba invadens
SPGHV

SEQ ID NO: 2908127 - protein, 12 aa, Entamoeba invadens
SPGKHNTEKAET

SEQ ID NO: 2908128 - protein, 22 aa, Entamoeba invadens
SPGLGEKGDTKVDKEKDETVEK

SEQ ID NO: 2908129 - protein, 5 aa, Entamoeba invadens
SPGNE

SEQ ID NO: 2908130 - protein, 11 aa, Entamoeba invadens
SPGNEPTPEPI

SEQ ID NO: 2908131 - protein, 6 aa, Entamoeba invadens
SPGNIK

SEQ ID NO: 2908132 - protein, 6 aa, Entamoeba invadens
SPGNNL

SEQ ID NO: 2908133 - protein, 6 aa, Entamoeba invadens
SPGPYQ

SEQ ID NO: 2908134 - protein, 5 aa, Entamoeba invadens
SPGTS

SEQ ID NO: 2908135 - protein, 14 aa, Entamoeba invadens
SPGTTQCPSPSFSP

SEQ ID NO: 2908136 - protein, 8 aa, Entamoeba invadens
SPHDSNDI

SEQ ID NO: 2908137 - protein, 4 aa, Entamoeba invadens
SPHG

SEQ ID NO: 2908138 - protein, 8 aa, Entamoeba invadens
SPHGNGVS

SEQ ID NO: 2908139 - protein, 14 aa, Entamoeba invadens
SPHHEEAPKRPELT

SEQ ID NO: 2908140 - protein, 7 aa, Entamoeba invadens
SPHPDDD

SEQ ID NO: 2908141 - protein, 5 aa, Entamoeba invadens
SPHPL

SEQ ID NO: 2908142 - protein, 13 aa, Entamoeba invadens
SPHSALDSVNGGI

SEQ ID NO: 2908143 - protein, 8 aa, Entamoeba invadens
SPHSGKTT

SEQ ID NO: 2908144 - protein, 4 aa, Entamoeba invadens
SPHT

SEQ ID NO: 2908145 - protein, 4 aa, Entamoeba invadens
SPIA

SEQ ID NO: 2908146 - protein, 38 aa, Entamoeba invadens
SPIANSKQKPTSTLSTIQKSYDESFQPSNEKKDAKNVL

SEQ ID NO: 2908147 - protein, 16 aa, Entamoeba invadens
SPIDSPRSEGERDEDN

SEQ ID NO: 2908148 - protein, 7 aa, Entamoeba invadens
SPIDTES

SEQ ID NO: 2908149 - protein, 14 aa, Entamoeba invadens
SPIDTNDKKNNVKA

SEQ ID NO: 2908150 - protein, 4 aa, Entamoeba invadens
SPIE

SEQ ID NO: 2908151 - protein, 6 aa, Entamoeba invadens
SPIENY

SEQ ID NO: 2908152 - protein, 9 aa, Entamoeba invadens
SPIESDTLT

SEQ ID NO: 2908153 - protein, 6 aa, Entamoeba invadens
SPIESS

SEQ ID NO: 2908154 - protein, 4 aa, Entamoeba invadens
SPIG

SEQ ID NO: 2908155 - protein, 6 aa, Entamoeba invadens
SPIGTG

SEQ ID NO: 2908156 - protein, 14 aa, Entamoeba invadens
SPIHKSSKTLNKTL

SEQ ID NO: 2908157 - protein, 6 aa, Entamoeba invadens
SPIHPT

SEQ ID NO: 2908158 - protein, 5 aa, Entamoeba invadens
SPIKE

SEQ ID NO: 2908159 - protein, 12 aa, Entamoeba invadens
SPIKGESNFDDP

SEQ ID NO: 2908160 - protein, 9 aa, Entamoeba invadens
SPIKVQQAD

SEQ ID NO: 2908161 - protein, 5 aa, Entamoeba invadens
SPIMR

SEQ ID NO: 2908162 - protein, 18 aa, Entamoeba invadens
SPINISGPKPKKPDTDTT

SEQ ID NO: 2908163 - protein, 5 aa, Entamoeba invadens
SPIPG

SEQ ID NO: 2908164 - protein, 8 aa, Entamoeba invadens
SPIPNISE

SEQ ID NO: 2908165 - protein, 23 aa, Entamoeba invadens
SPIQEGTDYIPPRMDKTTDNHFK

SEQ ID NO: 2908166 - protein, 8 aa, Entamoeba invadens
SPIQGSAA

SEQ ID NO: 2908167 - protein, 17 aa, Entamoeba invadens
SPIQNQSFQSPNTTRQQ

SEQ ID NO: 2908168 - protein, 12 aa, Entamoeba invadens
SPIQTKEIEKPE

SEQ ID NO: 2908169 - protein, 4 aa, Entamoeba invadens
SPIS

SEQ ID NO: 2908170 - protein, 15 aa, Entamoeba invadens
SPISCDNPRYEKDTP

SEQ ID NO: 2908171 - protein, 5 aa, Entamoeba invadens
SPISK

SEQ ID NO: 2908172 - protein, 5 aa, Entamoeba invadens
SPISP

SEQ ID NO: 2908173 - protein, 5 aa, Entamoeba invadens
SPISS

SEQ ID NO: 2908174 - protein, 13 aa, Entamoeba invadens
SPISYDNPRYEKE

SEQ ID NO: 2908175 - protein, 4 aa, Entamoeba invadens
SPIT

SEQ ID NO: 2908176 - protein, 16 aa, Entamoeba invadens
SPITQQITQNSNDSVK

SEQ ID NO: 2908177 - protein, 5 aa, Entamoeba invadens
SPITS

SEQ ID NO: 2908178 - protein, 4 aa, Entamoeba invadens
SPIV

SEQ ID NO: 2908179 - protein, 4 aa, Entamoeba invadens
SPKA

SEQ ID NO: 2908180 - protein, 33 aa, Entamoeba invadens
SPKATPPPQTPEVEAPKEIPKEFSKPKEPEAPS

SEQ ID NO: 2908181 - protein, 5 aa, Entamoeba invadens
SPKDI

SEQ ID NO: 2908182 - protein, 12 aa, Entamoeba invadens
SPKDKVKEKAIE

SEQ ID NO: 2908183 - protein, 6 aa, Entamoeba invadens
SPKDSV

SEQ ID NO: 2908184 - protein, 4 aa, Entamoeba invadens
SPKE

SEQ ID NO: 2908185 - protein, 9 aa, Entamoeba invadens
SPKEDGNRD

SEQ ID NO: 2908186 - protein, 9 aa, Entamoeba invadens
SPKEEKYSN

SEQ ID NO: 2908187 - protein, 11 aa, Entamoeba invadens
SPKEISKAPCA

SEQ ID NO: 2908188 - protein, 19 aa, Entamoeba invadens
SPKEKEKRKSSRMSQSYEV

SEQ ID NO: 2908189 - protein, 13 aa, Entamoeba invadens
SPKERLCNTTNEE

SEQ ID NO: 2908190 - protein, 5 aa, Entamoeba invadens
SPKGH

SEQ ID NO: 2908191 - protein, 6 aa, Entamoeba invadens
SPKHST

SEQ ID NO: 2908192 - protein, 11 aa, Entamoeba invadens
SPKIKKSDNKY

SEQ ID NO: 2908193 - protein, 16 aa, Entamoeba invadens
SPKIQNEKVEVKDKPA

SEQ ID NO: 2908194 - protein, 5 aa, Entamoeba invadens
SPKIT

SEQ ID NO: 2908195 - protein, 5 aa, Entamoeba invadens
SPKKC

SEQ ID NO: 2908196 - protein, 19 aa, Entamoeba invadens
SPKKRAPSPLNRKSPEERM

SEQ ID NO: 2908197 - protein, 22 aa, Entamoeba invadens
SPKKSNLNKSLDNFDKGRQPFT

SEQ ID NO: 2908198 - protein, 14 aa, Entamoeba invadens
SPKKVNAKEINDIG

SEQ ID NO: 2908199 - protein, 10 aa, Entamoeba invadens
SPKLSSGVVE

SEQ ID NO: 2908200 - protein, 6 aa, Entamoeba invadens
SPKLTW

SEQ ID NO: 2908201 - protein, 4 aa, Entamoeba invadens
SPKM

SEQ ID NO: 2908202 - protein, 4 aa, Entamoeba invadens
SPKN

SEQ ID NO: 2908203 - protein, 18 aa, Entamoeba invadens
SPKNDAQSKKQTQNRCIL

SEQ ID NO: 2908204 - protein, 13 aa, Entamoeba invadens
SPKNKENTPNLQN

SEQ ID NO: 2908205 - protein, 5 aa, Entamoeba invadens
SPKNL

SEQ ID NO: 2908206 - protein, 7 aa, Entamoeba invadens
SPKNTIS

SEQ ID NO: 2908207 - protein, 10 aa, Entamoeba invadens
SPKNTKYEPE

SEQ ID NO: 2908208 - protein, 8 aa, Entamoeba invadens
SPKNYTTF

SEQ ID NO: 2908209 - protein, 6 aa, Entamoeba invadens
SPKPFG

SEQ ID NO: 2908210 - protein, 7 aa, Entamoeba invadens
SPKPQRV

SEQ ID NO: 2908211 - protein, 32 aa, Entamoeba invadens
SPKPTQTSRTEKSEKPKMSRSVRTSEGKYDEN

SEQ ID NO: 2908212 - protein, 9 aa, Entamoeba invadens
SPKSETAPK

SEQ ID NO: 2908213 - protein, 8 aa, Entamoeba invadens
SPKSITYK

SEQ ID NO: 2908214 - protein, 9 aa, Entamoeba invadens
SPKSNIKTQ

SEQ ID NO: 2908215 - protein, 6 aa, Entamoeba invadens
SPKTFE

SEQ ID NO: 2908216 - protein, 14 aa, Entamoeba invadens
SPKTGISSAVGREI

SEQ ID NO: 2908217 - protein, 5 aa, Entamoeba invadens
SPKTK

SEQ ID NO: 2908218 - protein, 5 aa, Entamoeba invadens
SPKVQ

SEQ ID NO: 2908219 - protein, 5 aa, Entamoeba invadens
SPKVT

SEQ ID NO: 2908220 - protein, 10 aa, Entamoeba invadens
SPKYNKNGNI

SEQ ID NO: 2908221 - protein, 9 aa, Entamoeba invadens
SPKYSKNTV

SEQ ID NO: 2908222 - protein, 25 aa, Entamoeba invadens
SPKYSPKNSPRNSPTRMDKPKLVDN

SEQ ID NO: 2908223 - protein, 14 aa, Entamoeba invadens
SPLAGELQRSVNQN

SEQ ID NO: 2908224 - protein, 12 aa, Entamoeba invadens
SPLALSPRERAA

SEQ ID NO: 2908225 - protein, 21 aa, Entamoeba invadens
SPLASSTQALGSQAPSMTQSN

SEQ ID NO: 2908226 - protein, 22 aa, Entamoeba invadens
SPLDDNKRNVRQSAANCRNIWG

SEQ ID NO: 2908227 - protein, 8 aa, Entamoeba invadens
SPLDGQTV

SEQ ID NO: 2908228 - protein, 11 aa, Entamoeba invadens
SPLDVPDNYGQ

SEQ ID NO: 2908229 - protein, 11 aa, Entamoeba invadens
SPLEKTEKGYA

SEQ ID NO: 2908230 - protein, 6 aa, Entamoeba invadens
SPLERG

SEQ ID NO: 2908231 - protein, 8 aa, Entamoeba invadens
SPLESDDV

SEQ ID NO: 2908232 - protein, 15 aa, Entamoeba invadens
SPLETPRSGSVPREI

SEQ ID NO: 2908233 - protein, 10 aa, Entamoeba invadens
SPLGEETYTG

SEQ ID NO: 2908234 - protein, 8 aa, Entamoeba invadens
SPLGTNPF

SEQ ID NO: 2908235 - protein, 10 aa, Entamoeba invadens
SPLKKKVESV

SEQ ID NO: 2908236 - protein, 6 aa, Entamoeba invadens
SPLKTP

SEQ ID NO: 2908237 - protein, 15 aa, Entamoeba invadens
SPLKTSKKLIKSINP

SEQ ID NO: 2908238 - protein, 8 aa, Entamoeba invadens
SPLPSTLE

SEQ ID NO: 2908239 - protein, 7 aa, Entamoeba invadens
SPLPTSK

SEQ ID NO: 2908240 - protein, 5 aa, Entamoeba invadens
SPLQQ

SEQ ID NO: 2908241 - protein, 8 aa, Entamoeba invadens
SPLQRTSY

SEQ ID NO: 2908242 - protein, 6 aa, Entamoeba invadens
SPLQTA

SEQ ID NO: 2908243 - protein, 7 aa, Entamoeba invadens
SPLQTPF

SEQ ID NO: 2908244 - protein, 11 aa, Entamoeba invadens
SPLRGTITPPS

SEQ ID NO: 2908245 - protein, 10 aa, Entamoeba invadens
SPLRNGSQRN

SEQ ID NO: 2908246 - protein, 8 aa, Entamoeba invadens
SPLRPTQD

SEQ ID NO: 2908247 - protein, 14 aa, Entamoeba invadens
SPLRTYPTHETPSL

SEQ ID NO: 2908248 - protein, 14 aa, Entamoeba invadens
SPLSFGSESSFSLG

SEQ ID NO: 2908249 - protein, 24 aa, Entamoeba invadens
SPLSMSDTESEFSSSQSLRERQPY

SEQ ID NO: 2908250 - protein, 14 aa, Entamoeba invadens
SPLSNSKEIDDQRY

SEQ ID NO: 2908251 - protein, 7 aa, Entamoeba invadens
SPLSSAI

SEQ ID NO: 2908252 - protein, 7 aa, Entamoeba invadens
SPLTNET

SEQ ID NO: 2908253 - protein, 17 aa, Entamoeba invadens
SPLTPRSTNSQHSQQNI

SEQ ID NO: 2908254 - protein, 4 aa, Entamoeba invadens
SPMN

SEQ ID NO: 2908255 - protein, 5 aa, Entamoeba invadens
SPMNH

SEQ ID NO: 2908256 - protein, 12 aa, Entamoeba invadens
SPMRGTITPPSL

SEQ ID NO: 2908257 - protein, 13 aa, Entamoeba invadens
SPMRKQRKQYTIT

SEQ ID NO: 2908258 - protein, 6 aa, Entamoeba invadens
SPMSTT

SEQ ID NO: 2908259 - protein, 5 aa, Entamoeba invadens
SPMVE

SEQ ID NO: 2908260 - protein, 6 aa, Entamoeba invadens
SPNAQQ

SEQ ID NO: 2908261 - protein, 13 aa, Entamoeba invadens
SPNAVPQLPTTVT

SEQ ID NO: 2908262 - protein, 4 aa, Entamoeba invadens
SPND

SEQ ID NO: 2908263 - protein, 11 aa, Entamoeba invadens
SPNDESENEYY

SEQ ID NO: 2908264 - protein, 10 aa, Entamoeba invadens
SPNEQPEEIS

SEQ ID NO: 2908265 - protein, 5 aa, Entamoeba invadens
SPNES

SEQ ID NO: 2908266 - protein, 6 aa, Entamoeba invadens
SPNFEK

SEQ ID NO: 2908267 - protein, 14 aa, Entamoeba invadens
SPNFPKIETNELSR

SEQ ID NO: 2908268 - protein, 5 aa, Entamoeba invadens
SPNGI

SEQ ID NO: 2908269 - protein, 5 aa, Entamoeba invadens
SPNGQ

SEQ ID NO: 2908270 - protein, 8 aa, Entamoeba invadens
SPNGSVES

SEQ ID NO: 2908271 - protein, 4 aa, Entamoeba invadens
SPNI

SEQ ID NO: 2908272 - protein, 6 aa, Entamoeba invadens
SPNIAK

SEQ ID NO: 2908273 - protein, 5 aa, Entamoeba invadens
SPNIP

SEQ ID NO: 2908274 - protein, 10 aa, Entamoeba invadens
SPNLPEAEAT

SEQ ID NO: 2908275 - protein, 11 aa, Entamoeba invadens
SPNNELRNNAE

SEQ ID NO: 2908276 - protein, 8 aa, Entamoeba invadens
SPNNPTGV

SEQ ID NO: 2908277 - protein, 5 aa, Entamoeba invadens
SPNPF

SEQ ID NO: 2908278 - protein, 28 aa, Entamoeba invadens
SPNPSTIDDTENSKRNSNGNSTTSSSSL

SEQ ID NO: 2908279 - protein, 6 aa, Entamoeba invadens
SPNRVS

SEQ ID NO: 2908280 - protein, 4 aa, Entamoeba invadens
SPNS

SEQ ID NO: 2908281 - protein, 6 aa, Entamoeba invadens
SPNSAD

SEQ ID NO: 2908282 - protein, 9 aa, Entamoeba invadens
SPNSDEERV

SEQ ID NO: 2908283 - protein, 8 aa, Entamoeba invadens
SPNSENRQ

SEQ ID NO: 2908284 - protein, 16 aa, Entamoeba invadens
SPNSPEPKKFKPKHHG

SEQ ID NO: 2908285 - protein, 27 aa, Entamoeba invadens
SPNSSVTQSETPHEIGTPVPQSTSQSM

SEQ ID NO: 2908286 - protein, 4 aa, Entamoeba invadens
SPNT

SEQ ID NO: 2908287 - protein, 5 aa, Entamoeba invadens
SPNTL

SEQ ID NO: 2908288 - protein, 5 aa, Entamoeba invadens
SPNTP

SEQ ID NO: 2908289 - protein, 61 aa, Entamoeba invadens
SPNTTVTALKEEDGKNDDTETEIASETEEVTQQKPAQAVPPQTKKRGRKKVEKKQKVEEEK

SEQ ID NO: 2908290 - protein, 5 aa, Entamoeba invadens
SPNVD

SEQ ID NO: 2908291 - protein, 5 aa, Entamoeba invadens
SPNVE

SEQ ID NO: 2908292 - protein, 5 aa, Entamoeba invadens
SPNVT

SEQ ID NO: 2908293 - protein, 6 aa, Entamoeba invadens
SPPADT

SEQ ID NO: 2908294 - protein, 5 aa, Entamoeba invadens
SPPAT

SEQ ID NO: 2908295 - protein, 9 aa, Entamoeba invadens
SPPEGTNTM

SEQ ID NO: 2908296 - protein, 24 aa, Entamoeba invadens
SPPELPPDKSCRKRKNPTKRDKDA

SEQ ID NO: 2908297 - protein, 4 aa, Entamoeba invadens
SPPF

SEQ ID NO: 2908298 - protein, 38 aa, Entamoeba invadens
SPPHPNHSTNSSEVIQKSSNNQQQQTLEQQKVEKIDTP

SEQ ID NO: 2908299 - protein, 13 aa, Entamoeba invadens
SPPHQNNTRPPPL

SEQ ID NO: 2908300 - protein, 6 aa, Entamoeba invadens
SPPIPV

SEQ ID NO: 2908301 - protein, 5 aa, Entamoeba invadens
SPPIQ

SEQ ID NO: 2908302 - protein, 5 aa, Entamoeba invadens
SPPIS

SEQ ID NO: 2908303 - protein, 13 aa, Entamoeba invadens
SPPKINTDTKSGK

SEQ ID NO: 2908304 - protein, 11 aa, Entamoeba invadens
SPPKSNYDESL

SEQ ID NO: 2908305 - protein, 14 aa, Entamoeba invadens
SPPKTSAKTQPKAA

SEQ ID NO: 2908306 - protein, 10 aa, Entamoeba invadens
SPPKTTERGV

SEQ ID NO: 2908307 - protein, 4 aa, Entamoeba invadens
SPPL

SEQ ID NO: 2908308 - protein, 15 aa, Entamoeba invadens
SPPLGIKEYRLKADF

SEQ ID NO: 2908309 - protein, 8 aa, Entamoeba invadens
SPPLSKES

SEQ ID NO: 2908310 - protein, 8 aa, Entamoeba invadens
SPPNVARE

SEQ ID NO: 2908311 - protein, 5 aa, Entamoeba invadens
SPPPN

SEQ ID NO: 2908312 - protein, 7 aa, Entamoeba invadens
SPPSFRD

SEQ ID NO: 2908313 - protein, 7 aa, Entamoeba invadens
SPPSFTD

SEQ ID NO: 2908314 - protein, 9 aa, Entamoeba invadens
SPPSVEQSK

SEQ ID NO: 2908315 - protein, 5 aa, Entamoeba invadens
SPPTC

SEQ ID NO: 2908316 - protein, 11 aa, Entamoeba invadens
SPPTSKDKNKQ

SEQ ID NO: 2908317 - protein, 15 aa, Entamoeba invadens
SPPWGRPGAFRNKQS

SEQ ID NO: 2908318 - protein, 4 aa, Entamoeba invadens
SPPY

SEQ ID NO: 2908319 - protein, 12 aa, Entamoeba invadens
SPPYTVTENGWG

SEQ ID NO: 2908320 - protein, 6 aa, Entamoeba invadens
SPQDHT

SEQ ID NO: 2908321 - protein, 8 aa, Entamoeba invadens
SPQEREEI

SEQ ID NO: 2908322 - protein, 4 aa, Entamoeba invadens
SPQF

SEQ ID NO: 2908323 - protein, 4 aa, Entamoeba invadens
SPQG

SEQ ID NO: 2908324 - protein, 20 aa, Entamoeba invadens
SPQHKGTRSSFSTNRPLSQD

SEQ ID NO: 2908325 - protein, 6 aa, Entamoeba invadens
SPQHNC

SEQ ID NO: 2908326 - protein, 8 aa, Entamoeba invadens
SPQKAIEH

SEQ ID NO: 2908327 - protein, 15 aa, Entamoeba invadens
SPQKGLQTKSINPLT

SEQ ID NO: 2908328 - protein, 9 aa, Entamoeba invadens
SPQKKKSNV

SEQ ID NO: 2908329 - protein, 37 aa, Entamoeba invadens
SPQKKTPKKQKESKELKKNNTFSDEDKVDSLDQKSSL

SEQ ID NO: 2908330 - protein, 12 aa, Entamoeba invadens
SPQKPMIQPSPQ

SEQ ID NO: 2908331 - protein, 8 aa, Entamoeba invadens
SPQLKTSP

SEQ ID NO: 2908332 - protein, 7 aa, Entamoeba invadens
SPQLQGN

SEQ ID NO: 2908333 - protein, 5 aa, Entamoeba invadens
SPQLR

SEQ ID NO: 2908334 - protein, 8 aa, Entamoeba invadens
SPQNPTGV

SEQ ID NO: 2908335 - protein, 5 aa, Entamoeba invadens
SPQNS

SEQ ID NO: 2908336 - protein, 9 aa, Entamoeba invadens
SPQNVTGVS

SEQ ID NO: 2908337 - protein, 5 aa, Entamoeba invadens
SPQPK

SEQ ID NO: 2908338 - protein, 9 aa, Entamoeba invadens
SPQPTKSDV

SEQ ID NO: 2908339 - protein, 4 aa, Entamoeba invadens
SPQQ

SEQ ID NO: 2908340 - protein, 19 aa, Entamoeba invadens
SPQQAQTESESQDEEVEVK

SEQ ID NO: 2908341 - protein, 8 aa, Entamoeba invadens
SPQQNTQQ

SEQ ID NO: 2908342 - protein, 8 aa, Entamoeba invadens
SPQQRQKE

SEQ ID NO: 2908343 - protein, 10 aa, Entamoeba invadens
SPQQYEKENN

SEQ ID NO: 2908344 - protein, 4 aa, Entamoeba invadens
SPQR

SEQ ID NO: 2908345 - protein, 6 aa, Entamoeba invadens
SPQRET

SEQ ID NO: 2908346 - protein, 8 aa, Entamoeba invadens
SPQRVTAT

SEQ ID NO: 2908347 - protein, 5 aa, Entamoeba invadens
SPQSC

SEQ ID NO: 2908348 - protein, 11 aa, Entamoeba invadens
SPQSENKNEEL

SEQ ID NO: 2908349 - protein, 11 aa, Entamoeba invadens
SPQSFQNPENF

SEQ ID NO: 2908350 - protein, 9 aa, Entamoeba invadens
SPQSKLAQE

SEQ ID NO: 2908351 - protein, 5 aa, Entamoeba invadens
SPQTK

SEQ ID NO: 2908352 - protein, 12 aa, Entamoeba invadens
SPQTNQATREKV

SEQ ID NO: 2908353 - protein, 7 aa, Entamoeba invadens
SPQTRSI

SEQ ID NO: 2908354 - protein, 19 aa, Entamoeba invadens
SPQVANPNQIRKAKEIGGD

SEQ ID NO: 2908355 - protein, 13 aa, Entamoeba invadens
SPRALKADETLKI

SEQ ID NO: 2908356 - protein, 11 aa, Entamoeba invadens
SPRDNDDSESL

SEQ ID NO: 2908357 - protein, 5 aa, Entamoeba invadens
SPREF

SEQ ID NO: 2908358 - protein, 15 aa, Entamoeba invadens
SPREHKEKKRRSTVV

SEQ ID NO: 2908359 - protein, 16 aa, Entamoeba invadens
SPRENDSSEYRDNHHF

SEQ ID NO: 2908360 - protein, 5 aa, Entamoeba invadens
SPRKG

SEQ ID NO: 2908361 - protein, 29 aa, Entamoeba invadens
  misc_feature (14)..(15): Xaa can be any naturally occurring amino acid
SPRKGQKVQQKDEXXGEMVLMMLTNGDGV

SEQ ID NO: 2908362 - protein, 11 aa, Entamoeba invadens
SPRKQTKESIK

SEQ ID NO: 2908363 - protein, 11 aa, Entamoeba invadens
SPRKSQPTNIA

SEQ ID NO: 2908364 - protein, 9 aa, Entamoeba invadens
SPRKSRSKI

SEQ ID NO: 2908365 - protein, 5 aa, Entamoeba invadens
SPRLM

SEQ ID NO: 2908366 - protein, 5 aa, Entamoeba invadens
SPRLR

SEQ ID NO: 2908367 - protein, 9 aa, Entamoeba invadens
SPRLRSSPI

SEQ ID NO: 2908368 - protein, 7 aa, Entamoeba invadens
SPRLTEA

SEQ ID NO: 2908369 - protein, 4 aa, Entamoeba invadens
SPRN

SEQ ID NO: 2908370 - protein, 9 aa, Entamoeba invadens
SPRNPTPME

SEQ ID NO: 2908371 - protein, 11 aa, Entamoeba invadens
SPRQKRSPDII

SEQ ID NO: 2908372 - protein, 17 aa, Entamoeba invadens
SPRQKTQPKKPNDSRCT

SEQ ID NO: 2908373 - protein, 12 aa, Entamoeba invadens
SPRRARSEDPHE

SEQ ID NO: 2908374 - protein, 9 aa, Entamoeba invadens
SPRSGPKDV

SEQ ID NO: 2908375 - protein, 7 aa, Entamoeba invadens
SPRSPPL

SEQ ID NO: 2908376 - protein, 39 aa, Entamoeba invadens
SPRSPRKSKSSKHFEETLDPESITKSNGLSKSTSEERIS

SEQ ID NO: 2908377 - protein, 8 aa, Entamoeba invadens
SPRSRKGI

SEQ ID NO: 2908378 - protein, 6 aa, Entamoeba invadens
SPRSYN

SEQ ID NO: 2908379 - protein, 34 aa, Entamoeba invadens
SPRSYSTSTTPPGGGSYSPSQNSSPTSQQDHPEQ

SEQ ID NO: 2908380 - protein, 6 aa, Entamoeba invadens
SPRTSY

SEQ ID NO: 2908381 - protein, 9 aa, Entamoeba invadens
SPRTTTSAR

SEQ ID NO: 2908382 - protein, 5 aa, Entamoeba invadens
SPSAI

SEQ ID NO: 2908383 - protein, 6 aa, Entamoeba invadens
SPSALP

SEQ ID NO: 2908384 - protein, 12 aa, Entamoeba invadens
SPSANSKQKDTD

SEQ ID NO: 2908385 - protein, 4 aa, Entamoeba invadens
SPSC

SEQ ID NO: 2908386 - protein, 6 aa, Entamoeba invadens
SPSDAE

SEQ ID NO: 2908387 - protein, 6 aa, Entamoeba invadens
SPSEDI

SEQ ID NO: 2908388 - protein, 9 aa, Entamoeba invadens
SPSEKTKDV

SEQ ID NO: 2908389 - protein, 15 aa, Entamoeba invadens
SPSFDSQKSTYEEGV

SEQ ID NO: 2908390 - protein, 7 aa, Entamoeba invadens
SPSFNTE

SEQ ID NO: 2908391 - protein, 12 aa, Entamoeba invadens
SPSFTAYTTKSI

SEQ ID NO: 2908392 - protein, 13 aa, Entamoeba invadens
SPSGETLITNDGA

SEQ ID NO: 2908393 - protein, 7 aa, Entamoeba invadens
SPSGHNG

SEQ ID NO: 2908394 - protein, 13 aa, Entamoeba invadens
SPSGLSAKTKSVE

SEQ ID NO: 2908395 - protein, 14 aa, Entamoeba invadens
SPSGSFASSTCQSI

SEQ ID NO: 2908396 - protein, 4 aa, Entamoeba invadens
SPSH

SEQ ID NO: 2908397 - protein, 4 aa, Entamoeba invadens
SPSI

SEQ ID NO: 2908398 - protein, 17 aa, Entamoeba invadens
SPSIDKRPFSRKEDDAI

SEQ ID NO: 2908399 - protein, 15 aa, Entamoeba invadens
SPSIELKEANTSQLP

SEQ ID NO: 2908400 - protein, 5 aa, Entamoeba invadens
SPSII

SEQ ID NO: 2908401 - protein, 6 aa, Entamoeba invadens
SPSKID

SEQ ID NO: 2908402 - protein, 5 aa, Entamoeba invadens
SPSKL

SEQ ID NO: 2908403 - protein, 7 aa, Entamoeba invadens
SPSKQTK

SEQ ID NO: 2908404 - protein, 5 aa, Entamoeba invadens
SPSLE

SEQ ID NO: 2908405 - protein, 5 aa, Entamoeba invadens
SPSLH

SEQ ID NO: 2908406 - protein, 8 aa, Entamoeba invadens
SPSLNESK

SEQ ID NO: 2908407 - protein, 6 aa, Entamoeba invadens
SPSMSA

SEQ ID NO: 2908408 - protein, 7 aa, Entamoeba invadens
SPSMSSL

SEQ ID NO: 2908409 - protein, 18 aa, Entamoeba invadens
SPSNASGKKKEKEKGCAL

SEQ ID NO: 2908410 - protein, 6 aa, Entamoeba invadens
SPSNDE

SEQ ID NO: 2908411 - protein, 9 aa, Entamoeba invadens
SPSNGEAEV

SEQ ID NO: 2908412 - protein, 5 aa, Entamoeba invadens
SPSNN

SEQ ID NO: 2908413 - protein, 4 aa, Entamoeba invadens
SPSP

SEQ ID NO: 2908414 - protein, 7 aa, Entamoeba invadens
SPSPIEN

SEQ ID NO: 2908415 - protein, 31 aa, Entamoeba invadens
SPSPSEEVKETPKDESPKEEDVPRAKTPNWA

SEQ ID NO: 2908416 - protein, 8 aa, Entamoeba invadens
SPSPSFYK

SEQ ID NO: 2908417 - protein, 10 aa, Entamoeba invadens
SPSPTITPTF

SEQ ID NO: 2908418 - protein, 4 aa, Entamoeba invadens
SPSQ

SEQ ID NO: 2908419 - protein, 16 aa, Entamoeba invadens
SPSQFTPHTRQEPVRT

SEQ ID NO: 2908420 - protein, 14 aa, Entamoeba invadens
SPSQPKYNRNYDNE

SEQ ID NO: 2908421 - protein, 8 aa, Entamoeba invadens
SPSRLSPF

SEQ ID NO: 2908422 - protein, 6 aa, Entamoeba invadens
SPSRYG

SEQ ID NO: 2908423 - protein, 4 aa, Entamoeba invadens
SPSS

SEQ ID NO: 2908424 - protein, 6 aa, Entamoeba invadens
SPSSLF

SEQ ID NO: 2908425 - protein, 27 aa, Entamoeba invadens
SPSSPFSKISSPEKKSTSSKKDDTLDE

SEQ ID NO: 2908426 - protein, 8 aa, Entamoeba invadens
SPSSPKLY

SEQ ID NO: 2908427 - protein, 24 aa, Entamoeba invadens
SPSSVKESSLKKTQMKNSYEREMK

SEQ ID NO: 2908428 - protein, 12 aa, Entamoeba invadens
SPSTAPNTPTPQ

SEQ ID NO: 2908429 - protein, 9 aa, Entamoeba invadens
SPSTCYATT

SEQ ID NO: 2908430 - protein, 6 aa, Entamoeba invadens
SPSTLK

SEQ ID NO: 2908431 - protein, 10 aa, Entamoeba invadens
SPSTTYISHP

SEQ ID NO: 2908432 - protein, 4 aa, Entamoeba invadens
SPSV

SEQ ID NO: 2908433 - protein, 11 aa, Entamoeba invadens
SPSVDTKDPLK

SEQ ID NO: 2908434 - protein, 6 aa, Entamoeba invadens
SPSVKS

SEQ ID NO: 2908435 - protein, 9 aa, Entamoeba invadens
SPSVPPQYQ

SEQ ID NO: 2908436 - protein, 4 aa, Entamoeba invadens
SPSY

SEQ ID NO: 2908437 - protein, 6 aa, Entamoeba invadens
SPSYNE

SEQ ID NO: 2908438 - protein, 8 aa, Entamoeba invadens
SPTDDNVD

SEQ ID NO: 2908439 - protein, 5 aa, Entamoeba invadens
SPTDR

SEQ ID NO: 2908440 - protein, 10 aa, Entamoeba invadens
SPTDTVTSDD

SEQ ID NO: 2908441 - protein, 11 aa, Entamoeba invadens
SPTEKDGTNFT

SEQ ID NO: 2908442 - protein, 4 aa, Entamoeba invadens
SPTF

SEQ ID NO: 2908443 - protein, 5 aa, Entamoeba invadens
SPTFN

SEQ ID NO: 2908444 - protein, 5 aa, Entamoeba invadens
SPTFQ

SEQ ID NO: 2908445 - protein, 5 aa, Entamoeba invadens
SPTFR

SEQ ID NO: 2908446 - protein, 5 aa, Entamoeba invadens
SPTIP

SEQ ID NO: 2908447 - protein, 6 aa, Entamoeba invadens
SPTIQS

SEQ ID NO: 2908448 - protein, 8 aa, Entamoeba invadens
SPTKAIHP

SEQ ID NO: 2908449 - protein, 7 aa, Entamoeba invadens
SPTKDEV

SEQ ID NO: 2908450 - protein, 8 aa, Entamoeba invadens
SPTKETIN

SEQ ID NO: 2908451 - protein, 8 aa, Entamoeba invadens
SPTKGKAY

SEQ ID NO: 2908452 - protein, 7 aa, Entamoeba invadens
SPTKPLR

SEQ ID NO: 2908453 - protein, 5 aa, Entamoeba invadens
SPTKT

SEQ ID NO: 2908454 - protein, 16 aa, Entamoeba invadens
SPTKVGSVSKPTVTEN

SEQ ID NO: 2908455 - protein, 4 aa, Entamoeba invadens
SPTL

SEQ ID NO: 2908456 - protein, 17 aa, Entamoeba invadens
SPTLLPNSTIKSLKEED

SEQ ID NO: 2908457 - protein, 13 aa, Entamoeba invadens
SPTNDAKSKEIPQ

SEQ ID NO: 2908458 - protein, 6 aa, Entamoeba invadens
SPTNTR

SEQ ID NO: 2908459 - protein, 4 aa, Entamoeba invadens
SPTP

SEQ ID NO: 2908460 - protein, 14 aa, Entamoeba invadens
SPTPEDLEGSRPTT

SEQ ID NO: 2908461 - protein, 6 aa, Entamoeba invadens
SPTPFE

SEQ ID NO: 2908462 - protein, 7 aa, Entamoeba invadens
SPTPFPE

SEQ ID NO: 2908463 - protein, 6 aa, Entamoeba invadens
SPTPLL

SEQ ID NO: 2908464 - protein, 7 aa, Entamoeba invadens
SPTPPPQ

SEQ ID NO: 2908465 - protein, 7 aa, Entamoeba invadens
SPTPSYG

SEQ ID NO: 2908466 - protein, 16 aa, Entamoeba invadens
SPTQIRDKVNNTKSSF

SEQ ID NO: 2908467 - protein, 7 aa, Entamoeba invadens
SPTQTTY

SEQ ID NO: 2908468 - protein, 6 aa, Entamoeba invadens
SPTQYQ

SEQ ID NO: 2908469 - protein, 13 aa, Entamoeba invadens
SPTRRSITPQNDE

SEQ ID NO: 2908470 - protein, 7 aa, Entamoeba invadens
SPTSQSP

SEQ ID NO: 2908471 - protein, 22 aa, Entamoeba invadens
SPTSSEDEQSSEGRSGSDSEEF

SEQ ID NO: 2908472 - protein, 6 aa, Entamoeba invadens
SPTTDK

SEQ ID NO: 2908473 - protein, 4 aa, Entamoeba invadens
SPTV

SEQ ID NO: 2908474 - protein, 4 aa, Entamoeba invadens
SPVA

SEQ ID NO: 2908475 - protein, 15 aa, Entamoeba invadens
SPVAPQKKEYPPPLS

SEQ ID NO: 2908476 - protein, 5 aa, Entamoeba invadens
SPVDS

SEQ ID NO: 2908477 - protein, 14 aa, Entamoeba invadens
SPVEGTVQRNRKAR

SEQ ID NO: 2908478 - protein, 12 aa, Entamoeba invadens
SPVGITNSEKIP

SEQ ID NO: 2908479 - protein, 7 aa, Entamoeba invadens
SPVKRSV

SEQ ID NO: 2908480 - protein, 6 aa, Entamoeba invadens
SPVNKT

SEQ ID NO: 2908481 - protein, 4 aa, Entamoeba invadens
SPVP

SEQ ID NO: 2908482 - protein, 7 aa, Entamoeba invadens
SPVPPKK

SEQ ID NO: 2908483 - protein, 8 aa, Entamoeba invadens
SPVPRKTK

SEQ ID NO: 2908484 - protein, 8 aa, Entamoeba invadens
SPVRNGTI

SEQ ID NO: 2908485 - protein, 11 aa, Entamoeba invadens
SPVSRTDSGKN

SEQ ID NO: 2908486 - protein, 4 aa, Entamoeba invadens
SPVT

SEQ ID NO: 2908487 - protein, 19 aa, Entamoeba invadens
SPVTHSETQTTPSVPSYSP

SEQ ID NO: 2908488 - protein, 5 aa, Entamoeba invadens
SPVTP

SEQ ID NO: 2908489 - protein, 5 aa, Entamoeba invadens
SPVVP

SEQ ID NO: 2908490 - protein, 7 aa, Entamoeba invadens
SPVYDNK

SEQ ID NO: 2908491 - protein, 7 aa, Entamoeba invadens
SPYAKDG

SEQ ID NO: 2908492 - protein, 6 aa, Entamoeba invadens
SPYDGE

SEQ ID NO: 2908493 - protein, 9 aa, Entamoeba invadens
SPYDTEIES

SEQ ID NO: 2908494 - protein, 9 aa, Entamoeba invadens
SPYETKTIE

SEQ ID NO: 2908495 - protein, 5 aa, Entamoeba invadens
SPYFE

SEQ ID NO: 2908496 - protein, 5 aa, Entamoeba invadens
SPYFQ

SEQ ID NO: 2908497 - protein, 15 aa, Entamoeba invadens
SPYKPRTPETSRERW

SEQ ID NO: 2908498 - protein, 11 aa, Entamoeba invadens
SPYQSQRSNVL

SEQ ID NO: 2908499 - protein, 5 aa, Entamoeba invadens
SPYSG

SEQ ID NO: 2908500 - protein, 6 aa, Entamoeba invadens
SPYSQY

SEQ ID NO: 2908501 - protein, 6 aa, Entamoeba invadens
SPYSSH

SEQ ID NO: 2908502 - protein, 11 aa, Entamoeba invadens
SPYTKQEQTKV

SEQ ID NO: 2908503 - protein, 13 aa, Entamoeba invadens
SPYTTSSDEEKPL

SEQ ID NO: 2908504 - protein, 6 aa, Entamoeba invadens
SQADMD

SEQ ID NO: 2908505 - protein, 8 aa, Entamoeba invadens
SQAFNTGT

SEQ ID NO: 2908506 - protein, 5 aa, Entamoeba invadens
SQAFT

SEQ ID NO: 2908507 - protein, 9 aa, Entamoeba invadens
SQAGATPYC

SEQ ID NO: 2908508 - protein, 6 aa, Entamoeba invadens
SQAGYL

SEQ ID NO: 2908509 - protein, 4 aa, Entamoeba invadens
SQAK

SEQ ID NO: 2908510 - protein, 22 aa, Entamoeba invadens
SQAKIPQEKSHGDKLSQAEAEL

SEQ ID NO: 2908511 - protein, 8 aa, Entamoeba invadens
SQALPGTF

SEQ ID NO: 2908512 - protein, 6 aa, Entamoeba invadens
SQALPI

SEQ ID NO: 2908513 - protein, 6 aa, Entamoeba invadens
SQANTS

SEQ ID NO: 2908514 - protein, 7 aa, Entamoeba invadens
SQANVEP

SEQ ID NO: 2908515 - protein, 20 aa, Entamoeba invadens
SQAPMATHSRNLGSYSSNPF

SEQ ID NO: 2908516 - protein, 8 aa, Entamoeba invadens
SQAQINDF

SEQ ID NO: 2908517 - protein, 5 aa, Entamoeba invadens
SQASQ

SEQ ID NO: 2908518 - protein, 12 aa, Entamoeba invadens
SQASTQTPQKLH

SEQ ID NO: 2908519 - protein, 4 aa, Entamoeba invadens
SQAV

SEQ ID NO: 2908520 - protein, 5 aa, Entamoeba invadens
SQCGG

SEQ ID NO: 2908521 - protein, 5 aa, Entamoeba invadens
SQCPD

SEQ ID NO: 2908522 - protein, 13 aa, Entamoeba invadens
SQCPSQFTDSKKK

SEQ ID NO: 2908523 - protein, 10 aa, Entamoeba invadens
SQCQNKTYEF

SEQ ID NO: 2908524 - protein, 9 aa, Entamoeba invadens
SQDAQQSLR

SEQ ID NO: 2908525 - protein, 88 aa, Entamoeba invadens
SQDCLEKKGTYKQDKKVEKEQKNTSEDDEKVLKTSPSKQKEIKKRSEEEKEHQKVSKQQVEKKKKKKKTTKEEEKDDTKHNKKSKLVQ

SEQ ID NO: 2908526 - protein, 7 aa, Entamoeba invadens
SQDDIDN

SEQ ID NO: 2908527 - protein, 8 aa, Entamoeba invadens
SQDDLEDD

SEQ ID NO: 2908528 - protein, 8 aa, Entamoeba invadens
SQDDQKTI

SEQ ID NO: 2908529 - protein, 8 aa, Entamoeba invadens
SQDDSYKN

SEQ ID NO: 2908530 - protein, 8 aa, Entamoeba invadens
SQDEDDMP

SEQ ID NO: 2908531 - protein, 6 aa, Entamoeba invadens
SQDEGV

SEQ ID NO: 2908532 - protein, 9 aa, Entamoeba invadens
SQDETYTPT

SEQ ID NO: 2908533 - protein, 4 aa, Entamoeba invadens
SQDF

SEQ ID NO: 2908534 - protein, 16 aa, Entamoeba invadens
SQDGTLTGVSEGDAQI

SEQ ID NO: 2908535 - protein, 7 aa, Entamoeba invadens
SQDHTAS

SEQ ID NO: 2908536 - protein, 5 aa, Entamoeba invadens
SQDIS

SEQ ID NO: 2908537 - protein, 7 aa, Entamoeba invadens
SQDISEE

SEQ ID NO: 2908538 - protein, 5 aa, Entamoeba invadens
SQDIT

SEQ ID NO: 2908539 - protein, 6 aa, Entamoeba invadens
SQDITP

SEQ ID NO: 2908540 - protein, 6 aa, Entamoeba invadens
SQDKNT

SEQ ID NO: 2908541 - protein, 7 aa, Entamoeba invadens
SQDKPSC

SEQ ID NO: 2908542 - protein, 16 aa, Entamoeba invadens
SQDLVGTSNEFEGNNT

SEQ ID NO: 2908543 - protein, 7 aa, Entamoeba invadens
SQDLYGD

SEQ ID NO: 2908544 - protein, 10 aa, Entamoeba invadens
SQDMSTKFTE

SEQ ID NO: 2908545 - protein, 4 aa, Entamoeba invadens
SQDN

SEQ ID NO: 2908546 - protein, 9 aa, Entamoeba invadens
SQDNEITSK

SEQ ID NO: 2908547 - protein, 7 aa, Entamoeba invadens
SQDNPNT

SEQ ID NO: 2908548 - protein, 7 aa, Entamoeba invadens
SQDNTKC

SEQ ID NO: 2908549 - protein, 10 aa, Entamoeba invadens
SQDPQQRPSI

SEQ ID NO: 2908550 - protein, 23 aa, Entamoeba invadens
SQDPSIDSSQNDEVEVTDKKPLI

SEQ ID NO: 2908551 - protein, 9 aa, Entamoeba invadens
SQDQSGSRV

SEQ ID NO: 2908552 - protein, 7 aa, Entamoeba invadens
SQDSEPY

SEQ ID NO: 2908553 - protein, 5 aa, Entamoeba invadens
SQDSQ

SEQ ID NO: 2908554 - protein, 7 aa, Entamoeba invadens
SQDSQRL

SEQ ID NO: 2908555 - protein, 8 aa, Entamoeba invadens
SQDSSSLR

SEQ ID NO: 2908556 - protein, 7 aa, Entamoeba invadens
SQDSTFG

SEQ ID NO: 2908557 - protein, 15 aa, Entamoeba invadens
SQDSTKLVTSSGDHT

SEQ ID NO: 2908558 - protein, 4 aa, Entamoeba invadens
SQDT

SEQ ID NO: 2908559 - protein, 8 aa, Entamoeba invadens
SQDTPEVR

SEQ ID NO: 2908560 - protein, 6 aa, Entamoeba invadens
SQDTRE

SEQ ID NO: 2908561 - protein, 4 aa, Entamoeba invadens
SQDV

SEQ ID NO: 2908562 - protein, 10 aa, Entamoeba invadens
SQDVSSKCTE

SEQ ID NO: 2908563 - protein, 4 aa, Entamoeba invadens
SQEA

SEQ ID NO: 2908564 - protein, 4 aa, Entamoeba invadens
SQED

SEQ ID NO: 2908565 - protein, 5 aa, Entamoeba invadens
SQEDE

SEQ ID NO: 2908566 - protein, 6 aa, Entamoeba invadens
SQEEHV

SEQ ID NO: 2908567 - protein, 16 aa, Entamoeba invadens
SQEEVEGLGKGVAQSI

SEQ ID NO: 2908568 - protein, 15 aa, Entamoeba invadens
SQEFDEEQIPSQITQ

SEQ ID NO: 2908569 - protein, 12 aa, Entamoeba invadens
SQEGAQSVKPPT

SEQ ID NO: 2908570 - protein, 7 aa, Entamoeba invadens
SQEGLSK

SEQ ID NO: 2908571 - protein, 5 aa, Entamoeba invadens
SQEHQ

SEQ ID NO: 2908572 - protein, 7 aa, Entamoeba invadens
SQEIGEA

SEQ ID NO: 2908573 - protein, 7 aa, Entamoeba invadens
SQEIKNE

SEQ ID NO: 2908574 - protein, 11 aa, Entamoeba invadens
SQEIRTSKNYT

SEQ ID NO: 2908575 - protein, 11 aa, Entamoeba invadens
SQEKDKSKHLY

SEQ ID NO: 2908576 - protein, 5 aa, Entamoeba invadens
SQEKG

SEQ ID NO: 2908577 - protein, 9 aa, Entamoeba invadens
SQEKNKADV

SEQ ID NO: 2908578 - protein, 12 aa, Entamoeba invadens
SQEKSTLGEQQS

SEQ ID NO: 2908579 - protein, 11 aa, Entamoeba invadens
SQEKVTGSSSD

SEQ ID NO: 2908580 - protein, 5 aa, Entamoeba invadens
SQELE

SEQ ID NO: 2908581 - protein, 12 aa, Entamoeba invadens
SQELQPKSITSG

SEQ ID NO: 2908582 - protein, 12 aa, Entamoeba invadens
SQELSDTRIQPD

SEQ ID NO: 2908583 - protein, 21 aa, Entamoeba invadens
SQELSFKTKGAKEFGEKIGQQ

SEQ ID NO: 2908584 - protein, 39 aa, Entamoeba invadens
SQENGEIVDNQEERTNDESNEDVIEQTTNQNEDENINVE

SEQ ID NO: 2908585 - protein, 31 aa, Entamoeba invadens
SQENKQDNYSQETLSGSVMTQERPKLFLKLV

SEQ ID NO: 2908586 - protein, 6 aa, Entamoeba invadens
SQENSM

SEQ ID NO: 2908587 - protein, 8 aa, Entamoeba invadens
SQESDYKD

SEQ ID NO: 2908588 - protein, 10 aa, Entamoeba invadens
SQESLKDSPR

SEQ ID NO: 2908589 - protein, 6 aa, Entamoeba invadens
SQESYD

SEQ ID NO: 2908590 - protein, 11 aa, Entamoeba invadens
SQETDKGSSLK

SEQ ID NO: 2908591 - protein, 7 aa, Entamoeba invadens
SQETNFQ

SEQ ID NO: 2908592 - protein, 25 aa, Entamoeba invadens
SQEYTSYEDLSRDTDEDLSEVDQTR

SEQ ID NO: 2908593 - protein, 9 aa, Entamoeba invadens
SQFAPKNEA

SEQ ID NO: 2908594 - protein, 4 aa, Entamoeba invadens
SQFG

SEQ ID NO: 2908595 - protein, 6 aa, Entamoeba invadens
SQFGSE

SEQ ID NO: 2908596 - protein, 7 aa, Entamoeba invadens
SQFPDPA

SEQ ID NO: 2908597 - protein, 7 aa, Entamoeba invadens
SQFPYNR

SEQ ID NO: 2908598 - protein, 16 aa, Entamoeba invadens
SQFQTQEHSPDTSQNS

SEQ ID NO: 2908599 - protein, 6 aa, Entamoeba invadens
SQFSSI

SEQ ID NO: 2908600 - protein, 4 aa, Entamoeba invadens
SQFT

SEQ ID NO: 2908601 - protein, 9 aa, Entamoeba invadens
SQGATQKEI

SEQ ID NO: 2908602 - protein, 9 aa, Entamoeba invadens
SQGDGLQRK

SEQ ID NO: 2908603 - protein, 8 aa, Entamoeba invadens
SQGEAQQV

SEQ ID NO: 2908604 - protein, 12 aa, Entamoeba invadens
SQGEDVSSMPST

SEQ ID NO: 2908605 - protein, 20 aa, Entamoeba invadens
SQGEQPASIVESKKQPDPNL

SEQ ID NO: 2908606 - protein, 14 aa, Entamoeba invadens
SQGESAEFCINSHF

SEQ ID NO: 2908607 - protein, 6 aa, Entamoeba invadens
SQGFDE

SEQ ID NO: 2908608 - protein, 14 aa, Entamoeba invadens
SQGGTFQEIVCIEM

SEQ ID NO: 2908609 - protein, 5 aa, Entamoeba invadens
SQGHP

SEQ ID NO: 2908610 - protein, 7 aa, Entamoeba invadens
SQGIDKA

SEQ ID NO: 2908611 - protein, 8 aa, Entamoeba invadens
SQGKGKRS

SEQ ID NO: 2908612 - protein, 10 aa, Entamoeba invadens
SQGKPGAQHG

SEQ ID NO: 2908613 - protein, 10 aa, Entamoeba invadens
SQGKPGTQHD

SEQ ID NO: 2908614 - protein, 9 aa, Entamoeba invadens
SQGKPGVQH

SEQ ID NO: 2908615 - protein, 9 aa, Entamoeba invadens
SQGKPRAQH

SEQ ID NO: 2908616 - protein, 15 aa, Entamoeba invadens
SQGKQGGDEKIRLNP

SEQ ID NO: 2908617 - protein, 9 aa, Entamoeba invadens
SQGKQTKNR

SEQ ID NO: 2908618 - protein, 5 aa, Entamoeba invadens
SQGKR

SEQ ID NO: 2908619 - protein, 10 aa, Entamoeba invadens
SQGKSKIAEA

SEQ ID NO: 2908620 - protein, 5 aa, Entamoeba invadens
SQGKV

SEQ ID NO: 2908621 - protein, 4 aa, Entamoeba invadens
SQGL

SEQ ID NO: 2908622 - protein, 7 aa, Entamoeba invadens
SQGLTLP

SEQ ID NO: 2908623 - protein, 9 aa, Entamoeba invadens
SQGMGNKGA

SEQ ID NO: 2908624 - protein, 5 aa, Entamoeba invadens
SQGMT

SEQ ID NO: 2908625 - protein, 20 aa, Entamoeba invadens
SQGNCIDEEQHVDPNTIRGQ

SEQ ID NO: 2908626 - protein, 9 aa, Entamoeba invadens
SQGRDEAVK

SEQ ID NO: 2908627 - protein, 7 aa, Entamoeba invadens
SQGSAPF

SEQ ID NO: 2908628 - protein, 6 aa, Entamoeba invadens
SQGVGK

SEQ ID NO: 2908629 - protein, 13 aa, Entamoeba invadens
SQGVSKRDLKDDT

SEQ ID NO: 2908630 - protein, 5 aa, Entamoeba invadens
SQHED

SEQ ID NO: 2908631 - protein, 6 aa, Entamoeba invadens
SQHEDS

SEQ ID NO: 2908632 - protein, 8 aa, Entamoeba invadens
SQHHNDAI

SEQ ID NO: 2908633 - protein, 11 aa, Entamoeba invadens
SQHNEYGYNDT

SEQ ID NO: 2908634 - protein, 4 aa, Entamoeba invadens
SQHP

SEQ ID NO: 2908635 - protein, 6 aa, Entamoeba invadens
SQHPPP

SEQ ID NO: 2908636 - protein, 4 aa, Entamoeba invadens
SQIA

SEQ ID NO: 2908637 - protein, 5 aa, Entamoeba invadens
SQICT

SEQ ID NO: 2908638 - protein, 4 aa, Entamoeba invadens
SQID

SEQ ID NO: 2908639 - protein, 5 aa, Entamoeba invadens
SQIDE

SEQ ID NO: 2908640 - protein, 7 aa, Entamoeba invadens
SQIDGST

SEQ ID NO: 2908641 - protein, 5 aa, Entamoeba invadens
SQIDV

SEQ ID NO: 2908642 - protein, 5 aa, Entamoeba invadens
SQIEK

SEQ ID NO: 2908643 - protein, 5 aa, Entamoeba invadens
SQIGK

SEQ ID NO: 2908644 - protein, 4 aa, Entamoeba invadens
SQII

SEQ ID NO: 2908645 - protein, 4 aa, Entamoeba invadens
SQIK

SEQ ID NO: 2908646 - protein, 9 aa, Entamoeba invadens
SQIKPERSL

SEQ ID NO: 2908647 - protein, 12 aa, Entamoeba invadens
SQIKRSEQARRE

SEQ ID NO: 2908648 - protein, 12 aa, Entamoeba invadens
SQINRPNSDIVK

SEQ ID NO: 2908649 - protein, 4 aa, Entamoeba invadens
SQIP

SEQ ID NO: 2908650 - protein, 7 aa, Entamoeba invadens
SQIPKEV

SEQ ID NO: 2908651 - protein, 6 aa, Entamoeba invadens
SQIPNP

SEQ ID NO: 2908652 - protein, 8 aa, Entamoeba invadens
SQIPPSYS

SEQ ID NO: 2908653 - protein, 7 aa, Entamoeba invadens
SQIPSQE

SEQ ID NO: 2908654 - protein, 11 aa, Entamoeba invadens
SQIQNKEMPEL

SEQ ID NO: 2908655 - protein, 12 aa, Entamoeba invadens
SQIRQVGEKNQN

SEQ ID NO: 2908656 - protein, 16 aa, Entamoeba invadens
SQISAQNKGDLSPKRL

SEQ ID NO: 2908657 - protein, 13 aa, Entamoeba invadens
SQISSGMTSVPTD

SEQ ID NO: 2908658 - protein, 6 aa, Entamoeba invadens
SQISSK

SEQ ID NO: 2908659 - protein, 6 aa, Entamoeba invadens
SQISTI

SEQ ID NO: 2908660 - protein, 11 aa, Entamoeba invadens
SQITTTDNIAG

SEQ ID NO: 2908661 - protein, 5 aa, Entamoeba invadens
SQITV

SEQ ID NO: 2908662 - protein, 4 aa, Entamoeba invadens
SQKA

SEQ ID NO: 2908663 - protein, 6 aa, Entamoeba invadens
SQKAAN

SEQ ID NO: 2908664 - protein, 15 aa, Entamoeba invadens
SQKATVDAQNVNKAL

SEQ ID NO: 2908665 - protein, 9 aa, Entamoeba invadens
SQKCDKTVR

SEQ ID NO: 2908666 - protein, 10 aa, Entamoeba invadens
SQKDGEKNVT

SEQ ID NO: 2908667 - protein, 13 aa, Entamoeba invadens
SQKDIDKEKDDVA

SEQ ID NO: 2908668 - protein, 6 aa, Entamoeba invadens
SQKEAT

SEQ ID NO: 2908669 - protein, 15 aa, Entamoeba invadens
SQKEGSSLLSEVVEI

SEQ ID NO: 2908670 - protein, 17 aa, Entamoeba invadens
SQKENEKLTTVADFAKK

SEQ ID NO: 2908671 - protein, 5 aa, Entamoeba invadens
SQKES

SEQ ID NO: 2908672 - protein, 6 aa, Entamoeba invadens
SQKESV

SEQ ID NO: 2908673 - protein, 24 aa, Entamoeba invadens
SQKEVTSSPKPPRSPRSHSPKRKK

SEQ ID NO: 2908674 - protein, 13 aa, Entamoeba invadens
SQKFAEKGDGQIG

SEQ ID NO: 2908675 - protein, 8 aa, Entamoeba invadens
SQKFSTKM

SEQ ID NO: 2908676 - protein, 9 aa, Entamoeba invadens
SQKGAEKRA

SEQ ID NO: 2908677 - protein, 8 aa, Entamoeba invadens
SQKGKVEK

SEQ ID NO: 2908678 - protein, 6 aa, Entamoeba invadens
SQKIEK

SEQ ID NO: 2908679 - protein, 5 aa, Entamoeba invadens
SQKIY

SEQ ID NO: 2908680 - protein, 10 aa, Entamoeba invadens
SQKKKFEDEI

SEQ ID NO: 2908681 - protein, 11 aa, Entamoeba invadens
SQKKSGDGTNK

SEQ ID NO: 2908682 - protein, 9 aa, Entamoeba invadens
SQKKVPNDK

SEQ ID NO: 2908683 - protein, 12 aa, Entamoeba invadens
SQKLKSERCEKR

SEQ ID NO: 2908684 - protein, 14 aa, Entamoeba invadens
SQKLSGTGSAWSSA

SEQ ID NO: 2908685 - protein, 7 aa, Entamoeba invadens
SQKLTDS

SEQ ID NO: 2908686 - protein, 10 aa, Entamoeba invadens
SQKMDSSINK

SEQ ID NO: 2908687 - protein, 6 aa, Entamoeba invadens
SQKMPH

SEQ ID NO: 2908688 - protein, 9 aa, Entamoeba invadens
SQKNAKAEL

SEQ ID NO: 2908689 - protein, 12 aa, Entamoeba invadens
SQKNDIKKAEGM

SEQ ID NO: 2908690 - protein, 7 aa, Entamoeba invadens
SQKNDIT

SEQ ID NO: 2908691 - protein, 18 aa, Entamoeba invadens
SQKNENAQLKESVEKNKK

SEQ ID NO: 2908692 - protein, 6 aa, Entamoeba invadens
SQKNIK

SEQ ID NO: 2908693 - protein, 12 aa, Entamoeba invadens
SQKNNDLGYTQG

SEQ ID NO: 2908694 - protein, 8 aa, Entamoeba invadens
SQKNTFPS

SEQ ID NO: 2908695 - protein, 11 aa, Entamoeba invadens
SQKPEPQESKE

SEQ ID NO: 2908696 - protein, 8 aa, Entamoeba invadens
SQKQKENY

SEQ ID NO: 2908697 - protein, 11 aa, Entamoeba invadens
SQKQKGPVCDP

SEQ ID NO: 2908698 - protein, 6 aa, Entamoeba invadens
SQKQNE

SEQ ID NO: 2908699 - protein, 8 aa, Entamoeba invadens
SQKQPQQT

SEQ ID NO: 2908700 - protein, 13 aa, Entamoeba invadens
SQKRNNSAMKSTA

SEQ ID NO: 2908701 - protein, 7 aa, Entamoeba invadens
SQKRTSK

SEQ ID NO: 2908702 - protein, 9 aa, Entamoeba invadens
SQKSLDTEN

SEQ ID NO: 2908703 - protein, 9 aa, Entamoeba invadens
SQKSSEIER

SEQ ID NO: 2908704 - protein, 4 aa, Entamoeba invadens
SQKT

SEQ ID NO: 2908705 - protein, 8 aa, Entamoeba invadens
SQKTPQEK

SEQ ID NO: 2908706 - protein, 18 aa, Entamoeba invadens
SQKVSEFKSQCKEGWVFW

SEQ ID NO: 2908707 - protein, 7 aa, Entamoeba invadens
SQKYDEK

SEQ ID NO: 2908708 - protein, 32 aa, Entamoeba invadens
SQKYHQTSTQQQYRKHSDERYYDDQYGGYGDY

SEQ ID NO: 2908709 - protein, 32 aa, Entamoeba invadens
SQKYHQTSTQQQYRKHSDGRYYDDQYGGYGDY

SEQ ID NO: 2908710 - protein, 11 aa, Entamoeba invadens
SQKYQKTKGVV

SEQ ID NO: 2908711 - protein, 6 aa, Entamoeba invadens
SQKYSK

SEQ ID NO: 2908712 - protein, 17 aa, Entamoeba invadens
SQLADAKMSQLRGDGFS

SEQ ID NO: 2908713 - protein, 17 aa, Entamoeba invadens
SQLATRDSDVQKHTTSH

SEQ ID NO: 2908714 - protein, 4 aa, Entamoeba invadens
SQLE

SEQ ID NO: 2908715 - protein, 8 aa, Entamoeba invadens
SQLEKAKR

SEQ ID NO: 2908716 - protein, 6 aa, Entamoeba invadens
SQLEKK

SEQ ID NO: 2908717 - protein, 13 aa, Entamoeba invadens
SQLENEKAEKIAY

SEQ ID NO: 2908718 - protein, 6 aa, Entamoeba invadens
SQLETE

SEQ ID NO: 2908719 - protein, 5 aa, Entamoeba invadens
SQLKG

SEQ ID NO: 2908720 - protein, 13 aa, Entamoeba invadens
SQLKGTAAGGPLE

SEQ ID NO: 2908721 - protein, 8 aa, Entamoeba invadens
SQLNQNDE

SEQ ID NO: 2908722 - protein, 7 aa, Entamoeba invadens
SQLPHPL

SEQ ID NO: 2908723 - protein, 11 aa, Entamoeba invadens
SQLPKVETTQH

SEQ ID NO: 2908724 - protein, 27 aa, Entamoeba invadens
SQLQSEKDRADDLDKKLTDEKDRADDI

SEQ ID NO: 2908725 - protein, 15 aa, Entamoeba invadens
SQLQSYKDRANDYTT

SEQ ID NO: 2908726 - protein, 6 aa, Entamoeba invadens
SQLSEL

SEQ ID NO: 2908727 - protein, 9 aa, Entamoeba invadens
SQLSHTPQN

SEQ ID NO: 2908728 - protein, 8 aa, Entamoeba invadens
SQLSPAEQ

SEQ ID NO: 2908729 - protein, 6 aa, Entamoeba invadens
SQLSQT

SEQ ID NO: 2908730 - protein, 6 aa, Entamoeba invadens
SQLSQV

SEQ ID NO: 2908731 - protein, 4 aa, Entamoeba invadens
SQLT

SEQ ID NO: 2908732 - protein, 10 aa, Entamoeba invadens
SQLTEKQNEV

SEQ ID NO: 2908733 - protein, 5 aa, Entamoeba invadens
SQLTT

SEQ ID NO: 2908734 - protein, 13 aa, Entamoeba invadens
SQMAQGDSTQITE

SEQ ID NO: 2908735 - protein, 17 aa, Entamoeba invadens
SQMDSGKDVSGISSDSI

SEQ ID NO: 2908736 - protein, 14 aa, Entamoeba invadens
SQMERNRKLKNPNF

SEQ ID NO: 2908737 - protein, 4 aa, Entamoeba invadens
SQMG

SEQ ID NO: 2908738 - protein, 11 aa, Entamoeba invadens
SQMKKSKQCQL

SEQ ID NO: 2908739 - protein, 5 aa, Entamoeba invadens
SQMND

SEQ ID NO: 2908740 - protein, 8 aa, Entamoeba invadens
SQMPTTPL

SEQ ID NO: 2908741 - protein, 8 aa, Entamoeba invadens
SQMQNEQI

SEQ ID NO: 2908742 - protein, 4 aa, Entamoeba invadens
SQMR

SEQ ID NO: 2908743 - protein, 6 aa, Entamoeba invadens
SQMTPE

SEQ ID NO: 2908744 - protein, 12 aa, Entamoeba invadens
SQMYKTRRQSGS

SEQ ID NO: 2908745 - protein, 10 aa, Entamoeba invadens
SQNAEKNLMN

SEQ ID NO: 2908746 - protein, 8 aa, Entamoeba invadens
SQNAKTKV

SEQ ID NO: 2908747 - protein, 8 aa, Entamoeba invadens
SQNASVDL

SEQ ID NO: 2908748 - protein, 8 aa, Entamoeba invadens
SQNDDVKN

SEQ ID NO: 2908749 - protein, 14 aa, Entamoeba invadens
SQNDKECEDELTDK

SEQ ID NO: 2908750 - protein, 10 aa, Entamoeba invadens
SQNDNGETPL

SEQ ID NO: 2908751 - protein, 4 aa, Entamoeba invadens
SQNE

SEQ ID NO: 2908752 - protein, 18 aa, Entamoeba invadens
SQNEKPVEPIQKQSVSPS

SEQ ID NO: 2908753 - protein, 4 aa, Entamoeba invadens
SQNG

SEQ ID NO: 2908754 - protein, 4 aa, Entamoeba invadens
SQNI

SEQ ID NO: 2908755 - protein, 8 aa, Entamoeba invadens
SQNKCSSC

SEQ ID NO: 2908756 - protein, 5 aa, Entamoeba invadens
SQNKD

SEQ ID NO: 2908757 - protein, 15 aa, Entamoeba invadens
SQNKDPLANVPPFPK

SEQ ID NO: 2908758 - protein, 6 aa, Entamoeba invadens
SQNKDY

SEQ ID NO: 2908759 - protein, 10 aa, Entamoeba invadens
SQNKKPGILT

SEQ ID NO: 2908760 - protein, 11 aa, Entamoeba invadens
SQNKNTKNTEK

SEQ ID NO: 2908761 - protein, 14 aa, Entamoeba invadens
SQNKSILVIDLTLV

SEQ ID NO: 2908762 - protein, 7 aa, Entamoeba invadens
SQNKSLS

SEQ ID NO: 2908763 - protein, 9 aa, Entamoeba invadens
SQNKTHSTE

SEQ ID NO: 2908764 - protein, 23 aa, Entamoeba invadens
SQNMKRSSMSYHENASEIDESDF

SEQ ID NO: 2908765 - protein, 7 aa, Entamoeba invadens
SQNNKTI

SEQ ID NO: 2908766 - protein, 5 aa, Entamoeba invadens
SQNNP

SEQ ID NO: 2908767 - protein, 9 aa, Entamoeba invadens
SQNNPPDKF

SEQ ID NO: 2908768 - protein, 5 aa, Entamoeba invadens
SQNPL

SEQ ID NO: 2908769 - protein, 19 aa, Entamoeba invadens
SQNPNTMTPSDTSALSGQE

SEQ ID NO: 2908770 - protein, 9 aa, Entamoeba invadens
SQNQQPMGV

SEQ ID NO: 2908771 - protein, 4 aa, Entamoeba invadens
SQNS

SEQ ID NO: 2908772 - protein, 12 aa, Entamoeba invadens
SQNSDFDASSKI

SEQ ID NO: 2908773 - protein, 19 aa, Entamoeba invadens
SQNSEGATSNTEDTMSNEV

SEQ ID NO: 2908774 - protein, 24 aa, Entamoeba invadens
SQNSFGSFESSSQGNPSKELNEKS

SEQ ID NO: 2908775 - protein, 5 aa, Entamoeba invadens
SQNSI

SEQ ID NO: 2908776 - protein, 9 aa, Entamoeba invadens
SQNTENEAI

SEQ ID NO: 2908777 - protein, 93 aa, Entamoeba invadens
SQNTNSDDSSSSSNDSQILEQEEKKEDSSDGTSENSIDENDETNKKSAETSTPHGDSSDSASENSTERSPEKSAEKPEDSKEIKKSSTPEERE

SEQ ID NO: 2908778 - protein, 11 aa, Entamoeba invadens
SQNVTNKTSAE

SEQ ID NO: 2908779 - protein, 7 aa, Entamoeba invadens
SQNYDTK

SEQ ID NO: 2908780 - protein, 13 aa, Entamoeba invadens
SQNYTTKEPFADL

SEQ ID NO: 2908781 - protein, 9 aa, Entamoeba invadens
SQPDTKRKY

SEQ ID NO: 2908782 - protein, 6 aa, Entamoeba invadens
SQPHFP

SEQ ID NO: 2908783 - protein, 4 aa, Entamoeba invadens
SQPI

SEQ ID NO: 2908784 - protein, 5 aa, Entamoeba invadens
SQPIQ

SEQ ID NO: 2908785 - protein, 5 aa, Entamoeba invadens
SQPIR

SEQ ID NO: 2908786 - protein, 35 aa, Entamoeba invadens
SQPKLPKQKTPTAVDEKSPHSKKTSSGLSKKVGKQ

SEQ ID NO: 2908787 - protein, 22 aa, Entamoeba invadens
SQPKTPENQKKCDIPKTEKSPV

SEQ ID NO: 2908788 - protein, 5 aa, Entamoeba invadens
SQPLS

SEQ ID NO: 2908789 - protein, 14 aa, Entamoeba invadens
SQPLSQPLQQPLQQ

SEQ ID NO: 2908790 - protein, 4 aa, Entamoeba invadens
SQPN

SEQ ID NO: 2908791 - protein, 12 aa, Entamoeba invadens
SQPNDESPANVD

SEQ ID NO: 2908792 - protein, 5 aa, Entamoeba invadens
SQPNH

SEQ ID NO: 2908793 - protein, 8 aa, Entamoeba invadens
SQPPENPQ

SEQ ID NO: 2908794 - protein, 9 aa, Entamoeba invadens
SQPPTTHLK

SEQ ID NO: 2908795 - protein, 4 aa, Entamoeba invadens
SQPQ

SEQ ID NO: 2908796 - protein, 9 aa, Entamoeba invadens
SQPQFPKNL

SEQ ID NO: 2908797 - protein, 10 aa, Entamoeba invadens
SQPTGQGSLQ

SEQ ID NO: 2908798 - protein, 8 aa, Entamoeba invadens
SQPTPVEA

SEQ ID NO: 2908799 - protein, 6 aa, Entamoeba invadens
SQPTTE

SEQ ID NO: 2908800 - protein, 7 aa, Entamoeba invadens
SQQAQEK

SEQ ID NO: 2908801 - protein, 8 aa, Entamoeba invadens
SQQCDDNL

SEQ ID NO: 2908802 - protein, 6 aa, Entamoeba invadens
SQQDFK

SEQ ID NO: 2908803 - protein, 4 aa, Entamoeba invadens
SQQE

SEQ ID NO: 2908804 - protein, 15 aa, Entamoeba invadens
SQQEDSEKRTPSIRK

SEQ ID NO: 2908805 - protein, 19 aa, Entamoeba invadens
SQQGETASKPVLPPRRKQA

SEQ ID NO: 2908806 - protein, 5 aa, Entamoeba invadens
SQQHW

SEQ ID NO: 2908807 - protein, 7 aa, Entamoeba invadens
SQQITKE

SEQ ID NO: 2908808 - protein, 15 aa, Entamoeba invadens
SQQIVTPQKSQTKSV

SEQ ID NO: 2908809 - protein, 16 aa, Entamoeba invadens
SQQKENIQKLSDENEH

SEQ ID NO: 2908810 - protein, 11 aa, Entamoeba invadens
SQQKNDIQLEG

SEQ ID NO: 2908811 - protein, 14 aa, Entamoeba invadens
SQQKRKSDLRKRHK

SEQ ID NO: 2908812 - protein, 5 aa, Entamoeba invadens
SQQND

SEQ ID NO: 2908813 - protein, 14 aa, Entamoeba invadens
SQQNDRSRPVSPEI

SEQ ID NO: 2908814 - protein, 9 aa, Entamoeba invadens
SQQNTQRTM

SEQ ID NO: 2908815 - protein, 19 aa, Entamoeba invadens
SQQPEDRPNINEVVNFLKT

SEQ ID NO: 2908816 - protein, 5 aa, Entamoeba invadens
SQQPF

SEQ ID NO: 2908817 - protein, 8 aa, Entamoeba invadens
SQQPQQNV

SEQ ID NO: 2908818 - protein, 6 aa, Entamoeba invadens
SQQQAQ

SEQ ID NO: 2908819 - protein, 12 aa, Entamoeba invadens
SQQQKPNTFRPK

SEQ ID NO: 2908820 - protein, 41 aa, Entamoeba invadens
SQQQRASVGSTSGMYSPKTPNSRSEKHQQSMKEASEIKGSS

SEQ ID NO: 2908821 - protein, 7 aa, Entamoeba invadens
SQQQSQV

SEQ ID NO: 2908822 - protein, 5 aa, Entamoeba invadens
SQQRP

SEQ ID NO: 2908823 - protein, 8 aa, Entamoeba invadens
SQQRTDDK

SEQ ID NO: 2908824 - protein, 15 aa, Entamoeba invadens
SQQTPQQQSQPQEQL

SEQ ID NO: 2908825 - protein, 7 aa, Entamoeba invadens
SQQTTGL

SEQ ID NO: 2908826 - protein, 15 aa, Entamoeba invadens
SQQYKDNEDKKADDF

SEQ ID NO: 2908827 - protein, 10 aa, Entamoeba invadens
SQRADSPDFG

SEQ ID NO: 2908828 - protein, 5 aa, Entamoeba invadens
SQREK

SEQ ID NO: 2908829 - protein, 15 aa, Entamoeba invadens
SQRENSAQEDQEKYR

SEQ ID NO: 2908830 - protein, 9 aa, Entamoeba invadens
SQRENSSPN

SEQ ID NO: 2908831 - protein, 4 aa, Entamoeba invadens
SQRG

SEQ ID NO: 2908832 - protein, 10 aa, Entamoeba invadens
SQRGREIPHE

SEQ ID NO: 2908833 - protein, 7 aa, Entamoeba invadens
SQRIEAK

SEQ ID NO: 2908834 - protein, 10 aa, Entamoeba invadens
SQRKGITAGN

SEQ ID NO: 2908835 - protein, 34 aa, Entamoeba invadens
SQRKLTEAMQEGNEDGVKDALEELEKKKKMKDEV

SEQ ID NO: 2908836 - protein, 5 aa, Entamoeba invadens
SQRKN

SEQ ID NO: 2908837 - protein, 22 aa, Entamoeba invadens
SQRNPESIRDERAFKQEYQQSV

SEQ ID NO: 2908838 - protein, 7 aa, Entamoeba invadens
SQRRPNL

SEQ ID NO: 2908839 - protein, 5 aa, Entamoeba invadens
SQRSL

SEQ ID NO: 2908840 - protein, 12 aa, Entamoeba invadens
SQRSRGMPESKS

SEQ ID NO: 2908841 - protein, 7 aa, Entamoeba invadens
SQRTIKS

SEQ ID NO: 2908842 - protein, 12 aa, Entamoeba invadens
SQRTNLQQKSFQ

SEQ ID NO: 2908843 - protein, 8 aa, Entamoeba invadens
SQRTPDEV

SEQ ID NO: 2908844 - protein, 4 aa, Entamoeba invadens
SQRY

SEQ ID NO: 2908845 - protein, 5 aa, Entamoeba invadens
SQSDF

SEQ ID NO: 2908846 - protein, 5 aa, Entamoeba invadens
SQSDL

SEQ ID NO: 2908847 - protein, 5 aa, Entamoeba invadens
SQSDN

SEQ ID NO: 2908848 - protein, 7 aa, Entamoeba invadens
SQSDTDG

SEQ ID NO: 2908849 - protein, 8 aa, Entamoeba invadens
SQSDTNTL

SEQ ID NO: 2908850 - protein, 6 aa, Entamoeba invadens
SQSEDK

SEQ ID NO: 2908851 - protein, 10 aa, Entamoeba invadens
SQSELSDDQK

SEQ ID NO: 2908852 - protein, 19 aa, Entamoeba invadens
SQSESYTALPEDESESKKD

SEQ ID NO: 2908853 - protein, 26 aa, Entamoeba invadens
SQSETAGAKAEKAPQPKQQEPKKEVA

SEQ ID NO: 2908854 - protein, 6 aa, Entamoeba invadens
SQSEVT

SEQ ID NO: 2908855 - protein, 6 aa, Entamoeba invadens
SQSEYD

SEQ ID NO: 2908856 - protein, 4 aa, Entamoeba invadens
SQSF

SEQ ID NO: 2908857 - protein, 9 aa, Entamoeba invadens
SQSGYQQEV

SEQ ID NO: 2908858 - protein, 7 aa, Entamoeba invadens
SQSHDGD

SEQ ID NO: 2908859 - protein, 4 aa, Entamoeba invadens
SQSI

SEQ ID NO: 2908860 - protein, 16 aa, Entamoeba invadens
SQSKDGGFRDKPTKSV

SEQ ID NO: 2908861 - protein, 12 aa, Entamoeba invadens
SQSKKVDKALGL

SEQ ID NO: 2908862 - protein, 8 aa, Entamoeba invadens
SQSKLKGK

SEQ ID NO: 2908863 - protein, 10 aa, Entamoeba invadens
SQSKNTFSSQ

SEQ ID NO: 2908864 - protein, 10 aa, Entamoeba invadens
SQSKRTLGVS

SEQ ID NO: 2908865 - protein, 12 aa, Entamoeba invadens
SQSKSAFCIFYT

SEQ ID NO: 2908866 - protein, 13 aa, Entamoeba invadens
SQSKSQQDGDSMK

SEQ ID NO: 2908867 - protein, 8 aa, Entamoeba invadens
SQSKTIQA

SEQ ID NO: 2908868 - protein, 8 aa, Entamoeba invadens
SQSPESAI

SEQ ID NO: 2908869 - protein, 8 aa, Entamoeba invadens
SQSPKAND

SEQ ID NO: 2908870 - protein, 16 aa, Entamoeba invadens
SQSPTIQKHTPAKSQL

SEQ ID NO: 2908871 - protein, 8 aa, Entamoeba invadens
SQSPTSVS

SEQ ID NO: 2908872 - protein, 13 aa, Entamoeba invadens
SQSQDSEIGDGTT

SEQ ID NO: 2908873 - protein, 17 aa, Entamoeba invadens
SQSQQRKETKPKPLEKQ

SEQ ID NO: 2908874 - protein, 8 aa, Entamoeba invadens
SQSQSCGG

SEQ ID NO: 2908875 - protein, 7 aa, Entamoeba invadens
SQSQSSS

SEQ ID NO: 2908876 - protein, 9 aa, Entamoeba invadens
SQSRDVTKA

SEQ ID NO: 2908877 - protein, 15 aa, Entamoeba invadens
SQSRTAQDDAGTQIC

SEQ ID NO: 2908878 - protein, 7 aa, Entamoeba invadens
SQSSFDS

SEQ ID NO: 2908879 - protein, 20 aa, Entamoeba invadens
SQSTEIKSKKYTKPPKYTKD

SEQ ID NO: 2908880 - protein, 15 aa, Entamoeba invadens
SQSVSPSFEKSQSHL

SEQ ID NO: 2908881 - protein, 4 aa, Entamoeba invadens
SQSY

SEQ ID NO: 2908882 - protein, 10 aa, Entamoeba invadens
SQTAVNDSHA

SEQ ID NO: 2908883 - protein, 29 aa, Entamoeba invadens
SQTCGKSEEAAINSKNANQPKFKERQNDA

SEQ ID NO: 2908884 - protein, 4 aa, Entamoeba invadens
SQTD

SEQ ID NO: 2908885 - protein, 6 aa, Entamoeba invadens
SQTDPK

SEQ ID NO: 2908886 - protein, 5 aa, Entamoeba invadens
SQTEK

SEQ ID NO: 2908887 - protein, 20 aa, Entamoeba invadens
SQTESISLPKNSPILCQFLQ

SEQ ID NO: 2908888 - protein, 16 aa, Entamoeba invadens
SQTESSNFSNYNPINT

SEQ ID NO: 2908889 - protein, 16 aa, Entamoeba invadens
SQTETSDFSNYNPINT

SEQ ID NO: 2908890 - protein, 4 aa, Entamoeba invadens
SQTF

SEQ ID NO: 2908891 - protein, 8 aa, Entamoeba invadens
SQTGTLPK

SEQ ID NO: 2908892 - protein, 4 aa, Entamoeba invadens
SQTK

SEQ ID NO: 2908893 - protein, 10 aa, Entamoeba invadens
SQTKAEKTID

SEQ ID NO: 2908894 - protein, 10 aa, Entamoeba invadens
SQTKAERTID

SEQ ID NO: 2908895 - protein, 14 aa, Entamoeba invadens
SQTKKRYATMTEKR

SEQ ID NO: 2908896 - protein, 5 aa, Entamoeba invadens
SQTKS

SEQ ID NO: 2908897 - protein, 6 aa, Entamoeba invadens
SQTKTL

SEQ ID NO: 2908898 - protein, 6 aa, Entamoeba invadens
SQTNEI

SEQ ID NO: 2908899 - protein, 5 aa, Entamoeba invadens
SQTNF

SEQ ID NO: 2908900 - protein, 7 aa, Entamoeba invadens
SQTNFSS

SEQ ID NO: 2908901 - protein, 5 aa, Entamoeba invadens
SQTNK

SEQ ID NO: 2908902 - protein, 9 aa, Entamoeba invadens
SQTNPLPSV

SEQ ID NO: 2908903 - protein, 7 aa, Entamoeba invadens
SQTNSSF

SEQ ID NO: 2908904 - protein, 7 aa, Entamoeba invadens
SQTPSYG

SEQ ID NO: 2908905 - protein, 9 aa, Entamoeba invadens
SQTPTKAEK

SEQ ID NO: 2908906 - protein, 7 aa, Entamoeba invadens
SQTQMSQ

SEQ ID NO: 2908907 - protein, 6 aa, Entamoeba invadens
SQTRFD

SEQ ID NO: 2908908 - protein, 23 aa, Entamoeba invadens
SQTRGRRNYNEDRTCAKSIDPSN

SEQ ID NO: 2908909 - protein, 7 aa, Entamoeba invadens
SQTSLKL

SEQ ID NO: 2908910 - protein, 13 aa, Entamoeba invadens
SQTSQTQRQSPLQ

SEQ ID NO: 2908911 - protein, 9 aa, Entamoeba invadens
SQTSRESNV

SEQ ID NO: 2908912 - protein, 10 aa, Entamoeba invadens
SQTSTSQSIA

SEQ ID NO: 2908913 - protein, 6 aa, Entamoeba invadens
SQTTEK

SEQ ID NO: 2908914 - protein, 18 aa, Entamoeba invadens
SQTTNEHNSPLQERPSGI

SEQ ID NO: 2908915 - protein, 5 aa, Entamoeba invadens
SQTTP

SEQ ID NO: 2908916 - protein, 26 aa, Entamoeba invadens
SQTTTPTYQTQREQRKSQKGKSEQAI

SEQ ID NO: 2908917 - protein, 6 aa, Entamoeba invadens
SQTVNT

SEQ ID NO: 2908918 - protein, 8 aa, Entamoeba invadens
SQTYSDED

SEQ ID NO: 2908919 - protein, 10 aa, Entamoeba invadens
SQVANSVENN

SEQ ID NO: 2908920 - protein, 12 aa, Entamoeba invadens
SQVASKSGKELT

SEQ ID NO: 2908921 - protein, 56 aa, Entamoeba invadens
SQVEEEQKKRQEAYTEKAKKEWEQLKEKETSAKQTEDKKEEEKGEPTKTEVKEEHK

SEQ ID NO: 2908922 - protein, 8 aa, Entamoeba invadens
SQVEIDDA

SEQ ID NO: 2908923 - protein, 4 aa, Entamoeba invadens
SQVN

SEQ ID NO: 2908924 - protein, 12 aa, Entamoeba invadens
SQVNDGKKQKEM

SEQ ID NO: 2908925 - protein, 12 aa, Entamoeba invadens
SQVNESKRHHDN

SEQ ID NO: 2908926 - protein, 7 aa, Entamoeba invadens
SQVNREP

SEQ ID NO: 2908927 - protein, 14 aa, Entamoeba invadens
SQVNSGVGAGPSEL

SEQ ID NO: 2908928 - protein, 6 aa, Entamoeba invadens
SQVPGT

SEQ ID NO: 2908929 - protein, 10 aa, Entamoeba invadens
SQVRERAGKR

SEQ ID NO: 2908930 - protein, 10 aa, Entamoeba invadens
SQVSQENEEE

SEQ ID NO: 2908931 - protein, 10 aa, Entamoeba invadens
SQVSQKSELR

SEQ ID NO: 2908932 - protein, 8 aa, Entamoeba invadens
SQVSSLGN

SEQ ID NO: 2908933 - protein, 15 aa, Entamoeba invadens
SQVTQKSPNPIQPKE

SEQ ID NO: 2908934 - protein, 8 aa, Entamoeba invadens
SQWKKESA

SEQ ID NO: 2908935 - protein, 7 aa, Entamoeba invadens
SQWKSGG

SEQ ID NO: 2908936 - protein, 6 aa, Entamoeba invadens
SQWSEN

SEQ ID NO: 2908937 - protein, 5 aa, Entamoeba invadens
SQYFG

SEQ ID NO: 2908938 - protein, 5 aa, Entamoeba invadens
SQYIR

SEQ ID NO: 2908939 - protein, 5 aa, Entamoeba invadens
SQYPD

SEQ ID NO: 2908940 - protein, 43 aa, Entamoeba invadens
SQYPSSTGNANQMPVNATQQQAPQYQSQYPTSTANPQMSPQMD

SEQ ID NO: 2908941 - protein, 12 aa, Entamoeba invadens
SQYSDGCTTDVS

SEQ ID NO: 2908942 - protein, 11 aa, Entamoeba invadens
SQYSKSPKTVN

SEQ ID NO: 2908943 - protein, 10 aa, Entamoeba invadens
SQYSTTELPE

SEQ ID NO: 2908944 - protein, 35 aa, Entamoeba invadens
SQYTKQNKTGNGCSEKQQKEKKGGQTSTKGNKKHK

SEQ ID NO: 2908945 - protein, 12 aa, Entamoeba invadens
SQYTSGKNSTLK

SEQ ID NO: 2908946 - protein, 8 aa, Entamoeba invadens
SQYYRETQ

SEQ ID NO: 2908947 - protein, 36 aa, Entamoeba invadens
SRAAEERNLKEKTEKKNASKYTSIDKTKTPKAVGEE

SEQ ID NO: 2908948 - protein, 6 aa, Entamoeba invadens
SRAEGS

SEQ ID NO: 2908949 - protein, 6 aa, Entamoeba invadens
SRAFGE

SEQ ID NO: 2908950 - protein, 8 aa, Entamoeba invadens
SRAGRRTT

SEQ ID NO: 2908951 - protein, 48 aa, Entamoeba invadens
SRAGSGKRFTTDSTETPAKAEDSPVEKEAEPHKEKEKDKSGKDKKERR

SEQ ID NO: 2908952 - protein, 4 aa, Entamoeba invadens
SRAH

SEQ ID NO: 2908953 - protein, 4 aa, Entamoeba invadens
SRAK

SEQ ID NO: 2908954 - protein, 5 aa, Entamoeba invadens
SRAKY

SEQ ID NO: 2908955 - protein, 17 aa, Entamoeba invadens
SRANSAVRNYTTGRNPI

SEQ ID NO: 2908956 - protein, 14 aa, Entamoeba invadens
SRAPAEYSDFENQG

SEQ ID NO: 2908957 - protein, 10 aa, Entamoeba invadens
SRAPSQDAIP

SEQ ID NO: 2908958 - protein, 26 aa, Entamoeba invadens
SRAQKESLRDKSDAVVRKKDENESAK

SEQ ID NO: 2908959 - protein, 4 aa, Entamoeba invadens
SRAS

SEQ ID NO: 2908960 - protein, 9 aa, Entamoeba invadens
SRATAGPIV

SEQ ID NO: 2908961 - protein, 7 aa, Entamoeba invadens
SRATRGA

SEQ ID NO: 2908962 - protein, 34 aa, Entamoeba invadens
SRAYPPPPPPPPGGAVPPPPGASAPKCEAPASLD

SEQ ID NO: 2908963 - protein, 10 aa, Entamoeba invadens
SRCDTPSSPL

SEQ ID NO: 2908964 - protein, 8 aa, Entamoeba invadens
SRCDTTGK

SEQ ID NO: 2908965 - protein, 5 aa, Entamoeba invadens
SRCNK

SEQ ID NO: 2908966 - protein, 10 aa, Entamoeba invadens
SRCNSEKESE

SEQ ID NO: 2908967 - protein, 6 aa, Entamoeba invadens
SRCTSE

SEQ ID NO: 2908968 - protein, 16 aa, Entamoeba invadens
SRDARSSLEFSTEESV

SEQ ID NO: 2908969 - protein, 8 aa, Entamoeba invadens
SRDENDPL

SEQ ID NO: 2908970 - protein, 20 aa, Entamoeba invadens
SRDETKRVKPKSSPPAQRPP

SEQ ID NO: 2908971 - protein, 10 aa, Entamoeba invadens
SRDFRNAQTM

SEQ ID NO: 2908972 - protein, 6 aa, Entamoeba invadens
SRDFST

SEQ ID NO: 2908973 - protein, 8 aa, Entamoeba invadens
SRDGLSRK

SEQ ID NO: 2908974 - protein, 6 aa, Entamoeba invadens
SRDKSI

SEQ ID NO: 2908975 - protein, 4 aa, Entamoeba invadens
SRDN

SEQ ID NO: 2908976 - protein, 5 aa, Entamoeba invadens
SRDPA

SEQ ID NO: 2908977 - protein, 43 aa, Entamoeba invadens
SRDPEKKSKQTKVKVTTARSSSTSIGKPPSPLGVSKGDNTSDS

SEQ ID NO: 2908978 - protein, 10 aa, Entamoeba invadens
SRDPESLSRT

SEQ ID NO: 2908979 - protein, 13 aa, Entamoeba invadens
SRDPSLAYLKNDE

SEQ ID NO: 2908980 - protein, 8 aa, Entamoeba invadens
SRDQRTRL

SEQ ID NO: 2908981 - protein, 5 aa, Entamoeba invadens
SRDQY

SEQ ID NO: 2908982 - protein, 7 aa, Entamoeba invadens
SRDRRRF

SEQ ID NO: 2908983 - protein, 4 aa, Entamoeba invadens
SRDS

SEQ ID NO: 2908984 - protein, 5 aa, Entamoeba invadens
SRDSL

SEQ ID NO: 2908985 - protein, 4 aa, Entamoeba invadens
SRDT

SEQ ID NO: 2908986 - protein, 7 aa, Entamoeba invadens
SRDTIPS

SEQ ID NO: 2908987 - protein, 79 aa, Entamoeba invadens
SRDYEKYNDKKPRPREDEDYKRKEVRDDWRDERERRYERRDGGYDDGRDNHRGDYKDDRRDDRRERTERRDDSNQGSKL

SEQ ID NO: 2908988 - protein, 13 aa, Entamoeba invadens
SREATLNAKPISG

SEQ ID NO: 2908989 - protein, 5 aa, Entamoeba invadens
SREDG

SEQ ID NO: 2908990 - protein, 12 aa, Entamoeba invadens
SREDIHDGSDPF

SEQ ID NO: 2908991 - protein, 5 aa, Entamoeba invadens
SREEK

SEQ ID NO: 2908992 - protein, 5 aa, Entamoeba invadens
SREEN

SEQ ID NO: 2908993 - protein, 6 aa, Entamoeba invadens
SREERI

SEQ ID NO: 2908994 - protein, 8 aa, Entamoeba invadens
SREETESM

SEQ ID NO: 2908995 - protein, 4 aa, Entamoeba invadens
SREF

SEQ ID NO: 2908996 - protein, 6 aa, Entamoeba invadens
SREFRG

SEQ ID NO: 2908997 - protein, 6 aa, Entamoeba invadens
SREGQS

SEQ ID NO: 2908998 - protein, 10 aa, Entamoeba invadens
SREGRTRKGH

SEQ ID NO: 2908999 - protein, 24 aa, Entamoeba invadens
SREITEKVEDKNSKVYSKERSPRC

SEQ ID NO: 2909000 - protein, 7 aa, Entamoeba invadens
SREKKTM

SEQ ID NO: 2909001 - protein, 7 aa, Entamoeba invadens
SREKNIP

SEQ ID NO: 2909002 - protein, 11 aa, Entamoeba invadens
SRELDPEHKGI

SEQ ID NO: 2909003 - protein, 9 aa, Entamoeba invadens
SRENPASPF

SEQ ID NO: 2909004 - protein, 17 aa, Entamoeba invadens
SRENTPREDKERKHVKG

SEQ ID NO: 2909005 - protein, 4 aa, Entamoeba invadens
SREP

SEQ ID NO: 2909006 - protein, 7 aa, Entamoeba invadens
SREPFTK

SEQ ID NO: 2909007 - protein, 8 aa, Entamoeba invadens
SREQDDNS

SEQ ID NO: 2909008 - protein, 5 aa, Entamoeba invadens
SRERA

SEQ ID NO: 2909009 - protein, 5 aa, Entamoeba invadens
SRERY

SEQ ID NO: 2909010 - protein, 4 aa, Entamoeba invadens
SRES

SEQ ID NO: 2909011 - protein, 8 aa, Entamoeba invadens
SRESFDQT

SEQ ID NO: 2909012 - protein, 6 aa, Entamoeba invadens
SRESFE

SEQ ID NO: 2909013 - protein, 6 aa, Entamoeba invadens
SRESKP

SEQ ID NO: 2909014 - protein, 17 aa, Entamoeba invadens
SRESQEWTSALIHIKHI

SEQ ID NO: 2909015 - protein, 15 aa, Entamoeba invadens
SRESYRETRNYQAEQ

SEQ ID NO: 2909016 - protein, 4 aa, Entamoeba invadens
SRET

SEQ ID NO: 2909017 - protein, 10 aa, Entamoeba invadens
SRETLSRSKT

SEQ ID NO: 2909018 - protein, 23 aa, Entamoeba invadens
SRETQEAYNSDTVYGKERMTRQK

SEQ ID NO: 2909019 - protein, 6 aa, Entamoeba invadens
SRETYR

SEQ ID NO: 2909020 - protein, 7 aa, Entamoeba invadens
SREVEEK

SEQ ID NO: 2909021 - protein, 19 aa, Entamoeba invadens
SREYTTLSQKAAGKMEDKN

SEQ ID NO: 2909022 - protein, 13 aa, Entamoeba invadens
SRFKGKRSGNLAG

SEQ ID NO: 2909023 - protein, 12 aa, Entamoeba invadens
SRFPTKTEKFDE

SEQ ID NO: 2909024 - protein, 6 aa, Entamoeba invadens
SRFRPP

SEQ ID NO: 2909025 - protein, 4 aa, Entamoeba invadens
SRFT

SEQ ID NO: 2909026 - protein, 8 aa, Entamoeba invadens
SRGARGYY

SEQ ID NO: 2909027 - protein, 4 aa, Entamoeba invadens
SRGC

SEQ ID NO: 2909028 - protein, 8 aa, Entamoeba invadens
SRGERPAI

SEQ ID NO: 2909029 - protein, 10 aa, Entamoeba invadens
SRGGGTTPNH

SEQ ID NO: 2909030 - protein, 4 aa, Entamoeba invadens
SRGK

SEQ ID NO: 2909031 - protein, 6 aa, Entamoeba invadens
SRGKEK

SEQ ID NO: 2909032 - protein, 11 aa, Entamoeba invadens
SRGKQYVTSDA

SEQ ID NO: 2909033 - protein, 5 aa, Entamoeba invadens
SRGLD

SEQ ID NO: 2909034 - protein, 6 aa, Entamoeba invadens
SRGLNG

SEQ ID NO: 2909035 - protein, 4 aa, Entamoeba invadens
SRGM

SEQ ID NO: 2909036 - protein, 7 aa, Entamoeba invadens
SRGNSLQ

SEQ ID NO: 2909037 - protein, 7 aa, Entamoeba invadens
SRGNTYV

SEQ ID NO: 2909038 - protein, 6 aa, Entamoeba invadens
SRGPSC

SEQ ID NO: 2909039 - protein, 20 aa, Entamoeba invadens
SRGQNFGSAEMRKEGDENWE

SEQ ID NO: 2909040 - protein, 4 aa, Entamoeba invadens
SRGR

SEQ ID NO: 2909041 - protein, 6 aa, Entamoeba invadens
SRGRVE

SEQ ID NO: 2909042 - protein, 15 aa, Entamoeba invadens
SRGSYDRNSQRLYPG

SEQ ID NO: 2909043 - protein, 5 aa, Entamoeba invadens
SRGTD

SEQ ID NO: 2909044 - protein, 5 aa, Entamoeba invadens
SRGTE

SEQ ID NO: 2909045 - protein, 12 aa, Entamoeba invadens
SRGVGDIEEINS

SEQ ID NO: 2909046 - protein, 6 aa, Entamoeba invadens
SRGVKG

SEQ ID NO: 2909047 - protein, 7 aa, Entamoeba invadens
SRGVKGE

SEQ ID NO: 2909048 - protein, 8 aa, Entamoeba invadens
SRGVPETQ

SEQ ID NO: 2909049 - protein, 5 aa, Entamoeba invadens
SRHDV

SEQ ID NO: 2909050 - protein, 8 aa, Entamoeba invadens
SRHFSPDF

SEQ ID NO: 2909051 - protein, 6 aa, Entamoeba invadens
SRHGKS

SEQ ID NO: 2909052 - protein, 16 aa, Entamoeba invadens
SRHSARALKESKGMSF

SEQ ID NO: 2909053 - protein, 6 aa, Entamoeba invadens
SRIGGE

SEQ ID NO: 2909054 - protein, 7 aa, Entamoeba invadens
SRIGNGG

SEQ ID NO: 2909055 - protein, 5 aa, Entamoeba invadens
SRIGY

SEQ ID NO: 2909056 - protein, 13 aa, Entamoeba invadens
SRIRAERTKKYEH

SEQ ID NO: 2909057 - protein, 8 aa, Entamoeba invadens
SRKAVETK

SEQ ID NO: 2909058 - protein, 4 aa, Entamoeba invadens
SRKD

SEQ ID NO: 2909059 - protein, 48 aa, Entamoeba invadens
SRKDDFDLSSSPGFEEKSESTNDSETPKTARVESNSKELFETPRSEMN

SEQ ID NO: 2909060 - protein, 7 aa, Entamoeba invadens
SRKDVEK

SEQ ID NO: 2909061 - protein, 20 aa, Entamoeba invadens
SRKEKMGKFDDDEIETQIEK

SEQ ID NO: 2909062 - protein, 5 aa, Entamoeba invadens
SRKER

SEQ ID NO: 2909063 - protein, 11 aa, Entamoeba invadens
SRKGGDKGSVL

SEQ ID NO: 2909064 - protein, 12 aa, Entamoeba invadens
SRKGLPDGTRLR

SEQ ID NO: 2909065 - protein, 6 aa, Entamoeba invadens
SRKGRL

SEQ ID NO: 2909066 - protein, 23 aa, Entamoeba invadens
SRKGSLHDSQLPQLSPRKSPDTR

SEQ ID NO: 2909067 - protein, 4 aa, Entamoeba invadens
SRKK

SEQ ID NO: 2909068 - protein, 15 aa, Entamoeba invadens
SRKKDETNKEDDDMQ

SEQ ID NO: 2909069 - protein, 12 aa, Entamoeba invadens
SRKKEKISTETS

SEQ ID NO: 2909070 - protein, 10 aa, Entamoeba invadens
SRKKLKGRVA

SEQ ID NO: 2909071 - protein, 8 aa, Entamoeba invadens
SRKKNKAY

SEQ ID NO: 2909072 - protein, 17 aa, Entamoeba invadens
SRKLEKEQSEQSDLQAK

SEQ ID NO: 2909073 - protein, 6 aa, Entamoeba invadens
SRKLGG

SEQ ID NO: 2909074 - protein, 8 aa, Entamoeba invadens
SRKMSEKQ

SEQ ID NO: 2909075 - protein, 7 aa, Entamoeba invadens
SRKMTKK

SEQ ID NO: 2909076 - protein, 18 aa, Entamoeba invadens
SRKPEKKEVAIDMENPHL

SEQ ID NO: 2909077 - protein, 6 aa, Entamoeba invadens
SRKPEW

SEQ ID NO: 2909078 - protein, 7 aa, Entamoeba invadens
SRKPPEL

SEQ ID NO: 2909079 - protein, 6 aa, Entamoeba invadens
SRKPSL

SEQ ID NO: 2909080 - protein, 8 aa, Entamoeba invadens
SRKQCRER

SEQ ID NO: 2909081 - protein, 8 aa, Entamoeba invadens
SRKQDSTE

SEQ ID NO: 2909082 - protein, 4 aa, Entamoeba invadens
SRKR

SEQ ID NO: 2909083 - protein, 8 aa, Entamoeba invadens
SRKRGSHI

SEQ ID NO: 2909084 - protein, 11 aa, Entamoeba invadens
SRKRPENGEPI

SEQ ID NO: 2909085 - protein, 24 aa, Entamoeba invadens
SRKSEEERKRDLENIKGKKSVTCE

SEQ ID NO: 2909086 - protein, 10 aa, Entamoeba invadens
SRKSELENPE

SEQ ID NO: 2909087 - protein, 9 aa, Entamoeba invadens
SRKSKKTLR

SEQ ID NO: 2909088 - protein, 9 aa, Entamoeba invadens
SRKSNMKVD

SEQ ID NO: 2909089 - protein, 6 aa, Entamoeba invadens
SRKTFE

SEQ ID NO: 2909090 - protein, 7 aa, Entamoeba invadens
SRKTSSL

SEQ ID NO: 2909091 - protein, 8 aa, Entamoeba invadens
SRKVRDQD

SEQ ID NO: 2909092 - protein, 13 aa, Entamoeba invadens
SRKWSSTNTIPSP

SEQ ID NO: 2909093 - protein, 20 aa, Entamoeba invadens
SRKYAKSIEKNIDDTKPSCS

SEQ ID NO: 2909094 - protein, 52 aa, Entamoeba invadens
SRKYPNDLPQKEKDGYKQQERGNGSPSRNYSKEMQRKYTPYNNRPKSAVSSE

SEQ ID NO: 2909095 - protein, 8 aa, Entamoeba invadens
SRLEPEPI

SEQ ID NO: 2909096 - protein, 5 aa, Entamoeba invadens
SRLGA

SEQ ID NO: 2909097 - protein, 15 aa, Entamoeba invadens
SRLGEPRKKRCTTPN

SEQ ID NO: 2909098 - protein, 9 aa, Entamoeba invadens
SRLGSPSLN

SEQ ID NO: 2909099 - protein, 7 aa, Entamoeba invadens
SRLKSDE

SEQ ID NO: 2909100 - protein, 10 aa, Entamoeba invadens
SRLPKPDEMN

SEQ ID NO: 2909101 - protein, 10 aa, Entamoeba invadens
SRLQERIKEQ

SEQ ID NO: 2909102 - protein, 4 aa, Entamoeba invadens
SRLS

SEQ ID NO: 2909103 - protein, 15 aa, Entamoeba invadens
SRLSRSKKKIQLTRE

SEQ ID NO: 2909104 - protein, 7 aa, Entamoeba invadens
SRLSSAH

SEQ ID NO: 2909105 - protein, 9 aa, Entamoeba invadens
SRLTSKQQL

SEQ ID NO: 2909106 - protein, 7 aa, Entamoeba invadens
SRMTNEE

SEQ ID NO: 2909107 - protein, 6 aa, Entamoeba invadens
SRNAER

SEQ ID NO: 2909108 - protein, 7 aa, Entamoeba invadens
SRNAGIS

SEQ ID NO: 2909109 - protein, 5 aa, Entamoeba invadens
SRNCG

SEQ ID NO: 2909110 - protein, 6 aa, Entamoeba invadens
SRNDDS

SEQ ID NO: 2909111 - protein, 7 aa, Entamoeba invadens
SRNDELG

SEQ ID NO: 2909112 - protein, 5 aa, Entamoeba invadens
SRNDT

SEQ ID NO: 2909113 - protein, 7 aa, Entamoeba invadens
SRNDTDF

SEQ ID NO: 2909114 - protein, 8 aa, Entamoeba invadens
SRNDYTKG

SEQ ID NO: 2909115 - protein, 4 aa, Entamoeba invadens
SRNE

SEQ ID NO: 2909116 - protein, 8 aa, Entamoeba invadens
SRNEFETD

SEQ ID NO: 2909117 - protein, 11 aa, Entamoeba invadens
SRNESESKMGV

SEQ ID NO: 2909118 - protein, 14 aa, Entamoeba invadens
SRNFPPYSKENDMQ

SEQ ID NO: 2909119 - protein, 9 aa, Entamoeba invadens
SRNIASATQ

SEQ ID NO: 2909120 - protein, 10 aa, Entamoeba invadens
SRNKNTQELT

SEQ ID NO: 2909121 - protein, 5 aa, Entamoeba invadens
SRNNN

SEQ ID NO: 2909122 - protein, 8 aa, Entamoeba invadens
SRNPSAIG

SEQ ID NO: 2909123 - protein, 5 aa, Entamoeba invadens
SRNRI

SEQ ID NO: 2909124 - protein, 12 aa, Entamoeba invadens
SRNRSDEFSGLK

SEQ ID NO: 2909125 - protein, 6 aa, Entamoeba invadens
SRNSFE

SEQ ID NO: 2909126 - protein, 7 aa, Entamoeba invadens
SRNSFER

SEQ ID NO: 2909127 - protein, 7 aa, Entamoeba invadens
SRNSGFK

SEQ ID NO: 2909128 - protein, 8 aa, Entamoeba invadens
SRNSLNRA

SEQ ID NO: 2909129 - protein, 6 aa, Entamoeba invadens
SRNTQL

SEQ ID NO: 2909130 - protein, 7 aa, Entamoeba invadens
SRNTSQF

SEQ ID NO: 2909131 - protein, 4 aa, Entamoeba invadens
SRNV

SEQ ID NO: 2909132 - protein, 9 aa, Entamoeba invadens
SRPEENNTF

SEQ ID NO: 2909133 - protein, 7 aa, Entamoeba invadens
SRPEESD

SEQ ID NO: 2909134 - protein, 5 aa, Entamoeba invadens
SRPEP

SEQ ID NO: 2909135 - protein, 4 aa, Entamoeba invadens
SRPG

SEQ ID NO: 2909136 - protein, 9 aa, Entamoeba invadens
SRPGGKEIS

SEQ ID NO: 2909137 - protein, 6 aa, Entamoeba invadens
SRPIGN

SEQ ID NO: 2909138 - protein, 6 aa, Entamoeba invadens
SRPIKY

SEQ ID NO: 2909139 - protein, 11 aa, Entamoeba invadens
SRPISDKLSET

SEQ ID NO: 2909140 - protein, 8 aa, Entamoeba invadens
SRPKANAV

SEQ ID NO: 2909141 - protein, 7 aa, Entamoeba invadens
SRPKIEL

SEQ ID NO: 2909142 - protein, 9 aa, Entamoeba invadens
SRPKKVGQF

SEQ ID NO: 2909143 - protein, 10 aa, Entamoeba invadens
SRPQKSTKYS

SEQ ID NO: 2909144 - protein, 15 aa, Entamoeba invadens
SRPQPLQPSLSQQNL

SEQ ID NO: 2909145 - protein, 8 aa, Entamoeba invadens
SRPSFKNN

SEQ ID NO: 2909146 - protein, 6 aa, Entamoeba invadens
SRPSWT

SEQ ID NO: 2909147 - protein, 5 aa, Entamoeba invadens
SRPTA

SEQ ID NO: 2909148 - protein, 7 aa, Entamoeba invadens
SRPTDIP

SEQ ID NO: 2909149 - protein, 8 aa, Entamoeba invadens
SRPTKKAI

SEQ ID NO: 2909150 - protein, 9 aa, Entamoeba invadens
SRPYNDGGR

SEQ ID NO: 2909151 - protein, 13 aa, Entamoeba invadens
SRQFNDPKTPEIN

SEQ ID NO: 2909152 - protein, 11 aa, Entamoeba invadens
SRQKDNQYIPS

SEQ ID NO: 2909153 - protein, 6 aa, Entamoeba invadens
SRQLNQ

SEQ ID NO: 2909154 - protein, 9 aa, Entamoeba invadens
SRQNEENTF

SEQ ID NO: 2909155 - protein, 6 aa, Entamoeba invadens
SRQNGG

SEQ ID NO: 2909156 - protein, 9 aa, Entamoeba invadens
SRQNNTEKF

SEQ ID NO: 2909157 - protein, 9 aa, Entamoeba invadens
SRQPNPDGV

SEQ ID NO: 2909158 - protein, 8 aa, Entamoeba invadens
SRQPNTTN

SEQ ID NO: 2909159 - protein, 5 aa, Entamoeba invadens
SRQRV

SEQ ID NO: 2909160 - protein, 15 aa, Entamoeba invadens
SRQSGDNITCIVFRI

SEQ ID NO: 2909161 - protein, 6 aa, Entamoeba invadens
SRQSHE

SEQ ID NO: 2909162 - protein, 10 aa, Entamoeba invadens
SRQTTSQKEI

SEQ ID NO: 2909163 - protein, 13 aa, Entamoeba invadens
SRQTTSQPNKYTR

SEQ ID NO: 2909164 - protein, 5 aa, Entamoeba invadens
SRQTV

SEQ ID NO: 2909165 - protein, 7 aa, Entamoeba invadens
SRRAESM

SEQ ID NO: 2909166 - protein, 4 aa, Entamoeba invadens
SRRD

SEQ ID NO: 2909167 - protein, 4 aa, Entamoeba invadens
SRRE

SEQ ID NO: 2909168 - protein, 7 aa, Entamoeba invadens
SRRESEV

SEQ ID NO: 2909169 - protein, 11 aa, Entamoeba invadens
SRRETEETRKL

SEQ ID NO: 2909170 - protein, 6 aa, Entamoeba invadens
SRRGDD

SEQ ID NO: 2909171 - protein, 18 aa, Entamoeba invadens
SRRGKENGELKNAIKGKP

SEQ ID NO: 2909172 - protein, 10 aa, Entamoeba invadens
SRRKKYHGHY

SEQ ID NO: 2909173 - protein, 74 aa, Entamoeba invadens
SRRKREKEERRRRYENDERRDRSDRDSYRRSRDDRHYRSRSRSDSRERRTHDRYRRERSDSHESRLKRGDSSEK

SEQ ID NO: 2909174 - protein, 11 aa, Entamoeba invadens
SRRPETTRENQ

SEQ ID NO: 2909175 - protein, 9 aa, Entamoeba invadens
SRRQRKGAE

SEQ ID NO: 2909176 - protein, 6 aa, Entamoeba invadens
SRRRFT

SEQ ID NO: 2909177 - protein, 19 aa, Entamoeba invadens
SRRRNTRSMHERNSEFGSF

SEQ ID NO: 2909178 - protein, 9 aa, Entamoeba invadens
SRRTSMQGD

SEQ ID NO: 2909179 - protein, 6 aa, Entamoeba invadens
SRRVEG

SEQ ID NO: 2909180 - protein, 8 aa, Entamoeba invadens
SRRYYTNT

SEQ ID NO: 2909181 - protein, 9 aa, Entamoeba invadens
SRSAEAALK

SEQ ID NO: 2909182 - protein, 6 aa, Entamoeba invadens
SRSASL

SEQ ID NO: 2909183 - protein, 6 aa, Entamoeba invadens
SRSCKT

SEQ ID NO: 2909184 - protein, 10 aa, Entamoeba invadens
SRSDAEKSNL

SEQ ID NO: 2909185 - protein, 9 aa, Entamoeba invadens
SRSDEDANE

SEQ ID NO: 2909186 - protein, 8 aa, Entamoeba invadens
SRSDEGYI

SEQ ID NO: 2909187 - protein, 5 aa, Entamoeba invadens
SRSEI

SEQ ID NO: 2909188 - protein, 11 aa, Entamoeba invadens
SRSEKSKMTAE

SEQ ID NO: 2909189 - protein, 6 aa, Entamoeba invadens
SRSERS

SEQ ID NO: 2909190 - protein, 8 aa, Entamoeba invadens
SRSGNSIH

SEQ ID NO: 2909191 - protein, 8 aa, Entamoeba invadens
SRSGSIST

SEQ ID NO: 2909192 - protein, 8 aa, Entamoeba invadens
SRSIQESQ

SEQ ID NO: 2909193 - protein, 5 aa, Entamoeba invadens
SRSKL

SEQ ID NO: 2909194 - protein, 9 aa, Entamoeba invadens
SRSKSPKVA

SEQ ID NO: 2909195 - protein, 6 aa, Entamoeba invadens
SRSLGA

SEQ ID NO: 2909196 - protein, 10 aa, Entamoeba invadens
SRSLSPPVEL

SEQ ID NO: 2909197 - protein, 8 aa, Entamoeba invadens
SRSNASRL

SEQ ID NO: 2909198 - protein, 23 aa, Entamoeba invadens
SRSNSTPKKEKCASTNATRSQLR

SEQ ID NO: 2909199 - protein, 4 aa, Entamoeba invadens
SRSP

SEQ ID NO: 2909200 - protein, 9 aa, Entamoeba invadens
SRSPHENQD

SEQ ID NO: 2909201 - protein, 8 aa, Entamoeba invadens
SRSPSELK

SEQ ID NO: 2909202 - protein, 7 aa, Entamoeba invadens
SRSQPER

SEQ ID NO: 2909203 - protein, 4 aa, Entamoeba invadens
SRSR

SEQ ID NO: 2909204 - protein, 30 aa, Entamoeba invadens
SRSRNSPRKLTRKSVSETMKDLSKTGNSEI

SEQ ID NO: 2909205 - protein, 23 aa, Entamoeba invadens
SRSRSRSESRGATKDEKERPSRT

SEQ ID NO: 2909206 - protein, 13 aa, Entamoeba invadens
SRSSFEKATGNSR

SEQ ID NO: 2909207 - protein, 8 aa, Entamoeba invadens
SRSSFGNV

SEQ ID NO: 2909208 - protein, 9 aa, Entamoeba invadens
SRSSKLQKA

SEQ ID NO: 2909209 - protein, 11 aa, Entamoeba invadens
SRSSPGPQSLK

SEQ ID NO: 2909210 - protein, 10 aa, Entamoeba invadens
SRSSQENQDY

SEQ ID NO: 2909211 - protein, 5 aa, Entamoeba invadens
SRSST

SEQ ID NO: 2909212 - protein, 9 aa, Entamoeba invadens
SRSTSRGEI

SEQ ID NO: 2909213 - protein, 7 aa, Entamoeba invadens
SRSTTEV

SEQ ID NO: 2909214 - protein, 8 aa, Entamoeba invadens
SRSVGESR

SEQ ID NO: 2909215 - protein, 16 aa, Entamoeba invadens
SRSYEQQLKDAYKRSG

SEQ ID NO: 2909216 - protein, 34 aa, Entamoeba invadens
SRTDKKQKKKDKEKKPRKEGVREMKKRKKEELAN

SEQ ID NO: 2909217 - protein, 10 aa, Entamoeba invadens
SRTEEKASKL

SEQ ID NO: 2909218 - protein, 12 aa, Entamoeba invadens
SRTEKSKMTADN

SEQ ID NO: 2909219 - protein, 15 aa, Entamoeba invadens
SRTEMKKGRKKGSIN

SEQ ID NO: 2909220 - protein, 7 aa, Entamoeba invadens
SRTETKL

SEQ ID NO: 2909221 - protein, 5 aa, Entamoeba invadens
SRTFS

SEQ ID NO: 2909222 - protein, 5 aa, Entamoeba invadens
SRTGN

SEQ ID NO: 2909223 - protein, 9 aa, Entamoeba invadens
SRTGSGRYY

SEQ ID NO: 2909224 - protein, 11 aa, Entamoeba invadens
SRTKQSSLNFP

SEQ ID NO: 2909225 - protein, 7 aa, Entamoeba invadens
SRTLNTS

SEQ ID NO: 2909226 - protein, 4 aa, Entamoeba invadens
SRTM

SEQ ID NO: 2909227 - protein, 7 aa, Entamoeba invadens
SRTNGNL

SEQ ID NO: 2909228 - protein, 8 aa, Entamoeba invadens
SRTNGTLS

SEQ ID NO: 2909229 - protein, 7 aa, Entamoeba invadens
SRTNMYD

SEQ ID NO: 2909230 - protein, 5 aa, Entamoeba invadens
SRTNT

SEQ ID NO: 2909231 - protein, 6 aa, Entamoeba invadens
SRTNTK

SEQ ID NO: 2909232 - protein, 6 aa, Entamoeba invadens
SRTPAI

SEQ ID NO: 2909233 - protein, 13 aa, Entamoeba invadens
SRTPELGSPPPHN

SEQ ID NO: 2909234 - protein, 6 aa, Entamoeba invadens
SRTPIG

SEQ ID NO: 2909235 - protein, 8 aa, Entamoeba invadens
SRTPQAKG

SEQ ID NO: 2909236 - protein, 6 aa, Entamoeba invadens
SRTPSL

SEQ ID NO: 2909237 - protein, 6 aa, Entamoeba invadens
SRTQTY

SEQ ID NO: 2909238 - protein, 13 aa, Entamoeba invadens
SRTRQTQDGRQLT

SEQ ID NO: 2909239 - protein, 11 aa, Entamoeba invadens
SRTRSKKVETL

SEQ ID NO: 2909240 - protein, 7 aa, Entamoeba invadens
SRTSGRA

SEQ ID NO: 2909241 - protein, 8 aa, Entamoeba invadens
SRTSKIGT

SEQ ID NO: 2909242 - protein, 8 aa, Entamoeba invadens
SRTSSKGS

SEQ ID NO: 2909243 - protein, 7 aa, Entamoeba invadens
SRTSYEN

SEQ ID NO: 2909244 - protein, 4 aa, Entamoeba invadens
SRTT

SEQ ID NO: 2909245 - protein, 9 aa, Entamoeba invadens
SRTTANSIL

SEQ ID NO: 2909246 - protein, 13 aa, Entamoeba invadens
SRTTEKSDDSDPL

SEQ ID NO: 2909247 - protein, 7 aa, Entamoeba invadens
SRTTPIP

SEQ ID NO: 2909248 - protein, 13 aa, Entamoeba invadens
SRTVNRDTTNSDK

SEQ ID NO: 2909249 - protein, 24 aa, Entamoeba invadens
SRVDYQQKQNESVHQTISKNSELI

SEQ ID NO: 2909250 - protein, 5 aa, Entamoeba invadens
SRVEK

SEQ ID NO: 2909251 - protein, 9 aa, Entamoeba invadens
SRVNRKNQE

SEQ ID NO: 2909252 - protein, 6 aa, Entamoeba invadens
SRVTPR

SEQ ID NO: 2909253 - protein, 6 aa, Entamoeba invadens
SRVTTI

SEQ ID NO: 2909254 - protein, 4 aa, Entamoeba invadens
SRWT

SEQ ID NO: 2909255 - protein, 8 aa, Entamoeba invadens
SRYDETEM

SEQ ID NO: 2909256 - protein, 9 aa, Entamoeba invadens
SRYGENDRL

SEQ ID NO: 2909257 - protein, 16 aa, Entamoeba invadens
SRYKEHNEEMRSSKDI

SEQ ID NO: 2909258 - protein, 7 aa, Entamoeba invadens
SRYNARD

SEQ ID NO: 2909259 - protein, 6 aa, Entamoeba invadens
SRYNPE

SEQ ID NO: 2909260 - protein, 5 aa, Entamoeba invadens
SRYPI

SEQ ID NO: 2909261 - protein, 8 aa, Entamoeba invadens
SRYQPEET

SEQ ID NO: 2909262 - protein, 7 aa, Entamoeba invadens
SRYSGDV

SEQ ID NO: 2909263 - protein, 14 aa, Entamoeba invadens
SRYSSAVSDKVNNI

SEQ ID NO: 2909264 - protein, 14 aa, Entamoeba invadens
SRYTSGKKGAQKVE

SEQ ID NO: 2909265 - protein, 8 aa, Entamoeba invadens
SRYYPKNG

SEQ ID NO: 2909266 - protein, 5 aa, Entamoeba invadens
SSAAT

SEQ ID NO: 2909267 - protein, 8 aa, Entamoeba invadens
SSAEGGYI

SEQ ID NO: 2909268 - protein, 8 aa, Entamoeba invadens
SSAELGNN

SEQ ID NO: 2909269 - protein, 4 aa, Entamoeba invadens
SSAF

SEQ ID NO: 2909270 - protein, 7 aa, Entamoeba invadens
SSAFASK

SEQ ID NO: 2909271 - protein, 12 aa, Entamoeba invadens
SSAFERRCVMCN

SEQ ID NO: 2909272 - protein, 4 aa, Entamoeba invadens
SSAI

SEQ ID NO: 2909273 - protein, 9 aa, Entamoeba invadens
SSAISTEKL

SEQ ID NO: 2909274 - protein, 9 aa, Entamoeba invadens
SSAKEGTNV

SEQ ID NO: 2909275 - protein, 12 aa, Entamoeba invadens
SSAKGTENPNRL

SEQ ID NO: 2909276 - protein, 5 aa, Entamoeba invadens
SSAKN

SEQ ID NO: 2909277 - protein, 6 aa, Entamoeba invadens
SSALNQ

SEQ ID NO: 2909278 - protein, 9 aa, Entamoeba invadens
SSALSSVSL

SEQ ID NO: 2909279 - protein, 14 aa, Entamoeba invadens
SSANLNTCPKSTED

SEQ ID NO: 2909280 - protein, 9 aa, Entamoeba invadens
SSANSKLQE

SEQ ID NO: 2909281 - protein, 8 aa, Entamoeba invadens
SSAPEETP

SEQ ID NO: 2909282 - protein, 6 aa, Entamoeba invadens
SSAPEV

SEQ ID NO: 2909283 - protein, 19 aa, Entamoeba invadens
SSAPSTPSLSHSPRRSTLS

SEQ ID NO: 2909284 - protein, 31 aa, Entamoeba invadens
SSAPTEERGGYNNRDDSDDDDEGQSGAQCQT

SEQ ID NO: 2909285 - protein, 15 aa, Entamoeba invadens
SSAPTEKKTHTKSFD

SEQ ID NO: 2909286 - protein, 9 aa, Entamoeba invadens
SSAPVSGTY

SEQ ID NO: 2909287 - protein, 4 aa, Entamoeba invadens
SSAQ

SEQ ID NO: 2909288 - protein, 8 aa, Entamoeba invadens
SSASDDHM

SEQ ID NO: 2909289 - protein, 12 aa, Entamoeba invadens
SSASEGINSTQK

SEQ ID NO: 2909290 - protein, 5 aa, Entamoeba invadens
SSASL

SEQ ID NO: 2909291 - protein, 7 aa, Entamoeba invadens
SSASLAN

SEQ ID NO: 2909292 - protein, 7 aa, Entamoeba invadens
SSASLNK

SEQ ID NO: 2909293 - protein, 6 aa, Entamoeba invadens
SSATEV

SEQ ID NO: 2909294 - protein, 8 aa, Entamoeba invadens
SSCADGNK

SEQ ID NO: 2909295 - protein, 15 aa, Entamoeba invadens
SSCEQQDLKTQQQYP

SEQ ID NO: 2909296 - protein, 11 aa, Entamoeba invadens
SSCGGGASGES

SEQ ID NO: 2909297 - protein, 12 aa, Entamoeba invadens
SSCGGSCDTTNG

SEQ ID NO: 2909298 - protein, 5 aa, Entamoeba invadens
SSCLS

SEQ ID NO: 2909299 - protein, 5 aa, Entamoeba invadens
SSCNI

SEQ ID NO: 2909300 - protein, 6 aa, Entamoeba invadens
SSCPSD

SEQ ID NO: 2909301 - protein, 16 aa, Entamoeba invadens
SSCSKQCYNTTKREIN

SEQ ID NO: 2909302 - protein, 17 aa, Entamoeba invadens
SSCSTCDGTRPNNCTTC

SEQ ID NO: 2909303 - protein, 8 aa, Entamoeba invadens
SSCTDSTT

SEQ ID NO: 2909304 - protein, 5 aa, Entamoeba invadens
SSCTE

SEQ ID NO: 2909305 - protein, 17 aa, Entamoeba invadens
SSCTPRLSKNNKNNEIP

SEQ ID NO: 2909306 - protein, 7 aa, Entamoeba invadens
SSCTPST

SEQ ID NO: 2909307 - protein, 19 aa, Entamoeba invadens
SSDAIKQRKTRNSKAECNS

SEQ ID NO: 2909308 - protein, 6 aa, Entamoeba invadens
SSDANN

SEQ ID NO: 2909309 - protein, 5 aa, Entamoeba invadens
SSDAT

SEQ ID NO: 2909310 - protein, 8 aa, Entamoeba invadens
SSDATHNV

SEQ ID NO: 2909311 - protein, 11 aa, Entamoeba invadens
SSDCQNTTKTV

SEQ ID NO: 2909312 - protein, 8 aa, Entamoeba invadens
SSDCQSNN

SEQ ID NO: 2909313 - protein, 11 aa, Entamoeba invadens
SSDDIKKVKTG

SEQ ID NO: 2909314 - protein, 8 aa, Entamoeba invadens
SSDDKLAK

SEQ ID NO: 2909315 - protein, 6 aa, Entamoeba invadens
SSDDNE

SEQ ID NO: 2909316 - protein, 9 aa, Entamoeba invadens
SSDDSENKL

SEQ ID NO: 2909317 - protein, 5 aa, Entamoeba invadens
SSDDV

SEQ ID NO: 2909318 - protein, 4 aa, Entamoeba invadens
SSDE

SEQ ID NO: 2909319 - protein, 8 aa, Entamoeba invadens
SSDEEAEF

SEQ ID NO: 2909320 - protein, 5 aa, Entamoeba invadens
SSDEL

SEQ ID NO: 2909321 - protein, 8 aa, Entamoeba invadens
SSDELTQS

SEQ ID NO: 2909322 - protein, 7 aa, Entamoeba invadens
SSDENRN

SEQ ID NO: 2909323 - protein, 4 aa, Entamoeba invadens
SSDF

SEQ ID NO: 2909324 - protein, 5 aa, Entamoeba invadens
SSDFS

SEQ ID NO: 2909325 - protein, 4 aa, Entamoeba invadens
SSDG

SEQ ID NO: 2909326 - protein, 7 aa, Entamoeba invadens
SSDGGVR

SEQ ID NO: 2909327 - protein, 7 aa, Entamoeba invadens
SSDGIDQ

SEQ ID NO: 2909328 - protein, 8 aa, Entamoeba invadens
SSDGRSGV

SEQ ID NO: 2909329 - protein, 7 aa, Entamoeba invadens
SSDGTVK

SEQ ID NO: 2909330 - protein, 6 aa, Entamoeba invadens
SSDGVK

SEQ ID NO: 2909331 - protein, 6 aa, Entamoeba invadens
SSDIAT

SEQ ID NO: 2909332 - protein, 9 aa, Entamoeba invadens
SSDIESGER

SEQ ID NO: 2909333 - protein, 7 aa, Entamoeba invadens
SSDIGQT

SEQ ID NO: 2909334 - protein, 14 aa, Entamoeba invadens
SSDISDENLKKYNQ

SEQ ID NO: 2909335 - protein, 18 aa, Entamoeba invadens
SSDKEKMYQGERSRFQTT

SEQ ID NO: 2909336 - protein, 10 aa, Entamoeba invadens
SSDKGLYETS

SEQ ID NO: 2909337 - protein, 11 aa, Entamoeba invadens
SSDKIENLRRD

SEQ ID NO: 2909338 - protein, 8 aa, Entamoeba invadens
SSDKKQQL

SEQ ID NO: 2909339 - protein, 36 aa, Entamoeba invadens
SSDKLSRVSPRVSARTTPLHSPTPKTSPVPSPKRQS

SEQ ID NO: 2909340 - protein, 6 aa, Entamoeba invadens
SSDKPI

SEQ ID NO: 2909341 - protein, 9 aa, Entamoeba invadens
SSDKQRSCT

SEQ ID NO: 2909342 - protein, 5 aa, Entamoeba invadens
SSDKR

SEQ ID NO: 2909343 - protein, 19 aa, Entamoeba invadens
SSDKSGKMYYEENKTEVLE

SEQ ID NO: 2909344 - protein, 20 aa, Entamoeba invadens
SSDKTDMPCNPNNKTPTPTL

SEQ ID NO: 2909345 - protein, 5 aa, Entamoeba invadens
SSDLI

SEQ ID NO: 2909346 - protein, 10 aa, Entamoeba invadens
SSDLKTNEEA

SEQ ID NO: 2909347 - protein, 50 aa, Entamoeba invadens
SSDLSKDSLVRNEDLDRRIKDRRRRQKEKEKEKERSKESPKSQDGKVEKS

SEQ ID NO: 2909348 - protein, 9 aa, Entamoeba invadens
SSDMSGKED

SEQ ID NO: 2909349 - protein, 9 aa, Entamoeba invadens
SSDMSGKEN

SEQ ID NO: 2909350 - protein, 5 aa, Entamoeba invadens
SSDNG

SEQ ID NO: 2909351 - protein, 6 aa, Entamoeba invadens
SSDNIE

SEQ ID NO: 2909352 - protein, 6 aa, Entamoeba invadens
SSDNIQ

SEQ ID NO: 2909353 - protein, 9 aa, Entamoeba invadens
SSDNKGFTR

SEQ ID NO: 2909354 - protein, 7 aa, Entamoeba invadens
SSDPKDV

SEQ ID NO: 2909355 - protein, 7 aa, Entamoeba invadens
SSDPSFV

SEQ ID NO: 2909356 - protein, 7 aa, Entamoeba invadens
SSDPSIV

SEQ ID NO: 2909357 - protein, 9 aa, Entamoeba invadens
SSDPTRLDE

SEQ ID NO: 2909358 - protein, 8 aa, Entamoeba invadens
SSDPYATS

SEQ ID NO: 2909359 - protein, 15 aa, Entamoeba invadens
SSDQSADNISIVLCR

SEQ ID NO: 2909360 - protein, 6 aa, Entamoeba invadens
SSDQVS

SEQ ID NO: 2909361 - protein, 7 aa, Entamoeba invadens
SSDQYSK

SEQ ID NO: 2909362 - protein, 7 aa, Entamoeba invadens
SSDRTKL

SEQ ID NO: 2909363 - protein, 6 aa, Entamoeba invadens
SSDSDI

SEQ ID NO: 2909364 - protein, 22 aa, Entamoeba invadens
SSDSEEGRHKESPLPIDDESRQ

SEQ ID NO: 2909365 - protein, 11 aa, Entamoeba invadens
SSDSQKHRKNI

SEQ ID NO: 2909366 - protein, 18 aa, Entamoeba invadens
SSDSSDSSSDSSSSFSPE

SEQ ID NO: 2909367 - protein, 12 aa, Entamoeba invadens
SSDSSSKNDEEK

SEQ ID NO: 2909368 - protein, 5 aa, Entamoeba invadens
SSDST

SEQ ID NO: 2909369 - protein, 13 aa, Entamoeba invadens
SSDSTTASLSDTI

SEQ ID NO: 2909370 - protein, 4 aa, Entamoeba invadens
SSDV

SEQ ID NO: 2909371 - protein, 7 aa, Entamoeba invadens
SSDVADK

SEQ ID NO: 2909372 - protein, 5 aa, Entamoeba invadens
SSDYN

SEQ ID NO: 2909373 - protein, 7 aa, Entamoeba invadens
SSDYTFS

SEQ ID NO: 2909374 - protein, 8 aa, Entamoeba invadens
SSEAKAIE

SEQ ID NO: 2909375 - protein, 12 aa, Entamoeba invadens
SSEASQTFGNPP

SEQ ID NO: 2909376 - protein, 10 aa, Entamoeba invadens
SSEAVKEKTL

SEQ ID NO: 2909377 - protein, 6 aa, Entamoeba invadens
SSECNE

SEQ ID NO: 2909378 - protein, 4 aa, Entamoeba invadens
SSED

SEQ ID NO: 2909379 - protein, 8 aa, Entamoeba invadens
SSEDDEEN

SEQ ID NO: 2909380 - protein, 7 aa, Entamoeba invadens
SSEDEGI

SEQ ID NO: 2909381 - protein, 10 aa, Entamoeba invadens
SSEDQSIRST

SEQ ID NO: 2909382 - protein, 9 aa, Entamoeba invadens
SSEEAEVDD

SEQ ID NO: 2909383 - protein, 14 aa, Entamoeba invadens
SSEEAYKECEGNEK

SEQ ID NO: 2909384 - protein, 21 aa, Entamoeba invadens
SSEEEEVSARQINSKIEGKSD

SEQ ID NO: 2909385 - protein, 18 aa, Entamoeba invadens
SSEEKLKQQDNNDQLDEL

SEQ ID NO: 2909386 - protein, 8 aa, Entamoeba invadens
SSEEQKGV

SEQ ID NO: 2909387 - protein, 7 aa, Entamoeba invadens
SSEETLN

SEQ ID NO: 2909388 - protein, 30 aa, Entamoeba invadens
SSEETQSLNSNTSQSSEESGHSETKASPLL

SEQ ID NO: 2909389 - protein, 4 aa, Entamoeba invadens
SSEF

SEQ ID NO: 2909390 - protein, 7 aa, Entamoeba invadens
SSEFEPQ

SEQ ID NO: 2909391 - protein, 8 aa, Entamoeba invadens
SSEFESGK

SEQ ID NO: 2909392 - protein, 8 aa, Entamoeba invadens
SSEFKDNT

SEQ ID NO: 2909393 - protein, 6 aa, Entamoeba invadens
SSEFPT

SEQ ID NO: 2909394 - protein, 7 aa, Entamoeba invadens
SSEFPTD

SEQ ID NO: 2909395 - protein, 6 aa, Entamoeba invadens
SSEGEI

SEQ ID NO: 2909396 - protein, 7 aa, Entamoeba invadens
SSEGEVN

SEQ ID NO: 2909397 - protein, 7 aa, Entamoeba invadens
SSEGVES

SEQ ID NO: 2909398 - protein, 6 aa, Entamoeba invadens
SSEHNG

SEQ ID NO: 2909399 - protein, 8 aa, Entamoeba invadens
SSEIKDSE

SEQ ID NO: 2909400 - protein, 5 aa, Entamoeba invadens
SSEIR

SEQ ID NO: 2909401 - protein, 14 aa, Entamoeba invadens
SSEKEKKKIFNGGQ

SEQ ID NO: 2909402 - protein, 7 aa, Entamoeba invadens
SSEKEKL

SEQ ID NO: 2909403 - protein, 8 aa, Entamoeba invadens
SSEKFDDE

SEQ ID NO: 2909404 - protein, 9 aa, Entamoeba invadens
SSEKGSPVV

SEQ ID NO: 2909405 - protein, 6 aa, Entamoeba invadens
SSEKIE

SEQ ID NO: 2909406 - protein, 10 aa, Entamoeba invadens
SSEKKKLQYE

SEQ ID NO: 2909407 - protein, 18 aa, Entamoeba invadens
SSEKTNGVSEKTLHRRRQ

SEQ ID NO: 2909408 - protein, 12 aa, Entamoeba invadens
SSELELKTRADK

SEQ ID NO: 2909409 - protein, 10 aa, Entamoeba invadens
SSEMPSRDTE

SEQ ID NO: 2909410 - protein, 5 aa, Entamoeba invadens
SSENI

SEQ ID NO: 2909411 - protein, 6 aa, Entamoeba invadens
SSENIN

SEQ ID NO: 2909412 - protein, 5 aa, Entamoeba invadens
SSENS

SEQ ID NO: 2909413 - protein, 9 aa, Entamoeba invadens
SSENTRERY

SEQ ID NO: 2909414 - protein, 5 aa, Entamoeba invadens
SSEPN

SEQ ID NO: 2909415 - protein, 10 aa, Entamoeba invadens
SSEPRQNEEK

SEQ ID NO: 2909416 - protein, 14 aa, Entamoeba invadens
SSEPSFDPLKDDKE

SEQ ID NO: 2909417 - protein, 4 aa, Entamoeba invadens
SSEQ

SEQ ID NO: 2909418 - protein, 16 aa, Entamoeba invadens
SSEQEQDIEDNQQKEV

SEQ ID NO: 2909419 - protein, 5 aa, Entamoeba invadens
SSEQK

SEQ ID NO: 2909420 - protein, 7 aa, Entamoeba invadens
SSEQTPD

SEQ ID NO: 2909421 - protein, 6 aa, Entamoeba invadens
SSEQYS

SEQ ID NO: 2909422 - protein, 4 aa, Entamoeba invadens
SSER

SEQ ID NO: 2909423 - protein, 5 aa, Entamoeba invadens
SSERE

SEQ ID NO: 2909424 - protein, 7 aa, Entamoeba invadens
SSERLSR

SEQ ID NO: 2909425 - protein, 6 aa, Entamoeba invadens
SSESDK

SEQ ID NO: 2909426 - protein, 6 aa, Entamoeba invadens
SSESFA

SEQ ID NO: 2909427 - protein, 36 aa, Entamoeba invadens
SSESFEEDRVKSASKSEDKTKKLATEKGKTKGIESD

SEQ ID NO: 2909428 - protein, 15 aa, Entamoeba invadens
SSESGVKGKETVTKF

SEQ ID NO: 2909429 - protein, 7 aa, Entamoeba invadens
SSESIEY

SEQ ID NO: 2909430 - protein, 7 aa, Entamoeba invadens
SSESLNS

SEQ ID NO: 2909431 - protein, 15 aa, Entamoeba invadens
SSESQPTPPPEDDDQ

SEQ ID NO: 2909432 - protein, 10 aa, Entamoeba invadens
SSESRKELYK

SEQ ID NO: 2909433 - protein, 79 aa, Entamoeba invadens
SSESSESTDSKEEKSAESTTSTESSESSEEIKETNDTPTQLTTEEKLQPTTSTQKSLQEDDTKNQKKQNPTSTQEDPAY

SEQ ID NO: 2909434 - protein, 4 aa, Entamoeba invadens
SSET

SEQ ID NO: 2909435 - protein, 9 aa, Entamoeba invadens
SSETEAAKK

SEQ ID NO: 2909436 - protein, 20 aa, Entamoeba invadens
SSETEDDSEEEDKSRYNELE

SEQ ID NO: 2909437 - protein, 8 aa, Entamoeba invadens
SSETITKS

SEQ ID NO: 2909438 - protein, 6 aa, Entamoeba invadens
SSETLS

SEQ ID NO: 2909439 - protein, 6 aa, Entamoeba invadens
SSETQT

SEQ ID NO: 2909440 - protein, 5 aa, Entamoeba invadens
SSETV

SEQ ID NO: 2909441 - protein, 14 aa, Entamoeba invadens
SSEVSDELSTSKEM

SEQ ID NO: 2909442 - protein, 7 aa, Entamoeba invadens
SSEWSDG

SEQ ID NO: 2909443 - protein, 13 aa, Entamoeba invadens
SSEYEVQDATTIG

SEQ ID NO: 2909444 - protein, 6 aa, Entamoeba invadens
SSFCSE

SEQ ID NO: 2909445 - protein, 14 aa, Entamoeba invadens
SSFDCSDTECTVDE

SEQ ID NO: 2909446 - protein, 7 aa, Entamoeba invadens
SSFDEKS

SEQ ID NO: 2909447 - protein, 9 aa, Entamoeba invadens
SSFDQEAAT

SEQ ID NO: 2909448 - protein, 6 aa, Entamoeba invadens
SSFDSK

SEQ ID NO: 2909449 - protein, 15 aa, Entamoeba invadens
SSFEEAKYGPKKENR

SEQ ID NO: 2909450 - protein, 5 aa, Entamoeba invadens
SSFEG

SEQ ID NO: 2909451 - protein, 5 aa, Entamoeba invadens
SSFEK

SEQ ID NO: 2909452 - protein, 18 aa, Entamoeba invadens
SSFENGKKSVLEYLIKNN

SEQ ID NO: 2909453 - protein, 4 aa, Entamoeba invadens
SSFG

SEQ ID NO: 2909454 - protein, 14 aa, Entamoeba invadens
SSFGDVKGASEKET

SEQ ID NO: 2909455 - protein, 6 aa, Entamoeba invadens
SSFGHG

SEQ ID NO: 2909456 - protein, 4 aa, Entamoeba invadens
SSFK

SEQ ID NO: 2909457 - protein, 10 aa, Entamoeba invadens
SSFNDSTSSF

SEQ ID NO: 2909458 - protein, 6 aa, Entamoeba invadens
SSFPDE

SEQ ID NO: 2909459 - protein, 5 aa, Entamoeba invadens
SSFPR

SEQ ID NO: 2909460 - protein, 11 aa, Entamoeba invadens
SSFQAPSQMTK

SEQ ID NO: 2909461 - protein, 6 aa, Entamoeba invadens
SSFQDC

SEQ ID NO: 2909462 - protein, 7 aa, Entamoeba invadens
SSFSPTF

SEQ ID NO: 2909463 - protein, 15 aa, Entamoeba invadens
SSFTQKKVKRGGDTS

SEQ ID NO: 2909464 - protein, 12 aa, Entamoeba invadens
SSFTQVKPRPLT

SEQ ID NO: 2909465 - protein, 4 aa, Entamoeba invadens
SSGA

SEQ ID NO: 2909466 - protein, 9 aa, Entamoeba invadens
SSGADTQAS

SEQ ID NO: 2909467 - protein, 10 aa, Entamoeba invadens
SSGAEKSGAV

SEQ ID NO: 2909468 - protein, 8 aa, Entamoeba invadens
SSGAKPST

SEQ ID NO: 2909469 - protein, 5 aa, Entamoeba invadens
SSGDR

SEQ ID NO: 2909470 - protein, 9 aa, Entamoeba invadens
SSGERDMST

SEQ ID NO: 2909471 - protein, 12 aa, Entamoeba invadens
SSGESPIQTSGR

SEQ ID NO: 2909472 - protein, 6 aa, Entamoeba invadens
SSGEYD

SEQ ID NO: 2909473 - protein, 7 aa, Entamoeba invadens
SSGFEES

SEQ ID NO: 2909474 - protein, 10 aa, Entamoeba invadens
SSGFGKNQSG

SEQ ID NO: 2909475 - protein, 8 aa, Entamoeba invadens
SSGGGKNP

SEQ ID NO: 2909476 - protein, 7 aa, Entamoeba invadens
SSGGNSY

SEQ ID NO: 2909477 - protein, 8 aa, Entamoeba invadens
SSGGRSLQ

SEQ ID NO: 2909478 - protein, 4 aa, Entamoeba invadens
SSGK

SEQ ID NO: 2909479 - protein, 8 aa, Entamoeba invadens
SSGKDVSV

SEQ ID NO: 2909480 - protein, 11 aa, Entamoeba invadens
SSGKEKDEARN

SEQ ID NO: 2909481 - protein, 7 aa, Entamoeba invadens
SSGKGQL

SEQ ID NO: 2909482 - protein, 6 aa, Entamoeba invadens
SSGKGV

SEQ ID NO: 2909483 - protein, 5 aa, Entamoeba invadens
SSGKH

SEQ ID NO: 2909484 - protein, 6 aa, Entamoeba invadens
SSGKNA

SEQ ID NO: 2909485 - protein, 6 aa, Entamoeba invadens
SSGKRL

SEQ ID NO: 2909486 - protein, 15 aa, Entamoeba invadens
SSGKRPQIELEDEEH

SEQ ID NO: 2909487 - protein, 5 aa, Entamoeba invadens
SSGKS

SEQ ID NO: 2909488 - protein, 9 aa, Entamoeba invadens
SSGKSDNTT

SEQ ID NO: 2909489 - protein, 7 aa, Entamoeba invadens
SSGKSKD

SEQ ID NO: 2909490 - protein, 8 aa, Entamoeba invadens
SSGKTSKE

SEQ ID NO: 2909491 - protein, 13 aa, Entamoeba invadens
SSGKYPKESENYK

SEQ ID NO: 2909492 - protein, 12 aa, Entamoeba invadens
SSGLTSLPSHEK

SEQ ID NO: 2909493 - protein, 8 aa, Entamoeba invadens
SSGMEEIS

SEQ ID NO: 2909494 - protein, 23 aa, Entamoeba invadens
SSGMSQTSQQNNSQAPVSPDNQG

SEQ ID NO: 2909495 - protein, 7 aa, Entamoeba invadens
SSGNRHL

SEQ ID NO: 2909496 - protein, 8 aa, Entamoeba invadens
SSGNTNKV

SEQ ID NO: 2909497 - protein, 6 aa, Entamoeba invadens
SSGPFN

SEQ ID NO: 2909498 - protein, 11 aa, Entamoeba invadens
SSGPPAKSHIP

SEQ ID NO: 2909499 - protein, 5 aa, Entamoeba invadens
SSGQF

SEQ ID NO: 2909500 - protein, 9 aa, Entamoeba invadens
SSGRAPNNF

SEQ ID NO: 2909501 - protein, 8 aa, Entamoeba invadens
SSGRKEHI

SEQ ID NO: 2909502 - protein, 9 aa, Entamoeba invadens
SSGRPPVSY

SEQ ID NO: 2909503 - protein, 9 aa, Entamoeba invadens
SSGRTLGGA

SEQ ID NO: 2909504 - protein, 8 aa, Entamoeba invadens
SSGSGIKT

SEQ ID NO: 2909505 - protein, 7 aa, Entamoeba invadens
SSGSGRY

SEQ ID NO: 2909506 - protein, 17 aa, Entamoeba invadens
SSGSPTPNDSKNNSDKE

SEQ ID NO: 2909507 - protein, 8 aa, Entamoeba invadens
SSGSPVAS

SEQ ID NO: 2909508 - protein, 9 aa, Entamoeba invadens
SSGSQGGEI

SEQ ID NO: 2909509 - protein, 7 aa, Entamoeba invadens
SSGSQYH

SEQ ID NO: 2909510 - protein, 18 aa, Entamoeba invadens
SSGTDPECKFGTKSDHDK

SEQ ID NO: 2909511 - protein, 7 aa, Entamoeba invadens
SSGTFKG

SEQ ID NO: 2909512 - protein, 5 aa, Entamoeba invadens
SSGTT

SEQ ID NO: 2909513 - protein, 9 aa, Entamoeba invadens
SSGTTQNLS

SEQ ID NO: 2909514 - protein, 7 aa, Entamoeba invadens
SSGTVEE

SEQ ID NO: 2909515 - protein, 8 aa, Entamoeba invadens
SSGVGKTS

SEQ ID NO: 2909516 - protein, 53 aa, Entamoeba invadens
SSHASGGSAPPPPGDLAPPPGLAPPPGMMPPPPGPPPPSNSKMPAPSSAGRGD

SEQ ID NO: 2909517 - protein, 10 aa, Entamoeba invadens
SSHDSQDSQG

SEQ ID NO: 2909518 - protein, 4 aa, Entamoeba invadens
SSHE

SEQ ID NO: 2909519 - protein, 7 aa, Entamoeba invadens
SSHFSSK

SEQ ID NO: 2909520 - protein, 10 aa, Entamoeba invadens
SSHKNSLSAN

SEQ ID NO: 2909521 - protein, 9 aa, Entamoeba invadens
SSHNPKPWN

SEQ ID NO: 2909522 - protein, 7 aa, Entamoeba invadens
SSHPNSS

SEQ ID NO: 2909523 - protein, 6 aa, Entamoeba invadens
SSHRSK

SEQ ID NO: 2909524 - protein, 9 aa, Entamoeba invadens
SSHSNLKDP

SEQ ID NO: 2909525 - protein, 7 aa, Entamoeba invadens
SSHSQIS

SEQ ID NO: 2909526 - protein, 5 aa, Entamoeba invadens
SSHTV

SEQ ID NO: 2909527 - protein, 12 aa, Entamoeba invadens
SSHVESGKEACH

SEQ ID NO: 2909528 - protein, 11 aa, Entamoeba invadens
SSHVESGREAC

SEQ ID NO: 2909529 - protein, 16 aa, Entamoeba invadens
SSHVNENQNAQEVPVD

SEQ ID NO: 2909530 - protein, 4 aa, Entamoeba invadens
SSIA

SEQ ID NO: 2909531 - protein, 7 aa, Entamoeba invadens
SSIDESD

SEQ ID NO: 2909532 - protein, 10 aa, Entamoeba invadens
SSIDNNRSPI

SEQ ID NO: 2909533 - protein, 9 aa, Entamoeba invadens
SSIDPRTFE

SEQ ID NO: 2909534 - protein, 6 aa, Entamoeba invadens
SSIDPT

SEQ ID NO: 2909535 - protein, 7 aa, Entamoeba invadens
SSIDTDY

SEQ ID NO: 2909536 - protein, 19 aa, Entamoeba invadens
SSIDTKSKEDNTSQNNNKI

SEQ ID NO: 2909537 - protein, 4 aa, Entamoeba invadens
SSIE

SEQ ID NO: 2909538 - protein, 7 aa, Entamoeba invadens
SSIEEPR

SEQ ID NO: 2909539 - protein, 18 aa, Entamoeba invadens
SSIEGSMAKSKLTRLEQE

SEQ ID NO: 2909540 - protein, 15 aa, Entamoeba invadens
SSIEKNINEKENENV

SEQ ID NO: 2909541 - protein, 4 aa, Entamoeba invadens
SSIG

SEQ ID NO: 2909542 - protein, 11 aa, Entamoeba invadens
SSIHTASSDYR

SEQ ID NO: 2909543 - protein, 4 aa, Entamoeba invadens
SSIK

SEQ ID NO: 2909544 - protein, 5 aa, Entamoeba invadens
SSIKD

SEQ ID NO: 2909545 - protein, 13 aa, Entamoeba invadens
SSIKETEELKRLL

SEQ ID NO: 2909546 - protein, 25 aa, Entamoeba invadens
SSIKSSMKSSVKRSLGKFSEESTQA

SEQ ID NO: 2909547 - protein, 32 aa, Entamoeba invadens
SSIKTGGKCEKESKQFENKETKCPEIHEETDK

SEQ ID NO: 2909548 - protein, 15 aa, Entamoeba invadens
SSINPKLSQSVANTQ

SEQ ID NO: 2909549 - protein, 6 aa, Entamoeba invadens
SSINTR

SEQ ID NO: 2909550 - protein, 17 aa, Entamoeba invadens
SSIPANDKKELLKGSFN

SEQ ID NO: 2909551 - protein, 9 aa, Entamoeba invadens
SSIPDDTKN

SEQ ID NO: 2909552 - protein, 12 aa, Entamoeba invadens
SSIPDMKDDPLM

SEQ ID NO: 2909553 - protein, 7 aa, Entamoeba invadens
SSIPNAD

SEQ ID NO: 2909554 - protein, 7 aa, Entamoeba invadens
SSIPPKD

SEQ ID NO: 2909555 - protein, 7 aa, Entamoeba invadens
SSIQNGG

SEQ ID NO: 2909556 - protein, 22 aa, Entamoeba invadens
SSIQQNQKQKEKEWNYNGQQSA

SEQ ID NO: 2909557 - protein, 8 aa, Entamoeba invadens
SSIQRSIS

SEQ ID NO: 2909558 - protein, 14 aa, Entamoeba invadens
SSIQTSSNKRQITA

SEQ ID NO: 2909559 - protein, 16 aa, Entamoeba invadens
SSIRNEAFKQKSKDNI

SEQ ID NO: 2909560 - protein, 5 aa, Entamoeba invadens
SSIRS

SEQ ID NO: 2909561 - protein, 8 aa, Entamoeba invadens
SSIRSGSV

SEQ ID NO: 2909562 - protein, 4 aa, Entamoeba invadens
SSIS

SEQ ID NO: 2909563 - protein, 5 aa, Entamoeba invadens
SSISD

SEQ ID NO: 2909564 - protein, 6 aa, Entamoeba invadens
SSISLD

SEQ ID NO: 2909565 - protein, 14 aa, Entamoeba invadens
SSISQEDFDSDVQP

SEQ ID NO: 2909566 - protein, 5 aa, Entamoeba invadens
SSITF

SEQ ID NO: 2909567 - protein, 11 aa, Entamoeba invadens
SSITRSEDIEE

SEQ ID NO: 2909568 - protein, 5 aa, Entamoeba invadens
SSITT

SEQ ID NO: 2909569 - protein, 7 aa, Entamoeba invadens
SSITTPL

SEQ ID NO: 2909570 - protein, 5 aa, Entamoeba invadens
SSIVP

SEQ ID NO: 2909571 - protein, 9 aa, Entamoeba invadens
SSKAEEMEG

SEQ ID NO: 2909572 - protein, 7 aa, Entamoeba invadens
SSKAFAG

SEQ ID NO: 2909573 - protein, 8 aa, Entamoeba invadens
SSKAFGSI

SEQ ID NO: 2909574 - protein, 7 aa, Entamoeba invadens
SSKAFTN

SEQ ID NO: 2909575 - protein, 8 aa, Entamoeba invadens
SSKAPLDS

SEQ ID NO: 2909576 - protein, 10 aa, Entamoeba invadens
SSKASHIPYR

SEQ ID NO: 2909577 - protein, 16 aa, Entamoeba invadens
SSKASQNIQTQQQEPV

SEQ ID NO: 2909578 - protein, 11 aa, Entamoeba invadens
SSKATSFSLPT

SEQ ID NO: 2909579 - protein, 8 aa, Entamoeba invadens
SSKAVNVN

SEQ ID NO: 2909580 - protein, 4 aa, Entamoeba invadens
SSKD

SEQ ID NO: 2909581 - protein, 11 aa, Entamoeba invadens
SSKDKERKDEF

SEQ ID NO: 2909582 - protein, 20 aa, Entamoeba invadens
SSKDLKEQPTTPKDKEKYSL

SEQ ID NO: 2909583 - protein, 15 aa, Entamoeba invadens
SSKDNPKKSQSPLIK

SEQ ID NO: 2909584 - protein, 6 aa, Entamoeba invadens
SSKDPD

SEQ ID NO: 2909585 - protein, 5 aa, Entamoeba invadens
SSKEC

SEQ ID NO: 2909586 - protein, 13 aa, Entamoeba invadens
SSKEFEKKKDEIV

SEQ ID NO: 2909587 - protein, 10 aa, Entamoeba invadens
SSKEKFNTEL

SEQ ID NO: 2909588 - protein, 6 aa, Entamoeba invadens
SSKESN

SEQ ID NO: 2909589 - protein, 55 aa, Entamoeba invadens
SSKETGFSFGATPSNPFQNTTSGGDGQQNQLGSQEAEDDRAAAKELEAETDTKDY

SEQ ID NO: 2909590 - protein, 22 aa, Entamoeba invadens
SSKETIDQLNQQNSSQSNQMSK

SEQ ID NO: 2909591 - protein, 9 aa, Entamoeba invadens
SSKEYKGKE

SEQ ID NO: 2909592 - protein, 10 aa, Entamoeba invadens
SSKFGTNDPQ

SEQ ID NO: 2909593 - protein, 8 aa, Entamoeba invadens
SSKFQTDF

SEQ ID NO: 2909594 - protein, 4 aa, Entamoeba invadens
SSKG

SEQ ID NO: 2909595 - protein, 7 aa, Entamoeba invadens
SSKGAFK

SEQ ID NO: 2909596 - protein, 9 aa, Entamoeba invadens
SSKGDEYIP

SEQ ID NO: 2909597 - protein, 14 aa, Entamoeba invadens
SSKGEEMTKKLGAK

SEQ ID NO: 2909598 - protein, 52 aa, Entamoeba invadens
SSKGGSSSSGGVVGNDVTSSVGEACREAEDIERNLNEEERKACSVSEENKDI

SEQ ID NO: 2909599 - protein, 10 aa, Entamoeba invadens
SSKGSVPKRM

SEQ ID NO: 2909600 - protein, 13 aa, Entamoeba invadens
SSKGTTGQENPYF

SEQ ID NO: 2909601 - protein, 9 aa, Entamoeba invadens
SSKGYEAAP

SEQ ID NO: 2909602 - protein, 6 aa, Entamoeba invadens
SSKHGD

SEQ ID NO: 2909603 - protein, 8 aa, Entamoeba invadens
SSKHGRLT

SEQ ID NO: 2909604 - protein, 26 aa, Entamoeba invadens
SSKHSVNTRSSTLSTGQTTQGKNDAN

SEQ ID NO: 2909605 - protein, 42 aa, Entamoeba invadens
SSKIEKVDNCDDEETLEIPNDDTQIEKLENSTISTQPTKSNL

SEQ ID NO: 2909606 - protein, 16 aa, Entamoeba invadens
SSKIKPKSLKLNNKVI

SEQ ID NO: 2909607 - protein, 8 aa, Entamoeba invadens
SSKIRKQT

SEQ ID NO: 2909608 - protein, 10 aa, Entamoeba invadens
SSKKAEEEKN

SEQ ID NO: 2909609 - protein, 5 aa, Entamoeba invadens
SSKKD

SEQ ID NO: 2909610 - protein, 25 aa, Entamoeba invadens
SSKKDFDKFATKKTDVEKKPRKIEN

SEQ ID NO: 2909611 - protein, 8 aa, Entamoeba invadens
SSKKTAGV

SEQ ID NO: 2909612 - protein, 46 aa, Entamoeba invadens
SSKKVVPKQTHNEEDTVGSKVPPSVMPKESITKEGVIAPSKKEKKT

SEQ ID NO: 2909613 - protein, 7 aa, Entamoeba invadens
SSKKYEY

SEQ ID NO: 2909614 - protein, 19 aa, Entamoeba invadens
SSKLDPDELKENTKLGEGS

SEQ ID NO: 2909615 - protein, 7 aa, Entamoeba invadens
SSKLGGN

SEQ ID NO: 2909616 - protein, 9 aa, Entamoeba invadens
SSKLNNDKI

SEQ ID NO: 2909617 - protein, 12 aa, Entamoeba invadens
SSKLSETKKING

SEQ ID NO: 2909618 - protein, 4 aa, Entamoeba invadens
SSKN

SEQ ID NO: 2909619 - protein, 7 aa, Entamoeba invadens
SSKNEDV

SEQ ID NO: 2909620 - protein, 10 aa, Entamoeba invadens
SSKNEKSTSW

SEQ ID NO: 2909621 - protein, 8 aa, Entamoeba invadens
SSKNEVLN

SEQ ID NO: 2909622 - protein, 12 aa, Entamoeba invadens
SSKNFNKTPIKN

SEQ ID NO: 2909623 - protein, 14 aa, Entamoeba invadens
SSKNFRSDGGSSFI

SEQ ID NO: 2909624 - protein, 8 aa, Entamoeba invadens
SSKNFTGK

SEQ ID NO: 2909625 - protein, 5 aa, Entamoeba invadens
SSKNG

SEQ ID NO: 2909626 - protein, 9 aa, Entamoeba invadens
SSKNGTGMD

SEQ ID NO: 2909627 - protein, 26 aa, Entamoeba invadens
SSKNNSKNSSGTNTPINESSPAMDIA

SEQ ID NO: 2909628 - protein, 12 aa, Entamoeba invadens
SSKNSRSKSFGE

SEQ ID NO: 2909629 - protein, 8 aa, Entamoeba invadens
SSKNTKQF

SEQ ID NO: 2909630 - protein, 8 aa, Entamoeba invadens
SSKNTPNK

SEQ ID NO: 2909631 - protein, 8 aa, Entamoeba invadens
SSKPDEHH

SEQ ID NO: 2909632 - protein, 19 aa, Entamoeba invadens
SSKPKPAPAQVYKGNEKQL

SEQ ID NO: 2909633 - protein, 6 aa, Entamoeba invadens
SSKPRF

SEQ ID NO: 2909634 - protein, 33 aa, Entamoeba invadens
SSKPSLSSTPVVTTSTPQANKKERKASVADSTL

SEQ ID NO: 2909635 - protein, 14 aa, Entamoeba invadens
SSKPSNRAGSKAYM

SEQ ID NO: 2909636 - protein, 9 aa, Entamoeba invadens
SSKQETFQR

SEQ ID NO: 2909637 - protein, 10 aa, Entamoeba invadens
SSKQFPSSKF

SEQ ID NO: 2909638 - protein, 5 aa, Entamoeba invadens
SSKQH

SEQ ID NO: 2909639 - protein, 7 aa, Entamoeba invadens
SSKQHRK

SEQ ID NO: 2909640 - protein, 21 aa, Entamoeba invadens
SSKQKRKKHFSTNKTVELEPR

SEQ ID NO: 2909641 - protein, 9 aa, Entamoeba invadens
SSKQKVETQ

SEQ ID NO: 2909642 - protein, 5 aa, Entamoeba invadens
SSKQL

SEQ ID NO: 2909643 - protein, 10 aa, Entamoeba invadens
SSKQLPSHQQ

SEQ ID NO: 2909644 - protein, 10 aa, Entamoeba invadens
SSKQRSDMSM

SEQ ID NO: 2909645 - protein, 7 aa, Entamoeba invadens
SSKQSGE

SEQ ID NO: 2909646 - protein, 9 aa, Entamoeba invadens
SSKRENSVF

SEQ ID NO: 2909647 - protein, 8 aa, Entamoeba invadens
SSKSCDDT

SEQ ID NO: 2909648 - protein, 6 aa, Entamoeba invadens
SSKSDL

SEQ ID NO: 2909649 - protein, 5 aa, Entamoeba invadens
SSKSE

SEQ ID NO: 2909650 - protein, 7 aa, Entamoeba invadens
SSKSEVK

SEQ ID NO: 2909651 - protein, 9 aa, Entamoeba invadens
SSKSGNNIP

SEQ ID NO: 2909652 - protein, 17 aa, Entamoeba invadens
SSKSLHSDSDLNSSSFS

SEQ ID NO: 2909653 - protein, 19 aa, Entamoeba invadens
SSKSNSRSSSIGQTLTPKD

SEQ ID NO: 2909654 - protein, 13 aa, Entamoeba invadens
SSKSQNVESAPPL

SEQ ID NO: 2909655 - protein, 9 aa, Entamoeba invadens
SSKSSDEVT

SEQ ID NO: 2909656 - protein, 8 aa, Entamoeba invadens
SSKSVTAA

SEQ ID NO: 2909657 - protein, 5 aa, Entamoeba invadens
SSKSY

SEQ ID NO: 2909658 - protein, 9 aa, Entamoeba invadens
SSKSYETTH

SEQ ID NO: 2909659 - protein, 7 aa, Entamoeba invadens
SSKSYTF

SEQ ID NO: 2909660 - protein, 7 aa, Entamoeba invadens
SSKTGAA

SEQ ID NO: 2909661 - protein, 13 aa, Entamoeba invadens
SSKTGDNTKETYN

SEQ ID NO: 2909662 - protein, 10 aa, Entamoeba invadens
SSKTGENIQN

SEQ ID NO: 2909663 - protein, 11 aa, Entamoeba invadens
SSKTKEMEEQN

SEQ ID NO: 2909664 - protein, 11 aa, Entamoeba invadens
SSKTKNVPEPS

SEQ ID NO: 2909665 - protein, 7 aa, Entamoeba invadens
SSKTLTD

SEQ ID NO: 2909666 - protein, 25 aa, Entamoeba invadens
SSKTLTRGQGRLAGHGAQSSNSSKF

SEQ ID NO: 2909667 - protein, 6 aa, Entamoeba invadens
SSKTNA

SEQ ID NO: 2909668 - protein, 10 aa, Entamoeba invadens
SSKTNPDSLA

SEQ ID NO: 2909669 - protein, 9 aa, Entamoeba invadens
SSKTNTLGQ

SEQ ID NO: 2909670 - protein, 6 aa, Entamoeba invadens
SSKTPN

SEQ ID NO: 2909671 - protein, 10 aa, Entamoeba invadens
SSKTPSQKQV

SEQ ID NO: 2909672 - protein, 7 aa, Entamoeba invadens
SSKTQHG

SEQ ID NO: 2909673 - protein, 10 aa, Entamoeba invadens
SSKTRGKPIE

SEQ ID NO: 2909674 - protein, 7 aa, Entamoeba invadens
SSKTSGC

SEQ ID NO: 2909675 - protein, 11 aa, Entamoeba invadens
SSKTTAVPSDI

SEQ ID NO: 2909676 - protein, 9 aa, Entamoeba invadens
SSKTVNDEF

SEQ ID NO: 2909677 - protein, 10 aa, Entamoeba invadens
SSKVDKDNRD

SEQ ID NO: 2909678 - protein, 18 aa, Entamoeba invadens
SSKVEKVENAVDEKGKVD

SEQ ID NO: 2909679 - protein, 10 aa, Entamoeba invadens
SSKVPKGGSW

SEQ ID NO: 2909680 - protein, 6 aa, Entamoeba invadens
SSKVPS

SEQ ID NO: 2909681 - protein, 4 aa, Entamoeba invadens
SSLA

SEQ ID NO: 2909682 - protein, 8 aa, Entamoeba invadens
SSLAPGQL

SEQ ID NO: 2909683 - protein, 9 aa, Entamoeba invadens
SSLAPRERK

SEQ ID NO: 2909684 - protein, 13 aa, Entamoeba invadens
SSLATSQNTVGES

SEQ ID NO: 2909685 - protein, 4 aa, Entamoeba invadens
SSLD

SEQ ID NO: 2909686 - protein, 8 aa, Entamoeba invadens
SSLDAEKL

SEQ ID NO: 2909687 - protein, 8 aa, Entamoeba invadens
SSLDGSYF

SEQ ID NO: 2909688 - protein, 10 aa, Entamoeba invadens
SSLDSISEGT

SEQ ID NO: 2909689 - protein, 13 aa, Entamoeba invadens
SSLDSKARGHYNK

SEQ ID NO: 2909690 - protein, 15 aa, Entamoeba invadens
SSLEGTPSTKQSSED

SEQ ID NO: 2909691 - protein, 22 aa, Entamoeba invadens
SSLEKAEKESERRRIRNEELKD

SEQ ID NO: 2909692 - protein, 17 aa, Entamoeba invadens
SSLEKNKKECAVQGKKS

SEQ ID NO: 2909693 - protein, 9 aa, Entamoeba invadens
SSLINDDSG

SEQ ID NO: 2909694 - protein, 14 aa, Entamoeba invadens
SSLKETTRQGTIDE

SEQ ID NO: 2909695 - protein, 20 aa, Entamoeba invadens
SSLKNEKSDAESKGETVTNT

SEQ ID NO: 2909696 - protein, 8 aa, Entamoeba invadens
SSLKRQIT

SEQ ID NO: 2909697 - protein, 4 aa, Entamoeba invadens
SSLN

SEQ ID NO: 2909698 - protein, 23 aa, Entamoeba invadens
SSLNLSEQKDQKVETKRNALTPR

SEQ ID NO: 2909699 - protein, 16 aa, Entamoeba invadens
SSLNPKSSLFQQPSGV

SEQ ID NO: 2909700 - protein, 12 aa, Entamoeba invadens
SSLNQDYGYQPP

SEQ ID NO: 2909701 - protein, 26 aa, Entamoeba invadens
SSLNSSHSSSLSSPRVRADSPKRKEV

SEQ ID NO: 2909702 - protein, 6 aa, Entamoeba invadens
SSLNTS

SEQ ID NO: 2909703 - protein, 7 aa, Entamoeba invadens
SSLPDKK

SEQ ID NO: 2909704 - protein, 7 aa, Entamoeba invadens
SSLPNPV

SEQ ID NO: 2909705 - protein, 7 aa, Entamoeba invadens
SSLPRRA

SEQ ID NO: 2909706 - protein, 16 aa, Entamoeba invadens
SSLPSSPRSDSEIKTE

SEQ ID NO: 2909707 - protein, 15 aa, Entamoeba invadens
SSLPVSNSGSRVGSR

SEQ ID NO: 2909708 - protein, 4 aa, Entamoeba invadens
SSLQ

SEQ ID NO: 2909709 - protein, 16 aa, Entamoeba invadens
SSLQDDDLKSAQNKRW

SEQ ID NO: 2909710 - protein, 9 aa, Entamoeba invadens
SSLQLPKSG

SEQ ID NO: 2909711 - protein, 17 aa, Entamoeba invadens
SSLQPSPKESSFRNNED

SEQ ID NO: 2909712 - protein, 15 aa, Entamoeba invadens
SSLQSVNSKPDDSIK

SEQ ID NO: 2909713 - protein, 11 aa, Entamoeba invadens
SSLQTNHGSVD

SEQ ID NO: 2909714 - protein, 8 aa, Entamoeba invadens
SSLRGKTL

SEQ ID NO: 2909715 - protein, 13 aa, Entamoeba invadens
SSLRTKPLSPESK

SEQ ID NO: 2909716 - protein, 4 aa, Entamoeba invadens
SSLS

SEQ ID NO: 2909717 - protein, 8 aa, Entamoeba invadens
SSLSASTV

SEQ ID NO: 2909718 - protein, 10 aa, Entamoeba invadens
SSLSDTPLSN

SEQ ID NO: 2909719 - protein, 10 aa, Entamoeba invadens
SSLSENDETV

SEQ ID NO: 2909720 - protein, 10 aa, Entamoeba invadens
SSLSKTTEDS

SEQ ID NO: 2909721 - protein, 17 aa, Entamoeba invadens
SSLSNSGEVSFENTPRT

SEQ ID NO: 2909722 - protein, 9 aa, Entamoeba invadens
SSLSRSSKM

SEQ ID NO: 2909723 - protein, 9 aa, Entamoeba invadens
SSLSSGQGM

SEQ ID NO: 2909724 - protein, 8 aa, Entamoeba invadens
SSLSTEAH

SEQ ID NO: 2909725 - protein, 9 aa, Entamoeba invadens
SSLSTNLKS

SEQ ID NO: 2909726 - protein, 6 aa, Entamoeba invadens
SSLTEL

SEQ ID NO: 2909727 - protein, 11 aa, Entamoeba invadens
SSLTKREQKIA

SEQ ID NO: 2909728 - protein, 20 aa, Entamoeba invadens
SSLTRNYQKSTLTTKEIETA

SEQ ID NO: 2909729 - protein, 25 aa, Entamoeba invadens
SSLTSPRSPKTKSARSTPSTPGQKF

SEQ ID NO: 2909730 - protein, 19 aa, Entamoeba invadens
SSLTTRDIPYSTKSVDKEM

SEQ ID NO: 2909731 - protein, 8 aa, Entamoeba invadens
SSLVQNQK

SEQ ID NO: 2909732 - protein, 6 aa, Entamoeba invadens
SSMGAN

SEQ ID NO: 2909733 - protein, 15 aa, Entamoeba invadens
SSMPQNRAGSKSYMA

SEQ ID NO: 2909734 - protein, 6 aa, Entamoeba invadens
SSNADT

SEQ ID NO: 2909735 - protein, 8 aa, Entamoeba invadens
SSNAESTC

SEQ ID NO: 2909736 - protein, 7 aa, Entamoeba invadens
SSNAPMR

SEQ ID NO: 2909737 - protein, 7 aa, Entamoeba invadens
SSNCAKV

SEQ ID NO: 2909738 - protein, 23 aa, Entamoeba invadens
SSNCENGKVTQDAKCTKNSESEI

SEQ ID NO: 2909739 - protein, 10 aa, Entamoeba invadens
SSNDAHTLSQ

SEQ ID NO: 2909740 - protein, 11 aa, Entamoeba invadens
SSNDCSDSPIN

SEQ ID NO: 2909741 - protein, 7 aa, Entamoeba invadens
SSNDFKV

SEQ ID NO: 2909742 - protein, 7 aa, Entamoeba invadens
SSNEARW

SEQ ID NO: 2909743 - protein, 8 aa, Entamoeba invadens
SSNEITAL

SEQ ID NO: 2909744 - protein, 7 aa, Entamoeba invadens
SSNEPAM

SEQ ID NO: 2909745 - protein, 22 aa, Entamoeba invadens
SSNEQVSHKKEGFKAKIQHFIH

SEQ ID NO: 2909746 - protein, 15 aa, Entamoeba invadens
SSNFGKSSEGIPTGG

SEQ ID NO: 2909747 - protein, 7 aa, Entamoeba invadens
SSNFGTK

SEQ ID NO: 2909748 - protein, 8 aa, Entamoeba invadens
SSNGDCSS

SEQ ID NO: 2909749 - protein, 6 aa, Entamoeba invadens
SSNGDY

SEQ ID NO: 2909750 - protein, 17 aa, Entamoeba invadens
SSNGNCSSCDQNENESL

SEQ ID NO: 2909751 - protein, 9 aa, Entamoeba invadens
SSNGQNIDS

SEQ ID NO: 2909752 - protein, 4 aa, Entamoeba invadens
SSNI

SEQ ID NO: 2909753 - protein, 7 aa, Entamoeba invadens
SSNIGDA

SEQ ID NO: 2909754 - protein, 6 aa, Entamoeba invadens
SSNIKN

SEQ ID NO: 2909755 - protein, 4 aa, Entamoeba invadens
SSNK

SEQ ID NO: 2909756 - protein, 9 aa, Entamoeba invadens
SSNKELSQK

SEQ ID NO: 2909757 - protein, 8 aa, Entamoeba invadens
SSNKENAY

SEQ ID NO: 2909758 - protein, 30 aa, Entamoeba invadens
SSNKTQKSSSENYEGVESFETQKKMSRSSK

SEQ ID NO: 2909759 - protein, 6 aa, Entamoeba invadens
SSNKTV

SEQ ID NO: 2909760 - protein, 4 aa, Entamoeba invadens
SSNL

SEQ ID NO: 2909761 - protein, 14 aa, Entamoeba invadens
SSNLNNGENTIKEL

SEQ ID NO: 2909762 - protein, 6 aa, Entamoeba invadens
SSNMTG

SEQ ID NO: 2909763 - protein, 8 aa, Entamoeba invadens
SSNNIEQF

SEQ ID NO: 2909764 - protein, 9 aa, Entamoeba invadens
SSNNKQYSR

SEQ ID NO: 2909765 - protein, 6 aa, Entamoeba invadens
SSNNNE

SEQ ID NO: 2909766 - protein, 6 aa, Entamoeba invadens
SSNNSD

SEQ ID NO: 2909767 - protein, 15 aa, Entamoeba invadens
SSNPQKEQKKKQKKI

SEQ ID NO: 2909768 - protein, 18 aa, Entamoeba invadens
SSNPQQMEQQPQQPPQQF

SEQ ID NO: 2909769 - protein, 7 aa, Entamoeba invadens
SSNPSQF

SEQ ID NO: 2909770 - protein, 8 aa, Entamoeba invadens
SSNPTLDN

SEQ ID NO: 2909771 - protein, 8 aa, Entamoeba invadens
SSNPVTAK

SEQ ID NO: 2909772 - protein, 13 aa, Entamoeba invadens
SSNQTSKNEKDEK

SEQ ID NO: 2909773 - protein, 5 aa, Entamoeba invadens
SSNRI

SEQ ID NO: 2909774 - protein, 5 aa, Entamoeba invadens
SSNRQ

SEQ ID NO: 2909775 - protein, 7 aa, Entamoeba invadens
SSNSATE

SEQ ID NO: 2909776 - protein, 5 aa, Entamoeba invadens
SSNSF

SEQ ID NO: 2909777 - protein, 6 aa, Entamoeba invadens
SSNSFN

SEQ ID NO: 2909778 - protein, 14 aa, Entamoeba invadens
SSNTAKTEKTISDE

SEQ ID NO: 2909779 - protein, 4 aa, Entamoeba invadens
SSNV

SEQ ID NO: 2909780 - protein, 8 aa, Entamoeba invadens
SSNVEVTG

SEQ ID NO: 2909781 - protein, 9 aa, Entamoeba invadens
SSNVGSSYY

SEQ ID NO: 2909782 - protein, 6 aa, Entamoeba invadens
SSNVSE

SEQ ID NO: 2909783 - protein, 9 aa, Entamoeba invadens
SSNVTTTDS

SEQ ID NO: 2909784 - protein, 16 aa, Entamoeba invadens
SSNYHKVNGQIKDGDK

SEQ ID NO: 2909785 - protein, 20 aa, Entamoeba invadens
SSNYRDDDKKVTGGRNGYGA

SEQ ID NO: 2909786 - protein, 7 aa, Entamoeba invadens
SSNYVQK

SEQ ID NO: 2909787 - protein, 5 aa, Entamoeba invadens
SSNYY

SEQ ID NO: 2909788 - protein, 7 aa, Entamoeba invadens
SSPAEVE

SEQ ID NO: 2909789 - protein, 28 aa, Entamoeba invadens
SSPDKRKAYDSTDDTDDTIPSDKTYSEK

SEQ ID NO: 2909790 - protein, 7 aa, Entamoeba invadens
SSPDLST

SEQ ID NO: 2909791 - protein, 7 aa, Entamoeba invadens
SSPDNRF

SEQ ID NO: 2909792 - protein, 6 aa, Entamoeba invadens
SSPDRY

SEQ ID NO: 2909793 - protein, 9 aa, Entamoeba invadens
SSPDVLSST

SEQ ID NO: 2909794 - protein, 6 aa, Entamoeba invadens
SSPDYK

SEQ ID NO: 2909795 - protein, 5 aa, Entamoeba invadens
SSPEH

SEQ ID NO: 2909796 - protein, 7 aa, Entamoeba invadens
SSPEKLS

SEQ ID NO: 2909797 - protein, 10 aa, Entamoeba invadens
SSPETARQAI

SEQ ID NO: 2909798 - protein, 4 aa, Entamoeba invadens
SSPF

SEQ ID NO: 2909799 - protein, 9 aa, Entamoeba invadens
SSPGANGKV

SEQ ID NO: 2909800 - protein, 4 aa, Entamoeba invadens
SSPH

SEQ ID NO: 2909801 - protein, 5 aa, Entamoeba invadens
SSPHT

SEQ ID NO: 2909802 - protein, 5 aa, Entamoeba invadens
SSPIL

SEQ ID NO: 2909803 - protein, 7 aa, Entamoeba invadens
SSPIPPL

SEQ ID NO: 2909804 - protein, 6 aa, Entamoeba invadens
SSPKFG

SEQ ID NO: 2909805 - protein, 6 aa, Entamoeba invadens
SSPKVT

SEQ ID NO: 2909806 - protein, 16 aa, Entamoeba invadens
SSPLIPEKPETNDPNW

SEQ ID NO: 2909807 - protein, 15 aa, Entamoeba invadens
SSPLKTRDSDARKHS

SEQ ID NO: 2909808 - protein, 18 aa, Entamoeba invadens
SSPLPIKNTPSCGDNGVE

SEQ ID NO: 2909809 - protein, 37 aa, Entamoeba invadens
SSPLPKEKETESLDTKRGSSVNAQKERQFKNQQAYQE

SEQ ID NO: 2909810 - protein, 5 aa, Entamoeba invadens
SSPLY

SEQ ID NO: 2909811 - protein, 7 aa, Entamoeba invadens
SSPNGQL

SEQ ID NO: 2909812 - protein, 8 aa, Entamoeba invadens
SSPNPEDA

SEQ ID NO: 2909813 - protein, 8 aa, Entamoeba invadens
SSPNSTLA

SEQ ID NO: 2909814 - protein, 8 aa, Entamoeba invadens
SSPPHKKI

SEQ ID NO: 2909815 - protein, 8 aa, Entamoeba invadens
SSPPKPSC

SEQ ID NO: 2909816 - protein, 9 aa, Entamoeba invadens
SSPPRGLQS

SEQ ID NO: 2909817 - protein, 4 aa, Entamoeba invadens
SSPQ

SEQ ID NO: 2909818 - protein, 6 aa, Entamoeba invadens
SSPQFE

SEQ ID NO: 2909819 - protein, 8 aa, Entamoeba invadens
SSPQFQDP

SEQ ID NO: 2909820 - protein, 6 aa, Entamoeba invadens
SSPQIN

SEQ ID NO: 2909821 - protein, 24 aa, Entamoeba invadens
SSPQPQKTTQQNKIGEVKSASVSP

SEQ ID NO: 2909822 - protein, 11 aa, Entamoeba invadens
SSPQSEKTPEQ

SEQ ID NO: 2909823 - protein, 12 aa, Entamoeba invadens
SSPQTTTSDYEK

SEQ ID NO: 2909824 - protein, 4 aa, Entamoeba invadens
SSPR

SEQ ID NO: 2909825 - protein, 12 aa, Entamoeba invadens
SSPRCGSMTSNP

SEQ ID NO: 2909826 - protein, 8 aa, Entamoeba invadens
SSPSEATR

SEQ ID NO: 2909827 - protein, 5 aa, Entamoeba invadens
SSPSL

SEQ ID NO: 2909828 - protein, 13 aa, Entamoeba invadens
SSPSTSMPYPSSF

SEQ ID NO: 2909829 - protein, 14 aa, Entamoeba invadens
SSPTEDPDAPKTPF

SEQ ID NO: 2909830 - protein, 6 aa, Entamoeba invadens
SSPTKP

SEQ ID NO: 2909831 - protein, 7 aa, Entamoeba invadens
SSPTNNW

SEQ ID NO: 2909832 - protein, 4 aa, Entamoeba invadens
SSPV

SEQ ID NO: 2909833 - protein, 17 aa, Entamoeba invadens
SSPVEGKRKTQKPRQLH

SEQ ID NO: 2909834 - protein, 6 aa, Entamoeba invadens
SSPVTP

SEQ ID NO: 2909835 - protein, 6 aa, Entamoeba invadens
SSPYSI

SEQ ID NO: 2909836 - protein, 6 aa, Entamoeba invadens
SSQAEN

SEQ ID NO: 2909837 - protein, 13 aa, Entamoeba invadens
SSQASAQSSIPEA

SEQ ID NO: 2909838 - protein, 5 aa, Entamoeba invadens
SSQCT

SEQ ID NO: 2909839 - protein, 7 aa, Entamoeba invadens
SSQDGID

SEQ ID NO: 2909840 - protein, 6 aa, Entamoeba invadens
SSQDGK

SEQ ID NO: 2909841 - protein, 4 aa, Entamoeba invadens
SSQE

SEQ ID NO: 2909842 - protein, 7 aa, Entamoeba invadens
SSQEATE

SEQ ID NO: 2909843 - protein, 7 aa, Entamoeba invadens
SSQECDK

SEQ ID NO: 2909844 - protein, 6 aa, Entamoeba invadens
SSQEKI

SEQ ID NO: 2909845 - protein, 6 aa, Entamoeba invadens
SSQENV

SEQ ID NO: 2909846 - protein, 7 aa, Entamoeba invadens
SSQESYE

SEQ ID NO: 2909847 - protein, 5 aa, Entamoeba invadens
SSQGF

SEQ ID NO: 2909848 - protein, 4 aa, Entamoeba invadens
SSQH

SEQ ID NO: 2909849 - protein, 7 aa, Entamoeba invadens
SSQIKDC

SEQ ID NO: 2909850 - protein, 12 aa, Entamoeba invadens
SSQIKEGDLDKT

SEQ ID NO: 2909851 - protein, 8 aa, Entamoeba invadens
SSQINEAE

SEQ ID NO: 2909852 - protein, 6 aa, Entamoeba invadens
SSQIPE

SEQ ID NO: 2909853 - protein, 6 aa, Entamoeba invadens
SSQIPK

SEQ ID NO: 2909854 - protein, 9 aa, Entamoeba invadens
SSQISSPVT

SEQ ID NO: 2909855 - protein, 8 aa, Entamoeba invadens
SSQKDPHF

SEQ ID NO: 2909856 - protein, 8 aa, Entamoeba invadens
SSQKKEMM

SEQ ID NO: 2909857 - protein, 10 aa, Entamoeba invadens
SSQKKFEQKK

SEQ ID NO: 2909858 - protein, 18 aa, Entamoeba invadens
SSQKVPDTPMNEPKNIGN

SEQ ID NO: 2909859 - protein, 5 aa, Entamoeba invadens
SSQMN

SEQ ID NO: 2909860 - protein, 4 aa, Entamoeba invadens
SSQN

SEQ ID NO: 2909861 - protein, 23 aa, Entamoeba invadens
SSQNGASNSKENSEFPTDPDESY

SEQ ID NO: 2909862 - protein, 13 aa, Entamoeba invadens
SSQNYSPVTVSRG

SEQ ID NO: 2909863 - protein, 4 aa, Entamoeba invadens
SSQP

SEQ ID NO: 2909864 - protein, 9 aa, Entamoeba invadens
SSQPGTGVL

SEQ ID NO: 2909865 - protein, 7 aa, Entamoeba invadens
SSQPLPG

SEQ ID NO: 2909866 - protein, 16 aa, Entamoeba invadens
SSQPSITSYEQTKSNG

SEQ ID NO: 2909867 - protein, 5 aa, Entamoeba invadens
SSQQI

SEQ ID NO: 2909868 - protein, 7 aa, Entamoeba invadens
SSQQIVG

SEQ ID NO: 2909869 - protein, 9 aa, Entamoeba invadens
SSQQSSTNF

SEQ ID NO: 2909870 - protein, 16 aa, Entamoeba invadens
SSQQTSEISSPSTDNS

SEQ ID NO: 2909871 - protein, 7 aa, Entamoeba invadens
SSQQYDG

SEQ ID NO: 2909872 - protein, 4 aa, Entamoeba invadens
SSQR

SEQ ID NO: 2909873 - protein, 9 aa, Entamoeba invadens
SSQRKNPRS

SEQ ID NO: 2909874 - protein, 6 aa, Entamoeba invadens
SSQSEN

SEQ ID NO: 2909875 - protein, 16 aa, Entamoeba invadens
SSQSNTPNQCKVSSSR

SEQ ID NO: 2909876 - protein, 9 aa, Entamoeba invadens
SSQSYVKPE

SEQ ID NO: 2909877 - protein, 4 aa, Entamoeba invadens
SSQT

SEQ ID NO: 2909878 - protein, 9 aa, Entamoeba invadens
SSQTQKYQK

SEQ ID NO: 2909879 - protein, 5 aa, Entamoeba invadens
SSQTR

SEQ ID NO: 2909880 - protein, 24 aa, Entamoeba invadens
SSQTRKSKSVPNTPKKLRNERSCS

SEQ ID NO: 2909881 - protein, 9 aa, Entamoeba invadens
SSQTTSQEK

SEQ ID NO: 2909882 - protein, 22 aa, Entamoeba invadens
SSQWKGDKAENYTKELQKDKNF

SEQ ID NO: 2909883 - protein, 22 aa, Entamoeba invadens
SSQWKGDKAENYTKKLQKDKNF

SEQ ID NO: 2909884 - protein, 19 aa, Entamoeba invadens
SSQYEKEEEEQYDDYEEYY

SEQ ID NO: 2909885 - protein, 12 aa, Entamoeba invadens
SSRASSFSLPTT

SEQ ID NO: 2909886 - protein, 7 aa, Entamoeba invadens
SSRATQK

SEQ ID NO: 2909887 - protein, 6 aa, Entamoeba invadens
SSRDGL

SEQ ID NO: 2909888 - protein, 5 aa, Entamoeba invadens
SSRDK

SEQ ID NO: 2909889 - protein, 26 aa, Entamoeba invadens
SSRDTPRRSPKISPRKQATETISPDQ

SEQ ID NO: 2909890 - protein, 12 aa, Entamoeba invadens
SSRDTSEKRTFE

SEQ ID NO: 2909891 - protein, 5 aa, Entamoeba invadens
SSREF

SEQ ID NO: 2909892 - protein, 9 aa, Entamoeba invadens
SSRFGTPDQ

SEQ ID NO: 2909893 - protein, 8 aa, Entamoeba invadens
SSRITELP

SEQ ID NO: 2909894 - protein, 14 aa, Entamoeba invadens
SSRKKTSQSDSQRC

SEQ ID NO: 2909895 - protein, 7 aa, Entamoeba invadens
SSRKTSL

SEQ ID NO: 2909896 - protein, 4 aa, Entamoeba invadens
SSRL

SEQ ID NO: 2909897 - protein, 9 aa, Entamoeba invadens
SSRNATEEQ

SEQ ID NO: 2909898 - protein, 7 aa, Entamoeba invadens
SSRNIDS

SEQ ID NO: 2909899 - protein, 5 aa, Entamoeba invadens
SSRNL

SEQ ID NO: 2909900 - protein, 9 aa, Entamoeba invadens
SSRNPSKVL

SEQ ID NO: 2909901 - protein, 7 aa, Entamoeba invadens
SSRPEKI

SEQ ID NO: 2909902 - protein, 7 aa, Entamoeba invadens
SSRPISN

SEQ ID NO: 2909903 - protein, 8 aa, Entamoeba invadens
SSRPWTGT

SEQ ID NO: 2909904 - protein, 12 aa, Entamoeba invadens
SSRQFPPKNTTT

SEQ ID NO: 2909905 - protein, 12 aa, Entamoeba invadens
SSRQIRGMYALY

SEQ ID NO: 2909906 - protein, 96 aa, Entamoeba invadens
SSRQSRHESYSDRRDDYNDRDYYRERRDYHERHRDRYESHYDNRPRDRYDSPKRRYYDKEDRSPPRHDERRKARSPSLSPLGKKIKSRWDEQPVAD

SEQ ID NO: 2909907 - protein, 9 aa, Entamoeba invadens
SSRRDHPPM

SEQ ID NO: 2909908 - protein, 6 aa, Entamoeba invadens
SSRRTE

SEQ ID NO: 2909909 - protein, 7 aa, Entamoeba invadens
SSRSGKY

SEQ ID NO: 2909910 - protein, 18 aa, Entamoeba invadens
SSRSLNNLQKSKKGIGAT

SEQ ID NO: 2909911 - protein, 6 aa, Entamoeba invadens
SSRSTL

SEQ ID NO: 2909912 - protein, 8 aa, Entamoeba invadens
SSRSVEIS

SEQ ID NO: 2909913 - protein, 4 aa, Entamoeba invadens
SSRT

SEQ ID NO: 2909914 - protein, 6 aa, Entamoeba invadens
SSRTCN

SEQ ID NO: 2909915 - protein, 6 aa, Entamoeba invadens
SSRTGC

SEQ ID NO: 2909916 - protein, 12 aa, Entamoeba invadens
SSRTPDEEVNGL

SEQ ID NO: 2909917 - protein, 9 aa, Entamoeba invadens
SSRTSKTVT

SEQ ID NO: 2909918 - protein, 5 aa, Entamoeba invadens
SSRVE

SEQ ID NO: 2909919 - protein, 10 aa, Entamoeba invadens
SSRYDGDSEL

SEQ ID NO: 2909920 - protein, 8 aa, Entamoeba invadens
SSSATEEV

SEQ ID NO: 2909921 - protein, 6 aa, Entamoeba invadens
SSSCEN

SEQ ID NO: 2909922 - protein, 6 aa, Entamoeba invadens
SSSCKK

SEQ ID NO: 2909923 - protein, 9 aa, Entamoeba invadens
SSSCSTSED

SEQ ID NO: 2909924 - protein, 15 aa, Entamoeba invadens
SSSDDFDKDYADGTY

SEQ ID NO: 2909925 - protein, 6 aa, Entamoeba invadens
SSSDEY

SEQ ID NO: 2909926 - protein, 5 aa, Entamoeba invadens
SSSDI

SEQ ID NO: 2909927 - protein, 7 aa, Entamoeba invadens
SSSDKER

SEQ ID NO: 2909928 - protein, 7 aa, Entamoeba invadens
SSSDKKP

SEQ ID NO: 2909929 - protein, 8 aa, Entamoeba invadens
SSSDPTQK

SEQ ID NO: 2909930 - protein, 8 aa, Entamoeba invadens
SSSDPTRI

SEQ ID NO: 2909931 - protein, 8 aa, Entamoeba invadens
SSSDSTAK

SEQ ID NO: 2909932 - protein, 4 aa, Entamoeba invadens
SSSE

SEQ ID NO: 2909933 - protein, 8 aa, Entamoeba invadens
SSSEDNTV

SEQ ID NO: 2909934 - protein, 7 aa, Entamoeba invadens
SSSEDSE

SEQ ID NO: 2909935 - protein, 7 aa, Entamoeba invadens
SSSEDVE

SEQ ID NO: 2909936 - protein, 19 aa, Entamoeba invadens
SSSEEDTNQEATKDTNKDF

SEQ ID NO: 2909937 - protein, 9 aa, Entamoeba invadens
SSSEFEETI

SEQ ID NO: 2909938 - protein, 6 aa, Entamoeba invadens
SSSEIE

SEQ ID NO: 2909939 - protein, 9 aa, Entamoeba invadens
SSSEIESRD

SEQ ID NO: 2909940 - protein, 19 aa, Entamoeba invadens
SSSEIKDDSSRGIVVSELT

SEQ ID NO: 2909941 - protein, 10 aa, Entamoeba invadens
SSSEKRNKNV

SEQ ID NO: 2909942 - protein, 5 aa, Entamoeba invadens
SSSEL

SEQ ID NO: 2909943 - protein, 9 aa, Entamoeba invadens
SSSENSEIA

SEQ ID NO: 2909944 - protein, 8 aa, Entamoeba invadens
SSSESEHG

SEQ ID NO: 2909945 - protein, 7 aa, Entamoeba invadens
SSSESHL

SEQ ID NO: 2909946 - protein, 7 aa, Entamoeba invadens
SSSESPV

SEQ ID NO: 2909947 - protein, 7 aa, Entamoeba invadens
SSSETEV

SEQ ID NO: 2909948 - protein, 7 aa, Entamoeba invadens
SSSEVEE

SEQ ID NO: 2909949 - protein, 8 aa, Entamoeba invadens
SSSEYTKG

SEQ ID NO: 2909950 - protein, 4 aa, Entamoeba invadens
SSSF

SEQ ID NO: 2909951 - protein, 16 aa, Entamoeba invadens
SSSGKSLESLNTGNLT

SEQ ID NO: 2909952 - protein, 7 aa, Entamoeba invadens
SSSGKSY

SEQ ID NO: 2909953 - protein, 15 aa, Entamoeba invadens
SSSGRYLASADQKGS

SEQ ID NO: 2909954 - protein, 8 aa, Entamoeba invadens
SSSGWSPV

SEQ ID NO: 2909955 - protein, 6 aa, Entamoeba invadens
SSSHPN

SEQ ID NO: 2909956 - protein, 9 aa, Entamoeba invadens
SSSIGDGSR

SEQ ID NO: 2909957 - protein, 26 aa, Entamoeba invadens
SSSINEKKPRLVKERKYKKKRWDPAL

SEQ ID NO: 2909958 - protein, 8 aa, Entamoeba invadens
SSSIPVSE

SEQ ID NO: 2909959 - protein, 11 aa, Entamoeba invadens
SSSISESSETL

SEQ ID NO: 2909960 - protein, 5 aa, Entamoeba invadens
SSSIV

SEQ ID NO: 2909961 - protein, 7 aa, Entamoeba invadens
SSSIVTS

SEQ ID NO: 2909962 - protein, 4 aa, Entamoeba invadens
SSSK

SEQ ID NO: 2909963 - protein, 9 aa, Entamoeba invadens
SSSKAFSGI

SEQ ID NO: 2909964 - protein, 10 aa, Entamoeba invadens
SSSKALEDKD

SEQ ID NO: 2909965 - protein, 13 aa, Entamoeba invadens
SSSKKMAKELTPI

SEQ ID NO: 2909966 - protein, 17 aa, Entamoeba invadens
SSSKRISTFGDSPNDAI

SEQ ID NO: 2909967 - protein, 17 aa, Entamoeba invadens
SSSKSPQESLENFLKAI

SEQ ID NO: 2909968 - protein, 6 aa, Entamoeba invadens
SSSKSV

SEQ ID NO: 2909969 - protein, 8 aa, Entamoeba invadens
SSSKTCDI

SEQ ID NO: 2909970 - protein, 29 aa, Entamoeba invadens
SSSKTPNGTSPHSQESPNYLAGNGNRRTT

SEQ ID NO: 2909971 - protein, 5 aa, Entamoeba invadens
SSSKV

SEQ ID NO: 2909972 - protein, 7 aa, Entamoeba invadens
SSSLDGT

SEQ ID NO: 2909973 - protein, 6 aa, Entamoeba invadens
SSSLEG

SEQ ID NO: 2909974 - protein, 6 aa, Entamoeba invadens
SSSLES

SEQ ID NO: 2909975 - protein, 6 aa, Entamoeba invadens
SSSLGY

SEQ ID NO: 2909976 - protein, 8 aa, Entamoeba invadens
SSSLNKDA

SEQ ID NO: 2909977 - protein, 8 aa, Entamoeba invadens
SSSLSEED

SEQ ID NO: 2909978 - protein, 6 aa, Entamoeba invadens
SSSLSS

SEQ ID NO: 2909979 - protein, 7 aa, Entamoeba invadens
SSSLTEK

SEQ ID NO: 2909980 - protein, 8 aa, Entamoeba invadens
SSSNDELK

SEQ ID NO: 2909981 - protein, 5 aa, Entamoeba invadens
SSSNT

SEQ ID NO: 2909982 - protein, 13 aa, Entamoeba invadens
SSSNYSSPRRESL

SEQ ID NO: 2909983 - protein, 9 aa, Entamoeba invadens
SSSPDSRAQ

SEQ ID NO: 2909984 - protein, 7 aa, Entamoeba invadens
SSSPIGF

SEQ ID NO: 2909985 - protein, 8 aa, Entamoeba invadens
SSSPIQQS

SEQ ID NO: 2909986 - protein, 7 aa, Entamoeba invadens
SSSPLHK

SEQ ID NO: 2909987 - protein, 9 aa, Entamoeba invadens
SSSPSAVKA

SEQ ID NO: 2909988 - protein, 13 aa, Entamoeba invadens
SSSPSGDQDLPKT

SEQ ID NO: 2909989 - protein, 8 aa, Entamoeba invadens
SSSPTLST

SEQ ID NO: 2909990 - protein, 5 aa, Entamoeba invadens
SSSPV

SEQ ID NO: 2909991 - protein, 7 aa, Entamoeba invadens
SSSQDVE

SEQ ID NO: 2909992 - protein, 9 aa, Entamoeba invadens
SSSQIPKVD

SEQ ID NO: 2909993 - protein, 17 aa, Entamoeba invadens
SSSQPSTTKDKEGDELP

SEQ ID NO: 2909994 - protein, 5 aa, Entamoeba invadens
SSSQQ

SEQ ID NO: 2909995 - protein, 11 aa, Entamoeba invadens
SSSQSSFEYGP

SEQ ID NO: 2909996 - protein, 5 aa, Entamoeba invadens
SSSQT

SEQ ID NO: 2909997 - protein, 5 aa, Entamoeba invadens
SSSQV

SEQ ID NO: 2909998 - protein, 13 aa, Entamoeba invadens
SSSREATALPTKG

SEQ ID NO: 2909999 - protein, 8 aa, Entamoeba invadens
SSSRNGGL

SEQ ID NO: 2910000 - protein, 8 aa, Entamoeba invadens
SSSRNHQH

SEQ ID NO: 2910001 - protein, 6 aa, Entamoeba invadens
SSSRSV

SEQ ID NO: 2910002 - protein, 37 aa, Entamoeba invadens
SSSSAQSLQSPPLAEQTIRKDGKKELKTTKSSSVITN

SEQ ID NO: 2910003 - protein, 9 aa, Entamoeba invadens
SSSSDETFE

SEQ ID NO: 2910004 - protein, 7 aa, Entamoeba invadens
SSSSDGT

SEQ ID NO: 2910005 - protein, 5 aa, Entamoeba invadens
SSSSG

SEQ ID NO: 2910006 - protein, 9 aa, Entamoeba invadens
SSSSKSLSI

SEQ ID NO: 2910007 - protein, 8 aa, Entamoeba invadens
SSSSPFQL

SEQ ID NO: 2910008 - protein, 9 aa, Entamoeba invadens
SSSSQSFEN

SEQ ID NO: 2910009 - protein, 12 aa, Entamoeba invadens
SSSSRGNLGVGG

SEQ ID NO: 2910010 - protein, 39 aa, Entamoeba invadens
SSSSSEETPIPLGPKKDRMSDFGGKRPSNATMEKRRKRI

SEQ ID NO: 2910011 - protein, 104 aa, Entamoeba invadens
SSSSSESSSSSDSTSSSDSSVSSKSTNTSTNPSQVSEKDQKAETKKQMSEDSSSDSSSDSSSDESENVTKKAMSEDTDDSEEEKSEHETQKDNAENATEKGEQF

SEQ ID NO: 2910012 - protein, 26 aa, Entamoeba invadens
SSSSSKSKSNSSSNSEEQNKTPTPKV

SEQ ID NO: 2910013 - protein, 11 aa, Entamoeba invadens
SSSSSQSEKEW

SEQ ID NO: 2910014 - protein, 5 aa, Entamoeba invadens
SSSTA

SEQ ID NO: 2910015 - protein, 9 aa, Entamoeba invadens
SSSTARKYD

SEQ ID NO: 2910016 - protein, 8 aa, Entamoeba invadens
SSSTEKKT

SEQ ID NO: 2910017 - protein, 8 aa, Entamoeba invadens
SSSTENTK

SEQ ID NO: 2910018 - protein, 8 aa, Entamoeba invadens
SSSTKESF

SEQ ID NO: 2910019 - protein, 7 aa, Entamoeba invadens
SSSTKGT

SEQ ID NO: 2910020 - protein, 6 aa, Entamoeba invadens
SSSTLS

SEQ ID NO: 2910021 - protein, 22 aa, Entamoeba invadens
SSSTMGKLTTSEEFVHVSRQSL

SEQ ID NO: 2910022 - protein, 14 aa, Entamoeba invadens
SSSTPLEDADKGGR

SEQ ID NO: 2910023 - protein, 7 aa, Entamoeba invadens
SSSTQRI

SEQ ID NO: 2910024 - protein, 9 aa, Entamoeba invadens
SSSTTCQEC

SEQ ID NO: 2910025 - protein, 6 aa, Entamoeba invadens
SSSTTF

SEQ ID NO: 2910026 - protein, 7 aa, Entamoeba invadens
SSSTVLT

SEQ ID NO: 2910027 - protein, 17 aa, Entamoeba invadens
SSSVEDKKKRRQHKRNM

SEQ ID NO: 2910028 - protein, 13 aa, Entamoeba invadens
SSSVFSKSSESHH

SEQ ID NO: 2910029 - protein, 7 aa, Entamoeba invadens
SSSVNEV

SEQ ID NO: 2910030 - protein, 6 aa, Entamoeba invadens
SSSVNT

SEQ ID NO: 2910031 - protein, 7 aa, Entamoeba invadens
SSSVPQE

SEQ ID NO: 2910032 - protein, 9 aa, Entamoeba invadens
SSSVTAPQQ

SEQ ID NO: 2910033 - protein, 6 aa, Entamoeba invadens
SSSVTT

SEQ ID NO: 2910034 - protein, 4 aa, Entamoeba invadens
SSSW

SEQ ID NO: 2910035 - protein, 4 aa, Entamoeba invadens
SSSY

SEQ ID NO: 2910036 - protein, 7 aa, Entamoeba invadens
SSSYAED

SEQ ID NO: 2910037 - protein, 20 aa, Entamoeba invadens
SSSYGSQPPRASSSYSSDRL

SEQ ID NO: 2910038 - protein, 6 aa, Entamoeba invadens
SSSYIQ

SEQ ID NO: 2910039 - protein, 9 aa, Entamoeba invadens
SSSYKTEKM

SEQ ID NO: 2910040 - protein, 6 aa, Entamoeba invadens
SSSYYD

SEQ ID NO: 2910041 - protein, 24 aa, Entamoeba invadens
SSTAAGAAESINGDEKEKRKRDPR

SEQ ID NO: 2910042 - protein, 8 aa, Entamoeba invadens
SSTDDSGY

SEQ ID NO: 2910043 - protein, 5 aa, Entamoeba invadens
SSTDE

SEQ ID NO: 2910044 - protein, 6 aa, Entamoeba invadens
SSTDES

SEQ ID NO: 2910045 - protein, 12 aa, Entamoeba invadens
SSTDETSFYHFN

SEQ ID NO: 2910046 - protein, 8 aa, Entamoeba invadens
SSTDNNNN

SEQ ID NO: 2910047 - protein, 7 aa, Entamoeba invadens
SSTDQKA

SEQ ID NO: 2910048 - protein, 9 aa, Entamoeba invadens
SSTDSEENL

SEQ ID NO: 2910049 - protein, 6 aa, Entamoeba invadens
SSTDSF

SEQ ID NO: 2910050 - protein, 7 aa, Entamoeba invadens
SSTDSGL

SEQ ID NO: 2910051 - protein, 6 aa, Entamoeba invadens
SSTDSI

SEQ ID NO: 2910052 - protein, 17 aa, Entamoeba invadens
SSTDTASPKDEKEVEKI

SEQ ID NO: 2910053 - protein, 6 aa, Entamoeba invadens
SSTEFQ

SEQ ID NO: 2910054 - protein, 26 aa, Entamoeba invadens
SSTEPHSDTSDQSTAPPSLVSSSPIG

SEQ ID NO: 2910055 - protein, 9 aa, Entamoeba invadens
SSTERCDSN

SEQ ID NO: 2910056 - protein, 7 aa, Entamoeba invadens
SSTERSE

SEQ ID NO: 2910057 - protein, 5 aa, Entamoeba invadens
SSTFA

SEQ ID NO: 2910058 - protein, 13 aa, Entamoeba invadens
SSTFDSDSDDDNI

SEQ ID NO: 2910059 - protein, 7 aa, Entamoeba invadens
SSTFEGG

SEQ ID NO: 2910060 - protein, 8 aa, Entamoeba invadens
SSTGNNNN

SEQ ID NO: 2910061 - protein, 12 aa, Entamoeba invadens
SSTGPTQNTQCQ

SEQ ID NO: 2910062 - protein, 4 aa, Entamoeba invadens
SSTH

SEQ ID NO: 2910063 - protein, 4 aa, Entamoeba invadens
SSTI

SEQ ID NO: 2910064 - protein, 22 aa, Entamoeba invadens
SSTISESDSGSSKQSPRKRTPI

SEQ ID NO: 2910065 - protein, 7 aa, Entamoeba invadens
SSTISIK

SEQ ID NO: 2910066 - protein, 5 aa, Entamoeba invadens
SSTKK

SEQ ID NO: 2910067 - protein, 9 aa, Entamoeba invadens
SSTKPTKPI

SEQ ID NO: 2910068 - protein, 5 aa, Entamoeba invadens
SSTLE

SEQ ID NO: 2910069 - protein, 10 aa, Entamoeba invadens
SSTLENQAKR

SEQ ID NO: 2910070 - protein, 5 aa, Entamoeba invadens
SSTLH

SEQ ID NO: 2910071 - protein, 38 aa, Entamoeba invadens
SSTLKQSRAKLDQDMGASNTAHPQQATPNGAPQAPANA

SEQ ID NO: 2910072 - protein, 4 aa, Entamoeba invadens
SSTM

SEQ ID NO: 2910073 - protein, 5 aa, Entamoeba invadens
SSTME

SEQ ID NO: 2910074 - protein, 6 aa, Entamoeba invadens
SSTNNT

SEQ ID NO: 2910075 - protein, 6 aa, Entamoeba invadens
SSTNSV

SEQ ID NO: 2910076 - protein, 8 aa, Entamoeba invadens
SSTPDKIN

SEQ ID NO: 2910077 - protein, 7 aa, Entamoeba invadens
SSTPDQI

SEQ ID NO: 2910078 - protein, 7 aa, Entamoeba invadens
SSTPNIY

SEQ ID NO: 2910079 - protein, 48 aa, Entamoeba invadens
SSTPPKKTEEEKSTETTNAEANSFGSKPQSQASPNETEQQKEEKKSDN

SEQ ID NO: 2910080 - protein, 11 aa, Entamoeba invadens
SSTPVTSSLES

SEQ ID NO: 2910081 - protein, 6 aa, Entamoeba invadens
SSTQEI

SEQ ID NO: 2910082 - protein, 5 aa, Entamoeba invadens
SSTQI

SEQ ID NO: 2910083 - protein, 9 aa, Entamoeba invadens
SSTQIENTN

SEQ ID NO: 2910084 - protein, 9 aa, Entamoeba invadens
SSTQIQAPS

SEQ ID NO: 2910085 - protein, 9 aa, Entamoeba invadens
SSTQNVGTN

SEQ ID NO: 2910086 - protein, 6 aa, Entamoeba invadens
SSTQQK

SEQ ID NO: 2910087 - protein, 7 aa, Entamoeba invadens
SSTQQRV

SEQ ID NO: 2910088 - protein, 5 aa, Entamoeba invadens
SSTQR

SEQ ID NO: 2910089 - protein, 7 aa, Entamoeba invadens
SSTREQT

SEQ ID NO: 2910090 - protein, 6 aa, Entamoeba invadens
SSTRRS

SEQ ID NO: 2910091 - protein, 7 aa, Entamoeba invadens
SSTRRYV

SEQ ID NO: 2910092 - protein, 9 aa, Entamoeba invadens
SSTSEKFNG

SEQ ID NO: 2910093 - protein, 13 aa, Entamoeba invadens
SSTSETIEKTSKK

SEQ ID NO: 2910094 - protein, 21 aa, Entamoeba invadens
SSTSKAPVPPTLSNNPTPKFT

SEQ ID NO: 2910095 - protein, 18 aa, Entamoeba invadens
SSTSKSSDENLTQEDRDR

SEQ ID NO: 2910096 - protein, 8 aa, Entamoeba invadens
SSTSKTQK

SEQ ID NO: 2910097 - protein, 6 aa, Entamoeba invadens
SSTSNN

SEQ ID NO: 2910098 - protein, 6 aa, Entamoeba invadens
SSTSST

SEQ ID NO: 2910099 - protein, 6 aa, Entamoeba invadens
SSTSTD

SEQ ID NO: 2910100 - protein, 7 aa, Entamoeba invadens
SSTSTVT

SEQ ID NO: 2910101 - protein, 7 aa, Entamoeba invadens
SSTTATL

SEQ ID NO: 2910102 - protein, 7 aa, Entamoeba invadens
SSTTKEK

SEQ ID NO: 2910103 - protein, 7 aa, Entamoeba invadens
SSTTLPE

SEQ ID NO: 2910104 - protein, 8 aa, Entamoeba invadens
SSTTPQMK

SEQ ID NO: 2910105 - protein, 11 aa, Entamoeba invadens
SSTTTNPKSNL

SEQ ID NO: 2910106 - protein, 7 aa, Entamoeba invadens
SSTVETI

SEQ ID NO: 2910107 - protein, 7 aa, Entamoeba invadens
SSTVNKK

SEQ ID NO: 2910108 - protein, 7 aa, Entamoeba invadens
SSTVYGN

SEQ ID NO: 2910109 - protein, 13 aa, Entamoeba invadens
SSTYNATNPFFED

SEQ ID NO: 2910110 - protein, 12 aa, Entamoeba invadens
SSTYSSPSLSPE

SEQ ID NO: 2910111 - protein, 5 aa, Entamoeba invadens
SSVDA

SEQ ID NO: 2910112 - protein, 5 aa, Entamoeba invadens
SSVDE

SEQ ID NO: 2910113 - protein, 7 aa, Entamoeba invadens
SSVDQNP

SEQ ID NO: 2910114 - protein, 9 aa, Entamoeba invadens
SSVDSSLSN

SEQ ID NO: 2910115 - protein, 12 aa, Entamoeba invadens
SSVDTTRMYTGF

SEQ ID NO: 2910116 - protein, 4 aa, Entamoeba invadens
SSVE

SEQ ID NO: 2910117 - protein, 14 aa, Entamoeba invadens
SSVEESEKFNGTKT

SEQ ID NO: 2910118 - protein, 17 aa, Entamoeba invadens
SSVEKTEKSDSTPTQVL

SEQ ID NO: 2910119 - protein, 4 aa, Entamoeba invadens
SSVG

SEQ ID NO: 2910120 - protein, 12 aa, Entamoeba invadens
SSVGEISGQTKT

SEQ ID NO: 2910121 - protein, 10 aa, Entamoeba invadens
SSVGIKQNKK

SEQ ID NO: 2910122 - protein, 6 aa, Entamoeba invadens
SSVGKT

SEQ ID NO: 2910123 - protein, 10 aa, Entamoeba invadens
SSVGKTSLTQ

SEQ ID NO: 2910124 - protein, 17 aa, Entamoeba invadens
SSVGPLSVSPKEKTENT

SEQ ID NO: 2910125 - protein, 12 aa, Entamoeba invadens
SSVITIGDNCFY

SEQ ID NO: 2910126 - protein, 4 aa, Entamoeba invadens
SSVK

SEQ ID NO: 2910127 - protein, 8 aa, Entamoeba invadens
SSVKDEEE

SEQ ID NO: 2910128 - protein, 10 aa, Entamoeba invadens
SSVKPKQNVI

SEQ ID NO: 2910129 - protein, 5 aa, Entamoeba invadens
SSVKS

SEQ ID NO: 2910130 - protein, 9 aa, Entamoeba invadens
SSVKSIGNN

SEQ ID NO: 2910131 - protein, 9 aa, Entamoeba invadens
SSVKSIGNS

SEQ ID NO: 2910132 - protein, 8 aa, Entamoeba invadens
SSVKSIGS

SEQ ID NO: 2910133 - protein, 4 aa, Entamoeba invadens
SSVN

SEQ ID NO: 2910134 - protein, 12 aa, Entamoeba invadens
SSVNISSSVTTI

SEQ ID NO: 2910135 - protein, 12 aa, Entamoeba invadens
SSVNLSSSVTTI

SEQ ID NO: 2910136 - protein, 7 aa, Entamoeba invadens
SSVNPFP

SEQ ID NO: 2910137 - protein, 5 aa, Entamoeba invadens
SSVPA

SEQ ID NO: 2910138 - protein, 9 aa, Entamoeba invadens
SSVPEAVKS

SEQ ID NO: 2910139 - protein, 9 aa, Entamoeba invadens
SSVPESSPY

SEQ ID NO: 2910140 - protein, 9 aa, Entamoeba invadens
SSVPGEGEH

SEQ ID NO: 2910141 - protein, 5 aa, Entamoeba invadens
SSVPL

SEQ ID NO: 2910142 - protein, 6 aa, Entamoeba invadens
SSVPQQ

SEQ ID NO: 2910143 - protein, 327 aa, Entamoeba invadens
SSVPSEVPSESKSKSEVVKNESSEVVKKESSSVVNKVSSNPPHVSSDVPNPPKQESSTIQIQSSSNPPKHQSSSVPSHSSNIPNQSSGVPTHSSSIPNHSSSIPNHSSSVPNHSSDVPKHESSNIPNQSSGIPSHSSSIPNQSSGVPSHSSNIPNHSSSIPNQSSGVPTHSSSIPNQSSGVPSHSSNIPNQSSDIPTHSSSIPNHSSSVPNHSSSGVPNQSSGVPNNSEQPPKDSEIPPPGDNSEQPPKDSSSTTPPFSEVPNSSEPPHKHDSFNPPKIDSEIPPPPYSDNPPHKEEEFSEPPKEKCEKKKDIFKEEKEKCDKPKRD

SEQ ID NO: 2910144 - protein, 7 aa, Entamoeba invadens
SSVQKSP

SEQ ID NO: 2910145 - protein, 6 aa, Entamoeba invadens
SSVRPT

SEQ ID NO: 2910146 - protein, 6 aa, Entamoeba invadens
SSVRSI

SEQ ID NO: 2910147 - protein, 14 aa, Entamoeba invadens
SSVSEKLGLGTSSR

SEQ ID NO: 2910148 - protein, 23 aa, Entamoeba invadens
SSVSFSTPGTPVKENVKADQTMG

SEQ ID NO: 2910149 - protein, 12 aa, Entamoeba invadens
SSVSGNMDGTNN

SEQ ID NO: 2910150 - protein, 8 aa, Entamoeba invadens
SSVSGTQF

SEQ ID NO: 2910151 - protein, 9 aa, Entamoeba invadens
SSVSNAVET

SEQ ID NO: 2910152 - protein, 7 aa, Entamoeba invadens
SSVSPFP

SEQ ID NO: 2910153 - protein, 8 aa, Entamoeba invadens
SSVSSIGE

SEQ ID NO: 2910154 - protein, 4 aa, Entamoeba invadens
SSVT

SEQ ID NO: 2910155 - protein, 7 aa, Entamoeba invadens
SSVTIPP

SEQ ID NO: 2910156 - protein, 9 aa, Entamoeba invadens
SSVTIPSSV

SEQ ID NO: 2910157 - protein, 10 aa, Entamoeba invadens
SSVTIPSSVR

SEQ ID NO: 2910158 - protein, 10 aa, Entamoeba invadens
SSVTIPSSVT

SEQ ID NO: 2910159 - protein, 11 aa, Entamoeba invadens
SSVTIPSSVTS

SEQ ID NO: 2910160 - protein, 13 aa, Entamoeba invadens
SSVTIPSSVTSIG

SEQ ID NO: 2910161 - protein, 5 aa, Entamoeba invadens
SSVTN

SEQ ID NO: 2910162 - protein, 7 aa, Entamoeba invadens
SSVTNNK

SEQ ID NO: 2910163 - protein, 8 aa, Entamoeba invadens
SSVTPSEI

SEQ ID NO: 2910164 - protein, 12 aa, Entamoeba invadens
SSVTSEEQAASI

SEQ ID NO: 2910165 - protein, 8 aa, Entamoeba invadens
SSVTSIGG

SEQ ID NO: 2910166 - protein, 9 aa, Entamoeba invadens
SSVTSPDYN

SEQ ID NO: 2910167 - protein, 5 aa, Entamoeba invadens
SSVTT

SEQ ID NO: 2910168 - protein, 6 aa, Entamoeba invadens
SSVTYK

SEQ ID NO: 2910169 - protein, 4 aa, Entamoeba invadens
SSVY

SEQ ID NO: 2910170 - protein, 9 aa, Entamoeba invadens
SSVYPSSSD

SEQ ID NO: 2910171 - protein, 6 aa, Entamoeba invadens
SSWNPY

SEQ ID NO: 2910172 - protein, 10 aa, Entamoeba invadens
SSYASGLQEL

SEQ ID NO: 2910173 - protein, 8 aa, Entamoeba invadens
SSYCNEED

SEQ ID NO: 2910174 - protein, 5 aa, Entamoeba invadens
SSYDK

SEQ ID NO: 2910175 - protein, 8 aa, Entamoeba invadens
SSYEGGVD

SEQ ID NO: 2910176 - protein, 8 aa, Entamoeba invadens
SSYESAYE

SEQ ID NO: 2910177 - protein, 6 aa, Entamoeba invadens
SSYEYG

SEQ ID NO: 2910178 - protein, 4 aa, Entamoeba invadens
SSYG

SEQ ID NO: 2910179 - protein, 12 aa, Entamoeba invadens
SSYGKTIQKPIK

SEQ ID NO: 2910180 - protein, 10 aa, Entamoeba invadens
SSYGRDVDRL

SEQ ID NO: 2910181 - protein, 16 aa, Entamoeba invadens
SSYKQDGDKEEITAEK

SEQ ID NO: 2910182 - protein, 4 aa, Entamoeba invadens
SSYN

SEQ ID NO: 2910183 - protein, 5 aa, Entamoeba invadens
SSYNA

SEQ ID NO: 2910184 - protein, 9 aa, Entamoeba invadens
SSYNSSKGV

SEQ ID NO: 2910185 - protein, 4 aa, Entamoeba invadens
SSYS

SEQ ID NO: 2910186 - protein, 8 aa, Entamoeba invadens
SSYSDTYN

SEQ ID NO: 2910187 - protein, 12 aa, Entamoeba invadens
SSYSRDEGDPVS

SEQ ID NO: 2910188 - protein, 25 aa, Entamoeba invadens
SSYTPPLESSQYGNENDNAENYEEY

SEQ ID NO: 2910189 - protein, 23 aa, Entamoeba invadens
SSYVRKGGLKAAPSPTHLLGTEI

SEQ ID NO: 2910190 - protein, 5 aa, Entamoeba invadens
STAAS

SEQ ID NO: 2910191 - protein, 33 aa, Entamoeba invadens
STADCSQIKSNLETSKRKSIKQSGDVLKPEEEQ

SEQ ID NO: 2910192 - protein, 6 aa, Entamoeba invadens
STAENV

SEQ ID NO: 2910193 - protein, 6 aa, Entamoeba invadens
STAETA

SEQ ID NO: 2910194 - protein, 7 aa, Entamoeba invadens
STAETPE

SEQ ID NO: 2910195 - protein, 7 aa, Entamoeba invadens
STAGKTA

SEQ ID NO: 2910196 - protein, 5 aa, Entamoeba invadens
STAKC

SEQ ID NO: 2910197 - protein, 6 aa, Entamoeba invadens
STAKNL

SEQ ID NO: 2910198 - protein, 16 aa, Entamoeba invadens
STAKSAQIEKDGSTER

SEQ ID NO: 2910199 - protein, 9 aa, Entamoeba invadens
STAKSLQSE

SEQ ID NO: 2910200 - protein, 7 aa, Entamoeba invadens
STAKSPI

SEQ ID NO: 2910201 - protein, 9 aa, Entamoeba invadens
STALPEIKK

SEQ ID NO: 2910202 - protein, 7 aa, Entamoeba invadens
STANETK

SEQ ID NO: 2910203 - protein, 22 aa, Entamoeba invadens
STANTKTSKTDTEMEQRAMEEE

SEQ ID NO: 2910204 - protein, 7 aa, Entamoeba invadens
STANTVD

SEQ ID NO: 2910205 - protein, 7 aa, Entamoeba invadens
STAPALE

SEQ ID NO: 2910206 - protein, 5 aa, Entamoeba invadens
STAPF

SEQ ID NO: 2910207 - protein, 7 aa, Entamoeba invadens
STAPNKV

SEQ ID NO: 2910208 - protein, 35 aa, Entamoeba invadens
STAPPSDNGSSSTRGGYDNDDDDDDGQQGGAQCQQ

SEQ ID NO: 2910209 - protein, 58 aa, Entamoeba invadens
STAPTGKKAPGGLMPPPPASKRQFAAPPSNSANKQVQQQPKQQAQPQQKKNDIDSLLF

SEQ ID NO: 2910210 - protein, 4 aa, Entamoeba invadens
STAQ

SEQ ID NO: 2910211 - protein, 19 aa, Entamoeba invadens
STAQRTTAQTDLNPNSSRS

SEQ ID NO: 2910212 - protein, 4 aa, Entamoeba invadens
STAS

SEQ ID NO: 2910213 - protein, 11 aa, Entamoeba invadens
STASERAGDTL

SEQ ID NO: 2910214 - protein, 10 aa, Entamoeba invadens
STASQGPLPA

SEQ ID NO: 2910215 - protein, 6 aa, Entamoeba invadens
STATFS

SEQ ID NO: 2910216 - protein, 6 aa, Entamoeba invadens
STATNG

SEQ ID NO: 2910217 - protein, 9 aa, Entamoeba invadens
STATQAQTE

SEQ ID NO: 2910218 - protein, 17 aa, Entamoeba invadens
STATTVSDGKISCSDES

SEQ ID NO: 2910219 - protein, 4 aa, Entamoeba invadens
STAV

SEQ ID NO: 2910220 - protein, 10 aa, Entamoeba invadens
STAVTNPNIL

SEQ ID NO: 2910221 - protein, 7 aa, Entamoeba invadens
STAYGSG

SEQ ID NO: 2910222 - protein, 6 aa, Entamoeba invadens
STCDPG

SEQ ID NO: 2910223 - protein, 6 aa, Entamoeba invadens
STCDTT

SEQ ID NO: 2910224 - protein, 13 aa, Entamoeba invadens
STCEKNQCDTSTG

SEQ ID NO: 2910225 - protein, 11 aa, Entamoeba invadens
STCGEKCDPTY

SEQ ID NO: 2910226 - protein, 17 aa, Entamoeba invadens
STCGGKCDGVSGECTGC

SEQ ID NO: 2910227 - protein, 12 aa, Entamoeba invadens
STCGGSCDATNG

SEQ ID NO: 2910228 - protein, 14 aa, Entamoeba invadens
STCKPNTCDSTSGF

SEQ ID NO: 2910229 - protein, 13 aa, Entamoeba invadens
STCKPNTCDSTTE

SEQ ID NO: 2910230 - protein, 4 aa, Entamoeba invadens
STCN

SEQ ID NO: 2910231 - protein, 12 aa, Entamoeba invadens
STCNTKDALHQK

SEQ ID NO: 2910232 - protein, 7 aa, Entamoeba invadens
STCNTNS

SEQ ID NO: 2910233 - protein, 7 aa, Entamoeba invadens
STCSGPI

SEQ ID NO: 2910234 - protein, 10 aa, Entamoeba invadens
STCTGSLTSM

SEQ ID NO: 2910235 - protein, 7 aa, Entamoeba invadens
STDATLE

SEQ ID NO: 2910236 - protein, 13 aa, Entamoeba invadens
STDCQKYGEEIPE

SEQ ID NO: 2910237 - protein, 9 aa, Entamoeba invadens
STDDHETEV

SEQ ID NO: 2910238 - protein, 5 aa, Entamoeba invadens
STDDP

SEQ ID NO: 2910239 - protein, 9 aa, Entamoeba invadens
STDEDGGKC

SEQ ID NO: 2910240 - protein, 7 aa, Entamoeba invadens
STDEKWN

SEQ ID NO: 2910241 - protein, 7 aa, Entamoeba invadens
STDETTM

SEQ ID NO: 2910242 - protein, 6 aa, Entamoeba invadens
STDFPR

SEQ ID NO: 2910243 - protein, 4 aa, Entamoeba invadens
STDG

SEQ ID NO: 2910244 - protein, 11 aa, Entamoeba invadens
STDGDTHLGGK

SEQ ID NO: 2910245 - protein, 37 aa, Entamoeba invadens
STDIDKSLERSEGSQSVKLSKEKSSTPFEKTKVDDVS

SEQ ID NO: 2910246 - protein, 10 aa, Entamoeba invadens
STDIPVDSET

SEQ ID NO: 2910247 - protein, 7 aa, Entamoeba invadens
STDKEYC

SEQ ID NO: 2910248 - protein, 13 aa, Entamoeba invadens
STDKIKKSEVQEK

SEQ ID NO: 2910249 - protein, 8 aa, Entamoeba invadens
STDKPKEI

SEQ ID NO: 2910250 - protein, 7 aa, Entamoeba invadens
STDKQPH

SEQ ID NO: 2910251 - protein, 20 aa, Entamoeba invadens
STDLPQRRKEDVSDDDTCPN

SEQ ID NO: 2910252 - protein, 8 aa, Entamoeba invadens
STDPAARG

SEQ ID NO: 2910253 - protein, 8 aa, Entamoeba invadens
STDPNEVI

SEQ ID NO: 2910254 - protein, 7 aa, Entamoeba invadens
STDPPHA

SEQ ID NO: 2910255 - protein, 9 aa, Entamoeba invadens
STDPQEPAS

SEQ ID NO: 2910256 - protein, 5 aa, Entamoeba invadens
STDRQ

SEQ ID NO: 2910257 - protein, 4 aa, Entamoeba invadens
STDS

SEQ ID NO: 2910258 - protein, 6 aa, Entamoeba invadens
STDSIG

SEQ ID NO: 2910259 - protein, 8 aa, Entamoeba invadens
STDSIQNK

SEQ ID NO: 2910260 - protein, 12 aa, Entamoeba invadens
STDSKIDFPNTE

SEQ ID NO: 2910261 - protein, 14 aa, Entamoeba invadens
STDSTTESSSSLLT

SEQ ID NO: 2910262 - protein, 8 aa, Entamoeba invadens
STDTQGRY

SEQ ID NO: 2910263 - protein, 13 aa, Entamoeba invadens
STDTVIKNGEQIA

SEQ ID NO: 2910264 - protein, 7 aa, Entamoeba invadens
STDVTPF

SEQ ID NO: 2910265 - protein, 6 aa, Entamoeba invadens
STDYSV

SEQ ID NO: 2910266 - protein, 10 aa, Entamoeba invadens
STEACGTHKV

SEQ ID NO: 2910267 - protein, 6 aa, Entamoeba invadens
STECTK

SEQ ID NO: 2910268 - protein, 8 aa, Entamoeba invadens
STEDALDN

SEQ ID NO: 2910269 - protein, 8 aa, Entamoeba invadens
STEDKNER

SEQ ID NO: 2910270 - protein, 33 aa, Entamoeba invadens
STEDPSAAEKRKLEGKNGNRRSLQSEDGDTDTV

SEQ ID NO: 2910271 - protein, 7 aa, Entamoeba invadens
STEDQKR

SEQ ID NO: 2910272 - protein, 4 aa, Entamoeba invadens
STEE

SEQ ID NO: 2910273 - protein, 11 aa, Entamoeba invadens
STEEAETIASA

SEQ ID NO: 2910274 - protein, 7 aa, Entamoeba invadens
STEEDQC

SEQ ID NO: 2910275 - protein, 17 aa, Entamoeba invadens
STEEDVDNSKEISSEEI

SEQ ID NO: 2910276 - protein, 5 aa, Entamoeba invadens
STEEK

SEQ ID NO: 2910277 - protein, 7 aa, Entamoeba invadens
STEEKKK

SEQ ID NO: 2910278 - protein, 6 aa, Entamoeba invadens
STEERA

SEQ ID NO: 2910279 - protein, 10 aa, Entamoeba invadens
STEERSEEYE

SEQ ID NO: 2910280 - protein, 5 aa, Entamoeba invadens
STEES

SEQ ID NO: 2910281 - protein, 35 aa, Entamoeba invadens
STEESDENCTLNEESPSGTEEDKQVQNTTKPVTEK

SEQ ID NO: 2910282 - protein, 9 aa, Entamoeba invadens
STEESSSSM

SEQ ID NO: 2910283 - protein, 8 aa, Entamoeba invadens
STEETLTQ

SEQ ID NO: 2910284 - protein, 7 aa, Entamoeba invadens
STEETSE

SEQ ID NO: 2910285 - protein, 7 aa, Entamoeba invadens
STEFPGV

SEQ ID NO: 2910286 - protein, 11 aa, Entamoeba invadens
STEGCKKVKGL

SEQ ID NO: 2910287 - protein, 6 aa, Entamoeba invadens
STEGME

SEQ ID NO: 2910288 - protein, 7 aa, Entamoeba invadens
STEGRSQ

SEQ ID NO: 2910289 - protein, 5 aa, Entamoeba invadens
STEGT

SEQ ID NO: 2910290 - protein, 6 aa, Entamoeba invadens
STEGVT

SEQ ID NO: 2910291 - protein, 8 aa, Entamoeba invadens
STEIEEES

SEQ ID NO: 2910292 - protein, 8 aa, Entamoeba invadens
STEIKNTS

SEQ ID NO: 2910293 - protein, 6 aa, Entamoeba invadens
STEKAK

SEQ ID NO: 2910294 - protein, 10 aa, Entamoeba invadens
STEKKKPQKT

SEQ ID NO: 2910295 - protein, 10 aa, Entamoeba invadens
STEKKLDVSP

SEQ ID NO: 2910296 - protein, 7 aa, Entamoeba invadens
STEKNTQ

SEQ ID NO: 2910297 - protein, 8 aa, Entamoeba invadens
STEKQEEF

SEQ ID NO: 2910298 - protein, 5 aa, Entamoeba invadens
STEKR

SEQ ID NO: 2910299 - protein, 13 aa, Entamoeba invadens
STEKRTLSVNQSG

SEQ ID NO: 2910300 - protein, 7 aa, Entamoeba invadens
STELGEQ

SEQ ID NO: 2910301 - protein, 8 aa, Entamoeba invadens
STELKKDE

SEQ ID NO: 2910302 - protein, 11 aa, Entamoeba invadens
STELKNKRKNR

SEQ ID NO: 2910303 - protein, 5 aa, Entamoeba invadens
STELS

SEQ ID NO: 2910304 - protein, 6 aa, Entamoeba invadens
STENEH

SEQ ID NO: 2910305 - protein, 6 aa, Entamoeba invadens
STENTK

SEQ ID NO: 2910306 - protein, 9 aa, Entamoeba invadens
STENTQEQI

SEQ ID NO: 2910307 - protein, 4 aa, Entamoeba invadens
STEP

SEQ ID NO: 2910308 - protein, 7 aa, Entamoeba invadens
STEPAKF

SEQ ID NO: 2910309 - protein, 5 aa, Entamoeba invadens
STEPD

SEQ ID NO: 2910310 - protein, 10 aa, Entamoeba invadens
STEPEQRPKF

SEQ ID NO: 2910311 - protein, 7 aa, Entamoeba invadens
STEPFEK

SEQ ID NO: 2910312 - protein, 7 aa, Entamoeba invadens
STEPITS

SEQ ID NO: 2910313 - protein, 7 aa, Entamoeba invadens
STEPRQM

SEQ ID NO: 2910314 - protein, 9 aa, Entamoeba invadens
STEPTESYK

SEQ ID NO: 2910315 - protein, 7 aa, Entamoeba invadens
STEQEEA

SEQ ID NO: 2910316 - protein, 4 aa, Entamoeba invadens
STER

SEQ ID NO: 2910317 - protein, 15 aa, Entamoeba invadens
STERSSTVSTQSEQT

SEQ ID NO: 2910318 - protein, 9 aa, Entamoeba invadens
STESDPLQI

SEQ ID NO: 2910319 - protein, 5 aa, Entamoeba invadens
STESE

SEQ ID NO: 2910320 - protein, 5 aa, Entamoeba invadens
STESS

SEQ ID NO: 2910321 - protein, 5 aa, Entamoeba invadens
STESY

SEQ ID NO: 2910322 - protein, 6 aa, Entamoeba invadens
STESYG

SEQ ID NO: 2910323 - protein, 6 aa, Entamoeba invadens
STETDI

SEQ ID NO: 2910324 - protein, 14 aa, Entamoeba invadens
STETIPDEEQYTKP

SEQ ID NO: 2910325 - protein, 9 aa, Entamoeba invadens
STETKTRYD

SEQ ID NO: 2910326 - protein, 9 aa, Entamoeba invadens
STETKVTNN

SEQ ID NO: 2910327 - protein, 7 aa, Entamoeba invadens
STETLND

SEQ ID NO: 2910328 - protein, 15 aa, Entamoeba invadens
STETPSLRESEENVF

SEQ ID NO: 2910329 - protein, 6 aa, Entamoeba invadens
STEVKD

SEQ ID NO: 2910330 - protein, 16 aa, Entamoeba invadens
STEYEGYDNVSGPIKE

SEQ ID NO: 2910331 - protein, 6 aa, Entamoeba invadens
STEYKE

SEQ ID NO: 2910332 - protein, 11 aa, Entamoeba invadens
STFDDGSFNYN

SEQ ID NO: 2910333 - protein, 12 aa, Entamoeba invadens
STFEKNQRLKNE

SEQ ID NO: 2910334 - protein, 5 aa, Entamoeba invadens
STFEN

SEQ ID NO: 2910335 - protein, 7 aa, Entamoeba invadens
STFEQQK

SEQ ID NO: 2910336 - protein, 4 aa, Entamoeba invadens
STFG

SEQ ID NO: 2910337 - protein, 11 aa, Entamoeba invadens
STFNDKDPKYT

SEQ ID NO: 2910338 - protein, 11 aa, Entamoeba invadens
STFNNKNIKPH

SEQ ID NO: 2910339 - protein, 7 aa, Entamoeba invadens
STFPEEY

SEQ ID NO: 2910340 - protein, 11 aa, Entamoeba invadens
STFPKRKNDHI

SEQ ID NO: 2910341 - protein, 6 aa, Entamoeba invadens
STFPPK

SEQ ID NO: 2910342 - protein, 6 aa, Entamoeba invadens
STFSIE

SEQ ID NO: 2910343 - protein, 12 aa, Entamoeba invadens
STFTAQSGQLCT

SEQ ID NO: 2910344 - protein, 7 aa, Entamoeba invadens
STFTEEK

SEQ ID NO: 2910345 - protein, 9 aa, Entamoeba invadens
STFTPTDKS

SEQ ID NO: 2910346 - protein, 4 aa, Entamoeba invadens
STFV

SEQ ID NO: 2910347 - protein, 8 aa, Entamoeba invadens
STFVEESE

SEQ ID NO: 2910348 - protein, 4 aa, Entamoeba invadens
STGA

SEQ ID NO: 2910349 - protein, 5 aa, Entamoeba invadens
STGAT

SEQ ID NO: 2910350 - protein, 7 aa, Entamoeba invadens
STGATQL

SEQ ID NO: 2910351 - protein, 6 aa, Entamoeba invadens
STGDDS

SEQ ID NO: 2910352 - protein, 5 aa, Entamoeba invadens
STGDL

SEQ ID NO: 2910353 - protein, 7 aa, Entamoeba invadens
STGDRKS

SEQ ID NO: 2910354 - protein, 7 aa, Entamoeba invadens
STGDVEE

SEQ ID NO: 2910355 - protein, 18 aa, Entamoeba invadens
STGETALDTALNSDGNRK

SEQ ID NO: 2910356 - protein, 7 aa, Entamoeba invadens
STGFGQL

SEQ ID NO: 2910357 - protein, 7 aa, Entamoeba invadens
STGGVKV

SEQ ID NO: 2910358 - protein, 15 aa, Entamoeba invadens
STGHGSIREPNDIST

SEQ ID NO: 2910359 - protein, 9 aa, Entamoeba invadens
STGHKNVKY

SEQ ID NO: 2910360 - protein, 9 aa, Entamoeba invadens
STGIKQPSK

SEQ ID NO: 2910361 - protein, 15 aa, Entamoeba invadens
STGIVDSGTLSKTTA

SEQ ID NO: 2910362 - protein, 11 aa, Entamoeba invadens
STGKPHDKKTI

SEQ ID NO: 2910363 - protein, 11 aa, Entamoeba invadens
STGKRGTLKAE

SEQ ID NO: 2910364 - protein, 10 aa, Entamoeba invadens
STGKSYVKTG

SEQ ID NO: 2910365 - protein, 24 aa, Entamoeba invadens
STGLSAPLKHGSPYSSLSGSPRTF

SEQ ID NO: 2910366 - protein, 20 aa, Entamoeba invadens
STGMSDGKHTTAEYSPEDKT

SEQ ID NO: 2910367 - protein, 4 aa, Entamoeba invadens
STGN

SEQ ID NO: 2910368 - protein, 8 aa, Entamoeba invadens
STGNSGEV

SEQ ID NO: 2910369 - protein, 5 aa, Entamoeba invadens
STGNY

SEQ ID NO: 2910370 - protein, 9 aa, Entamoeba invadens
STGPNSAKL

SEQ ID NO: 2910371 - protein, 9 aa, Entamoeba invadens
STGRPCPGA

SEQ ID NO: 2910372 - protein, 18 aa, Entamoeba invadens
STGRSTGKKITLFTALDQ

SEQ ID NO: 2910373 - protein, 7 aa, Entamoeba invadens
STGSNEA

SEQ ID NO: 2910374 - protein, 25 aa, Entamoeba invadens
STGSSTHKKKEAKSTPLFSTSSSKK

SEQ ID NO: 2910375 - protein, 5 aa, Entamoeba invadens
STGSY

SEQ ID NO: 2910376 - protein, 4 aa, Entamoeba invadens
STGT

SEQ ID NO: 2910377 - protein, 8 aa, Entamoeba invadens
STGVNTQN

SEQ ID NO: 2910378 - protein, 17 aa, Entamoeba invadens
STGVTVEKPVQNEEPTH

SEQ ID NO: 2910379 - protein, 7 aa, Entamoeba invadens
STGYGES

SEQ ID NO: 2910380 - protein, 19 aa, Entamoeba invadens
STGYGKQKDVVKDVPSEAN

SEQ ID NO: 2910381 - protein, 5 aa, Entamoeba invadens
STGYP

SEQ ID NO: 2910382 - protein, 8 aa, Entamoeba invadens
STHDDEMK

SEQ ID NO: 2910383 - protein, 4 aa, Entamoeba invadens
STHK

SEQ ID NO: 2910384 - protein, 8 aa, Entamoeba invadens
STHKSSNV

SEQ ID NO: 2910385 - protein, 5 aa, Entamoeba invadens
STHNG

SEQ ID NO: 2910386 - protein, 39 aa, Entamoeba invadens
STHPESDPQPHDDVPKDIKKTGKVTKKKIDSKSVEEEAV

SEQ ID NO: 2910387 - protein, 4 aa, Entamoeba invadens
STHQ

SEQ ID NO: 2910388 - protein, 6 aa, Entamoeba invadens
STHQKG

SEQ ID NO: 2910389 - protein, 5 aa, Entamoeba invadens
STHSA

SEQ ID NO: 2910390 - protein, 5 aa, Entamoeba invadens
STHTG

SEQ ID NO: 2910391 - protein, 30 aa, Entamoeba invadens
STHTNRSEDVTNSTNLTQSQSTYQSPYTSE

SEQ ID NO: 2910392 - protein, 13 aa, Entamoeba invadens
STHYTNSHVDRAR

SEQ ID NO: 2910393 - protein, 5 aa, Entamoeba invadens
STIAS

SEQ ID NO: 2910394 - protein, 6 aa, Entamoeba invadens
STIERE

SEQ ID NO: 2910395 - protein, 10 aa, Entamoeba invadens
STIESHSNST

SEQ ID NO: 2910396 - protein, 8 aa, Entamoeba invadens
STIGENGI

SEQ ID NO: 2910397 - protein, 7 aa, Entamoeba invadens
STIGETQ

SEQ ID NO: 2910398 - protein, 9 aa, Entamoeba invadens
STIGQNERQ

SEQ ID NO: 2910399 - protein, 23 aa, Entamoeba invadens
STIKQRSSSAKPRIRNEKRNGMR

SEQ ID NO: 2910400 - protein, 6 aa, Entamoeba invadens
STIPEN

SEQ ID NO: 2910401 - protein, 6 aa, Entamoeba invadens
STIPRP

SEQ ID NO: 2910402 - protein, 6 aa, Entamoeba invadens
STIPSQ

SEQ ID NO: 2910403 - protein, 26 aa, Entamoeba invadens
STIPTQLKTPEKPLPQTTPQKIEKEE

SEQ ID NO: 2910404 - protein, 13 aa, Entamoeba invadens
STIQPPKPVSPKE

SEQ ID NO: 2910405 - protein, 5 aa, Entamoeba invadens
STIQS

SEQ ID NO: 2910406 - protein, 24 aa, Entamoeba invadens
STIQSSSSEMSKLPQNTRRTKPEE

SEQ ID NO: 2910407 - protein, 4 aa, Entamoeba invadens
STIR

SEQ ID NO: 2910408 - protein, 12 aa, Entamoeba invadens
STISIQAEEKEL

SEQ ID NO: 2910409 - protein, 13 aa, Entamoeba invadens
STISTMNSSRSKG

SEQ ID NO: 2910410 - protein, 6 aa, Entamoeba invadens
STITEK

SEQ ID NO: 2910411 - protein, 5 aa, Entamoeba invadens
STITK

SEQ ID NO: 2910412 - protein, 12 aa, Entamoeba invadens
STITSIGGGAFS

SEQ ID NO: 2910413 - protein, 6 aa, Entamoeba invadens
STITSM

SEQ ID NO: 2910414 - protein, 21 aa, Entamoeba invadens
STIYQTTDKSDSDDDESEEGA

SEQ ID NO: 2910415 - protein, 15 aa, Entamoeba invadens
STKAFQKKNVDVTPK

SEQ ID NO: 2910416 - protein, 9 aa, Entamoeba invadens
STKAQRQVK

SEQ ID NO: 2910417 - protein, 7 aa, Entamoeba invadens
STKARCP

SEQ ID NO: 2910418 - protein, 10 aa, Entamoeba invadens
STKASNEIEQ

SEQ ID NO: 2910419 - protein, 8 aa, Entamoeba invadens
STKDDYAV

SEQ ID NO: 2910420 - protein, 10 aa, Entamoeba invadens
STKDNLTAKA

SEQ ID NO: 2910421 - protein, 21 aa, Entamoeba invadens
STKDSKITELQKTNEQLTNSL

SEQ ID NO: 2910422 - protein, 10 aa, Entamoeba invadens
STKDYESNPR

SEQ ID NO: 2910423 - protein, 8 aa, Entamoeba invadens
STKEEPFD

SEQ ID NO: 2910424 - protein, 14 aa, Entamoeba invadens
STKEEVIAKGKKME

SEQ ID NO: 2910425 - protein, 6 aa, Entamoeba invadens
STKEKY

SEQ ID NO: 2910426 - protein, 9 aa, Entamoeba invadens
STKENSIPY

SEQ ID NO: 2910427 - protein, 7 aa, Entamoeba invadens
STKESDL

SEQ ID NO: 2910428 - protein, 7 aa, Entamoeba invadens
STKETNV

SEQ ID NO: 2910429 - protein, 8 aa, Entamoeba invadens
STKGGMGQ

SEQ ID NO: 2910430 - protein, 5 aa, Entamoeba invadens
STKHR

SEQ ID NO: 2910431 - protein, 7 aa, Entamoeba invadens
STKIEEL

SEQ ID NO: 2910432 - protein, 6 aa, Entamoeba invadens
STKIKS

SEQ ID NO: 2910433 - protein, 9 aa, Entamoeba invadens
STKISPPCQ

SEQ ID NO: 2910434 - protein, 4 aa, Entamoeba invadens
STKK

SEQ ID NO: 2910435 - protein, 12 aa, Entamoeba invadens
STKKENVPFNQK

SEQ ID NO: 2910436 - protein, 10 aa, Entamoeba invadens
STKKERTKDD

SEQ ID NO: 2910437 - protein, 9 aa, Entamoeba invadens
STKKIDSDI

SEQ ID NO: 2910438 - protein, 10 aa, Entamoeba invadens
STKKLTKDDW

SEQ ID NO: 2910439 - protein, 12 aa, Entamoeba invadens
STKNEKTSEQNY

SEQ ID NO: 2910440 - protein, 10 aa, Entamoeba invadens
STKNGSAFNE

SEQ ID NO: 2910441 - protein, 14 aa, Entamoeba invadens
STKNKEMESQTSRV

SEQ ID NO: 2910442 - protein, 5 aa, Entamoeba invadens
STKNM

SEQ ID NO: 2910443 - protein, 5 aa, Entamoeba invadens
STKNP

SEQ ID NO: 2910444 - protein, 7 aa, Entamoeba invadens
STKPIKS

SEQ ID NO: 2910445 - protein, 5 aa, Entamoeba invadens
STKPL

SEQ ID NO: 2910446 - protein, 16 aa, Entamoeba invadens
STKPPFERDRDTTRRR

SEQ ID NO: 2910447 - protein, 8 aa, Entamoeba invadens
STKPSSTV

SEQ ID NO: 2910448 - protein, 7 aa, Entamoeba invadens
STKPTNF

SEQ ID NO: 2910449 - protein, 12 aa, Entamoeba invadens
STKQDAGYQDGV

SEQ ID NO: 2910450 - protein, 12 aa, Entamoeba invadens
STKRKGTKEQED

SEQ ID NO: 2910451 - protein, 22 aa, Entamoeba invadens
STKRKVQKKRTASQSNEDDEPK

SEQ ID NO: 2910452 - protein, 8 aa, Entamoeba invadens
STKRVEGK

SEQ ID NO: 2910453 - protein, 5 aa, Entamoeba invadens
STKRY

SEQ ID NO: 2910454 - protein, 10 aa, Entamoeba invadens
STKSCGPMQK

SEQ ID NO: 2910455 - protein, 6 aa, Entamoeba invadens
STKSEI

SEQ ID NO: 2910456 - protein, 7 aa, Entamoeba invadens
STKSGCG

SEQ ID NO: 2910457 - protein, 8 aa, Entamoeba invadens
STKSKFEK

SEQ ID NO: 2910458 - protein, 9 aa, Entamoeba invadens
STKSKSEVD

SEQ ID NO: 2910459 - protein, 8 aa, Entamoeba invadens
STKSLVPT

SEQ ID NO: 2910460 - protein, 8 aa, Entamoeba invadens
STKSQKVR

SEQ ID NO: 2910461 - protein, 7 aa, Entamoeba invadens
STKSQST

SEQ ID NO: 2910462 - protein, 6 aa, Entamoeba invadens
STKSRV

SEQ ID NO: 2910463 - protein, 7 aa, Entamoeba invadens
STKTCSS

SEQ ID NO: 2910464 - protein, 8 aa, Entamoeba invadens
STKTEIEN

SEQ ID NO: 2910465 - protein, 6 aa, Entamoeba invadens
STKTGA

SEQ ID NO: 2910466 - protein, 7 aa, Entamoeba invadens
STKTGPE

SEQ ID NO: 2910467 - protein, 13 aa, Entamoeba invadens
STKTQTTEKPIRI

SEQ ID NO: 2910468 - protein, 5 aa, Entamoeba invadens
STKTS

SEQ ID NO: 2910469 - protein, 66 aa, Entamoeba invadens
STKTSKKKQKPKKKKETQDKKSEKKSETSNETKDDKIDEEKQTENVKSAITENQDDDKRNEIKEEA

SEQ ID NO: 2910470 - protein, 11 aa, Entamoeba invadens
STKYTRNDGNA

SEQ ID NO: 2910471 - protein, 5 aa, Entamoeba invadens
STLDQ

SEQ ID NO: 2910472 - protein, 20 aa, Entamoeba invadens
STLEPQKHPSPTQKQQSPRE

SEQ ID NO: 2910473 - protein, 4 aa, Entamoeba invadens
STLG

SEQ ID NO: 2910474 - protein, 5 aa, Entamoeba invadens
STLGD

SEQ ID NO: 2910475 - protein, 6 aa, Entamoeba invadens
STLKDD

SEQ ID NO: 2910476 - protein, 11 aa, Entamoeba invadens
STLKDTPPYDP

SEQ ID NO: 2910477 - protein, 29 aa, Entamoeba invadens
STLKHSSAENYDENKRKMNEENDAGQYTR

SEQ ID NO: 2910478 - protein, 6 aa, Entamoeba invadens
STLKKA

SEQ ID NO: 2910479 - protein, 9 aa, Entamoeba invadens
STLNEANLT

SEQ ID NO: 2910480 - protein, 8 aa, Entamoeba invadens
STLPDDES

SEQ ID NO: 2910481 - protein, 5 aa, Entamoeba invadens
STLPG

SEQ ID NO: 2910482 - protein, 22 aa, Entamoeba invadens
STLPLNPNTFEGRHTPQTPKSV

SEQ ID NO: 2910483 - protein, 9 aa, Entamoeba invadens
STLPNQPDF

SEQ ID NO: 2910484 - protein, 13 aa, Entamoeba invadens
STLPQNQKAKQAI

SEQ ID NO: 2910485 - protein, 11 aa, Entamoeba invadens
STLQNTTNVKA

SEQ ID NO: 2910486 - protein, 15 aa, Entamoeba invadens
STLQTPQKSPSVPRV

SEQ ID NO: 2910487 - protein, 4 aa, Entamoeba invadens
STLR

SEQ ID NO: 2910488 - protein, 6 aa, Entamoeba invadens
STLSGS

SEQ ID NO: 2910489 - protein, 23 aa, Entamoeba invadens
STLSKRKKQRKNITRQRLTETYD

SEQ ID NO: 2910490 - protein, 24 aa, Entamoeba invadens
STLSKSSYQLGTRPDASKTKVSKV

SEQ ID NO: 2910491 - protein, 5 aa, Entamoeba invadens
STLSN

SEQ ID NO: 2910492 - protein, 14 aa, Entamoeba invadens
STLSPHKKEENKRP

SEQ ID NO: 2910493 - protein, 6 aa, Entamoeba invadens
STLSPT

SEQ ID NO: 2910494 - protein, 8 aa, Entamoeba invadens
STLSSTET

SEQ ID NO: 2910495 - protein, 17 aa, Entamoeba invadens
STLSTESDSKFTQLKPP

SEQ ID NO: 2910496 - protein, 4 aa, Entamoeba invadens
STLT

SEQ ID NO: 2910497 - protein, 5 aa, Entamoeba invadens
STLTN

SEQ ID NO: 2910498 - protein, 7 aa, Entamoeba invadens
STLTPPT

SEQ ID NO: 2910499 - protein, 10 aa, Entamoeba invadens
STLTQNSNLE

SEQ ID NO: 2910500 - protein, 10 aa, Entamoeba invadens
STLTSSVQSN

SEQ ID NO: 2910501 - protein, 29 aa, Entamoeba invadens
STLVQQSEHTFDHKEKAYNKDVDDKALDS

SEQ ID NO: 2910502 - protein, 4 aa, Entamoeba invadens
STMD

SEQ ID NO: 2910503 - protein, 10 aa, Entamoeba invadens
STMISDEGGL

SEQ ID NO: 2910504 - protein, 9 aa, Entamoeba invadens
STMKQDTYA

SEQ ID NO: 2910505 - protein, 18 aa, Entamoeba invadens
STMNNNAQSPDVFAFDED

SEQ ID NO: 2910506 - protein, 10 aa, Entamoeba invadens
STMPDTKRTR

SEQ ID NO: 2910507 - protein, 7 aa, Entamoeba invadens
STMSGST

SEQ ID NO: 2910508 - protein, 5 aa, Entamoeba invadens
STMSS

SEQ ID NO: 2910509 - protein, 5 aa, Entamoeba invadens
STMSV

SEQ ID NO: 2910510 - protein, 8 aa, Entamoeba invadens
STMTPTKR

SEQ ID NO: 2910511 - protein, 12 aa, Entamoeba invadens
STNCTSCQNSYY

SEQ ID NO: 2910512 - protein, 11 aa, Entamoeba invadens
STNDCSDSPIN

SEQ ID NO: 2910513 - protein, 14 aa, Entamoeba invadens
STNDDERNPSYVKN

SEQ ID NO: 2910514 - protein, 10 aa, Entamoeba invadens
STNDDYSNLG

SEQ ID NO: 2910515 - protein, 6 aa, Entamoeba invadens
STNDNF

SEQ ID NO: 2910516 - protein, 31 aa, Entamoeba invadens
STNEAEEIARQKTCEKQKMRRSVKKEKMMKP

SEQ ID NO: 2910517 - protein, 16 aa, Entamoeba invadens
STNEDNTLDFHNYTAL

SEQ ID NO: 2910518 - protein, 11 aa, Entamoeba invadens
STNEERTKEKL

SEQ ID NO: 2910519 - protein, 10 aa, Entamoeba invadens
STNEETKNRL

SEQ ID NO: 2910520 - protein, 6 aa, Entamoeba invadens
STNEEY

SEQ ID NO: 2910521 - protein, 5 aa, Entamoeba invadens
STNEI

SEQ ID NO: 2910522 - protein, 13 aa, Entamoeba invadens
STNEKDANFNYTA

SEQ ID NO: 2910523 - protein, 10 aa, Entamoeba invadens
STNEKTKNRL

SEQ ID NO: 2910524 - protein, 12 aa, Entamoeba invadens
STNESDTFENEN

SEQ ID NO: 2910525 - protein, 5 aa, Entamoeba invadens
STNFR

SEQ ID NO: 2910526 - protein, 5 aa, Entamoeba invadens
STNGC

SEQ ID NO: 2910527 - protein, 7 aa, Entamoeba invadens
STNGFTA

SEQ ID NO: 2910528 - protein, 6 aa, Entamoeba invadens
STNGGW

SEQ ID NO: 2910529 - protein, 7 aa, Entamoeba invadens
STNGTLL

SEQ ID NO: 2910530 - protein, 7 aa, Entamoeba invadens
STNGTLV

SEQ ID NO: 2910531 - protein, 7 aa, Entamoeba invadens
STNGVEK

SEQ ID NO: 2910532 - protein, 26 aa, Entamoeba invadens
STNGVQKSQVNSKKDQFTKSRNWQSQ

SEQ ID NO: 2910533 - protein, 30 aa, Entamoeba invadens
STNINNSFTGRTSKNTHKIMPSPTQSRLAS

SEQ ID NO: 2910534 - protein, 13 aa, Entamoeba invadens
STNITQPDAVSAT

SEQ ID NO: 2910535 - protein, 9 aa, Entamoeba invadens
STNKCQTLG

SEQ ID NO: 2910536 - protein, 12 aa, Entamoeba invadens
STNKDAGYQDGV

SEQ ID NO: 2910537 - protein, 21 aa, Entamoeba invadens
STNKGFPEQKKNEKRKQKKKH

SEQ ID NO: 2910538 - protein, 9 aa, Entamoeba invadens
STNKVNSIE

SEQ ID NO: 2910539 - protein, 4 aa, Entamoeba invadens
STNL

SEQ ID NO: 2910540 - protein, 8 aa, Entamoeba invadens
STNNENDA

SEQ ID NO: 2910541 - protein, 17 aa, Entamoeba invadens
STNNSMDDDENKIEIDS

SEQ ID NO: 2910542 - protein, 7 aa, Entamoeba invadens
STNNVTE

SEQ ID NO: 2910543 - protein, 8 aa, Entamoeba invadens
STNPNSIK

SEQ ID NO: 2910544 - protein, 11 aa, Entamoeba invadens
STNQKKQNQSI

SEQ ID NO: 2910545 - protein, 11 aa, Entamoeba invadens
STNSENKTAMP

SEQ ID NO: 2910546 - protein, 18 aa, Entamoeba invadens
STNSGNDRTEGVIQTDPE

SEQ ID NO: 2910547 - protein, 6 aa, Entamoeba invadens
STNSKL

SEQ ID NO: 2910548 - protein, 8 aa, Entamoeba invadens
STNSKYIE

SEQ ID NO: 2910549 - protein, 9 aa, Entamoeba invadens
STNSQNDSL

SEQ ID NO: 2910550 - protein, 11 aa, Entamoeba invadens
STNTDQCESCS

SEQ ID NO: 2910551 - protein, 5 aa, Entamoeba invadens
STNTN

SEQ ID NO: 2910552 - protein, 12 aa, Entamoeba invadens
STNVGKSSIVSS

SEQ ID NO: 2910553 - protein, 7 aa, Entamoeba invadens
STNVKIE

SEQ ID NO: 2910554 - protein, 12 aa, Entamoeba invadens
STNVSSQQSEEL

SEQ ID NO: 2910555 - protein, 6 aa, Entamoeba invadens
STNVTS

SEQ ID NO: 2910556 - protein, 6 aa, Entamoeba invadens
STNWQG

SEQ ID NO: 2910557 - protein, 17 aa, Entamoeba invadens
STNYKTLTGDCKSQSSI

SEQ ID NO: 2910558 - protein, 15 aa, Entamoeba invadens
STNYKTNGGDCLPQK

SEQ ID NO: 2910559 - protein, 69 aa, Entamoeba invadens
STPAKGTDQSRSPHTTHTSDSFEGKTEQKKTGRYVKANKKKSNALPPIEDKKPRKRSNKIYTKDQKEQL

SEQ ID NO: 2910560 - protein, 13 aa, Entamoeba invadens
STPASEKKEPTDH

SEQ ID NO: 2910561 - protein, 4 aa, Entamoeba invadens
STPD

SEQ ID NO: 2910562 - protein, 6 aa, Entamoeba invadens
STPDIH

SEQ ID NO: 2910563 - protein, 8 aa, Entamoeba invadens
STPDNQTC

SEQ ID NO: 2910564 - protein, 4 aa, Entamoeba invadens
STPE

SEQ ID NO: 2910565 - protein, 8 aa, Entamoeba invadens
STPEEHQK

SEQ ID NO: 2910566 - protein, 7 aa, Entamoeba invadens
STPEKIS

SEQ ID NO: 2910567 - protein, 7 aa, Entamoeba invadens
STPEKLS

SEQ ID NO: 2910568 - protein, 6 aa, Entamoeba invadens
STPELF

SEQ ID NO: 2910569 - protein, 21 aa, Entamoeba invadens
STPEQTAKEMEEKKITVTGKL

SEQ ID NO: 2910570 - protein, 7 aa, Entamoeba invadens
STPEYKA

SEQ ID NO: 2910571 - protein, 5 aa, Entamoeba invadens
STPFK

SEQ ID NO: 2910572 - protein, 5 aa, Entamoeba invadens
STPGK

SEQ ID NO: 2910573 - protein, 8 aa, Entamoeba invadens
STPGNGYS

SEQ ID NO: 2910574 - protein, 8 aa, Entamoeba invadens
STPGPGVV

SEQ ID NO: 2910575 - protein, 17 aa, Entamoeba invadens
STPGQQNEDEMYANTQC

SEQ ID NO: 2910576 - protein, 12 aa, Entamoeba invadens
STPGSAVRTLNE

SEQ ID NO: 2910577 - protein, 4 aa, Entamoeba invadens
STPI

SEQ ID NO: 2910578 - protein, 9 aa, Entamoeba invadens
STPIDRSDS

SEQ ID NO: 2910579 - protein, 10 aa, Entamoeba invadens
STPIETSSDY

SEQ ID NO: 2910580 - protein, 6 aa, Entamoeba invadens
STPIPK

SEQ ID NO: 2910581 - protein, 6 aa, Entamoeba invadens
STPIPL

SEQ ID NO: 2910582 - protein, 13 aa, Entamoeba invadens
STPIPPDIEGDKE

SEQ ID NO: 2910583 - protein, 14 aa, Entamoeba invadens
STPIPQELKENEEY

SEQ ID NO: 2910584 - protein, 6 aa, Entamoeba invadens
STPIRN

SEQ ID NO: 2910585 - protein, 10 aa, Entamoeba invadens
STPISKEDID

SEQ ID NO: 2910586 - protein, 6 aa, Entamoeba invadens
STPKGD

SEQ ID NO: 2910587 - protein, 9 aa, Entamoeba invadens
STPKLPYNE

SEQ ID NO: 2910588 - protein, 9 aa, Entamoeba invadens
STPKSSSMQ

SEQ ID NO: 2910589 - protein, 16 aa, Entamoeba invadens
STPKTQSPKSDKEDDL

SEQ ID NO: 2910590 - protein, 6 aa, Entamoeba invadens
STPLGY

SEQ ID NO: 2910591 - protein, 25 aa, Entamoeba invadens
STPLHRPQRSLTGSLSRKAEDEDLE

SEQ ID NO: 2910592 - protein, 10 aa, Entamoeba invadens
STPLPSQKSK

SEQ ID NO: 2910593 - protein, 7 aa, Entamoeba invadens
STPLTPK

SEQ ID NO: 2910594 - protein, 7 aa, Entamoeba invadens
STPLTVK

SEQ ID NO: 2910595 - protein, 6 aa, Entamoeba invadens
STPNEE

SEQ ID NO: 2910596 - protein, 8 aa, Entamoeba invadens
STPNEEDL

SEQ ID NO: 2910597 - protein, 15 aa, Entamoeba invadens
STPNQRTPKHLGGGA

SEQ ID NO: 2910598 - protein, 14 aa, Entamoeba invadens
STPNTAKKAKEDLT

SEQ ID NO: 2910599 - protein, 7 aa, Entamoeba invadens
STPNTTW

SEQ ID NO: 2910600 - protein, 13 aa, Entamoeba invadens
STPPAYKKPSHNM

SEQ ID NO: 2910601 - protein, 6 aa, Entamoeba invadens
STPPII

SEQ ID NO: 2910602 - protein, 34 aa, Entamoeba invadens
STPPTIQTRNATHVDYSQATNNESQNTNDSTKEE

SEQ ID NO: 2910603 - protein, 9 aa, Entamoeba invadens
STPQDGEKL

SEQ ID NO: 2910604 - protein, 8 aa, Entamoeba invadens
STPQEKKT

SEQ ID NO: 2910605 - protein, 6 aa, Entamoeba invadens
STPQNI

SEQ ID NO: 2910606 - protein, 16 aa, Entamoeba invadens
STPQPEATQQQQQTLP

SEQ ID NO: 2910607 - protein, 44 aa, Entamoeba invadens
STPQVVQQTNQTNPNDSQNLTQQNTQLNGQNSIQHDQQQNVPDI

SEQ ID NO: 2910608 - protein, 6 aa, Entamoeba invadens
STPSKQ

SEQ ID NO: 2910609 - protein, 5 aa, Entamoeba invadens
STPSN

SEQ ID NO: 2910610 - protein, 7 aa, Entamoeba invadens
STPSTAE

SEQ ID NO: 2910611 - protein, 7 aa, Entamoeba invadens
STPSTVR

SEQ ID NO: 2910612 - protein, 8 aa, Entamoeba invadens
STPTGGKV

SEQ ID NO: 2910613 - protein, 5 aa, Entamoeba invadens
STPTI

SEQ ID NO: 2910614 - protein, 7 aa, Entamoeba invadens
STPTLRP

SEQ ID NO: 2910615 - protein, 7 aa, Entamoeba invadens
STPTRKQ

SEQ ID NO: 2910616 - protein, 7 aa, Entamoeba invadens
STPTTEI

SEQ ID NO: 2910617 - protein, 8 aa, Entamoeba invadens
STPTTISS

SEQ ID NO: 2910618 - protein, 8 aa, Entamoeba invadens
STPTTLPE

SEQ ID NO: 2910619 - protein, 13 aa, Entamoeba invadens
STPVKGESTDKPI

SEQ ID NO: 2910620 - protein, 5 aa, Entamoeba invadens
STQCP

SEQ ID NO: 2910621 - protein, 4 aa, Entamoeba invadens
STQD

SEQ ID NO: 2910622 - protein, 6 aa, Entamoeba invadens
STQEIG

SEQ ID NO: 2910623 - protein, 6 aa, Entamoeba invadens
STQEPT

SEQ ID NO: 2910624 - protein, 5 aa, Entamoeba invadens
STQGI

SEQ ID NO: 2910625 - protein, 6 aa, Entamoeba invadens
STQGYH

SEQ ID NO: 2910626 - protein, 16 aa, Entamoeba invadens
STQIGNSIEKKYSSNI

SEQ ID NO: 2910627 - protein, 6 aa, Entamoeba invadens
STQIPS

SEQ ID NO: 2910628 - protein, 12 aa, Entamoeba invadens
STQIRDSDLDKK

SEQ ID NO: 2910629 - protein, 11 aa, Entamoeba invadens
STQKAANPQDV

SEQ ID NO: 2910630 - protein, 6 aa, Entamoeba invadens
STQKDP

SEQ ID NO: 2910631 - protein, 6 aa, Entamoeba invadens
STQKEV

SEQ ID NO: 2910632 - protein, 6 aa, Entamoeba invadens
STQKKF

SEQ ID NO: 2910633 - protein, 6 aa, Entamoeba invadens
STQKLE

SEQ ID NO: 2910634 - protein, 29 aa, Entamoeba invadens
STQKTKSLKKFAEKKDAIGKTLSEQKETA

SEQ ID NO: 2910635 - protein, 15 aa, Entamoeba invadens
STQLSQLESSSHLQS

SEQ ID NO: 2910636 - protein, 4 aa, Entamoeba invadens
STQM

SEQ ID NO: 2910637 - protein, 45 aa, Entamoeba invadens
STQMEEEKIDEKINQKIDQQNKDDKKSVPKEEEKAEDKIHEEPKD

SEQ ID NO: 2910638 - protein, 6 aa, Entamoeba invadens
STQNLK

SEQ ID NO: 2910639 - protein, 8 aa, Entamoeba invadens
STQNRNKD

SEQ ID NO: 2910640 - protein, 8 aa, Entamoeba invadens
STQPADLA

SEQ ID NO: 2910641 - protein, 7 aa, Entamoeba invadens
STQPTLT

SEQ ID NO: 2910642 - protein, 14 aa, Entamoeba invadens
STQQEAYDNGKGIV

SEQ ID NO: 2910643 - protein, 16 aa, Entamoeba invadens
STQQGTDDEINEKLGT

SEQ ID NO: 2910644 - protein, 8 aa, Entamoeba invadens
STQQSETI

SEQ ID NO: 2910645 - protein, 6 aa, Entamoeba invadens
STQSAI

SEQ ID NO: 2910646 - protein, 11 aa, Entamoeba invadens
STQSEISQPTP

SEQ ID NO: 2910647 - protein, 5 aa, Entamoeba invadens
STQSH

SEQ ID NO: 2910648 - protein, 9 aa, Entamoeba invadens
STQTEDCNT

SEQ ID NO: 2910649 - protein, 5 aa, Entamoeba invadens
STQTT

SEQ ID NO: 2910650 - protein, 16 aa, Entamoeba invadens
STQYNESPKTLKKSSS

SEQ ID NO: 2910651 - protein, 4 aa, Entamoeba invadens
STRA

SEQ ID NO: 2910652 - protein, 12 aa, Entamoeba invadens
STRAINGRRNTD

SEQ ID NO: 2910653 - protein, 8 aa, Entamoeba invadens
STRARSAP

SEQ ID NO: 2910654 - protein, 7 aa, Entamoeba invadens
STRDLEN

SEQ ID NO: 2910655 - protein, 15 aa, Entamoeba invadens
STRDPLNDVGADGEN

SEQ ID NO: 2910656 - protein, 4 aa, Entamoeba invadens
STRE

SEQ ID NO: 2910657 - protein, 5 aa, Entamoeba invadens
STREA

SEQ ID NO: 2910658 - protein, 7 aa, Entamoeba invadens
STREESK

SEQ ID NO: 2910659 - protein, 5 aa, Entamoeba invadens
STREG

SEQ ID NO: 2910660 - protein, 4 aa, Entamoeba invadens
STRI

SEQ ID NO: 2910661 - protein, 6 aa, Entamoeba invadens
STRIDP

SEQ ID NO: 2910662 - protein, 5 aa, Entamoeba invadens
STRIT

SEQ ID NO: 2910663 - protein, 8 aa, Entamoeba invadens
STRKDSPL

SEQ ID NO: 2910664 - protein, 4 aa, Entamoeba invadens
STRL

SEQ ID NO: 2910665 - protein, 8 aa, Entamoeba invadens
STRLNRGN

SEQ ID NO: 2910666 - protein, 6 aa, Entamoeba invadens
STRNIG

SEQ ID NO: 2910667 - protein, 6 aa, Entamoeba invadens
STRNPV

SEQ ID NO: 2910668 - protein, 12 aa, Entamoeba invadens
STRNSLSPNALK

SEQ ID NO: 2910669 - protein, 8 aa, Entamoeba invadens
STRPNEQG

SEQ ID NO: 2910670 - protein, 5 aa, Entamoeba invadens
STRQD

SEQ ID NO: 2910671 - protein, 11 aa, Entamoeba invadens
STRQPKGYSPV

SEQ ID NO: 2910672 - protein, 20 aa, Entamoeba invadens
STRQSTNSRNQSNHLQTTTK

SEQ ID NO: 2910673 - protein, 5 aa, Entamoeba invadens
STRRG

SEQ ID NO: 2910674 - protein, 6 aa, Entamoeba invadens
STRSGE

SEQ ID NO: 2910675 - protein, 8 aa, Entamoeba invadens
STRSPDAP

SEQ ID NO: 2910676 - protein, 6 aa, Entamoeba invadens
STRSSD

SEQ ID NO: 2910677 - protein, 4 aa, Entamoeba invadens
STRT

SEQ ID NO: 2910678 - protein, 5 aa, Entamoeba invadens
STRTS

SEQ ID NO: 2910679 - protein, 6 aa, Entamoeba invadens
STRTSK

SEQ ID NO: 2910680 - protein, 7 aa, Entamoeba invadens
STRVDVE

SEQ ID NO: 2910681 - protein, 16 aa, Entamoeba invadens
STRVLGDGDVTPPGGL

SEQ ID NO: 2910682 - protein, 9 aa, Entamoeba invadens
STSAAAEFA

SEQ ID NO: 2910683 - protein, 12 aa, Entamoeba invadens
STSAGDNKTKTY

SEQ ID NO: 2910684 - protein, 7 aa, Entamoeba invadens
STSAGFE

SEQ ID NO: 2910685 - protein, 16 aa, Entamoeba invadens
STSANGPLTDGYEDPT

SEQ ID NO: 2910686 - protein, 9 aa, Entamoeba invadens
STSAPPDIA

SEQ ID NO: 2910687 - protein, 9 aa, Entamoeba invadens
STSCTEESL

SEQ ID NO: 2910688 - protein, 5 aa, Entamoeba invadens
STSDA

SEQ ID NO: 2910689 - protein, 7 aa, Entamoeba invadens
STSDDIK

SEQ ID NO: 2910690 - protein, 9 aa, Entamoeba invadens
STSDKVRVG

SEQ ID NO: 2910691 - protein, 7 aa, Entamoeba invadens
STSDWTL

SEQ ID NO: 2910692 - protein, 10 aa, Entamoeba invadens
STSEDASENI

SEQ ID NO: 2910693 - protein, 7 aa, Entamoeba invadens
STSEDVD

SEQ ID NO: 2910694 - protein, 7 aa, Entamoeba invadens
STSEGTI

SEQ ID NO: 2910695 - protein, 7 aa, Entamoeba invadens
STSEIEI

SEQ ID NO: 2910696 - protein, 5 aa, Entamoeba invadens
STSEK

SEQ ID NO: 2910697 - protein, 6 aa, Entamoeba invadens
STSETC

SEQ ID NO: 2910698 - protein, 6 aa, Entamoeba invadens
STSEVN

SEQ ID NO: 2910699 - protein, 9 aa, Entamoeba invadens
STSFEGEQE

SEQ ID NO: 2910700 - protein, 8 aa, Entamoeba invadens
STSFETKY

SEQ ID NO: 2910701 - protein, 9 aa, Entamoeba invadens
STSGGNDGK

SEQ ID NO: 2910702 - protein, 8 aa, Entamoeba invadens
STSGICNT

SEQ ID NO: 2910703 - protein, 8 aa, Entamoeba invadens
STSHSGKT

SEQ ID NO: 2910704 - protein, 8 aa, Entamoeba invadens
STSIDSET

SEQ ID NO: 2910705 - protein, 5 aa, Entamoeba invadens
STSIR

SEQ ID NO: 2910706 - protein, 6 aa, Entamoeba invadens
STSKGT

SEQ ID NO: 2910707 - protein, 11 aa, Entamoeba invadens
STSKNLPNIED

SEQ ID NO: 2910708 - protein, 9 aa, Entamoeba invadens
STSKTCQSC

SEQ ID NO: 2910709 - protein, 11 aa, Entamoeba invadens
STSKTGKHGHA

SEQ ID NO: 2910710 - protein, 9 aa, Entamoeba invadens
STSKTTSMS

SEQ ID NO: 2910711 - protein, 33 aa, Entamoeba invadens
STSLKTSFDTSQQKKDAVQSQPILQPSKTDDSI

SEQ ID NO: 2910712 - protein, 19 aa, Entamoeba invadens
STSLQQATNTLNDRDTTRH

SEQ ID NO: 2910713 - protein, 18 aa, Entamoeba invadens
STSLQRAEIDQKKKEQYY

SEQ ID NO: 2910714 - protein, 5 aa, Entamoeba invadens
STSLT

SEQ ID NO: 2910715 - protein, 6 aa, Entamoeba invadens
STSLTE

SEQ ID NO: 2910716 - protein, 9 aa, Entamoeba invadens
STSNELDTD

SEQ ID NO: 2910717 - protein, 5 aa, Entamoeba invadens
STSNG

SEQ ID NO: 2910718 - protein, 7 aa, Entamoeba invadens
STSNGEV

SEQ ID NO: 2910719 - protein, 7 aa, Entamoeba invadens
STSNMKN

SEQ ID NO: 2910720 - protein, 7 aa, Entamoeba invadens
STSNNSN

SEQ ID NO: 2910721 - protein, 9 aa, Entamoeba invadens
STSNSTKTE

SEQ ID NO: 2910722 - protein, 6 aa, Entamoeba invadens
STSNTD

SEQ ID NO: 2910723 - protein, 5 aa, Entamoeba invadens
STSPE

SEQ ID NO: 2910724 - protein, 10 aa, Entamoeba invadens
STSPKPDNKI

SEQ ID NO: 2910725 - protein, 9 aa, Entamoeba invadens
STSPKYTME

SEQ ID NO: 2910726 - protein, 4 aa, Entamoeba invadens
STSQ

SEQ ID NO: 2910727 - protein, 8 aa, Entamoeba invadens
STSQEAMQ

SEQ ID NO: 2910728 - protein, 9 aa, Entamoeba invadens
STSQTLTKI

SEQ ID NO: 2910729 - protein, 6 aa, Entamoeba invadens
STSRWA

SEQ ID NO: 2910730 - protein, 4 aa, Entamoeba invadens
STSS

SEQ ID NO: 2910731 - protein, 6 aa, Entamoeba invadens
STSSCQ

SEQ ID NO: 2910732 - protein, 8 aa, Entamoeba invadens
STSSQRYT

SEQ ID NO: 2910733 - protein, 9 aa, Entamoeba invadens
STSSTSPSL

SEQ ID NO: 2910734 - protein, 10 aa, Entamoeba invadens
STSTEKGVEE

SEQ ID NO: 2910735 - protein, 16 aa, Entamoeba invadens
STSTESDLADQLADAR

SEQ ID NO: 2910736 - protein, 10 aa, Entamoeba invadens
STSTKKKSGW

SEQ ID NO: 2910737 - protein, 5 aa, Entamoeba invadens
STSTR

SEQ ID NO: 2910738 - protein, 10 aa, Entamoeba invadens
STSVKGSPFT

SEQ ID NO: 2910739 - protein, 19 aa, Entamoeba invadens
STSVKGSPLTLSRKDNGKV

SEQ ID NO: 2910740 - protein, 20 aa, Entamoeba invadens
STSVPNSPLTLSRRNAGQTL

SEQ ID NO: 2910741 - protein, 5 aa, Entamoeba invadens
STSVT

SEQ ID NO: 2910742 - protein, 33 aa, Entamoeba invadens
STTANAPQITVPPPTPVNTQQINPPQNETQVPT

SEQ ID NO: 2910743 - protein, 7 aa, Entamoeba invadens
STTANPF

SEQ ID NO: 2910744 - protein, 6 aa, Entamoeba invadens
STTAQK

SEQ ID NO: 2910745 - protein, 6 aa, Entamoeba invadens
STTATE

SEQ ID NO: 2910746 - protein, 4 aa, Entamoeba invadens
STTD

SEQ ID NO: 2910747 - protein, 7 aa, Entamoeba invadens
STTDDWS

SEQ ID NO: 2910748 - protein, 9 aa, Entamoeba invadens
STTDKKYPN

SEQ ID NO: 2910749 - protein, 6 aa, Entamoeba invadens
STTDLN

SEQ ID NO: 2910750 - protein, 9 aa, Entamoeba invadens
STTDPSSPL

SEQ ID NO: 2910751 - protein, 15 aa, Entamoeba invadens
STTDTENTQERGKGM

SEQ ID NO: 2910752 - protein, 5 aa, Entamoeba invadens
STTDV

SEQ ID NO: 2910753 - protein, 7 aa, Entamoeba invadens
STTEAGK

SEQ ID NO: 2910754 - protein, 8 aa, Entamoeba invadens
STTEDSLK

SEQ ID NO: 2910755 - protein, 12 aa, Entamoeba invadens
STTEKGEKTRGV

SEQ ID NO: 2910756 - protein, 11 aa, Entamoeba invadens
STTEKHDDEKM

SEQ ID NO: 2910757 - protein, 5 aa, Entamoeba invadens
STTEN

SEQ ID NO: 2910758 - protein, 8 aa, Entamoeba invadens
STTENGKR

SEQ ID NO: 2910759 - protein, 6 aa, Entamoeba invadens
STTEQI

SEQ ID NO: 2910760 - protein, 8 aa, Entamoeba invadens
STTEWANS

SEQ ID NO: 2910761 - protein, 5 aa, Entamoeba invadens
STTFE

SEQ ID NO: 2910762 - protein, 7 aa, Entamoeba invadens
STTFGRA

SEQ ID NO: 2910763 - protein, 6 aa, Entamoeba invadens
STTHPV

SEQ ID NO: 2910764 - protein, 14 aa, Entamoeba invadens
STTHSTNTSPQKQF

SEQ ID NO: 2910765 - protein, 4 aa, Entamoeba invadens
STTK

SEQ ID NO: 2910766 - protein, 7 aa, Entamoeba invadens
STTKCDK

SEQ ID NO: 2910767 - protein, 6 aa, Entamoeba invadens
STTKGS

SEQ ID NO: 2910768 - protein, 5 aa, Entamoeba invadens
STTKH

SEQ ID NO: 2910769 - protein, 11 aa, Entamoeba invadens
STTKKRYATMT

SEQ ID NO: 2910770 - protein, 6 aa, Entamoeba invadens
STTKNL

SEQ ID NO: 2910771 - protein, 9 aa, Entamoeba invadens
STTKNTTTL

SEQ ID NO: 2910772 - protein, 11 aa, Entamoeba invadens
STTKPHTDKVQ

SEQ ID NO: 2910773 - protein, 9 aa, Entamoeba invadens
STTKPQETI

SEQ ID NO: 2910774 - protein, 6 aa, Entamoeba invadens
STTKQI

SEQ ID NO: 2910775 - protein, 14 aa, Entamoeba invadens
STTKTEEKSPMKSS

SEQ ID NO: 2910776 - protein, 12 aa, Entamoeba invadens
STTLGDTPARQA

SEQ ID NO: 2910777 - protein, 7 aa, Entamoeba invadens
STTLKDY

SEQ ID NO: 2910778 - protein, 7 aa, Entamoeba invadens
STTLPAR

SEQ ID NO: 2910779 - protein, 4 aa, Entamoeba invadens
STTM

SEQ ID NO: 2910780 - protein, 6 aa, Entamoeba invadens
STTNAL

SEQ ID NO: 2910781 - protein, 6 aa, Entamoeba invadens
STTNEL

SEQ ID NO: 2910782 - protein, 6 aa, Entamoeba invadens
STTNES

SEQ ID NO: 2910783 - protein, 8 aa, Entamoeba invadens
STTNKSVK

SEQ ID NO: 2910784 - protein, 6 aa, Entamoeba invadens
STTNNR

SEQ ID NO: 2910785 - protein, 10 aa, Entamoeba invadens
STTNVEKGTD

SEQ ID NO: 2910786 - protein, 5 aa, Entamoeba invadens
STTPA

SEQ ID NO: 2910787 - protein, 15 aa, Entamoeba invadens
STTPSTSTTTTTTDF

SEQ ID NO: 2910788 - protein, 10 aa, Entamoeba invadens
STTPSYGKYA

SEQ ID NO: 2910789 - protein, 49 aa, Entamoeba invadens
STTPTTNSSQESLASHTMSDNVSEDRSRSTSQDGSSSKNHSKEPSQLAS

SEQ ID NO: 2910790 - protein, 7 aa, Entamoeba invadens
STTQENL

SEQ ID NO: 2910791 - protein, 6 aa, Entamoeba invadens
STTQQT

SEQ ID NO: 2910792 - protein, 6 aa, Entamoeba invadens
STTQTP

SEQ ID NO: 2910793 - protein, 14 aa, Entamoeba invadens
STTQVEEEPTMNVP

SEQ ID NO: 2910794 - protein, 9 aa, Entamoeba invadens
STTRKYTNE

SEQ ID NO: 2910795 - protein, 17 aa, Entamoeba invadens
STTRSEVQTLKKPKEKD

SEQ ID NO: 2910796 - protein, 6 aa, Entamoeba invadens
STTSAN

SEQ ID NO: 2910797 - protein, 17 aa, Entamoeba invadens
STTSGVSLQEPEATNTH

SEQ ID NO: 2910798 - protein, 6 aa, Entamoeba invadens
STTSLI

SEQ ID NO: 2910799 - protein, 6 aa, Entamoeba invadens
STTSNN

SEQ ID NO: 2910800 - protein, 7 aa, Entamoeba invadens
STTSPIK

SEQ ID NO: 2910801 - protein, 14 aa, Entamoeba invadens
STTSSSQVNDSEIV

SEQ ID NO: 2910802 - protein, 9 aa, Entamoeba invadens
STTSTFGAK

SEQ ID NO: 2910803 - protein, 5 aa, Entamoeba invadens
STTSV

SEQ ID NO: 2910804 - protein, 7 aa, Entamoeba invadens
STTSVYG

SEQ ID NO: 2910805 - protein, 4 aa, Entamoeba invadens
STTT

SEQ ID NO: 2910806 - protein, 6 aa, Entamoeba invadens
STTTGH

SEQ ID NO: 2910807 - protein, 15 aa, Entamoeba invadens
STTTIDVKGKPQDLT

SEQ ID NO: 2910808 - protein, 5 aa, Entamoeba invadens
STTTK

SEQ ID NO: 2910809 - protein, 6 aa, Entamoeba invadens
STTTQP

SEQ ID NO: 2910810 - protein, 7 aa, Entamoeba invadens
STTTSVA

SEQ ID NO: 2910811 - protein, 8 aa, Entamoeba invadens
STTVNPKD

SEQ ID NO: 2910812 - protein, 16 aa, Entamoeba invadens
STTVYTADKKDGAQSI

SEQ ID NO: 2910813 - protein, 6 aa, Entamoeba invadens
STVATK

SEQ ID NO: 2910814 - protein, 17 aa, Entamoeba invadens
STVDANLSGDKQKKEIE

SEQ ID NO: 2910815 - protein, 10 aa, Entamoeba invadens
STVDKKKSIV

SEQ ID NO: 2910816 - protein, 5 aa, Entamoeba invadens
STVDT

SEQ ID NO: 2910817 - protein, 5 aa, Entamoeba invadens
STVGD

SEQ ID NO: 2910818 - protein, 15 aa, Entamoeba invadens
STVGDNVTITNDGAT

SEQ ID NO: 2910819 - protein, 9 aa, Entamoeba invadens
STVGGRFND

SEQ ID NO: 2910820 - protein, 6 aa, Entamoeba invadens
STVGKT

SEQ ID NO: 2910821 - protein, 22 aa, Entamoeba invadens
STVKEDPSSEASTTQPQKPQNL

SEQ ID NO: 2910822 - protein, 8 aa, Entamoeba invadens
STVKSLGT

SEQ ID NO: 2910823 - protein, 9 aa, Entamoeba invadens
STVKTAPQN

SEQ ID NO: 2910824 - protein, 7 aa, Entamoeba invadens
STVKTIG

SEQ ID NO: 2910825 - protein, 5 aa, Entamoeba invadens
STVKY

SEQ ID NO: 2910826 - protein, 13 aa, Entamoeba invadens
STVMQSNTNNMDL

SEQ ID NO: 2910827 - protein, 11 aa, Entamoeba invadens
STVNHPQSPKI

SEQ ID NO: 2910828 - protein, 8 aa, Entamoeba invadens
STVNKSKD

SEQ ID NO: 2910829 - protein, 11 aa, Entamoeba invadens
STVNPSPNPEV

SEQ ID NO: 2910830 - protein, 19 aa, Entamoeba invadens
STVNRISSATIGDELTKDE

SEQ ID NO: 2910831 - protein, 7 aa, Entamoeba invadens
STVPAQE

SEQ ID NO: 2910832 - protein, 9 aa, Entamoeba invadens
STVPGEHTP

SEQ ID NO: 2910833 - protein, 8 aa, Entamoeba invadens
STVPRSPI

SEQ ID NO: 2910834 - protein, 9 aa, Entamoeba invadens
STVPSCEKA

SEQ ID NO: 2910835 - protein, 7 aa, Entamoeba invadens
STVQDED

SEQ ID NO: 2910836 - protein, 4 aa, Entamoeba invadens
STVR

SEQ ID NO: 2910837 - protein, 5 aa, Entamoeba invadens
STVRT

SEQ ID NO: 2910838 - protein, 12 aa, Entamoeba invadens
STVSPKVSPGIG

SEQ ID NO: 2910839 - protein, 25 aa, Entamoeba invadens
STVSPSTAAPVSSPQPFNESALTRK

SEQ ID NO: 2910840 - protein, 10 aa, Entamoeba invadens
STVSSGQNTI

SEQ ID NO: 2910841 - protein, 4 aa, Entamoeba invadens
STVT

SEQ ID NO: 2910842 - protein, 9 aa, Entamoeba invadens
STVTQHPEM

SEQ ID NO: 2910843 - protein, 5 aa, Entamoeba invadens
STVTS

SEQ ID NO: 2910844 - protein, 6 aa, Entamoeba invadens
STVTSI

SEQ ID NO: 2910845 - protein, 6 aa, Entamoeba invadens
STVTSL

SEQ ID NO: 2910846 - protein, 4 aa, Entamoeba invadens
STVV

SEQ ID NO: 2910847 - protein, 10 aa, Entamoeba invadens
STVYGNPNKV

SEQ ID NO: 2910848 - protein, 10 aa, Entamoeba invadens
STWKNNETKV

SEQ ID NO: 2910849 - protein, 22 aa, Entamoeba invadens
STYDTENISAKASILKKVIEHF

SEQ ID NO: 2910850 - protein, 10 aa, Entamoeba invadens
STYEADEVSE

SEQ ID NO: 2910851 - protein, 6 aa, Entamoeba invadens
STYEEI

SEQ ID NO: 2910852 - protein, 5 aa, Entamoeba invadens
STYFE

SEQ ID NO: 2910853 - protein, 16 aa, Entamoeba invadens
STYKTTVESTDKVKAN

SEQ ID NO: 2910854 - protein, 4 aa, Entamoeba invadens
STYL

SEQ ID NO: 2910855 - protein, 6 aa, Entamoeba invadens
STYNDL

SEQ ID NO: 2910856 - protein, 7 aa, Entamoeba invadens
STYNERM

SEQ ID NO: 2910857 - protein, 5 aa, Entamoeba invadens
STYNP

SEQ ID NO: 2910858 - protein, 8 aa, Entamoeba invadens
STYNPPSM

SEQ ID NO: 2910859 - protein, 5 aa, Entamoeba invadens
STYNR

SEQ ID NO: 2910860 - protein, 5 aa, Entamoeba invadens
STYNY

SEQ ID NO: 2910861 - protein, 15 aa, Entamoeba invadens
STYPTATKSSSNITW

SEQ ID NO: 2910862 - protein, 4 aa, Entamoeba invadens
STYQ

SEQ ID NO: 2910863 - protein, 5 aa, Entamoeba invadens
STYQR

SEQ ID NO: 2910864 - protein, 5 aa, Entamoeba invadens
STYQT

SEQ ID NO: 2910865 - protein, 5 aa, Entamoeba invadens
STYRK

SEQ ID NO: 2910866 - protein, 22 aa, Entamoeba invadens
STYTEPRHKKQPTKKTETHPQH

SEQ ID NO: 2910867 - protein, 6 aa, Entamoeba invadens
STYTNK

SEQ ID NO: 2910868 - protein, 6 aa, Entamoeba invadens
STYTQE

SEQ ID NO: 2910869 - protein, 9 aa, Entamoeba invadens
STYVPSNTN

SEQ ID NO: 2910870 - protein, 8 aa, Entamoeba invadens
SVAASNGE

SEQ ID NO: 2910871 - protein, 5 aa, Entamoeba invadens
SVADS

SEQ ID NO: 2910872 - protein, 5 aa, Entamoeba invadens
SVAEN

SEQ ID NO: 2910873 - protein, 12 aa, Entamoeba invadens
SVAEQSTNIGNI

SEQ ID NO: 2910874 - protein, 8 aa, Entamoeba invadens
SVAGNNTV

SEQ ID NO: 2910875 - protein, 10 aa, Entamoeba invadens
SVAKNKDNFE

SEQ ID NO: 2910876 - protein, 10 aa, Entamoeba invadens
SVAPADLPFT

SEQ ID NO: 2910877 - protein, 5 aa, Entamoeba invadens
SVAPT

SEQ ID NO: 2910878 - protein, 11 aa, Entamoeba invadens
SVAQARPTAVD

SEQ ID NO: 2910879 - protein, 8 aa, Entamoeba invadens
SVARKDNW

SEQ ID NO: 2910880 - protein, 6 aa, Entamoeba invadens
SVASKT

SEQ ID NO: 2910881 - protein, 6 aa, Entamoeba invadens
SVATGG

SEQ ID NO: 2910882 - protein, 5 aa, Entamoeba invadens
SVCKP

SEQ ID NO: 2910883 - protein, 22 aa, Entamoeba invadens
SVDALTGEKNALSEDLREARNR

SEQ ID NO: 2910884 - protein, 20 aa, Entamoeba invadens
SVDCSEKNSYNEKDKQVEYK

SEQ ID NO: 2910885 - protein, 11 aa, Entamoeba invadens
SVDDEDGGDDL

SEQ ID NO: 2910886 - protein, 6 aa, Entamoeba invadens
SVDDEF

SEQ ID NO: 2910887 - protein, 10 aa, Entamoeba invadens
SVDDRTRKER

SEQ ID NO: 2910888 - protein, 8 aa, Entamoeba invadens
SVDEEDLG

SEQ ID NO: 2910889 - protein, 9 aa, Entamoeba invadens
SVDEERIEP

SEQ ID NO: 2910890 - protein, 10 aa, Entamoeba invadens
SVDEKSPTLL

SEQ ID NO: 2910891 - protein, 5 aa, Entamoeba invadens
SVDEQ

SEQ ID NO: 2910892 - protein, 6 aa, Entamoeba invadens
SVDEQE

SEQ ID NO: 2910893 - protein, 19 aa, Entamoeba invadens
SVDGRGSSQMSSATGSISG

SEQ ID NO: 2910894 - protein, 4 aa, Entamoeba invadens
SVDH

SEQ ID NO: 2910895 - protein, 4 aa, Entamoeba invadens
SVDK

SEQ ID NO: 2910896 - protein, 8 aa, Entamoeba invadens
SVDKIENA

SEQ ID NO: 2910897 - protein, 11 aa, Entamoeba invadens
SVDKTSAGNNK

SEQ ID NO: 2910898 - protein, 13 aa, Entamoeba invadens
SVDPNTNQMTLSS

SEQ ID NO: 2910899 - protein, 10 aa, Entamoeba invadens
SVDSAEKSAS

SEQ ID NO: 2910900 - protein, 36 aa, Entamoeba invadens
SVDSDSDEQITSNPPIEESIAEQNSKKKKRRNNSLT

SEQ ID NO: 2910901 - protein, 6 aa, Entamoeba invadens
SVDSES

SEQ ID NO: 2910902 - protein, 5 aa, Entamoeba invadens
SVDSL

SEQ ID NO: 2910903 - protein, 25 aa, Entamoeba invadens
SVDSQQQETKERNTQLEQEGETKSI

SEQ ID NO: 2910904 - protein, 6 aa, Entamoeba invadens
SVDSSR

SEQ ID NO: 2910905 - protein, 8 aa, Entamoeba invadens
SVDSVDDK

SEQ ID NO: 2910906 - protein, 7 aa, Entamoeba invadens
SVDSVKE

SEQ ID NO: 2910907 - protein, 9 aa, Entamoeba invadens
SVEAPTPEV

SEQ ID NO: 2910908 - protein, 8 aa, Entamoeba invadens
SVEAYKEN

SEQ ID NO: 2910909 - protein, 25 aa, Entamoeba invadens
SVECNGTELQVTQSEAIESTTDADG

SEQ ID NO: 2910910 - protein, 14 aa, Entamoeba invadens
SVEDASKIENNKSH

SEQ ID NO: 2910911 - protein, 5 aa, Entamoeba invadens
SVEDD

SEQ ID NO: 2910912 - protein, 13 aa, Entamoeba invadens
SVEDDTSKNSLYK

SEQ ID NO: 2910913 - protein, 9 aa, Entamoeba invadens
SVEDGSEGK

SEQ ID NO: 2910914 - protein, 5 aa, Entamoeba invadens
SVEDP

SEQ ID NO: 2910915 - protein, 10 aa, Entamoeba invadens
SVEDQQTKAF

SEQ ID NO: 2910916 - protein, 6 aa, Entamoeba invadens
SVEDRA

SEQ ID NO: 2910917 - protein, 4 aa, Entamoeba invadens
SVEE

SEQ ID NO: 2910918 - protein, 10 aa, Entamoeba invadens
SVEEAKAKGT

SEQ ID NO: 2910919 - protein, 5 aa, Entamoeba invadens
SVEEF

SEQ ID NO: 2910920 - protein, 6 aa, Entamoeba invadens
SVEEKK

SEQ ID NO: 2910921 - protein, 6 aa, Entamoeba invadens
SVEEKP

SEQ ID NO: 2910922 - protein, 12 aa, Entamoeba invadens
SVEEQFSQYDSS

SEQ ID NO: 2910923 - protein, 6 aa, Entamoeba invadens
SVEGEG

SEQ ID NO: 2910924 - protein, 22 aa, Entamoeba invadens
SVEGEVDREKSLTQRKDNAKRV

SEQ ID NO: 2910925 - protein, 10 aa, Entamoeba invadens
SVEGKNGKVT

SEQ ID NO: 2910926 - protein, 16 aa, Entamoeba invadens
SVEGMNDKQYTRTREA

SEQ ID NO: 2910927 - protein, 12 aa, Entamoeba invadens
SVEGQEKDISQQ

SEQ ID NO: 2910928 - protein, 15 aa, Entamoeba invadens
SVEHPATSQIVTSGD

SEQ ID NO: 2910929 - protein, 7 aa, Entamoeba invadens
SVEISQQ

SEQ ID NO: 2910930 - protein, 4 aa, Entamoeba invadens
SVEK

SEQ ID NO: 2910931 - protein, 52 aa, Entamoeba invadens
SVEKEGKKTKGEKEEQKKRRKAEKEREKEERKAAKAEKKEKAEREKQEKMEK

SEQ ID NO: 2910932 - protein, 11 aa, Entamoeba invadens
SVEKESQTDFD

SEQ ID NO: 2910933 - protein, 8 aa, Entamoeba invadens
SVEKGKIT

SEQ ID NO: 2910934 - protein, 36 aa, Entamoeba invadens
SVEKKEKENSKKAKFGEKERNELSRLEGEEKRRKEV

SEQ ID NO: 2910935 - protein, 4 aa, Entamoeba invadens
SVEN

SEQ ID NO: 2910936 - protein, 5 aa, Entamoeba invadens
SVEPG

SEQ ID NO: 2910937 - protein, 31 aa, Entamoeba invadens
SVEPQGTQQSFSGKNSVNDDSSDDEGNSTPS

SEQ ID NO: 2910938 - protein, 14 aa, Entamoeba invadens
SVEQKHPQNESQNV

SEQ ID NO: 2910939 - protein, 8 aa, Entamoeba invadens
SVEQSRSE

SEQ ID NO: 2910940 - protein, 12 aa, Entamoeba invadens
SVERGVAKKGTL

SEQ ID NO: 2910941 - protein, 13 aa, Entamoeba invadens
SVESGIPDFRSSN

SEQ ID NO: 2910942 - protein, 9 aa, Entamoeba invadens
SVESKDEGM

SEQ ID NO: 2910943 - protein, 19 aa, Entamoeba invadens
SVESLNSSLSLDERSEEDR

SEQ ID NO: 2910944 - protein, 8 aa, Entamoeba invadens
SVESSSMV

SEQ ID NO: 2910945 - protein, 16 aa, Entamoeba invadens
SVETDIKKKNSELTKS

SEQ ID NO: 2910946 - protein, 14 aa, Entamoeba invadens
SVETGSGVISKDTE

SEQ ID NO: 2910947 - protein, 5 aa, Entamoeba invadens
SVETY

SEQ ID NO: 2910948 - protein, 11 aa, Entamoeba invadens
SVEVDENDRPL

SEQ ID NO: 2910949 - protein, 6 aa, Entamoeba invadens
SVFDNN

SEQ ID NO: 2910950 - protein, 25 aa, Entamoeba invadens
SVFNGPETTMQKDNIHQDGENTFEH

SEQ ID NO: 2910951 - protein, 4 aa, Entamoeba invadens
SVFS

SEQ ID NO: 2910952 - protein, 4 aa, Entamoeba invadens
SVGD

SEQ ID NO: 2910953 - protein, 8 aa, Entamoeba invadens
SVGDIENK

SEQ ID NO: 2910954 - protein, 4 aa, Entamoeba invadens
SVGE

SEQ ID NO: 2910955 - protein, 5 aa, Entamoeba invadens
SVGEA

SEQ ID NO: 2910956 - protein, 5 aa, Entamoeba invadens
SVGEQ

SEQ ID NO: 2910957 - protein, 12 aa, Entamoeba invadens
SVGGNEKTQTAA

SEQ ID NO: 2910958 - protein, 9 aa, Entamoeba invadens
SVGGSVRDK

SEQ ID NO: 2910959 - protein, 8 aa, Entamoeba invadens
SVGKEKSR

SEQ ID NO: 2910960 - protein, 8 aa, Entamoeba invadens
SVGKGGFG

SEQ ID NO: 2910961 - protein, 6 aa, Entamoeba invadens
SVGKST

SEQ ID NO: 2910962 - protein, 5 aa, Entamoeba invadens
SVGKT

SEQ ID NO: 2910963 - protein, 9 aa, Entamoeba invadens
SVGMQQKQT

SEQ ID NO: 2910964 - protein, 7 aa, Entamoeba invadens
SVGNTKA

SEQ ID NO: 2910965 - protein, 23 aa, Entamoeba invadens
SVGSDAMSSGRVSISGTAASGLS

SEQ ID NO: 2910966 - protein, 6 aa, Entamoeba invadens
SVGSER

SEQ ID NO: 2910967 - protein, 29 aa, Entamoeba invadens
SVGSKNPSPSINDGDVNESVEVKTRQRTA

SEQ ID NO: 2910968 - protein, 9 aa, Entamoeba invadens
SVGTNKKEL

SEQ ID NO: 2910969 - protein, 4 aa, Entamoeba invadens
SVGY

SEQ ID NO: 2910970 - protein, 8 aa, Entamoeba invadens
SVGYHGDD

SEQ ID NO: 2910971 - protein, 7 aa, Entamoeba invadens
SVGYHSD

SEQ ID NO: 2910972 - protein, 12 aa, Entamoeba invadens
SVHSSEDQSIPD

SEQ ID NO: 2910973 - protein, 5 aa, Entamoeba invadens
SVIGP

SEQ ID NO: 2910974 - protein, 6 aa, Entamoeba invadens
SVIKKS

SEQ ID NO: 2910975 - protein, 16 aa, Entamoeba invadens
SVIKQEKESERKEAEM

SEQ ID NO: 2910976 - protein, 45 aa, Entamoeba invadens
SVIPTPKSQSQNEMTTTPRQGDIPVPDGYKTPIQNSPQSKYPPPL

SEQ ID NO: 2910977 - protein, 26 aa, Entamoeba invadens
SVISKEKKRHRSGSLSELKSQKSSEH

SEQ ID NO: 2910978 - protein, 8 aa, Entamoeba invadens
SVKDAPGK

SEQ ID NO: 2910979 - protein, 16 aa, Entamoeba invadens
SVKDEVRNNDNKPKTM

SEQ ID NO: 2910980 - protein, 6 aa, Entamoeba invadens
SVKDNY

SEQ ID NO: 2910981 - protein, 10 aa, Entamoeba invadens
SVKEEKETCE

SEQ ID NO: 2910982 - protein, 12 aa, Entamoeba invadens
SVKEVATAARNA

SEQ ID NO: 2910983 - protein, 7 aa, Entamoeba invadens
SVKGDYN

SEQ ID NO: 2910984 - protein, 12 aa, Entamoeba invadens
SVKGKDHTFKGS

SEQ ID NO: 2910985 - protein, 13 aa, Entamoeba invadens
SVKGKEVETSVPS

SEQ ID NO: 2910986 - protein, 9 aa, Entamoeba invadens
SVKGNGADG

SEQ ID NO: 2910987 - protein, 15 aa, Entamoeba invadens
SVKGTNHVTEIGNSS

SEQ ID NO: 2910988 - protein, 25 aa, Entamoeba invadens
SVKGTRPSLSEDSDYEDRPYSAPLK

SEQ ID NO: 2910989 - protein, 4 aa, Entamoeba invadens
SVKK

SEQ ID NO: 2910990 - protein, 7 aa, Entamoeba invadens
SVKKAED

SEQ ID NO: 2910991 - protein, 15 aa, Entamoeba invadens
SVKKQHSAGVFSSFF

SEQ ID NO: 2910992 - protein, 7 aa, Entamoeba invadens
SVKKYTK

SEQ ID NO: 2910993 - protein, 9 aa, Entamoeba invadens
SVKNGGNYD

SEQ ID NO: 2910994 - protein, 7 aa, Entamoeba invadens
SVKNQTM

SEQ ID NO: 2910995 - protein, 19 aa, Entamoeba invadens
SVKPGKEGKKHALSSKKIP

SEQ ID NO: 2910996 - protein, 12 aa, Entamoeba invadens
SVKPIGELIESN

SEQ ID NO: 2910997 - protein, 12 aa, Entamoeba invadens
SVKQDKSERPKR

SEQ ID NO: 2910998 - protein, 9 aa, Entamoeba invadens
SVKQNIDNA

SEQ ID NO: 2910999 - protein, 5 aa, Entamoeba invadens
SVKQS

SEQ ID NO: 2911000 - protein, 8 aa, Entamoeba invadens
SVKRGDVT

SEQ ID NO: 2911001 - protein, 12 aa, Entamoeba invadens
SVKRGIAKKGTL

SEQ ID NO: 2911002 - protein, 17 aa, Entamoeba invadens
SVKRPQGKYVIEWGATL

SEQ ID NO: 2911003 - protein, 18 aa, Entamoeba invadens
SVKRPQGKYVIEWGATLI

SEQ ID NO: 2911004 - protein, 18 aa, Entamoeba invadens
SVKRPQGKYVIEWGATPI

SEQ ID NO: 2911005 - protein, 12 aa, Entamoeba invadens
SVKSADFDKPIT

SEQ ID NO: 2911006 - protein, 10 aa, Entamoeba invadens
SVKSDSGLQQ

SEQ ID NO: 2911007 - protein, 16 aa, Entamoeba invadens
SVKSGPSGLRGSENLQ

SEQ ID NO: 2911008 - protein, 6 aa, Entamoeba invadens
SVKSSV

SEQ ID NO: 2911009 - protein, 5 aa, Entamoeba invadens
SVKST

SEQ ID NO: 2911010 - protein, 12 aa, Entamoeba invadens
SVKTGDIDDWGD

SEQ ID NO: 2911011 - protein, 6 aa, Entamoeba invadens
SVKTVV

SEQ ID NO: 2911012 - protein, 19 aa, Entamoeba invadens
SVLESDKNDEKQEKPQDKD

SEQ ID NO: 2911013 - protein, 5 aa, Entamoeba invadens
SVLPQ

SEQ ID NO: 2911014 - protein, 12 aa, Entamoeba invadens
SVLSGESSGLNI

SEQ ID NO: 2911015 - protein, 9 aa, Entamoeba invadens
SVLSKSKNP

SEQ ID NO: 2911016 - protein, 11 aa, Entamoeba invadens
SVLSRKQSEIA

SEQ ID NO: 2911017 - protein, 4 aa, Entamoeba invadens
SVNA

SEQ ID NO: 2911018 - protein, 13 aa, Entamoeba invadens
SVNASQTEGPQIT

SEQ ID NO: 2911019 - protein, 7 aa, Entamoeba invadens
SVNDGVT

SEQ ID NO: 2911020 - protein, 12 aa, Entamoeba invadens
SVNEVTSPFSPV

SEQ ID NO: 2911021 - protein, 4 aa, Entamoeba invadens
SVNG

SEQ ID NO: 2911022 - protein, 136 aa, Entamoeba invadens
SVNGNAQKTNTNGQKSTSFGVGADNTSKKLTASTSYTQNKSPNSKTKNLKYSATYKPTDNLKLSTDGSFTKQNGQKSRDLSASADYTSKKLDANLKVSSSKSVQTKSKSIAGGVTYRPTDKVTIGANGKYSKTNGV

SEQ ID NO: 2911023 - protein, 113 aa, Entamoeba invadens
SVNGNAQKTNTNGQRSSSFGVGADYTSKKLTASTSYTQNKSPNSKTKNLKYSATYKPTDNLKLSTDGSFTKQNGQKSRDLSASADYTSKKLDANVKVSSSKSVQTKSKSIAGG

SEQ ID NO: 2911024 - protein, 24 aa, Entamoeba invadens
SVNGRGKSVLSKRGKNIGGSTPMK

SEQ ID NO: 2911025 - protein, 8 aa, Entamoeba invadens
SVNHTERQ

SEQ ID NO: 2911026 - protein, 5 aa, Entamoeba invadens
SVNIP

SEQ ID NO: 2911027 - protein, 7 aa, Entamoeba invadens
SVNIPGN

SEQ ID NO: 2911028 - protein, 13 aa, Entamoeba invadens
SVNIPSNVKSIDK

SEQ ID NO: 2911029 - protein, 14 aa, Entamoeba invadens
SVNIPSNVKSIGEG

SEQ ID NO: 2911030 - protein, 11 aa, Entamoeba invadens
SVNIPSSIKSI

SEQ ID NO: 2911031 - protein, 10 aa, Entamoeba invadens
SVNIPSSVKS

SEQ ID NO: 2911032 - protein, 10 aa, Entamoeba invadens
SVNIPSSVTS

SEQ ID NO: 2911033 - protein, 11 aa, Entamoeba invadens
SVNIPSSVTSI

SEQ ID NO: 2911034 - protein, 9 aa, Entamoeba invadens
SVNIPTSVT

SEQ ID NO: 2911035 - protein, 7 aa, Entamoeba invadens
SVNKESY

SEQ ID NO: 2911036 - protein, 9 aa, Entamoeba invadens
SVNKPEDTL

SEQ ID NO: 2911037 - protein, 5 aa, Entamoeba invadens
SVNLP

SEQ ID NO: 2911038 - protein, 14 aa, Entamoeba invadens
SVNNGGLQSYADSK

SEQ ID NO: 2911039 - protein, 7 aa, Entamoeba invadens
SVNNPHK

SEQ ID NO: 2911040 - protein, 7 aa, Entamoeba invadens
SVNNQNG

SEQ ID NO: 2911041 - protein, 6 aa, Entamoeba invadens
SVNPDW

SEQ ID NO: 2911042 - protein, 10 aa, Entamoeba invadens
SVNPSSLKQK

SEQ ID NO: 2911043 - protein, 11 aa, Entamoeba invadens
SVNQSTSIKPI

SEQ ID NO: 2911044 - protein, 4 aa, Entamoeba invadens
SVNR

SEQ ID NO: 2911045 - protein, 7 aa, Entamoeba invadens
SVNRNGY

SEQ ID NO: 2911046 - protein, 8 aa, Entamoeba invadens
SVNRTHKD

SEQ ID NO: 2911047 - protein, 4 aa, Entamoeba invadens
SVNS

SEQ ID NO: 2911048 - protein, 5 aa, Entamoeba invadens
SVNSA

SEQ ID NO: 2911049 - protein, 11 aa, Entamoeba invadens
SVNSEQRTDGV

SEQ ID NO: 2911050 - protein, 10 aa, Entamoeba invadens
SVNSGVKGQQ

SEQ ID NO: 2911051 - protein, 12 aa, Entamoeba invadens
SVNSNKANTYKD

SEQ ID NO: 2911052 - protein, 5 aa, Entamoeba invadens
SVNSV

SEQ ID NO: 2911053 - protein, 13 aa, Entamoeba invadens
SVNTSASSSFNFG

SEQ ID NO: 2911054 - protein, 11 aa, Entamoeba invadens
SVNVPSGPITN

SEQ ID NO: 2911055 - protein, 9 aa, Entamoeba invadens
SVPAQKRTQ

SEQ ID NO: 2911056 - protein, 7 aa, Entamoeba invadens
SVPDNNW

SEQ ID NO: 2911057 - protein, 6 aa, Entamoeba invadens
SVPEHP

SEQ ID NO: 2911058 - protein, 6 aa, Entamoeba invadens
SVPEIE

SEQ ID NO: 2911059 - protein, 7 aa, Entamoeba invadens
SVPEKRK

SEQ ID NO: 2911060 - protein, 5 aa, Entamoeba invadens
SVPGG

SEQ ID NO: 2911061 - protein, 7 aa, Entamoeba invadens
SVPKQRT

SEQ ID NO: 2911062 - protein, 6 aa, Entamoeba invadens
SVPNIG

SEQ ID NO: 2911063 - protein, 5 aa, Entamoeba invadens
SVPNQ

SEQ ID NO: 2911064 - protein, 7 aa, Entamoeba invadens
SVPPPTL

SEQ ID NO: 2911065 - protein, 8 aa, Entamoeba invadens
SVPPTAQR

SEQ ID NO: 2911066 - protein, 13 aa, Entamoeba invadens
SVPPVPPTIPREC

SEQ ID NO: 2911067 - protein, 7 aa, Entamoeba invadens
SVPQDTT

SEQ ID NO: 2911068 - protein, 22 aa, Entamoeba invadens
SVPRIEGKEDTIKEYTLPDGRT

SEQ ID NO: 2911069 - protein, 16 aa, Entamoeba invadens
SVPRQQRAILSSYDES

SEQ ID NO: 2911070 - protein, 4 aa, Entamoeba invadens
SVPS

SEQ ID NO: 2911071 - protein, 9 aa, Entamoeba invadens
SVPSAVSKQ

SEQ ID NO: 2911072 - protein, 9 aa, Entamoeba invadens
SVPSDSPDD

SEQ ID NO: 2911073 - protein, 9 aa, Entamoeba invadens
SVPSTKPMD

SEQ ID NO: 2911074 - protein, 5 aa, Entamoeba invadens
SVPTA

SEQ ID NO: 2911075 - protein, 7 aa, Entamoeba invadens
SVPTENK

SEQ ID NO: 2911076 - protein, 9 aa, Entamoeba invadens
SVPTEPSML

SEQ ID NO: 2911077 - protein, 11 aa, Entamoeba invadens
SVPTKNDQVED

SEQ ID NO: 2911078 - protein, 13 aa, Entamoeba invadens
SVPYQSDSTSTFA

SEQ ID NO: 2911079 - protein, 6 aa, Entamoeba invadens
SVQAET

SEQ ID NO: 2911080 - protein, 4 aa, Entamoeba invadens
SVQE

SEQ ID NO: 2911081 - protein, 28 aa, Entamoeba invadens
SVQEEGGTESQFRPNEFQQTTYSQPLQN

SEQ ID NO: 2911082 - protein, 7 aa, Entamoeba invadens
SVQENEA

SEQ ID NO: 2911083 - protein, 19 aa, Entamoeba invadens
SVQKNEKFAEDENEENKTL

SEQ ID NO: 2911084 - protein, 6 aa, Entamoeba invadens
SVQNGD

SEQ ID NO: 2911085 - protein, 9 aa, Entamoeba invadens
SVQNPPDLS

SEQ ID NO: 2911086 - protein, 26 aa, Entamoeba invadens
SVQNTMSQQQVQDSKVHQTEEQEKST

SEQ ID NO: 2911087 - protein, 14 aa, Entamoeba invadens
SVQPKQRAEHKQST

SEQ ID NO: 2911088 - protein, 8 aa, Entamoeba invadens
SVQPQNQL

SEQ ID NO: 2911089 - protein, 12 aa, Entamoeba invadens
SVQQVGDNAFSG

SEQ ID NO: 2911090 - protein, 6 aa, Entamoeba invadens
SVQRDA

SEQ ID NO: 2911091 - protein, 4 aa, Entamoeba invadens
SVQY

SEQ ID NO: 2911092 - protein, 8 aa, Entamoeba invadens
SVRANPTL

SEQ ID NO: 2911093 - protein, 4 aa, Entamoeba invadens
SVRG

SEQ ID NO: 2911094 - protein, 5 aa, Entamoeba invadens
SVRNK

SEQ ID NO: 2911095 - protein, 18 aa, Entamoeba invadens
SVRNNIAKKNASITLPPP

SEQ ID NO: 2911096 - protein, 5 aa, Entamoeba invadens
SVRPE

SEQ ID NO: 2911097 - protein, 5 aa, Entamoeba invadens
SVRPG

SEQ ID NO: 2911098 - protein, 8 aa, Entamoeba invadens
SVRPLSRD

SEQ ID NO: 2911099 - protein, 14 aa, Entamoeba invadens
SVRQQNESLLQEKE

SEQ ID NO: 2911100 - protein, 10 aa, Entamoeba invadens
SVRRSGISDH

SEQ ID NO: 2911101 - protein, 8 aa, Entamoeba invadens
SVRSQTAA

SEQ ID NO: 2911102 - protein, 6 aa, Entamoeba invadens
SVRSTE

SEQ ID NO: 2911103 - protein, 7 aa, Entamoeba invadens
SVRTAQD

SEQ ID NO: 2911104 - protein, 15 aa, Entamoeba invadens
SVRYGSVKGSFDDPH

SEQ ID NO: 2911105 - protein, 9 aa, Entamoeba invadens
SVSAPSENL

SEQ ID NO: 2911106 - protein, 5 aa, Entamoeba invadens
SVSDA

SEQ ID NO: 2911107 - protein, 9 aa, Entamoeba invadens
SVSEAKSVC

SEQ ID NO: 2911108 - protein, 13 aa, Entamoeba invadens
SVSEGISPDSHNF

SEQ ID NO: 2911109 - protein, 5 aa, Entamoeba invadens
SVSEI

SEQ ID NO: 2911110 - protein, 5 aa, Entamoeba invadens
SVSEN

SEQ ID NO: 2911111 - protein, 14 aa, Entamoeba invadens
SVSETALESDEEQH

SEQ ID NO: 2911112 - protein, 7 aa, Entamoeba invadens
SVSGDTV

SEQ ID NO: 2911113 - protein, 7 aa, Entamoeba invadens
SVSGGEV

SEQ ID NO: 2911114 - protein, 8 aa, Entamoeba invadens
SVSGKTPY

SEQ ID NO: 2911115 - protein, 16 aa, Entamoeba invadens
SVSGYSFPGTVEENGA

SEQ ID NO: 2911116 - protein, 4 aa, Entamoeba invadens
SVSI

SEQ ID NO: 2911117 - protein, 6 aa, Entamoeba invadens
SVSIPS

SEQ ID NO: 2911118 - protein, 10 aa, Entamoeba invadens
SVSIPSSVTS

SEQ ID NO: 2911119 - protein, 11 aa, Entamoeba invadens
SVSIPSSVTSI

SEQ ID NO: 2911120 - protein, 19 aa, Entamoeba invadens
SVSIPTSVTSIGEGCFYKC

SEQ ID NO: 2911121 - protein, 10 aa, Entamoeba invadens
SVSISSNVTS

SEQ ID NO: 2911122 - protein, 8 aa, Entamoeba invadens
SVSKDGKI

SEQ ID NO: 2911123 - protein, 9 aa, Entamoeba invadens
SVSKDNGSK

SEQ ID NO: 2911124 - protein, 8 aa, Entamoeba invadens
SVSKEDEL

SEQ ID NO: 2911125 - protein, 9 aa, Entamoeba invadens
SVSKEIGAH

SEQ ID NO: 2911126 - protein, 9 aa, Entamoeba invadens
SVSKEKCGK

SEQ ID NO: 2911127 - protein, 9 aa, Entamoeba invadens
SVSKEREDD

SEQ ID NO: 2911128 - protein, 5 aa, Entamoeba invadens
SVSKI

SEQ ID NO: 2911129 - protein, 14 aa, Entamoeba invadens
SVSKPVKQEENKQI

SEQ ID NO: 2911130 - protein, 8 aa, Entamoeba invadens
SVSKRKAK

SEQ ID NO: 2911131 - protein, 12 aa, Entamoeba invadens
SVSKVSKRMEDK

SEQ ID NO: 2911132 - protein, 12 aa, Entamoeba invadens
SVSLSEEQKSEF

SEQ ID NO: 2911133 - protein, 6 aa, Entamoeba invadens
SVSNAP

SEQ ID NO: 2911134 - protein, 5 aa, Entamoeba invadens
SVSNE

SEQ ID NO: 2911135 - protein, 12 aa, Entamoeba invadens
SVSNGTMNEKKK

SEQ ID NO: 2911136 - protein, 12 aa, Entamoeba invadens
SVSNHIESNGVN

SEQ ID NO: 2911137 - protein, 5 aa, Entamoeba invadens
SVSNI

SEQ ID NO: 2911138 - protein, 6 aa, Entamoeba invadens
SVSNQG

SEQ ID NO: 2911139 - protein, 10 aa, Entamoeba invadens
SVSNYTAEQV

SEQ ID NO: 2911140 - protein, 4 aa, Entamoeba invadens
SVSP

SEQ ID NO: 2911141 - protein, 8 aa, Entamoeba invadens
SVSPAGKT

SEQ ID NO: 2911142 - protein, 9 aa, Entamoeba invadens
SVSPGETAR

SEQ ID NO: 2911143 - protein, 27 aa, Entamoeba invadens
SVSPHSDSLEENSKNDKENKNEKMSMS

SEQ ID NO: 2911144 - protein, 5 aa, Entamoeba invadens
SVSPN

SEQ ID NO: 2911145 - protein, 8 aa, Entamoeba invadens
SVSPNIGN

SEQ ID NO: 2911146 - protein, 23 aa, Entamoeba invadens
SVSPNRRNSLSPTRKQRKQYTIT

SEQ ID NO: 2911147 - protein, 5 aa, Entamoeba invadens
SVSPP

SEQ ID NO: 2911148 - protein, 10 aa, Entamoeba invadens
SVSQFPTSQY

SEQ ID NO: 2911149 - protein, 5 aa, Entamoeba invadens
SVSQP

SEQ ID NO: 2911150 - protein, 15 aa, Entamoeba invadens
SVSQPVIRKSSNDLN

SEQ ID NO: 2911151 - protein, 4 aa, Entamoeba invadens
SVSS

SEQ ID NO: 2911152 - protein, 5 aa, Entamoeba invadens
SVSSC

SEQ ID NO: 2911153 - protein, 10 aa, Entamoeba invadens
SVSSDNTPYE

SEQ ID NO: 2911154 - protein, 6 aa, Entamoeba invadens
SVSSGI

SEQ ID NO: 2911155 - protein, 10 aa, Entamoeba invadens
SVSSKNTEEI

SEQ ID NO: 2911156 - protein, 6 aa, Entamoeba invadens
SVSSKQ

SEQ ID NO: 2911157 - protein, 9 aa, Entamoeba invadens
SVSSKTKTD

SEQ ID NO: 2911158 - protein, 5 aa, Entamoeba invadens
SVSSL

SEQ ID NO: 2911159 - protein, 12 aa, Entamoeba invadens
SVSSSSESQSVI

SEQ ID NO: 2911160 - protein, 5 aa, Entamoeba invadens
SVSST

SEQ ID NO: 2911161 - protein, 8 aa, Entamoeba invadens
SVSSTRSF

SEQ ID NO: 2911162 - protein, 18 aa, Entamoeba invadens
SVSSTSENCFPSNTIIYR

SEQ ID NO: 2911163 - protein, 13 aa, Entamoeba invadens
SVSTEKPATGTYN

SEQ ID NO: 2911164 - protein, 17 aa, Entamoeba invadens
SVSTGGANPRTLDGEEL

SEQ ID NO: 2911165 - protein, 4 aa, Entamoeba invadens
SVSV

SEQ ID NO: 2911166 - protein, 4 aa, Entamoeba invadens
SVSY

SEQ ID NO: 2911167 - protein, 14 aa, Entamoeba invadens
SVTAKEKARGVRPN

SEQ ID NO: 2911168 - protein, 19 aa, Entamoeba invadens
SVTARGNMCGKPPKQCRVS

SEQ ID NO: 2911169 - protein, 13 aa, Entamoeba invadens
SVTDDNKSVEEFE

SEQ ID NO: 2911170 - protein, 10 aa, Entamoeba invadens
SVTDGGSNCM

SEQ ID NO: 2911171 - protein, 5 aa, Entamoeba invadens
SVTDS

SEQ ID NO: 2911172 - protein, 8 aa, Entamoeba invadens
SVTDTSNF

SEQ ID NO: 2911173 - protein, 11 aa, Entamoeba invadens
SVTEKGEHLTN

SEQ ID NO: 2911174 - protein, 13 aa, Entamoeba invadens
SVTENNRAGQKID

SEQ ID NO: 2911175 - protein, 8 aa, Entamoeba invadens
SVTIPESV

SEQ ID NO: 2911176 - protein, 6 aa, Entamoeba invadens
SVTIPP

SEQ ID NO: 2911177 - protein, 11 aa, Entamoeba invadens
SVTIPPSVTSI

SEQ ID NO: 2911178 - protein, 8 aa, Entamoeba invadens
SVTIPSNM

SEQ ID NO: 2911179 - protein, 12 aa, Entamoeba invadens
SVTIPSNVTSIG

SEQ ID NO: 2911180 - protein, 10 aa, Entamoeba invadens
SVTIPSSVRS

SEQ ID NO: 2911181 - protein, 11 aa, Entamoeba invadens
SVTIPSSVRSI

SEQ ID NO: 2911182 - protein, 13 aa, Entamoeba invadens
SVTIPSSVRSIGE

SEQ ID NO: 2911183 - protein, 10 aa, Entamoeba invadens
SVTIPSSVTE

SEQ ID NO: 2911184 - protein, 10 aa, Entamoeba invadens
SVTIPSSVTS

SEQ ID NO: 2911185 - protein, 11 aa, Entamoeba invadens
SVTIPSSVTSF

SEQ ID NO: 2911186 - protein, 11 aa, Entamoeba invadens
SVTIPSSVTSI

SEQ ID NO: 2911187 - protein, 13 aa, Entamoeba invadens
SVTIPSSVTSIGD

SEQ ID NO: 2911188 - protein, 12 aa, Entamoeba invadens
SVTIPSSVTSIS

SEQ ID NO: 2911189 - protein, 11 aa, Entamoeba invadens
SVTIPSTVSSI

SEQ ID NO: 2911190 - protein, 18 aa, Entamoeba invadens
SVTIPSTVSSIGNHYDRE

SEQ ID NO: 2911191 - protein, 7 aa, Entamoeba invadens
SVTIPTN

SEQ ID NO: 2911192 - protein, 4 aa, Entamoeba invadens
SVTK

SEQ ID NO: 2911193 - protein, 9 aa, Entamoeba invadens
SVTKDAADN

SEQ ID NO: 2911194 - protein, 6 aa, Entamoeba invadens
SVTKIG

SEQ ID NO: 2911195 - protein, 10 aa, Entamoeba invadens
SVTKQNTYSR

SEQ ID NO: 2911196 - protein, 10 aa, Entamoeba invadens
SVTKVGPSSF

SEQ ID NO: 2911197 - protein, 4 aa, Entamoeba invadens
SVTL

SEQ ID NO: 2911198 - protein, 29 aa, Entamoeba invadens
SVTNMDDSKSELSSKKKRKTTIIGKLRKM

SEQ ID NO: 2911199 - protein, 9 aa, Entamoeba invadens
SVTNPTTVD

SEQ ID NO: 2911200 - protein, 11 aa, Entamoeba invadens
SVTNRSKTSIE

SEQ ID NO: 2911201 - protein, 7 aa, Entamoeba invadens
SVTPLDT

SEQ ID NO: 2911202 - protein, 6 aa, Entamoeba invadens
SVTPQL

SEQ ID NO: 2911203 - protein, 6 aa, Entamoeba invadens
SVTPRQ

SEQ ID NO: 2911204 - protein, 4 aa, Entamoeba invadens
SVTQ

SEQ ID NO: 2911205 - protein, 15 aa, Entamoeba invadens
SVTQEVNNKTKAIER

SEQ ID NO: 2911206 - protein, 5 aa, Entamoeba invadens
SVTQI

SEQ ID NO: 2911207 - protein, 5 aa, Entamoeba invadens
SVTQN

SEQ ID NO: 2911208 - protein, 5 aa, Entamoeba invadens
SVTQQ

SEQ ID NO: 2911209 - protein, 5 aa, Entamoeba invadens
SVTQR

SEQ ID NO: 2911210 - protein, 5 aa, Entamoeba invadens
SVTQS

SEQ ID NO: 2911211 - protein, 5 aa, Entamoeba invadens
SVTRI

SEQ ID NO: 2911212 - protein, 7 aa, Entamoeba invadens
SVTRPRE

SEQ ID NO: 2911213 - protein, 7 aa, Entamoeba invadens
SVTSEEL

SEQ ID NO: 2911214 - protein, 8 aa, Entamoeba invadens
SVTSENDL

SEQ ID NO: 2911215 - protein, 6 aa, Entamoeba invadens
SVTSET

SEQ ID NO: 2911216 - protein, 5 aa, Entamoeba invadens
SVTSF

SEQ ID NO: 2911217 - protein, 10 aa, Entamoeba invadens
SVTSIEKNSF

SEQ ID NO: 2911218 - protein, 12 aa, Entamoeba invadens
SVTSIGKNAFDG

SEQ ID NO: 2911219 - protein, 6 aa, Entamoeba invadens
SVTSLG

SEQ ID NO: 2911220 - protein, 6 aa, Entamoeba invadens
SVTSNY

SEQ ID NO: 2911221 - protein, 14 aa, Entamoeba invadens
SVTSPKEVRRYIDF

SEQ ID NO: 2911222 - protein, 12 aa, Entamoeba invadens
SVTSSPVPPLND

SEQ ID NO: 2911223 - protein, 9 aa, Entamoeba invadens
SVTSSVEEG

SEQ ID NO: 2911224 - protein, 9 aa, Entamoeba invadens
SVTSSVEEK

SEQ ID NO: 2911225 - protein, 5 aa, Entamoeba invadens
SVTST

SEQ ID NO: 2911226 - protein, 11 aa, Entamoeba invadens
SVTTCNPANGE

SEQ ID NO: 2911227 - protein, 10 aa, Entamoeba invadens
SVTTIGEGAF

SEQ ID NO: 2911228 - protein, 5 aa, Entamoeba invadens
SVTTL

SEQ ID NO: 2911229 - protein, 9 aa, Entamoeba invadens
SVTTPDTVF

SEQ ID NO: 2911230 - protein, 5 aa, Entamoeba invadens
SVVEE

SEQ ID NO: 2911231 - protein, 12 aa, Entamoeba invadens
SVVKSEDDFLKD

SEQ ID NO: 2911232 - protein, 21 aa, Entamoeba invadens
SVVKSTQKDIQSEQKEQEKAV

SEQ ID NO: 2911233 - protein, 9 aa, Entamoeba invadens
SVVNSSKEV

SEQ ID NO: 2911234 - protein, 7 aa, Entamoeba invadens
SVVPDTK

SEQ ID NO: 2911235 - protein, 7 aa, Entamoeba invadens
SVVPNQP

SEQ ID NO: 2911236 - protein, 7 aa, Entamoeba invadens
SVVPNTK

SEQ ID NO: 2911237 - protein, 20 aa, Entamoeba invadens
SVVPPNVPTHPFSTTTPKKL

SEQ ID NO: 2911238 - protein, 10 aa, Entamoeba invadens
SVVQDKRNEP

SEQ ID NO: 2911239 - protein, 12 aa, Entamoeba invadens
SVVTSEAKRKVI

SEQ ID NO: 2911240 - protein, 10 aa, Entamoeba invadens
SVVTSNNFPR

SEQ ID NO: 2911241 - protein, 5 aa, Entamoeba invadens
SVYDN

SEQ ID NO: 2911242 - protein, 8 aa, Entamoeba invadens
SVYKPEDV

SEQ ID NO: 2911243 - protein, 10 aa, Entamoeba invadens
SVYPQTPSGE

SEQ ID NO: 2911244 - protein, 9 aa, Entamoeba invadens
SVYRDSTKT

SEQ ID NO: 2911245 - protein, 11 aa, Entamoeba invadens
SVYSQTDEINS

SEQ ID NO: 2911246 - protein, 8 aa, Entamoeba invadens
SVYSSPLS

SEQ ID NO: 2911247 - protein, 17 aa, Entamoeba invadens
SVYTKEKSQTVLKDPKR

SEQ ID NO: 2911248 - protein, 8 aa, Entamoeba invadens
SVYTPPTN

SEQ ID NO: 2911249 - protein, 6 aa, Entamoeba invadens
SWDIPK

SEQ ID NO: 2911250 - protein, 4 aa, Entamoeba invadens
SWDK

SEQ ID NO: 2911251 - protein, 5 aa, Entamoeba invadens
SWDKE

SEQ ID NO: 2911252 - protein, 11 aa, Entamoeba invadens
SWEDDPDVKFD

SEQ ID NO: 2911253 - protein, 12 aa, Entamoeba invadens
SWEGKEFNSIGD

SEQ ID NO: 2911254 - protein, 9 aa, Entamoeba invadens
SWEQYSTQK

SEQ ID NO: 2911255 - protein, 16 aa, Entamoeba invadens
SWESEGDLTLPEDKEA

SEQ ID NO: 2911256 - protein, 5 aa, Entamoeba invadens
SWGAL

SEQ ID NO: 2911257 - protein, 5 aa, Entamoeba invadens
SWGHD

SEQ ID NO: 2911258 - protein, 11 aa, Entamoeba invadens
SWNGTDGNTHS

SEQ ID NO: 2911259 - protein, 10 aa, Entamoeba invadens
SWNNNTESQI

SEQ ID NO: 2911260 - protein, 8 aa, Entamoeba invadens
SWNNSEKA

SEQ ID NO: 2911261 - protein, 5 aa, Entamoeba invadens
SWNTS

SEQ ID NO: 2911262 - protein, 13 aa, Entamoeba invadens
SWPFEEGKKLKER

SEQ ID NO: 2911263 - protein, 11 aa, Entamoeba invadens
SWSEDPNLRPS

SEQ ID NO: 2911264 - protein, 12 aa, Entamoeba invadens
SWSSKNPAEQRR

SEQ ID NO: 2911265 - protein, 8 aa, Entamoeba invadens
SWTTKKRR

SEQ ID NO: 2911266 - protein, 24 aa, Entamoeba invadens
SYADSLREVSAAREEVPGRRGYPG

SEQ ID NO: 2911267 - protein, 10 aa, Entamoeba invadens
SYAKTKAEPI

SEQ ID NO: 2911268 - protein, 5 aa, Entamoeba invadens
SYAQQ

SEQ ID NO: 2911269 - protein, 4 aa, Entamoeba invadens
SYAS

SEQ ID NO: 2911270 - protein, 8 aa, Entamoeba invadens
SYASETFG

SEQ ID NO: 2911271 - protein, 6 aa, Entamoeba invadens
SYATPT

SEQ ID NO: 2911272 - protein, 4 aa, Entamoeba invadens
SYCG

SEQ ID NO: 2911273 - protein, 11 aa, Entamoeba invadens
SYDEGGKNQLS

SEQ ID NO: 2911274 - protein, 7 aa, Entamoeba invadens
SYDEKEK

SEQ ID NO: 2911275 - protein, 5 aa, Entamoeba invadens
SYDEQ

SEQ ID NO: 2911276 - protein, 8 aa, Entamoeba invadens
SYDGDRRL

SEQ ID NO: 2911277 - protein, 5 aa, Entamoeba invadens
SYDGT

SEQ ID NO: 2911278 - protein, 7 aa, Entamoeba invadens
SYDKTAR

SEQ ID NO: 2911279 - protein, 11 aa, Entamoeba invadens
SYDPQTVNSQD

SEQ ID NO: 2911280 - protein, 6 aa, Entamoeba invadens
SYDPSM

SEQ ID NO: 2911281 - protein, 7 aa, Entamoeba invadens
SYDQTSE

SEQ ID NO: 2911282 - protein, 7 aa, Entamoeba invadens
SYDRGSG

SEQ ID NO: 2911283 - protein, 4 aa, Entamoeba invadens
SYDT

SEQ ID NO: 2911284 - protein, 9 aa, Entamoeba invadens
SYDTETPKV

SEQ ID NO: 2911285 - protein, 4 aa, Entamoeba invadens
SYED

SEQ ID NO: 2911286 - protein, 5 aa, Entamoeba invadens
SYEDC

SEQ ID NO: 2911287 - protein, 33 aa, Entamoeba invadens
SYEDVSPLAQPKAKTARMEEDENDKMQSPSQIS

SEQ ID NO: 2911288 - protein, 15 aa, Entamoeba invadens
SYEEEQKSHNKTIEE

SEQ ID NO: 2911289 - protein, 26 aa, Entamoeba invadens
SYEEESFSPIEQDDKKSKGKGKAPKV

SEQ ID NO: 2911290 - protein, 10 aa, Entamoeba invadens
SYEESVEKSR

SEQ ID NO: 2911291 - protein, 13 aa, Entamoeba invadens
SYEETHLSSIVKS

SEQ ID NO: 2911292 - protein, 8 aa, Entamoeba invadens
SYEGKSSI

SEQ ID NO: 2911293 - protein, 9 aa, Entamoeba invadens
SYEGLTDED

SEQ ID NO: 2911294 - protein, 10 aa, Entamoeba invadens
SYEKRKTLRK

SEQ ID NO: 2911295 - protein, 7 aa, Entamoeba invadens
SYEKSSP

SEQ ID NO: 2911296 - protein, 13 aa, Entamoeba invadens
SYEKYTKTNKEDP

SEQ ID NO: 2911297 - protein, 22 aa, Entamoeba invadens
SYENSTVENKEKIIKEKQSEIE

SEQ ID NO: 2911298 - protein, 9 aa, Entamoeba invadens
SYEQIEDSI

SEQ ID NO: 2911299 - protein, 8 aa, Entamoeba invadens
SYETGGDV

SEQ ID NO: 2911300 - protein, 6 aa, Entamoeba invadens
SYETGK

SEQ ID NO: 2911301 - protein, 4 aa, Entamoeba invadens
SYEY

SEQ ID NO: 2911302 - protein, 11 aa, Entamoeba invadens
SYFEDTKRNRR

SEQ ID NO: 2911303 - protein, 24 aa, Entamoeba invadens
SYFSTDSLGTENVNEDTDFETPYL

SEQ ID NO: 2911304 - protein, 10 aa, Entamoeba invadens
SYGATDNSDL

SEQ ID NO: 2911305 - protein, 14 aa, Entamoeba invadens
SYGDKEEKARNEKK

SEQ ID NO: 2911306 - protein, 6 aa, Entamoeba invadens
SYGKAG

SEQ ID NO: 2911307 - protein, 10 aa, Entamoeba invadens
SYGKTIQNPI

SEQ ID NO: 2911308 - protein, 12 aa, Entamoeba invadens
SYGKTNQKPIKT

SEQ ID NO: 2911309 - protein, 7 aa, Entamoeba invadens
SYGNNSQ

SEQ ID NO: 2911310 - protein, 7 aa, Entamoeba invadens
SYGTKGH

SEQ ID NO: 2911311 - protein, 5 aa, Entamoeba invadens
SYIKN

SEQ ID NO: 2911312 - protein, 13 aa, Entamoeba invadens
SYIQSEHPNFRFT

SEQ ID NO: 2911313 - protein, 14 aa, Entamoeba invadens
SYISQEQKARERLE

SEQ ID NO: 2911314 - protein, 10 aa, Entamoeba invadens
SYKDSDTRQT

SEQ ID NO: 2911315 - protein, 10 aa, Entamoeba invadens
SYKEGQQIAE

SEQ ID NO: 2911316 - protein, 114 aa, Entamoeba invadens
SYKEKKDAIEKAKADATKISGTKKVKKVKKVKKVKKATSEVAEENGAEGSNKKVKKVKKVKKVKKVKKVKTEAVEESVQPAQPEEKKEEPKAEEPKVEENKEEKKLTREEQEKI

SEQ ID NO: 2911317 - protein, 14 aa, Entamoeba invadens
SYKENGTLDKKIGT

SEQ ID NO: 2911318 - protein, 7 aa, Entamoeba invadens
SYKENGV

SEQ ID NO: 2911319 - protein, 5 aa, Entamoeba invadens
SYKGD

SEQ ID NO: 2911320 - protein, 5 aa, Entamoeba invadens
SYKGN

SEQ ID NO: 2911321 - protein, 8 aa, Entamoeba invadens
SYKISGES

SEQ ID NO: 2911322 - protein, 4 aa, Entamoeba invadens
SYKK

SEQ ID NO: 2911323 - protein, 7 aa, Entamoeba invadens
SYKNGRT

SEQ ID NO: 2911324 - protein, 14 aa, Entamoeba invadens
SYKNNKTTSLPDED

SEQ ID NO: 2911325 - protein, 9 aa, Entamoeba invadens
SYKNTTHEK

SEQ ID NO: 2911326 - protein, 5 aa, Entamoeba invadens
SYKPS

SEQ ID NO: 2911327 - protein, 15 aa, Entamoeba invadens
SYKSQNQRVKPSHSK

SEQ ID NO: 2911328 - protein, 10 aa, Entamoeba invadens
SYKTHSTQSE

SEQ ID NO: 2911329 - protein, 9 aa, Entamoeba invadens
SYKTNDAER

SEQ ID NO: 2911330 - protein, 7 aa, Entamoeba invadens
SYKTQVS

SEQ ID NO: 2911331 - protein, 4 aa, Entamoeba invadens
SYLD

SEQ ID NO: 2911332 - protein, 5 aa, Entamoeba invadens
SYLDD

SEQ ID NO: 2911333 - protein, 6 aa, Entamoeba invadens
SYLGDD

SEQ ID NO: 2911334 - protein, 5 aa, Entamoeba invadens
SYLPS

SEQ ID NO: 2911335 - protein, 5 aa, Entamoeba invadens
SYLTT

SEQ ID NO: 2911336 - protein, 4 aa, Entamoeba invadens
SYMR

SEQ ID NO: 2911337 - protein, 7 aa, Entamoeba invadens
SYMTGSG

SEQ ID NO: 2911338 - protein, 4 aa, Entamoeba invadens
SYNE

SEQ ID NO: 2911339 - protein, 6 aa, Entamoeba invadens
SYNEES

SEQ ID NO: 2911340 - protein, 21 aa, Entamoeba invadens
SYNGEGLEEFKDKTIKLPFCV

SEQ ID NO: 2911341 - protein, 5 aa, Entamoeba invadens
SYNKR

SEQ ID NO: 2911342 - protein, 12 aa, Entamoeba invadens
SYNQSEKEYQNA

SEQ ID NO: 2911343 - protein, 4 aa, Entamoeba invadens
SYNR

SEQ ID NO: 2911344 - protein, 7 aa, Entamoeba invadens
SYNSSQK

SEQ ID NO: 2911345 - protein, 5 aa, Entamoeba invadens
SYNTQ

SEQ ID NO: 2911346 - protein, 9 aa, Entamoeba invadens
SYPDAKISE

SEQ ID NO: 2911347 - protein, 4 aa, Entamoeba invadens
SYPE

SEQ ID NO: 2911348 - protein, 6 aa, Entamoeba invadens
SYPEAT

SEQ ID NO: 2911349 - protein, 55 aa, Entamoeba invadens
SYPGEKKKNTEKKEAEKKKKNTKQTKPKNQCKKKEKKEKSSEKLQEKIEENRDQD

SEQ ID NO: 2911350 - protein, 5 aa, Entamoeba invadens
SYPHD

SEQ ID NO: 2911351 - protein, 7 aa, Entamoeba invadens
SYPKCED

SEQ ID NO: 2911352 - protein, 6 aa, Entamoeba invadens
SYPKTQ

SEQ ID NO: 2911353 - protein, 12 aa, Entamoeba invadens
SYPLDSNSVTKI

SEQ ID NO: 2911354 - protein, 4 aa, Entamoeba invadens
SYPN

SEQ ID NO: 2911355 - protein, 82 aa, Entamoeba invadens
SYPNFQNPYSNQPYDTHDDPYAYEKPRQSLQQQQNPSQIPPAQLSSSQSTSHLQSNVNPHQSLQQQVPQNVPQQMQPTQQAN

SEQ ID NO: 2911356 - protein, 9 aa, Entamoeba invadens
SYPNQETQR

SEQ ID NO: 2911357 - protein, 7 aa, Entamoeba invadens
SYPPATY

SEQ ID NO: 2911358 - protein, 6 aa, Entamoeba invadens
SYPPYK

SEQ ID NO: 2911359 - protein, 4 aa, Entamoeba invadens
SYPQ

SEQ ID NO: 2911360 - protein, 8 aa, Entamoeba invadens
SYPSDTPL

SEQ ID NO: 2911361 - protein, 7 aa, Entamoeba invadens
SYPSFTP

SEQ ID NO: 2911362 - protein, 8 aa, Entamoeba invadens
SYPSGITR

SEQ ID NO: 2911363 - protein, 7 aa, Entamoeba invadens
SYPSQEC

SEQ ID NO: 2911364 - protein, 5 aa, Entamoeba invadens
SYPST

SEQ ID NO: 2911365 - protein, 11 aa, Entamoeba invadens
SYPSTDKKNNF

SEQ ID NO: 2911366 - protein, 6 aa, Entamoeba invadens
SYPTAP

SEQ ID NO: 2911367 - protein, 23 aa, Entamoeba invadens
SYPTSTTPQIIENSEGSRTTPSI

SEQ ID NO: 2911368 - protein, 16 aa, Entamoeba invadens
SYQEKTKNDSKACEVS

SEQ ID NO: 2911369 - protein, 5 aa, Entamoeba invadens
SYQEQ

SEQ ID NO: 2911370 - protein, 5 aa, Entamoeba invadens
SYQFT

SEQ ID NO: 2911371 - protein, 11 aa, Entamoeba invadens
SYQGRGPKNSK

SEQ ID NO: 2911372 - protein, 20 aa, Entamoeba invadens
SYQNEKQECDELQKNYNEQL

SEQ ID NO: 2911373 - protein, 9 aa, Entamoeba invadens
SYQNTNEVQ

SEQ ID NO: 2911374 - protein, 7 aa, Entamoeba invadens
SYQPTCR

SEQ ID NO: 2911375 - protein, 9 aa, Entamoeba invadens
SYQQGQNEL

SEQ ID NO: 2911376 - protein, 6 aa, Entamoeba invadens
SYQRER

SEQ ID NO: 2911377 - protein, 13 aa, Entamoeba invadens
SYQTANSSSNEEW

SEQ ID NO: 2911378 - protein, 8 aa, Entamoeba invadens
SYRENGIK

SEQ ID NO: 2911379 - protein, 4 aa, Entamoeba invadens
SYRG

SEQ ID NO: 2911380 - protein, 4 aa, Entamoeba invadens
SYRS

SEQ ID NO: 2911381 - protein, 6 aa, Entamoeba invadens
SYSAGS

SEQ ID NO: 2911382 - protein, 26 aa, Entamoeba invadens
SYSALQNTPPTKKKMTAKEARLGKRT

SEQ ID NO: 2911383 - protein, 6 aa, Entamoeba invadens
SYSDEA

SEQ ID NO: 2911384 - protein, 6 aa, Entamoeba invadens
SYSDVA

SEQ ID NO: 2911385 - protein, 5 aa, Entamoeba invadens
SYSGN

SEQ ID NO: 2911386 - protein, 8 aa, Entamoeba invadens
SYSIGNAT

SEQ ID NO: 2911387 - protein, 4 aa, Entamoeba invadens
SYSK

SEQ ID NO: 2911388 - protein, 10 aa, Entamoeba invadens
SYSKSNPTLH

SEQ ID NO: 2911389 - protein, 9 aa, Entamoeba invadens
SYSMDTSRW

SEQ ID NO: 2911390 - protein, 16 aa, Entamoeba invadens
SYSMEEKTTLSPRQPS

SEQ ID NO: 2911391 - protein, 8 aa, Entamoeba invadens
SYSNEDPH

SEQ ID NO: 2911392 - protein, 14 aa, Entamoeba invadens
SYSNEKDQQKRGEW

SEQ ID NO: 2911393 - protein, 12 aa, Entamoeba invadens
SYSNTKGIGLVN

SEQ ID NO: 2911394 - protein, 4 aa, Entamoeba invadens
SYSP

SEQ ID NO: 2911395 - protein, 16 aa, Entamoeba invadens
SYSPKKSKKEEKTKVE

SEQ ID NO: 2911396 - protein, 9 aa, Entamoeba invadens
SYSPPPDFP

SEQ ID NO: 2911397 - protein, 6 aa, Entamoeba invadens
SYSPQG

SEQ ID NO: 2911398 - protein, 19 aa, Entamoeba invadens
SYSPQLSRSKSPRGDRSPI

SEQ ID NO: 2911399 - protein, 5 aa, Entamoeba invadens
SYSPS

SEQ ID NO: 2911400 - protein, 11 aa, Entamoeba invadens
SYSRAKGEKEK

SEQ ID NO: 2911401 - protein, 5 aa, Entamoeba invadens
SYSRN

SEQ ID NO: 2911402 - protein, 83 aa, Entamoeba invadens
SYSSEETSQQTKLATTNPAAEKPSKQTTKNDKSTDSKSASHSGSDSKSDSHSSSGSDKSKGTTSTGSTDDDYSDDDDSSENYP

SEQ ID NO: 2911403 - protein, 7 aa, Entamoeba invadens
SYSSGVS

SEQ ID NO: 2911404 - protein, 5 aa, Entamoeba invadens
SYSSN

SEQ ID NO: 2911405 - protein, 16 aa, Entamoeba invadens
SYSSSWQSEPVPVTQE

SEQ ID NO: 2911406 - protein, 7 aa, Entamoeba invadens
SYSTGEI

SEQ ID NO: 2911407 - protein, 13 aa, Entamoeba invadens
SYSTSNGFYNKTK

SEQ ID NO: 2911408 - protein, 8 aa, Entamoeba invadens
SYSTTLDD

SEQ ID NO: 2911409 - protein, 6 aa, Entamoeba invadens
SYSYQD

SEQ ID NO: 2911410 - protein, 10 aa, Entamoeba invadens
SYTDEKYPLG

SEQ ID NO: 2911411 - protein, 8 aa, Entamoeba invadens
SYTEKNRP

SEQ ID NO: 2911412 - protein, 5 aa, Entamoeba invadens
SYTER

SEQ ID NO: 2911413 - protein, 10 aa, Entamoeba invadens
SYTETIDDEY

SEQ ID NO: 2911414 - protein, 4 aa, Entamoeba invadens
SYTG

SEQ ID NO: 2911415 - protein, 6 aa, Entamoeba invadens
SYTGEN

SEQ ID NO: 2911416 - protein, 13 aa, Entamoeba invadens
SYTGQTLKEVNGP

SEQ ID NO: 2911417 - protein, 4 aa, Entamoeba invadens
SYTK

SEQ ID NO: 2911418 - protein, 7 aa, Entamoeba invadens
SYTKGYS

SEQ ID NO: 2911419 - protein, 13 aa, Entamoeba invadens
SYTKNDRTQFGKT

SEQ ID NO: 2911420 - protein, 8 aa, Entamoeba invadens
SYTKNNSL

SEQ ID NO: 2911421 - protein, 14 aa, Entamoeba invadens
SYTKSGVQIKERET

SEQ ID NO: 2911422 - protein, 4 aa, Entamoeba invadens
SYTL

SEQ ID NO: 2911423 - protein, 7 aa, Entamoeba invadens
SYTLDQK

SEQ ID NO: 2911424 - protein, 5 aa, Entamoeba invadens
SYTND

SEQ ID NO: 2911425 - protein, 9 aa, Entamoeba invadens
SYTNDTEEM

SEQ ID NO: 2911426 - protein, 5 aa, Entamoeba invadens
SYTNK

SEQ ID NO: 2911427 - protein, 12 aa, Entamoeba invadens
SYTNSPNQLWLI

SEQ ID NO: 2911428 - protein, 6 aa, Entamoeba invadens
SYTNVR

SEQ ID NO: 2911429 - protein, 8 aa, Entamoeba invadens
SYTPDASH

SEQ ID NO: 2911430 - protein, 5 aa, Entamoeba invadens
SYTPE

SEQ ID NO: 2911431 - protein, 16 aa, Entamoeba invadens
SYTQKDRNRFGNEIPD

SEQ ID NO: 2911432 - protein, 20 aa, Entamoeba invadens
SYTQNDRKKFGNKIPSSVTS

SEQ ID NO: 2911433 - protein, 7 aa, Entamoeba invadens
SYTQQTL

SEQ ID NO: 2911434 - protein, 4 aa, Entamoeba invadens
SYTS

SEQ ID NO: 2911435 - protein, 8 aa, Entamoeba invadens
SYTSEETI

SEQ ID NO: 2911436 - protein, 5 aa, Entamoeba invadens
SYTSK

SEQ ID NO: 2911437 - protein, 4 aa, Entamoeba invadens
SYTT

SEQ ID NO: 2911438 - protein, 11 aa, Entamoeba invadens
SYVPTTSDPFK

SEQ ID NO: 2911439 - protein, 4 aa, Entamoeba invadens
SYWN

SEQ ID NO: 2911440 - protein, 11 aa, Entamoeba invadens
SYYNTEETDPV

SEQ ID NO: 2911441 - protein, 7 aa, Entamoeba invadens
SYYPNDG

SEQ ID NO: 2911442 - protein, 7 aa, Entamoeba invadens
SYYQETS

SEQ ID NO: 2911443 - protein, 9 aa, Entamoeba invadens
SYYQTNNVK

SEQ ID NO: 2911444 - protein, 4 aa, Entamoeba invadens
SYYR

SEQ ID NO: 2911445 - protein, 6 aa, Entamoeba invadens
SYYRGS

SEQ ID NO: 2911446 - protein, 5 aa, Entamoeba invadens
SYYRN

SEQ ID NO: 2911447 - protein, 22 aa, Entamoeba invadens
SYYRPRTKDSKEEQISNNSVTY

SEQ ID NO: 2911448 - protein, 9 aa, Entamoeba invadens
SYYSSQKHR

SEQ ID NO: 2911449 - protein, 5 aa, Entamoeba invadens
SYYTG

SEQ ID NO: 2911450 - protein, 65 aa, Entamoeba invadens
TAAAKKRKAQRAVDKGDDSKAREKALKEENARLEAEKKKKEEEERKKKEESRKRLKERAAMFNAA

SEQ ID NO: 2911451 - protein, 23 aa, Entamoeba invadens
TAAATKKMEMQSNKEKQKKVQAK

SEQ ID NO: 2911452 - protein, 13 aa, Entamoeba invadens
TAAATTTTTATAC

SEQ ID NO: 2911453 - protein, 21 aa, Entamoeba invadens
TAADQFDRRKKDKRPSQSTQC

SEQ ID NO: 2911454 - protein, 44 aa, Entamoeba invadens
TAADQSDRRKKMEDQSKHSMHKQNADNTDAARKAADSKLQEAND

SEQ ID NO: 2911455 - protein, 9 aa, Entamoeba invadens
TAAEEGELT

SEQ ID NO: 2911456 - protein, 12 aa, Entamoeba invadens
TAAERDKEMCPI

SEQ ID NO: 2911457 - protein, 8 aa, Entamoeba invadens
TAAESGKM

SEQ ID NO: 2911458 - protein, 8 aa, Entamoeba invadens
TAAGEGNI

SEQ ID NO: 2911459 - protein, 4 aa, Entamoeba invadens
TAAM

SEQ ID NO: 2911460 - protein, 4 aa, Entamoeba invadens
TAAN

SEQ ID NO: 2911461 - protein, 7 aa, Entamoeba invadens
TAAPAAE

SEQ ID NO: 2911462 - protein, 14 aa, Entamoeba invadens
TAAPKEQPKPVITE

SEQ ID NO: 2911463 - protein, 8 aa, Entamoeba invadens
TAAPKKNW

SEQ ID NO: 2911464 - protein, 22 aa, Entamoeba invadens
TAAQQDVEKGNRREFQPPPPLQ

SEQ ID NO: 2911465 - protein, 7 aa, Entamoeba invadens
TAAREND

SEQ ID NO: 2911466 - protein, 6 aa, Entamoeba invadens
TAASSA

SEQ ID NO: 2911467 - protein, 21 aa, Entamoeba invadens
TAATDDDVKPCEATINGRQTR

SEQ ID NO: 2911468 - protein, 19 aa, Entamoeba invadens
TAATELRNKDWKEPRPRGA

SEQ ID NO: 2911469 - protein, 12 aa, Entamoeba invadens
TAATKPKNLDYD

SEQ ID NO: 2911470 - protein, 10 aa, Entamoeba invadens
TACNDDEKGS

SEQ ID NO: 2911471 - protein, 9 aa, Entamoeba invadens
TACSVSTGA

SEQ ID NO: 2911472 - protein, 14 aa, Entamoeba invadens
TADAFQSASGSNTN

SEQ ID NO: 2911473 - protein, 9 aa, Entamoeba invadens
TADDQSPEC

SEQ ID NO: 2911474 - protein, 15 aa, Entamoeba invadens
TADDSKDFGEDIPED

SEQ ID NO: 2911475 - protein, 8 aa, Entamoeba invadens
TADDSSYF

SEQ ID NO: 2911476 - protein, 6 aa, Entamoeba invadens
TADEAH

SEQ ID NO: 2911477 - protein, 9 aa, Entamoeba invadens
TADEALTNN

SEQ ID NO: 2911478 - protein, 8 aa, Entamoeba invadens
TADEEPIP

SEQ ID NO: 2911479 - protein, 11 aa, Entamoeba invadens
TADEQGKITQQ

SEQ ID NO: 2911480 - protein, 14 aa, Entamoeba invadens
TADFEKEAENTRQE

SEQ ID NO: 2911481 - protein, 19 aa, Entamoeba invadens
TADGKLQKMNKEKRPDINK

SEQ ID NO: 2911482 - protein, 15 aa, Entamoeba invadens
TADGMKEKQEDAELA

SEQ ID NO: 2911483 - protein, 6 aa, Entamoeba invadens
TADGTQ

SEQ ID NO: 2911484 - protein, 7 aa, Entamoeba invadens
TADGYSP

SEQ ID NO: 2911485 - protein, 7 aa, Entamoeba invadens
TADHSKS

SEQ ID NO: 2911486 - protein, 8 aa, Entamoeba invadens
TADKCEHS

SEQ ID NO: 2911487 - protein, 9 aa, Entamoeba invadens
TADKCEHSE

SEQ ID NO: 2911488 - protein, 7 aa, Entamoeba invadens
TADKNAK

SEQ ID NO: 2911489 - protein, 10 aa, Entamoeba invadens
TADKNATAQD

SEQ ID NO: 2911490 - protein, 19 aa, Entamoeba invadens
TADKPATTTSTPAATTTTP

SEQ ID NO: 2911491 - protein, 17 aa, Entamoeba invadens
TADLTNSEKVTGKRNSG

SEQ ID NO: 2911492 - protein, 8 aa, Entamoeba invadens
TADQEGTH

SEQ ID NO: 2911493 - protein, 14 aa, Entamoeba invadens
TADQSKKGNPMKGT

SEQ ID NO: 2911494 - protein, 27 aa, Entamoeba invadens
TADRENSKQKLLASPKIGDKASSESSS

SEQ ID NO: 2911495 - protein, 13 aa, Entamoeba invadens
TADSTKLKNDDFS

SEQ ID NO: 2911496 - protein, 4 aa, Entamoeba invadens
TADV

SEQ ID NO: 2911497 - protein, 12 aa, Entamoeba invadens
TADVDAEEYSKD

SEQ ID NO: 2911498 - protein, 9 aa, Entamoeba invadens
TAEAESELT

SEQ ID NO: 2911499 - protein, 5 aa, Entamoeba invadens
TAEDA

SEQ ID NO: 2911500 - protein, 5 aa, Entamoeba invadens
TAEDQ

SEQ ID NO: 2911501 - protein, 23 aa, Entamoeba invadens
TAEEDIQIEEEEPNEDKEGDAVK

SEQ ID NO: 2911502 - protein, 7 aa, Entamoeba invadens
TAEEFEG

SEQ ID NO: 2911503 - protein, 17 aa, Entamoeba invadens
TAEEISQGLAEMNTNIN

SEQ ID NO: 2911504 - protein, 10 aa, Entamoeba invadens
TAEERLNAEK

SEQ ID NO: 2911505 - protein, 9 aa, Entamoeba invadens
TAEGANNAI

SEQ ID NO: 2911506 - protein, 6 aa, Entamoeba invadens
TAEGKE

SEQ ID NO: 2911507 - protein, 4 aa, Entamoeba invadens
TAEI

SEQ ID NO: 2911508 - protein, 76 aa, Entamoeba invadens
TAEKKEKENKESKESKEEIKEPPKENQIPQKEEKVIEQKPQEIVPTKPEDTPVVNEDGKTPDEEKEEEKEDEEDDA

SEQ ID NO: 2911509 - protein, 10 aa, Entamoeba invadens
TAEKSKESLE

SEQ ID NO: 2911510 - protein, 4 aa, Entamoeba invadens
TAEN

SEQ ID NO: 2911511 - protein, 5 aa, Entamoeba invadens
TAEPE

SEQ ID NO: 2911512 - protein, 7 aa, Entamoeba invadens
TAEPKAA

SEQ ID NO: 2911513 - protein, 11 aa, Entamoeba invadens
TAEPKDGNVAD

SEQ ID NO: 2911514 - protein, 14 aa, Entamoeba invadens
TAEPTTSPTETELN

SEQ ID NO: 2911515 - protein, 4 aa, Entamoeba invadens
TAEQ

SEQ ID NO: 2911516 - protein, 8 aa, Entamoeba invadens
TAEQRKNV

SEQ ID NO: 2911517 - protein, 10 aa, Entamoeba invadens
TAEQYPEKRN

SEQ ID NO: 2911518 - protein, 8 aa, Entamoeba invadens
TAERQKQI

SEQ ID NO: 2911519 - protein, 23 aa, Entamoeba invadens
TAERTKSLKHAGDDYSKKGKSDL

SEQ ID NO: 2911520 - protein, 14 aa, Entamoeba invadens
TAESQVLDKSSGQK

SEQ ID NO: 2911521 - protein, 4 aa, Entamoeba invadens
TAET

SEQ ID NO: 2911522 - protein, 5 aa, Entamoeba invadens
TAETL

SEQ ID NO: 2911523 - protein, 6 aa, Entamoeba invadens
TAEVSE

SEQ ID NO: 2911524 - protein, 8 aa, Entamoeba invadens
TAEYTTSQ

SEQ ID NO: 2911525 - protein, 11 aa, Entamoeba invadens
TAFDDSSESAI

SEQ ID NO: 2911526 - protein, 16 aa, Entamoeba invadens
TAFDKTQDTNKTETFD

SEQ ID NO: 2911527 - protein, 10 aa, Entamoeba invadens
TAFENNKDTI

SEQ ID NO: 2911528 - protein, 10 aa, Entamoeba invadens
TAFGGDKLDD

SEQ ID NO: 2911529 - protein, 5 aa, Entamoeba invadens
TAFPT

SEQ ID NO: 2911530 - protein, 4 aa, Entamoeba invadens
TAFT

SEQ ID NO: 2911531 - protein, 9 aa, Entamoeba invadens
TAGADEYDK

SEQ ID NO: 2911532 - protein, 6 aa, Entamoeba invadens
TAGDEE

SEQ ID NO: 2911533 - protein, 9 aa, Entamoeba invadens
TAGDGPEKC

SEQ ID NO: 2911534 - protein, 10 aa, Entamoeba invadens
TAGEKEYETC

SEQ ID NO: 2911535 - protein, 5 aa, Entamoeba invadens
TAGFE

SEQ ID NO: 2911536 - protein, 4 aa, Entamoeba invadens
TAGG

SEQ ID NO: 2911537 - protein, 8 aa, Entamoeba invadens
TAGGDGSM

SEQ ID NO: 2911538 - protein, 4 aa, Entamoeba invadens
TAGK

SEQ ID NO: 2911539 - protein, 7 aa, Entamoeba invadens
TAGKTLP

SEQ ID NO: 2911540 - protein, 6 aa, Entamoeba invadens
TAGLER

SEQ ID NO: 2911541 - protein, 9 aa, Entamoeba invadens
TAGPGYEDI

SEQ ID NO: 2911542 - protein, 10 aa, Entamoeba invadens
TAGQDEYKSL

SEQ ID NO: 2911543 - protein, 10 aa, Entamoeba invadens
TAGQDEYNSL

SEQ ID NO: 2911544 - protein, 10 aa, Entamoeba invadens
TAGQDEYSTY

SEQ ID NO: 2911545 - protein, 9 aa, Entamoeba invadens
TAGQEDYDK

SEQ ID NO: 2911546 - protein, 6 aa, Entamoeba invadens
TAGQEE

SEQ ID NO: 2911547 - protein, 8 aa, Entamoeba invadens
TAGQEEFD

SEQ ID NO: 2911548 - protein, 9 aa, Entamoeba invadens
TAGQEEYAG

SEQ ID NO: 2911549 - protein, 8 aa, Entamoeba invadens
TAGQEEYD

SEQ ID NO: 2911550 - protein, 9 aa, Entamoeba invadens
TAGQEEYDK

SEQ ID NO: 2911551 - protein, 9 aa, Entamoeba invadens
TAGQEEYDQ

SEQ ID NO: 2911552 - protein, 9 aa, Entamoeba invadens
TAGQEEYDR

SEQ ID NO: 2911553 - protein, 9 aa, Entamoeba invadens
TAGQEEYNS

SEQ ID NO: 2911554 - protein, 9 aa, Entamoeba invadens
TAGQEEYTQ

SEQ ID NO: 2911555 - protein, 9 aa, Entamoeba invadens
TAGQEEYTS

SEQ ID NO: 2911556 - protein, 7 aa, Entamoeba invadens
TAGQEKF

SEQ ID NO: 2911557 - protein, 11 aa, Entamoeba invadens
TAGQEKFQSVS

SEQ ID NO: 2911558 - protein, 8 aa, Entamoeba invadens
TAGQEKFR

SEQ ID NO: 2911559 - protein, 7 aa, Entamoeba invadens
TAGQEKY

SEQ ID NO: 2911560 - protein, 8 aa, Entamoeba invadens
TAGQEKYH

SEQ ID NO: 2911561 - protein, 8 aa, Entamoeba invadens
TAGQEKYK

SEQ ID NO: 2911562 - protein, 9 aa, Entamoeba invadens
TAGQEKYRA

SEQ ID NO: 2911563 - protein, 9 aa, Entamoeba invadens
TAGQEKYRS

SEQ ID NO: 2911564 - protein, 6 aa, Entamoeba invadens
TAGQER

SEQ ID NO: 2911565 - protein, 8 aa, Entamoeba invadens
TAGQERFR

SEQ ID NO: 2911566 - protein, 8 aa, Entamoeba invadens
TAGQPDYD

SEQ ID NO: 2911567 - protein, 8 aa, Entamoeba invadens
TAGQPNYD

SEQ ID NO: 2911568 - protein, 7 aa, Entamoeba invadens
TAGQSAI

SEQ ID NO: 2911569 - protein, 8 aa, Entamoeba invadens
TAGREEYQ

SEQ ID NO: 2911570 - protein, 9 aa, Entamoeba invadens
TAGSEEYSA

SEQ ID NO: 2911571 - protein, 9 aa, Entamoeba invadens
TAGSEEYST

SEQ ID NO: 2911572 - protein, 7 aa, Entamoeba invadens
TAGSEKF

SEQ ID NO: 2911573 - protein, 9 aa, Entamoeba invadens
TAGSEKFRS

SEQ ID NO: 2911574 - protein, 8 aa, Entamoeba invadens
TAGSEKYQ

SEQ ID NO: 2911575 - protein, 8 aa, Entamoeba invadens
TAGSERFR

SEQ ID NO: 2911576 - protein, 8 aa, Entamoeba invadens
TAGTFRSR

SEQ ID NO: 2911577 - protein, 7 aa, Entamoeba invadens
TAGTPVQ

SEQ ID NO: 2911578 - protein, 17 aa, Entamoeba invadens
TAGVSTKEDGKKYDTTP

SEQ ID NO: 2911579 - protein, 9 aa, Entamoeba invadens
TAGYQTETS

SEQ ID NO: 2911580 - protein, 4 aa, Entamoeba invadens
TAHP

SEQ ID NO: 2911581 - protein, 10 aa, Entamoeba invadens
TAHTNATQKF

SEQ ID NO: 2911582 - protein, 13 aa, Entamoeba invadens
TAIDNQDKQIEQL

SEQ ID NO: 2911583 - protein, 9 aa, Entamoeba invadens
TAIEGGGGD

SEQ ID NO: 2911584 - protein, 6 aa, Entamoeba invadens
TAIGKD

SEQ ID NO: 2911585 - protein, 6 aa, Entamoeba invadens
TAIGSA

SEQ ID NO: 2911586 - protein, 18 aa, Entamoeba invadens
TAITKKRYTRAKNDTESM

SEQ ID NO: 2911587 - protein, 9 aa, Entamoeba invadens
TAKAGDLTG

SEQ ID NO: 2911588 - protein, 10 aa, Entamoeba invadens
TAKAGYKRAG

SEQ ID NO: 2911589 - protein, 5 aa, Entamoeba invadens
TAKAN

SEQ ID NO: 2911590 - protein, 8 aa, Entamoeba invadens
TAKASGQI

SEQ ID NO: 2911591 - protein, 5 aa, Entamoeba invadens
TAKDK

SEQ ID NO: 2911592 - protein, 5 aa, Entamoeba invadens
TAKDN

SEQ ID NO: 2911593 - protein, 5 aa, Entamoeba invadens
TAKDR

SEQ ID NO: 2911594 - protein, 7 aa, Entamoeba invadens
TAKEENS

SEQ ID NO: 2911595 - protein, 6 aa, Entamoeba invadens
TAKELG

SEQ ID NO: 2911596 - protein, 9 aa, Entamoeba invadens
TAKETVKQS

SEQ ID NO: 2911597 - protein, 7 aa, Entamoeba invadens
TAKEVGD

SEQ ID NO: 2911598 - protein, 19 aa, Entamoeba invadens
TAKEYTERYNNDPSVNTGY

SEQ ID NO: 2911599 - protein, 13 aa, Entamoeba invadens
TAKFDSADKPPKC

SEQ ID NO: 2911600 - protein, 10 aa, Entamoeba invadens
TAKGEELKTK

SEQ ID NO: 2911601 - protein, 9 aa, Entamoeba invadens
TAKGSGHTL

SEQ ID NO: 2911602 - protein, 14 aa, Entamoeba invadens
TAKGTEAFATNQIE

SEQ ID NO: 2911603 - protein, 7 aa, Entamoeba invadens
TAKGTGC

SEQ ID NO: 2911604 - protein, 11 aa, Entamoeba invadens
TAKIAATKGYG

SEQ ID NO: 2911605 - protein, 6 aa, Entamoeba invadens
TAKKME

SEQ ID NO: 2911606 - protein, 5 aa, Entamoeba invadens
TAKLE

SEQ ID NO: 2911607 - protein, 5 aa, Entamoeba invadens
TAKLS

SEQ ID NO: 2911608 - protein, 4 aa, Entamoeba invadens
TAKN

SEQ ID NO: 2911609 - protein, 9 aa, Entamoeba invadens
TAKNNTKWD

SEQ ID NO: 2911610 - protein, 8 aa, Entamoeba invadens
TAKPEGIE

SEQ ID NO: 2911611 - protein, 19 aa, Entamoeba invadens
TAKPETNTSEVKPKQEPQI

SEQ ID NO: 2911612 - protein, 7 aa, Entamoeba invadens
TAKPLPG

SEQ ID NO: 2911613 - protein, 6 aa, Entamoeba invadens
TAKPQI

SEQ ID NO: 2911614 - protein, 4 aa, Entamoeba invadens
TAKQ

SEQ ID NO: 2911615 - protein, 5 aa, Entamoeba invadens
TAKRE

SEQ ID NO: 2911616 - protein, 7 aa, Entamoeba invadens
TAKRKSR

SEQ ID NO: 2911617 - protein, 12 aa, Entamoeba invadens
TAKRSGLQEDIL

SEQ ID NO: 2911618 - protein, 5 aa, Entamoeba invadens
TAKSC

SEQ ID NO: 2911619 - protein, 9 aa, Entamoeba invadens
TAKSLQSDS

SEQ ID NO: 2911620 - protein, 8 aa, Entamoeba invadens
TAKSTDVP

SEQ ID NO: 2911621 - protein, 6 aa, Entamoeba invadens
TAKTMK

SEQ ID NO: 2911622 - protein, 8 aa, Entamoeba invadens
TALAGTDS

SEQ ID NO: 2911623 - protein, 10 aa, Entamoeba invadens
TALDKTSDRY

SEQ ID NO: 2911624 - protein, 6 aa, Entamoeba invadens
TALDTS

SEQ ID NO: 2911625 - protein, 4 aa, Entamoeba invadens
TALL

SEQ ID NO: 2911626 - protein, 4 aa, Entamoeba invadens
TALN

SEQ ID NO: 2911627 - protein, 8 aa, Entamoeba invadens
TALNSSHD

SEQ ID NO: 2911628 - protein, 110 aa, Entamoeba invadens
TALPASNASVAKKQEVLPPPGTLAPPPGLAPPGGLAPPPGLEPPGGLAPPPGLAPPGMLPPPAPPGGLAPPGMLPPPGLAPPGGMMPPPGLAPPGGMMPPPGLAPPGGLM

SEQ ID NO: 2911629 - protein, 7 aa, Entamoeba invadens
TALSEKR

SEQ ID NO: 2911630 - protein, 9 aa, Entamoeba invadens
TALSSSTMQ

SEQ ID NO: 2911631 - protein, 12 aa, Entamoeba invadens
TALTESTENFGN

SEQ ID NO: 2911632 - protein, 14 aa, Entamoeba invadens
TALTQRVNQSEIKQ

SEQ ID NO: 2911633 - protein, 5 aa, Entamoeba invadens
TALVG

SEQ ID NO: 2911634 - protein, 4 aa, Entamoeba invadens
TAMA

SEQ ID NO: 2911635 - protein, 4 aa, Entamoeba invadens
TAMG

SEQ ID NO: 2911636 - protein, 5 aa, Entamoeba invadens
TAMGS

SEQ ID NO: 2911637 - protein, 9 aa, Entamoeba invadens
TAMNATKID

SEQ ID NO: 2911638 - protein, 8 aa, Entamoeba invadens
TAMRRSEN

SEQ ID NO: 2911639 - protein, 4 aa, Entamoeba invadens
TAMS

SEQ ID NO: 2911640 - protein, 8 aa, Entamoeba invadens
TANCGGDN

SEQ ID NO: 2911641 - protein, 10 aa, Entamoeba invadens
TANDKQKKGI

SEQ ID NO: 2911642 - protein, 8 aa, Entamoeba invadens
TANDSVAS

SEQ ID NO: 2911643 - protein, 4 aa, Entamoeba invadens
TANK

SEQ ID NO: 2911644 - protein, 6 aa, Entamoeba invadens
TANKED

SEQ ID NO: 2911645 - protein, 14 aa, Entamoeba invadens
TANKYEKKSDAEYS

SEQ ID NO: 2911646 - protein, 11 aa, Entamoeba invadens
TANNKRQSDTI

SEQ ID NO: 2911647 - protein, 6 aa, Entamoeba invadens
TANPDR

SEQ ID NO: 2911648 - protein, 7 aa, Entamoeba invadens
TANRERL

SEQ ID NO: 2911649 - protein, 16 aa, Entamoeba invadens
TANSAIPQNSENDFET

SEQ ID NO: 2911650 - protein, 9 aa, Entamoeba invadens
TAPDGLQSP

SEQ ID NO: 2911651 - protein, 17 aa, Entamoeba invadens
TAPDTTVFPASSTNFTD

SEQ ID NO: 2911652 - protein, 15 aa, Entamoeba invadens
TAPEDFEDLDKTRSV

SEQ ID NO: 2911653 - protein, 5 aa, Entamoeba invadens
TAPEL

SEQ ID NO: 2911654 - protein, 6 aa, Entamoeba invadens
TAPEVR

SEQ ID NO: 2911655 - protein, 5 aa, Entamoeba invadens
TAPFS

SEQ ID NO: 2911656 - protein, 16 aa, Entamoeba invadens
TAPGGSSSYKTIEQEL

SEQ ID NO: 2911657 - protein, 4 aa, Entamoeba invadens
TAPI

SEQ ID NO: 2911658 - protein, 9 aa, Entamoeba invadens
TAPKAEVKN

SEQ ID NO: 2911659 - protein, 11 aa, Entamoeba invadens
TAPKSQSPTSV

SEQ ID NO: 2911660 - protein, 4 aa, Entamoeba invadens
TAPL

SEQ ID NO: 2911661 - protein, 6 aa, Entamoeba invadens
TAPNAE

SEQ ID NO: 2911662 - protein, 6 aa, Entamoeba invadens
TAPPRL

SEQ ID NO: 2911663 - protein, 7 aa, Entamoeba invadens
TAPPTKL

SEQ ID NO: 2911664 - protein, 13 aa, Entamoeba invadens
TAPPVVEVSTTPV

SEQ ID NO: 2911665 - protein, 7 aa, Entamoeba invadens
TAPQQEL

SEQ ID NO: 2911666 - protein, 10 aa, Entamoeba invadens
TAPQTGRPRG

SEQ ID NO: 2911667 - protein, 10 aa, Entamoeba invadens
TAPQTPNPQL

SEQ ID NO: 2911668 - protein, 25 aa, Entamoeba invadens
TAPSSPPLSGTPSKVSRDWNDESTS

SEQ ID NO: 2911669 - protein, 8 aa, Entamoeba invadens
TAPTEEDV

SEQ ID NO: 2911670 - protein, 17 aa, Entamoeba invadens
TAPTGDFPHTPEPIPEN

SEQ ID NO: 2911671 - protein, 6 aa, Entamoeba invadens
TAPTGH

SEQ ID NO: 2911672 - protein, 16 aa, Entamoeba invadens
TAPTIPKTTKPTSKHY

SEQ ID NO: 2911673 - protein, 13 aa, Entamoeba invadens
TAPTLSPDTEIRQ

SEQ ID NO: 2911674 - protein, 7 aa, Entamoeba invadens
TAQAVAT

SEQ ID NO: 2911675 - protein, 8 aa, Entamoeba invadens
TAQEDRKR

SEQ ID NO: 2911676 - protein, 9 aa, Entamoeba invadens
TAQEQGELT

SEQ ID NO: 2911677 - protein, 17 aa, Entamoeba invadens
TAQESSDVQKYSEIESN

SEQ ID NO: 2911678 - protein, 4 aa, Entamoeba invadens
TAQH

SEQ ID NO: 2911679 - protein, 12 aa, Entamoeba invadens
TAQHEEKRHSRC

SEQ ID NO: 2911680 - protein, 28 aa, Entamoeba invadens
TAQKADSQKELEKERAMKQKPDKETQKL

SEQ ID NO: 2911681 - protein, 28 aa, Entamoeba invadens
TAQKADSQKELEKERAMKQKPDKETQRL

SEQ ID NO: 2911682 - protein, 28 aa, Entamoeba invadens
TAQKADSQKELEKERTMKQEADKETQRL

SEQ ID NO: 2911683 - protein, 7 aa, Entamoeba invadens
TAQKAGY

SEQ ID NO: 2911684 - protein, 5 aa, Entamoeba invadens
TAQNG

SEQ ID NO: 2911685 - protein, 11 aa, Entamoeba invadens
TAQNIESEHQS

SEQ ID NO: 2911686 - protein, 5 aa, Entamoeba invadens
TAQNQ

SEQ ID NO: 2911687 - protein, 13 aa, Entamoeba invadens
TAQNQCEKLSKST

SEQ ID NO: 2911688 - protein, 26 aa, Entamoeba invadens
TAQNSLNKNEAKDTSKDAFKNNGRQI

SEQ ID NO: 2911689 - protein, 10 aa, Entamoeba invadens
TAQPGSENSL

SEQ ID NO: 2911690 - protein, 6 aa, Entamoeba invadens
TAQPKR

SEQ ID NO: 2911691 - protein, 9 aa, Entamoeba invadens
TAQPNSRVL

SEQ ID NO: 2911692 - protein, 28 aa, Entamoeba invadens
TAQPSNPVIPSPNPVTTQPPQEVPQPVP

SEQ ID NO: 2911693 - protein, 44 aa, Entamoeba invadens
TAQQAKAQKKSNADKLREVKTNSKELEKERAMKQEADKETQKLR

SEQ ID NO: 2911694 - protein, 23 aa, Entamoeba invadens
TAQQAKTQKKKYADKIVNIIYCQ

SEQ ID NO: 2911695 - protein, 19 aa, Entamoeba invadens
TAQQSQTKLRESEEGQIEL

SEQ ID NO: 2911696 - protein, 9 aa, Entamoeba invadens
TAQQTHPKE

SEQ ID NO: 2911697 - protein, 16 aa, Entamoeba invadens
TAQRCGKGKYRLKGTN

SEQ ID NO: 2911698 - protein, 17 aa, Entamoeba invadens
TAQTAEPLKSPQDNQAV

SEQ ID NO: 2911699 - protein, 11 aa, Entamoeba invadens
TAQTKNSTRLD

SEQ ID NO: 2911700 - protein, 6 aa, Entamoeba invadens
TAQVEG

SEQ ID NO: 2911701 - protein, 13 aa, Entamoeba invadens
TAQYTAVDETHAK

SEQ ID NO: 2911702 - protein, 6 aa, Entamoeba invadens
TARDQD

SEQ ID NO: 2911703 - protein, 9 aa, Entamoeba invadens
TAREHATES

SEQ ID NO: 2911704 - protein, 7 aa, Entamoeba invadens
TAREYET

SEQ ID NO: 2911705 - protein, 4 aa, Entamoeba invadens
TARG

SEQ ID NO: 2911706 - protein, 10 aa, Entamoeba invadens
TARGKESKYD

SEQ ID NO: 2911707 - protein, 7 aa, Entamoeba invadens
TARGTGC

SEQ ID NO: 2911708 - protein, 8 aa, Entamoeba invadens
TARQNTKI

SEQ ID NO: 2911709 - protein, 5 aa, Entamoeba invadens
TARRR

SEQ ID NO: 2911710 - protein, 5 aa, Entamoeba invadens
TARSA

SEQ ID NO: 2911711 - protein, 5 aa, Entamoeba invadens
TARSP

SEQ ID NO: 2911712 - protein, 7 aa, Entamoeba invadens
TASADRT

SEQ ID NO: 2911713 - protein, 5 aa, Entamoeba invadens
TASAM

SEQ ID NO: 2911714 - protein, 5 aa, Entamoeba invadens
TASAP

SEQ ID NO: 2911715 - protein, 9 aa, Entamoeba invadens
TASAPQNPF

SEQ ID NO: 2911716 - protein, 5 aa, Entamoeba invadens
TASCG

SEQ ID NO: 2911717 - protein, 13 aa, Entamoeba invadens
TASEEDFPRKRPS

SEQ ID NO: 2911718 - protein, 6 aa, Entamoeba invadens
TASFSN

SEQ ID NO: 2911719 - protein, 9 aa, Entamoeba invadens
TASGDSFKP

SEQ ID NO: 2911720 - protein, 7 aa, Entamoeba invadens
TASKAEV

SEQ ID NO: 2911721 - protein, 10 aa, Entamoeba invadens
TASKTGDIEL

SEQ ID NO: 2911722 - protein, 13 aa, Entamoeba invadens
TASLEKAKQFTAD

SEQ ID NO: 2911723 - protein, 8 aa, Entamoeba invadens
TASLSSLE

SEQ ID NO: 2911724 - protein, 4 aa, Entamoeba invadens
TASN

SEQ ID NO: 2911725 - protein, 8 aa, Entamoeba invadens
TASNGWPS

SEQ ID NO: 2911726 - protein, 6 aa, Entamoeba invadens
TASNKF

SEQ ID NO: 2911727 - protein, 11 aa, Entamoeba invadens
TASNSRASNMS

SEQ ID NO: 2911728 - protein, 6 aa, Entamoeba invadens
TASPNV

SEQ ID NO: 2911729 - protein, 7 aa, Entamoeba invadens
TASQKAL

SEQ ID NO: 2911730 - protein, 15 aa, Entamoeba invadens
TASQNDKELKHTEER

SEQ ID NO: 2911731 - protein, 6 aa, Entamoeba invadens
TASRGI

SEQ ID NO: 2911732 - protein, 9 aa, Entamoeba invadens
TASRNNHSE

SEQ ID NO: 2911733 - protein, 6 aa, Entamoeba invadens
TASRRY

SEQ ID NO: 2911734 - protein, 11 aa, Entamoeba invadens
TASSDKKWEYQ

SEQ ID NO: 2911735 - protein, 7 aa, Entamoeba invadens
TASSFAE

SEQ ID NO: 2911736 - protein, 13 aa, Entamoeba invadens
TASSFKGYTTTDF

SEQ ID NO: 2911737 - protein, 7 aa, Entamoeba invadens
TASSSNA

SEQ ID NO: 2911738 - protein, 11 aa, Entamoeba invadens
TASSSNTKSVE

SEQ ID NO: 2911739 - protein, 6 aa, Entamoeba invadens
TASTNR

SEQ ID NO: 2911740 - protein, 29 aa, Entamoeba invadens
TASTTQQQTTDSTDTSKKEQVDIQHPEKD

SEQ ID NO: 2911741 - protein, 13 aa, Entamoeba invadens
TASVGGEPTSARE

SEQ ID NO: 2911742 - protein, 6 aa, Entamoeba invadens
TASVSR

SEQ ID NO: 2911743 - protein, 4 aa, Entamoeba invadens
TATC

SEQ ID NO: 2911744 - protein, 13 aa, Entamoeba invadens
TATDQAEKENDVQ

SEQ ID NO: 2911745 - protein, 4 aa, Entamoeba invadens
TATE

SEQ ID NO: 2911746 - protein, 27 aa, Entamoeba invadens
TATECPSGYYKDTATATRKKSKTGSNC

SEQ ID NO: 2911747 - protein, 6 aa, Entamoeba invadens
TATEDM

SEQ ID NO: 2911748 - protein, 10 aa, Entamoeba invadens
TATEEEKGNY

SEQ ID NO: 2911749 - protein, 5 aa, Entamoeba invadens
TATEI

SEQ ID NO: 2911750 - protein, 15 aa, Entamoeba invadens
TATEPIQQPTQQQPA

SEQ ID NO: 2911751 - protein, 13 aa, Entamoeba invadens
TATESVKGGTNLE

SEQ ID NO: 2911752 - protein, 17 aa, Entamoeba invadens
TATIEDKDPQRTHGRKK

SEQ ID NO: 2911753 - protein, 7 aa, Entamoeba invadens
TATIGRG

SEQ ID NO: 2911754 - protein, 4 aa, Entamoeba invadens
TATK

SEQ ID NO: 2911755 - protein, 13 aa, Entamoeba invadens
TATKPPASRNTSA

SEQ ID NO: 2911756 - protein, 26 aa, Entamoeba invadens
TATKPTLKRTRRTRNNKGKKTERALQ

SEQ ID NO: 2911757 - protein, 4 aa, Entamoeba invadens
TATL

SEQ ID NO: 2911758 - protein, 8 aa, Entamoeba invadens
TATLGDEL

SEQ ID NO: 2911759 - protein, 7 aa, Entamoeba invadens
TATNEFS

SEQ ID NO: 2911760 - protein, 13 aa, Entamoeba invadens
TATNRERDAKEKL

SEQ ID NO: 2911761 - protein, 5 aa, Entamoeba invadens
TATNV

SEQ ID NO: 2911762 - protein, 6 aa, Entamoeba invadens
TATPSS

SEQ ID NO: 2911763 - protein, 10 aa, Entamoeba invadens
TATPWDDKTD

SEQ ID NO: 2911764 - protein, 7 aa, Entamoeba invadens
TATQSQL

SEQ ID NO: 2911765 - protein, 8 aa, Entamoeba invadens
TATSFEGR

SEQ ID NO: 2911766 - protein, 15 aa, Entamoeba invadens
TATSKLTTRLDPDEL

SEQ ID NO: 2911767 - protein, 25 aa, Entamoeba invadens
TATSKLTTRLDPDELEEDKKLGEGS

SEQ ID NO: 2911768 - protein, 25 aa, Entamoeba invadens
TATSKLTTRLDPDELKEDKKLGEGS

SEQ ID NO: 2911769 - protein, 15 aa, Entamoeba invadens
TATVGGWPSKFTPER

SEQ ID NO: 2911770 - protein, 4 aa, Entamoeba invadens
TATY

SEQ ID NO: 2911771 - protein, 13 aa, Entamoeba invadens
TAVAHQKSGESGL

SEQ ID NO: 2911772 - protein, 6 aa, Entamoeba invadens
TAVEES

SEQ ID NO: 2911773 - protein, 7 aa, Entamoeba invadens
TAVESGV

SEQ ID NO: 2911774 - protein, 9 aa, Entamoeba invadens
TAVGTGLNA

SEQ ID NO: 2911775 - protein, 12 aa, Entamoeba invadens
TAVGTGLNAEPT

SEQ ID NO: 2911776 - protein, 8 aa, Entamoeba invadens
TAVNNRNR

SEQ ID NO: 2911777 - protein, 4 aa, Entamoeba invadens
TAVQ

SEQ ID NO: 2911778 - protein, 13 aa, Entamoeba invadens
TAVRRKKANIQAE

SEQ ID NO: 2911779 - protein, 4 aa, Entamoeba invadens
TAVS

SEQ ID NO: 2911780 - protein, 6 aa, Entamoeba invadens
TAVSGI

SEQ ID NO: 2911781 - protein, 6 aa, Entamoeba invadens
TAVTDN

SEQ ID NO: 2911782 - protein, 6 aa, Entamoeba invadens
TAYARK

SEQ ID NO: 2911783 - protein, 13 aa, Entamoeba invadens
TAYEMSPKRPLDA

SEQ ID NO: 2911784 - protein, 12 aa, Entamoeba invadens
TAYNGLDDNTHL

SEQ ID NO: 2911785 - protein, 12 aa, Entamoeba invadens
TAYPPDKLNEGG

SEQ ID NO: 2911786 - protein, 28 aa, Entamoeba invadens
TCADTQNELAISGTTERHETNDSELPTQ

SEQ ID NO: 2911787 - protein, 4 aa, Entamoeba invadens
TCAK

SEQ ID NO: 2911788 - protein, 7 aa, Entamoeba invadens
TCAQSNL

SEQ ID NO: 2911789 - protein, 5 aa, Entamoeba invadens
TCATD

SEQ ID NO: 2911790 - protein, 13 aa, Entamoeba invadens
TCDDSSDDDASAY

SEQ ID NO: 2911791 - protein, 8 aa, Entamoeba invadens
TCDEDAKP

SEQ ID NO: 2911792 - protein, 10 aa, Entamoeba invadens
TCDGTSGGVS

SEQ ID NO: 2911793 - protein, 9 aa, Entamoeba invadens
TCDKSGLGT

SEQ ID NO: 2911794 - protein, 11 aa, Entamoeba invadens
TCDTGNDNKPL

SEQ ID NO: 2911795 - protein, 33 aa, Entamoeba invadens
TCEAAKKKSEKARKEAEDAAEEMRKKMEEAEAY

SEQ ID NO: 2911796 - protein, 14 aa, Entamoeba invadens
TCEGSSSNCTSCED

SEQ ID NO: 2911797 - protein, 9 aa, Entamoeba invadens
TCEKTCEKA

SEQ ID NO: 2911798 - protein, 12 aa, Entamoeba invadens
TCENCGNGITTT

SEQ ID NO: 2911799 - protein, 41 aa, Entamoeba invadens
TCETVTPPQTKSPSFKRPSPPPPKQDQIKINEDKAKEEKLK

SEQ ID NO: 2911800 - protein, 4 aa, Entamoeba invadens
TCEY

SEQ ID NO: 2911801 - protein, 12 aa, Entamoeba invadens
TCGGACNPTTGY

SEQ ID NO: 2911802 - protein, 16 aa, Entamoeba invadens
TCGITTDPIYPTGVKY

SEQ ID NO: 2911803 - protein, 13 aa, Entamoeba invadens
TCGNSCSDSTGYC

SEQ ID NO: 2911804 - protein, 14 aa, Entamoeba invadens
TCGRRSSMQDNDLT

SEQ ID NO: 2911805 - protein, 17 aa, Entamoeba invadens
TCGTTQKGFEEFKESTK

SEQ ID NO: 2911806 - protein, 4 aa, Entamoeba invadens
TCGV

SEQ ID NO: 2911807 - protein, 12 aa, Entamoeba invadens
TCKANTCNSTTG

SEQ ID NO: 2911808 - protein, 5 aa, Entamoeba invadens
TCKEE

SEQ ID NO: 2911809 - protein, 6 aa, Entamoeba invadens
TCKEEL

SEQ ID NO: 2911810 - protein, 9 aa, Entamoeba invadens
TCKENGERK

SEQ ID NO: 2911811 - protein, 6 aa, Entamoeba invadens
TCKITQ

SEQ ID NO: 2911812 - protein, 18 aa, Entamoeba invadens
TCKTFESGKDFRKEHEKC

SEQ ID NO: 2911813 - protein, 6 aa, Entamoeba invadens
TCLNAT

SEQ ID NO: 2911814 - protein, 5 aa, Entamoeba invadens
TCNET

SEQ ID NO: 2911815 - protein, 14 aa, Entamoeba invadens
TCNGKCDQTTGKCN

SEQ ID NO: 2911816 - protein, 9 aa, Entamoeba invadens
TCNGPEPNN

SEQ ID NO: 2911817 - protein, 11 aa, Entamoeba invadens
TCNGPKESDPL

SEQ ID NO: 2911818 - protein, 7 aa, Entamoeba invadens
TCNNTNN

SEQ ID NO: 2911819 - protein, 6 aa, Entamoeba invadens
TCNSVN

SEQ ID NO: 2911820 - protein, 6 aa, Entamoeba invadens
TCNTKE

SEQ ID NO: 2911821 - protein, 6 aa, Entamoeba invadens
TCNTKN

SEQ ID NO: 2911822 - protein, 9 aa, Entamoeba invadens
TCPGNGPVS

SEQ ID NO: 2911823 - protein, 7 aa, Entamoeba invadens
TCPNPKG

SEQ ID NO: 2911824 - protein, 6 aa, Entamoeba invadens
TCPNPR

SEQ ID NO: 2911825 - protein, 6 aa, Entamoeba invadens
TCPPPL

SEQ ID NO: 2911826 - protein, 19 aa, Entamoeba invadens
TCPSEFPDYNAKTSARSVV

SEQ ID NO: 2911827 - protein, 19 aa, Entamoeba invadens
TCQDAFESTTKLETKTVQK

SEQ ID NO: 2911828 - protein, 11 aa, Entamoeba invadens
TCQQNECNTAN

SEQ ID NO: 2911829 - protein, 11 aa, Entamoeba invadens
TCQQNKCNTAN

SEQ ID NO: 2911830 - protein, 18 aa, Entamoeba invadens
TCQSCSSTLSSCEECAST

SEQ ID NO: 2911831 - protein, 14 aa, Entamoeba invadens
TCQSGYKQIEDKTN

SEQ ID NO: 2911832 - protein, 8 aa, Entamoeba invadens
TCRDKPPF

SEQ ID NO: 2911833 - protein, 7 aa, Entamoeba invadens
TCRGNGL

SEQ ID NO: 2911834 - protein, 11 aa, Entamoeba invadens
TCRKGDNCNYS

SEQ ID NO: 2911835 - protein, 6 aa, Entamoeba invadens
TCRKGE

SEQ ID NO: 2911836 - protein, 6 aa, Entamoeba invadens
TCRKGK

SEQ ID NO: 2911837 - protein, 11 aa, Entamoeba invadens
TCRNKKSKFKN

SEQ ID NO: 2911838 - protein, 4 aa, Entamoeba invadens
TCRQ

SEQ ID NO: 2911839 - protein, 19 aa, Entamoeba invadens
TCRQSQDKNSVEVVEGSEE

SEQ ID NO: 2911840 - protein, 4 aa, Entamoeba invadens
TCSA

SEQ ID NO: 2911841 - protein, 18 aa, Entamoeba invadens
TCSANGYSSPNVNEKPHI

SEQ ID NO: 2911842 - protein, 7 aa, Entamoeba invadens
TCSDNNT

SEQ ID NO: 2911843 - protein, 7 aa, Entamoeba invadens
TCSESGS

SEQ ID NO: 2911844 - protein, 13 aa, Entamoeba invadens
TCSGFGGSQVTAR

SEQ ID NO: 2911845 - protein, 19 aa, Entamoeba invadens
TCSKCDDTCGGTCEDTTGY

SEQ ID NO: 2911846 - protein, 16 aa, Entamoeba invadens
TCSKSSSQCTSCEDGD

SEQ ID NO: 2911847 - protein, 20 aa, Entamoeba invadens
TCSKTCGDNYGAIKDTTPNW

SEQ ID NO: 2911848 - protein, 6 aa, Entamoeba invadens
TCSNDG

SEQ ID NO: 2911849 - protein, 11 aa, Entamoeba invadens
TCSNDNAEQIA

SEQ ID NO: 2911850 - protein, 6 aa, Entamoeba invadens
TCSPDF

SEQ ID NO: 2911851 - protein, 13 aa, Entamoeba invadens
TCSPEKKEENVQS

SEQ ID NO: 2911852 - protein, 7 aa, Entamoeba invadens
TCSPTYE

SEQ ID NO: 2911853 - protein, 7 aa, Entamoeba invadens
TCSQCDS

SEQ ID NO: 2911854 - protein, 7 aa, Entamoeba invadens
TCSQTEK

SEQ ID NO: 2911855 - protein, 11 aa, Entamoeba invadens
TCSSATGKCSA

SEQ ID NO: 2911856 - protein, 6 aa, Entamoeba invadens
TCSSDF

SEQ ID NO: 2911857 - protein, 9 aa, Entamoeba invadens
TCSSPQGIS

SEQ ID NO: 2911858 - protein, 14 aa, Entamoeba invadens
TCSSPQGTSTDITH

SEQ ID NO: 2911859 - protein, 8 aa, Entamoeba invadens
TCSSTDRK

SEQ ID NO: 2911860 - protein, 8 aa, Entamoeba invadens
TCSTPSEY

SEQ ID NO: 2911861 - protein, 5 aa, Entamoeba invadens
TCSTQ

SEQ ID NO: 2911862 - protein, 18 aa, Entamoeba invadens
TCTAIPQATTSSGLMILF

SEQ ID NO: 2911863 - protein, 31 aa, Entamoeba invadens
TCTDATKCTECTTDNLKPDNTCKAKIPEGYY

SEQ ID NO: 2911864 - protein, 13 aa, Entamoeba invadens
TCTEETKCTACKD

SEQ ID NO: 2911865 - protein, 4 aa, Entamoeba invadens
TCTM

SEQ ID NO: 2911866 - protein, 10 aa, Entamoeba invadens
TCTNGTNCQY

SEQ ID NO: 2911867 - protein, 11 aa, Entamoeba invadens
TCTNKAGDIGD

SEQ ID NO: 2911868 - protein, 14 aa, Entamoeba invadens
TCTTGKYPSPSSPF

SEQ ID NO: 2911869 - protein, 8 aa, Entamoeba invadens
TCTTTRIS

SEQ ID NO: 2911870 - protein, 4 aa, Entamoeba invadens
TDAA

SEQ ID NO: 2911871 - protein, 9 aa, Entamoeba invadens
TDAASSTHI

SEQ ID NO: 2911872 - protein, 4 aa, Entamoeba invadens
TDAD

SEQ ID NO: 2911873 - protein, 5 aa, Entamoeba invadens
TDADV

SEQ ID NO: 2911874 - protein, 5 aa, Entamoeba invadens
TDAEI

SEQ ID NO: 2911875 - protein, 6 aa, Entamoeba invadens
TDAEKA

SEQ ID NO: 2911876 - protein, 13 aa, Entamoeba invadens
TDAEMARAILVSL

SEQ ID NO: 2911877 - protein, 8 aa, Entamoeba invadens
TDAENNSC

SEQ ID NO: 2911878 - protein, 14 aa, Entamoeba invadens
TDAERLKGISEEAK

SEQ ID NO: 2911879 - protein, 13 aa, Entamoeba invadens
TDAGTTKSQPNSP

SEQ ID NO: 2911880 - protein, 9 aa, Entamoeba invadens
TDAHQKGDL

SEQ ID NO: 2911881 - protein, 29 aa, Entamoeba invadens
TDAINEHEEKLRRTKKEFESQMKQTQLEN

SEQ ID NO: 2911882 - protein, 5 aa, Entamoeba invadens
TDAKT

SEQ ID NO: 2911883 - protein, 4 aa, Entamoeba invadens
TDAL

SEQ ID NO: 2911884 - protein, 5 aa, Entamoeba invadens
TDAND

SEQ ID NO: 2911885 - protein, 6 aa, Entamoeba invadens
TDASGT

SEQ ID NO: 2911886 - protein, 10 aa, Entamoeba invadens
TDASNYTPKK

SEQ ID NO: 2911887 - protein, 9 aa, Entamoeba invadens
TDASSSRQI

SEQ ID NO: 2911888 - protein, 11 aa, Entamoeba invadens
TDATKLQNPFY

SEQ ID NO: 2911889 - protein, 19 aa, Entamoeba invadens
TDATLTDRRRFDEKTQTKM

SEQ ID NO: 2911890 - protein, 7 aa, Entamoeba invadens
TDAYGNS

SEQ ID NO: 2911891 - protein, 4 aa, Entamoeba invadens
TDCN

SEQ ID NO: 2911892 - protein, 15 aa, Entamoeba invadens
TDCSDQPRGKQIQTP

SEQ ID NO: 2911893 - protein, 6 aa, Entamoeba invadens
TDCSNG

SEQ ID NO: 2911894 - protein, 18 aa, Entamoeba invadens
TDCSSNLDKHSSKISSNL

SEQ ID NO: 2911895 - protein, 6 aa, Entamoeba invadens
TDCSTR

SEQ ID NO: 2911896 - protein, 7 aa, Entamoeba invadens
TDDADQN

SEQ ID NO: 2911897 - protein, 8 aa, Entamoeba invadens
TDDANLSE

SEQ ID NO: 2911898 - protein, 6 aa, Entamoeba invadens
TDDDGE

SEQ ID NO: 2911899 - protein, 9 aa, Entamoeba invadens
TDDDKTYTI

SEQ ID NO: 2911900 - protein, 9 aa, Entamoeba invadens
TDDDPETKI

SEQ ID NO: 2911901 - protein, 16 aa, Entamoeba invadens
TDDEERTRVVDGDKHN

SEQ ID NO: 2911902 - protein, 5 aa, Entamoeba invadens
TDDEF

SEQ ID NO: 2911903 - protein, 22 aa, Entamoeba invadens
TDDENFDDEDSELDSTQKYFEL

SEQ ID NO: 2911904 - protein, 8 aa, Entamoeba invadens
TDDESRTY

SEQ ID NO: 2911905 - protein, 6 aa, Entamoeba invadens
TDDFGQ

SEQ ID NO: 2911906 - protein, 6 aa, Entamoeba invadens
TDDHPQ

SEQ ID NO: 2911907 - protein, 9 aa, Entamoeba invadens
TDDIDKATT

SEQ ID NO: 2911908 - protein, 7 aa, Entamoeba invadens
TDDIPQT

SEQ ID NO: 2911909 - protein, 21 aa, Entamoeba invadens
TDDIQLDSPDEHVRTKSIDTV

SEQ ID NO: 2911910 - protein, 10 aa, Entamoeba invadens
TDDKEGELEL

SEQ ID NO: 2911911 - protein, 12 aa, Entamoeba invadens
TDDKEYQTNTAG

SEQ ID NO: 2911912 - protein, 7 aa, Entamoeba invadens
TDDKPFQ

SEQ ID NO: 2911913 - protein, 13 aa, Entamoeba invadens
TDDKTEEEKRKQH

SEQ ID NO: 2911914 - protein, 9 aa, Entamoeba invadens
TDDLENPDL

SEQ ID NO: 2911915 - protein, 6 aa, Entamoeba invadens
TDDLPG

SEQ ID NO: 2911916 - protein, 6 aa, Entamoeba invadens
TDDNGI

SEQ ID NO: 2911917 - protein, 9 aa, Entamoeba invadens
TDDNKPSEL

SEQ ID NO: 2911918 - protein, 7 aa, Entamoeba invadens
TDDNPKT

SEQ ID NO: 2911919 - protein, 7 aa, Entamoeba invadens
TDDNQQN

SEQ ID NO: 2911920 - protein, 6 aa, Entamoeba invadens
TDDNTP

SEQ ID NO: 2911921 - protein, 4 aa, Entamoeba invadens
TDDQ

SEQ ID NO: 2911922 - protein, 20 aa, Entamoeba invadens
TDDQAEKCQASAEKRTAEEI

SEQ ID NO: 2911923 - protein, 8 aa, Entamoeba invadens
TDDQQKKR

SEQ ID NO: 2911924 - protein, 5 aa, Entamoeba invadens
TDDQV

SEQ ID NO: 2911925 - protein, 10 aa, Entamoeba invadens
TDDRRRPDYN

SEQ ID NO: 2911926 - protein, 8 aa, Entamoeba invadens
TDDRTESF

SEQ ID NO: 2911927 - protein, 9 aa, Entamoeba invadens
TDDSGYLER

SEQ ID NO: 2911928 - protein, 9 aa, Entamoeba invadens
TDDSPRRRI

SEQ ID NO: 2911929 - protein, 5 aa, Entamoeba invadens
TDDTD

SEQ ID NO: 2911930 - protein, 6 aa, Entamoeba invadens
TDDTDQ

SEQ ID NO: 2911931 - protein, 4 aa, Entamoeba invadens
TDDV

SEQ ID NO: 2911932 - protein, 8 aa, Entamoeba invadens
TDDVEKER

SEQ ID NO: 2911933 - protein, 4 aa, Entamoeba invadens
TDEA

SEQ ID NO: 2911934 - protein, 4 aa, Entamoeba invadens
TDEC

SEQ ID NO: 2911935 - protein, 12 aa, Entamoeba invadens
TDEDEKSDNETL

SEQ ID NO: 2911936 - protein, 13 aa, Entamoeba invadens
TDEDGSNGFPGTV

SEQ ID NO: 2911937 - protein, 7 aa, Entamoeba invadens
TDEDMTL

SEQ ID NO: 2911938 - protein, 7 aa, Entamoeba invadens
TDEEKQA

SEQ ID NO: 2911939 - protein, 7 aa, Entamoeba invadens
TDEEPGL

SEQ ID NO: 2911940 - protein, 21 aa, Entamoeba invadens
TDEEQTDKKVETTTPTNIDEE

SEQ ID NO: 2911941 - protein, 4 aa, Entamoeba invadens
TDEG

SEQ ID NO: 2911942 - protein, 9 aa, Entamoeba invadens
TDEGGVRIP

SEQ ID NO: 2911943 - protein, 7 aa, Entamoeba invadens
TDEGGVT

SEQ ID NO: 2911944 - protein, 7 aa, Entamoeba invadens
TDEGKDV

SEQ ID NO: 2911945 - protein, 11 aa, Entamoeba invadens
TDEICSDSDDI

SEQ ID NO: 2911946 - protein, 4 aa, Entamoeba invadens
TDEK

SEQ ID NO: 2911947 - protein, 19 aa, Entamoeba invadens
TDEKALAKQRKDKKSTSVT

SEQ ID NO: 2911948 - protein, 8 aa, Entamoeba invadens
TDEKKQCG

SEQ ID NO: 2911949 - protein, 6 aa, Entamoeba invadens
TDEKTI

SEQ ID NO: 2911950 - protein, 7 aa, Entamoeba invadens
TDEKYKD

SEQ ID NO: 2911951 - protein, 4 aa, Entamoeba invadens
TDEL

SEQ ID NO: 2911952 - protein, 7 aa, Entamoeba invadens
TDEMESN

SEQ ID NO: 2911953 - protein, 4 aa, Entamoeba invadens
TDEN

SEQ ID NO: 2911954 - protein, 5 aa, Entamoeba invadens
TDENG

SEQ ID NO: 2911955 - protein, 10 aa, Entamoeba invadens
TDENGKTEIT

SEQ ID NO: 2911956 - protein, 10 aa, Entamoeba invadens
TDENGQLGQT

SEQ ID NO: 2911957 - protein, 9 aa, Entamoeba invadens
TDENPSNSF

SEQ ID NO: 2911958 - protein, 7 aa, Entamoeba invadens
TDEPEEQ

SEQ ID NO: 2911959 - protein, 7 aa, Entamoeba invadens
TDEPGQQ

SEQ ID NO: 2911960 - protein, 16 aa, Entamoeba invadens
TDEPPKYKITSDETMQ

SEQ ID NO: 2911961 - protein, 7 aa, Entamoeba invadens
TDEPQKL

SEQ ID NO: 2911962 - protein, 6 aa, Entamoeba invadens
TDEPTV

SEQ ID NO: 2911963 - protein, 10 aa, Entamoeba invadens
TDEQADGTGV

SEQ ID NO: 2911964 - protein, 4 aa, Entamoeba invadens
TDER

SEQ ID NO: 2911965 - protein, 5 aa, Entamoeba invadens
TDERA

SEQ ID NO: 2911966 - protein, 8 aa, Entamoeba invadens
TDERFGND

SEQ ID NO: 2911967 - protein, 7 aa, Entamoeba invadens
TDESNDI

SEQ ID NO: 2911968 - protein, 6 aa, Entamoeba invadens
TDETFG

SEQ ID NO: 2911969 - protein, 8 aa, Entamoeba invadens
TDETFGNR

SEQ ID NO: 2911970 - protein, 10 aa, Entamoeba invadens
TDETPQTDNI

SEQ ID NO: 2911971 - protein, 9 aa, Entamoeba invadens
TDETSDGCQ

SEQ ID NO: 2911972 - protein, 18 aa, Entamoeba invadens
TDETTLKESTEKTKCELT

SEQ ID NO: 2911973 - protein, 5 aa, Entamoeba invadens
TDEVD

SEQ ID NO: 2911974 - protein, 7 aa, Entamoeba invadens
TDEVNGK

SEQ ID NO: 2911975 - protein, 13 aa, Entamoeba invadens
TDEVNYKKTQIRQ

SEQ ID NO: 2911976 - protein, 6 aa, Entamoeba invadens
TDEVTE

SEQ ID NO: 2911977 - protein, 4 aa, Entamoeba invadens
TDEY

SEQ ID NO: 2911978 - protein, 17 aa, Entamoeba invadens
TDEYEQAPKYDIKDKTF

SEQ ID NO: 2911979 - protein, 10 aa, Entamoeba invadens
TDEYETTKGI

SEQ ID NO: 2911980 - protein, 14 aa, Entamoeba invadens
TDEYKANRVLLLQL

SEQ ID NO: 2911981 - protein, 4 aa, Entamoeba invadens
TDFG

SEQ ID NO: 2911982 - protein, 6 aa, Entamoeba invadens
TDFGAS

SEQ ID NO: 2911983 - protein, 5 aa, Entamoeba invadens
TDFGQ

SEQ ID NO: 2911984 - protein, 6 aa, Entamoeba invadens
TDFGSA

SEQ ID NO: 2911985 - protein, 9 aa, Entamoeba invadens
TDFGSARNT

SEQ ID NO: 2911986 - protein, 7 aa, Entamoeba invadens
TDFPKEE

SEQ ID NO: 2911987 - protein, 10 aa, Entamoeba invadens
TDFPQEVSDE

SEQ ID NO: 2911988 - protein, 6 aa, Entamoeba invadens
TDFPTK

SEQ ID NO: 2911989 - protein, 9 aa, Entamoeba invadens
TDFQTNEEL

SEQ ID NO: 2911990 - protein, 7 aa, Entamoeba invadens
TDFSGRT

SEQ ID NO: 2911991 - protein, 5 aa, Entamoeba invadens
TDFTR

SEQ ID NO: 2911992 - protein, 15 aa, Entamoeba invadens
TDFTSRYSTTSKDGF

SEQ ID NO: 2911993 - protein, 8 aa, Entamoeba invadens
TDGCGTQR

SEQ ID NO: 2911994 - protein, 6 aa, Entamoeba invadens
TDGDRK

SEQ ID NO: 2911995 - protein, 9 aa, Entamoeba invadens
TDGDVTPVG

SEQ ID NO: 2911996 - protein, 9 aa, Entamoeba invadens
TDGEEPTRE

SEQ ID NO: 2911997 - protein, 6 aa, Entamoeba invadens
TDGENA

SEQ ID NO: 2911998 - protein, 7 aa, Entamoeba invadens
TDGFEGD

SEQ ID NO: 2911999 - protein, 9 aa, Entamoeba invadens
TDGFSSEAL

SEQ ID NO: 2912000 - protein, 11 aa, Entamoeba invadens
TDGGKKKKEEI

SEQ ID NO: 2912001 - protein, 6 aa, Entamoeba invadens
TDGGNV

SEQ ID NO: 2912002 - protein, 8 aa, Entamoeba invadens
TDGMSDNI

SEQ ID NO: 2912003 - protein, 13 aa, Entamoeba invadens
TDGNKTITSDSTV

SEQ ID NO: 2912004 - protein, 5 aa, Entamoeba invadens
TDGNV

SEQ ID NO: 2912005 - protein, 7 aa, Entamoeba invadens
TDGNVEV

SEQ ID NO: 2912006 - protein, 9 aa, Entamoeba invadens
TDGRINESD

SEQ ID NO: 2912007 - protein, 15 aa, Entamoeba invadens
TDGSFYGGETEQEID

SEQ ID NO: 2912008 - protein, 11 aa, Entamoeba invadens
TDGSKVISTTS

SEQ ID NO: 2912009 - protein, 8 aa, Entamoeba invadens
TDGSPESL

SEQ ID NO: 2912010 - protein, 9 aa, Entamoeba invadens
TDGSSGRGS

SEQ ID NO: 2912011 - protein, 26 aa, Entamoeba invadens
TDGSSSSQDEESSCSMKNEEVPPPKQ

SEQ ID NO: 2912012 - protein, 4 aa, Entamoeba invadens
TDGT

SEQ ID NO: 2912013 - protein, 9 aa, Entamoeba invadens
TDGTQWTTE

SEQ ID NO: 2912014 - protein, 9 aa, Entamoeba invadens
TDGVAGRGG

SEQ ID NO: 2912015 - protein, 6 aa, Entamoeba invadens
TDGVNS

SEQ ID NO: 2912016 - protein, 9 aa, Entamoeba invadens
TDGYDTKQF

SEQ ID NO: 2912017 - protein, 10 aa, Entamoeba invadens
TDHMREDNTW

SEQ ID NO: 2912018 - protein, 8 aa, Entamoeba invadens
TDHNDSIS

SEQ ID NO: 2912019 - protein, 5 aa, Entamoeba invadens
TDHPL

SEQ ID NO: 2912020 - protein, 6 aa, Entamoeba invadens
TDHPNR

SEQ ID NO: 2912021 - protein, 7 aa, Entamoeba invadens
TDHPPLA

SEQ ID NO: 2912022 - protein, 6 aa, Entamoeba invadens
TDHSPL

SEQ ID NO: 2912023 - protein, 8 aa, Entamoeba invadens
TDIANDTS

SEQ ID NO: 2912024 - protein, 14 aa, Entamoeba invadens
TDIEKRDEKAPPDI

SEQ ID NO: 2912025 - protein, 6 aa, Entamoeba invadens
TDIITQ

SEQ ID NO: 2912026 - protein, 21 aa, Entamoeba invadens
TDIKESKKKEKKCEKLHRQNS

SEQ ID NO: 2912027 - protein, 9 aa, Entamoeba invadens
TDIKTPDIN

SEQ ID NO: 2912028 - protein, 6 aa, Entamoeba invadens
TDINGE

SEQ ID NO: 2912029 - protein, 7 aa, Entamoeba invadens
TDINNDG

SEQ ID NO: 2912030 - protein, 8 aa, Entamoeba invadens
TDIPNPLS

SEQ ID NO: 2912031 - protein, 6 aa, Entamoeba invadens
TDIQQE

SEQ ID NO: 2912032 - protein, 5 aa, Entamoeba invadens
TDIQT

SEQ ID NO: 2912033 - protein, 9 aa, Entamoeba invadens
TDITNENEY

SEQ ID NO: 2912034 - protein, 7 aa, Entamoeba invadens
TDKAQSE

SEQ ID NO: 2912035 - protein, 7 aa, Entamoeba invadens
TDKASEV

SEQ ID NO: 2912036 - protein, 9 aa, Entamoeba invadens
TDKASYYPQ

SEQ ID NO: 2912037 - protein, 9 aa, Entamoeba invadens
TDKDDGRQF

SEQ ID NO: 2912038 - protein, 10 aa, Entamoeba invadens
TDKDGKISSE

SEQ ID NO: 2912039 - protein, 7 aa, Entamoeba invadens
TDKDGWD

SEQ ID NO: 2912040 - protein, 6 aa, Entamoeba invadens
TDKDLT

SEQ ID NO: 2912041 - protein, 18 aa, Entamoeba invadens
TDKDPYDKFRKCGLSSGS

SEQ ID NO: 2912042 - protein, 7 aa, Entamoeba invadens
TDKERLS

SEQ ID NO: 2912043 - protein, 11 aa, Entamoeba invadens
TDKERLSDAKT

SEQ ID NO: 2912044 - protein, 24 aa, Entamoeba invadens
TDKESQKEILEENGALEKDEKYSE

SEQ ID NO: 2912045 - protein, 11 aa, Entamoeba invadens
TDKFSKSDVGN

SEQ ID NO: 2912046 - protein, 5 aa, Entamoeba invadens
TDKHK

SEQ ID NO: 2912047 - protein, 13 aa, Entamoeba invadens
TDKHPTTSVTCKK

SEQ ID NO: 2912048 - protein, 10 aa, Entamoeba invadens
TDKKHVKTET

SEQ ID NO: 2912049 - protein, 21 aa, Entamoeba invadens
TDKKKKRIISGTSSGLSQGQK

SEQ ID NO: 2912050 - protein, 9 aa, Entamoeba invadens
TDKKNNRYF

SEQ ID NO: 2912051 - protein, 11 aa, Entamoeba invadens
TDKKRSREELN

SEQ ID NO: 2912052 - protein, 5 aa, Entamoeba invadens
TDKKT

SEQ ID NO: 2912053 - protein, 12 aa, Entamoeba invadens
TDKLPGLEALGL

SEQ ID NO: 2912054 - protein, 5 aa, Entamoeba invadens
TDKNI

SEQ ID NO: 2912055 - protein, 8 aa, Entamoeba invadens
TDKNITPT

SEQ ID NO: 2912056 - protein, 9 aa, Entamoeba invadens
TDKNVDGVD

SEQ ID NO: 2912057 - protein, 6 aa, Entamoeba invadens
TDKPPK

SEQ ID NO: 2912058 - protein, 4 aa, Entamoeba invadens
TDKQ

SEQ ID NO: 2912059 - protein, 10 aa, Entamoeba invadens
TDKQDYADAS

SEQ ID NO: 2912060 - protein, 7 aa, Entamoeba invadens
TDKQSFN

SEQ ID NO: 2912061 - protein, 12 aa, Entamoeba invadens
TDKRNTHNNPKI

SEQ ID NO: 2912062 - protein, 10 aa, Entamoeba invadens
TDKRNTHYNP

SEQ ID NO: 2912063 - protein, 10 aa, Entamoeba invadens
TDKRPDIDNG

SEQ ID NO: 2912064 - protein, 8 aa, Entamoeba invadens
TDKRTTSF

SEQ ID NO: 2912065 - protein, 9 aa, Entamoeba invadens
TDKRYNDGY

SEQ ID NO: 2912066 - protein, 7 aa, Entamoeba invadens
TDKSANE

SEQ ID NO: 2912067 - protein, 11 aa, Entamoeba invadens
TDKSDNNTQGL

SEQ ID NO: 2912068 - protein, 9 aa, Entamoeba invadens
TDKSQEITS

SEQ ID NO: 2912069 - protein, 8 aa, Entamoeba invadens
TDKTAEEL

SEQ ID NO: 2912070 - protein, 5 aa, Entamoeba invadens
TDKTK

SEQ ID NO: 2912071 - protein, 6 aa, Entamoeba invadens
TDKTKS

SEQ ID NO: 2912072 - protein, 8 aa, Entamoeba invadens
TDKTNKNV

SEQ ID NO: 2912073 - protein, 11 aa, Entamoeba invadens
TDKTNLKNPLK

SEQ ID NO: 2912074 - protein, 40 aa, Entamoeba invadens
TDKTQSGKGGYVRQASAPPKTENLRYGKEAKENKENKGND

SEQ ID NO: 2912075 - protein, 9 aa, Entamoeba invadens
TDKTSNLST

SEQ ID NO: 2912076 - protein, 9 aa, Entamoeba invadens
TDKTTFSEA

SEQ ID NO: 2912077 - protein, 16 aa, Entamoeba invadens
TDKYSSTESNIFQTTD

SEQ ID NO: 2912078 - protein, 13 aa, Entamoeba invadens
TDLDNQANDIEKK

SEQ ID NO: 2912079 - protein, 10 aa, Entamoeba invadens
TDLEGENDDL

SEQ ID NO: 2912080 - protein, 10 aa, Entamoeba invadens
TDLEGENDEL

SEQ ID NO: 2912081 - protein, 6 aa, Entamoeba invadens
TDLGDK

SEQ ID NO: 2912082 - protein, 10 aa, Entamoeba invadens
TDLGKTGYSV

SEQ ID NO: 2912083 - protein, 13 aa, Entamoeba invadens
TDLGRTKAELDQL

SEQ ID NO: 2912084 - protein, 13 aa, Entamoeba invadens
TDLKEISSKTGIT

SEQ ID NO: 2912085 - protein, 12 aa, Entamoeba invadens
TDLNEADIPSER

SEQ ID NO: 2912086 - protein, 9 aa, Entamoeba invadens
TDLPRTGNS

SEQ ID NO: 2912087 - protein, 5 aa, Entamoeba invadens
TDLQA

SEQ ID NO: 2912088 - protein, 9 aa, Entamoeba invadens
TDLQPKDID

SEQ ID NO: 2912089 - protein, 5 aa, Entamoeba invadens
TDLQR

SEQ ID NO: 2912090 - protein, 9 aa, Entamoeba invadens
TDLRNGNPR

SEQ ID NO: 2912091 - protein, 8 aa, Entamoeba invadens
TDLRTNPD

SEQ ID NO: 2912092 - protein, 4 aa, Entamoeba invadens
TDLS

SEQ ID NO: 2912093 - protein, 9 aa, Entamoeba invadens
TDLSKEDLE

SEQ ID NO: 2912094 - protein, 13 aa, Entamoeba invadens
TDLSPTGKKEFGN

SEQ ID NO: 2912095 - protein, 8 aa, Entamoeba invadens
TDLSTNDN

SEQ ID NO: 2912096 - protein, 6 aa, Entamoeba invadens
TDLTTE

SEQ ID NO: 2912097 - protein, 9 aa, Entamoeba invadens
TDMDTGANS

SEQ ID NO: 2912098 - protein, 5 aa, Entamoeba invadens
TDMKP

SEQ ID NO: 2912099 - protein, 8 aa, Entamoeba invadens
TDMSSNEC

SEQ ID NO: 2912100 - protein, 4 aa, Entamoeba invadens
TDND

SEQ ID NO: 2912101 - protein, 9 aa, Entamoeba invadens
TDNDETHSC

SEQ ID NO: 2912102 - protein, 10 aa, Entamoeba invadens
TDNDGKVPTN

SEQ ID NO: 2912103 - protein, 9 aa, Entamoeba invadens
TDNDKEMES

SEQ ID NO: 2912104 - protein, 18 aa, Entamoeba invadens
TDNDKNKYGNNLPPNVTS

SEQ ID NO: 2912105 - protein, 7 aa, Entamoeba invadens
TDNDRSI

SEQ ID NO: 2912106 - protein, 4 aa, Entamoeba invadens
TDNE

SEQ ID NO: 2912107 - protein, 8 aa, Entamoeba invadens
TDNEEELS

SEQ ID NO: 2912108 - protein, 7 aa, Entamoeba invadens
TDNEEVK

SEQ ID NO: 2912109 - protein, 4 aa, Entamoeba invadens
TDNG

SEQ ID NO: 2912110 - protein, 11 aa, Entamoeba invadens
TDNGEAIGTKY

SEQ ID NO: 2912111 - protein, 5 aa, Entamoeba invadens
TDNGR

SEQ ID NO: 2912112 - protein, 6 aa, Entamoeba invadens
TDNGRV

SEQ ID NO: 2912113 - protein, 4 aa, Entamoeba invadens
TDNH

SEQ ID NO: 2912114 - protein, 5 aa, Entamoeba invadens
TDNIE

SEQ ID NO: 2912115 - protein, 12 aa, Entamoeba invadens
TDNKPENWAPTK

SEQ ID NO: 2912116 - protein, 5 aa, Entamoeba invadens
TDNPP

SEQ ID NO: 2912117 - protein, 14 aa, Entamoeba invadens
TDNPSDDSDDYQKI

SEQ ID NO: 2912118 - protein, 8 aa, Entamoeba invadens
TDNQISTN

SEQ ID NO: 2912119 - protein, 20 aa, Entamoeba invadens
TDNQVSASSYTVHTTRKEQK

SEQ ID NO: 2912120 - protein, 18 aa, Entamoeba invadens
TDNSNKISMTEFLEWYVS

SEQ ID NO: 2912121 - protein, 7 aa, Entamoeba invadens
TDNSVTA

SEQ ID NO: 2912122 - protein, 10 aa, Entamoeba invadens
TDNTEALGQF

SEQ ID NO: 2912123 - protein, 11 aa, Entamoeba invadens
TDNTELTQMTP

SEQ ID NO: 2912124 - protein, 9 aa, Entamoeba invadens
TDNVQPNLT

SEQ ID NO: 2912125 - protein, 13 aa, Entamoeba invadens
TDNVRTLWERFCS

SEQ ID NO: 2912126 - protein, 32 aa, Entamoeba invadens
TDPDDNEIEAKVTKNEDGTYHAEYQPTKPGEY

SEQ ID NO: 2912127 - protein, 5 aa, Entamoeba invadens
TDPDK

SEQ ID NO: 2912128 - protein, 4 aa, Entamoeba invadens
TDPE

SEQ ID NO: 2912129 - protein, 5 aa, Entamoeba invadens
TDPEC

SEQ ID NO: 2912130 - protein, 18 aa, Entamoeba invadens
TDPEGKEIEPKVERGENG

SEQ ID NO: 2912131 - protein, 5 aa, Entamoeba invadens
TDPEK

SEQ ID NO: 2912132 - protein, 10 aa, Entamoeba invadens
TDPEKRPTFT

SEQ ID NO: 2912133 - protein, 9 aa, Entamoeba invadens
TDPETKDCK

SEQ ID NO: 2912134 - protein, 8 aa, Entamoeba invadens
TDPETVAN

SEQ ID NO: 2912135 - protein, 6 aa, Entamoeba invadens
TDPHLG

SEQ ID NO: 2912136 - protein, 8 aa, Entamoeba invadens
TDPIENAD

SEQ ID NO: 2912137 - protein, 7 aa, Entamoeba invadens
TDPIREA

SEQ ID NO: 2912138 - protein, 15 aa, Entamoeba invadens
TDPITERNNEDRNMD

SEQ ID NO: 2912139 - protein, 7 aa, Entamoeba invadens
TDPITGR

SEQ ID NO: 2912140 - protein, 4 aa, Entamoeba invadens
TDPK

SEQ ID NO: 2912141 - protein, 6 aa, Entamoeba invadens
TDPKDV

SEQ ID NO: 2912142 - protein, 7 aa, Entamoeba invadens
TDPKKAA

SEQ ID NO: 2912143 - protein, 11 aa, Entamoeba invadens
TDPLFDPRAPG

SEQ ID NO: 2912144 - protein, 5 aa, Entamoeba invadens
TDPLK

SEQ ID NO: 2912145 - protein, 4 aa, Entamoeba invadens
TDPM

SEQ ID NO: 2912146 - protein, 6 aa, Entamoeba invadens
TDPNEN

SEQ ID NO: 2912147 - protein, 7 aa, Entamoeba invadens
TDPNFSS

SEQ ID NO: 2912148 - protein, 12 aa, Entamoeba invadens
TDPNPSDPLDPD

SEQ ID NO: 2912149 - protein, 4 aa, Entamoeba invadens
TDPP

SEQ ID NO: 2912150 - protein, 12 aa, Entamoeba invadens
TDPPTDSTFNGN

SEQ ID NO: 2912151 - protein, 4 aa, Entamoeba invadens
TDPQ

SEQ ID NO: 2912152 - protein, 13 aa, Entamoeba invadens
TDPQKKVLSKEEA

SEQ ID NO: 2912153 - protein, 13 aa, Entamoeba invadens
TDPQQHHQQRTET

SEQ ID NO: 2912154 - protein, 14 aa, Entamoeba invadens
TDPQTRRDDKGEYT

SEQ ID NO: 2912155 - protein, 4 aa, Entamoeba invadens
TDPR

SEQ ID NO: 2912156 - protein, 9 aa, Entamoeba invadens
TDPREGMKP

SEQ ID NO: 2912157 - protein, 12 aa, Entamoeba invadens
TDPRTDKPKTFL

SEQ ID NO: 2912158 - protein, 6 aa, Entamoeba invadens
TDPSFR

SEQ ID NO: 2912159 - protein, 10 aa, Entamoeba invadens
TDPSKKVYTP

SEQ ID NO: 2912160 - protein, 9 aa, Entamoeba invadens
TDPSKRPDI

SEQ ID NO: 2912161 - protein, 8 aa, Entamoeba invadens
TDPSRSTA

SEQ ID NO: 2912162 - protein, 7 aa, Entamoeba invadens
TDPTDYT

SEQ ID NO: 2912163 - protein, 13 aa, Entamoeba invadens
TDPTGKTGPAARI

SEQ ID NO: 2912164 - protein, 5 aa, Entamoeba invadens
TDPTL

SEQ ID NO: 2912165 - protein, 5 aa, Entamoeba invadens
TDPTQ

SEQ ID NO: 2912166 - protein, 5 aa, Entamoeba invadens
TDPTW

SEQ ID NO: 2912167 - protein, 4 aa, Entamoeba invadens
TDPW

SEQ ID NO: 2912168 - protein, 4 aa, Entamoeba invadens
TDQD

SEQ ID NO: 2912169 - protein, 7 aa, Entamoeba invadens
TDQDIPI

SEQ ID NO: 2912170 - protein, 12 aa, Entamoeba invadens
TDQEGKVRYTDK

SEQ ID NO: 2912171 - protein, 7 aa, Entamoeba invadens
TDQERAS

SEQ ID NO: 2912172 - protein, 6 aa, Entamoeba invadens
TDQGES

SEQ ID NO: 2912173 - protein, 7 aa, Entamoeba invadens
TDQIDDS

SEQ ID NO: 2912174 - protein, 5 aa, Entamoeba invadens
TDQNG

SEQ ID NO: 2912175 - protein, 7 aa, Entamoeba invadens
TDQNNSP

SEQ ID NO: 2912176 - protein, 18 aa, Entamoeba invadens
TDQPKTITSEEAKQAAEK

SEQ ID NO: 2912177 - protein, 7 aa, Entamoeba invadens
TDQSKFA

SEQ ID NO: 2912178 - protein, 10 aa, Entamoeba invadens
TDQSNADRKT

SEQ ID NO: 2912179 - protein, 17 aa, Entamoeba invadens
TDQSNKCDEIAKQQQEI

SEQ ID NO: 2912180 - protein, 7 aa, Entamoeba invadens
TDQTLNG

SEQ ID NO: 2912181 - protein, 5 aa, Entamoeba invadens
TDQVG

SEQ ID NO: 2912182 - protein, 7 aa, Entamoeba invadens
TDQYTKN

SEQ ID NO: 2912183 - protein, 9 aa, Entamoeba invadens
TDRESYENT

SEQ ID NO: 2912184 - protein, 6 aa, Entamoeba invadens
TDRFGS

SEQ ID NO: 2912185 - protein, 68 aa, Entamoeba invadens
TDRKQRSPTGVRNDYENLDSDGDKETQYSAVKTKTQERDRSPSPQPASETSDNSSPERKSSGTDSEAS

SEQ ID NO: 2912186 - protein, 8 aa, Entamoeba invadens
TDRKTFEK

SEQ ID NO: 2912187 - protein, 4 aa, Entamoeba invadens
TDRN

SEQ ID NO: 2912188 - protein, 6 aa, Entamoeba invadens
TDRQKG

SEQ ID NO: 2912189 - protein, 12 aa, Entamoeba invadens
TDRQKTPKRVTK

SEQ ID NO: 2912190 - protein, 6 aa, Entamoeba invadens
TDRSTY

SEQ ID NO: 2912191 - protein, 8 aa, Entamoeba invadens
TDRSYAQS

SEQ ID NO: 2912192 - protein, 5 aa, Entamoeba invadens
TDRVS

SEQ ID NO: 2912193 - protein, 9 aa, Entamoeba invadens
TDRVTADLT

SEQ ID NO: 2912194 - protein, 9 aa, Entamoeba invadens
TDSAELTEQ

SEQ ID NO: 2912195 - protein, 18 aa, Entamoeba invadens
TDSDEVYSYTQELMDYFV

SEQ ID NO: 2912196 - protein, 9 aa, Entamoeba invadens
TDSDKDKLA

SEQ ID NO: 2912197 - protein, 7 aa, Entamoeba invadens
TDSEFTS

SEQ ID NO: 2912198 - protein, 8 aa, Entamoeba invadens
TDSEKHAE

SEQ ID NO: 2912199 - protein, 11 aa, Entamoeba invadens
TDSEKKQTVKH

SEQ ID NO: 2912200 - protein, 17 aa, Entamoeba invadens
TDSEKNSVDQSFDDFPQ

SEQ ID NO: 2912201 - protein, 6 aa, Entamoeba invadens
TDSEPL

SEQ ID NO: 2912202 - protein, 6 aa, Entamoeba invadens
TDSERL

SEQ ID NO: 2912203 - protein, 16 aa, Entamoeba invadens
TDSERNKVNQSFDDFP

SEQ ID NO: 2912204 - protein, 5 aa, Entamoeba invadens
TDSGG

SEQ ID NO: 2912205 - protein, 6 aa, Entamoeba invadens
TDSGRT

SEQ ID NO: 2912206 - protein, 6 aa, Entamoeba invadens
TDSGSP

SEQ ID NO: 2912207 - protein, 6 aa, Entamoeba invadens
TDSGTL

SEQ ID NO: 2912208 - protein, 10 aa, Entamoeba invadens
TDSINKEGKY

SEQ ID NO: 2912209 - protein, 18 aa, Entamoeba invadens
TDSKGIETDDKGNVLSGP

SEQ ID NO: 2912210 - protein, 7 aa, Entamoeba invadens
TDSKHNL

SEQ ID NO: 2912211 - protein, 11 aa, Entamoeba invadens
TDSKKLSLEEV

SEQ ID NO: 2912212 - protein, 8 aa, Entamoeba invadens
TDSKLTPQ

SEQ ID NO: 2912213 - protein, 4 aa, Entamoeba invadens
TDSM

SEQ ID NO: 2912214 - protein, 6 aa, Entamoeba invadens
TDSMRE

SEQ ID NO: 2912215 - protein, 5 aa, Entamoeba invadens
TDSND

SEQ ID NO: 2912216 - protein, 8 aa, Entamoeba invadens
TDSNGTFF

SEQ ID NO: 2912217 - protein, 14 aa, Entamoeba invadens
TDSPMHSHTTDQPL

SEQ ID NO: 2912218 - protein, 12 aa, Entamoeba invadens
TDSPQKYTDKVT

SEQ ID NO: 2912219 - protein, 8 aa, Entamoeba invadens
TDSQGTIE

SEQ ID NO: 2912220 - protein, 6 aa, Entamoeba invadens
TDSQTI

SEQ ID NO: 2912221 - protein, 10 aa, Entamoeba invadens
TDSSKKENEI

SEQ ID NO: 2912222 - protein, 6 aa, Entamoeba invadens
TDSSPV

SEQ ID NO: 2912223 - protein, 4 aa, Entamoeba invadens
TDST

SEQ ID NO: 2912224 - protein, 8 aa, Entamoeba invadens
TDSTDNSN

SEQ ID NO: 2912225 - protein, 6 aa, Entamoeba invadens
TDSTEQ

SEQ ID NO: 2912226 - protein, 7 aa, Entamoeba invadens
TDSTHPG

SEQ ID NO: 2912227 - protein, 9 aa, Entamoeba invadens
TDSTLKERE

SEQ ID NO: 2912228 - protein, 8 aa, Entamoeba invadens
TDSTPSEF

SEQ ID NO: 2912229 - protein, 4 aa, Entamoeba invadens
TDSV

SEQ ID NO: 2912230 - protein, 13 aa, Entamoeba invadens
TDSVEDDKVPSRL

SEQ ID NO: 2912231 - protein, 12 aa, Entamoeba invadens
TDSYNETTGRGA

SEQ ID NO: 2912232 - protein, 8 aa, Entamoeba invadens
TDTAESSV

SEQ ID NO: 2912233 - protein, 6 aa, Entamoeba invadens
TDTATY

SEQ ID NO: 2912234 - protein, 8 aa, Entamoeba invadens
TDTCSEYS

SEQ ID NO: 2912235 - protein, 10 aa, Entamoeba invadens
TDTDGNRPTF

SEQ ID NO: 2912236 - protein, 4 aa, Entamoeba invadens
TDTE

SEQ ID NO: 2912237 - protein, 6 aa, Entamoeba invadens
TDTEKS

SEQ ID NO: 2912238 - protein, 8 aa, Entamoeba invadens
TDTERFED

SEQ ID NO: 2912239 - protein, 4 aa, Entamoeba invadens
TDTH

SEQ ID NO: 2912240 - protein, 12 aa, Entamoeba invadens
TDTHEDKEIDEK

SEQ ID NO: 2912241 - protein, 21 aa, Entamoeba invadens
TDTHVGNADLTKAPAQESSGC

SEQ ID NO: 2912242 - protein, 7 aa, Entamoeba invadens
TDTKENG

SEQ ID NO: 2912243 - protein, 9 aa, Entamoeba invadens
TDTKKQSFT

SEQ ID NO: 2912244 - protein, 11 aa, Entamoeba invadens
TDTLTEKEHGA

SEQ ID NO: 2912245 - protein, 4 aa, Entamoeba invadens
TDTN

SEQ ID NO: 2912246 - protein, 10 aa, Entamoeba invadens
TDTNGSGKVN

SEQ ID NO: 2912247 - protein, 15 aa, Entamoeba invadens
TDTPAIDNNISPEQI

SEQ ID NO: 2912248 - protein, 8 aa, Entamoeba invadens
TDTPEKKF

SEQ ID NO: 2912249 - protein, 25 aa, Entamoeba invadens
TDTPVNDHSNEEEKENTKNSKKTIK

SEQ ID NO: 2912250 - protein, 11 aa, Entamoeba invadens
TDTQKSSEVSN

SEQ ID NO: 2912251 - protein, 16 aa, Entamoeba invadens
TDTRVEKKKKNGKVSV

SEQ ID NO: 2912252 - protein, 6 aa, Entamoeba invadens
TDTSDI

SEQ ID NO: 2912253 - protein, 6 aa, Entamoeba invadens
TDTSEH

SEQ ID NO: 2912254 - protein, 6 aa, Entamoeba invadens
TDTSFN

SEQ ID NO: 2912255 - protein, 10 aa, Entamoeba invadens
TDTSGQEEYN

SEQ ID NO: 2912256 - protein, 8 aa, Entamoeba invadens
TDTSHQTE

SEQ ID NO: 2912257 - protein, 24 aa, Entamoeba invadens
TDTTAEIKVESKSPEVKGPSYLKG

SEQ ID NO: 2912258 - protein, 10 aa, Entamoeba invadens
TDTTEPEKVR

SEQ ID NO: 2912259 - protein, 16 aa, Entamoeba invadens
TDTTEQQPTPKRRNTI

SEQ ID NO: 2912260 - protein, 7 aa, Entamoeba invadens
TDTTERR

SEQ ID NO: 2912261 - protein, 5 aa, Entamoeba invadens
TDTTP

SEQ ID NO: 2912262 - protein, 9 aa, Entamoeba invadens
TDTTSEEDL

SEQ ID NO: 2912263 - protein, 10 aa, Entamoeba invadens
TDTYGEEKYR

SEQ ID NO: 2912264 - protein, 14 aa, Entamoeba invadens
TDVDKSESSENEPA

SEQ ID NO: 2912265 - protein, 9 aa, Entamoeba invadens
TDVDTNTVQ

SEQ ID NO: 2912266 - protein, 13 aa, Entamoeba invadens
TDVGKKQREIDPI

SEQ ID NO: 2912267 - protein, 8 aa, Entamoeba invadens
TDVGRKPY

SEQ ID NO: 2912268 - protein, 5 aa, Entamoeba invadens
TDVKE

SEQ ID NO: 2912269 - protein, 7 aa, Entamoeba invadens
TDVNEIA

SEQ ID NO: 2912270 - protein, 8 aa, Entamoeba invadens
TDVPSQAN

SEQ ID NO: 2912271 - protein, 7 aa, Entamoeba invadens
TDVRIED

SEQ ID NO: 2912272 - protein, 16 aa, Entamoeba invadens
TDVSASVDDAFKETKN

SEQ ID NO: 2912273 - protein, 12 aa, Entamoeba invadens
TDVSDEGRLATR

SEQ ID NO: 2912274 - protein, 41 aa, Entamoeba invadens
TDVSHEDLKGEMKSQEHNEGRAMSLEPKDAVRSDEKSEIKM

SEQ ID NO: 2912275 - protein, 8 aa, Entamoeba invadens
TDVSPATK

SEQ ID NO: 2912276 - protein, 5 aa, Entamoeba invadens
TDVSS

SEQ ID NO: 2912277 - protein, 5 aa, Entamoeba invadens
TDVTN

SEQ ID NO: 2912278 - protein, 7 aa, Entamoeba invadens
TDVTNNT

SEQ ID NO: 2912279 - protein, 6 aa, Entamoeba invadens
TDVTNY

SEQ ID NO: 2912280 - protein, 18 aa, Entamoeba invadens
TDWNTPYKPRADVGTSRV

SEQ ID NO: 2912281 - protein, 14 aa, Entamoeba invadens
TDYEPPKKVSKYSR

SEQ ID NO: 2912282 - protein, 5 aa, Entamoeba invadens
TDYIG

SEQ ID NO: 2912283 - protein, 19 aa, Entamoeba invadens
TDYKRKGVENSSKNNNLFL

SEQ ID NO: 2912284 - protein, 10 aa, Entamoeba invadens
TDYKTEQERI

SEQ ID NO: 2912285 - protein, 4 aa, Entamoeba invadens
TDYL

SEQ ID NO: 2912286 - protein, 13 aa, Entamoeba invadens
TDYRTDASKWKSR

SEQ ID NO: 2912287 - protein, 10 aa, Entamoeba invadens
TDYSGRGELA

SEQ ID NO: 2912288 - protein, 12 aa, Entamoeba invadens
TDYSNGECASEL

SEQ ID NO: 2912289 - protein, 8 aa, Entamoeba invadens
TDYTDQDK

SEQ ID NO: 2912290 - protein, 10 aa, Entamoeba invadens
TEAASPEKIT

SEQ ID NO: 2912291 - protein, 8 aa, Entamoeba invadens
TEAASRVN

SEQ ID NO: 2912292 - protein, 13 aa, Entamoeba invadens
TEADFKTASDTAK

SEQ ID NO: 2912293 - protein, 20 aa, Entamoeba invadens
TEADIAKAKSTPIPIKENEE

SEQ ID NO: 2912294 - protein, 8 aa, Entamoeba invadens
TEADKNRM

SEQ ID NO: 2912295 - protein, 6 aa, Entamoeba invadens
TEAEAF

SEQ ID NO: 2912296 - protein, 9 aa, Entamoeba invadens
TEAENTSSL

SEQ ID NO: 2912297 - protein, 7 aa, Entamoeba invadens
TEAESLE

SEQ ID NO: 2912298 - protein, 7 aa, Entamoeba invadens
TEAGFDS

SEQ ID NO: 2912299 - protein, 5 aa, Entamoeba invadens
TEAGT

SEQ ID NO: 2912300 - protein, 15 aa, Entamoeba invadens
TEAKKYKPQKKGGIA

SEQ ID NO: 2912301 - protein, 14 aa, Entamoeba invadens
TEARNIINDMLISS

SEQ ID NO: 2912302 - protein, 10 aa, Entamoeba invadens
TEARTGTGKT

SEQ ID NO: 2912303 - protein, 10 aa, Entamoeba invadens
TEATKEQEKY

SEQ ID NO: 2912304 - protein, 11 aa, Entamoeba invadens
TEATKPLTTQY

SEQ ID NO: 2912305 - protein, 10 aa, Entamoeba invadens
TEATSSTQID

SEQ ID NO: 2912306 - protein, 6 aa, Entamoeba invadens
TEATSV

SEQ ID NO: 2912307 - protein, 16 aa, Entamoeba invadens
TECDKITKDALKKDNN

SEQ ID NO: 2912308 - protein, 7 aa, Entamoeba invadens
TECEQTI

SEQ ID NO: 2912309 - protein, 12 aa, Entamoeba invadens
TECGGKKGTLKE

SEQ ID NO: 2912310 - protein, 5 aa, Entamoeba invadens
TECPK

SEQ ID NO: 2912311 - protein, 25 aa, Entamoeba invadens
TECQSSQQIPKTINGGFDDDEDEVE

SEQ ID NO: 2912312 - protein, 4 aa, Entamoeba invadens
TECR

SEQ ID NO: 2912313 - protein, 4 aa, Entamoeba invadens
TECS

SEQ ID NO: 2912314 - protein, 6 aa, Entamoeba invadens
TECSSG

SEQ ID NO: 2912315 - protein, 8 aa, Entamoeba invadens
TECVPTNE

SEQ ID NO: 2912316 - protein, 6 aa, Entamoeba invadens
TECYDT

SEQ ID NO: 2912317 - protein, 9 aa, Entamoeba invadens
TEDAKKVAD

SEQ ID NO: 2912318 - protein, 9 aa, Entamoeba invadens
TEDANKVAD

SEQ ID NO: 2912319 - protein, 13 aa, Entamoeba invadens
TEDDGKEVSAYGD

SEQ ID NO: 2912320 - protein, 51 aa, Entamoeba invadens
TEDEKEAYKPKKNGKKKVEDNEEKDEEKKSTKKETKKETKSEKKTPKKKGG

SEQ ID NO: 2912321 - protein, 10 aa, Entamoeba invadens
TEDEKSLEDI

SEQ ID NO: 2912322 - protein, 7 aa, Entamoeba invadens
TEDEMDV

SEQ ID NO: 2912323 - protein, 5 aa, Entamoeba invadens
TEDEV

SEQ ID NO: 2912324 - protein, 10 aa, Entamoeba invadens
TEDEYAQTDL

SEQ ID NO: 2912325 - protein, 6 aa, Entamoeba invadens
TEDGKY

SEQ ID NO: 2912326 - protein, 4 aa, Entamoeba invadens
TEDK

SEQ ID NO: 2912327 - protein, 9 aa, Entamoeba invadens
TEDKEAVAN

SEQ ID NO: 2912328 - protein, 7 aa, Entamoeba invadens
TEDKKKY

SEQ ID NO: 2912329 - protein, 7 aa, Entamoeba invadens
TEDKNTL

SEQ ID NO: 2912330 - protein, 14 aa, Entamoeba invadens
TEDKQPEKKSRTNV

SEQ ID NO: 2912331 - protein, 12 aa, Entamoeba invadens
TEDKTQPLESRH

SEQ ID NO: 2912332 - protein, 13 aa, Entamoeba invadens
TEDKTVGDLPQCD

SEQ ID NO: 2912333 - protein, 5 aa, Entamoeba invadens
TEDMK

SEQ ID NO: 2912334 - protein, 6 aa, Entamoeba invadens
TEDMNN

SEQ ID NO: 2912335 - protein, 8 aa, Entamoeba invadens
TEDNPNTK

SEQ ID NO: 2912336 - protein, 8 aa, Entamoeba invadens
TEDPEGQS

SEQ ID NO: 2912337 - protein, 7 aa, Entamoeba invadens
TEDPEWP

SEQ ID NO: 2912338 - protein, 7 aa, Entamoeba invadens
TEDPQKV

SEQ ID NO: 2912339 - protein, 6 aa, Entamoeba invadens
TEDPSC

SEQ ID NO: 2912340 - protein, 6 aa, Entamoeba invadens
TEDPTQ

SEQ ID NO: 2912341 - protein, 5 aa, Entamoeba invadens
TEDQL

SEQ ID NO: 2912342 - protein, 6 aa, Entamoeba invadens
TEDRSG

SEQ ID NO: 2912343 - protein, 9 aa, Entamoeba invadens
TEDSESESY

SEQ ID NO: 2912344 - protein, 11 aa, Entamoeba invadens
TEDSFKQNGGK

SEQ ID NO: 2912345 - protein, 10 aa, Entamoeba invadens
TEDSKRDQKM

SEQ ID NO: 2912346 - protein, 10 aa, Entamoeba invadens
TEDSPENSEI

SEQ ID NO: 2912347 - protein, 8 aa, Entamoeba invadens
TEDSTEVM

SEQ ID NO: 2912348 - protein, 15 aa, Entamoeba invadens
TEDSYQGKSSLKTAL

SEQ ID NO: 2912349 - protein, 9 aa, Entamoeba invadens
TEDTNGNRF

SEQ ID NO: 2912350 - protein, 5 aa, Entamoeba invadens
TEDTV

SEQ ID NO: 2912351 - protein, 6 aa, Entamoeba invadens
TEDVEK

SEQ ID NO: 2912352 - protein, 17 aa, Entamoeba invadens
TEDVERKMKENEARSRA

SEQ ID NO: 2912353 - protein, 11 aa, Entamoeba invadens
TEDYPSDFESH

SEQ ID NO: 2912354 - protein, 40 aa, Entamoeba invadens
TEDYTDEERAALEKEKEEKKVVEKSVEEKSEEESESSEDI

SEQ ID NO: 2912355 - protein, 4 aa, Entamoeba invadens
TEED

SEQ ID NO: 2912356 - protein, 12 aa, Entamoeba invadens
TEEDAHKTKSKL

SEQ ID NO: 2912357 - protein, 10 aa, Entamoeba invadens
TEEDAKNIET

SEQ ID NO: 2912358 - protein, 5 aa, Entamoeba invadens
TEEDC

SEQ ID NO: 2912359 - protein, 16 aa, Entamoeba invadens
TEEDKKSTVTSTTEDT

SEQ ID NO: 2912360 - protein, 5 aa, Entamoeba invadens
TEEDL

SEQ ID NO: 2912361 - protein, 15 aa, Entamoeba invadens
TEEDMKKAKTTPINI

SEQ ID NO: 2912362 - protein, 4 aa, Entamoeba invadens
TEEE

SEQ ID NO: 2912363 - protein, 8 aa, Entamoeba invadens
TEEECDEV

SEQ ID NO: 2912364 - protein, 7 aa, Entamoeba invadens
TEEEDQI

SEQ ID NO: 2912365 - protein, 5 aa, Entamoeba invadens
TEEEE

SEQ ID NO: 2912366 - protein, 12 aa, Entamoeba invadens
TEEEKNSSEAKE

SEQ ID NO: 2912367 - protein, 6 aa, Entamoeba invadens
TEEELN

SEQ ID NO: 2912368 - protein, 5 aa, Entamoeba invadens
TEEEM

SEQ ID NO: 2912369 - protein, 8 aa, Entamoeba invadens
TEEEPKQV

SEQ ID NO: 2912370 - protein, 22 aa, Entamoeba invadens
TEEERKKERKRNKEDVVKDKKQ

SEQ ID NO: 2912371 - protein, 6 aa, Entamoeba invadens
TEEERT

SEQ ID NO: 2912372 - protein, 15 aa, Entamoeba invadens
TEEESELKEPEDKEV

SEQ ID NO: 2912373 - protein, 9 aa, Entamoeba invadens
TEEESVSGV

SEQ ID NO: 2912374 - protein, 7 aa, Entamoeba invadens
TEEETRT

SEQ ID NO: 2912375 - protein, 4 aa, Entamoeba invadens
TEEF

SEQ ID NO: 2912376 - protein, 5 aa, Entamoeba invadens
TEEGE

SEQ ID NO: 2912377 - protein, 7 aa, Entamoeba invadens
TEEGEVT

SEQ ID NO: 2912378 - protein, 5 aa, Entamoeba invadens
TEEGI

SEQ ID NO: 2912379 - protein, 11 aa, Entamoeba invadens
TEEGLDAAKRI

SEQ ID NO: 2912380 - protein, 12 aa, Entamoeba invadens
TEEGLDAAKSIG

SEQ ID NO: 2912381 - protein, 6 aa, Entamoeba invadens
TEEGRK

SEQ ID NO: 2912382 - protein, 11 aa, Entamoeba invadens
TEEGVPEKERN

SEQ ID NO: 2912383 - protein, 8 aa, Entamoeba invadens
TEEHAEET

SEQ ID NO: 2912384 - protein, 12 aa, Entamoeba invadens
TEEHKNRIGEVP

SEQ ID NO: 2912385 - protein, 53 aa, Entamoeba invadens
TEEIEQKEIQEVPPPPIPKPKELESKDTTLPPPKPKRSSLQMQEQTPPPKPRR

SEQ ID NO: 2912386 - protein, 4 aa, Entamoeba invadens
TEEK

SEQ ID NO: 2912387 - protein, 16 aa, Entamoeba invadens
TEEKEAALSKTDDGQC

SEQ ID NO: 2912388 - protein, 32 aa, Entamoeba invadens
TEEKEDEEERVEKAEKNEQPTTDLNKEVPKQD

SEQ ID NO: 2912389 - protein, 11 aa, Entamoeba invadens
TEEKEDSAEVL

SEQ ID NO: 2912390 - protein, 9 aa, Entamoeba invadens
TEEKETIER

SEQ ID NO: 2912391 - protein, 9 aa, Entamoeba invadens
TEEKHKRTQ

SEQ ID NO: 2912392 - protein, 10 aa, Entamoeba invadens
TEEKKQDHSL

SEQ ID NO: 2912393 - protein, 6 aa, Entamoeba invadens
TEEKRI

SEQ ID NO: 2912394 - protein, 13 aa, Entamoeba invadens
TEEKRKKSQLPKA

SEQ ID NO: 2912395 - protein, 38 aa, Entamoeba invadens
TEEKTKWAETISTEIETAKAKKQKLEEQAKSALKEKAE

SEQ ID NO: 2912396 - protein, 8 aa, Entamoeba invadens
TEELDDNE

SEQ ID NO: 2912397 - protein, 13 aa, Entamoeba invadens
TEENATKNITETK

SEQ ID NO: 2912398 - protein, 8 aa, Entamoeba invadens
TEENDAKR

SEQ ID NO: 2912399 - protein, 11 aa, Entamoeba invadens
TEENDDCENKA

SEQ ID NO: 2912400 - protein, 16 aa, Entamoeba invadens
TEENEDCENENSENEV

SEQ ID NO: 2912401 - protein, 12 aa, Entamoeba invadens
TEENEDSENKGV

SEQ ID NO: 2912402 - protein, 8 aa, Entamoeba invadens
TEENESTP

SEQ ID NO: 2912403 - protein, 10 aa, Entamoeba invadens
TEENGDCGNK

SEQ ID NO: 2912404 - protein, 9 aa, Entamoeba invadens
TEENNSKNE

SEQ ID NO: 2912405 - protein, 11 aa, Entamoeba invadens
TEENQDCENKS

SEQ ID NO: 2912406 - protein, 6 aa, Entamoeba invadens
TEENSV

SEQ ID NO: 2912407 - protein, 10 aa, Entamoeba invadens
TEENTQQTLQ

SEQ ID NO: 2912408 - protein, 15 aa, Entamoeba invadens
TEEPPANADRPSTCV

SEQ ID NO: 2912409 - protein, 22 aa, Entamoeba invadens
TEEQGPPSDYNEFEPPHQAPGI

SEQ ID NO: 2912410 - protein, 14 aa, Entamoeba invadens
TEEQIKKRLNISQT

SEQ ID NO: 2912411 - protein, 5 aa, Entamoeba invadens
TEEQV

SEQ ID NO: 2912412 - protein, 4 aa, Entamoeba invadens
TEER

SEQ ID NO: 2912413 - protein, 8 aa, Entamoeba invadens
TEERAKEI

SEQ ID NO: 2912414 - protein, 4 aa, Entamoeba invadens
TEES

SEQ ID NO: 2912415 - protein, 5 aa, Entamoeba invadens
TEESA

SEQ ID NO: 2912416 - protein, 22 aa, Entamoeba invadens
TEESGKIKATGLGTTDMKGGNV

SEQ ID NO: 2912417 - protein, 5 aa, Entamoeba invadens
TEESK

SEQ ID NO: 2912418 - protein, 11 aa, Entamoeba invadens
TEESKKGVKNY

SEQ ID NO: 2912419 - protein, 9 aa, Entamoeba invadens
TEESKTETT

SEQ ID NO: 2912420 - protein, 8 aa, Entamoeba invadens
TEESRKEI

SEQ ID NO: 2912421 - protein, 23 aa, Entamoeba invadens
TEETDDPKNVKQNNVQKKSKCFL

SEQ ID NO: 2912422 - protein, 9 aa, Entamoeba invadens
TEETSMDAG

SEQ ID NO: 2912423 - protein, 5 aa, Entamoeba invadens
TEETY

SEQ ID NO: 2912424 - protein, 8 aa, Entamoeba invadens
TEEVSEEN

SEQ ID NO: 2912425 - protein, 14 aa, Entamoeba invadens
TEFDETGHSYYGQS

SEQ ID NO: 2912426 - protein, 12 aa, Entamoeba invadens
TEFDPDDNSTYV

SEQ ID NO: 2912427 - protein, 6 aa, Entamoeba invadens
TEFDQR

SEQ ID NO: 2912428 - protein, 5 aa, Entamoeba invadens
TEFEE

SEQ ID NO: 2912429 - protein, 6 aa, Entamoeba invadens
TEFENP

SEQ ID NO: 2912430 - protein, 21 aa, Entamoeba invadens
TEFESQQKTVQQSQEKDKSKL

SEQ ID NO: 2912431 - protein, 7 aa, Entamoeba invadens
TEFETQV

SEQ ID NO: 2912432 - protein, 7 aa, Entamoeba invadens
TEFPEPP

SEQ ID NO: 2912433 - protein, 12 aa, Entamoeba invadens
TEFTEKEGDVTR

SEQ ID NO: 2912434 - protein, 5 aa, Entamoeba invadens
TEFTK

SEQ ID NO: 2912435 - protein, 10 aa, Entamoeba invadens
TEFTKNDEDI

SEQ ID NO: 2912436 - protein, 7 aa, Entamoeba invadens
TEGAGTK

SEQ ID NO: 2912437 - protein, 14 aa, Entamoeba invadens
TEGAPQVAEEKERP

SEQ ID NO: 2912438 - protein, 6 aa, Entamoeba invadens
TEGCPA

SEQ ID NO: 2912439 - protein, 16 aa, Entamoeba invadens
TEGDVNAAIDEGARTI

SEQ ID NO: 2912440 - protein, 8 aa, Entamoeba invadens
TEGELKGD

SEQ ID NO: 2912441 - protein, 5 aa, Entamoeba invadens
TEGEY

SEQ ID NO: 2912442 - protein, 4 aa, Entamoeba invadens
TEGF

SEQ ID NO: 2912443 - protein, 5 aa, Entamoeba invadens
TEGFG

SEQ ID NO: 2912444 - protein, 7 aa, Entamoeba invadens
TEGGEEL

SEQ ID NO: 2912445 - protein, 8 aa, Entamoeba invadens
TEGGKKLN

SEQ ID NO: 2912446 - protein, 21 aa, Entamoeba invadens
TEGGVAKSFKTTIQKNTATPV

SEQ ID NO: 2912447 - protein, 7 aa, Entamoeba invadens
TEGIPKQ

SEQ ID NO: 2912448 - protein, 14 aa, Entamoeba invadens
TEGITSKKKISDEE

SEQ ID NO: 2912449 - protein, 5 aa, Entamoeba invadens
TEGKD

SEQ ID NO: 2912450 - protein, 5 aa, Entamoeba invadens
TEGKE

SEQ ID NO: 2912451 - protein, 10 aa, Entamoeba invadens
TEGKQKPIIS

SEQ ID NO: 2912452 - protein, 9 aa, Entamoeba invadens
TEGKSGTVK

SEQ ID NO: 2912453 - protein, 4 aa, Entamoeba invadens
TEGL

SEQ ID NO: 2912454 - protein, 7 aa, Entamoeba invadens
TEGLDTS

SEQ ID NO: 2912455 - protein, 6 aa, Entamoeba invadens
TEGLSS

SEQ ID NO: 2912456 - protein, 4 aa, Entamoeba invadens
TEGN

SEQ ID NO: 2912457 - protein, 17 aa, Entamoeba invadens
TEGPIDKKEEDIERKSA

SEQ ID NO: 2912458 - protein, 7 aa, Entamoeba invadens
TEGRVTP

SEQ ID NO: 2912459 - protein, 6 aa, Entamoeba invadens
TEGSEE

SEQ ID NO: 2912460 - protein, 7 aa, Entamoeba invadens
TEGSEEL

SEQ ID NO: 2912461 - protein, 6 aa, Entamoeba invadens
TEGSKR

SEQ ID NO: 2912462 - protein, 9 aa, Entamoeba invadens
TEGSVRKRK

SEQ ID NO: 2912463 - protein, 9 aa, Entamoeba invadens
TEGTEREGV

SEQ ID NO: 2912464 - protein, 9 aa, Entamoeba invadens
TEGTFRPER

SEQ ID NO: 2912465 - protein, 15 aa, Entamoeba invadens
TEGTLNDTTTNTATS

SEQ ID NO: 2912466 - protein, 24 aa, Entamoeba invadens
TEGTPTEKYDKLKKEIDSSISEEA

SEQ ID NO: 2912467 - protein, 8 aa, Entamoeba invadens
TEGTRDPY

SEQ ID NO: 2912468 - protein, 8 aa, Entamoeba invadens
TEGTTSTF

SEQ ID NO: 2912469 - protein, 7 aa, Entamoeba invadens
TEGVGER

SEQ ID NO: 2912470 - protein, 8 aa, Entamoeba invadens
TEGVSKRR

SEQ ID NO: 2912471 - protein, 5 aa, Entamoeba invadens
TEGVT

SEQ ID NO: 2912472 - protein, 17 aa, Entamoeba invadens
TEGVTRINKNKKKEMTV

SEQ ID NO: 2912473 - protein, 5 aa, Entamoeba invadens
TEHDQ

SEQ ID NO: 2912474 - protein, 8 aa, Entamoeba invadens
TEHGGDIT

SEQ ID NO: 2912475 - protein, 6 aa, Entamoeba invadens
TEHGNE

SEQ ID NO: 2912476 - protein, 6 aa, Entamoeba invadens
TEHKAG

SEQ ID NO: 2912477 - protein, 12 aa, Entamoeba invadens
TEHNDVTNGQIP

SEQ ID NO: 2912478 - protein, 16 aa, Entamoeba invadens
TEHPPISPVDTPQSFK

SEQ ID NO: 2912479 - protein, 4 aa, Entamoeba invadens
TEHS

SEQ ID NO: 2912480 - protein, 5 aa, Entamoeba invadens
TEHTR

SEQ ID NO: 2912481 - protein, 4 aa, Entamoeba invadens
TEHV

SEQ ID NO: 2912482 - protein, 9 aa, Entamoeba invadens
TEHVSDPTV

SEQ ID NO: 2912483 - protein, 25 aa, Entamoeba invadens
TEIATQSTSSVVSNGPSEIESKTHN

SEQ ID NO: 2912484 - protein, 6 aa, Entamoeba invadens
TEIDNR

SEQ ID NO: 2912485 - protein, 37 aa, Entamoeba invadens
TEIEEKNMVDSSKSESLSDNEETEKSEKKEKKSQRNL

SEQ ID NO: 2912486 - protein, 11 aa, Entamoeba invadens
TEIEKSENITT

SEQ ID NO: 2912487 - protein, 12 aa, Entamoeba invadens
TEIESKESQLEI

SEQ ID NO: 2912488 - protein, 5 aa, Entamoeba invadens
TEIGK

SEQ ID NO: 2912489 - protein, 10 aa, Entamoeba invadens
TEIGNATNKY

SEQ ID NO: 2912490 - protein, 5 aa, Entamoeba invadens
TEIGS

SEQ ID NO: 2912491 - protein, 9 aa, Entamoeba invadens
TEIGTDDAS

SEQ ID NO: 2912492 - protein, 6 aa, Entamoeba invadens
TEIGTE

SEQ ID NO: 2912493 - protein, 11 aa, Entamoeba invadens
TEIKKSSFENM

SEQ ID NO: 2912494 - protein, 8 aa, Entamoeba invadens
TEIKNSSF

SEQ ID NO: 2912495 - protein, 13 aa, Entamoeba invadens
TEIKSYPTQLTNE

SEQ ID NO: 2912496 - protein, 19 aa, Entamoeba invadens
TEINESKNKADAERKTPQL

SEQ ID NO: 2912497 - protein, 7 aa, Entamoeba invadens
TEINTPN

SEQ ID NO: 2912498 - protein, 23 aa, Entamoeba invadens
TEIPENPVPPKIPQKAPPKLPQR

SEQ ID NO: 2912499 - protein, 10 aa, Entamoeba invadens
TEIPKKEEVK

SEQ ID NO: 2912500 - protein, 6 aa, Entamoeba invadens
TEIPQN

SEQ ID NO: 2912501 - protein, 6 aa, Entamoeba invadens
TEIPSA

SEQ ID NO: 2912502 - protein, 6 aa, Entamoeba invadens
TEIRKK

SEQ ID NO: 2912503 - protein, 4 aa, Entamoeba invadens
TEIS

SEQ ID NO: 2912504 - protein, 12 aa, Entamoeba invadens
TEISGSPAQVTR

SEQ ID NO: 2912505 - protein, 11 aa, Entamoeba invadens
TEITSPESEIE

SEQ ID NO: 2912506 - protein, 11 aa, Entamoeba invadens
TEITSPESEIK

SEQ ID NO: 2912507 - protein, 12 aa, Entamoeba invadens
TEITSRKATRAQ

SEQ ID NO: 2912508 - protein, 4 aa, Entamoeba invadens
TEIV

SEQ ID NO: 2912509 - protein, 4 aa, Entamoeba invadens
TEKA

SEQ ID NO: 2912510 - protein, 21 aa, Entamoeba invadens
TEKACKQCDSKCENCTSATEC

SEQ ID NO: 2912511 - protein, 14 aa, Entamoeba invadens
TEKCDKVKSKFDKF

SEQ ID NO: 2912512 - protein, 5 aa, Entamoeba invadens
TEKDE

SEQ ID NO: 2912513 - protein, 57 aa, Entamoeba invadens
TEKDEKPKKTRITKTKKKTKEKKDEEKKPKRKYTRRKPLKSKEAKDLKEKKEEKTDS

SEQ ID NO: 2912514 - protein, 16 aa, Entamoeba invadens
TEKDFQDQIDEKNEEL

SEQ ID NO: 2912515 - protein, 6 aa, Entamoeba invadens
TEKDGQ

SEQ ID NO: 2912516 - protein, 11 aa, Entamoeba invadens
TEKDNASGSVT

SEQ ID NO: 2912517 - protein, 28 aa, Entamoeba invadens
TEKDSANNNDDPDNSDNMLPTTQPGTDE

SEQ ID NO: 2912518 - protein, 14 aa, Entamoeba invadens
TEKDSEKVLSKEEY

SEQ ID NO: 2912519 - protein, 9 aa, Entamoeba invadens
TEKDSEKYV

SEQ ID NO: 2912520 - protein, 7 aa, Entamoeba invadens
TEKDVEK

SEQ ID NO: 2912521 - protein, 4 aa, Entamoeba invadens
TEKE

SEQ ID NO: 2912522 - protein, 9 aa, Entamoeba invadens
TEKEAIKTG

SEQ ID NO: 2912523 - protein, 39 aa, Entamoeba invadens
TEKEKKMKEITEKEMKSQNEKTENDKQQEESDKSKIKQL

SEQ ID NO: 2912524 - protein, 10 aa, Entamoeba invadens
TEKETPKHTI

SEQ ID NO: 2912525 - protein, 8 aa, Entamoeba invadens
TEKEVERK

SEQ ID NO: 2912526 - protein, 6 aa, Entamoeba invadens
TEKEYP

SEQ ID NO: 2912527 - protein, 7 aa, Entamoeba invadens
TEKFPPI

SEQ ID NO: 2912528 - protein, 6 aa, Entamoeba invadens
TEKGDI

SEQ ID NO: 2912529 - protein, 6 aa, Entamoeba invadens
TEKGDR

SEQ ID NO: 2912530 - protein, 20 aa, Entamoeba invadens
TEKGITPKTEADGQKLAQEI

SEQ ID NO: 2912531 - protein, 6 aa, Entamoeba invadens
TEKGKD

SEQ ID NO: 2912532 - protein, 9 aa, Entamoeba invadens
TEKGKESVD

SEQ ID NO: 2912533 - protein, 6 aa, Entamoeba invadens
TEKGNY

SEQ ID NO: 2912534 - protein, 12 aa, Entamoeba invadens
TEKGQKSVQECN

SEQ ID NO: 2912535 - protein, 9 aa, Entamoeba invadens
TEKGSEESL

SEQ ID NO: 2912536 - protein, 8 aa, Entamoeba invadens
TEKGSIQS

SEQ ID NO: 2912537 - protein, 4 aa, Entamoeba invadens
TEKH

SEQ ID NO: 2912538 - protein, 6 aa, Entamoeba invadens
TEKHLS

SEQ ID NO: 2912539 - protein, 6 aa, Entamoeba invadens
TEKHND

SEQ ID NO: 2912540 - protein, 8 aa, Entamoeba invadens
TEKHNDDH

SEQ ID NO: 2912541 - protein, 18 aa, Entamoeba invadens
TEKIDSNPNVVKESADVK

SEQ ID NO: 2912542 - protein, 6 aa, Entamoeba invadens
TEKKED

SEQ ID NO: 2912543 - protein, 5 aa, Entamoeba invadens
TEKKK

SEQ ID NO: 2912544 - protein, 16 aa, Entamoeba invadens
TEKKKYMPTRKGGVAK

SEQ ID NO: 2912545 - protein, 8 aa, Entamoeba invadens
TEKKNEIQ

SEQ ID NO: 2912546 - protein, 11 aa, Entamoeba invadens
TEKKYYADGEN

SEQ ID NO: 2912547 - protein, 18 aa, Entamoeba invadens
TEKLEEATPLVEGEERKR

SEQ ID NO: 2912548 - protein, 4 aa, Entamoeba invadens
TEKM

SEQ ID NO: 2912549 - protein, 13 aa, Entamoeba invadens
TEKMQKQINDLYR

SEQ ID NO: 2912550 - protein, 10 aa, Entamoeba invadens
TEKMQQKNEE

SEQ ID NO: 2912551 - protein, 4 aa, Entamoeba invadens
TEKN

SEQ ID NO: 2912552 - protein, 16 aa, Entamoeba invadens
TEKNCATAKHEDGGLS

SEQ ID NO: 2912553 - protein, 11 aa, Entamoeba invadens
TEKNDNLRSQS

SEQ ID NO: 2912554 - protein, 12 aa, Entamoeba invadens
TEKNEDSENKGV

SEQ ID NO: 2912555 - protein, 10 aa, Entamoeba invadens
TEKNEEKNCF

SEQ ID NO: 2912556 - protein, 11 aa, Entamoeba invadens
TEKNGKPLPFK

SEQ ID NO: 2912557 - protein, 14 aa, Entamoeba invadens
TEKNREKWMKYIDG

SEQ ID NO: 2912558 - protein, 13 aa, Entamoeba invadens
TEKNSRLPNDQEK

SEQ ID NO: 2912559 - protein, 9 aa, Entamoeba invadens
TEKPEDHRK

SEQ ID NO: 2912560 - protein, 27 aa, Entamoeba invadens
TEKPKKAQPADSAKQGDAPKKKKACLI

SEQ ID NO: 2912561 - protein, 12 aa, Entamoeba invadens
TEKPSFSLSTEP

SEQ ID NO: 2912562 - protein, 9 aa, Entamoeba invadens
TEKQSSFKS

SEQ ID NO: 2912563 - protein, 4 aa, Entamoeba invadens
TEKR

SEQ ID NO: 2912564 - protein, 9 aa, Entamoeba invadens
TEKRGESCI

SEQ ID NO: 2912565 - protein, 4 aa, Entamoeba invadens
TEKS

SEQ ID NO: 2912566 - protein, 14 aa, Entamoeba invadens
TEKSECSRLLVLQA

SEQ ID NO: 2912567 - protein, 6 aa, Entamoeba invadens
TEKSMS

SEQ ID NO: 2912568 - protein, 9 aa, Entamoeba invadens
TEKSNEDIL

SEQ ID NO: 2912569 - protein, 7 aa, Entamoeba invadens
TEKSPTF

SEQ ID NO: 2912570 - protein, 5 aa, Entamoeba invadens
TEKSQ

SEQ ID NO: 2912571 - protein, 6 aa, Entamoeba invadens
TEKSQV

SEQ ID NO: 2912572 - protein, 5 aa, Entamoeba invadens
TEKSR

SEQ ID NO: 2912573 - protein, 5 aa, Entamoeba invadens
TEKSY

SEQ ID NO: 2912574 - protein, 4 aa, Entamoeba invadens
TEKT

SEQ ID NO: 2912575 - protein, 7 aa, Entamoeba invadens
TEKTDTL

SEQ ID NO: 2912576 - protein, 12 aa, Entamoeba invadens
TEKTEVADRANM

SEQ ID NO: 2912577 - protein, 8 aa, Entamoeba invadens
TEKTGKEM

SEQ ID NO: 2912578 - protein, 10 aa, Entamoeba invadens
TEKTKKSNRD

SEQ ID NO: 2912579 - protein, 10 aa, Entamoeba invadens
TEKTKNPFGL

SEQ ID NO: 2912580 - protein, 5 aa, Entamoeba invadens
TEKTN

SEQ ID NO: 2912581 - protein, 9 aa, Entamoeba invadens
TEKTSQEVD

SEQ ID NO: 2912582 - protein, 5 aa, Entamoeba invadens
TEKTY

SEQ ID NO: 2912583 - protein, 9 aa, Entamoeba invadens
TEKTYNESL

SEQ ID NO: 2912584 - protein, 7 aa, Entamoeba invadens
TEKTYTQ

SEQ ID NO: 2912585 - protein, 6 aa, Entamoeba invadens
TEKTYV

SEQ ID NO: 2912586 - protein, 5 aa, Entamoeba invadens
TEKVE

SEQ ID NO: 2912587 - protein, 11 aa, Entamoeba invadens
TEKVEKQETPL

SEQ ID NO: 2912588 - protein, 13 aa, Entamoeba invadens
TEKVHEGSKTLAN

SEQ ID NO: 2912589 - protein, 5 aa, Entamoeba invadens
TEKVQ

SEQ ID NO: 2912590 - protein, 8 aa, Entamoeba invadens
TEKVQQED

SEQ ID NO: 2912591 - protein, 4 aa, Entamoeba invadens
TEKY

SEQ ID NO: 2912592 - protein, 9 aa, Entamoeba invadens
TEKYEEDTF

SEQ ID NO: 2912593 - protein, 5 aa, Entamoeba invadens
TEKYN

SEQ ID NO: 2912594 - protein, 35 aa, Entamoeba invadens
TELAPKDPNPEKTSADEDSDRETDESLKDKRDWDE

SEQ ID NO: 2912595 - protein, 4 aa, Entamoeba invadens
TELD

SEQ ID NO: 2912596 - protein, 9 aa, Entamoeba invadens
TELDEGPRI

SEQ ID NO: 2912597 - protein, 5 aa, Entamoeba invadens
TELDK

SEQ ID NO: 2912598 - protein, 10 aa, Entamoeba invadens
TELDQPDQYL

SEQ ID NO: 2912599 - protein, 11 aa, Entamoeba invadens
TELEDEYSKKY

SEQ ID NO: 2912600 - protein, 10 aa, Entamoeba invadens
TELEGESQFE

SEQ ID NO: 2912601 - protein, 12 aa, Entamoeba invadens
TELGQNPSRISE

SEQ ID NO: 2912602 - protein, 5 aa, Entamoeba invadens
TELGR

SEQ ID NO: 2912603 - protein, 24 aa, Entamoeba invadens
TELKDEQQELDEYEKLDKQRKGIE

SEQ ID NO: 2912604 - protein, 10 aa, Entamoeba invadens
TELKEKVAKK

SEQ ID NO: 2912605 - protein, 21 aa, Entamoeba invadens
TELKSKQKEIDTLDKDKQNYL

SEQ ID NO: 2912606 - protein, 14 aa, Entamoeba invadens
TELNENRVSDDTSY

SEQ ID NO: 2912607 - protein, 6 aa, Entamoeba invadens
TELNEQ

SEQ ID NO: 2912608 - protein, 6 aa, Entamoeba invadens
TELNKD

SEQ ID NO: 2912609 - protein, 17 aa, Entamoeba invadens
TELPDEAKTIKGRTPDT

SEQ ID NO: 2912610 - protein, 6 aa, Entamoeba invadens
TELPEN

SEQ ID NO: 2912611 - protein, 13 aa, Entamoeba invadens
TELPKSGDIDLSS

SEQ ID NO: 2912612 - protein, 13 aa, Entamoeba invadens
TELPRKKKRKRSF

SEQ ID NO: 2912613 - protein, 6 aa, Entamoeba invadens
TELQEY

SEQ ID NO: 2912614 - protein, 4 aa, Entamoeba invadens
TELR

SEQ ID NO: 2912615 - protein, 4 aa, Entamoeba invadens
TELS

SEQ ID NO: 2912616 - protein, 20 aa, Entamoeba invadens
TELSGTTEKVQTKVNKNEAI

SEQ ID NO: 2912617 - protein, 7 aa, Entamoeba invadens
TELSSYK

SEQ ID NO: 2912618 - protein, 23 aa, Entamoeba invadens
TELTEKEKKSQDKITQLQSEIGQ

SEQ ID NO: 2912619 - protein, 8 aa, Entamoeba invadens
TELTENGK

SEQ ID NO: 2912620 - protein, 11 aa, Entamoeba invadens
TELTKSKKLNK

SEQ ID NO: 2912621 - protein, 20 aa, Entamoeba invadens
TELTSKQKEIDTLNKDKQNF

SEQ ID NO: 2912622 - protein, 5 aa, Entamoeba invadens
TEMDG

SEQ ID NO: 2912623 - protein, 12 aa, Entamoeba invadens
TEMESTSKKPKF

SEQ ID NO: 2912624 - protein, 12 aa, Entamoeba invadens
TEMGKKKAAQLN

SEQ ID NO: 2912625 - protein, 10 aa, Entamoeba invadens
TEMKEQQQKL

SEQ ID NO: 2912626 - protein, 18 aa, Entamoeba invadens
TEMKGITEETKKDEKEDN

SEQ ID NO: 2912627 - protein, 12 aa, Entamoeba invadens
TEMNSRLDPTEI

SEQ ID NO: 2912628 - protein, 16 aa, Entamoeba invadens
TEMQSNENTNASPANS

SEQ ID NO: 2912629 - protein, 13 aa, Entamoeba invadens
TEMSEGKNGAMRN

SEQ ID NO: 2912630 - protein, 9 aa, Entamoeba invadens
TEMSEYTER

SEQ ID NO: 2912631 - protein, 4 aa, Entamoeba invadens
TEMT

SEQ ID NO: 2912632 - protein, 22 aa, Entamoeba invadens
TEMTSTRSSVSNLTRDSNDKIA

SEQ ID NO: 2912633 - protein, 8 aa, Entamoeba invadens
TENALESH

SEQ ID NO: 2912634 - protein, 6 aa, Entamoeba invadens
TENALP

SEQ ID NO: 2912635 - protein, 15 aa, Entamoeba invadens
TENCHRKDTSTNYKQ

SEQ ID NO: 2912636 - protein, 4 aa, Entamoeba invadens
TEND

SEQ ID NO: 2912637 - protein, 11 aa, Entamoeba invadens
TENDASTRNEC

SEQ ID NO: 2912638 - protein, 16 aa, Entamoeba invadens
TENDDGEQAGPSGYNT

SEQ ID NO: 2912639 - protein, 15 aa, Entamoeba invadens
TENDEFSGKKKIERK

SEQ ID NO: 2912640 - protein, 7 aa, Entamoeba invadens
TENDGNI

SEQ ID NO: 2912641 - protein, 12 aa, Entamoeba invadens
TENDLNKKRPYD

SEQ ID NO: 2912642 - protein, 10 aa, Entamoeba invadens
TENDNQDAFN

SEQ ID NO: 2912643 - protein, 7 aa, Entamoeba invadens
TENDVTV

SEQ ID NO: 2912644 - protein, 42 aa, Entamoeba invadens
TENEENAYSQSDDGDLSYSSSTGSDTNTSESSDDDADMSSSE

SEQ ID NO: 2912645 - protein, 25 aa, Entamoeba invadens
TENEESDGKTDVEMQNEKEKIERKL

SEQ ID NO: 2912646 - protein, 6 aa, Entamoeba invadens
TENELG

SEQ ID NO: 2912647 - protein, 7 aa, Entamoeba invadens
TENETIS

SEQ ID NO: 2912648 - protein, 13 aa, Entamoeba invadens
TENEVDLDAASDA

SEQ ID NO: 2912649 - protein, 7 aa, Entamoeba invadens
TENFSGA

SEQ ID NO: 2912650 - protein, 7 aa, Entamoeba invadens
TENGAQR

SEQ ID NO: 2912651 - protein, 10 aa, Entamoeba invadens
TENGDTNPIK

SEQ ID NO: 2912652 - protein, 6 aa, Entamoeba invadens
TENGEV

SEQ ID NO: 2912653 - protein, 10 aa, Entamoeba invadens
TENGEVDPST

SEQ ID NO: 2912654 - protein, 6 aa, Entamoeba invadens
TENGIK

SEQ ID NO: 2912655 - protein, 7 aa, Entamoeba invadens
TENGKIS

SEQ ID NO: 2912656 - protein, 8 aa, Entamoeba invadens
TENGKISY

SEQ ID NO: 2912657 - protein, 11 aa, Entamoeba invadens
TENGLKKEGPL

SEQ ID NO: 2912658 - protein, 5 aa, Entamoeba invadens
TENGN

SEQ ID NO: 2912659 - protein, 8 aa, Entamoeba invadens
TENHEEEL

SEQ ID NO: 2912660 - protein, 5 aa, Entamoeba invadens
TENIE

SEQ ID NO: 2912661 - protein, 4 aa, Entamoeba invadens
TENK

SEQ ID NO: 2912662 - protein, 8 aa, Entamoeba invadens
TENKDATV

SEQ ID NO: 2912663 - protein, 11 aa, Entamoeba invadens
TENKTQQQKTF

SEQ ID NO: 2912664 - protein, 4 aa, Entamoeba invadens
TENL

SEQ ID NO: 2912665 - protein, 6 aa, Entamoeba invadens
TENLRK

SEQ ID NO: 2912666 - protein, 11 aa, Entamoeba invadens
TENLTKSLSEI

SEQ ID NO: 2912667 - protein, 18 aa, Entamoeba invadens
TENMENVENDEEGQTKSA

SEQ ID NO: 2912668 - protein, 7 aa, Entamoeba invadens
TENMTTV

SEQ ID NO: 2912669 - protein, 7 aa, Entamoeba invadens
TENNANG

SEQ ID NO: 2912670 - protein, 8 aa, Entamoeba invadens
TENNIGKI

SEQ ID NO: 2912671 - protein, 5 aa, Entamoeba invadens
TENNN

SEQ ID NO: 2912672 - protein, 5 aa, Entamoeba invadens
TENNV

SEQ ID NO: 2912673 - protein, 14 aa, Entamoeba invadens
TENPKRMESYPSHN

SEQ ID NO: 2912674 - protein, 10 aa, Entamoeba invadens
TENPTTTPAN

SEQ ID NO: 2912675 - protein, 7 aa, Entamoeba invadens
TENPTYE

SEQ ID NO: 2912676 - protein, 10 aa, Entamoeba invadens
TENPYDAKPF

SEQ ID NO: 2912677 - protein, 6 aa, Entamoeba invadens
TENQRR

SEQ ID NO: 2912678 - protein, 5 aa, Entamoeba invadens
TENRD

SEQ ID NO: 2912679 - protein, 8 aa, Entamoeba invadens
TENREEEI

SEQ ID NO: 2912680 - protein, 13 aa, Entamoeba invadens
TENRGYLTEEEMR

SEQ ID NO: 2912681 - protein, 7 aa, Entamoeba invadens
TENRKTC

SEQ ID NO: 2912682 - protein, 7 aa, Entamoeba invadens
TENRPTS

SEQ ID NO: 2912683 - protein, 21 aa, Entamoeba invadens
TENSEENGEKEEQQKVEEKEM

SEQ ID NO: 2912684 - protein, 8 aa, Entamoeba invadens
TENSEQMK

SEQ ID NO: 2912685 - protein, 9 aa, Entamoeba invadens
TENSESCPC

SEQ ID NO: 2912686 - protein, 15 aa, Entamoeba invadens
TENSEYQKPKPLTVD

SEQ ID NO: 2912687 - protein, 9 aa, Entamoeba invadens
TENSGDHHK

SEQ ID NO: 2912688 - protein, 8 aa, Entamoeba invadens
TENSKNLN

SEQ ID NO: 2912689 - protein, 11 aa, Entamoeba invadens
TENSQNALSGQ

SEQ ID NO: 2912690 - protein, 5 aa, Entamoeba invadens
TENTT

SEQ ID NO: 2912691 - protein, 6 aa, Entamoeba invadens
TENTTL

SEQ ID NO: 2912692 - protein, 8 aa, Entamoeba invadens
TENTTLTK

SEQ ID NO: 2912693 - protein, 6 aa, Entamoeba invadens
TENVNE

SEQ ID NO: 2912694 - protein, 49 aa, Entamoeba invadens
TENVSSLDDKQKAELKSRRNEASKTAASSYTKAKETDEWRDAKSQAKVV

SEQ ID NO: 2912695 - protein, 8 aa, Entamoeba invadens
TENWGDEE

SEQ ID NO: 2912696 - protein, 6 aa, Entamoeba invadens
TENWTE

SEQ ID NO: 2912697 - protein, 13 aa, Entamoeba invadens
TEPAGSVLSATNT

SEQ ID NO: 2912698 - protein, 8 aa, Entamoeba invadens
TEPDHSGS

SEQ ID NO: 2912699 - protein, 7 aa, Entamoeba invadens
TEPERKS

SEQ ID NO: 2912700 - protein, 7 aa, Entamoeba invadens
TEPETGY

SEQ ID NO: 2912701 - protein, 9 aa, Entamoeba invadens
TEPFPEDDN

SEQ ID NO: 2912702 - protein, 10 aa, Entamoeba invadens
TEPHKDVSSH

SEQ ID NO: 2912703 - protein, 12 aa, Entamoeba invadens
TEPHSSTTNELI

SEQ ID NO: 2912704 - protein, 7 aa, Entamoeba invadens
TEPIPPL

SEQ ID NO: 2912705 - protein, 15 aa, Entamoeba invadens
TEPIQAGLPTAPSRD

SEQ ID NO: 2912706 - protein, 7 aa, Entamoeba invadens
TEPIRAR

SEQ ID NO: 2912707 - protein, 4 aa, Entamoeba invadens
TEPL

SEQ ID NO: 2912708 - protein, 18 aa, Entamoeba invadens
TEPLPQKKMTAAQQGDLT

SEQ ID NO: 2912709 - protein, 9 aa, Entamoeba invadens
TEPNEESTL

SEQ ID NO: 2912710 - protein, 14 aa, Entamoeba invadens
TEPNGTPRQGSMAP

SEQ ID NO: 2912711 - protein, 6 aa, Entamoeba invadens
TEPNPK

SEQ ID NO: 2912712 - protein, 6 aa, Entamoeba invadens
TEPNTA

SEQ ID NO: 2912713 - protein, 6 aa, Entamoeba invadens
TEPNYY

SEQ ID NO: 2912714 - protein, 46 aa, Entamoeba invadens
TEPPDISESNDNSISQNNDDQDDKENKTLKNQSIRESSHESEEDYY

SEQ ID NO: 2912715 - protein, 9 aa, Entamoeba invadens
TEPPQFPQS

SEQ ID NO: 2912716 - protein, 9 aa, Entamoeba invadens
TEPQQQKLR

SEQ ID NO: 2912717 - protein, 12 aa, Entamoeba invadens
TEPQTQEQKTIE

SEQ ID NO: 2912718 - protein, 6 aa, Entamoeba invadens
TEPRET

SEQ ID NO: 2912719 - protein, 6 aa, Entamoeba invadens
TEPSLI

SEQ ID NO: 2912720 - protein, 4 aa, Entamoeba invadens
TEPT

SEQ ID NO: 2912721 - protein, 6 aa, Entamoeba invadens
TEPTNP

SEQ ID NO: 2912722 - protein, 5 aa, Entamoeba invadens
TEPTP

SEQ ID NO: 2912723 - protein, 6 aa, Entamoeba invadens
TEPVRR

SEQ ID NO: 2912724 - protein, 5 aa, Entamoeba invadens
TEQAY

SEQ ID NO: 2912725 - protein, 7 aa, Entamoeba invadens
TEQDYDS

SEQ ID NO: 2912726 - protein, 6 aa, Entamoeba invadens
TEQEDQ

SEQ ID NO: 2912727 - protein, 6 aa, Entamoeba invadens
TEQEEY

SEQ ID NO: 2912728 - protein, 59 aa, Entamoeba invadens
TEQEKNNKLNEELDNIKNEKNKITNQLKTTEKEKDKIESELNTQKEKTTQQEKIINEKE

SEQ ID NO: 2912729 - protein, 51 aa, Entamoeba invadens
TEQEKNNKLNEELKKSQNDKDKVANQLKTTEEEKNKIESELKKKDDELNVA

SEQ ID NO: 2912730 - protein, 19 aa, Entamoeba invadens
TEQEKTDEEIGKKPTKKSA

SEQ ID NO: 2912731 - protein, 4 aa, Entamoeba invadens
TEQG

SEQ ID NO: 2912732 - protein, 10 aa, Entamoeba invadens
TEQGINKAKE

SEQ ID NO: 2912733 - protein, 5 aa, Entamoeba invadens
TEQGV

SEQ ID NO: 2912734 - protein, 4 aa, Entamoeba invadens
TEQI

SEQ ID NO: 2912735 - protein, 7 aa, Entamoeba invadens
TEQIKEV

SEQ ID NO: 2912736 - protein, 7 aa, Entamoeba invadens
TEQISEG

SEQ ID NO: 2912737 - protein, 6 aa, Entamoeba invadens
TEQKNG

SEQ ID NO: 2912738 - protein, 6 aa, Entamoeba invadens
TEQKWD

SEQ ID NO: 2912739 - protein, 10 aa, Entamoeba invadens
TEQLNSSDKV

SEQ ID NO: 2912740 - protein, 51 aa, Entamoeba invadens
TEQLNSSDKVSHKKQMSVEESQVSNSSNQPTELSTGKLSHNSKSSDTDKLI

SEQ ID NO: 2912741 - protein, 5 aa, Entamoeba invadens
TEQNL

SEQ ID NO: 2912742 - protein, 7 aa, Entamoeba invadens
TEQNRED

SEQ ID NO: 2912743 - protein, 7 aa, Entamoeba invadens
TEQPIAA

SEQ ID NO: 2912744 - protein, 6 aa, Entamoeba invadens
TEQQLT

SEQ ID NO: 2912745 - protein, 9 aa, Entamoeba invadens
TEQQPISTH

SEQ ID NO: 2912746 - protein, 4 aa, Entamoeba invadens
TEQR

SEQ ID NO: 2912747 - protein, 9 aa, Entamoeba invadens
TEQRTPKQL

SEQ ID NO: 2912748 - protein, 8 aa, Entamoeba invadens
TEQSKEAQ

SEQ ID NO: 2912749 - protein, 14 aa, Entamoeba invadens
TEQSPPIIPKSQTE

SEQ ID NO: 2912750 - protein, 13 aa, Entamoeba invadens
TEQSQELEKNKEL

SEQ ID NO: 2912751 - protein, 8 aa, Entamoeba invadens
TEQTENVS

SEQ ID NO: 2912752 - protein, 6 aa, Entamoeba invadens
TEQTTC

SEQ ID NO: 2912753 - protein, 18 aa, Entamoeba invadens
TEQTVAKPLNGVENSDVK

SEQ ID NO: 2912754 - protein, 5 aa, Entamoeba invadens
TEQVA

SEQ ID NO: 2912755 - protein, 6 aa, Entamoeba invadens
TEQVTQ

SEQ ID NO: 2912756 - protein, 6 aa, Entamoeba invadens
TEQYNE

SEQ ID NO: 2912757 - protein, 4 aa, Entamoeba invadens
TERA

SEQ ID NO: 2912758 - protein, 5 aa, Entamoeba invadens
TERAT

SEQ ID NO: 2912759 - protein, 9 aa, Entamoeba invadens
TERCDRDKC

SEQ ID NO: 2912760 - protein, 8 aa, Entamoeba invadens
TERDDEIR

SEQ ID NO: 2912761 - protein, 7 aa, Entamoeba invadens
TERDTEG

SEQ ID NO: 2912762 - protein, 29 aa, Entamoeba invadens
TEREERKFEEQKKRAKIEKQKKEEKLKSE

SEQ ID NO: 2912763 - protein, 41 aa, Entamoeba invadens
TEREKPSPPPKREKSFESLPSKVPMTSKDFNNTLTKEEQAE

SEQ ID NO: 2912764 - protein, 11 aa, Entamoeba invadens
TERGKKEIQNM

SEQ ID NO: 2912765 - protein, 12 aa, Entamoeba invadens
TERGKRKAEPTF

SEQ ID NO: 2912766 - protein, 16 aa, Entamoeba invadens
TERIAKEKAEQEAREL

SEQ ID NO: 2912767 - protein, 4 aa, Entamoeba invadens
TERK

SEQ ID NO: 2912768 - protein, 11 aa, Entamoeba invadens
TERLDKKTFET

SEQ ID NO: 2912769 - protein, 5 aa, Entamoeba invadens
TERLE

SEQ ID NO: 2912770 - protein, 6 aa, Entamoeba invadens
TERNPA

SEQ ID NO: 2912771 - protein, 6 aa, Entamoeba invadens
TERPEK

SEQ ID NO: 2912772 - protein, 4 aa, Entamoeba invadens
TERQ

SEQ ID NO: 2912773 - protein, 8 aa, Entamoeba invadens
TERQEGKL

SEQ ID NO: 2912774 - protein, 29 aa, Entamoeba invadens
TERREKEGRRDGERPRSRSRSRESRRSEL

SEQ ID NO: 2912775 - protein, 30 aa, Entamoeba invadens
TERRISSEKQSEEKKPRKSEKEKNKKDGVC

SEQ ID NO: 2912776 - protein, 4 aa, Entamoeba invadens
TERS

SEQ ID NO: 2912777 - protein, 5 aa, Entamoeba invadens
TERSD

SEQ ID NO: 2912778 - protein, 6 aa, Entamoeba invadens
TERSHM

SEQ ID NO: 2912779 - protein, 7 aa, Entamoeba invadens
TERSLKD

SEQ ID NO: 2912780 - protein, 7 aa, Entamoeba invadens
TERTNVS

SEQ ID NO: 2912781 - protein, 4 aa, Entamoeba invadens
TERV

SEQ ID NO: 2912782 - protein, 4 aa, Entamoeba invadens
TERY

SEQ ID NO: 2912783 - protein, 8 aa, Entamoeba invadens
TERYPPHE

SEQ ID NO: 2912784 - protein, 4 aa, Entamoeba invadens
TESA

SEQ ID NO: 2912785 - protein, 20 aa, Entamoeba invadens
TESAPTGAAPKSRSFHNEEE

SEQ ID NO: 2912786 - protein, 10 aa, Entamoeba invadens
TESAREYQLP

SEQ ID NO: 2912787 - protein, 8 aa, Entamoeba invadens
TESASSKL

SEQ ID NO: 2912788 - protein, 8 aa, Entamoeba invadens
TESATWTD

SEQ ID NO: 2912789 - protein, 6 aa, Entamoeba invadens
TESCGG

SEQ ID NO: 2912790 - protein, 5 aa, Entamoeba invadens
TESDA

SEQ ID NO: 2912791 - protein, 12 aa, Entamoeba invadens
TESDFSSIQEIN

SEQ ID NO: 2912792 - protein, 9 aa, Entamoeba invadens
TESDGEQRD

SEQ ID NO: 2912793 - protein, 5 aa, Entamoeba invadens
TESDK

SEQ ID NO: 2912794 - protein, 4 aa, Entamoeba invadens
TESE

SEQ ID NO: 2912795 - protein, 10 aa, Entamoeba invadens
TESEAGRESV

SEQ ID NO: 2912796 - protein, 10 aa, Entamoeba invadens
TESEAQNAIE

SEQ ID NO: 2912797 - protein, 7 aa, Entamoeba invadens
TESEKNS

SEQ ID NO: 2912798 - protein, 10 aa, Entamoeba invadens
TESELTEKGN

SEQ ID NO: 2912799 - protein, 15 aa, Entamoeba invadens
TESETRELCSSEEYE

SEQ ID NO: 2912800 - protein, 11 aa, Entamoeba invadens
TESFASKNEVI

SEQ ID NO: 2912801 - protein, 5 aa, Entamoeba invadens
TESGC

SEQ ID NO: 2912802 - protein, 20 aa, Entamoeba invadens
TESGCSTCKDGYYTVNGNEC

SEQ ID NO: 2912803 - protein, 8 aa, Entamoeba invadens
TESGESAI

SEQ ID NO: 2912804 - protein, 7 aa, Entamoeba invadens
TESGKTS

SEQ ID NO: 2912805 - protein, 7 aa, Entamoeba invadens
TESGLEE

SEQ ID NO: 2912806 - protein, 6 aa, Entamoeba invadens
TESGNV

SEQ ID NO: 2912807 - protein, 5 aa, Entamoeba invadens
TESGP

SEQ ID NO: 2912808 - protein, 10 aa, Entamoeba invadens
TESGQRQMDA

SEQ ID NO: 2912809 - protein, 7 aa, Entamoeba invadens
TESGTTA

SEQ ID NO: 2912810 - protein, 11 aa, Entamoeba invadens
TESISSNETRL

SEQ ID NO: 2912811 - protein, 7 aa, Entamoeba invadens
TESITNI

SEQ ID NO: 2912812 - protein, 6 aa, Entamoeba invadens
TESITS

SEQ ID NO: 2912813 - protein, 25 aa, Entamoeba invadens
TESKCQIRDNKGCQRCNDGYYDENN

SEQ ID NO: 2912814 - protein, 41 aa, Entamoeba invadens
TESKNAEKRRKKEEKEKKLNIENEKTKEPAPSDNNGTPQKM

SEQ ID NO: 2912815 - protein, 5 aa, Entamoeba invadens
TESMD

SEQ ID NO: 2912816 - protein, 5 aa, Entamoeba invadens
TESME

SEQ ID NO: 2912817 - protein, 8 aa, Entamoeba invadens
TESNFDKG

SEQ ID NO: 2912818 - protein, 16 aa, Entamoeba invadens
TESNRSSKHKSLKQEF

SEQ ID NO: 2912819 - protein, 9 aa, Entamoeba invadens
TESPEAAQT

SEQ ID NO: 2912820 - protein, 7 aa, Entamoeba invadens
TESPSGN

SEQ ID NO: 2912821 - protein, 7 aa, Entamoeba invadens
TESQEEN

SEQ ID NO: 2912822 - protein, 5 aa, Entamoeba invadens
TESQW

SEQ ID NO: 2912823 - protein, 6 aa, Entamoeba invadens
TESRIR

SEQ ID NO: 2912824 - protein, 6 aa, Entamoeba invadens
TESRYK

SEQ ID NO: 2912825 - protein, 8 aa, Entamoeba invadens
TESSLGMQ

SEQ ID NO: 2912826 - protein, 14 aa, Entamoeba invadens
TESSPTPKESETEL

SEQ ID NO: 2912827 - protein, 13 aa, Entamoeba invadens
TESSTKRYVPRTT

SEQ ID NO: 2912828 - protein, 5 aa, Entamoeba invadens
TESTF

SEQ ID NO: 2912829 - protein, 4 aa, Entamoeba invadens
TESV

SEQ ID NO: 2912830 - protein, 14 aa, Entamoeba invadens
TESVGDGESLEEEV

SEQ ID NO: 2912831 - protein, 5 aa, Entamoeba invadens
TESVY

SEQ ID NO: 2912832 - protein, 6 aa, Entamoeba invadens
TESYGS

SEQ ID NO: 2912833 - protein, 6 aa, Entamoeba invadens
TETAKG

SEQ ID NO: 2912834 - protein, 10 aa, Entamoeba invadens
TETASPRVEL

SEQ ID NO: 2912835 - protein, 4 aa, Entamoeba invadens
TETD

SEQ ID NO: 2912836 - protein, 10 aa, Entamoeba invadens
TETDEEGKEL

SEQ ID NO: 2912837 - protein, 8 aa, Entamoeba invadens
TETDEWNS

SEQ ID NO: 2912838 - protein, 5 aa, Entamoeba invadens
TETDL

SEQ ID NO: 2912839 - protein, 4 aa, Entamoeba invadens
TETE

SEQ ID NO: 2912840 - protein, 6 aa, Entamoeba invadens
TETERS

SEQ ID NO: 2912841 - protein, 5 aa, Entamoeba invadens
TETES

SEQ ID NO: 2912842 - protein, 4 aa, Entamoeba invadens
TETF

SEQ ID NO: 2912843 - protein, 5 aa, Entamoeba invadens
TETFD

SEQ ID NO: 2912844 - protein, 12 aa, Entamoeba invadens
TETFEYGNKEYG

SEQ ID NO: 2912845 - protein, 11 aa, Entamoeba invadens
TETHRNKFPSP

SEQ ID NO: 2912846 - protein, 4 aa, Entamoeba invadens
TETI

SEQ ID NO: 2912847 - protein, 5 aa, Entamoeba invadens
TETIF

SEQ ID NO: 2912848 - protein, 6 aa, Entamoeba invadens
TETIGD

SEQ ID NO: 2912849 - protein, 10 aa, Entamoeba invadens
TETKDSSDIS

SEQ ID NO: 2912850 - protein, 7 aa, Entamoeba invadens
TETKFTR

SEQ ID NO: 2912851 - protein, 8 aa, Entamoeba invadens
TETLPNDM

SEQ ID NO: 2912852 - protein, 6 aa, Entamoeba invadens
TETMGK

SEQ ID NO: 2912853 - protein, 13 aa, Entamoeba invadens
TETMKSKDDVTPT

SEQ ID NO: 2912854 - protein, 4 aa, Entamoeba invadens
TETN

SEQ ID NO: 2912855 - protein, 4 aa, Entamoeba invadens
TETP

SEQ ID NO: 2912856 - protein, 8 aa, Entamoeba invadens
TETPIAEG

SEQ ID NO: 2912857 - protein, 6 aa, Entamoeba invadens
TETPTG

SEQ ID NO: 2912858 - protein, 6 aa, Entamoeba invadens
TETPVK

SEQ ID NO: 2912859 - protein, 7 aa, Entamoeba invadens
TETPWDK

SEQ ID NO: 2912860 - protein, 5 aa, Entamoeba invadens
TETQD

SEQ ID NO: 2912861 - protein, 5 aa, Entamoeba invadens
TETQT

SEQ ID NO: 2912862 - protein, 6 aa, Entamoeba invadens
TETSAH

SEQ ID NO: 2912863 - protein, 8 aa, Entamoeba invadens
TETSGLTS

SEQ ID NO: 2912864 - protein, 5 aa, Entamoeba invadens
TETSK

SEQ ID NO: 2912865 - protein, 15 aa, Entamoeba invadens
TETSSCSSGDEALEL

SEQ ID NO: 2912866 - protein, 11 aa, Entamoeba invadens
TETSSCVDSPN

SEQ ID NO: 2912867 - protein, 4 aa, Entamoeba invadens
TETT

SEQ ID NO: 2912868 - protein, 8 aa, Entamoeba invadens
TETTAEGV

SEQ ID NO: 2912869 - protein, 6 aa, Entamoeba invadens
TETTEP

SEQ ID NO: 2912870 - protein, 9 aa, Entamoeba invadens
TETTQKRLE

SEQ ID NO: 2912871 - protein, 9 aa, Entamoeba invadens
TETTSVISS

SEQ ID NO: 2912872 - protein, 8 aa, Entamoeba invadens
TETVNHPT

SEQ ID NO: 2912873 - protein, 13 aa, Entamoeba invadens
TETVSTTAKEIDN

SEQ ID NO: 2912874 - protein, 8 aa, Entamoeba invadens
TETYNSVS

SEQ ID NO: 2912875 - protein, 9 aa, Entamoeba invadens
TEVDDQEKC

SEQ ID NO: 2912876 - protein, 4 aa, Entamoeba invadens
TEVE

SEQ ID NO: 2912877 - protein, 19 aa, Entamoeba invadens
TEVEEEKEEVRKRPKSDSF

SEQ ID NO: 2912878 - protein, 10 aa, Entamoeba invadens
TEVEKAGNKV

SEQ ID NO: 2912879 - protein, 8 aa, Entamoeba invadens
TEVEQNRQ

SEQ ID NO: 2912880 - protein, 5 aa, Entamoeba invadens
TEVGP

SEQ ID NO: 2912881 - protein, 13 aa, Entamoeba invadens
TEVGYEDTRVGAM

SEQ ID NO: 2912882 - protein, 11 aa, Entamoeba invadens
TEVKNSEFGRT

SEQ ID NO: 2912883 - protein, 20 aa, Entamoeba invadens
TEVKTDPKALKKYQQTFTGK

SEQ ID NO: 2912884 - protein, 16 aa, Entamoeba invadens
TEVKTGYCKENSNTGC

SEQ ID NO: 2912885 - protein, 7 aa, Entamoeba invadens
TEVNENN

SEQ ID NO: 2912886 - protein, 5 aa, Entamoeba invadens
TEVNY

SEQ ID NO: 2912887 - protein, 4 aa, Entamoeba invadens
TEVP

SEQ ID NO: 2912888 - protein, 16 aa, Entamoeba invadens
TEVQESKDIENEEART

SEQ ID NO: 2912889 - protein, 5 aa, Entamoeba invadens
TEVQN

SEQ ID NO: 2912890 - protein, 10 aa, Entamoeba invadens
TEVQTSRENY

SEQ ID NO: 2912891 - protein, 11 aa, Entamoeba invadens
TEVRDSSDPTV

SEQ ID NO: 2912892 - protein, 9 aa, Entamoeba invadens
TEVTNQRNN

SEQ ID NO: 2912893 - protein, 11 aa, Entamoeba invadens
TEVTSANLKNG

SEQ ID NO: 2912894 - protein, 15 aa, Entamoeba invadens
TEVTSEKTIKNKKRV

SEQ ID NO: 2912895 - protein, 5 aa, Entamoeba invadens
TEWHT

SEQ ID NO: 2912896 - protein, 5 aa, Entamoeba invadens
TEWNK

SEQ ID NO: 2912897 - protein, 12 aa, Entamoeba invadens
TEWNTKKLSEHQ

SEQ ID NO: 2912898 - protein, 23 aa, Entamoeba invadens
TEWTERGYKGSAFSHSAADAELG

SEQ ID NO: 2912899 - protein, 16 aa, Entamoeba invadens
TEYAEALTKNGLNSEE

SEQ ID NO: 2912900 - protein, 4 aa, Entamoeba invadens
TEYD

SEQ ID NO: 2912901 - protein, 6 aa, Entamoeba invadens
TEYDDQ

SEQ ID NO: 2912902 - protein, 6 aa, Entamoeba invadens
TEYGNG

SEQ ID NO: 2912903 - protein, 6 aa, Entamoeba invadens
TEYGQK

SEQ ID NO: 2912904 - protein, 5 aa, Entamoeba invadens
TEYHP

SEQ ID NO: 2912905 - protein, 9 aa, Entamoeba invadens
TEYKETYQT

SEQ ID NO: 2912906 - protein, 4 aa, Entamoeba invadens
TEYQ

SEQ ID NO: 2912907 - protein, 16 aa, Entamoeba invadens
TEYQYNSKDCTGTPRS

SEQ ID NO: 2912908 - protein, 10 aa, Entamoeba invadens
TEYSEPIYKQ

SEQ ID NO: 2912909 - protein, 7 aa, Entamoeba invadens
TEYTKEV

SEQ ID NO: 2912910 - protein, 6 aa, Entamoeba invadens
TEYTPL

SEQ ID NO: 2912911 - protein, 45 aa, Entamoeba invadens
TEYTQTKSSVTSIPQAPKSPTDNFDESEQVSQKYDDDASQSKPSI

SEQ ID NO: 2912912 - protein, 10 aa, Entamoeba invadens
TEYTSESDPV

SEQ ID NO: 2912913 - protein, 12 aa, Entamoeba invadens
TFAKDTESSLDP

SEQ ID NO: 2912914 - protein, 8 aa, Entamoeba invadens
TFASGGES

SEQ ID NO: 2912915 - protein, 8 aa, Entamoeba invadens
TFCNGNGS

SEQ ID NO: 2912916 - protein, 5 aa, Entamoeba invadens
TFDDD

SEQ ID NO: 2912917 - protein, 4 aa, Entamoeba invadens
TFDE

SEQ ID NO: 2912918 - protein, 10 aa, Entamoeba invadens
TFDEKPNGEI

SEQ ID NO: 2912919 - protein, 30 aa, Entamoeba invadens
TFDENDKLKTDTKTATETSCQIRNNKGCQH

SEQ ID NO: 2912920 - protein, 27 aa, Entamoeba invadens
TFDENNDFKNYREEYESLDNECPKTPS

SEQ ID NO: 2912921 - protein, 10 aa, Entamoeba invadens
TFDESNYSDK

SEQ ID NO: 2912922 - protein, 7 aa, Entamoeba invadens
TFDGGSS

SEQ ID NO: 2912923 - protein, 6 aa, Entamoeba invadens
TFDGKR

SEQ ID NO: 2912924 - protein, 6 aa, Entamoeba invadens
TFDPID

SEQ ID NO: 2912925 - protein, 12 aa, Entamoeba invadens
TFDPKQDKTIDK

SEQ ID NO: 2912926 - protein, 5 aa, Entamoeba invadens
TFDPQ

SEQ ID NO: 2912927 - protein, 9 aa, Entamoeba invadens
TFDQKQDKH

SEQ ID NO: 2912928 - protein, 8 aa, Entamoeba invadens
TFDSESSA

SEQ ID NO: 2912929 - protein, 7 aa, Entamoeba invadens
TFDTNSN

SEQ ID NO: 2912930 - protein, 9 aa, Entamoeba invadens
TFDTSNNPE

SEQ ID NO: 2912931 - protein, 13 aa, Entamoeba invadens
TFDTSPASFPDED

SEQ ID NO: 2912932 - protein, 7 aa, Entamoeba invadens
TFDTTVS

SEQ ID NO: 2912933 - protein, 5 aa, Entamoeba invadens
TFEDS

SEQ ID NO: 2912934 - protein, 4 aa, Entamoeba invadens
TFEE

SEQ ID NO: 2912935 - protein, 7 aa, Entamoeba invadens
TFEEKKN

SEQ ID NO: 2912936 - protein, 12 aa, Entamoeba invadens
TFEKAKKKDALT

SEQ ID NO: 2912937 - protein, 9 aa, Entamoeba invadens
TFEKETKRN

SEQ ID NO: 2912938 - protein, 6 aa, Entamoeba invadens
TFESEN

SEQ ID NO: 2912939 - protein, 6 aa, Entamoeba invadens
TFESPD

SEQ ID NO: 2912940 - protein, 4 aa, Entamoeba invadens
TFET

SEQ ID NO: 2912941 - protein, 7 aa, Entamoeba invadens
TFETPSK

SEQ ID NO: 2912942 - protein, 10 aa, Entamoeba invadens
TFETPTGNCE

SEQ ID NO: 2912943 - protein, 16 aa, Entamoeba invadens
TFETTNKGKDQLFQNN

SEQ ID NO: 2912944 - protein, 7 aa, Entamoeba invadens
TFGDDEE

SEQ ID NO: 2912945 - protein, 11 aa, Entamoeba invadens
TFGDKKLSDLK

SEQ ID NO: 2912946 - protein, 5 aa, Entamoeba invadens
TFGEG

SEQ ID NO: 2912947 - protein, 10 aa, Entamoeba invadens
TFGEIRGDKD

SEQ ID NO: 2912948 - protein, 9 aa, Entamoeba invadens
TFGEQGGRH

SEQ ID NO: 2912949 - protein, 10 aa, Entamoeba invadens
TFGGKKGLDI

SEQ ID NO: 2912950 - protein, 14 aa, Entamoeba invadens
TFGNSNEKPFKTRE

SEQ ID NO: 2912951 - protein, 32 aa, Entamoeba invadens
TFGNSSKSEDYRATDDKQKVPSPHYENDTDSF

SEQ ID NO: 2912952 - protein, 6 aa, Entamoeba invadens
TFGQKN

SEQ ID NO: 2912953 - protein, 13 aa, Entamoeba invadens
TFGRERPVMVYKS

SEQ ID NO: 2912954 - protein, 11 aa, Entamoeba invadens
TFGSTSPRKSV

SEQ ID NO: 2912955 - protein, 12 aa, Entamoeba invadens
TFGTPKFPTKAE

SEQ ID NO: 2912956 - protein, 20 aa, Entamoeba invadens
TFGTTEDLKPDNTENADNDH

SEQ ID NO: 2912957 - protein, 17 aa, Entamoeba invadens
TFHPSQYPHSASQALPE

SEQ ID NO: 2912958 - protein, 5 aa, Entamoeba invadens
TFIGP

SEQ ID NO: 2912959 - protein, 4 aa, Entamoeba invadens
TFKD

SEQ ID NO: 2912960 - protein, 5 aa, Entamoeba invadens
TFKDA

SEQ ID NO: 2912961 - protein, 10 aa, Entamoeba invadens
TFKGDGGYVT

SEQ ID NO: 2912962 - protein, 13 aa, Entamoeba invadens
TFKPKLDNTEKEM

SEQ ID NO: 2912963 - protein, 9 aa, Entamoeba invadens
TFKPTADSE

SEQ ID NO: 2912964 - protein, 19 aa, Entamoeba invadens
TFKPTSFSNEPKKTLEDDV

SEQ ID NO: 2912965 - protein, 13 aa, Entamoeba invadens
TFKQDEKSTIGAS

SEQ ID NO: 2912966 - protein, 16 aa, Entamoeba invadens
TFKQEKRKQNKGECQL

SEQ ID NO: 2912967 - protein, 15 aa, Entamoeba invadens
TFKSRGGKDVQETFN

SEQ ID NO: 2912968 - protein, 4 aa, Entamoeba invadens
TFKT

SEQ ID NO: 2912969 - protein, 10 aa, Entamoeba invadens
TFKTRQTNRD

SEQ ID NO: 2912970 - protein, 7 aa, Entamoeba invadens
TFNDPRG

SEQ ID NO: 2912971 - protein, 5 aa, Entamoeba invadens
TFNDR

SEQ ID NO: 2912972 - protein, 6 aa, Entamoeba invadens
TFNERK

SEQ ID NO: 2912973 - protein, 6 aa, Entamoeba invadens
TFNGIE

SEQ ID NO: 2912974 - protein, 9 aa, Entamoeba invadens
TFNKNKNRN

SEQ ID NO: 2912975 - protein, 8 aa, Entamoeba invadens
TFNPHTTG

SEQ ID NO: 2912976 - protein, 8 aa, Entamoeba invadens
TFNPRAPT

SEQ ID NO: 2912977 - protein, 7 aa, Entamoeba invadens
TFNPTPD

SEQ ID NO: 2912978 - protein, 12 aa, Entamoeba invadens
TFNQAEKDLSKQ

SEQ ID NO: 2912979 - protein, 24 aa, Entamoeba invadens
TFNQQGNQNLFGTQQQGNTFGQQQ

SEQ ID NO: 2912980 - protein, 20 aa, Entamoeba invadens
TFNSEKSGSESDKNSDDEGV

SEQ ID NO: 2912981 - protein, 11 aa, Entamoeba invadens
TFNSTDGTCAR

SEQ ID NO: 2912982 - protein, 19 aa, Entamoeba invadens
TFNTVGSKTRRWKDRGTSM

SEQ ID NO: 2912983 - protein, 9 aa, Entamoeba invadens
TFPAGGANT

SEQ ID NO: 2912984 - protein, 4 aa, Entamoeba invadens
TFPD

SEQ ID NO: 2912985 - protein, 7 aa, Entamoeba invadens
TFPDPPQ

SEQ ID NO: 2912986 - protein, 5 aa, Entamoeba invadens
TFPDQ

SEQ ID NO: 2912987 - protein, 12 aa, Entamoeba invadens
TFPDTTEKRLGD

SEQ ID NO: 2912988 - protein, 17 aa, Entamoeba invadens
TFPEDKDIDNTEGMDTK

SEQ ID NO: 2912989 - protein, 10 aa, Entamoeba invadens
TFPKKPKKAF

SEQ ID NO: 2912990 - protein, 6 aa, Entamoeba invadens
TFPQRT

SEQ ID NO: 2912991 - protein, 13 aa, Entamoeba invadens
TFPQSSTEAEAIA

SEQ ID NO: 2912992 - protein, 5 aa, Entamoeba invadens
TFPST

SEQ ID NO: 2912993 - protein, 10 aa, Entamoeba invadens
TFPTPPPTRI

SEQ ID NO: 2912994 - protein, 9 aa, Entamoeba invadens
TFQNQKKDG

SEQ ID NO: 2912995 - protein, 9 aa, Entamoeba invadens
TFQNQKKNG

SEQ ID NO: 2912996 - protein, 7 aa, Entamoeba invadens
TFQPKGD

SEQ ID NO: 2912997 - protein, 17 aa, Entamoeba invadens
TFQPPPQQQRVPQPPPQ

SEQ ID NO: 2912998 - protein, 7 aa, Entamoeba invadens
TFQSGNN

SEQ ID NO: 2912999 - protein, 9 aa, Entamoeba invadens
TFQTQQDNI

SEQ ID NO: 2913000 - protein, 8 aa, Entamoeba invadens
TFQTTDYS

SEQ ID NO: 2913001 - protein, 4 aa, Entamoeba invadens
TFRE

SEQ ID NO: 2913002 - protein, 6 aa, Entamoeba invadens
TFRENA

SEQ ID NO: 2913003 - protein, 4 aa, Entamoeba invadens
TFRT

SEQ ID NO: 2913004 - protein, 13 aa, Entamoeba invadens
TFSDQNNTSNGVT

SEQ ID NO: 2913005 - protein, 5 aa, Entamoeba invadens
TFSDY

SEQ ID NO: 2913006 - protein, 5 aa, Entamoeba invadens
TFSEI

SEQ ID NO: 2913007 - protein, 6 aa, Entamoeba invadens
TFSEKI

SEQ ID NO: 2913008 - protein, 4 aa, Entamoeba invadens
TFSG

SEQ ID NO: 2913009 - protein, 13 aa, Entamoeba invadens
TFSGEAYARVWSG

SEQ ID NO: 2913010 - protein, 4 aa, Entamoeba invadens
TFSK

SEQ ID NO: 2913011 - protein, 10 aa, Entamoeba invadens
TFSNGRGQQK

SEQ ID NO: 2913012 - protein, 5 aa, Entamoeba invadens
TFSPP

SEQ ID NO: 2913013 - protein, 7 aa, Entamoeba invadens
TFSPSGK

SEQ ID NO: 2913014 - protein, 13 aa, Entamoeba invadens
TFSPTTSIDDAVS

SEQ ID NO: 2913015 - protein, 9 aa, Entamoeba invadens
TFSRTKYNP

SEQ ID NO: 2913016 - protein, 5 aa, Entamoeba invadens
TFSSE

SEQ ID NO: 2913017 - protein, 6 aa, Entamoeba invadens
TFSSID

SEQ ID NO: 2913018 - protein, 12 aa, Entamoeba invadens
TFSSSATGKRSL

SEQ ID NO: 2913019 - protein, 5 aa, Entamoeba invadens
TFSTN

SEQ ID NO: 2913020 - protein, 5 aa, Entamoeba invadens
TFTDG

SEQ ID NO: 2913021 - protein, 11 aa, Entamoeba invadens
TFTDKGRTTGD

SEQ ID NO: 2913022 - protein, 9 aa, Entamoeba invadens
TFTDNPPTV

SEQ ID NO: 2913023 - protein, 11 aa, Entamoeba invadens
TFTKENTFKQK

SEQ ID NO: 2913024 - protein, 10 aa, Entamoeba invadens
TFTKKESRNE

SEQ ID NO: 2913025 - protein, 6 aa, Entamoeba invadens
TFTPKI

SEQ ID NO: 2913026 - protein, 14 aa, Entamoeba invadens
TFTPKRITVLQLAS

SEQ ID NO: 2913027 - protein, 5 aa, Entamoeba invadens
TFTPS

SEQ ID NO: 2913028 - protein, 9 aa, Entamoeba invadens
TFTQEAEKK

SEQ ID NO: 2913029 - protein, 11 aa, Entamoeba invadens
TFTQEKKDEIL

SEQ ID NO: 2913030 - protein, 11 aa, Entamoeba invadens
TFTQSAQKYAV

SEQ ID NO: 2913031 - protein, 17 aa, Entamoeba invadens
TFTRQDKPIEKKDVKEM

SEQ ID NO: 2913032 - protein, 11 aa, Entamoeba invadens
TFTRTSELTNQ

SEQ ID NO: 2913033 - protein, 4 aa, Entamoeba invadens
TFTS

SEQ ID NO: 2913034 - protein, 7 aa, Entamoeba invadens
TFTSKTP

SEQ ID NO: 2913035 - protein, 7 aa, Entamoeba invadens
TFYDEDK

SEQ ID NO: 2913036 - protein, 6 aa, Entamoeba invadens
TGAAPS

SEQ ID NO: 2913037 - protein, 9 aa, Entamoeba invadens
TGAERETND

SEQ ID NO: 2913038 - protein, 12 aa, Entamoeba invadens
TGAKDDENLNTA

SEQ ID NO: 2913039 - protein, 4 aa, Entamoeba invadens
TGAN

SEQ ID NO: 2913040 - protein, 9 aa, Entamoeba invadens
TGANASYDD

SEQ ID NO: 2913041 - protein, 8 aa, Entamoeba invadens
TGAPNVPY

SEQ ID NO: 2913042 - protein, 6 aa, Entamoeba invadens
TGARPF

SEQ ID NO: 2913043 - protein, 8 aa, Entamoeba invadens
TGARRGRG

SEQ ID NO: 2913044 - protein, 10 aa, Entamoeba invadens
TGASGEGDFK

SEQ ID NO: 2913045 - protein, 9 aa, Entamoeba invadens
TGATLPNIQ

SEQ ID NO: 2913046 - protein, 18 aa, Entamoeba invadens
TGATTDFNGIPAVTMTRN

SEQ ID NO: 2913047 - protein, 10 aa, Entamoeba invadens
TGAVEPVNDS

SEQ ID NO: 2913048 - protein, 30 aa, Entamoeba invadens
TGCASKSKCKDEDNDVENTENEKEGCCGDT

SEQ ID NO: 2913049 - protein, 6 aa, Entamoeba invadens
TGCGKT

SEQ ID NO: 2913050 - protein, 7 aa, Entamoeba invadens
TGCGKTT

SEQ ID NO: 2913051 - protein, 10 aa, Entamoeba invadens
TGCGKTTQIT

SEQ ID NO: 2913052 - protein, 5 aa, Entamoeba invadens
TGCNE

SEQ ID NO: 2913053 - protein, 4 aa, Entamoeba invadens
TGCQ

SEQ ID NO: 2913054 - protein, 4 aa, Entamoeba invadens
TGCT

SEQ ID NO: 2913055 - protein, 7 aa, Entamoeba invadens
TGDASPY

SEQ ID NO: 2913056 - protein, 13 aa, Entamoeba invadens
TGDDVEHPKPAPD

SEQ ID NO: 2913057 - protein, 7 aa, Entamoeba invadens
TGDDVKS

SEQ ID NO: 2913058 - protein, 4 aa, Entamoeba invadens
TGDE

SEQ ID NO: 2913059 - protein, 6 aa, Entamoeba invadens
TGDEDG

SEQ ID NO: 2913060 - protein, 5 aa, Entamoeba invadens
TGDEN

SEQ ID NO: 2913061 - protein, 8 aa, Entamoeba invadens
TGDENKNV

SEQ ID NO: 2913062 - protein, 17 aa, Entamoeba invadens
TGDESFGNFASQNTQDL

SEQ ID NO: 2913063 - protein, 6 aa, Entamoeba invadens
TGDETG

SEQ ID NO: 2913064 - protein, 13 aa, Entamoeba invadens
TGDGAVDNTKEVN

SEQ ID NO: 2913065 - protein, 5 aa, Entamoeba invadens
TGDIG

SEQ ID NO: 2913066 - protein, 5 aa, Entamoeba invadens
TGDKR

SEQ ID NO: 2913067 - protein, 5 aa, Entamoeba invadens
TGDKS

SEQ ID NO: 2913068 - protein, 6 aa, Entamoeba invadens
TGDKSN

SEQ ID NO: 2913069 - protein, 13 aa, Entamoeba invadens
TGDKVKEFRRGKS

SEQ ID NO: 2913070 - protein, 35 aa, Entamoeba invadens
TGDLESLNDTVHDKTNRCRMSEKEKNAISPDNERA

SEQ ID NO: 2913071 - protein, 9 aa, Entamoeba invadens
TGDLNSCTG

SEQ ID NO: 2913072 - protein, 5 aa, Entamoeba invadens
TGDLT

SEQ ID NO: 2913073 - protein, 7 aa, Entamoeba invadens
TGDNEIT

SEQ ID NO: 2913074 - protein, 9 aa, Entamoeba invadens
TGDNVPSFK

SEQ ID NO: 2913075 - protein, 7 aa, Entamoeba invadens
TGDPEIY

SEQ ID NO: 2913076 - protein, 10 aa, Entamoeba invadens
TGDPSPALNP

SEQ ID NO: 2913077 - protein, 6 aa, Entamoeba invadens
TGDREY

SEQ ID NO: 2913078 - protein, 6 aa, Entamoeba invadens
TGDRWK

SEQ ID NO: 2913079 - protein, 11 aa, Entamoeba invadens
TGDSNDKAAAN

SEQ ID NO: 2913080 - protein, 5 aa, Entamoeba invadens
TGDSV

SEQ ID NO: 2913081 - protein, 4 aa, Entamoeba invadens
TGDT

SEQ ID NO: 2913082 - protein, 23 aa, Entamoeba invadens
TGDTSMQETFGNTKEEEKRGKKL

SEQ ID NO: 2913083 - protein, 6 aa, Entamoeba invadens
TGDTTF

SEQ ID NO: 2913084 - protein, 9 aa, Entamoeba invadens
TGDTTSMSP

SEQ ID NO: 2913085 - protein, 6 aa, Entamoeba invadens
TGDVGD

SEQ ID NO: 2913086 - protein, 5 aa, Entamoeba invadens
TGDVT

SEQ ID NO: 2913087 - protein, 7 aa, Entamoeba invadens
TGDYKND

SEQ ID NO: 2913088 - protein, 7 aa, Entamoeba invadens
TGDYKSD

SEQ ID NO: 2913089 - protein, 20 aa, Entamoeba invadens
TGEASVEQSQNQFESFIQNS

SEQ ID NO: 2913090 - protein, 12 aa, Entamoeba invadens
TGECKELQKQAK

SEQ ID NO: 2913091 - protein, 16 aa, Entamoeba invadens
TGEEETPTETGNSGDL

SEQ ID NO: 2913092 - protein, 7 aa, Entamoeba invadens
TGEGTSM

SEQ ID NO: 2913093 - protein, 4 aa, Entamoeba invadens
TGEH

SEQ ID NO: 2913094 - protein, 4 aa, Entamoeba invadens
TGEL

SEQ ID NO: 2913095 - protein, 5 aa, Entamoeba invadens
TGELG

SEQ ID NO: 2913096 - protein, 4 aa, Entamoeba invadens
TGEN

SEQ ID NO: 2913097 - protein, 26 aa, Entamoeba invadens
TGENDTSAINIDGTEGNVTAHPVGDI

SEQ ID NO: 2913098 - protein, 6 aa, Entamoeba invadens
TGENKR

SEQ ID NO: 2913099 - protein, 7 aa, Entamoeba invadens
TGENPRG

SEQ ID NO: 2913100 - protein, 4 aa, Entamoeba invadens
TGEP

SEQ ID NO: 2913101 - protein, 11 aa, Entamoeba invadens
TGEPEKSLKQK

SEQ ID NO: 2913102 - protein, 6 aa, Entamoeba invadens
TGEQEW

SEQ ID NO: 2913103 - protein, 7 aa, Entamoeba invadens
TGEQNNH

SEQ ID NO: 2913104 - protein, 4 aa, Entamoeba invadens
TGER

SEQ ID NO: 2913105 - protein, 4 aa, Entamoeba invadens
TGES

SEQ ID NO: 2913106 - protein, 8 aa, Entamoeba invadens
TGESQARN

SEQ ID NO: 2913107 - protein, 4 aa, Entamoeba invadens
TGET

SEQ ID NO: 2913108 - protein, 5 aa, Entamoeba invadens
TGETF

SEQ ID NO: 2913109 - protein, 9 aa, Entamoeba invadens
TGETSSQIQ

SEQ ID NO: 2913110 - protein, 4 aa, Entamoeba invadens
TGEV

SEQ ID NO: 2913111 - protein, 5 aa, Entamoeba invadens
TGEVE

SEQ ID NO: 2913112 - protein, 5 aa, Entamoeba invadens
TGEVN

SEQ ID NO: 2913113 - protein, 4 aa, Entamoeba invadens
TGEY

SEQ ID NO: 2913114 - protein, 11 aa, Entamoeba invadens
TGFASSRKEAN

SEQ ID NO: 2913115 - protein, 5 aa, Entamoeba invadens
TGFGG

SEQ ID NO: 2913116 - protein, 10 aa, Entamoeba invadens
TGFGGKGANQ

SEQ ID NO: 2913117 - protein, 6 aa, Entamoeba invadens
TGFGQP

SEQ ID NO: 2913118 - protein, 4 aa, Entamoeba invadens
TGFP

SEQ ID NO: 2913119 - protein, 13 aa, Entamoeba invadens
TGFSEKSAQQRLS

SEQ ID NO: 2913120 - protein, 7 aa, Entamoeba invadens
TGFSGNV

SEQ ID NO: 2913121 - protein, 10 aa, Entamoeba invadens
TGFSPDKQDL

SEQ ID NO: 2913122 - protein, 11 aa, Entamoeba invadens
TGGCKPKASGF

SEQ ID NO: 2913123 - protein, 4 aa, Entamoeba invadens
TGGD

SEQ ID NO: 2913124 - protein, 7 aa, Entamoeba invadens
TGGDPTV

SEQ ID NO: 2913125 - protein, 6 aa, Entamoeba invadens
TGGGAY

SEQ ID NO: 2913126 - protein, 9 aa, Entamoeba invadens
TGGGEDYPR

SEQ ID NO: 2913127 - protein, 6 aa, Entamoeba invadens
TGGGKS

SEQ ID NO: 2913128 - protein, 7 aa, Entamoeba invadens
TGGIDSI

SEQ ID NO: 2913129 - protein, 15 aa, Entamoeba invadens
TGGKTIDDSRLAGRK

SEQ ID NO: 2913130 - protein, 8 aa, Entamoeba invadens
TGGMTEEK

SEQ ID NO: 2913131 - protein, 10 aa, Entamoeba invadens
TGGNANWGET

SEQ ID NO: 2913132 - protein, 8 aa, Entamoeba invadens
TGGNQEDL

SEQ ID NO: 2913133 - protein, 15 aa, Entamoeba invadens
TGGSPSEEENLKNEI

SEQ ID NO: 2913134 - protein, 12 aa, Entamoeba invadens
TGGSQLSTENKA

SEQ ID NO: 2913135 - protein, 9 aa, Entamoeba invadens
TGGSSIEFS

SEQ ID NO: 2913136 - protein, 5 aa, Entamoeba invadens
TGGSY

SEQ ID NO: 2913137 - protein, 7 aa, Entamoeba invadens
TGGTYTA

SEQ ID NO: 2913138 - protein, 5 aa, Entamoeba invadens
TGGVD

SEQ ID NO: 2913139 - protein, 5 aa, Entamoeba invadens
TGGVN

SEQ ID NO: 2913140 - protein, 7 aa, Entamoeba invadens
TGHKPDW

SEQ ID NO: 2913141 - protein, 9 aa, Entamoeba invadens
TGHNGDDVA

SEQ ID NO: 2913142 - protein, 19 aa, Entamoeba invadens
TGHSETPEEKAEREKADSE

SEQ ID NO: 2913143 - protein, 5 aa, Entamoeba invadens
TGHTF

SEQ ID NO: 2913144 - protein, 6 aa, Entamoeba invadens
TGHTGD

SEQ ID NO: 2913145 - protein, 10 aa, Entamoeba invadens
TGHTKSNCPE

SEQ ID NO: 2913146 - protein, 4 aa, Entamoeba invadens
TGIG

SEQ ID NO: 2913147 - protein, 6 aa, Entamoeba invadens
TGIGID

SEQ ID NO: 2913148 - protein, 22 aa, Entamoeba invadens
TGIGKATAESGKSGSDDFDPNK

SEQ ID NO: 2913149 - protein, 20 aa, Entamoeba invadens
TGIGSCRTGAIGGTLANKGG

SEQ ID NO: 2913150 - protein, 11 aa, Entamoeba invadens
TGIPDERPAQF

SEQ ID NO: 2913151 - protein, 27 aa, Entamoeba invadens
TGIPNDQPSRATFSSNVEEEEDDISGF

SEQ ID NO: 2913152 - protein, 5 aa, Entamoeba invadens
TGISQ

SEQ ID NO: 2913153 - protein, 7 aa, Entamoeba invadens
TGITEKR

SEQ ID NO: 2913154 - protein, 7 aa, Entamoeba invadens
TGITKED

SEQ ID NO: 2913155 - protein, 5 aa, Entamoeba invadens
TGITT

SEQ ID NO: 2913156 - protein, 4 aa, Entamoeba invadens
TGKA

SEQ ID NO: 2913157 - protein, 11 aa, Entamoeba invadens
TGKAKPENEAQ

SEQ ID NO: 2913158 - protein, 7 aa, Entamoeba invadens
TGKAQRT

SEQ ID NO: 2913159 - protein, 5 aa, Entamoeba invadens
TGKAR

SEQ ID NO: 2913160 - protein, 5 aa, Entamoeba invadens
TGKDD

SEQ ID NO: 2913161 - protein, 8 aa, Entamoeba invadens
TGKDFGKE

SEQ ID NO: 2913162 - protein, 8 aa, Entamoeba invadens
TGKDHQHP

SEQ ID NO: 2913163 - protein, 7 aa, Entamoeba invadens
TGKENAV

SEQ ID NO: 2913164 - protein, 5 aa, Entamoeba invadens
TGKEV

SEQ ID NO: 2913165 - protein, 10 aa, Entamoeba invadens
TGKFISDSNG

SEQ ID NO: 2913166 - protein, 4 aa, Entamoeba invadens
TGKI

SEQ ID NO: 2913167 - protein, 13 aa, Entamoeba invadens
TGKIEKDKDNQIM

SEQ ID NO: 2913168 - protein, 4 aa, Entamoeba invadens
TGKK

SEQ ID NO: 2913169 - protein, 6 aa, Entamoeba invadens
TGKKED

SEQ ID NO: 2913170 - protein, 15 aa, Entamoeba invadens
TGKKEFETKVETNGI

SEQ ID NO: 2913171 - protein, 9 aa, Entamoeba invadens
TGKKEQARK

SEQ ID NO: 2913172 - protein, 57 aa, Entamoeba invadens
TGKKPAKKTDEFKKSQINSSTKVKEEEEIKEMKDYKDNKVTASDVKENTEKSSNEIS

SEQ ID NO: 2913173 - protein, 14 aa, Entamoeba invadens
TGKKWGSLTTFEFD

SEQ ID NO: 2913174 - protein, 4 aa, Entamoeba invadens
TGKN

SEQ ID NO: 2913175 - protein, 12 aa, Entamoeba invadens
TGKNERRIPGNK

SEQ ID NO: 2913176 - protein, 5 aa, Entamoeba invadens
TGKNG

SEQ ID NO: 2913177 - protein, 5 aa, Entamoeba invadens
TGKNK

SEQ ID NO: 2913178 - protein, 11 aa, Entamoeba invadens
TGKNSEERESK

SEQ ID NO: 2913179 - protein, 10 aa, Entamoeba invadens
TGKNVKEITT

SEQ ID NO: 2913180 - protein, 4 aa, Entamoeba invadens
TGKP

SEQ ID NO: 2913181 - protein, 9 aa, Entamoeba invadens
TGKPLKLTK

SEQ ID NO: 2913182 - protein, 9 aa, Entamoeba invadens
TGKPVETPI

SEQ ID NO: 2913183 - protein, 7 aa, Entamoeba invadens
TGKPVFS

SEQ ID NO: 2913184 - protein, 19 aa, Entamoeba invadens
TGKQKTETTLCEKLLILKC

SEQ ID NO: 2913185 - protein, 9 aa, Entamoeba invadens
TGKRPTLSE

SEQ ID NO: 2913186 - protein, 4 aa, Entamoeba invadens
TGKS

SEQ ID NO: 2913187 - protein, 14 aa, Entamoeba invadens
TGKSAHASEPERGI

SEQ ID NO: 2913188 - protein, 9 aa, Entamoeba invadens
TGKSENGVS

SEQ ID NO: 2913189 - protein, 13 aa, Entamoeba invadens
TGKSLTNSGERFT

SEQ ID NO: 2913190 - protein, 7 aa, Entamoeba invadens
TGKSTGF

SEQ ID NO: 2913191 - protein, 13 aa, Entamoeba invadens
TGKTATPDQAQEA

SEQ ID NO: 2913192 - protein, 8 aa, Entamoeba invadens
TGKTEEQV

SEQ ID NO: 2913193 - protein, 7 aa, Entamoeba invadens
TGKTGSV

SEQ ID NO: 2913194 - protein, 8 aa, Entamoeba invadens
TGKTGSVK

SEQ ID NO: 2913195 - protein, 7 aa, Entamoeba invadens
TGKTKGI

SEQ ID NO: 2913196 - protein, 9 aa, Entamoeba invadens
TGKTPKEVS

SEQ ID NO: 2913197 - protein, 11 aa, Entamoeba invadens
TGKTYKTQVEN

SEQ ID NO: 2913198 - protein, 4 aa, Entamoeba invadens
TGKV

SEQ ID NO: 2913199 - protein, 5 aa, Entamoeba invadens
TGKVY

SEQ ID NO: 2913200 - protein, 4 aa, Entamoeba invadens
TGKY

SEQ ID NO: 2913201 - protein, 11 aa, Entamoeba invadens
TGKYPNPSSPF

SEQ ID NO: 2913202 - protein, 7 aa, Entamoeba invadens
TGLATET

SEQ ID NO: 2913203 - protein, 9 aa, Entamoeba invadens
TGLERGKRR

SEQ ID NO: 2913204 - protein, 12 aa, Entamoeba invadens
TGLGSTGAWDNT

SEQ ID NO: 2913205 - protein, 6 aa, Entamoeba invadens
TGLPDI

SEQ ID NO: 2913206 - protein, 5 aa, Entamoeba invadens
TGLPQ

SEQ ID NO: 2913207 - protein, 10 aa, Entamoeba invadens
TGLSDTEKDV

SEQ ID NO: 2913208 - protein, 22 aa, Entamoeba invadens
TGLSKSPKLEKPRKSDGGEKRE

SEQ ID NO: 2913209 - protein, 6 aa, Entamoeba invadens
TGLSPR

SEQ ID NO: 2913210 - protein, 9 aa, Entamoeba invadens
TGLTDEEIK

SEQ ID NO: 2913211 - protein, 7 aa, Entamoeba invadens
TGLTRSD

SEQ ID NO: 2913212 - protein, 9 aa, Entamoeba invadens
TGMGTGSTE

SEQ ID NO: 2913213 - protein, 7 aa, Entamoeba invadens
TGMNGKG

SEQ ID NO: 2913214 - protein, 9 aa, Entamoeba invadens
TGMVGDGSA

SEQ ID NO: 2913215 - protein, 10 aa, Entamoeba invadens
TGNANPRSTV

SEQ ID NO: 2913216 - protein, 4 aa, Entamoeba invadens
TGNC

SEQ ID NO: 2913217 - protein, 4 aa, Entamoeba invadens
TGND

SEQ ID NO: 2913218 - protein, 19 aa, Entamoeba invadens
TGNDMSISTGWGGGYDGQD

SEQ ID NO: 2913219 - protein, 6 aa, Entamoeba invadens
TGNETG

SEQ ID NO: 2913220 - protein, 9 aa, Entamoeba invadens
TGNETTTNW

SEQ ID NO: 2913221 - protein, 6 aa, Entamoeba invadens
TGNFSE

SEQ ID NO: 2913222 - protein, 10 aa, Entamoeba invadens
TGNGGKATED

SEQ ID NO: 2913223 - protein, 6 aa, Entamoeba invadens
TGNGSH

SEQ ID NO: 2913224 - protein, 7 aa, Entamoeba invadens
TGNIESG

SEQ ID NO: 2913225 - protein, 4 aa, Entamoeba invadens
TGNK

SEQ ID NO: 2913226 - protein, 7 aa, Entamoeba invadens
TGNKEFQ

SEQ ID NO: 2913227 - protein, 10 aa, Entamoeba invadens
TGNKTSNSRF

SEQ ID NO: 2913228 - protein, 5 aa, Entamoeba invadens
TGNLS

SEQ ID NO: 2913229 - protein, 6 aa, Entamoeba invadens
TGNPMN

SEQ ID NO: 2913230 - protein, 10 aa, Entamoeba invadens
TGNPNKAKEI

SEQ ID NO: 2913231 - protein, 5 aa, Entamoeba invadens
TGNPV

SEQ ID NO: 2913232 - protein, 8 aa, Entamoeba invadens
TGNQQNQK

SEQ ID NO: 2913233 - protein, 10 aa, Entamoeba invadens
TGNQQSAERL

SEQ ID NO: 2913234 - protein, 8 aa, Entamoeba invadens
TGNQTKSN

SEQ ID NO: 2913235 - protein, 11 aa, Entamoeba invadens
TGNSKSGCCNT

SEQ ID NO: 2913236 - protein, 8 aa, Entamoeba invadens
TGNSLSRC

SEQ ID NO: 2913237 - protein, 8 aa, Entamoeba invadens
TGNSYSGT

SEQ ID NO: 2913238 - protein, 9 aa, Entamoeba invadens
TGNTENLRT

SEQ ID NO: 2913239 - protein, 6 aa, Entamoeba invadens
TGNTQP

SEQ ID NO: 2913240 - protein, 6 aa, Entamoeba invadens
TGNTTH

SEQ ID NO: 2913241 - protein, 4 aa, Entamoeba invadens
TGNV

SEQ ID NO: 2913242 - protein, 15 aa, Entamoeba invadens
TGNVGPLTQEEKRAL

SEQ ID NO: 2913243 - protein, 5 aa, Entamoeba invadens
TGNWS

SEQ ID NO: 2913244 - protein, 5 aa, Entamoeba invadens
TGPAT

SEQ ID NO: 2913245 - protein, 4 aa, Entamoeba invadens
TGPD

SEQ ID NO: 2913246 - protein, 10 aa, Entamoeba invadens
TGPDDSPYQG

SEQ ID NO: 2913247 - protein, 16 aa, Entamoeba invadens
TGPEGLEKVKENQTDA

SEQ ID NO: 2913248 - protein, 7 aa, Entamoeba invadens
TGPFGEN

SEQ ID NO: 2913249 - protein, 13 aa, Entamoeba invadens
TGPIGEAEKYASK

SEQ ID NO: 2913250 - protein, 9 aa, Entamoeba invadens
TGPINTRRG

SEQ ID NO: 2913251 - protein, 6 aa, Entamoeba invadens
TGPSTV

SEQ ID NO: 2913252 - protein, 7 aa, Entamoeba invadens
TGPTSPK

SEQ ID NO: 2913253 - protein, 8 aa, Entamoeba invadens
TGPTTPAD

SEQ ID NO: 2913254 - protein, 10 aa, Entamoeba invadens
TGPVEKGPGV

SEQ ID NO: 2913255 - protein, 11 aa, Entamoeba invadens
TGQGLDNTTSV

SEQ ID NO: 2913256 - protein, 6 aa, Entamoeba invadens
TGQGLQ

SEQ ID NO: 2913257 - protein, 7 aa, Entamoeba invadens
TGQGLQR

SEQ ID NO: 2913258 - protein, 4 aa, Entamoeba invadens
TGQI

SEQ ID NO: 2913259 - protein, 4 aa, Entamoeba invadens
TGQL

SEQ ID NO: 2913260 - protein, 8 aa, Entamoeba invadens
TGQNKNKG

SEQ ID NO: 2913261 - protein, 7 aa, Entamoeba invadens
TGQPADV

SEQ ID NO: 2913262 - protein, 6 aa, Entamoeba invadens
TGQPDI

SEQ ID NO: 2913263 - protein, 11 aa, Entamoeba invadens
TGQQKQKQHTR

SEQ ID NO: 2913264 - protein, 6 aa, Entamoeba invadens
TGQSTG

SEQ ID NO: 2913265 - protein, 7 aa, Entamoeba invadens
TGQTGTN

SEQ ID NO: 2913266 - protein, 10 aa, Entamoeba invadens
TGQVAPTWEG

SEQ ID NO: 2913267 - protein, 13 aa, Entamoeba invadens
TGQVNENKRKESL

SEQ ID NO: 2913268 - protein, 15 aa, Entamoeba invadens
TGRERKKKEDKTERT

SEQ ID NO: 2913269 - protein, 9 aa, Entamoeba invadens
TGRITRNGS

SEQ ID NO: 2913270 - protein, 4 aa, Entamoeba invadens
TGRK

SEQ ID NO: 2913271 - protein, 7 aa, Entamoeba invadens
TGRKAQN

SEQ ID NO: 2913272 - protein, 6 aa, Entamoeba invadens
TGRNDC

SEQ ID NO: 2913273 - protein, 6 aa, Entamoeba invadens
TGRNYG

SEQ ID NO: 2913274 - protein, 9 aa, Entamoeba invadens
TGRRPPETK

SEQ ID NO: 2913275 - protein, 4 aa, Entamoeba invadens
TGRS

SEQ ID NO: 2913276 - protein, 19 aa, Entamoeba invadens
TGRSLSTLKGEKEDASVES

SEQ ID NO: 2913277 - protein, 4 aa, Entamoeba invadens
TGRT

SEQ ID NO: 2913278 - protein, 8 aa, Entamoeba invadens
TGRTCDTS

SEQ ID NO: 2913279 - protein, 5 aa, Entamoeba invadens
TGRTT

SEQ ID NO: 2913280 - protein, 5 aa, Entamoeba invadens
TGRVE

SEQ ID NO: 2913281 - protein, 4 aa, Entamoeba invadens
TGRY

SEQ ID NO: 2913282 - protein, 4 aa, Entamoeba invadens
TGSA

SEQ ID NO: 2913283 - protein, 8 aa, Entamoeba invadens
TGSADKTV

SEQ ID NO: 2913284 - protein, 13 aa, Entamoeba invadens
TGSAKFCPSCGFK

SEQ ID NO: 2913285 - protein, 5 aa, Entamoeba invadens
TGSDD

SEQ ID NO: 2913286 - protein, 5 aa, Entamoeba invadens
TGSDF

SEQ ID NO: 2913287 - protein, 4 aa, Entamoeba invadens
TGSE

SEQ ID NO: 2913288 - protein, 5 aa, Entamoeba invadens
TGSEA

SEQ ID NO: 2913289 - protein, 12 aa, Entamoeba invadens
TGSEDHTMALFA

SEQ ID NO: 2913290 - protein, 10 aa, Entamoeba invadens
TGSEEITPSQ

SEQ ID NO: 2913291 - protein, 5 aa, Entamoeba invadens
TGSEF

SEQ ID NO: 2913292 - protein, 9 aa, Entamoeba invadens
TGSETFSRN

SEQ ID NO: 2913293 - protein, 8 aa, Entamoeba invadens
TGSEVSSI

SEQ ID NO: 2913294 - protein, 13 aa, Entamoeba invadens
TGSFDDPPQRDGL

SEQ ID NO: 2913295 - protein, 9 aa, Entamoeba invadens
TGSFGSSTL

SEQ ID NO: 2913296 - protein, 9 aa, Entamoeba invadens
TGSGTRLGT

SEQ ID NO: 2913297 - protein, 9 aa, Entamoeba invadens
TGSIAETNS

SEQ ID NO: 2913298 - protein, 10 aa, Entamoeba invadens
TGSKEDVEKF

SEQ ID NO: 2913299 - protein, 15 aa, Entamoeba invadens
TGSKISSKDVDSRYA

SEQ ID NO: 2913300 - protein, 6 aa, Entamoeba invadens
TGSMGQ

SEQ ID NO: 2913301 - protein, 14 aa, Entamoeba invadens
TGSNQSSGKRTYGR

SEQ ID NO: 2913302 - protein, 14 aa, Entamoeba invadens
TGSNQTSGKRTYGR

SEQ ID NO: 2913303 - protein, 7 aa, Entamoeba invadens
TGSPDLM

SEQ ID NO: 2913304 - protein, 5 aa, Entamoeba invadens
TGSPI

SEQ ID NO: 2913305 - protein, 10 aa, Entamoeba invadens
TGSPNSPIGG

SEQ ID NO: 2913306 - protein, 9 aa, Entamoeba invadens
TGSPVKAKE

SEQ ID NO: 2913307 - protein, 6 aa, Entamoeba invadens
TGSPVV

SEQ ID NO: 2913308 - protein, 9 aa, Entamoeba invadens
TGSQPCKAS

SEQ ID NO: 2913309 - protein, 9 aa, Entamoeba invadens
TGSRNPHSW

SEQ ID NO: 2913310 - protein, 5 aa, Entamoeba invadens
TGSSD

SEQ ID NO: 2913311 - protein, 8 aa, Entamoeba invadens
TGSSDKKV

SEQ ID NO: 2913312 - protein, 7 aa, Entamoeba invadens
TGSSDRK

SEQ ID NO: 2913313 - protein, 8 aa, Entamoeba invadens
TGSSNNAV

SEQ ID NO: 2913314 - protein, 15 aa, Entamoeba invadens
TGSSTEIKPTSSTLS

SEQ ID NO: 2913315 - protein, 6 aa, Entamoeba invadens
TGSTDG

SEQ ID NO: 2913316 - protein, 13 aa, Entamoeba invadens
TGSVSKESPLKEK

SEQ ID NO: 2913317 - protein, 4 aa, Entamoeba invadens
TGTC

SEQ ID NO: 2913318 - protein, 5 aa, Entamoeba invadens
TGTDG

SEQ ID NO: 2913319 - protein, 6 aa, Entamoeba invadens
TGTEMQ

SEQ ID NO: 2913320 - protein, 11 aa, Entamoeba invadens
TGTETTYSTKD

SEQ ID NO: 2913321 - protein, 4 aa, Entamoeba invadens
TGTF

SEQ ID NO: 2913322 - protein, 6 aa, Entamoeba invadens
TGTFPR

SEQ ID NO: 2913323 - protein, 13 aa, Entamoeba invadens
TGTFTSASKNKCA

SEQ ID NO: 2913324 - protein, 9 aa, Entamoeba invadens
TGTGDFETN

SEQ ID NO: 2913325 - protein, 8 aa, Entamoeba invadens
TGTGGVPK

SEQ ID NO: 2913326 - protein, 7 aa, Entamoeba invadens
TGTGKTT

SEQ ID NO: 2913327 - protein, 5 aa, Entamoeba invadens
TGTHA

SEQ ID NO: 2913328 - protein, 6 aa, Entamoeba invadens
TGTHEP

SEQ ID NO: 2913329 - protein, 4 aa, Entamoeba invadens
TGTI

SEQ ID NO: 2913330 - protein, 6 aa, Entamoeba invadens
TGTIDP

SEQ ID NO: 2913331 - protein, 10 aa, Entamoeba invadens
TGTIKPNTFG

SEQ ID NO: 2913332 - protein, 11 aa, Entamoeba invadens
TGTIPDDEEDM

SEQ ID NO: 2913333 - protein, 6 aa, Entamoeba invadens
TGTIPN

SEQ ID NO: 2913334 - protein, 5 aa, Entamoeba invadens
TGTIT

SEQ ID NO: 2913335 - protein, 4 aa, Entamoeba invadens
TGTL

SEQ ID NO: 2913336 - protein, 10 aa, Entamoeba invadens
TGTLDSVDPS

SEQ ID NO: 2913337 - protein, 5 aa, Entamoeba invadens
TGTNE

SEQ ID NO: 2913338 - protein, 14 aa, Entamoeba invadens
TGTNPLPKTNECND

SEQ ID NO: 2913339 - protein, 23 aa, Entamoeba invadens
TGTNPTGGMGSPYGQPQQQPMAG

SEQ ID NO: 2913340 - protein, 7 aa, Entamoeba invadens
TGTNTPY

SEQ ID NO: 2913341 - protein, 9 aa, Entamoeba invadens
TGTPGTGKS

SEQ ID NO: 2913342 - protein, 14 aa, Entamoeba invadens
TGTPLEGKPYLKKL

SEQ ID NO: 2913343 - protein, 9 aa, Entamoeba invadens
TGTPQKPKL

SEQ ID NO: 2913344 - protein, 12 aa, Entamoeba invadens
TGTPTSDEFKDE

SEQ ID NO: 2913345 - protein, 10 aa, Entamoeba invadens
TGTPVPNGVE

SEQ ID NO: 2913346 - protein, 10 aa, Entamoeba invadens
TGTQKDGEEY

SEQ ID NO: 2913347 - protein, 9 aa, Entamoeba invadens
TGTQSIAPE

SEQ ID NO: 2913348 - protein, 15 aa, Entamoeba invadens
TGTQTPSPKQAESQV

SEQ ID NO: 2913349 - protein, 4 aa, Entamoeba invadens
TGTS

SEQ ID NO: 2913350 - protein, 8 aa, Entamoeba invadens
TGTSERET

SEQ ID NO: 2913351 - protein, 16 aa, Entamoeba invadens
TGTSTGVKTDPQEVRD

SEQ ID NO: 2913352 - protein, 8 aa, Entamoeba invadens
TGTTGETV

SEQ ID NO: 2913353 - protein, 10 aa, Entamoeba invadens
TGTTHEDTTS

SEQ ID NO: 2913354 - protein, 8 aa, Entamoeba invadens
TGTTNPEH

SEQ ID NO: 2913355 - protein, 5 aa, Entamoeba invadens
TGTTQ

SEQ ID NO: 2913356 - protein, 17 aa, Entamoeba invadens
TGTTSDQKGVSQQPQIE

SEQ ID NO: 2913357 - protein, 6 aa, Entamoeba invadens
TGTTTQ

SEQ ID NO: 2913358 - protein, 8 aa, Entamoeba invadens
TGTYSDQV

SEQ ID NO: 2913359 - protein, 4 aa, Entamoeba invadens
TGVD

SEQ ID NO: 2913360 - protein, 16 aa, Entamoeba invadens
TGVDPTQTTGKMPNSR

SEQ ID NO: 2913361 - protein, 18 aa, Entamoeba invadens
TGVEKEIADGEKNNLNQM

SEQ ID NO: 2913362 - protein, 5 aa, Entamoeba invadens
TGVGA

SEQ ID NO: 2913363 - protein, 6 aa, Entamoeba invadens
TGVGKT

SEQ ID NO: 2913364 - protein, 5 aa, Entamoeba invadens
TGVGQ

SEQ ID NO: 2913365 - protein, 4 aa, Entamoeba invadens
TGVL

SEQ ID NO: 2913366 - protein, 18 aa, Entamoeba invadens
TGVNYPSDAFQGDQPMGG

SEQ ID NO: 2913367 - protein, 4 aa, Entamoeba invadens
TGVP

SEQ ID NO: 2913368 - protein, 13 aa, Entamoeba invadens
TGVPFNSEDGQKY

SEQ ID NO: 2913369 - protein, 5 aa, Entamoeba invadens
TGVQP

SEQ ID NO: 2913370 - protein, 5 aa, Entamoeba invadens
TGVQY

SEQ ID NO: 2913371 - protein, 7 aa, Entamoeba invadens
TGVSESI

SEQ ID NO: 2913372 - protein, 5 aa, Entamoeba invadens
TGVTA

SEQ ID NO: 2913373 - protein, 6 aa, Entamoeba invadens
TGVYPA

SEQ ID NO: 2913374 - protein, 4 aa, Entamoeba invadens
TGYH

SEQ ID NO: 2913375 - protein, 10 aa, Entamoeba invadens
TGYMTSTDKV

SEQ ID NO: 2913376 - protein, 6 aa, Entamoeba invadens
TGYNGG

SEQ ID NO: 2913377 - protein, 8 aa, Entamoeba invadens
TGYRQTRI

SEQ ID NO: 2913378 - protein, 20 aa, Entamoeba invadens
TGYSGDSRGPRRYDTTPNAA

SEQ ID NO: 2913379 - protein, 16 aa, Entamoeba invadens
TGYSGDSRGPRRYHTT

SEQ ID NO: 2913380 - protein, 6 aa, Entamoeba invadens
TGYSGG

SEQ ID NO: 2913381 - protein, 7 aa, Entamoeba invadens
TGYTNGP

SEQ ID NO: 2913382 - protein, 5 aa, Entamoeba invadens
TGYTQ

SEQ ID NO: 2913383 - protein, 11 aa, Entamoeba invadens
THARGKGVPGY

SEQ ID NO: 2913384 - protein, 11 aa, Entamoeba invadens
THASNDPTKLR

SEQ ID NO: 2913385 - protein, 5 aa, Entamoeba invadens
THDAA

SEQ ID NO: 2913386 - protein, 8 aa, Entamoeba invadens
THDESTFP

SEQ ID NO: 2913387 - protein, 5 aa, Entamoeba invadens
THDKE

SEQ ID NO: 2913388 - protein, 9 aa, Entamoeba invadens
THDTERNER

SEQ ID NO: 2913389 - protein, 9 aa, Entamoeba invadens
THDTPSELS

SEQ ID NO: 2913390 - protein, 18 aa, Entamoeba invadens
THEARQEENISEKEIEKN

SEQ ID NO: 2913391 - protein, 12 aa, Entamoeba invadens
THECSTPPSVVS

SEQ ID NO: 2913392 - protein, 5 aa, Entamoeba invadens
THEDK

SEQ ID NO: 2913393 - protein, 7 aa, Entamoeba invadens
THEGHEK

SEQ ID NO: 2913394 - protein, 24 aa, Entamoeba invadens
THEGKYSPSVSTTVSVSNSSNKAD

SEQ ID NO: 2913395 - protein, 5 aa, Entamoeba invadens
THENT

SEQ ID NO: 2913396 - protein, 5 aa, Entamoeba invadens
THESE

SEQ ID NO: 2913397 - protein, 8 aa, Entamoeba invadens
THESEIRN

SEQ ID NO: 2913398 - protein, 9 aa, Entamoeba invadens
THETEKPKV

SEQ ID NO: 2913399 - protein, 5 aa, Entamoeba invadens
THFSS

SEQ ID NO: 2913400 - protein, 13 aa, Entamoeba invadens
THGGSVDKSTVST

SEQ ID NO: 2913401 - protein, 21 aa, Entamoeba invadens
THGHTSTVTSGEFSPISSQSF

SEQ ID NO: 2913402 - protein, 12 aa, Entamoeba invadens
THGKNGANKLDT

SEQ ID NO: 2913403 - protein, 22 aa, Entamoeba invadens
THGPPLNAEDVETDVNTIQPHE

SEQ ID NO: 2913404 - protein, 5 aa, Entamoeba invadens
THGQE

SEQ ID NO: 2913405 - protein, 11 aa, Entamoeba invadens
THGQYASLSGA

SEQ ID NO: 2913406 - protein, 6 aa, Entamoeba invadens
THGRNT

SEQ ID NO: 2913407 - protein, 12 aa, Entamoeba invadens
THGYDSYDGPYD

SEQ ID NO: 2913408 - protein, 34 aa, Entamoeba invadens
THHEEGDPQPKKTPQQNTQYKAYTSTAGPPPRPH

SEQ ID NO: 2913409 - protein, 8 aa, Entamoeba invadens
THHGTTEK

SEQ ID NO: 2913410 - protein, 4 aa, Entamoeba invadens
THIK

SEQ ID NO: 2913411 - protein, 7 aa, Entamoeba invadens
THINSDQ

SEQ ID NO: 2913412 - protein, 4 aa, Entamoeba invadens
THIT

SEQ ID NO: 2913413 - protein, 10 aa, Entamoeba invadens
THKEGAENAK

SEQ ID NO: 2913414 - protein, 13 aa, Entamoeba invadens
THKHDKDLSVPSL

SEQ ID NO: 2913415 - protein, 10 aa, Entamoeba invadens
THKKISKPLP

SEQ ID NO: 2913416 - protein, 23 aa, Entamoeba invadens
THKLENKNENQKTTDIKVKSPQL

SEQ ID NO: 2913417 - protein, 68 aa, Entamoeba invadens
THKNKDDTKTQSANPSDTHQETSIQKEVEVKKEEVTGTTTSVVTNTTEAKSDSYDSSEGSGERAEEGT

SEQ ID NO: 2913418 - protein, 9 aa, Entamoeba invadens
THKNSTACI

SEQ ID NO: 2913419 - protein, 7 aa, Entamoeba invadens
THKRDKI

SEQ ID NO: 2913420 - protein, 11 aa, Entamoeba invadens
THKYDPEIDPA

SEQ ID NO: 2913421 - protein, 8 aa, Entamoeba invadens
THLATTPV

SEQ ID NO: 2913422 - protein, 4 aa, Entamoeba invadens
THLE

SEQ ID NO: 2913423 - protein, 30 aa, Entamoeba invadens
THLEEKTQNEIKETKEMKPKASANNPYLPQ

SEQ ID NO: 2913424 - protein, 12 aa, Entamoeba invadens
THLEQQESTLQQ

SEQ ID NO: 2913425 - protein, 10 aa, Entamoeba invadens
THLTNAETDA

SEQ ID NO: 2913426 - protein, 14 aa, Entamoeba invadens
THNANVKTKTMDTY

SEQ ID NO: 2913427 - protein, 22 aa, Entamoeba invadens
THNESAQKRVLNTEDKIKEIEQ

SEQ ID NO: 2913428 - protein, 11 aa, Entamoeba invadens
THNGEKPYTCP

SEQ ID NO: 2913429 - protein, 10 aa, Entamoeba invadens
THNKDEKNMS

SEQ ID NO: 2913430 - protein, 8 aa, Entamoeba invadens
THNKRNDY

SEQ ID NO: 2913431 - protein, 6 aa, Entamoeba invadens
THNNNI

SEQ ID NO: 2913432 - protein, 5 aa, Entamoeba invadens
THNSP

SEQ ID NO: 2913433 - protein, 10 aa, Entamoeba invadens
THNSPNVAQY

SEQ ID NO: 2913434 - protein, 11 aa, Entamoeba invadens
THNSQKPRKRI

SEQ ID NO: 2913435 - protein, 6 aa, Entamoeba invadens
THNSRG

SEQ ID NO: 2913436 - protein, 18 aa, Entamoeba invadens
THNTDLDAQTQSLQVETA

SEQ ID NO: 2913437 - protein, 5 aa, Entamoeba invadens
THNTS

SEQ ID NO: 2913438 - protein, 12 aa, Entamoeba invadens
THPDKNKSMEEI

SEQ ID NO: 2913439 - protein, 6 aa, Entamoeba invadens
THPDRV

SEQ ID NO: 2913440 - protein, 7 aa, Entamoeba invadens
THPEYTR

SEQ ID NO: 2913441 - protein, 6 aa, Entamoeba invadens
THPIAT

SEQ ID NO: 2913442 - protein, 6 aa, Entamoeba invadens
THPKAV

SEQ ID NO: 2913443 - protein, 7 aa, Entamoeba invadens
THPLPSS

SEQ ID NO: 2913444 - protein, 6 aa, Entamoeba invadens
THPQNM

SEQ ID NO: 2913445 - protein, 5 aa, Entamoeba invadens
THPQR

SEQ ID NO: 2913446 - protein, 6 aa, Entamoeba invadens
THPSEE

SEQ ID NO: 2913447 - protein, 7 aa, Entamoeba invadens
THPTDPV

SEQ ID NO: 2913448 - protein, 10 aa, Entamoeba invadens
THPTEENSRD

SEQ ID NO: 2913449 - protein, 7 aa, Entamoeba invadens
THPTLPA

SEQ ID NO: 2913450 - protein, 9 aa, Entamoeba invadens
THQDKGEVI

SEQ ID NO: 2913451 - protein, 19 aa, Entamoeba invadens
THQNTQQIVQNESKTQFSY

SEQ ID NO: 2913452 - protein, 7 aa, Entamoeba invadens
THQRQKR

SEQ ID NO: 2913453 - protein, 5 aa, Entamoeba invadens
THQTC

SEQ ID NO: 2913454 - protein, 6 aa, Entamoeba invadens
THQTLP

SEQ ID NO: 2913455 - protein, 4 aa, Entamoeba invadens
THRG

SEQ ID NO: 2913456 - protein, 6 aa, Entamoeba invadens
THRNGK

SEQ ID NO: 2913457 - protein, 19 aa, Entamoeba invadens
THRQNPTHRGALAGSGIGQ

SEQ ID NO: 2913458 - protein, 4 aa, Entamoeba invadens
THRS

SEQ ID NO: 2913459 - protein, 8 aa, Entamoeba invadens
THRYGPNS

SEQ ID NO: 2913460 - protein, 6 aa, Entamoeba invadens
THSDKK

SEQ ID NO: 2913461 - protein, 4 aa, Entamoeba invadens
THSK

SEQ ID NO: 2913462 - protein, 14 aa, Entamoeba invadens
THSKQMRLTRIKGG

SEQ ID NO: 2913463 - protein, 5 aa, Entamoeba invadens
THSKS

SEQ ID NO: 2913464 - protein, 6 aa, Entamoeba invadens
THSPNE

SEQ ID NO: 2913465 - protein, 15 aa, Entamoeba invadens
THSQKQKIDAKKHYD

SEQ ID NO: 2913466 - protein, 12 aa, Entamoeba invadens
THSQKQKIEAKK

SEQ ID NO: 2913467 - protein, 30 aa, Entamoeba invadens
THSQQERIDKKKKQNKEITEKKPKYDNENE

SEQ ID NO: 2913468 - protein, 6 aa, Entamoeba invadens
THSQSY

SEQ ID NO: 2913469 - protein, 16 aa, Entamoeba invadens
THSQTSKLILSKMKVV

SEQ ID NO: 2913470 - protein, 7 aa, Entamoeba invadens
THSRCSQ

SEQ ID NO: 2913471 - protein, 8 aa, Entamoeba invadens
THSSKGTE

SEQ ID NO: 2913472 - protein, 6 aa, Entamoeba invadens
THSSSS

SEQ ID NO: 2913473 - protein, 5 aa, Entamoeba invadens
THSTQ

SEQ ID NO: 2913474 - protein, 4 aa, Entamoeba invadens
THTD

SEQ ID NO: 2913475 - protein, 9 aa, Entamoeba invadens
THTMTGHSN

SEQ ID NO: 2913476 - protein, 5 aa, Entamoeba invadens
THTQE

SEQ ID NO: 2913477 - protein, 4 aa, Entamoeba invadens
THTR

SEQ ID NO: 2913478 - protein, 9 aa, Entamoeba invadens
THTSKTLPF

SEQ ID NO: 2913479 - protein, 14 aa, Entamoeba invadens
THTSMAKSTPSPID

SEQ ID NO: 2913480 - protein, 5 aa, Entamoeba invadens
THTST

SEQ ID NO: 2913481 - protein, 6 aa, Entamoeba invadens
THTTEL

SEQ ID NO: 2913482 - protein, 6 aa, Entamoeba invadens
THTTGK

SEQ ID NO: 2913483 - protein, 11 aa, Entamoeba invadens
THTTGKGNVPC

SEQ ID NO: 2913484 - protein, 4 aa, Entamoeba invadens
THTV

SEQ ID NO: 2913485 - protein, 13 aa, Entamoeba invadens
THTYGEDDGPYDP

SEQ ID NO: 2913486 - protein, 13 aa, Entamoeba invadens
THVSDEVKRRRDL

SEQ ID NO: 2913487 - protein, 4 aa, Entamoeba invadens
THVY

SEQ ID NO: 2913488 - protein, 11 aa, Entamoeba invadens
THYADPNAKPE

SEQ ID NO: 2913489 - protein, 10 aa, Entamoeba invadens
TIAKKDSVIT

SEQ ID NO: 2913490 - protein, 6 aa, Entamoeba invadens
TIASNK

SEQ ID NO: 2913491 - protein, 7 aa, Entamoeba invadens
TIASRDS

SEQ ID NO: 2913492 - protein, 8 aa, Entamoeba invadens
TIATRENA

SEQ ID NO: 2913493 - protein, 10 aa, Entamoeba invadens
TIDDNFGSQQ

SEQ ID NO: 2913494 - protein, 5 aa, Entamoeba invadens
TIDDS

SEQ ID NO: 2913495 - protein, 10 aa, Entamoeba invadens
TIDEKGEYTS

SEQ ID NO: 2913496 - protein, 9 aa, Entamoeba invadens
TIDEKQSGV

SEQ ID NO: 2913497 - protein, 6 aa, Entamoeba invadens
TIDENK

SEQ ID NO: 2913498 - protein, 8 aa, Entamoeba invadens
TIDEVADG

SEQ ID NO: 2913499 - protein, 6 aa, Entamoeba invadens
TIDGDT

SEQ ID NO: 2913500 - protein, 11 aa, Entamoeba invadens
TIDITKDEPDV

SEQ ID NO: 2913501 - protein, 11 aa, Entamoeba invadens
TIDKKTPDNDE

SEQ ID NO: 2913502 - protein, 5 aa, Entamoeba invadens
TIDLS

SEQ ID NO: 2913503 - protein, 6 aa, Entamoeba invadens
TIDNEI

SEQ ID NO: 2913504 - protein, 19 aa, Entamoeba invadens
TIDNTKSEDQDGPENLTQE

SEQ ID NO: 2913505 - protein, 5 aa, Entamoeba invadens
TIDPK

SEQ ID NO: 2913506 - protein, 58 aa, Entamoeba invadens
TIDPKDSTTMNKDSSQQNFDFSDDEKKNDKIERGYTDKNKQTSVSATISSESDSEDLN

SEQ ID NO: 2913507 - protein, 11 aa, Entamoeba invadens
TIDSDGNADIY

SEQ ID NO: 2913508 - protein, 8 aa, Entamoeba invadens
TIDSENDY

SEQ ID NO: 2913509 - protein, 7 aa, Entamoeba invadens
TIDSERR

SEQ ID NO: 2913510 - protein, 13 aa, Entamoeba invadens
TIDTPDITTKGGL

SEQ ID NO: 2913511 - protein, 7 aa, Entamoeba invadens
TIDTSEL

SEQ ID NO: 2913512 - protein, 6 aa, Entamoeba invadens
TIEDQK

SEQ ID NO: 2913513 - protein, 21 aa, Entamoeba invadens
TIEDSETLKSEKGKKVRPPSQ

SEQ ID NO: 2913514 - protein, 15 aa, Entamoeba invadens
TIEDSYRTNISVDGE

SEQ ID NO: 2913515 - protein, 24 aa, Entamoeba invadens
TIEDTRTRKRANRVNANRNDYGNE

SEQ ID NO: 2913516 - protein, 6 aa, Entamoeba invadens
TIEDTY

SEQ ID NO: 2913517 - protein, 4 aa, Entamoeba invadens
TIEE

SEQ ID NO: 2913518 - protein, 18 aa, Entamoeba invadens
TIEEAKQAADHVMDILLK

SEQ ID NO: 2913519 - protein, 64 aa, Entamoeba invadens
TIEEEKDKIQQELENTKEEKDKVANQLKTTNEEKENINEQLNKTKEAKDKIEHELKEQKEKFSA

SEQ ID NO: 2913520 - protein, 9 aa, Entamoeba invadens
TIEKDKEKM

SEQ ID NO: 2913521 - protein, 28 aa, Entamoeba invadens
TIEKNELKEHEDKEEGTEALQSRLVMRQ

SEQ ID NO: 2913522 - protein, 41 aa, Entamoeba invadens
TIEKREKAEKIEEKAQEDLKKPIPNSERNVGKEPKKLTKVE

SEQ ID NO: 2913523 - protein, 11 aa, Entamoeba invadens
TIEKSASTESW

SEQ ID NO: 2913524 - protein, 12 aa, Entamoeba invadens
TIEKSSASTDTY

SEQ ID NO: 2913525 - protein, 10 aa, Entamoeba invadens
TIELDSDQSF

SEQ ID NO: 2913526 - protein, 6 aa, Entamoeba invadens
TIEMES

SEQ ID NO: 2913527 - protein, 4 aa, Entamoeba invadens
TIEN

SEQ ID NO: 2913528 - protein, 8 aa, Entamoeba invadens
TIENEDSM

SEQ ID NO: 2913529 - protein, 7 aa, Entamoeba invadens
TIENTTT

SEQ ID NO: 2913530 - protein, 11 aa, Entamoeba invadens
TIEPSETQIRA

SEQ ID NO: 2913531 - protein, 10 aa, Entamoeba invadens
TIEPSTIPEA

SEQ ID NO: 2913532 - protein, 7 aa, Entamoeba invadens
TIERGSF

SEQ ID NO: 2913533 - protein, 7 aa, Entamoeba invadens
TIERRKS

SEQ ID NO: 2913534 - protein, 13 aa, Entamoeba invadens
TIESANKAKINEA

SEQ ID NO: 2913535 - protein, 17 aa, Entamoeba invadens
TIESKRSRRQKATMKKQ

SEQ ID NO: 2913536 - protein, 5 aa, Entamoeba invadens
TIESN

SEQ ID NO: 2913537 - protein, 10 aa, Entamoeba invadens
TIESRETNTI

SEQ ID NO: 2913538 - protein, 15 aa, Entamoeba invadens
TIETEKKKKDGTSEV

SEQ ID NO: 2913539 - protein, 13 aa, Entamoeba invadens
TIETKESQMLSAQ

SEQ ID NO: 2913540 - protein, 6 aa, Entamoeba invadens
TIETRT

SEQ ID NO: 2913541 - protein, 12 aa, Entamoeba invadens
TIETSDEKELQH

SEQ ID NO: 2913542 - protein, 7 aa, Entamoeba invadens
TIGANYT

SEQ ID NO: 2913543 - protein, 16 aa, Entamoeba invadens
TIGAQNLSKPEKSSAS

SEQ ID NO: 2913544 - protein, 4 aa, Entamoeba invadens
TIGE

SEQ ID NO: 2913545 - protein, 5 aa, Entamoeba invadens
TIGEG

SEQ ID NO: 2913546 - protein, 11 aa, Entamoeba invadens
TIGENPSYDKG

SEQ ID NO: 2913547 - protein, 5 aa, Entamoeba invadens
TIGES

SEQ ID NO: 2913548 - protein, 4 aa, Entamoeba invadens
TIGF

SEQ ID NO: 2913549 - protein, 4 aa, Entamoeba invadens
TIGG

SEQ ID NO: 2913550 - protein, 27 aa, Entamoeba invadens
TIGGDEKPQTRRKNVSEAKREEDRENF

SEQ ID NO: 2913551 - protein, 10 aa, Entamoeba invadens
TIGKGGQFDA

SEQ ID NO: 2913552 - protein, 35 aa, Entamoeba invadens
TIGNEDKSKDKTEDDGWDTWQTRQKKANTPMLSAD

SEQ ID NO: 2913553 - protein, 18 aa, Entamoeba invadens
TIGQGQPPGLQQPQTQQY

SEQ ID NO: 2913554 - protein, 7 aa, Entamoeba invadens
TIGSTSS

SEQ ID NO: 2913555 - protein, 73 aa, Entamoeba invadens
TIGTETDQNVEQREDTNIVQKEASGSPDPTQVSDANQNIEQTEDDKTVSETKDLQKTGSEDDVQEIAEEGITP

SEQ ID NO: 2913556 - protein, 5 aa, Entamoeba invadens
TIGTR

SEQ ID NO: 2913557 - protein, 4 aa, Entamoeba invadens
TIHP

SEQ ID NO: 2913558 - protein, 4 aa, Entamoeba invadens
TIID

SEQ ID NO: 2913559 - protein, 5 aa, Entamoeba invadens
TIKAE

SEQ ID NO: 2913560 - protein, 6 aa, Entamoeba invadens
TIKDGD

SEQ ID NO: 2913561 - protein, 7 aa, Entamoeba invadens
TIKDLPP

SEQ ID NO: 2913562 - protein, 8 aa, Entamoeba invadens
TIKDPEGN

SEQ ID NO: 2913563 - protein, 42 aa, Entamoeba invadens
TIKEQPKQQVKKEEAKIEVKAKNDGKLNSQAKPQKKSATRNL

SEQ ID NO: 2913564 - protein, 14 aa, Entamoeba invadens
TIKETLEKGNVRSY

SEQ ID NO: 2913565 - protein, 16 aa, Entamoeba invadens
TIKETLKKGNIRSSTI

SEQ ID NO: 2913566 - protein, 5 aa, Entamoeba invadens
TIKEV

SEQ ID NO: 2913567 - protein, 12 aa, Entamoeba invadens
TIKHTKNKQDTK

SEQ ID NO: 2913568 - protein, 5 aa, Entamoeba invadens
TIKKK

SEQ ID NO: 2913569 - protein, 12 aa, Entamoeba invadens
TIKNNKGQTPFD

SEQ ID NO: 2913570 - protein, 17 aa, Entamoeba invadens
TIKNRKNANDKARHLQE

SEQ ID NO: 2913571 - protein, 24 aa, Entamoeba invadens
TIKQQNETTTQLQNQLKDKDDIIE

SEQ ID NO: 2913572 - protein, 10 aa, Entamoeba invadens
TIKREDEREM

SEQ ID NO: 2913573 - protein, 16 aa, Entamoeba invadens
TIKSESVTPRKRLDEK

SEQ ID NO: 2913574 - protein, 7 aa, Entamoeba invadens
TIKSPEE

SEQ ID NO: 2913575 - protein, 5 aa, Entamoeba invadens
TIKTE

SEQ ID NO: 2913576 - protein, 8 aa, Entamoeba invadens
TIKTEPKV

SEQ ID NO: 2913577 - protein, 7 aa, Entamoeba invadens
TIKTSER

SEQ ID NO: 2913578 - protein, 5 aa, Entamoeba invadens
TIKVP

SEQ ID NO: 2913579 - protein, 8 aa, Entamoeba invadens
TIKVSTSN

SEQ ID NO: 2913580 - protein, 4 aa, Entamoeba invadens
TILD

SEQ ID NO: 2913581 - protein, 5 aa, Entamoeba invadens
TILSG

SEQ ID NO: 2913582 - protein, 5 aa, Entamoeba invadens
TINAD

SEQ ID NO: 2913583 - protein, 4 aa, Entamoeba invadens
TINC

SEQ ID NO: 2913584 - protein, 8 aa, Entamoeba invadens
TINDDTKL

SEQ ID NO: 2913585 - protein, 75 aa, Entamoeba invadens
TINEKAEDSVVVPQEKKVEAQPTEEKKEEVQPVEKKEEVKEEQKPVEEKAEDAKPEEKKEENPVEEDNKEDLQEI

SEQ ID NO: 2913586 - protein, 5 aa, Entamoeba invadens
TINGR

SEQ ID NO: 2913587 - protein, 11 aa, Entamoeba invadens
TINKEQKDEDV

SEQ ID NO: 2913588 - protein, 6 aa, Entamoeba invadens
TINNTR

SEQ ID NO: 2913589 - protein, 6 aa, Entamoeba invadens
TINPKD

SEQ ID NO: 2913590 - protein, 13 aa, Entamoeba invadens
TINPKMTKDAMNE

SEQ ID NO: 2913591 - protein, 4 aa, Entamoeba invadens
TINR

SEQ ID NO: 2913592 - protein, 33 aa, Entamoeba invadens
TINTNTNRTVTPLNTTNQINRHTTPKSVATDKI

SEQ ID NO: 2913593 - protein, 5 aa, Entamoeba invadens
TINTV

SEQ ID NO: 2913594 - protein, 10 aa, Entamoeba invadens
TIPADYKSNK

SEQ ID NO: 2913595 - protein, 5 aa, Entamoeba invadens
TIPAK

SEQ ID NO: 2913596 - protein, 4 aa, Entamoeba invadens
TIPD

SEQ ID NO: 2913597 - protein, 6 aa, Entamoeba invadens
TIPDMD

SEQ ID NO: 2913598 - protein, 4 aa, Entamoeba invadens
TIPE

SEQ ID NO: 2913599 - protein, 5 aa, Entamoeba invadens
TIPES

SEQ ID NO: 2913600 - protein, 8 aa, Entamoeba invadens
TIPETVNS

SEQ ID NO: 2913601 - protein, 5 aa, Entamoeba invadens
TIPGN

SEQ ID NO: 2913602 - protein, 6 aa, Entamoeba invadens
TIPGQN

SEQ ID NO: 2913603 - protein, 6 aa, Entamoeba invadens
TIPKEV

SEQ ID NO: 2913604 - protein, 5 aa, Entamoeba invadens
TIPKS

SEQ ID NO: 2913605 - protein, 17 aa, Entamoeba invadens
TIPNKQALRETTTESVY

SEQ ID NO: 2913606 - protein, 20 aa, Entamoeba invadens
TIPNPQSGLTITTTQNDTSI

SEQ ID NO: 2913607 - protein, 12 aa, Entamoeba invadens
TIPNTNPVSLNK

SEQ ID NO: 2913608 - protein, 8 aa, Entamoeba invadens
TIPPSVSS

SEQ ID NO: 2913609 - protein, 9 aa, Entamoeba invadens
TIPPSVTSI

SEQ ID NO: 2913610 - protein, 4 aa, Entamoeba invadens
TIPQ

SEQ ID NO: 2913611 - protein, 9 aa, Entamoeba invadens
TIPQNVKSL

SEQ ID NO: 2913612 - protein, 9 aa, Entamoeba invadens
TIPQSPKVQ

SEQ ID NO: 2913613 - protein, 15 aa, Entamoeba invadens
TIPQSSKPIPQPKNM

SEQ ID NO: 2913614 - protein, 13 aa, Entamoeba invadens
TIPRAINKPDNTE

SEQ ID NO: 2913615 - protein, 5 aa, Entamoeba invadens
TIPRP

SEQ ID NO: 2913616 - protein, 15 aa, Entamoeba invadens
TIPSFGDNENDSTKV

SEQ ID NO: 2913617 - protein, 6 aa, Entamoeba invadens
TIPSGV

SEQ ID NO: 2913618 - protein, 5 aa, Entamoeba invadens
TIPSK

SEQ ID NO: 2913619 - protein, 11 aa, Entamoeba invadens
TIPSPYKYTTP

SEQ ID NO: 2913620 - protein, 9 aa, Entamoeba invadens
TIPSSIKSI

SEQ ID NO: 2913621 - protein, 12 aa, Entamoeba invadens
TIPSSIKSIGND

SEQ ID NO: 2913622 - protein, 9 aa, Entamoeba invadens
TIPSSIKSM

SEQ ID NO: 2913623 - protein, 8 aa, Entamoeba invadens
TIPSSITS

SEQ ID NO: 2913624 - protein, 9 aa, Entamoeba invadens
TIPSSVASF

SEQ ID NO: 2913625 - protein, 9 aa, Entamoeba invadens
TIPSSVKSI

SEQ ID NO: 2913626 - protein, 14 aa, Entamoeba invadens
TIPSSVKSIGDGCF

SEQ ID NO: 2913627 - protein, 8 aa, Entamoeba invadens
TIPSSVNS

SEQ ID NO: 2913628 - protein, 8 aa, Entamoeba invadens
TIPSSVRS

SEQ ID NO: 2913629 - protein, 8 aa, Entamoeba invadens
TIPSSVTN

SEQ ID NO: 2913630 - protein, 12 aa, Entamoeba invadens
TIPSSVTSIGDG

SEQ ID NO: 2913631 - protein, 11 aa, Entamoeba invadens
TIPSSVTSTGK

SEQ ID NO: 2913632 - protein, 9 aa, Entamoeba invadens
TIPSSVTTI

SEQ ID NO: 2913633 - protein, 5 aa, Entamoeba invadens
TIPTD

SEQ ID NO: 2913634 - protein, 8 aa, Entamoeba invadens
TIPTGTPV

SEQ ID NO: 2913635 - protein, 12 aa, Entamoeba invadens
TIPTSVSSLENG

SEQ ID NO: 2913636 - protein, 9 aa, Entamoeba invadens
TIPTSVTSI

SEQ ID NO: 2913637 - protein, 5 aa, Entamoeba invadens
TIPYS

SEQ ID NO: 2913638 - protein, 9 aa, Entamoeba invadens
TIQEKKPVN

SEQ ID NO: 2913639 - protein, 4 aa, Entamoeba invadens
TIQK

SEQ ID NO: 2913640 - protein, 18 aa, Entamoeba invadens
TIQKEEKSCESPKGKHRV

SEQ ID NO: 2913641 - protein, 21 aa, Entamoeba invadens
TIQNDGSVQQVQSQKIEEEKH

SEQ ID NO: 2913642 - protein, 10 aa, Entamoeba invadens
TIQNDPQQNM

SEQ ID NO: 2913643 - protein, 9 aa, Entamoeba invadens
TIQNNGGKI

SEQ ID NO: 2913644 - protein, 6 aa, Entamoeba invadens
TIQNNT

SEQ ID NO: 2913645 - protein, 7 aa, Entamoeba invadens
TIQPGVR

SEQ ID NO: 2913646 - protein, 6 aa, Entamoeba invadens
TIQQPQ

SEQ ID NO: 2913647 - protein, 10 aa, Entamoeba invadens
TIQRDAKKYT

SEQ ID NO: 2913648 - protein, 6 aa, Entamoeba invadens
TIQRPR

SEQ ID NO: 2913649 - protein, 5 aa, Entamoeba invadens
TIQSV

SEQ ID NO: 2913650 - protein, 7 aa, Entamoeba invadens
TIRAGTT

SEQ ID NO: 2913651 - protein, 4 aa, Entamoeba invadens
TIRE

SEQ ID NO: 2913652 - protein, 6 aa, Entamoeba invadens
TIRERY

SEQ ID NO: 2913653 - protein, 6 aa, Entamoeba invadens
TIRESE

SEQ ID NO: 2913654 - protein, 7 aa, Entamoeba invadens
TIRSEEE

SEQ ID NO: 2913655 - protein, 10 aa, Entamoeba invadens
TIRTGGKARI

SEQ ID NO: 2913656 - protein, 20 aa, Entamoeba invadens
TISADDYEAGTRAAACGGTT

SEQ ID NO: 2913657 - protein, 9 aa, Entamoeba invadens
TISDGKGAV

SEQ ID NO: 2913658 - protein, 6 aa, Entamoeba invadens
TISDST

SEQ ID NO: 2913659 - protein, 10 aa, Entamoeba invadens
TISDTKNETI

SEQ ID NO: 2913660 - protein, 5 aa, Entamoeba invadens
TISEI

SEQ ID NO: 2913661 - protein, 6 aa, Entamoeba invadens
TISEIG

SEQ ID NO: 2913662 - protein, 8 aa, Entamoeba invadens
TISGDTKN

SEQ ID NO: 2913663 - protein, 5 aa, Entamoeba invadens
TISGI

SEQ ID NO: 2913664 - protein, 17 aa, Entamoeba invadens
TISGWPSGKMSKTTTRE

SEQ ID NO: 2913665 - protein, 16 aa, Entamoeba invadens
TISKPQNQKYEKEDLQ

SEQ ID NO: 2913666 - protein, 8 aa, Entamoeba invadens
TISKSYNG

SEQ ID NO: 2913667 - protein, 12 aa, Entamoeba invadens
TISNANKRKRQQ

SEQ ID NO: 2913668 - protein, 5 aa, Entamoeba invadens
TISNE

SEQ ID NO: 2913669 - protein, 5 aa, Entamoeba invadens
TISNT

SEQ ID NO: 2913670 - protein, 6 aa, Entamoeba invadens
TISPNE

SEQ ID NO: 2913671 - protein, 17 aa, Entamoeba invadens
TISPPQSQPEKKVEKKA

SEQ ID NO: 2913672 - protein, 7 aa, Entamoeba invadens
TISPVDT

SEQ ID NO: 2913673 - protein, 4 aa, Entamoeba invadens
TISR

SEQ ID NO: 2913674 - protein, 8 aa, Entamoeba invadens
TISRVKDS

SEQ ID NO: 2913675 - protein, 6 aa, Entamoeba invadens
TISSEP

SEQ ID NO: 2913676 - protein, 5 aa, Entamoeba invadens
TISSG

SEQ ID NO: 2913677 - protein, 10 aa, Entamoeba invadens
TISSSVTSIG

SEQ ID NO: 2913678 - protein, 5 aa, Entamoeba invadens
TISTS

SEQ ID NO: 2913679 - protein, 13 aa, Entamoeba invadens
TISTTADIPFGPS

SEQ ID NO: 2913680 - protein, 9 aa, Entamoeba invadens
TISYSNPVR

SEQ ID NO: 2913681 - protein, 6 aa, Entamoeba invadens
TITAEN

SEQ ID NO: 2913682 - protein, 15 aa, Entamoeba invadens
TITDEKTPDQKYPKI

SEQ ID NO: 2913683 - protein, 5 aa, Entamoeba invadens
TITDG

SEQ ID NO: 2913684 - protein, 11 aa, Entamoeba invadens
TITDGKTDDFK

SEQ ID NO: 2913685 - protein, 6 aa, Entamoeba invadens
TITDTN

SEQ ID NO: 2913686 - protein, 6 aa, Entamoeba invadens
TITEED

SEQ ID NO: 2913687 - protein, 6 aa, Entamoeba invadens
TITEKQ

SEQ ID NO: 2913688 - protein, 6 aa, Entamoeba invadens
TITENR

SEQ ID NO: 2913689 - protein, 6 aa, Entamoeba invadens
TITETV

SEQ ID NO: 2913690 - protein, 24 aa, Entamoeba invadens
TITGEKKEFTVKNKTNTTIQQRDY

SEQ ID NO: 2913691 - protein, 6 aa, Entamoeba invadens
TITGER

SEQ ID NO: 2913692 - protein, 5 aa, Entamoeba invadens
TITIE

SEQ ID NO: 2913693 - protein, 10 aa, Entamoeba invadens
TITKNSERNI

SEQ ID NO: 2913694 - protein, 7 aa, Entamoeba invadens
TITNDGA

SEQ ID NO: 2913695 - protein, 5 aa, Entamoeba invadens
TITNG

SEQ ID NO: 2913696 - protein, 16 aa, Entamoeba invadens
TITNGSSQTSSNYSYN

SEQ ID NO: 2913697 - protein, 11 aa, Entamoeba invadens
TITNTGISTNL

SEQ ID NO: 2913698 - protein, 8 aa, Entamoeba invadens
TITPQKEI

SEQ ID NO: 2913699 - protein, 8 aa, Entamoeba invadens
TITPQTSR

SEQ ID NO: 2913700 - protein, 4 aa, Entamoeba invadens
TITQ

SEQ ID NO: 2913701 - protein, 31 aa, Entamoeba invadens
TITQDSDTNKYEISNPANSIYPEDKNDSDNF

SEQ ID NO: 2913702 - protein, 12 aa, Entamoeba invadens
TITQPNTENKKM

SEQ ID NO: 2913703 - protein, 6 aa, Entamoeba invadens
TITQQG

SEQ ID NO: 2913704 - protein, 8 aa, Entamoeba invadens
TITQRASK

SEQ ID NO: 2913705 - protein, 4 aa, Entamoeba invadens
TITR

SEQ ID NO: 2913706 - protein, 11 aa, Entamoeba invadens
TITRHSSISTD

SEQ ID NO: 2913707 - protein, 10 aa, Entamoeba invadens
TITSDDGQIF

SEQ ID NO: 2913708 - protein, 5 aa, Entamoeba invadens
TITSE

SEQ ID NO: 2913709 - protein, 26 aa, Entamoeba invadens
TITSGQSEKPSQPNIQTSQSTERLQT

SEQ ID NO: 2913710 - protein, 17 aa, Entamoeba invadens
TITSPSTPCHNENHDNC

SEQ ID NO: 2913711 - protein, 7 aa, Entamoeba invadens
TITSRPV

SEQ ID NO: 2913712 - protein, 29 aa, Entamoeba invadens
TITSSKEEVLTASNEGVLTAKTSGTSEIT

SEQ ID NO: 2913713 - protein, 7 aa, Entamoeba invadens
TITSTTR

SEQ ID NO: 2913714 - protein, 9 aa, Entamoeba invadens
TITTENPEW

SEQ ID NO: 2913715 - protein, 12 aa, Entamoeba invadens
TITTNSVERQNN

SEQ ID NO: 2913716 - protein, 21 aa, Entamoeba invadens
TITTSDSKELRKSLQEDAEVQ

SEQ ID NO: 2913717 - protein, 5 aa, Entamoeba invadens
TIVSG

SEQ ID NO: 2913718 - protein, 7 aa, Entamoeba invadens
TIYPPTK

SEQ ID NO: 2913719 - protein, 9 aa, Entamoeba invadens
TKAAKGKAY

SEQ ID NO: 2913720 - protein, 15 aa, Entamoeba invadens
TKAAVPKIQPATNMK

SEQ ID NO: 2913721 - protein, 11 aa, Entamoeba invadens
TKADEEKNGRI

SEQ ID NO: 2913722 - protein, 6 aa, Entamoeba invadens
TKADNI

SEQ ID NO: 2913723 - protein, 6 aa, Entamoeba invadens
TKAEDI

SEQ ID NO: 2913724 - protein, 8 aa, Entamoeba invadens
TKAEKCSQ

SEQ ID NO: 2913725 - protein, 10 aa, Entamoeba invadens
TKAEQSIDTS

SEQ ID NO: 2913726 - protein, 16 aa, Entamoeba invadens
TKAESDRRHIDCNYGV

SEQ ID NO: 2913727 - protein, 8 aa, Entamoeba invadens
TKAGDKPM

SEQ ID NO: 2913728 - protein, 10 aa, Entamoeba invadens
TKAGGQMEDT

SEQ ID NO: 2913729 - protein, 7 aa, Entamoeba invadens
TKAGSKR

SEQ ID NO: 2913730 - protein, 9 aa, Entamoeba invadens
TKAHPKEQQ

SEQ ID NO: 2913731 - protein, 8 aa, Entamoeba invadens
TKAKDQNA

SEQ ID NO: 2913732 - protein, 8 aa, Entamoeba invadens
TKAKEANE

SEQ ID NO: 2913733 - protein, 12 aa, Entamoeba invadens
TKAKEGKGDDKV

SEQ ID NO: 2913734 - protein, 9 aa, Entamoeba invadens
TKAKLQKED

SEQ ID NO: 2913735 - protein, 7 aa, Entamoeba invadens
TKAKMSC

SEQ ID NO: 2913736 - protein, 5 aa, Entamoeba invadens
TKAKN

SEQ ID NO: 2913737 - protein, 7 aa, Entamoeba invadens
TKAKSST

SEQ ID NO: 2913738 - protein, 13 aa, Entamoeba invadens
TKAKSTEKESTLL

SEQ ID NO: 2913739 - protein, 6 aa, Entamoeba invadens
TKALNR

SEQ ID NO: 2913740 - protein, 11 aa, Entamoeba invadens
TKANTESIEET

SEQ ID NO: 2913741 - protein, 6 aa, Entamoeba invadens
TKANTY

SEQ ID NO: 2913742 - protein, 8 aa, Entamoeba invadens
TKAPESQF

SEQ ID NO: 2913743 - protein, 17 aa, Entamoeba invadens
TKAPQFSTRKATIEGDT

SEQ ID NO: 2913744 - protein, 13 aa, Entamoeba invadens
TKAPVENEKSRRI

SEQ ID NO: 2913745 - protein, 15 aa, Entamoeba invadens
TKASDAKKKKPRQRH

SEQ ID NO: 2913746 - protein, 8 aa, Entamoeba invadens
TKASNNVT

SEQ ID NO: 2913747 - protein, 16 aa, Entamoeba invadens
TKASRHNISNTAITRS

SEQ ID NO: 2913748 - protein, 8 aa, Entamoeba invadens
TKASYTED

SEQ ID NO: 2913749 - protein, 7 aa, Entamoeba invadens
TKATSKE

SEQ ID NO: 2913750 - protein, 8 aa, Entamoeba invadens
TKAVSQKE

SEQ ID NO: 2913751 - protein, 8 aa, Entamoeba invadens
TKCATTTD

SEQ ID NO: 2913752 - protein, 4 aa, Entamoeba invadens
TKCD

SEQ ID NO: 2913753 - protein, 11 aa, Entamoeba invadens
TKCEPVGSTDL

SEQ ID NO: 2913754 - protein, 4 aa, Entamoeba invadens
TKCP

SEQ ID NO: 2913755 - protein, 18 aa, Entamoeba invadens
TKCPKKDGKFWSSSEDAQ

SEQ ID NO: 2913756 - protein, 6 aa, Entamoeba invadens
TKCRSP

SEQ ID NO: 2913757 - protein, 16 aa, Entamoeba invadens
TKCSKNQRKSSKRRPK

SEQ ID NO: 2913758 - protein, 13 aa, Entamoeba invadens
TKCSPNNRNANYS

SEQ ID NO: 2913759 - protein, 13 aa, Entamoeba invadens
TKCSPNNRNATLS

SEQ ID NO: 2913760 - protein, 12 aa, Entamoeba invadens
TKCSPNNRNTSC

SEQ ID NO: 2913761 - protein, 12 aa, Entamoeba invadens
TKCSREKRNLEA

SEQ ID NO: 2913762 - protein, 6 aa, Entamoeba invadens
TKCVTS

SEQ ID NO: 2913763 - protein, 9 aa, Entamoeba invadens
TKDDKDSKL

SEQ ID NO: 2913764 - protein, 11 aa, Entamoeba invadens
TKDDKKHFGNT

SEQ ID NO: 2913765 - protein, 6 aa, Entamoeba invadens
TKDDKL

SEQ ID NO: 2913766 - protein, 14 aa, Entamoeba invadens
TKDDQEKYGNEVPQ

SEQ ID NO: 2913767 - protein, 9 aa, Entamoeba invadens
TKDDQEVKE

SEQ ID NO: 2913768 - protein, 9 aa, Entamoeba invadens
TKDDYEKIT

SEQ ID NO: 2913769 - protein, 5 aa, Entamoeba invadens
TKDEA

SEQ ID NO: 2913770 - protein, 9 aa, Entamoeba invadens
TKDEEGEKD

SEQ ID NO: 2913771 - protein, 6 aa, Entamoeba invadens
TKDEES

SEQ ID NO: 2913772 - protein, 8 aa, Entamoeba invadens
TKDEQKQY

SEQ ID NO: 2913773 - protein, 5 aa, Entamoeba invadens
TKDES

SEQ ID NO: 2913774 - protein, 8 aa, Entamoeba invadens
TKDESTRR

SEQ ID NO: 2913775 - protein, 11 aa, Entamoeba invadens
TKDEVLEKGRS

SEQ ID NO: 2913776 - protein, 6 aa, Entamoeba invadens
TKDEWE

SEQ ID NO: 2913777 - protein, 11 aa, Entamoeba invadens
TKDFETSNTDE

SEQ ID NO: 2913778 - protein, 6 aa, Entamoeba invadens
TKDFSK

SEQ ID NO: 2913779 - protein, 12 aa, Entamoeba invadens
TKDFTQEQKTAL

SEQ ID NO: 2913780 - protein, 4 aa, Entamoeba invadens
TKDG

SEQ ID NO: 2913781 - protein, 7 aa, Entamoeba invadens
TKDGKPY

SEQ ID NO: 2913782 - protein, 21 aa, Entamoeba invadens
TKDGNDQRVRESDAKDSGMAK

SEQ ID NO: 2913783 - protein, 9 aa, Entamoeba invadens
TKDGTIQET

SEQ ID NO: 2913784 - protein, 8 aa, Entamoeba invadens
TKDGYNPQ

SEQ ID NO: 2913785 - protein, 17 aa, Entamoeba invadens
TKDHEKKDAKPTSECLS

SEQ ID NO: 2913786 - protein, 8 aa, Entamoeba invadens
TKDIASYG

SEQ ID NO: 2913787 - protein, 12 aa, Entamoeba invadens
TKDKAKKNLLEN

SEQ ID NO: 2913788 - protein, 13 aa, Entamoeba invadens
TKDKGDGTNVTSY

SEQ ID NO: 2913789 - protein, 5 aa, Entamoeba invadens
TKDKT

SEQ ID NO: 2913790 - protein, 4 aa, Entamoeba invadens
TKDL

SEQ ID NO: 2913791 - protein, 6 aa, Entamoeba invadens
TKDMTS

SEQ ID NO: 2913792 - protein, 6 aa, Entamoeba invadens
TKDMVT

SEQ ID NO: 2913793 - protein, 5 aa, Entamoeba invadens
TKDNH

SEQ ID NO: 2913794 - protein, 10 aa, Entamoeba invadens
TKDNLPNTSN

SEQ ID NO: 2913795 - protein, 5 aa, Entamoeba invadens
TKDNR

SEQ ID NO: 2913796 - protein, 7 aa, Entamoeba invadens
TKDNSCY

SEQ ID NO: 2913797 - protein, 8 aa, Entamoeba invadens
TKDPHPSR

SEQ ID NO: 2913798 - protein, 17 aa, Entamoeba invadens
TKDPIGETKKIYKYFGM

SEQ ID NO: 2913799 - protein, 7 aa, Entamoeba invadens
TKDPKEV

SEQ ID NO: 2913800 - protein, 7 aa, Entamoeba invadens
TKDPKKV

SEQ ID NO: 2913801 - protein, 13 aa, Entamoeba invadens
TKDQATSQIESEI

SEQ ID NO: 2913802 - protein, 53 aa, Entamoeba invadens
TKDQFESIENNQQENTEPTELKEEEQGTQDESPKEVIQDEKSQSDETKDTTDV

SEQ ID NO: 2913803 - protein, 6 aa, Entamoeba invadens
TKDRIP

SEQ ID NO: 2913804 - protein, 15 aa, Entamoeba invadens
TKDRNSCTEHKKYTD

SEQ ID NO: 2913805 - protein, 16 aa, Entamoeba invadens
TKDRQSLICSRLIVLK

SEQ ID NO: 2913806 - protein, 11 aa, Entamoeba invadens
TKDSAKMDEQL

SEQ ID NO: 2913807 - protein, 6 aa, Entamoeba invadens
TKDSEP

SEQ ID NO: 2913808 - protein, 6 aa, Entamoeba invadens
TKDSLE

SEQ ID NO: 2913809 - protein, 30 aa, Entamoeba invadens
TKDSLKKKSPRRSPLSSPRKSPHSAKERPI

SEQ ID NO: 2913810 - protein, 7 aa, Entamoeba invadens
TKDSNVT

SEQ ID NO: 2913811 - protein, 5 aa, Entamoeba invadens
TKDST

SEQ ID NO: 2913812 - protein, 13 aa, Entamoeba invadens
TKDSTKTISDHER

SEQ ID NO: 2913813 - protein, 4 aa, Entamoeba invadens
TKDT

SEQ ID NO: 2913814 - protein, 19 aa, Entamoeba invadens
TKDTDSKQVKTSNANDMSQ

SEQ ID NO: 2913815 - protein, 7 aa, Entamoeba invadens
TKDTENL

SEQ ID NO: 2913816 - protein, 9 aa, Entamoeba invadens
TKDTGIRES

SEQ ID NO: 2913817 - protein, 13 aa, Entamoeba invadens
TKDTIELSPSTQC

SEQ ID NO: 2913818 - protein, 18 aa, Entamoeba invadens
TKDTRPILAGGNDVLKAL

SEQ ID NO: 2913819 - protein, 16 aa, Entamoeba invadens
TKDVPDNSIVAGNPAK

SEQ ID NO: 2913820 - protein, 8 aa, Entamoeba invadens
TKDVQTTK

SEQ ID NO: 2913821 - protein, 9 aa, Entamoeba invadens
TKDVSKNTD

SEQ ID NO: 2913822 - protein, 35 aa, Entamoeba invadens
TKEAAEMTERASVEKKRREEECAQMEEEERKIEIE

SEQ ID NO: 2913823 - protein, 6 aa, Entamoeba invadens
TKEAAS

SEQ ID NO: 2913824 - protein, 13 aa, Entamoeba invadens
TKEARAYEKAEDP

SEQ ID NO: 2913825 - protein, 5 aa, Entamoeba invadens
TKECG

SEQ ID NO: 2913826 - protein, 4 aa, Entamoeba invadens
TKED

SEQ ID NO: 2913827 - protein, 7 aa, Entamoeba invadens
TKEDDDV

SEQ ID NO: 2913828 - protein, 16 aa, Entamoeba invadens
TKEDEKDKLKVENKRK

SEQ ID NO: 2913829 - protein, 8 aa, Entamoeba invadens
TKEDGERA

SEQ ID NO: 2913830 - protein, 17 aa, Entamoeba invadens
TKEDKFDDLKTSLPKSS

SEQ ID NO: 2913831 - protein, 8 aa, Entamoeba invadens
TKEDNSIK

SEQ ID NO: 2913832 - protein, 10 aa, Entamoeba invadens
TKEDQQNAIK

SEQ ID NO: 2913833 - protein, 22 aa, Entamoeba invadens
TKEDREKYGDTIPYKTKALGAN

SEQ ID NO: 2913834 - protein, 13 aa, Entamoeba invadens
TKEDREKYGNTIP

SEQ ID NO: 2913835 - protein, 5 aa, Entamoeba invadens
TKEDS

SEQ ID NO: 2913836 - protein, 8 aa, Entamoeba invadens
TKEDTKNG

SEQ ID NO: 2913837 - protein, 8 aa, Entamoeba invadens
TKEDTSDV

SEQ ID NO: 2913838 - protein, 20 aa, Entamoeba invadens
TKEDYNERGPDCITQKFYFR

SEQ ID NO: 2913839 - protein, 4 aa, Entamoeba invadens
TKEE

SEQ ID NO: 2913840 - protein, 5 aa, Entamoeba invadens
TKEEA

SEQ ID NO: 2913841 - protein, 10 aa, Entamoeba invadens
TKEEAKTFAD

SEQ ID NO: 2913842 - protein, 6 aa, Entamoeba invadens
TKEECD

SEQ ID NO: 2913843 - protein, 8 aa, Entamoeba invadens
TKEEDTGL

SEQ ID NO: 2913844 - protein, 16 aa, Entamoeba invadens
TKEEEAKKAKDELTGR

SEQ ID NO: 2913845 - protein, 12 aa, Entamoeba invadens
TKEEEEAPVEDT

SEQ ID NO: 2913846 - protein, 18 aa, Entamoeba invadens
TKEEEEEIKQKNKWLEEF

SEQ ID NO: 2913847 - protein, 10 aa, Entamoeba invadens
TKEEIEKRKE

SEQ ID NO: 2913848 - protein, 16 aa, Entamoeba invadens
TKEEIESKKPRPMKKN

SEQ ID NO: 2913849 - protein, 5 aa, Entamoeba invadens
TKEEL

SEQ ID NO: 2913850 - protein, 7 aa, Entamoeba invadens
TKEELAQ

SEQ ID NO: 2913851 - protein, 13 aa, Entamoeba invadens
TKEELNKTKHEIG

SEQ ID NO: 2913852 - protein, 5 aa, Entamoeba invadens
TKEEM

SEQ ID NO: 2913853 - protein, 9 aa, Entamoeba invadens
TKEENEIIG

SEQ ID NO: 2913854 - protein, 10 aa, Entamoeba invadens
TKEERESASQ

SEQ ID NO: 2913855 - protein, 6 aa, Entamoeba invadens
TKEERQ

SEQ ID NO: 2913856 - protein, 9 aa, Entamoeba invadens
TKEERSEEL

SEQ ID NO: 2913857 - protein, 6 aa, Entamoeba invadens
TKEERY

SEQ ID NO: 2913858 - protein, 8 aa, Entamoeba invadens
TKEETERA

SEQ ID NO: 2913859 - protein, 9 aa, Entamoeba invadens
TKEETIEEN

SEQ ID NO: 2913860 - protein, 8 aa, Entamoeba invadens
TKEETQKR

SEQ ID NO: 2913861 - protein, 6 aa, Entamoeba invadens
TKEETS

SEQ ID NO: 2913862 - protein, 7 aa, Entamoeba invadens
TKEGAEK

SEQ ID NO: 2913863 - protein, 5 aa, Entamoeba invadens
TKEGD

SEQ ID NO: 2913864 - protein, 9 aa, Entamoeba invadens
TKEGESRAV

SEQ ID NO: 2913865 - protein, 5 aa, Entamoeba invadens
TKEGG

SEQ ID NO: 2913866 - protein, 9 aa, Entamoeba invadens
TKEGTKSYI

SEQ ID NO: 2913867 - protein, 7 aa, Entamoeba invadens
TKEGVSR

SEQ ID NO: 2913868 - protein, 19 aa, Entamoeba invadens
TKEHSNLDKEEKELADKED

SEQ ID NO: 2913869 - protein, 13 aa, Entamoeba invadens
TKEIKGNDRTTTK

SEQ ID NO: 2913870 - protein, 6 aa, Entamoeba invadens
TKEIPK

SEQ ID NO: 2913871 - protein, 14 aa, Entamoeba invadens
TKEIPNKKNPLTFN

SEQ ID NO: 2913872 - protein, 7 aa, Entamoeba invadens
TKEITEF

SEQ ID NO: 2913873 - protein, 11 aa, Entamoeba invadens
TKEKCDSEGKM

SEQ ID NO: 2913874 - protein, 8 aa, Entamoeba invadens
TKEKLVPQ

SEQ ID NO: 2913875 - protein, 8 aa, Entamoeba invadens
TKEKMDGP

SEQ ID NO: 2913876 - protein, 5 aa, Entamoeba invadens
TKEKN

SEQ ID NO: 2913877 - protein, 28 aa, Entamoeba invadens
TKEKPDSELVTKTKKTREKAKKAKDALI

SEQ ID NO: 2913878 - protein, 6 aa, Entamoeba invadens
TKEKQF

SEQ ID NO: 2913879 - protein, 11 aa, Entamoeba invadens
TKELEKAKGQI

SEQ ID NO: 2913880 - protein, 9 aa, Entamoeba invadens
TKELKEKAD

SEQ ID NO: 2913881 - protein, 13 aa, Entamoeba invadens
TKELKEKSLQEEN

SEQ ID NO: 2913882 - protein, 5 aa, Entamoeba invadens
TKEME

SEQ ID NO: 2913883 - protein, 4 aa, Entamoeba invadens
TKEN

SEQ ID NO: 2913884 - protein, 11 aa, Entamoeba invadens
TKENANYPRRV

SEQ ID NO: 2913885 - protein, 5 aa, Entamoeba invadens
TKENE

SEQ ID NO: 2913886 - protein, 9 aa, Entamoeba invadens
TKENEAKNF

SEQ ID NO: 2913887 - protein, 8 aa, Entamoeba invadens
TKENEDSE

SEQ ID NO: 2913888 - protein, 11 aa, Entamoeba invadens
TKENIDVASTA

SEQ ID NO: 2913889 - protein, 6 aa, Entamoeba invadens
TKENKE

SEQ ID NO: 2913890 - protein, 6 aa, Entamoeba invadens
TKENKN

SEQ ID NO: 2913891 - protein, 6 aa, Entamoeba invadens
TKENKV

SEQ ID NO: 2913892 - protein, 19 aa, Entamoeba invadens
TKENPKAEKGKTGSPEELA

SEQ ID NO: 2913893 - protein, 8 aa, Entamoeba invadens
TKEPKYHP

SEQ ID NO: 2913894 - protein, 6 aa, Entamoeba invadens
TKEPLQ

SEQ ID NO: 2913895 - protein, 13 aa, Entamoeba invadens
TKEPSTTNTNNAK

SEQ ID NO: 2913896 - protein, 43 aa, Entamoeba invadens
TKEPTKSEAKPIKQSTHQISKIEDKKNNSKKETQKASTDHHTL

SEQ ID NO: 2913897 - protein, 15 aa, Entamoeba invadens
TKEQDDELGLNDMKT

SEQ ID NO: 2913898 - protein, 15 aa, Entamoeba invadens
TKEQEEKEKIKINKE

SEQ ID NO: 2913899 - protein, 16 aa, Entamoeba invadens
TKEQEEKEKKEINKER

SEQ ID NO: 2913900 - protein, 16 aa, Entamoeba invadens
TKEQKSISYEKSPLDV

SEQ ID NO: 2913901 - protein, 6 aa, Entamoeba invadens
TKEQTQ

SEQ ID NO: 2913902 - protein, 8 aa, Entamoeba invadens
TKEQYERD

SEQ ID NO: 2913903 - protein, 17 aa, Entamoeba invadens
TKEQYERDNNVNIESNR

SEQ ID NO: 2913904 - protein, 8 aa, Entamoeba invadens
TKERGGDV

SEQ ID NO: 2913905 - protein, 8 aa, Entamoeba invadens
TKERGSDV

SEQ ID NO: 2913906 - protein, 15 aa, Entamoeba invadens
TKERHEHKKQIGEMT

SEQ ID NO: 2913907 - protein, 9 aa, Entamoeba invadens
TKERKTVDP

SEQ ID NO: 2913908 - protein, 7 aa, Entamoeba invadens
TKERTDD

SEQ ID NO: 2913909 - protein, 8 aa, Entamoeba invadens
TKESEIQQ

SEQ ID NO: 2913910 - protein, 9 aa, Entamoeba invadens
TKESENNKY

SEQ ID NO: 2913911 - protein, 7 aa, Entamoeba invadens
TKESGSL

SEQ ID NO: 2913912 - protein, 20 aa, Entamoeba invadens
TKESHKKAAKKVLDSIRSLN

SEQ ID NO: 2913913 - protein, 9 aa, Entamoeba invadens
TKESLAQNV

SEQ ID NO: 2913914 - protein, 6 aa, Entamoeba invadens
TKESWV

SEQ ID NO: 2913915 - protein, 4 aa, Entamoeba invadens
TKET

SEQ ID NO: 2913916 - protein, 7 aa, Entamoeba invadens
TKETEVQ

SEQ ID NO: 2913917 - protein, 16 aa, Entamoeba invadens
TKEVKEVKEAKESDML

SEQ ID NO: 2913918 - protein, 4 aa, Entamoeba invadens
TKEY

SEQ ID NO: 2913919 - protein, 5 aa, Entamoeba invadens
TKFET

SEQ ID NO: 2913920 - protein, 15 aa, Entamoeba invadens
TKFETKEDDKYATTC

SEQ ID NO: 2913921 - protein, 12 aa, Entamoeba invadens
TKFGDGAEEIYK

SEQ ID NO: 2913922 - protein, 4 aa, Entamoeba invadens
TKFK

SEQ ID NO: 2913923 - protein, 9 aa, Entamoeba invadens
TKFKDNTSK

SEQ ID NO: 2913924 - protein, 31 aa, Entamoeba invadens
TKFNNSVEEKKKLETDLADKDKQIKDKDDEV

SEQ ID NO: 2913925 - protein, 13 aa, Entamoeba invadens
TKFPRRLSAFGLL

SEQ ID NO: 2913926 - protein, 6 aa, Entamoeba invadens
TKFRNQ

SEQ ID NO: 2913927 - protein, 6 aa, Entamoeba invadens
TKFSND

SEQ ID NO: 2913928 - protein, 14 aa, Entamoeba invadens
TKGADKGGKSLGDV

SEQ ID NO: 2913929 - protein, 7 aa, Entamoeba invadens
TKGAKPH

SEQ ID NO: 2913930 - protein, 6 aa, Entamoeba invadens
TKGATI

SEQ ID NO: 2913931 - protein, 8 aa, Entamoeba invadens
TKGDAQRV

SEQ ID NO: 2913932 - protein, 9 aa, Entamoeba invadens
TKGDDVPKD

SEQ ID NO: 2913933 - protein, 12 aa, Entamoeba invadens
TKGDGTTPPPSV

SEQ ID NO: 2913934 - protein, 6 aa, Entamoeba invadens
TKGDIG

SEQ ID NO: 2913935 - protein, 14 aa, Entamoeba invadens
TKGDRKVYGDDIPS

SEQ ID NO: 2913936 - protein, 5 aa, Entamoeba invadens
TKGES

SEQ ID NO: 2913937 - protein, 11 aa, Entamoeba invadens
TKGFAKHKTSG

SEQ ID NO: 2913938 - protein, 4 aa, Entamoeba invadens
TKGI

SEQ ID NO: 2913939 - protein, 7 aa, Entamoeba invadens
TKGINET

SEQ ID NO: 2913940 - protein, 9 aa, Entamoeba invadens
TKGIPPVTY

SEQ ID NO: 2913941 - protein, 5 aa, Entamoeba invadens
TKGIR

SEQ ID NO: 2913942 - protein, 5 aa, Entamoeba invadens
TKGKE

SEQ ID NO: 2913943 - protein, 8 aa, Entamoeba invadens
TKGKEQDK

SEQ ID NO: 2913944 - protein, 11 aa, Entamoeba invadens
TKGKKDGGVEY

SEQ ID NO: 2913945 - protein, 6 aa, Entamoeba invadens
TKGKPM

SEQ ID NO: 2913946 - protein, 14 aa, Entamoeba invadens
TKGKTDVTVEKSES

SEQ ID NO: 2913947 - protein, 7 aa, Entamoeba invadens
TKGNKFG

SEQ ID NO: 2913948 - protein, 6 aa, Entamoeba invadens
TKGNPV

SEQ ID NO: 2913949 - protein, 30 aa, Entamoeba invadens
TKGNTLSREDSVTESTSNSETPAGNGHMQQ

SEQ ID NO: 2913950 - protein, 4 aa, Entamoeba invadens
TKGP

SEQ ID NO: 2913951 - protein, 9 aa, Entamoeba invadens
TKGPKGDEY

SEQ ID NO: 2913952 - protein, 5 aa, Entamoeba invadens
TKGPV

SEQ ID NO: 2913953 - protein, 9 aa, Entamoeba invadens
TKGQEGPLL

SEQ ID NO: 2913954 - protein, 7 aa, Entamoeba invadens
TKGRNGS

SEQ ID NO: 2913955 - protein, 5 aa, Entamoeba invadens
TKGRP

SEQ ID NO: 2913956 - protein, 15 aa, Entamoeba invadens
TKGRVTLQKNDTTLS

SEQ ID NO: 2913957 - protein, 7 aa, Entamoeba invadens
TKGSEND

SEQ ID NO: 2913958 - protein, 6 aa, Entamoeba invadens
TKGSVP

SEQ ID NO: 2913959 - protein, 6 aa, Entamoeba invadens
TKGSVR

SEQ ID NO: 2913960 - protein, 6 aa, Entamoeba invadens
TKGTED

SEQ ID NO: 2913961 - protein, 7 aa, Entamoeba invadens
TKGTGKF

SEQ ID NO: 2913962 - protein, 8 aa, Entamoeba invadens
TKGTGTPK

SEQ ID NO: 2913963 - protein, 8 aa, Entamoeba invadens
TKGTVGCG

SEQ ID NO: 2913964 - protein, 6 aa, Entamoeba invadens
TKGVPE

SEQ ID NO: 2913965 - protein, 9 aa, Entamoeba invadens
TKGVPNENG

SEQ ID NO: 2913966 - protein, 5 aa, Entamoeba invadens
TKGVS

SEQ ID NO: 2913967 - protein, 9 aa, Entamoeba invadens
TKGVSQSLQ

SEQ ID NO: 2913968 - protein, 7 aa, Entamoeba invadens
TKGYEQE

SEQ ID NO: 2913969 - protein, 5 aa, Entamoeba invadens
TKGYG

SEQ ID NO: 2913970 - protein, 10 aa, Entamoeba invadens
TKHEAPQEPH

SEQ ID NO: 2913971 - protein, 5 aa, Entamoeba invadens
TKHGA

SEQ ID NO: 2913972 - protein, 9 aa, Entamoeba invadens
TKHGEPNAD

SEQ ID NO: 2913973 - protein, 5 aa, Entamoeba invadens
TKHGG

SEQ ID NO: 2913974 - protein, 12 aa, Entamoeba invadens
TKHGKRNKITFM

SEQ ID NO: 2913975 - protein, 6 aa, Entamoeba invadens
TKHKQY

SEQ ID NO: 2913976 - protein, 11 aa, Entamoeba invadens
TKHLTRPPTPP

SEQ ID NO: 2913977 - protein, 4 aa, Entamoeba invadens
TKHN

SEQ ID NO: 2913978 - protein, 14 aa, Entamoeba invadens
TKHNGTGGKSIYGA

SEQ ID NO: 2913979 - protein, 7 aa, Entamoeba invadens
TKHNKSM

SEQ ID NO: 2913980 - protein, 19 aa, Entamoeba invadens
TKHNPTDDAEKKRIEEAGG

SEQ ID NO: 2913981 - protein, 6 aa, Entamoeba invadens
TKHPEE

SEQ ID NO: 2913982 - protein, 6 aa, Entamoeba invadens
TKHPPT

SEQ ID NO: 2913983 - protein, 4 aa, Entamoeba invadens
TKHS

SEQ ID NO: 2913984 - protein, 12 aa, Entamoeba invadens
TKHSKRNKITFM

SEQ ID NO: 2913985 - protein, 15 aa, Entamoeba invadens
TKHSSDSKSVVKESP

SEQ ID NO: 2913986 - protein, 4 aa, Entamoeba invadens
TKHT

SEQ ID NO: 2913987 - protein, 9 aa, Entamoeba invadens
TKHTDRNKR

SEQ ID NO: 2913988 - protein, 7 aa, Entamoeba invadens
TKHTTPH

SEQ ID NO: 2913989 - protein, 7 aa, Entamoeba invadens
TKHTTSK

SEQ ID NO: 2913990 - protein, 8 aa, Entamoeba invadens
TKIATSKK

SEQ ID NO: 2913991 - protein, 4 aa, Entamoeba invadens
TKID

SEQ ID NO: 2913992 - protein, 13 aa, Entamoeba invadens
TKIDAKNKGMETP

SEQ ID NO: 2913993 - protein, 35 aa, Entamoeba invadens
TKIDETKDKTQKVKEENEALKKERKGDDDRGTNIK

SEQ ID NO: 2913994 - protein, 7 aa, Entamoeba invadens
TKIDGRP

SEQ ID NO: 2913995 - protein, 9 aa, Entamoeba invadens
TKIDSADSI

SEQ ID NO: 2913996 - protein, 10 aa, Entamoeba invadens
TKIEDGNAPK

SEQ ID NO: 2913997 - protein, 17 aa, Entamoeba invadens
TKIEKEAEKKVTKPNEA

SEQ ID NO: 2913998 - protein, 26 aa, Entamoeba invadens
TKIEMKEQKGGKVEKIEKAKTPFINS

SEQ ID NO: 2913999 - protein, 5 aa, Entamoeba invadens
TKIEN

SEQ ID NO: 2914000 - protein, 14 aa, Entamoeba invadens
TKIERTDFKSEAKL

SEQ ID NO: 2914001 - protein, 5 aa, Entamoeba invadens
TKIES

SEQ ID NO: 2914002 - protein, 7 aa, Entamoeba invadens
TKIGKGG

SEQ ID NO: 2914003 - protein, 14 aa, Entamoeba invadens
TKIGNLKATQTNNV

SEQ ID NO: 2914004 - protein, 13 aa, Entamoeba invadens
TKIKKNKKDSEKI

SEQ ID NO: 2914005 - protein, 7 aa, Entamoeba invadens
TKINDAN

SEQ ID NO: 2914006 - protein, 22 aa, Entamoeba invadens
TKINGEVTGNNIESIKKAEDQL

SEQ ID NO: 2914007 - protein, 6 aa, Entamoeba invadens
TKINKY

SEQ ID NO: 2914008 - protein, 10 aa, Entamoeba invadens
TKINSKSEGI

SEQ ID NO: 2914009 - protein, 4 aa, Entamoeba invadens
TKIP

SEQ ID NO: 2914010 - protein, 8 aa, Entamoeba invadens
TKIPNGCA

SEQ ID NO: 2914011 - protein, 10 aa, Entamoeba invadens
TKIPSLPGYE

SEQ ID NO: 2914012 - protein, 4 aa, Entamoeba invadens
TKIQ

SEQ ID NO: 2914013 - protein, 5 aa, Entamoeba invadens
TKIQP

SEQ ID NO: 2914014 - protein, 7 aa, Entamoeba invadens
TKIQRTV

SEQ ID NO: 2914015 - protein, 14 aa, Entamoeba invadens
TKISKIPTLREKDH

SEQ ID NO: 2914016 - protein, 18 aa, Entamoeba invadens
TKISKNAAIEMNDDTLEP

SEQ ID NO: 2914017 - protein, 8 aa, Entamoeba invadens
TKISNENN

SEQ ID NO: 2914018 - protein, 7 aa, Entamoeba invadens
TKISNKS

SEQ ID NO: 2914019 - protein, 10 aa, Entamoeba invadens
TKISPEKSTF

SEQ ID NO: 2914020 - protein, 6 aa, Entamoeba invadens
TKISPQ

SEQ ID NO: 2914021 - protein, 7 aa, Entamoeba invadens
TKISPQL

SEQ ID NO: 2914022 - protein, 12 aa, Entamoeba invadens
TKISRDLPEPTN

SEQ ID NO: 2914023 - protein, 16 aa, Entamoeba invadens
TKISRPNSPSHSTSRS

SEQ ID NO: 2914024 - protein, 6 aa, Entamoeba invadens
TKITAK

SEQ ID NO: 2914025 - protein, 10 aa, Entamoeba invadens
TKITDPKRAL

SEQ ID NO: 2914026 - protein, 9 aa, Entamoeba invadens
TKITEKRKS

SEQ ID NO: 2914027 - protein, 5 aa, Entamoeba invadens
TKITG

SEQ ID NO: 2914028 - protein, 8 aa, Entamoeba invadens
TKITNPNN

SEQ ID NO: 2914029 - protein, 6 aa, Entamoeba invadens
TKITNR

SEQ ID NO: 2914030 - protein, 13 aa, Entamoeba invadens
TKITQQNKDLDKH

SEQ ID NO: 2914031 - protein, 15 aa, Entamoeba invadens
TKITSEKKPRQDKTT

SEQ ID NO: 2914032 - protein, 11 aa, Entamoeba invadens
TKITSNDEDIE

SEQ ID NO: 2914033 - protein, 9 aa, Entamoeba invadens
TKITTKEGM

SEQ ID NO: 2914034 - protein, 16 aa, Entamoeba invadens
TKKACNSMNTPPKPKH

SEQ ID NO: 2914035 - protein, 17 aa, Entamoeba invadens
TKKACNSVYSPPKPKHV

SEQ ID NO: 2914036 - protein, 19 aa, Entamoeba invadens
TKKAIAEPGVVSINKTSSC

SEQ ID NO: 2914037 - protein, 8 aa, Entamoeba invadens
TKKAKLTE

SEQ ID NO: 2914038 - protein, 8 aa, Entamoeba invadens
TKKAPKLY

SEQ ID NO: 2914039 - protein, 13 aa, Entamoeba invadens
TKKATEKVQFEGK

SEQ ID NO: 2914040 - protein, 8 aa, Entamoeba invadens
TKKDEDWN

SEQ ID NO: 2914041 - protein, 7 aa, Entamoeba invadens
TKKDEIR

SEQ ID NO: 2914042 - protein, 29 aa, Entamoeba invadens
TKKDEKKGKKRHASISTEAPSTQPPPPKL

SEQ ID NO: 2914043 - protein, 14 aa, Entamoeba invadens
TKKDGKKIEGETMH

SEQ ID NO: 2914044 - protein, 8 aa, Entamoeba invadens
TKKDKEME

SEQ ID NO: 2914045 - protein, 9 aa, Entamoeba invadens
TKKDKKHHT

SEQ ID NO: 2914046 - protein, 9 aa, Entamoeba invadens
TKKDKYERC

SEQ ID NO: 2914047 - protein, 11 aa, Entamoeba invadens
TKKDNKGNHNV

SEQ ID NO: 2914048 - protein, 8 aa, Entamoeba invadens
TKKDQKKR

SEQ ID NO: 2914049 - protein, 11 aa, Entamoeba invadens
TKKDRENYGNV

SEQ ID NO: 2914050 - protein, 10 aa, Entamoeba invadens
TKKDSGPCFD

SEQ ID NO: 2914051 - protein, 9 aa, Entamoeba invadens
TKKEDLRKS

SEQ ID NO: 2914052 - protein, 7 aa, Entamoeba invadens
TKKEDPF

SEQ ID NO: 2914053 - protein, 8 aa, Entamoeba invadens
TKKELGDT

SEQ ID NO: 2914054 - protein, 16 aa, Entamoeba invadens
TKKEPTPKKAKSKSTV

SEQ ID NO: 2914055 - protein, 31 aa, Entamoeba invadens
TKKETSLSPQIQDTSKQEFERKSSGETSPAV

SEQ ID NO: 2914056 - protein, 9 aa, Entamoeba invadens
TKKETVNTE

SEQ ID NO: 2914057 - protein, 50 aa, Entamoeba invadens
TKKEVPKIDADQKAGMKQRMGEAKVTAKSSYSKAKETEEWKAAKGQAKVV

SEQ ID NO: 2914058 - protein, 7 aa, Entamoeba invadens
TKKFENK

SEQ ID NO: 2914059 - protein, 6 aa, Entamoeba invadens
TKKGDP

SEQ ID NO: 2914060 - protein, 6 aa, Entamoeba invadens
TKKGES

SEQ ID NO: 2914061 - protein, 8 aa, Entamoeba invadens
TKKGLNPQ

SEQ ID NO: 2914062 - protein, 7 aa, Entamoeba invadens
TKKGRFD

SEQ ID NO: 2914063 - protein, 9 aa, Entamoeba invadens
TKKGYTEHD

SEQ ID NO: 2914064 - protein, 9 aa, Entamoeba invadens
TKKHLNNEE

SEQ ID NO: 2914065 - protein, 19 aa, Entamoeba invadens
TKKHTEEIQKSEQQINEKE

SEQ ID NO: 2914066 - protein, 5 aa, Entamoeba invadens
TKKIG

SEQ ID NO: 2914067 - protein, 17 aa, Entamoeba invadens
TKKITTPCSKLEKSSFY

SEQ ID NO: 2914068 - protein, 38 aa, Entamoeba invadens
TKKKEEETKKEKEKEKEEKLRKQIEKQSAEKRENGRKK

SEQ ID NO: 2914069 - protein, 9 aa, Entamoeba invadens
TKKKGDMKC

SEQ ID NO: 2914070 - protein, 26 aa, Entamoeba invadens
TKKKSAESSLSVEPINESVPKHSEET

SEQ ID NO: 2914071 - protein, 8 aa, Entamoeba invadens
TKKKSGIT

SEQ ID NO: 2914072 - protein, 7 aa, Entamoeba invadens
TKKKSNV

SEQ ID NO: 2914073 - protein, 10 aa, Entamoeba invadens
TKKKSSTDKH

SEQ ID NO: 2914074 - protein, 5 aa, Entamoeba invadens
TKKLE

SEQ ID NO: 2914075 - protein, 9 aa, Entamoeba invadens
TKKNEEKES

SEQ ID NO: 2914076 - protein, 8 aa, Entamoeba invadens
TKKNEIRT

SEQ ID NO: 2914077 - protein, 5 aa, Entamoeba invadens
TKKNG

SEQ ID NO: 2914078 - protein, 8 aa, Entamoeba invadens
TKKNTIPG

SEQ ID NO: 2914079 - protein, 4 aa, Entamoeba invadens
TKKP

SEQ ID NO: 2914080 - protein, 9 aa, Entamoeba invadens
TKKPQAPEE

SEQ ID NO: 2914081 - protein, 8 aa, Entamoeba invadens
TKKPSKTV

SEQ ID NO: 2914082 - protein, 10 aa, Entamoeba invadens
TKKPTPEELK

SEQ ID NO: 2914083 - protein, 6 aa, Entamoeba invadens
TKKQDP

SEQ ID NO: 2914084 - protein, 17 aa, Entamoeba invadens
TKKQNSSPVAPSNFKDE

SEQ ID NO: 2914085 - protein, 7 aa, Entamoeba invadens
TKKQRSN

SEQ ID NO: 2914086 - protein, 10 aa, Entamoeba invadens
TKKQTLIKQN

SEQ ID NO: 2914087 - protein, 9 aa, Entamoeba invadens
TKKQVGYIN

SEQ ID NO: 2914088 - protein, 8 aa, Entamoeba invadens
TKKRRTKG

SEQ ID NO: 2914089 - protein, 19 aa, Entamoeba invadens
TKKRSGPSMFEPPKSLVSH

SEQ ID NO: 2914090 - protein, 14 aa, Entamoeba invadens
TKKRSLECTCCGSS

SEQ ID NO: 2914091 - protein, 13 aa, Entamoeba invadens
TKKRTFNSKTQLT

SEQ ID NO: 2914092 - protein, 7 aa, Entamoeba invadens
TKKSDAP

SEQ ID NO: 2914093 - protein, 10 aa, Entamoeba invadens
TKKSDDTTKS

SEQ ID NO: 2914094 - protein, 17 aa, Entamoeba invadens
TKKSDEMNISPPKQESL

SEQ ID NO: 2914095 - protein, 8 aa, Entamoeba invadens
TKKSDKVI

SEQ ID NO: 2914096 - protein, 9 aa, Entamoeba invadens
TKKSDSQRL

SEQ ID NO: 2914097 - protein, 8 aa, Entamoeba invadens
TKKSESVN

SEQ ID NO: 2914098 - protein, 5 aa, Entamoeba invadens
TKKSF

SEQ ID NO: 2914099 - protein, 16 aa, Entamoeba invadens
TKKSKDAHRYYPDPRE

SEQ ID NO: 2914100 - protein, 8 aa, Entamoeba invadens
TKKSKRAI

SEQ ID NO: 2914101 - protein, 11 aa, Entamoeba invadens
TKKSTKEEGSV

SEQ ID NO: 2914102 - protein, 16 aa, Entamoeba invadens
TKKSTKKNLRNIQKRQ

SEQ ID NO: 2914103 - protein, 5 aa, Entamoeba invadens
TKKSY

SEQ ID NO: 2914104 - protein, 12 aa, Entamoeba invadens
TKKTERNREDAK

SEQ ID NO: 2914105 - protein, 10 aa, Entamoeba invadens
TKKTHENTPD

SEQ ID NO: 2914106 - protein, 10 aa, Entamoeba invadens
TKKTKHPSNI

SEQ ID NO: 2914107 - protein, 13 aa, Entamoeba invadens
TKKTKLQSSDDDK

SEQ ID NO: 2914108 - protein, 28 aa, Entamoeba invadens
TKKTKSRDSVKKKIPTSFSIPKKKTETE

SEQ ID NO: 2914109 - protein, 14 aa, Entamoeba invadens
TKKTSGSKGSVKES

SEQ ID NO: 2914110 - protein, 21 aa, Entamoeba invadens
TKKTTKAYQFPTKTDITSSQC

SEQ ID NO: 2914111 - protein, 9 aa, Entamoeba invadens
TKKTTNTNK

SEQ ID NO: 2914112 - protein, 9 aa, Entamoeba invadens
TKKTTSTSL

SEQ ID NO: 2914113 - protein, 12 aa, Entamoeba invadens
TKKVETTRLDDK

SEQ ID NO: 2914114 - protein, 5 aa, Entamoeba invadens
TKKVH

SEQ ID NO: 2914115 - protein, 14 aa, Entamoeba invadens
TKKVLGGGAELDGD

SEQ ID NO: 2914116 - protein, 6 aa, Entamoeba invadens
TKKYDE

SEQ ID NO: 2914117 - protein, 5 aa, Entamoeba invadens
TKKYH

SEQ ID NO: 2914118 - protein, 7 aa, Entamoeba invadens
TKKYNEN

SEQ ID NO: 2914119 - protein, 8 aa, Entamoeba invadens
TKKYSSNV

SEQ ID NO: 2914120 - protein, 10 aa, Entamoeba invadens
TKKYTRDETP

SEQ ID NO: 2914121 - protein, 5 aa, Entamoeba invadens
TKLDE

SEQ ID NO: 2914122 - protein, 17 aa, Entamoeba invadens
TKLDKRKTQHNSSRQIV

SEQ ID NO: 2914123 - protein, 9 aa, Entamoeba invadens
TKLEEENLK

SEQ ID NO: 2914124 - protein, 22 aa, Entamoeba invadens
TKLEKRKQDEMKYTQKKREMRD

SEQ ID NO: 2914125 - protein, 7 aa, Entamoeba invadens
TKLENSR

SEQ ID NO: 2914126 - protein, 12 aa, Entamoeba invadens
TKLENYNTTSND

SEQ ID NO: 2914127 - protein, 15 aa, Entamoeba invadens
TKLGDTSDANKALQN

SEQ ID NO: 2914128 - protein, 7 aa, Entamoeba invadens
TKLGKKD

SEQ ID NO: 2914129 - protein, 7 aa, Entamoeba invadens
TKLKEGG

SEQ ID NO: 2914130 - protein, 18 aa, Entamoeba invadens
TKLKKPKVKPQQNEEDDF

SEQ ID NO: 2914131 - protein, 13 aa, Entamoeba invadens
TKLKSSDFEEKTL

SEQ ID NO: 2914132 - protein, 6 aa, Entamoeba invadens
TKLNEE

SEQ ID NO: 2914133 - protein, 4 aa, Entamoeba invadens
TKLP

SEQ ID NO: 2914134 - protein, 12 aa, Entamoeba invadens
TKLPKKDLLSSD

SEQ ID NO: 2914135 - protein, 4 aa, Entamoeba invadens
TKLT

SEQ ID NO: 2914136 - protein, 8 aa, Entamoeba invadens
TKLTTPTK

SEQ ID NO: 2914137 - protein, 5 aa, Entamoeba invadens
TKMAQ

SEQ ID NO: 2914138 - protein, 35 aa, Entamoeba invadens
TKMEEVTPNQQTSKTLEQKSQDEKGSKMDEEVDNE

SEQ ID NO: 2914139 - protein, 9 aa, Entamoeba invadens
TKMGATNKL

SEQ ID NO: 2914140 - protein, 9 aa, Entamoeba invadens
TKMKDSMGT

SEQ ID NO: 2914141 - protein, 11 aa, Entamoeba invadens
TKMREEKGAEA

SEQ ID NO: 2914142 - protein, 15 aa, Entamoeba invadens
TKMRRRREGKTDYYA

SEQ ID NO: 2914143 - protein, 41 aa, Entamoeba invadens
TKMSPRKNKQKNVQKEKKTTRRKLKSGMSRKEGQNEDSNAG

SEQ ID NO: 2914144 - protein, 6 aa, Entamoeba invadens
TKMTGE

SEQ ID NO: 2914145 - protein, 9 aa, Entamoeba invadens
TKMTKQSSG

SEQ ID NO: 2914146 - protein, 13 aa, Entamoeba invadens
TKMTSAKKRRVEK

SEQ ID NO: 2914147 - protein, 4 aa, Entamoeba invadens
TKND

SEQ ID NO: 2914148 - protein, 10 aa, Entamoeba invadens
TKNDREMYGS

SEQ ID NO: 2914149 - protein, 8 aa, Entamoeba invadens
TKNDSANY

SEQ ID NO: 2914150 - protein, 6 aa, Entamoeba invadens
TKNDWK

SEQ ID NO: 2914151 - protein, 9 aa, Entamoeba invadens
TKNEEIQKE

SEQ ID NO: 2914152 - protein, 6 aa, Entamoeba invadens
TKNEEM

SEQ ID NO: 2914153 - protein, 5 aa, Entamoeba invadens
TKNEN

SEQ ID NO: 2914154 - protein, 7 aa, Entamoeba invadens
TKNENEV

SEQ ID NO: 2914155 - protein, 7 aa, Entamoeba invadens
TKNEQDY

SEQ ID NO: 2914156 - protein, 10 aa, Entamoeba invadens
TKNERKEVNT

SEQ ID NO: 2914157 - protein, 8 aa, Entamoeba invadens
TKNGCASC

SEQ ID NO: 2914158 - protein, 16 aa, Entamoeba invadens
TKNGHVDNLDEALIAL

SEQ ID NO: 2914159 - protein, 7 aa, Entamoeba invadens
TKNGKTQ

SEQ ID NO: 2914160 - protein, 11 aa, Entamoeba invadens
TKNGNYKIEGS

SEQ ID NO: 2914161 - protein, 7 aa, Entamoeba invadens
TKNGSNM

SEQ ID NO: 2914162 - protein, 14 aa, Entamoeba invadens
TKNGWRQLSGNEMS

SEQ ID NO: 2914163 - protein, 4 aa, Entamoeba invadens
TKNI

SEQ ID NO: 2914164 - protein, 7 aa, Entamoeba invadens
TKNIEGK

SEQ ID NO: 2914165 - protein, 14 aa, Entamoeba invadens
TKNINKPDTEAGKK

SEQ ID NO: 2914166 - protein, 5 aa, Entamoeba invadens
TKNIQ

SEQ ID NO: 2914167 - protein, 4 aa, Entamoeba invadens
TKNK

SEQ ID NO: 2914168 - protein, 9 aa, Entamoeba invadens
TKNKKPTFM

SEQ ID NO: 2914169 - protein, 15 aa, Entamoeba invadens
TKNKQRYNKQHKKTE

SEQ ID NO: 2914170 - protein, 5 aa, Entamoeba invadens
TKNKR

SEQ ID NO: 2914171 - protein, 7 aa, Entamoeba invadens
TKNKTNV

SEQ ID NO: 2914172 - protein, 8 aa, Entamoeba invadens
TKNLGTSV

SEQ ID NO: 2914173 - protein, 9 aa, Entamoeba invadens
TKNNDDEQY

SEQ ID NO: 2914174 - protein, 6 aa, Entamoeba invadens
TKNNKF

SEQ ID NO: 2914175 - protein, 9 aa, Entamoeba invadens
TKNNSNNNL

SEQ ID NO: 2914176 - protein, 15 aa, Entamoeba invadens
TKNNVKEISDAPKKV

SEQ ID NO: 2914177 - protein, 8 aa, Entamoeba invadens
TKNPDGCK

SEQ ID NO: 2914178 - protein, 8 aa, Entamoeba invadens
TKNPIKPQ

SEQ ID NO: 2914179 - protein, 5 aa, Entamoeba invadens
TKNPL

SEQ ID NO: 2914180 - protein, 7 aa, Entamoeba invadens
TKNQIER

SEQ ID NO: 2914181 - protein, 6 aa, Entamoeba invadens
TKNQKN

SEQ ID NO: 2914182 - protein, 8 aa, Entamoeba invadens
TKNQTYDE

SEQ ID NO: 2914183 - protein, 7 aa, Entamoeba invadens
TKNRNAD

SEQ ID NO: 2914184 - protein, 15 aa, Entamoeba invadens
TKNRNIKIGKQTPKF

SEQ ID NO: 2914185 - protein, 16 aa, Entamoeba invadens
TKNRNIKIGKQTPKFK

SEQ ID NO: 2914186 - protein, 14 aa, Entamoeba invadens
TKNSCEQQIDGKSI

SEQ ID NO: 2914187 - protein, 8 aa, Entamoeba invadens
TKNSEGEA

SEQ ID NO: 2914188 - protein, 6 aa, Entamoeba invadens
TKNSLN

SEQ ID NO: 2914189 - protein, 19 aa, Entamoeba invadens
TKNSQPEEVDNLERKDTQL

SEQ ID NO: 2914190 - protein, 6 aa, Entamoeba invadens
TKNSSD

SEQ ID NO: 2914191 - protein, 8 aa, Entamoeba invadens
TKNSTMAK

SEQ ID NO: 2914192 - protein, 7 aa, Entamoeba invadens
TKNSVNR

SEQ ID NO: 2914193 - protein, 11 aa, Entamoeba invadens
TKNTFDNEEEN

SEQ ID NO: 2914194 - protein, 7 aa, Entamoeba invadens
TKNTFNK

SEQ ID NO: 2914195 - protein, 9 aa, Entamoeba invadens
TKNTGVKQT

SEQ ID NO: 2914196 - protein, 7 aa, Entamoeba invadens
TKNTKNF

SEQ ID NO: 2914197 - protein, 5 aa, Entamoeba invadens
TKNTN

SEQ ID NO: 2914198 - protein, 13 aa, Entamoeba invadens
TKNTYSSKSEDMS

SEQ ID NO: 2914199 - protein, 5 aa, Entamoeba invadens
TKNVP

SEQ ID NO: 2914200 - protein, 9 aa, Entamoeba invadens
TKNVPENTI

SEQ ID NO: 2914201 - protein, 19 aa, Entamoeba invadens
TKNVPPKVERSPSNAPTTI

SEQ ID NO: 2914202 - protein, 5 aa, Entamoeba invadens
TKNWA

SEQ ID NO: 2914203 - protein, 12 aa, Entamoeba invadens
TKNYGQAAESFA

SEQ ID NO: 2914204 - protein, 8 aa, Entamoeba invadens
TKPALPTN

SEQ ID NO: 2914205 - protein, 14 aa, Entamoeba invadens
TKPDMKPRRYQNGE

SEQ ID NO: 2914206 - protein, 7 aa, Entamoeba invadens
TKPDNVD

SEQ ID NO: 2914207 - protein, 8 aa, Entamoeba invadens
TKPDPTIP

SEQ ID NO: 2914208 - protein, 42 aa, Entamoeba invadens
TKPEETKESIPEEKGEEKKEEKKEEAKVEKEEEAAKQTVVAT

SEQ ID NO: 2914209 - protein, 22 aa, Entamoeba invadens
TKPEGVKMPQNLPSLQPQPGMP

SEQ ID NO: 2914210 - protein, 9 aa, Entamoeba invadens
TKPEKTISD

SEQ ID NO: 2914211 - protein, 5 aa, Entamoeba invadens
TKPEN

SEQ ID NO: 2914212 - protein, 12 aa, Entamoeba invadens
TKPETAPRNNCP

SEQ ID NO: 2914213 - protein, 4 aa, Entamoeba invadens
TKPF

SEQ ID NO: 2914214 - protein, 7 aa, Entamoeba invadens
TKPGKYG

SEQ ID NO: 2914215 - protein, 8 aa, Entamoeba invadens
TKPGSKVC

SEQ ID NO: 2914216 - protein, 6 aa, Entamoeba invadens
TKPIEK

SEQ ID NO: 2914217 - protein, 7 aa, Entamoeba invadens
TKPIEQL

SEQ ID NO: 2914218 - protein, 5 aa, Entamoeba invadens
TKPIG

SEQ ID NO: 2914219 - protein, 13 aa, Entamoeba invadens
TKPKEKGCKPMPL

SEQ ID NO: 2914220 - protein, 11 aa, Entamoeba invadens
TKPKELPPPQV

SEQ ID NO: 2914221 - protein, 14 aa, Entamoeba invadens
TKPKKKKEDEDTLE

SEQ ID NO: 2914222 - protein, 10 aa, Entamoeba invadens
TKPKTETVEK

SEQ ID NO: 2914223 - protein, 10 aa, Entamoeba invadens
TKPKTTQPHG

SEQ ID NO: 2914224 - protein, 7 aa, Entamoeba invadens
TKPKVGT

SEQ ID NO: 2914225 - protein, 37 aa, Entamoeba invadens
TKPNEIKAEEASNALAQDCKAAEKLAKEPNEKKIKDL

SEQ ID NO: 2914226 - protein, 23 aa, Entamoeba invadens
TKPNNRLKEKRDTQLKDTQPLRK

SEQ ID NO: 2914227 - protein, 12 aa, Entamoeba invadens
TKPNPVSETTVG

SEQ ID NO: 2914228 - protein, 5 aa, Entamoeba invadens
TKPNS

SEQ ID NO: 2914229 - protein, 6 aa, Entamoeba invadens
TKPPSC

SEQ ID NO: 2914230 - protein, 12 aa, Entamoeba invadens
TKPPVKTGHAKM

SEQ ID NO: 2914231 - protein, 23 aa, Entamoeba invadens
TKPPVSKKAKEAVRNEKDTIGET

SEQ ID NO: 2914232 - protein, 4 aa, Entamoeba invadens
TKPQ

SEQ ID NO: 2914233 - protein, 5 aa, Entamoeba invadens
TKPQM

SEQ ID NO: 2914234 - protein, 7 aa, Entamoeba invadens
TKPQNGF

SEQ ID NO: 2914235 - protein, 5 aa, Entamoeba invadens
TKPRA

SEQ ID NO: 2914236 - protein, 11 aa, Entamoeba invadens
TKPRKNTEEKK

SEQ ID NO: 2914237 - protein, 10 aa, Entamoeba invadens
TKPRRKTTIT

SEQ ID NO: 2914238 - protein, 9 aa, Entamoeba invadens
TKPRTITET

SEQ ID NO: 2914239 - protein, 5 aa, Entamoeba invadens
TKPRV

SEQ ID NO: 2914240 - protein, 17 aa, Entamoeba invadens
TKPSENIEKTTSKVETE

SEQ ID NO: 2914241 - protein, 7 aa, Entamoeba invadens
TKPSFKI

SEQ ID NO: 2914242 - protein, 14 aa, Entamoeba invadens
TKPSGGKKGDTPSF

SEQ ID NO: 2914243 - protein, 5 aa, Entamoeba invadens
TKPSI

SEQ ID NO: 2914244 - protein, 28 aa, Entamoeba invadens
TKPSQTETEQPKKRKYELPKEGDQVLEI

SEQ ID NO: 2914245 - protein, 4 aa, Entamoeba invadens
TKPT

SEQ ID NO: 2914246 - protein, 7 aa, Entamoeba invadens
TKPTDVQ

SEQ ID NO: 2914247 - protein, 8 aa, Entamoeba invadens
TKPTHPYY

SEQ ID NO: 2914248 - protein, 14 aa, Entamoeba invadens
TKPTISRQQQRELS

SEQ ID NO: 2914249 - protein, 24 aa, Entamoeba invadens
TKPTLKRTRRTRNNKGKKTERALQ

SEQ ID NO: 2914250 - protein, 16 aa, Entamoeba invadens
TKPTPLAPKNKKDDFA

SEQ ID NO: 2914251 - protein, 8 aa, Entamoeba invadens
TKPTSTIK

SEQ ID NO: 2914252 - protein, 19 aa, Entamoeba invadens
TKPTVSKLQRAKKQWKDSE

SEQ ID NO: 2914253 - protein, 4 aa, Entamoeba invadens
TKPV

SEQ ID NO: 2914254 - protein, 12 aa, Entamoeba invadens
TKPVPPPQSQPL

SEQ ID NO: 2914255 - protein, 4 aa, Entamoeba invadens
TKPY

SEQ ID NO: 2914256 - protein, 10 aa, Entamoeba invadens
TKPYRKEYTE

SEQ ID NO: 2914257 - protein, 11 aa, Entamoeba invadens
TKQCKSCNSSC

SEQ ID NO: 2914258 - protein, 10 aa, Entamoeba invadens
TKQCSSKNTI

SEQ ID NO: 2914259 - protein, 4 aa, Entamoeba invadens
TKQD

SEQ ID NO: 2914260 - protein, 9 aa, Entamoeba invadens
TKQDEEKSQ

SEQ ID NO: 2914261 - protein, 13 aa, Entamoeba invadens
TKQEAANAKAAMA

SEQ ID NO: 2914262 - protein, 11 aa, Entamoeba invadens
TKQEANNLPYE

SEQ ID NO: 2914263 - protein, 7 aa, Entamoeba invadens
TKQEKED

SEQ ID NO: 2914264 - protein, 8 aa, Entamoeba invadens
TKQEKKEG

SEQ ID NO: 2914265 - protein, 9 aa, Entamoeba invadens
TKQEKSKEF

SEQ ID NO: 2914266 - protein, 5 aa, Entamoeba invadens
TKQEL

SEQ ID NO: 2914267 - protein, 12 aa, Entamoeba invadens
TKQEVEKKEESM

SEQ ID NO: 2914268 - protein, 5 aa, Entamoeba invadens
TKQEY

SEQ ID NO: 2914269 - protein, 10 aa, Entamoeba invadens
TKQGGGHKSW

SEQ ID NO: 2914270 - protein, 22 aa, Entamoeba invadens
TKQGVKKSDEDDKELSSYSGRA

SEQ ID NO: 2914271 - protein, 13 aa, Entamoeba invadens
TKQHDQLKGQFNN

SEQ ID NO: 2914272 - protein, 4 aa, Entamoeba invadens
TKQI

SEQ ID NO: 2914273 - protein, 7 aa, Entamoeba invadens
TKQIPGD

SEQ ID NO: 2914274 - protein, 6 aa, Entamoeba invadens
TKQITE

SEQ ID NO: 2914275 - protein, 9 aa, Entamoeba invadens
TKQKCEGDG

SEQ ID NO: 2914276 - protein, 6 aa, Entamoeba invadens
TKQKGG

SEQ ID NO: 2914277 - protein, 7 aa, Entamoeba invadens
TKQKGIE

SEQ ID NO: 2914278 - protein, 19 aa, Entamoeba invadens
TKQKGSTNPLMSKETQTNR

SEQ ID NO: 2914279 - protein, 9 aa, Entamoeba invadens
TKQKTIEKN

SEQ ID NO: 2914280 - protein, 5 aa, Entamoeba invadens
TKQKV

SEQ ID NO: 2914281 - protein, 27 aa, Entamoeba invadens
TKQLDDVKNDEKTTEDKTGTTEKKDEK

SEQ ID NO: 2914282 - protein, 6 aa, Entamoeba invadens
TKQMGV

SEQ ID NO: 2914283 - protein, 8 aa, Entamoeba invadens
TKQNDIKQ

SEQ ID NO: 2914284 - protein, 6 aa, Entamoeba invadens
TKQNQS

SEQ ID NO: 2914285 - protein, 16 aa, Entamoeba invadens
TKQNRTNQSLEKSPQL

SEQ ID NO: 2914286 - protein, 5 aa, Entamoeba invadens
TKQNY

SEQ ID NO: 2914287 - protein, 15 aa, Entamoeba invadens
TKQPATPDDKQTKQL

SEQ ID NO: 2914288 - protein, 9 aa, Entamoeba invadens
TKQPNALSP

SEQ ID NO: 2914289 - protein, 8 aa, Entamoeba invadens
TKQPQTDL

SEQ ID NO: 2914290 - protein, 21 aa, Entamoeba invadens
TKQQDDANKQLNDKNKENDTL

SEQ ID NO: 2914291 - protein, 9 aa, Entamoeba invadens
TKQQDGTFR

SEQ ID NO: 2914292 - protein, 5 aa, Entamoeba invadens
TKQQI

SEQ ID NO: 2914293 - protein, 7 aa, Entamoeba invadens
TKQQQTP

SEQ ID NO: 2914294 - protein, 4 aa, Entamoeba invadens
TKQR

SEQ ID NO: 2914295 - protein, 4 aa, Entamoeba invadens
TKQS

SEQ ID NO: 2914296 - protein, 8 aa, Entamoeba invadens
TKQSETKV

SEQ ID NO: 2914297 - protein, 12 aa, Entamoeba invadens
TKQSRDLTGERL

SEQ ID NO: 2914298 - protein, 6 aa, Entamoeba invadens
TKQSTE

SEQ ID NO: 2914299 - protein, 9 aa, Entamoeba invadens
TKQTEVQNE

SEQ ID NO: 2914300 - protein, 16 aa, Entamoeba invadens
TKQTLHKKEKRDLAEM

SEQ ID NO: 2914301 - protein, 15 aa, Entamoeba invadens
TKQTQQATRQVKSTA

SEQ ID NO: 2914302 - protein, 15 aa, Entamoeba invadens
TKQTQYSTNTPTNTF

SEQ ID NO: 2914303 - protein, 10 aa, Entamoeba invadens
TKQTTHTTDV

SEQ ID NO: 2914304 - protein, 6 aa, Entamoeba invadens
TKQTTQ

SEQ ID NO: 2914305 - protein, 6 aa, Entamoeba invadens
TKQTVD

SEQ ID NO: 2914306 - protein, 6 aa, Entamoeba invadens
TKQWTE

SEQ ID NO: 2914307 - protein, 4 aa, Entamoeba invadens
TKQY

SEQ ID NO: 2914308 - protein, 7 aa, Entamoeba invadens
TKQYDTA

SEQ ID NO: 2914309 - protein, 10 aa, Entamoeba invadens
TKRAERKSSC

SEQ ID NO: 2914310 - protein, 6 aa, Entamoeba invadens
TKRDDD

SEQ ID NO: 2914311 - protein, 8 aa, Entamoeba invadens
TKRDNSEL

SEQ ID NO: 2914312 - protein, 8 aa, Entamoeba invadens
TKREKCKS

SEQ ID NO: 2914313 - protein, 22 aa, Entamoeba invadens
TKREKEKIKKVEAPEDDESCTV

SEQ ID NO: 2914314 - protein, 28 aa, Entamoeba invadens
TKREKRMEEQEKQDKEKEEEKEEKEPVG

SEQ ID NO: 2914315 - protein, 12 aa, Entamoeba invadens
TKRELEAQQSTL

SEQ ID NO: 2914316 - protein, 10 aa, Entamoeba invadens
TKRENGRKAQ

SEQ ID NO: 2914317 - protein, 8 aa, Entamoeba invadens
TKRENSEG

SEQ ID NO: 2914318 - protein, 9 aa, Entamoeba invadens
TKRESKQRA

SEQ ID NO: 2914319 - protein, 6 aa, Entamoeba invadens
TKRGLA

SEQ ID NO: 2914320 - protein, 5 aa, Entamoeba invadens
TKRGV

SEQ ID NO: 2914321 - protein, 12 aa, Entamoeba invadens
TKRKKRKDTAVT

SEQ ID NO: 2914322 - protein, 5 aa, Entamoeba invadens
TKRKP

SEQ ID NO: 2914323 - protein, 5 aa, Entamoeba invadens
TKRKT

SEQ ID NO: 2914324 - protein, 9 aa, Entamoeba invadens
TKRLNNTVD

SEQ ID NO: 2914325 - protein, 7 aa, Entamoeba invadens
TKRNANA

SEQ ID NO: 2914326 - protein, 6 aa, Entamoeba invadens
TKRNVD

SEQ ID NO: 2914327 - protein, 10 aa, Entamoeba invadens
TKRPSQRMTT

SEQ ID NO: 2914328 - protein, 5 aa, Entamoeba invadens
TKRQE

SEQ ID NO: 2914329 - protein, 6 aa, Entamoeba invadens
TKRQEN

SEQ ID NO: 2914330 - protein, 10 aa, Entamoeba invadens
TKRQVPQTKI

SEQ ID NO: 2914331 - protein, 15 aa, Entamoeba invadens
TKRRTPRLQRAESSM

SEQ ID NO: 2914332 - protein, 15 aa, Entamoeba invadens
TKRSAPENITIKTED

SEQ ID NO: 2914333 - protein, 6 aa, Entamoeba invadens
TKRSLV

SEQ ID NO: 2914334 - protein, 8 aa, Entamoeba invadens
TKRSNTVK

SEQ ID NO: 2914335 - protein, 7 aa, Entamoeba invadens
TKRSSSA

SEQ ID NO: 2914336 - protein, 8 aa, Entamoeba invadens
TKRSSYAK

SEQ ID NO: 2914337 - protein, 8 aa, Entamoeba invadens
TKRTENTI

SEQ ID NO: 2914338 - protein, 8 aa, Entamoeba invadens
TKRTGRGI

SEQ ID NO: 2914339 - protein, 8 aa, Entamoeba invadens
TKRTKKSM

SEQ ID NO: 2914340 - protein, 8 aa, Entamoeba invadens
TKRTSFMD

SEQ ID NO: 2914341 - protein, 8 aa, Entamoeba invadens
TKRTTNTN

SEQ ID NO: 2914342 - protein, 9 aa, Entamoeba invadens
TKRTVEEKI

SEQ ID NO: 2914343 - protein, 4 aa, Entamoeba invadens
TKRV

SEQ ID NO: 2914344 - protein, 11 aa, Entamoeba invadens
TKSADEQKKDL

SEQ ID NO: 2914345 - protein, 17 aa, Entamoeba invadens
TKSAIGQTKIEGKFNPS

SEQ ID NO: 2914346 - protein, 8 aa, Entamoeba invadens
TKSATIEK

SEQ ID NO: 2914347 - protein, 8 aa, Entamoeba invadens
TKSATVEK

SEQ ID NO: 2914348 - protein, 4 aa, Entamoeba invadens
TKSD

SEQ ID NO: 2914349 - protein, 6 aa, Entamoeba invadens
TKSDDQ

SEQ ID NO: 2914350 - protein, 8 aa, Entamoeba invadens
TKSDKEFM

SEQ ID NO: 2914351 - protein, 6 aa, Entamoeba invadens
TKSDKI

SEQ ID NO: 2914352 - protein, 20 aa, Entamoeba invadens
TKSDLENNREVSTEEGERLA

SEQ ID NO: 2914353 - protein, 14 aa, Entamoeba invadens
TKSDLGASISDSQV

SEQ ID NO: 2914354 - protein, 8 aa, Entamoeba invadens
TKSDLKTI

SEQ ID NO: 2914355 - protein, 8 aa, Entamoeba invadens
TKSDLQER

SEQ ID NO: 2914356 - protein, 28 aa, Entamoeba invadens
TKSDTTNSKETTDETLHTGTKNTQSKTA

SEQ ID NO: 2914357 - protein, 8 aa, Entamoeba invadens
TKSDVETP

SEQ ID NO: 2914358 - protein, 8 aa, Entamoeba invadens
TKSEDLKT

SEQ ID NO: 2914359 - protein, 11 aa, Entamoeba invadens
TKSEKEGTTVY

SEQ ID NO: 2914360 - protein, 11 aa, Entamoeba invadens
TKSEKEKGRDM

SEQ ID NO: 2914361 - protein, 7 aa, Entamoeba invadens
TKSELEG

SEQ ID NO: 2914362 - protein, 18 aa, Entamoeba invadens
TKSEQTEVKEDDITEKPP

SEQ ID NO: 2914363 - protein, 10 aa, Entamoeba invadens
TKSETTENRA

SEQ ID NO: 2914364 - protein, 7 aa, Entamoeba invadens
TKSEVEV

SEQ ID NO: 2914365 - protein, 4 aa, Entamoeba invadens
TKSF

SEQ ID NO: 2914366 - protein, 5 aa, Entamoeba invadens
TKSFS

SEQ ID NO: 2914367 - protein, 9 aa, Entamoeba invadens
TKSGEDMTS

SEQ ID NO: 2914368 - protein, 7 aa, Entamoeba invadens
TKSGEWK

SEQ ID NO: 2914369 - protein, 8 aa, Entamoeba invadens
TKSGKDVD

SEQ ID NO: 2914370 - protein, 8 aa, Entamoeba invadens
TKSGKPMY

SEQ ID NO: 2914371 - protein, 6 aa, Entamoeba invadens
TKSGMK

SEQ ID NO: 2914372 - protein, 5 aa, Entamoeba invadens
TKSGQ

SEQ ID NO: 2914373 - protein, 7 aa, Entamoeba invadens
TKSGRID

SEQ ID NO: 2914374 - protein, 7 aa, Entamoeba invadens
TKSGSFG

SEQ ID NO: 2914375 - protein, 11 aa, Entamoeba invadens
TKSGSSDLQEP

SEQ ID NO: 2914376 - protein, 7 aa, Entamoeba invadens
TKSGTEK

SEQ ID NO: 2914377 - protein, 5 aa, Entamoeba invadens
TKSIQ

SEQ ID NO: 2914378 - protein, 7 aa, Entamoeba invadens
TKSISDR

SEQ ID NO: 2914379 - protein, 9 aa, Entamoeba invadens
TKSKDEFTI

SEQ ID NO: 2914380 - protein, 10 aa, Entamoeba invadens
TKSKEGTNEL

SEQ ID NO: 2914381 - protein, 12 aa, Entamoeba invadens
TKSKIPKLQSSG

SEQ ID NO: 2914382 - protein, 5 aa, Entamoeba invadens
TKSKK

SEQ ID NO: 2914383 - protein, 8 aa, Entamoeba invadens
TKSKNGVG

SEQ ID NO: 2914384 - protein, 10 aa, Entamoeba invadens
TKSKTKRNTI

SEQ ID NO: 2914385 - protein, 31 aa, Entamoeba invadens
TKSKTMGGLQESPTSSPTLSTSTKKSLPNSL

SEQ ID NO: 2914386 - protein, 9 aa, Entamoeba invadens
TKSKTVNPK

SEQ ID NO: 2914387 - protein, 6 aa, Entamoeba invadens
TKSLDL

SEQ ID NO: 2914388 - protein, 5 aa, Entamoeba invadens
TKSLE

SEQ ID NO: 2914389 - protein, 8 aa, Entamoeba invadens
TKSLKLKS

SEQ ID NO: 2914390 - protein, 5 aa, Entamoeba invadens
TKSLS

SEQ ID NO: 2914391 - protein, 4 aa, Entamoeba invadens
TKSM

SEQ ID NO: 2914392 - protein, 13 aa, Entamoeba invadens
TKSMKKPETQVRR

SEQ ID NO: 2914393 - protein, 4 aa, Entamoeba invadens
TKSN

SEQ ID NO: 2914394 - protein, 9 aa, Entamoeba invadens
TKSNDQKFD

SEQ ID NO: 2914395 - protein, 5 aa, Entamoeba invadens
TKSNE

SEQ ID NO: 2914396 - protein, 15 aa, Entamoeba invadens
TKSNETEQKYEICKL

SEQ ID NO: 2914397 - protein, 5 aa, Entamoeba invadens
TKSNM

SEQ ID NO: 2914398 - protein, 6 aa, Entamoeba invadens
TKSNQK

SEQ ID NO: 2914399 - protein, 8 aa, Entamoeba invadens
TKSNQSNE

SEQ ID NO: 2914400 - protein, 8 aa, Entamoeba invadens
TKSPLSAT

SEQ ID NO: 2914401 - protein, 8 aa, Entamoeba invadens
TKSPTPCD

SEQ ID NO: 2914402 - protein, 7 aa, Entamoeba invadens
TKSQFPE

SEQ ID NO: 2914403 - protein, 15 aa, Entamoeba invadens
TKSQGKNGIAKSETI

SEQ ID NO: 2914404 - protein, 11 aa, Entamoeba invadens
TKSQNTELIPR

SEQ ID NO: 2914405 - protein, 7 aa, Entamoeba invadens
TKSQTSL

SEQ ID NO: 2914406 - protein, 9 aa, Entamoeba invadens
TKSRSSKLP

SEQ ID NO: 2914407 - protein, 4 aa, Entamoeba invadens
TKSS

SEQ ID NO: 2914408 - protein, 9 aa, Entamoeba invadens
TKSSEIEKR

SEQ ID NO: 2914409 - protein, 40 aa, Entamoeba invadens
TKSSKEENLLPKDDHQEKEVQTEKKQVKSTRKKTKKEEIV

SEQ ID NO: 2914410 - protein, 7 aa, Entamoeba invadens
TKSSPSL

SEQ ID NO: 2914411 - protein, 11 aa, Entamoeba invadens
TKSTPNLRKDY

SEQ ID NO: 2914412 - protein, 5 aa, Entamoeba invadens
TKSTR

SEQ ID NO: 2914413 - protein, 8 aa, Entamoeba invadens
TKSTVPET

SEQ ID NO: 2914414 - protein, 11 aa, Entamoeba invadens
TKSVDNTDSIF

SEQ ID NO: 2914415 - protein, 8 aa, Entamoeba invadens
TKSVENLP

SEQ ID NO: 2914416 - protein, 15 aa, Entamoeba invadens
TKSVRESFKRKHPKF

SEQ ID NO: 2914417 - protein, 5 aa, Entamoeba invadens
TKSVT

SEQ ID NO: 2914418 - protein, 11 aa, Entamoeba invadens
TKSVTNVYQGT

SEQ ID NO: 2914419 - protein, 6 aa, Entamoeba invadens
TKSWGE

SEQ ID NO: 2914420 - protein, 4 aa, Entamoeba invadens
TKSY

SEQ ID NO: 2914421 - protein, 8 aa, Entamoeba invadens
TKSYPDRV

SEQ ID NO: 2914422 - protein, 4 aa, Entamoeba invadens
TKTA

SEQ ID NO: 2914423 - protein, 6 aa, Entamoeba invadens
TKTARC

SEQ ID NO: 2914424 - protein, 8 aa, Entamoeba invadens
TKTAYRGV

SEQ ID NO: 2914425 - protein, 9 aa, Entamoeba invadens
TKTCEQCNS

SEQ ID NO: 2914426 - protein, 9 aa, Entamoeba invadens
TKTCERCNS

SEQ ID NO: 2914427 - protein, 13 aa, Entamoeba invadens
TKTDREKCGNTIP

SEQ ID NO: 2914428 - protein, 9 aa, Entamoeba invadens
TKTDREKFG

SEQ ID NO: 2914429 - protein, 13 aa, Entamoeba invadens
TKTDREKYGNTIP

SEQ ID NO: 2914430 - protein, 16 aa, Entamoeba invadens
TKTDSRKRKKDYDNEI

SEQ ID NO: 2914431 - protein, 5 aa, Entamoeba invadens
TKTDV

SEQ ID NO: 2914432 - protein, 9 aa, Entamoeba invadens
TKTEEDAAK

SEQ ID NO: 2914433 - protein, 7 aa, Entamoeba invadens
TKTEEEI

SEQ ID NO: 2914434 - protein, 12 aa, Entamoeba invadens
TKTEEIRKEEPL

SEQ ID NO: 2914435 - protein, 13 aa, Entamoeba invadens
TKTEFNAKGFGEE

SEQ ID NO: 2914436 - protein, 23 aa, Entamoeba invadens
TKTEHNEKQDKCDKLEDDMSEMK

SEQ ID NO: 2914437 - protein, 8 aa, Entamoeba invadens
TKTEIKSP

SEQ ID NO: 2914438 - protein, 7 aa, Entamoeba invadens
TKTEKEE

SEQ ID NO: 2914439 - protein, 7 aa, Entamoeba invadens
TKTEKSM

SEQ ID NO: 2914440 - protein, 19 aa, Entamoeba invadens
TKTELDDKQEDMRQTRRQI

SEQ ID NO: 2914441 - protein, 9 aa, Entamoeba invadens
TKTELKQRS

SEQ ID NO: 2914442 - protein, 9 aa, Entamoeba invadens
TKTEPSPQT

SEQ ID NO: 2914443 - protein, 5 aa, Entamoeba invadens
TKTEY

SEQ ID NO: 2914444 - protein, 6 aa, Entamoeba invadens
TKTGDV

SEQ ID NO: 2914445 - protein, 21 aa, Entamoeba invadens
TKTGNQKRKKKKKKTLMSIKS

SEQ ID NO: 2914446 - protein, 5 aa, Entamoeba invadens
TKTGR

SEQ ID NO: 2914447 - protein, 18 aa, Entamoeba invadens
TKTGTTQPSKAEGQPQAV

SEQ ID NO: 2914448 - protein, 13 aa, Entamoeba invadens
TKTHPTTSLDATN

SEQ ID NO: 2914449 - protein, 5 aa, Entamoeba invadens
TKTKE

SEQ ID NO: 2914450 - protein, 8 aa, Entamoeba invadens
TKTKEQEI

SEQ ID NO: 2914451 - protein, 7 aa, Entamoeba invadens
TKTKETI

SEQ ID NO: 2914452 - protein, 5 aa, Entamoeba invadens
TKTKK

SEQ ID NO: 2914453 - protein, 9 aa, Entamoeba invadens
TKTKNPNTK

SEQ ID NO: 2914454 - protein, 5 aa, Entamoeba invadens
TKTKP

SEQ ID NO: 2914455 - protein, 11 aa, Entamoeba invadens
TKTKPEKNETK

SEQ ID NO: 2914456 - protein, 12 aa, Entamoeba invadens
TKTKQNGKAKNI

SEQ ID NO: 2914457 - protein, 6 aa, Entamoeba invadens
TKTKQQ

SEQ ID NO: 2914458 - protein, 7 aa, Entamoeba invadens
TKTKRSP

SEQ ID NO: 2914459 - protein, 6 aa, Entamoeba invadens
TKTKSK

SEQ ID NO: 2914460 - protein, 12 aa, Entamoeba invadens
TKTKTVKPIIPD

SEQ ID NO: 2914461 - protein, 4 aa, Entamoeba invadens
TKTL

SEQ ID NO: 2914462 - protein, 9 aa, Entamoeba invadens
TKTLEKSQK

SEQ ID NO: 2914463 - protein, 8 aa, Entamoeba invadens
TKTLETKD

SEQ ID NO: 2914464 - protein, 11 aa, Entamoeba invadens
TKTLKTKTKDL

SEQ ID NO: 2914465 - protein, 7 aa, Entamoeba invadens
TKTLQDL

SEQ ID NO: 2914466 - protein, 6 aa, Entamoeba invadens
TKTLQE

SEQ ID NO: 2914467 - protein, 7 aa, Entamoeba invadens
TKTLRED

SEQ ID NO: 2914468 - protein, 4 aa, Entamoeba invadens
TKTM

SEQ ID NO: 2914469 - protein, 16 aa, Entamoeba invadens
TKTNDGDKLSSPVKET

SEQ ID NO: 2914470 - protein, 5 aa, Entamoeba invadens
TKTNT

SEQ ID NO: 2914471 - protein, 8 aa, Entamoeba invadens
TKTNTESA

SEQ ID NO: 2914472 - protein, 11 aa, Entamoeba invadens
TKTNTSLQNLG

SEQ ID NO: 2914473 - protein, 22 aa, Entamoeba invadens
TKTPEDALKTIEKKNKAPWEDR

SEQ ID NO: 2914474 - protein, 7 aa, Entamoeba invadens
TKTPEGE

SEQ ID NO: 2914475 - protein, 7 aa, Entamoeba invadens
TKTPFEL

SEQ ID NO: 2914476 - protein, 8 aa, Entamoeba invadens
TKTPKQIA

SEQ ID NO: 2914477 - protein, 8 aa, Entamoeba invadens
TKTPLLRS

SEQ ID NO: 2914478 - protein, 9 aa, Entamoeba invadens
TKTPLPNPI

SEQ ID NO: 2914479 - protein, 5 aa, Entamoeba invadens
TKTPN

SEQ ID NO: 2914480 - protein, 9 aa, Entamoeba invadens
TKTQEEDDL

SEQ ID NO: 2914481 - protein, 51 aa, Entamoeba invadens
TKTQNLKTEDKIEQKVENKEKEIDLNASASDSQQTPEKKVEKAKIKTENVK

SEQ ID NO: 2914482 - protein, 8 aa, Entamoeba invadens
TKTQQENG

SEQ ID NO: 2914483 - protein, 18 aa, Entamoeba invadens
TKTQTCDPCKDKLNEFCF

SEQ ID NO: 2914484 - protein, 11 aa, Entamoeba invadens
TKTQVNTSQID

SEQ ID NO: 2914485 - protein, 11 aa, Entamoeba invadens
TKTRCADKEEI

SEQ ID NO: 2914486 - protein, 6 aa, Entamoeba invadens
TKTREN

SEQ ID NO: 2914487 - protein, 11 aa, Entamoeba invadens
TKTRKRMSSTG

SEQ ID NO: 2914488 - protein, 9 aa, Entamoeba invadens
TKTSEGKAI

SEQ ID NO: 2914489 - protein, 8 aa, Entamoeba invadens
TKTSENSP

SEQ ID NO: 2914490 - protein, 7 aa, Entamoeba invadens
TKTSESF

SEQ ID NO: 2914491 - protein, 10 aa, Entamoeba invadens
TKTSPRGASY

SEQ ID NO: 2914492 - protein, 9 aa, Entamoeba invadens
TKTSTQIRD

SEQ ID NO: 2914493 - protein, 6 aa, Entamoeba invadens
TKTTFK

SEQ ID NO: 2914494 - protein, 6 aa, Entamoeba invadens
TKTTIR

SEQ ID NO: 2914495 - protein, 9 aa, Entamoeba invadens
TKTTKEKDE

SEQ ID NO: 2914496 - protein, 5 aa, Entamoeba invadens
TKTTN

SEQ ID NO: 2914497 - protein, 6 aa, Entamoeba invadens
TKTTSW

SEQ ID NO: 2914498 - protein, 9 aa, Entamoeba invadens
TKTTYGPQG

SEQ ID NO: 2914499 - protein, 6 aa, Entamoeba invadens
TKTVDR

SEQ ID NO: 2914500 - protein, 19 aa, Entamoeba invadens
TKTVETNDKNIQTETNGFG

SEQ ID NO: 2914501 - protein, 10 aa, Entamoeba invadens
TKTVKKSEQL

SEQ ID NO: 2914502 - protein, 8 aa, Entamoeba invadens
TKTVKTIG

SEQ ID NO: 2914503 - protein, 8 aa, Entamoeba invadens
TKTVPLPQ

SEQ ID NO: 2914504 - protein, 7 aa, Entamoeba invadens
TKTWNEE

SEQ ID NO: 2914505 - protein, 6 aa, Entamoeba invadens
TKTWNK

SEQ ID NO: 2914506 - protein, 10 aa, Entamoeba invadens
TKTYLTKTGS

SEQ ID NO: 2914507 - protein, 10 aa, Entamoeba invadens
TKVACSDKTA

SEQ ID NO: 2914508 - protein, 8 aa, Entamoeba invadens
TKVCEDNA

SEQ ID NO: 2914509 - protein, 26 aa, Entamoeba invadens
TKVDEAKAGGEQAQKKKPITKKPAVK

SEQ ID NO: 2914510 - protein, 16 aa, Entamoeba invadens
TKVDSFGTEINPTRPK

SEQ ID NO: 2914511 - protein, 4 aa, Entamoeba invadens
TKVE

SEQ ID NO: 2914512 - protein, 6 aa, Entamoeba invadens
TKVEEE

SEQ ID NO: 2914513 - protein, 7 aa, Entamoeba invadens
TKVEELE

SEQ ID NO: 2914514 - protein, 9 aa, Entamoeba invadens
TKVEPSVEE

SEQ ID NO: 2914515 - protein, 9 aa, Entamoeba invadens
TKVGNTNPM

SEQ ID NO: 2914516 - protein, 7 aa, Entamoeba invadens
TKVGTSS

SEQ ID NO: 2914517 - protein, 9 aa, Entamoeba invadens
TKVKAVEKL

SEQ ID NO: 2914518 - protein, 5 aa, Entamoeba invadens
TKVKD

SEQ ID NO: 2914519 - protein, 11 aa, Entamoeba invadens
TKVKKGPLDNS

SEQ ID NO: 2914520 - protein, 8 aa, Entamoeba invadens
TKVNNEIR

SEQ ID NO: 2914521 - protein, 4 aa, Entamoeba invadens
TKVP

SEQ ID NO: 2914522 - protein, 8 aa, Entamoeba invadens
TKVPEEKI

SEQ ID NO: 2914523 - protein, 5 aa, Entamoeba invadens
TKVPI

SEQ ID NO: 2914524 - protein, 7 aa, Entamoeba invadens
TKVPIPE

SEQ ID NO: 2914525 - protein, 9 aa, Entamoeba invadens
TKVPKKEDL

SEQ ID NO: 2914526 - protein, 9 aa, Entamoeba invadens
TKVPLNENT

SEQ ID NO: 2914527 - protein, 8 aa, Entamoeba invadens
TKVPNKQA

SEQ ID NO: 2914528 - protein, 5 aa, Entamoeba invadens
TKVQM

SEQ ID NO: 2914529 - protein, 9 aa, Entamoeba invadens
TKVQNSKPV

SEQ ID NO: 2914530 - protein, 10 aa, Entamoeba invadens
TKVREKSEMY

SEQ ID NO: 2914531 - protein, 4 aa, Entamoeba invadens
TKVS

SEQ ID NO: 2914532 - protein, 7 aa, Entamoeba invadens
TKVSPTA

SEQ ID NO: 2914533 - protein, 9 aa, Entamoeba invadens
TKVTDEGVS

SEQ ID NO: 2914534 - protein, 6 aa, Entamoeba invadens
TKVTNT

SEQ ID NO: 2914535 - protein, 8 aa, Entamoeba invadens
TKVTQDDL

SEQ ID NO: 2914536 - protein, 13 aa, Entamoeba invadens
TKVYKRHEAEMKS

SEQ ID NO: 2914537 - protein, 5 aa, Entamoeba invadens
TKVYT

SEQ ID NO: 2914538 - protein, 6 aa, Entamoeba invadens
TKWQPE

SEQ ID NO: 2914539 - protein, 7 aa, Entamoeba invadens
TKYARNK

SEQ ID NO: 2914540 - protein, 17 aa, Entamoeba invadens
TKYDGRKIGHKKENDIY

SEQ ID NO: 2914541 - protein, 7 aa, Entamoeba invadens
TKYDNGE

SEQ ID NO: 2914542 - protein, 5 aa, Entamoeba invadens
TKYDR

SEQ ID NO: 2914543 - protein, 16 aa, Entamoeba invadens
TKYEGIDNDDLNATNN

SEQ ID NO: 2914544 - protein, 6 aa, Entamoeba invadens
TKYEKE

SEQ ID NO: 2914545 - protein, 10 aa, Entamoeba invadens
TKYEQTKAFN

SEQ ID NO: 2914546 - protein, 10 aa, Entamoeba invadens
TKYFKTDKKV

SEQ ID NO: 2914547 - protein, 7 aa, Entamoeba invadens
TKYGDEL

SEQ ID NO: 2914548 - protein, 19 aa, Entamoeba invadens
TKYKDEFKGNDPEKKENEY

SEQ ID NO: 2914549 - protein, 9 aa, Entamoeba invadens
TKYKPETGA

SEQ ID NO: 2914550 - protein, 9 aa, Entamoeba invadens
TKYNKENAL

SEQ ID NO: 2914551 - protein, 4 aa, Entamoeba invadens
TKYP

SEQ ID NO: 2914552 - protein, 6 aa, Entamoeba invadens
TKYPEK

SEQ ID NO: 2914553 - protein, 8 aa, Entamoeba invadens
TKYPPRPY

SEQ ID NO: 2914554 - protein, 7 aa, Entamoeba invadens
TKYPQNI

SEQ ID NO: 2914555 - protein, 5 aa, Entamoeba invadens
TKYPT

SEQ ID NO: 2914556 - protein, 7 aa, Entamoeba invadens
TKYRNQS

SEQ ID NO: 2914557 - protein, 18 aa, Entamoeba invadens
TKYSHKKTTEENNKEAVD

SEQ ID NO: 2914558 - protein, 11 aa, Entamoeba invadens
TKYSQTLEDIP

SEQ ID NO: 2914559 - protein, 5 aa, Entamoeba invadens
TKYTK

SEQ ID NO: 2914560 - protein, 7 aa, Entamoeba invadens
TKYVSYQ

SEQ ID NO: 2914561 - protein, 6 aa, Entamoeba invadens
TLADKT

SEQ ID NO: 2914562 - protein, 4 aa, Entamoeba invadens
TLAP

SEQ ID NO: 2914563 - protein, 12 aa, Entamoeba invadens
TLASGKYKTANG

SEQ ID NO: 2914564 - protein, 13 aa, Entamoeba invadens
TLASTIGVSRPKF

SEQ ID NO: 2914565 - protein, 6 aa, Entamoeba invadens
TLDCEP

SEQ ID NO: 2914566 - protein, 12 aa, Entamoeba invadens
TLDDGSEKIEDK

SEQ ID NO: 2914567 - protein, 11 aa, Entamoeba invadens
TLDDKTKGENC

SEQ ID NO: 2914568 - protein, 8 aa, Entamoeba invadens
TLDDPNAK

SEQ ID NO: 2914569 - protein, 10 aa, Entamoeba invadens
TLDDRKNDPI

SEQ ID NO: 2914570 - protein, 9 aa, Entamoeba invadens
TLDESQEDY

SEQ ID NO: 2914571 - protein, 10 aa, Entamoeba invadens
TLDGPQNVQM

SEQ ID NO: 2914572 - protein, 8 aa, Entamoeba invadens
TLDISKKG

SEQ ID NO: 2914573 - protein, 13 aa, Entamoeba invadens
TLDKEKDYLGAGE

SEQ ID NO: 2914574 - protein, 8 aa, Entamoeba invadens
TLDKTTNK

SEQ ID NO: 2914575 - protein, 6 aa, Entamoeba invadens
TLDNTE

SEQ ID NO: 2914576 - protein, 7 aa, Entamoeba invadens
TLDPAYA

SEQ ID NO: 2914577 - protein, 4 aa, Entamoeba invadens
TLDQ

SEQ ID NO: 2914578 - protein, 6 aa, Entamoeba invadens
TLDRKD

SEQ ID NO: 2914579 - protein, 20 aa, Entamoeba invadens
TLDSAKRAMTSLENTRTFGP

SEQ ID NO: 2914580 - protein, 9 aa, Entamoeba invadens
TLDVPSSSL

SEQ ID NO: 2914581 - protein, 11 aa, Entamoeba invadens
TLEDSKKDDNV

SEQ ID NO: 2914582 - protein, 11 aa, Entamoeba invadens
TLEDTNDKNMN

SEQ ID NO: 2914583 - protein, 16 aa, Entamoeba invadens
TLEEADMKSQEDQEHI

SEQ ID NO: 2914584 - protein, 11 aa, Entamoeba invadens
TLEEEEDDTQA

SEQ ID NO: 2914585 - protein, 5 aa, Entamoeba invadens
TLEET

SEQ ID NO: 2914586 - protein, 27 aa, Entamoeba invadens
TLEETRSGELSKENKKAISKGKEGAEK

SEQ ID NO: 2914587 - protein, 7 aa, Entamoeba invadens
TLEGDEL

SEQ ID NO: 2914588 - protein, 6 aa, Entamoeba invadens
TLEGTP

SEQ ID NO: 2914589 - protein, 15 aa, Entamoeba invadens
TLEKKSKWLNKRRLR

SEQ ID NO: 2914590 - protein, 7 aa, Entamoeba invadens
TLEKSDL

SEQ ID NO: 2914591 - protein, 16 aa, Entamoeba invadens
TLEMPKAGTHQEPEKF

SEQ ID NO: 2914592 - protein, 8 aa, Entamoeba invadens
TLENDLDE

SEQ ID NO: 2914593 - protein, 11 aa, Entamoeba invadens
TLENKKDDTYV

SEQ ID NO: 2914594 - protein, 6 aa, Entamoeba invadens
TLENND

SEQ ID NO: 2914595 - protein, 5 aa, Entamoeba invadens
TLENS

SEQ ID NO: 2914596 - protein, 9 aa, Entamoeba invadens
TLENVSPSQ

SEQ ID NO: 2914597 - protein, 14 aa, Entamoeba invadens
TLEPEKNGLIAPKA

SEQ ID NO: 2914598 - protein, 28 aa, Entamoeba invadens
TLEPERNFASQATLPEITASQKEAPQQK

SEQ ID NO: 2914599 - protein, 14 aa, Entamoeba invadens
TLEPHSKGSQGKVY

SEQ ID NO: 2914600 - protein, 7 aa, Entamoeba invadens
TLEPNDQ

SEQ ID NO: 2914601 - protein, 6 aa, Entamoeba invadens
TLEQAG

SEQ ID NO: 2914602 - protein, 6 aa, Entamoeba invadens
TLEQNS

SEQ ID NO: 2914603 - protein, 15 aa, Entamoeba invadens
TLEQQNSEKDKTIKS

SEQ ID NO: 2914604 - protein, 18 aa, Entamoeba invadens
TLESKKSRRLNRVKPQQT

SEQ ID NO: 2914605 - protein, 6 aa, Entamoeba invadens
TLESKL

SEQ ID NO: 2914606 - protein, 10 aa, Entamoeba invadens
TLETANVGPR

SEQ ID NO: 2914607 - protein, 16 aa, Entamoeba invadens
TLETKGEALDEEIQTR

SEQ ID NO: 2914608 - protein, 6 aa, Entamoeba invadens
TLETPQ

SEQ ID NO: 2914609 - protein, 6 aa, Entamoeba invadens
TLETQK

SEQ ID NO: 2914610 - protein, 5 aa, Entamoeba invadens
TLETT

SEQ ID NO: 2914611 - protein, 11 aa, Entamoeba invadens
TLGADDTVRFT

SEQ ID NO: 2914612 - protein, 6 aa, Entamoeba invadens
TLGDRN

SEQ ID NO: 2914613 - protein, 5 aa, Entamoeba invadens
TLGEK

SEQ ID NO: 2914614 - protein, 8 aa, Entamoeba invadens
TLGERGDR

SEQ ID NO: 2914615 - protein, 11 aa, Entamoeba invadens
TLGGDKNTINN

SEQ ID NO: 2914616 - protein, 5 aa, Entamoeba invadens
TLGGG

SEQ ID NO: 2914617 - protein, 6 aa, Entamoeba invadens
TLGGKI

SEQ ID NO: 2914618 - protein, 20 aa, Entamoeba invadens
TLGGNKEDEQTIYSTVQHKH

SEQ ID NO: 2914619 - protein, 7 aa, Entamoeba invadens
TLGHKTE

SEQ ID NO: 2914620 - protein, 16 aa, Entamoeba invadens
TLGNPPNYPVGTGESK

SEQ ID NO: 2914621 - protein, 9 aa, Entamoeba invadens
TLGNPTPTK

SEQ ID NO: 2914622 - protein, 9 aa, Entamoeba invadens
TLGNPTPTS

SEQ ID NO: 2914623 - protein, 13 aa, Entamoeba invadens
TLGNPTPTSVSLE

SEQ ID NO: 2914624 - protein, 7 aa, Entamoeba invadens
TLGPKGR

SEQ ID NO: 2914625 - protein, 5 aa, Entamoeba invadens
TLGPM

SEQ ID NO: 2914626 - protein, 6 aa, Entamoeba invadens
TLGPRG

SEQ ID NO: 2914627 - protein, 5 aa, Entamoeba invadens
TLGPS

SEQ ID NO: 2914628 - protein, 53 aa, Entamoeba invadens
TLGSNTQQQSVTPAQVPPSPPSNAQQTTQQSQTTPITTTQGNAPSSNDPLATP

SEQ ID NO: 2914629 - protein, 4 aa, Entamoeba invadens
TLGT

SEQ ID NO: 2914630 - protein, 6 aa, Entamoeba invadens
TLGTPP

SEQ ID NO: 2914631 - protein, 10 aa, Entamoeba invadens
TLGTSLDTAE

SEQ ID NO: 2914632 - protein, 26 aa, Entamoeba invadens
TLHDKDGKNDIGEKAKEGKGNTENVD

SEQ ID NO: 2914633 - protein, 6 aa, Entamoeba invadens
TLHPNG

SEQ ID NO: 2914634 - protein, 4 aa, Entamoeba invadens
TLHQ

SEQ ID NO: 2914635 - protein, 37 aa, Entamoeba invadens
TLHQTKGKGFQKSKTKLKKSDFKGTIDDTDAGSSSFF

SEQ ID NO: 2914636 - protein, 16 aa, Entamoeba invadens
TLIEKKEKKPKPTQQD

SEQ ID NO: 2914637 - protein, 12 aa, Entamoeba invadens
TLINNSNNKYSK

SEQ ID NO: 2914638 - protein, 12 aa, Entamoeba invadens
TLKAPQDELTTL

SEQ ID NO: 2914639 - protein, 8 aa, Entamoeba invadens
TLKDPSGY

SEQ ID NO: 2914640 - protein, 9 aa, Entamoeba invadens
TLKDPSKKY

SEQ ID NO: 2914641 - protein, 12 aa, Entamoeba invadens
TLKDSADKRTFH

SEQ ID NO: 2914642 - protein, 4 aa, Entamoeba invadens
TLKE

SEQ ID NO: 2914643 - protein, 10 aa, Entamoeba invadens
TLKEDNKTKA

SEQ ID NO: 2914644 - protein, 10 aa, Entamoeba invadens
TLKEEKHKSV

SEQ ID NO: 2914645 - protein, 11 aa, Entamoeba invadens
TLKEEKPQFPS

SEQ ID NO: 2914646 - protein, 15 aa, Entamoeba invadens
TLKEHSKGISEQNEM

SEQ ID NO: 2914647 - protein, 11 aa, Entamoeba invadens
TLKETFEEEKQ

SEQ ID NO: 2914648 - protein, 15 aa, Entamoeba invadens
TLKGCKGDTNAISIG

SEQ ID NO: 2914649 - protein, 5 aa, Entamoeba invadens
TLKGG

SEQ ID NO: 2914650 - protein, 9 aa, Entamoeba invadens
TLKGHKGAV

SEQ ID NO: 2914651 - protein, 9 aa, Entamoeba invadens
TLKKESYKN

SEQ ID NO: 2914652 - protein, 12 aa, Entamoeba invadens
TLKKRGKVSQKS

SEQ ID NO: 2914653 - protein, 14 aa, Entamoeba invadens
TLKKSAKLQPPNLT

SEQ ID NO: 2914654 - protein, 5 aa, Entamoeba invadens
TLKKT

SEQ ID NO: 2914655 - protein, 35 aa, Entamoeba invadens
TLKNAAEEAATQTKTIQSNHPSQVTESERGGCCYI

SEQ ID NO: 2914656 - protein, 12 aa, Entamoeba invadens
TLKNENARLNQE

SEQ ID NO: 2914657 - protein, 15 aa, Entamoeba invadens
TLKNKNGTTPKDKEM

SEQ ID NO: 2914658 - protein, 8 aa, Entamoeba invadens
TLKNNSQI

SEQ ID NO: 2914659 - protein, 7 aa, Entamoeba invadens
TLKPEEI

SEQ ID NO: 2914660 - protein, 14 aa, Entamoeba invadens
TLKPPERSRLDTGP

SEQ ID NO: 2914661 - protein, 6 aa, Entamoeba invadens
TLKSDN

SEQ ID NO: 2914662 - protein, 11 aa, Entamoeba invadens
TLKSKDQRALE

SEQ ID NO: 2914663 - protein, 8 aa, Entamoeba invadens
TLKSLTEN

SEQ ID NO: 2914664 - protein, 12 aa, Entamoeba invadens
TLKSSHNNTSYD

SEQ ID NO: 2914665 - protein, 12 aa, Entamoeba invadens
TLKSSRIKREGS

SEQ ID NO: 2914666 - protein, 27 aa, Entamoeba invadens
TLKSTSGFQDEKDALKKVQSKLQTELQ

SEQ ID NO: 2914667 - protein, 10 aa, Entamoeba invadens
TLKTPQGSKM

SEQ ID NO: 2914668 - protein, 19 aa, Entamoeba invadens
TLLPPEKKTYDAAKLSGSD

SEQ ID NO: 2914669 - protein, 5 aa, Entamoeba invadens
TLLQD

SEQ ID NO: 2914670 - protein, 12 aa, Entamoeba invadens
TLLSGTSKPLPL

SEQ ID NO: 2914671 - protein, 5 aa, Entamoeba invadens
TLNAG

SEQ ID NO: 2914672 - protein, 9 aa, Entamoeba invadens
TLNDQDVEI

SEQ ID NO: 2914673 - protein, 32 aa, Entamoeba invadens
TLNEENKKIANELDTTKEEVNKQKEEGEKKVE

SEQ ID NO: 2914674 - protein, 8 aa, Entamoeba invadens
TLNEKQKQ

SEQ ID NO: 2914675 - protein, 5 aa, Entamoeba invadens
TLNEN

SEQ ID NO: 2914676 - protein, 7 aa, Entamoeba invadens
TLNERSR

SEQ ID NO: 2914677 - protein, 12 aa, Entamoeba invadens
TLNGNGAQKEYY

SEQ ID NO: 2914678 - protein, 6 aa, Entamoeba invadens
TLNGNK

SEQ ID NO: 2914679 - protein, 4 aa, Entamoeba invadens
TLNK

SEQ ID NO: 2914680 - protein, 7 aa, Entamoeba invadens
TLNKGAG

SEQ ID NO: 2914681 - protein, 4 aa, Entamoeba invadens
TLNN

SEQ ID NO: 2914682 - protein, 9 aa, Entamoeba invadens
TLNNTNNTI

SEQ ID NO: 2914683 - protein, 7 aa, Entamoeba invadens
TLNPDGK

SEQ ID NO: 2914684 - protein, 7 aa, Entamoeba invadens
TLNSGEL

SEQ ID NO: 2914685 - protein, 22 aa, Entamoeba invadens
TLNSQNKESTIKQSDASTDVVN

SEQ ID NO: 2914686 - protein, 6 aa, Entamoeba invadens
TLNTQA

SEQ ID NO: 2914687 - protein, 5 aa, Entamoeba invadens
TLNTT

SEQ ID NO: 2914688 - protein, 5 aa, Entamoeba invadens
TLNTY

SEQ ID NO: 2914689 - protein, 13 aa, Entamoeba invadens
TLPADRSKNLREL

SEQ ID NO: 2914690 - protein, 34 aa, Entamoeba invadens
TLPAKMKTEEARQLKRQQALENAKQLDKEGKDTM

SEQ ID NO: 2914691 - protein, 8 aa, Entamoeba invadens
TLPALPPE

SEQ ID NO: 2914692 - protein, 6 aa, Entamoeba invadens
TLPDSG

SEQ ID NO: 2914693 - protein, 7 aa, Entamoeba invadens
TLPDSVT

SEQ ID NO: 2914694 - protein, 6 aa, Entamoeba invadens
TLPDTG

SEQ ID NO: 2914695 - protein, 18 aa, Entamoeba invadens
TLPDTPNDNSGEDNDESH

SEQ ID NO: 2914696 - protein, 4 aa, Entamoeba invadens
TLPE

SEQ ID NO: 2914697 - protein, 5 aa, Entamoeba invadens
TLPEG

SEQ ID NO: 2914698 - protein, 5 aa, Entamoeba invadens
TLPEK

SEQ ID NO: 2914699 - protein, 12 aa, Entamoeba invadens
TLPENNDLKTYA

SEQ ID NO: 2914700 - protein, 11 aa, Entamoeba invadens
TLPEPVKKRRN

SEQ ID NO: 2914701 - protein, 6 aa, Entamoeba invadens
TLPESG

SEQ ID NO: 2914702 - protein, 11 aa, Entamoeba invadens
TLPESKTKKPV

SEQ ID NO: 2914703 - protein, 6 aa, Entamoeba invadens
TLPKKE

SEQ ID NO: 2914704 - protein, 18 aa, Entamoeba invadens
TLPKKETKKRTQKRKHED

SEQ ID NO: 2914705 - protein, 13 aa, Entamoeba invadens
TLPKQSDATSLNN

SEQ ID NO: 2914706 - protein, 19 aa, Entamoeba invadens
TLPKSQPIQKSKAETQNGF

SEQ ID NO: 2914707 - protein, 5 aa, Entamoeba invadens
TLPLP

SEQ ID NO: 2914708 - protein, 4 aa, Entamoeba invadens
TLPN

SEQ ID NO: 2914709 - protein, 5 aa, Entamoeba invadens
TLPNN

SEQ ID NO: 2914710 - protein, 15 aa, Entamoeba invadens
TLPNPYEKDQKKPDL

SEQ ID NO: 2914711 - protein, 6 aa, Entamoeba invadens
TLPNRD

SEQ ID NO: 2914712 - protein, 5 aa, Entamoeba invadens
TLPPA

SEQ ID NO: 2914713 - protein, 5 aa, Entamoeba invadens
TLPPL

SEQ ID NO: 2914714 - protein, 5 aa, Entamoeba invadens
TLPPM

SEQ ID NO: 2914715 - protein, 5 aa, Entamoeba invadens
TLPPN

SEQ ID NO: 2914716 - protein, 6 aa, Entamoeba invadens
TLPPNS

SEQ ID NO: 2914717 - protein, 14 aa, Entamoeba invadens
TLPPNVTTESATIN

SEQ ID NO: 2914718 - protein, 5 aa, Entamoeba invadens
TLPPQ

SEQ ID NO: 2914719 - protein, 18 aa, Entamoeba invadens
TLPPRKIPKDKGERIEKK

SEQ ID NO: 2914720 - protein, 8 aa, Entamoeba invadens
TLPPSSTI

SEQ ID NO: 2914721 - protein, 5 aa, Entamoeba invadens
TLPPT

SEQ ID NO: 2914722 - protein, 6 aa, Entamoeba invadens
TLPPTF

SEQ ID NO: 2914723 - protein, 6 aa, Entamoeba invadens
TLPPTN

SEQ ID NO: 2914724 - protein, 11 aa, Entamoeba invadens
TLPQQNTTNVH

SEQ ID NO: 2914725 - protein, 15 aa, Entamoeba invadens
TLPRKGKLKRDVEES

SEQ ID NO: 2914726 - protein, 4 aa, Entamoeba invadens
TLPS

SEQ ID NO: 2914727 - protein, 5 aa, Entamoeba invadens
TLPSK

SEQ ID NO: 2914728 - protein, 7 aa, Entamoeba invadens
TLPSNLS

SEQ ID NO: 2914729 - protein, 13 aa, Entamoeba invadens
TLPSQLSHISIHR

SEQ ID NO: 2914730 - protein, 7 aa, Entamoeba invadens
TLPSSKN

SEQ ID NO: 2914731 - protein, 10 aa, Entamoeba invadens
TLPSSVKSIG

SEQ ID NO: 2914732 - protein, 8 aa, Entamoeba invadens
TLPSSVQK

SEQ ID NO: 2914733 - protein, 10 aa, Entamoeba invadens
TLPSSVTSIG

SEQ ID NO: 2914734 - protein, 21 aa, Entamoeba invadens
TLPTAGKAKVGSAVSTKGYNL

SEQ ID NO: 2914735 - protein, 9 aa, Entamoeba invadens
TLPTDLKGE

SEQ ID NO: 2914736 - protein, 5 aa, Entamoeba invadens
TLPTE

SEQ ID NO: 2914737 - protein, 9 aa, Entamoeba invadens
TLPTENDQH

SEQ ID NO: 2914738 - protein, 16 aa, Entamoeba invadens
TLPTESQNTNIEKVEK

SEQ ID NO: 2914739 - protein, 7 aa, Entamoeba invadens
TLPTGSG

SEQ ID NO: 2914740 - protein, 16 aa, Entamoeba invadens
TLPTQPIVNDPNSPVV

SEQ ID NO: 2914741 - protein, 15 aa, Entamoeba invadens
TLPTQYNPSPDILDG

SEQ ID NO: 2914742 - protein, 7 aa, Entamoeba invadens
TLPTTKK

SEQ ID NO: 2914743 - protein, 5 aa, Entamoeba invadens
TLPVT

SEQ ID NO: 2914744 - protein, 9 aa, Entamoeba invadens
TLQATDKYH

SEQ ID NO: 2914745 - protein, 15 aa, Entamoeba invadens
TLQDDETCTKDHYSN

SEQ ID NO: 2914746 - protein, 7 aa, Entamoeba invadens
TLQDPNT

SEQ ID NO: 2914747 - protein, 15 aa, Entamoeba invadens
TLQEETEHQKPNPLV

SEQ ID NO: 2914748 - protein, 11 aa, Entamoeba invadens
TLQGNNEELKT

SEQ ID NO: 2914749 - protein, 5 aa, Entamoeba invadens
TLQGT

SEQ ID NO: 2914750 - protein, 6 aa, Entamoeba invadens
TLQGTS

SEQ ID NO: 2914751 - protein, 11 aa, Entamoeba invadens
TLQNKNEIVSS

SEQ ID NO: 2914752 - protein, 11 aa, Entamoeba invadens
TLQNRKTGQFD

SEQ ID NO: 2914753 - protein, 5 aa, Entamoeba invadens
TLQPL

SEQ ID NO: 2914754 - protein, 7 aa, Entamoeba invadens
TLQPSDE

SEQ ID NO: 2914755 - protein, 5 aa, Entamoeba invadens
TLQPT

SEQ ID NO: 2914756 - protein, 35 aa, Entamoeba invadens
TLQPTQSQPLQLSQPQTPQPTQSQSQLLSQPQSLP

SEQ ID NO: 2914757 - protein, 5 aa, Entamoeba invadens
TLQQK

SEQ ID NO: 2914758 - protein, 11 aa, Entamoeba invadens
TLQQQQNQPVY

SEQ ID NO: 2914759 - protein, 7 aa, Entamoeba invadens
TLQQQSS

SEQ ID NO: 2914760 - protein, 7 aa, Entamoeba invadens
TLQQRNQ

SEQ ID NO: 2914761 - protein, 21 aa, Entamoeba invadens
TLQRETQTKVNNESKESFKSV

SEQ ID NO: 2914762 - protein, 7 aa, Entamoeba invadens
TLQTTGL

SEQ ID NO: 2914763 - protein, 7 aa, Entamoeba invadens
TLQTTPT

SEQ ID NO: 2914764 - protein, 6 aa, Entamoeba invadens
TLQTTT

SEQ ID NO: 2914765 - protein, 5 aa, Entamoeba invadens
TLQVE

SEQ ID NO: 2914766 - protein, 4 aa, Entamoeba invadens
TLQY

SEQ ID NO: 2914767 - protein, 14 aa, Entamoeba invadens
TLREQERKEREQRL

SEQ ID NO: 2914768 - protein, 6 aa, Entamoeba invadens
TLRERG

SEQ ID NO: 2914769 - protein, 7 aa, Entamoeba invadens
TLRETSS

SEQ ID NO: 2914770 - protein, 6 aa, Entamoeba invadens
TLRGDS

SEQ ID NO: 2914771 - protein, 42 aa, Entamoeba invadens
TLRGRNDSRCGGGEQVGECTCDKSSTKTVESSQTQCQPSTIS

SEQ ID NO: 2914772 - protein, 8 aa, Entamoeba invadens
TLRGSHNN

SEQ ID NO: 2914773 - protein, 13 aa, Entamoeba invadens
TLRGSSEALGESS

SEQ ID NO: 2914774 - protein, 6 aa, Entamoeba invadens
TLRGTN

SEQ ID NO: 2914775 - protein, 4 aa, Entamoeba invadens
TLRK

SEQ ID NO: 2914776 - protein, 12 aa, Entamoeba invadens
TLRNDTKTLRDT

SEQ ID NO: 2914777 - protein, 10 aa, Entamoeba invadens
TLRPDDKIGS

SEQ ID NO: 2914778 - protein, 10 aa, Entamoeba invadens
TLRPKDETSI

SEQ ID NO: 2914779 - protein, 6 aa, Entamoeba invadens
TLRPKN

SEQ ID NO: 2914780 - protein, 7 aa, Entamoeba invadens
TLRPPRS

SEQ ID NO: 2914781 - protein, 10 aa, Entamoeba invadens
TLRPTPKEVE

SEQ ID NO: 2914782 - protein, 15 aa, Entamoeba invadens
TLRQGEEAHASPTVA

SEQ ID NO: 2914783 - protein, 7 aa, Entamoeba invadens
TLRQIPD

SEQ ID NO: 2914784 - protein, 11 aa, Entamoeba invadens
TLRRPTKTDRQ

SEQ ID NO: 2914785 - protein, 9 aa, Entamoeba invadens
TLRSGTGYN

SEQ ID NO: 2914786 - protein, 7 aa, Entamoeba invadens
TLRSNIG

SEQ ID NO: 2914787 - protein, 8 aa, Entamoeba invadens
TLRSNIGE

SEQ ID NO: 2914788 - protein, 6 aa, Entamoeba invadens
TLRTQT

SEQ ID NO: 2914789 - protein, 14 aa, Entamoeba invadens
TLSADKSVRDQGDA

SEQ ID NO: 2914790 - protein, 11 aa, Entamoeba invadens
TLSDKGSQEAK

SEQ ID NO: 2914791 - protein, 11 aa, Entamoeba invadens
TLSDPDENYEN

SEQ ID NO: 2914792 - protein, 11 aa, Entamoeba invadens
TLSDTENKTIN

SEQ ID NO: 2914793 - protein, 8 aa, Entamoeba invadens
TLSEEKCD

SEQ ID NO: 2914794 - protein, 5 aa, Entamoeba invadens
TLSEK

SEQ ID NO: 2914795 - protein, 9 aa, Entamoeba invadens
TLSEKEKIS

SEQ ID NO: 2914796 - protein, 11 aa, Entamoeba invadens
TLSENPKESKL

SEQ ID NO: 2914797 - protein, 9 aa, Entamoeba invadens
TLSENPQKI

SEQ ID NO: 2914798 - protein, 14 aa, Entamoeba invadens
TLSENSVNHTTQSL

SEQ ID NO: 2914799 - protein, 15 aa, Entamoeba invadens
TLSERAKSAFTLHTQ

SEQ ID NO: 2914800 - protein, 9 aa, Entamoeba invadens
TLSGGEAQR

SEQ ID NO: 2914801 - protein, 9 aa, Entamoeba invadens
TLSGGQKSR

SEQ ID NO: 2914802 - protein, 6 aa, Entamoeba invadens
TLSGHN

SEQ ID NO: 2914803 - protein, 10 aa, Entamoeba invadens
TLSGKNGVNR

SEQ ID NO: 2914804 - protein, 20 aa, Entamoeba invadens
TLSHSNKIESVAPQKREPSL

SEQ ID NO: 2914805 - protein, 10 aa, Entamoeba invadens
TLSKASPLIR

SEQ ID NO: 2914806 - protein, 19 aa, Entamoeba invadens
TLSKEEPHSHTEHSYPDTV

SEQ ID NO: 2914807 - protein, 10 aa, Entamoeba invadens
TLSKKANVSL

SEQ ID NO: 2914808 - protein, 9 aa, Entamoeba invadens
TLSKNYSRL

SEQ ID NO: 2914809 - protein, 15 aa, Entamoeba invadens
TLSKTPKEGSNNRPH

SEQ ID NO: 2914810 - protein, 11 aa, Entamoeba invadens
TLSNEASHEVA

SEQ ID NO: 2914811 - protein, 16 aa, Entamoeba invadens
TLSNPVERRAKIEDKH

SEQ ID NO: 2914812 - protein, 6 aa, Entamoeba invadens
TLSNSK

SEQ ID NO: 2914813 - protein, 5 aa, Entamoeba invadens
TLSPD

SEQ ID NO: 2914814 - protein, 7 aa, Entamoeba invadens
TLSPNKQ

SEQ ID NO: 2914815 - protein, 11 aa, Entamoeba invadens
TLSPNPNVRAQ

SEQ ID NO: 2914816 - protein, 32 aa, Entamoeba invadens
TLSPRAKSERLRRDSPSRSPRTPKSAREHGEA

SEQ ID NO: 2914817 - protein, 7 aa, Entamoeba invadens
TLSPREL

SEQ ID NO: 2914818 - protein, 4 aa, Entamoeba invadens
TLSQ

SEQ ID NO: 2914819 - protein, 16 aa, Entamoeba invadens
TLSQNTCNKIESNELY

SEQ ID NO: 2914820 - protein, 9 aa, Entamoeba invadens
TLSQSTDFN

SEQ ID NO: 2914821 - protein, 8 aa, Entamoeba invadens
TLSRETQR

SEQ ID NO: 2914822 - protein, 6 aa, Entamoeba invadens
TLSRGI

SEQ ID NO: 2914823 - protein, 7 aa, Entamoeba invadens
TLSRGPN

SEQ ID NO: 2914824 - protein, 10 aa, Entamoeba invadens
TLSRSLRDQI

SEQ ID NO: 2914825 - protein, 7 aa, Entamoeba invadens
TLSSDPQ

SEQ ID NO: 2914826 - protein, 53 aa, Entamoeba invadens
TLSSDTENMSLEQNSDEESDNEFEDTNNDYIDQNENDEKEEREDEKTIKNKTD

SEQ ID NO: 2914827 - protein, 15 aa, Entamoeba invadens
TLSSDYTSTQKKYNV

SEQ ID NO: 2914828 - protein, 9 aa, Entamoeba invadens
TLSSKENAK

SEQ ID NO: 2914829 - protein, 16 aa, Entamoeba invadens
TLSSKTKDLDKATERS

SEQ ID NO: 2914830 - protein, 19 aa, Entamoeba invadens
TLSSQISNKEPTPSTITSK

SEQ ID NO: 2914831 - protein, 5 aa, Entamoeba invadens
TLSSR

SEQ ID NO: 2914832 - protein, 10 aa, Entamoeba invadens
TLSSRNKDAL

SEQ ID NO: 2914833 - protein, 12 aa, Entamoeba invadens
TLSSTDNCPSEK

SEQ ID NO: 2914834 - protein, 7 aa, Entamoeba invadens
TLSSTQT

SEQ ID NO: 2914835 - protein, 7 aa, Entamoeba invadens
TLSSYSP

SEQ ID NO: 2914836 - protein, 15 aa, Entamoeba invadens
TLSTGQKPVPTSPLD

SEQ ID NO: 2914837 - protein, 10 aa, Entamoeba invadens
TLSTKDDENS

SEQ ID NO: 2914838 - protein, 10 aa, Entamoeba invadens
TLSTQYNKKR

SEQ ID NO: 2914839 - protein, 30 aa, Entamoeba invadens
TLSTSQDQLGFPQNEDKSGDLQAKAREHHM

SEQ ID NO: 2914840 - protein, 8 aa, Entamoeba invadens
TLSTSQNF

SEQ ID NO: 2914841 - protein, 9 aa, Entamoeba invadens
TLSVGPNNI

SEQ ID NO: 2914842 - protein, 5 aa, Entamoeba invadens
TLTEE

SEQ ID NO: 2914843 - protein, 22 aa, Entamoeba invadens
TLTEEQKKKGVVAASAGNHAQG

SEQ ID NO: 2914844 - protein, 7 aa, Entamoeba invadens
TLTKKGY

SEQ ID NO: 2914845 - protein, 12 aa, Entamoeba invadens
TLTKSRNPITQE

SEQ ID NO: 2914846 - protein, 13 aa, Entamoeba invadens
TLTKTKTKKEAKQ

SEQ ID NO: 2914847 - protein, 6 aa, Entamoeba invadens
TLTNGS

SEQ ID NO: 2914848 - protein, 10 aa, Entamoeba invadens
TLTNKEDIET

SEQ ID NO: 2914849 - protein, 4 aa, Entamoeba invadens
TLTP

SEQ ID NO: 2914850 - protein, 8 aa, Entamoeba invadens
TLTPEEKV

SEQ ID NO: 2914851 - protein, 7 aa, Entamoeba invadens
TLTPGNI

SEQ ID NO: 2914852 - protein, 12 aa, Entamoeba invadens
TLTPPDKNLSDA

SEQ ID NO: 2914853 - protein, 7 aa, Entamoeba invadens
TLTPPQR

SEQ ID NO: 2914854 - protein, 9 aa, Entamoeba invadens
TLTPSKVNT

SEQ ID NO: 2914855 - protein, 7 aa, Entamoeba invadens
TLTQNAE

SEQ ID NO: 2914856 - protein, 5 aa, Entamoeba invadens
TLTQS

SEQ ID NO: 2914857 - protein, 20 aa, Entamoeba invadens
TLTRSESEWKRSLESVDNVM

SEQ ID NO: 2914858 - protein, 4 aa, Entamoeba invadens
TLTS

SEQ ID NO: 2914859 - protein, 5 aa, Entamoeba invadens
TLTSC

SEQ ID NO: 2914860 - protein, 38 aa, Entamoeba invadens
TLTSQGVKEKSQTDLEEESPIKSDMTESTENNEEGSAH

SEQ ID NO: 2914861 - protein, 9 aa, Entamoeba invadens
TLTSQNSEL

SEQ ID NO: 2914862 - protein, 8 aa, Entamoeba invadens
TLTSSNDD

SEQ ID NO: 2914863 - protein, 9 aa, Entamoeba invadens
TLTSSSFEQ

SEQ ID NO: 2914864 - protein, 9 aa, Entamoeba invadens
TLTSTRYSK

SEQ ID NO: 2914865 - protein, 13 aa, Entamoeba invadens
TLTTKERKKSRFG

SEQ ID NO: 2914866 - protein, 26 aa, Entamoeba invadens
TLTTPSRTISNEDKDIPQYTNGERFR

SEQ ID NO: 2914867 - protein, 18 aa, Entamoeba invadens
TLTTQTLENEKEKITEEL

SEQ ID NO: 2914868 - protein, 4 aa, Entamoeba invadens
TLVR

SEQ ID NO: 2914869 - protein, 19 aa, Entamoeba invadens
TLYGDEDEYMATRKSDGME

SEQ ID NO: 2914870 - protein, 4 aa, Entamoeba invadens
TMDD

SEQ ID NO: 2914871 - protein, 4 aa, Entamoeba invadens
TMDE

SEQ ID NO: 2914872 - protein, 10 aa, Entamoeba invadens
TMEDETLDGA

SEQ ID NO: 2914873 - protein, 8 aa, Entamoeba invadens
TMEEQTDI

SEQ ID NO: 2914874 - protein, 7 aa, Entamoeba invadens
TMEGGND

SEQ ID NO: 2914875 - protein, 9 aa, Entamoeba invadens
TMENEKEKL

SEQ ID NO: 2914876 - protein, 8 aa, Entamoeba invadens
TMEQNPIP

SEQ ID NO: 2914877 - protein, 13 aa, Entamoeba invadens
TMERNKKSKSKNY

SEQ ID NO: 2914878 - protein, 5 aa, Entamoeba invadens
TMGDR

SEQ ID NO: 2914879 - protein, 5 aa, Entamoeba invadens
TMGKM

SEQ ID NO: 2914880 - protein, 4 aa, Entamoeba invadens
TMGR

SEQ ID NO: 2914881 - protein, 8 aa, Entamoeba invadens
TMGTEERA

SEQ ID NO: 2914882 - protein, 13 aa, Entamoeba invadens
TMGTSSNKYNVER

SEQ ID NO: 2914883 - protein, 4 aa, Entamoeba invadens
TMKD

SEQ ID NO: 2914884 - protein, 9 aa, Entamoeba invadens
TMKESPPNI

SEQ ID NO: 2914885 - protein, 15 aa, Entamoeba invadens
TMKKNEDKGLGTPVY

SEQ ID NO: 2914886 - protein, 6 aa, Entamoeba invadens
TMKSKD

SEQ ID NO: 2914887 - protein, 10 aa, Entamoeba invadens
TMKSTDTREL

SEQ ID NO: 2914888 - protein, 4 aa, Entamoeba invadens
TMND

SEQ ID NO: 2914889 - protein, 8 aa, Entamoeba invadens
TMNKEEVE

SEQ ID NO: 2914890 - protein, 16 aa, Entamoeba invadens
TMNPPKPNFNPTETAP

SEQ ID NO: 2914891 - protein, 7 aa, Entamoeba invadens
TMPDPEY

SEQ ID NO: 2914892 - protein, 4 aa, Entamoeba invadens
TMPK

SEQ ID NO: 2914893 - protein, 7 aa, Entamoeba invadens
TMPSNVT

SEQ ID NO: 2914894 - protein, 4 aa, Entamoeba invadens
TMQG

SEQ ID NO: 2914895 - protein, 6 aa, Entamoeba invadens
TMRDAQ

SEQ ID NO: 2914896 - protein, 28 aa, Entamoeba invadens
TMSEHTRSPITEKDDEDDKEKKIPSEDI

SEQ ID NO: 2914897 - protein, 5 aa, Entamoeba invadens
TMSEI

SEQ ID NO: 2914898 - protein, 6 aa, Entamoeba invadens
TMSGKS

SEQ ID NO: 2914899 - protein, 9 aa, Entamoeba invadens
TMSGSEECS

SEQ ID NO: 2914900 - protein, 11 aa, Entamoeba invadens
TMSKADKADIH

SEQ ID NO: 2914901 - protein, 5 aa, Entamoeba invadens
TMSLD

SEQ ID NO: 2914902 - protein, 50 aa, Entamoeba invadens
TMSPRPKGEKYRKDSPTHSGKCSPRTPRSCRELTDSPLESPRYKKPPTFK

SEQ ID NO: 2914903 - protein, 5 aa, Entamoeba invadens
TMSRD

SEQ ID NO: 2914904 - protein, 6 aa, Entamoeba invadens
TMSVSE

SEQ ID NO: 2914905 - protein, 4 aa, Entamoeba invadens
TMTA

SEQ ID NO: 2914906 - protein, 14 aa, Entamoeba invadens
TMTAAEKLSKESDV

SEQ ID NO: 2914907 - protein, 8 aa, Entamoeba invadens
TMTDDERN

SEQ ID NO: 2914908 - protein, 6 aa, Entamoeba invadens
TMTDEL

SEQ ID NO: 2914909 - protein, 10 aa, Entamoeba invadens
TMTEDEKEAW

SEQ ID NO: 2914910 - protein, 22 aa, Entamoeba invadens
TMTPATKKFQNSVDSLQDSPIR

SEQ ID NO: 2914911 - protein, 7 aa, Entamoeba invadens
TMTPDSF

SEQ ID NO: 2914912 - protein, 12 aa, Entamoeba invadens
TMTPSPKIEESL

SEQ ID NO: 2914913 - protein, 5 aa, Entamoeba invadens
TMTSR

SEQ ID NO: 2914914 - protein, 11 aa, Entamoeba invadens
TNAEKQSNEIV

SEQ ID NO: 2914915 - protein, 9 aa, Entamoeba invadens
TNAEPTGEI

SEQ ID NO: 2914916 - protein, 6 aa, Entamoeba invadens
TNAGFG

SEQ ID NO: 2914917 - protein, 14 aa, Entamoeba invadens
TNAIAEEKQSKSIN

SEQ ID NO: 2914918 - protein, 4 aa, Entamoeba invadens
TNAK

SEQ ID NO: 2914919 - protein, 6 aa, Entamoeba invadens
TNAKLT

SEQ ID NO: 2914920 - protein, 10 aa, Entamoeba invadens
TNAKSNKPFE

SEQ ID NO: 2914921 - protein, 10 aa, Entamoeba invadens
TNAKTEKFDE

SEQ ID NO: 2914922 - protein, 5 aa, Entamoeba invadens
TNALN

SEQ ID NO: 2914923 - protein, 4 aa, Entamoeba invadens
TNAN

SEQ ID NO: 2914924 - protein, 23 aa, Entamoeba invadens
TNANESEPDLRQNTERSALQNTP

SEQ ID NO: 2914925 - protein, 6 aa, Entamoeba invadens
TNAPNS

SEQ ID NO: 2914926 - protein, 25 aa, Entamoeba invadens
TNAPPPPVQKQQVTPQTTTQPIQQP

SEQ ID NO: 2914927 - protein, 11 aa, Entamoeba invadens
TNAPSTGSMPN

SEQ ID NO: 2914928 - protein, 5 aa, Entamoeba invadens
TNAQQ

SEQ ID NO: 2914929 - protein, 10 aa, Entamoeba invadens
TNAQTRRNAE

SEQ ID NO: 2914930 - protein, 11 aa, Entamoeba invadens
TNASKDTGYKN

SEQ ID NO: 2914931 - protein, 6 aa, Entamoeba invadens
TNASNE

SEQ ID NO: 2914932 - protein, 44 aa, Entamoeba invadens
TNASQQTKDHISSQHSPLNGIEQQSYENKEPDCDNNSYNDTNND

SEQ ID NO: 2914933 - protein, 8 aa, Entamoeba invadens
TNASSGIA

SEQ ID NO: 2914934 - protein, 9 aa, Entamoeba invadens
TNAVGVGQA

SEQ ID NO: 2914935 - protein, 8 aa, Entamoeba invadens
TNCEEVTE

SEQ ID NO: 2914936 - protein, 5 aa, Entamoeba invadens
TNCEN

SEQ ID NO: 2914937 - protein, 17 aa, Entamoeba invadens
TNCETKTQNGCSQCSTG

SEQ ID NO: 2914938 - protein, 8 aa, Entamoeba invadens
TNCETKTS

SEQ ID NO: 2914939 - protein, 8 aa, Entamoeba invadens
TNCGRKSE

SEQ ID NO: 2914940 - protein, 12 aa, Entamoeba invadens
TNCSSSRDHHKK

SEQ ID NO: 2914941 - protein, 12 aa, Entamoeba invadens
TNCTNSKGTYCT

SEQ ID NO: 2914942 - protein, 4 aa, Entamoeba invadens
TNCV

SEQ ID NO: 2914943 - protein, 10 aa, Entamoeba invadens
TNCVNNSGTV

SEQ ID NO: 2914944 - protein, 10 aa, Entamoeba invadens
TNDATYTKNM

SEQ ID NO: 2914945 - protein, 9 aa, Entamoeba invadens
TNDCDPERS

SEQ ID NO: 2914946 - protein, 13 aa, Entamoeba invadens
TNDDEEVEDVTSR

SEQ ID NO: 2914947 - protein, 10 aa, Entamoeba invadens
TNDEEDKTWQ

SEQ ID NO: 2914948 - protein, 5 aa, Entamoeba invadens
TNDGL

SEQ ID NO: 2914949 - protein, 6 aa, Entamoeba invadens
TNDGYR

SEQ ID NO: 2914950 - protein, 6 aa, Entamoeba invadens
TNDIGT

SEQ ID NO: 2914951 - protein, 9 aa, Entamoeba invadens
TNDINNTEN

SEQ ID NO: 2914952 - protein, 11 aa, Entamoeba invadens
TNDISKSKSLR

SEQ ID NO: 2914953 - protein, 12 aa, Entamoeba invadens
TNDKNVKYAEQR

SEQ ID NO: 2914954 - protein, 4 aa, Entamoeba invadens
TNDL

SEQ ID NO: 2914955 - protein, 12 aa, Entamoeba invadens
TNDLAEALLREN

SEQ ID NO: 2914956 - protein, 5 aa, Entamoeba invadens
TNDLT

SEQ ID NO: 2914957 - protein, 45 aa, Entamoeba invadens
TNDMKTKNMKPEDKKPVEPKAAPKTAKPAAAKQAVQKPPKMEKVG

SEQ ID NO: 2914958 - protein, 4 aa, Entamoeba invadens
TNDN

SEQ ID NO: 2914959 - protein, 5 aa, Entamoeba invadens
TNDNK

SEQ ID NO: 2914960 - protein, 6 aa, Entamoeba invadens
TNDNNV

SEQ ID NO: 2914961 - protein, 6 aa, Entamoeba invadens
TNDNTE

SEQ ID NO: 2914962 - protein, 9 aa, Entamoeba invadens
TNDPNNHYK

SEQ ID NO: 2914963 - protein, 33 aa, Entamoeba invadens
TNDPPNQVKPTQVKKTGTSSENENEEKTEQIKT

SEQ ID NO: 2914964 - protein, 19 aa, Entamoeba invadens
TNDPSITQVSSSKPNCEYP

SEQ ID NO: 2914965 - protein, 8 aa, Entamoeba invadens
TNDPTDKY

SEQ ID NO: 2914966 - protein, 11 aa, Entamoeba invadens
TNDPVKQVSRK

SEQ ID NO: 2914967 - protein, 9 aa, Entamoeba invadens
TNDQDKPMN

SEQ ID NO: 2914968 - protein, 11 aa, Entamoeba invadens
TNDQMASYEKY

SEQ ID NO: 2914969 - protein, 5 aa, Entamoeba invadens
TNDSK

SEQ ID NO: 2914970 - protein, 15 aa, Entamoeba invadens
TNDSKISGVHPSKVP

SEQ ID NO: 2914971 - protein, 8 aa, Entamoeba invadens
TNDTNDLN

SEQ ID NO: 2914972 - protein, 7 aa, Entamoeba invadens
TNDTSTT

SEQ ID NO: 2914973 - protein, 7 aa, Entamoeba invadens
TNDTTVI

SEQ ID NO: 2914974 - protein, 6 aa, Entamoeba invadens
TNDVPT

SEQ ID NO: 2914975 - protein, 7 aa, Entamoeba invadens
TNDVRSR

SEQ ID NO: 2914976 - protein, 5 aa, Entamoeba invadens
TNDVT

SEQ ID NO: 2914977 - protein, 21 aa, Entamoeba invadens
TNDVVGTTQPLEKQQDKSDQD

SEQ ID NO: 2914978 - protein, 8 aa, Entamoeba invadens
TNEAAAAG

SEQ ID NO: 2914979 - protein, 7 aa, Entamoeba invadens
TNEASTK

SEQ ID NO: 2914980 - protein, 4 aa, Entamoeba invadens
TNEC

SEQ ID NO: 2914981 - protein, 4 aa, Entamoeba invadens
TNED

SEQ ID NO: 2914982 - protein, 28 aa, Entamoeba invadens
TNEDEESEDEDSENNELKPKIEQSCPYS

SEQ ID NO: 2914983 - protein, 8 aa, Entamoeba invadens
TNEDEQTQ

SEQ ID NO: 2914984 - protein, 26 aa, Entamoeba invadens
TNEDSDTSDEETQKNNGKTKKANALE

SEQ ID NO: 2914985 - protein, 20 aa, Entamoeba invadens
TNEDTPSKKKEVGKKTTIKQ

SEQ ID NO: 2914986 - protein, 5 aa, Entamoeba invadens
TNEEL

SEQ ID NO: 2914987 - protein, 10 aa, Entamoeba invadens
TNEENTKDAN

SEQ ID NO: 2914988 - protein, 28 aa, Entamoeba invadens
TNEEREKIKGEEKSEKVNNEIKSTSQNI

SEQ ID NO: 2914989 - protein, 7 aa, Entamoeba invadens
TNEETFS

SEQ ID NO: 2914990 - protein, 6 aa, Entamoeba invadens
TNEEVT

SEQ ID NO: 2914991 - protein, 18 aa, Entamoeba invadens
TNEFSDMTKSTVGVGVGS

SEQ ID NO: 2914992 - protein, 10 aa, Entamoeba invadens
TNEGEGKGVI

SEQ ID NO: 2914993 - protein, 5 aa, Entamoeba invadens
TNEIS

SEQ ID NO: 2914994 - protein, 16 aa, Entamoeba invadens
TNEKANAKLTDFGSSR

SEQ ID NO: 2914995 - protein, 24 aa, Entamoeba invadens
TNEKIKEKKEKVEKMKSEIEKGGK

SEQ ID NO: 2914996 - protein, 19 aa, Entamoeba invadens
TNEKNIEPQSSESSDSGEM

SEQ ID NO: 2914997 - protein, 8 aa, Entamoeba invadens
TNEKPIDD

SEQ ID NO: 2914998 - protein, 6 aa, Entamoeba invadens
TNEKQC

SEQ ID NO: 2914999 - protein, 8 aa, Entamoeba invadens
TNEKVGRR

SEQ ID NO: 2915000 - protein, 6 aa, Entamoeba invadens
TNEMKR

SEQ ID NO: 2915001 - protein, 10 aa, Entamoeba invadens
TNEMQPSPNL

SEQ ID NO: 2915002 - protein, 18 aa, Entamoeba invadens
TNEMSDGYYHDEEKTNEA

SEQ ID NO: 2915003 - protein, 4 aa, Entamoeba invadens
TNEN

SEQ ID NO: 2915004 - protein, 7 aa, Entamoeba invadens
TNENERI

SEQ ID NO: 2915005 - protein, 8 aa, Entamoeba invadens
TNENESKH

SEQ ID NO: 2915006 - protein, 8 aa, Entamoeba invadens
TNENINDR

SEQ ID NO: 2915007 - protein, 20 aa, Entamoeba invadens
TNENPHKFGDKRHASSQPEE

SEQ ID NO: 2915008 - protein, 9 aa, Entamoeba invadens
TNEQINESQ

SEQ ID NO: 2915009 - protein, 7 aa, Entamoeba invadens
TNEQLRE

SEQ ID NO: 2915010 - protein, 9 aa, Entamoeba invadens
TNEQQDAEE

SEQ ID NO: 2915011 - protein, 5 aa, Entamoeba invadens
TNERK

SEQ ID NO: 2915012 - protein, 7 aa, Entamoeba invadens
TNERVTP

SEQ ID NO: 2915013 - protein, 10 aa, Entamoeba invadens
TNESESEKYE

SEQ ID NO: 2915014 - protein, 14 aa, Entamoeba invadens
TNESHNEKDEISEI

SEQ ID NO: 2915015 - protein, 6 aa, Entamoeba invadens
TNESLE

SEQ ID NO: 2915016 - protein, 10 aa, Entamoeba invadens
TNESQTKMNA

SEQ ID NO: 2915017 - protein, 10 aa, Entamoeba invadens
TNESYPQGTN

SEQ ID NO: 2915018 - protein, 8 aa, Entamoeba invadens
TNETENIN

SEQ ID NO: 2915019 - protein, 9 aa, Entamoeba invadens
TNETEQSEA

SEQ ID NO: 2915020 - protein, 5 aa, Entamoeba invadens
TNETR

SEQ ID NO: 2915021 - protein, 11 aa, Entamoeba invadens
TNETSFGLSPE

SEQ ID NO: 2915022 - protein, 7 aa, Entamoeba invadens
TNETSYG

SEQ ID NO: 2915023 - protein, 6 aa, Entamoeba invadens
TNETTK

SEQ ID NO: 2915024 - protein, 7 aa, Entamoeba invadens
TNETTPV

SEQ ID NO: 2915025 - protein, 8 aa, Entamoeba invadens
TNETTTSA

SEQ ID NO: 2915026 - protein, 7 aa, Entamoeba invadens
TNETVNA

SEQ ID NO: 2915027 - protein, 6 aa, Entamoeba invadens
TNEVKQ

SEQ ID NO: 2915028 - protein, 12 aa, Entamoeba invadens
TNEVPEDEEMNK

SEQ ID NO: 2915029 - protein, 4 aa, Entamoeba invadens
TNEY

SEQ ID NO: 2915030 - protein, 15 aa, Entamoeba invadens
TNEYQYDDANEKAEE

SEQ ID NO: 2915031 - protein, 11 aa, Entamoeba invadens
TNFEYPTYGPI

SEQ ID NO: 2915032 - protein, 6 aa, Entamoeba invadens
TNFGNV

SEQ ID NO: 2915033 - protein, 5 aa, Entamoeba invadens
TNFGS

SEQ ID NO: 2915034 - protein, 4 aa, Entamoeba invadens
TNFK

SEQ ID NO: 2915035 - protein, 12 aa, Entamoeba invadens
TNFNPQIAPPPL

SEQ ID NO: 2915036 - protein, 6 aa, Entamoeba invadens
TNFPEE

SEQ ID NO: 2915037 - protein, 21 aa, Entamoeba invadens
TNFSQSDREVFNSDKRRLGWS

SEQ ID NO: 2915038 - protein, 4 aa, Entamoeba invadens
TNFT

SEQ ID NO: 2915039 - protein, 9 aa, Entamoeba invadens
TNFTQKRRP

SEQ ID NO: 2915040 - protein, 7 aa, Entamoeba invadens
TNFTTDR

SEQ ID NO: 2915041 - protein, 7 aa, Entamoeba invadens
TNGAPAE

SEQ ID NO: 2915042 - protein, 4 aa, Entamoeba invadens
TNGC

SEQ ID NO: 2915043 - protein, 9 aa, Entamoeba invadens
TNGDGQVER

SEQ ID NO: 2915044 - protein, 8 aa, Entamoeba invadens
TNGDIEKQ

SEQ ID NO: 2915045 - protein, 7 aa, Entamoeba invadens
TNGDLKK

SEQ ID NO: 2915046 - protein, 10 aa, Entamoeba invadens
TNGEALTSKS

SEQ ID NO: 2915047 - protein, 13 aa, Entamoeba invadens
TNGEDNEEKSDNI

SEQ ID NO: 2915048 - protein, 8 aa, Entamoeba invadens
TNGFEKSD

SEQ ID NO: 2915049 - protein, 7 aa, Entamoeba invadens
TNGFRSQ

SEQ ID NO: 2915050 - protein, 8 aa, Entamoeba invadens
TNGGLSVK

SEQ ID NO: 2915051 - protein, 8 aa, Entamoeba invadens
TNGGTDPW

SEQ ID NO: 2915052 - protein, 11 aa, Entamoeba invadens
TNGGTLSETEA

SEQ ID NO: 2915053 - protein, 9 aa, Entamoeba invadens
TNGIGKSTA

SEQ ID NO: 2915054 - protein, 7 aa, Entamoeba invadens
TNGKAPQ

SEQ ID NO: 2915055 - protein, 5 aa, Entamoeba invadens
TNGKR

SEQ ID NO: 2915056 - protein, 11 aa, Entamoeba invadens
TNGKSTQTSRS

SEQ ID NO: 2915057 - protein, 4 aa, Entamoeba invadens
TNGL

SEQ ID NO: 2915058 - protein, 6 aa, Entamoeba invadens
TNGMTQ

SEQ ID NO: 2915059 - protein, 11 aa, Entamoeba invadens
TNGNDTDPRDL

SEQ ID NO: 2915060 - protein, 25 aa, Entamoeba invadens
TNGNVSEMNSPNLEKSRDRSPEKAD

SEQ ID NO: 2915061 - protein, 10 aa, Entamoeba invadens
TNGRNAFNDI

SEQ ID NO: 2915062 - protein, 12 aa, Entamoeba invadens
TNGRSVQAATSH

SEQ ID NO: 2915063 - protein, 5 aa, Entamoeba invadens
TNGSA

SEQ ID NO: 2915064 - protein, 12 aa, Entamoeba invadens
TNGSGVNYQKYS

SEQ ID NO: 2915065 - protein, 6 aa, Entamoeba invadens
TNGSNV

SEQ ID NO: 2915066 - protein, 11 aa, Entamoeba invadens
TNGSVNGNVPV

SEQ ID NO: 2915067 - protein, 26 aa, Entamoeba invadens
TNGTQGTQNSTVGTQKSVLEQNETAS

SEQ ID NO: 2915068 - protein, 6 aa, Entamoeba invadens
TNGVGK

SEQ ID NO: 2915069 - protein, 5 aa, Entamoeba invadens
TNGVS

SEQ ID NO: 2915070 - protein, 6 aa, Entamoeba invadens
TNGVVE

SEQ ID NO: 2915071 - protein, 7 aa, Entamoeba invadens
TNHDPHV

SEQ ID NO: 2915072 - protein, 4 aa, Entamoeba invadens
TNHQ

SEQ ID NO: 2915073 - protein, 4 aa, Entamoeba invadens
TNHR

SEQ ID NO: 2915074 - protein, 8 aa, Entamoeba invadens
TNHYSGNN

SEQ ID NO: 2915075 - protein, 9 aa, Entamoeba invadens
TNHYSGNNL

SEQ ID NO: 2915076 - protein, 6 aa, Entamoeba invadens
TNIDRN

SEQ ID NO: 2915077 - protein, 6 aa, Entamoeba invadens
TNIFPK

SEQ ID NO: 2915078 - protein, 5 aa, Entamoeba invadens
TNIHS

SEQ ID NO: 2915079 - protein, 6 aa, Entamoeba invadens
TNIKSY

SEQ ID NO: 2915080 - protein, 4 aa, Entamoeba invadens
TNIN

SEQ ID NO: 2915081 - protein, 20 aa, Entamoeba invadens
TNINEQKDKINKQKTEIEEK

SEQ ID NO: 2915082 - protein, 20 aa, Entamoeba invadens
TNINEQKDKINKQKTEIEEQ

SEQ ID NO: 2915083 - protein, 8 aa, Entamoeba invadens
TNINGEDK

SEQ ID NO: 2915084 - protein, 6 aa, Entamoeba invadens
TNINQT

SEQ ID NO: 2915085 - protein, 17 aa, Entamoeba invadens
TNIPEEASQQEEASEEE

SEQ ID NO: 2915086 - protein, 13 aa, Entamoeba invadens
TNIPEQKQTYCPP

SEQ ID NO: 2915087 - protein, 6 aa, Entamoeba invadens
TNIPGE

SEQ ID NO: 2915088 - protein, 12 aa, Entamoeba invadens
TNIPPHKNSRIS

SEQ ID NO: 2915089 - protein, 9 aa, Entamoeba invadens
TNIPSGETS

SEQ ID NO: 2915090 - protein, 6 aa, Entamoeba invadens
TNIRNT

SEQ ID NO: 2915091 - protein, 10 aa, Entamoeba invadens
TNITDSKSSL

SEQ ID NO: 2915092 - protein, 13 aa, Entamoeba invadens
TNITKSAKTPFKN

SEQ ID NO: 2915093 - protein, 13 aa, Entamoeba invadens
TNITKSANTPFKN

SEQ ID NO: 2915094 - protein, 8 aa, Entamoeba invadens
TNKAQSEK

SEQ ID NO: 2915095 - protein, 6 aa, Entamoeba invadens
TNKASK

SEQ ID NO: 2915096 - protein, 7 aa, Entamoeba invadens
TNKDAFN

SEQ ID NO: 2915097 - protein, 8 aa, Entamoeba invadens
TNKDKKMD

SEQ ID NO: 2915098 - protein, 6 aa, Entamoeba invadens
TNKDSD

SEQ ID NO: 2915099 - protein, 8 aa, Entamoeba invadens
TNKDTKMV

SEQ ID NO: 2915100 - protein, 17 aa, Entamoeba invadens
TNKEDVVEYNTSGNLYD

SEQ ID NO: 2915101 - protein, 9 aa, Entamoeba invadens
TNKEEEMKK

SEQ ID NO: 2915102 - protein, 7 aa, Entamoeba invadens
TNKEGAL

SEQ ID NO: 2915103 - protein, 9 aa, Entamoeba invadens
TNKEGDDVD

SEQ ID NO: 2915104 - protein, 43 aa, Entamoeba invadens
TNKEKDINNSTAFETSLPKVQTSQSEMKKNPPETEKMQKSPTK

SEQ ID NO: 2915105 - protein, 6 aa, Entamoeba invadens
TNKEPI

SEQ ID NO: 2915106 - protein, 8 aa, Entamoeba invadens
TNKEPLRI

SEQ ID NO: 2915107 - protein, 8 aa, Entamoeba invadens
TNKFGEAM

SEQ ID NO: 2915108 - protein, 17 aa, Entamoeba invadens
TNKGNNVAKDLSSSRKI

SEQ ID NO: 2915109 - protein, 4 aa, Entamoeba invadens
TNKI

SEQ ID NO: 2915110 - protein, 9 aa, Entamoeba invadens
TNKIGPEEK

SEQ ID NO: 2915111 - protein, 9 aa, Entamoeba invadens
TNKKDQQEV

SEQ ID NO: 2915112 - protein, 20 aa, Entamoeba invadens
TNKKEPEGASDGTRNENELK

SEQ ID NO: 2915113 - protein, 15 aa, Entamoeba invadens
TNKKKEQDKKKSRIS

SEQ ID NO: 2915114 - protein, 27 aa, Entamoeba invadens
TNKKLKKKVKEEKPEKKEKQEEQKEVK

SEQ ID NO: 2915115 - protein, 7 aa, Entamoeba invadens
TNKKNVK

SEQ ID NO: 2915116 - protein, 5 aa, Entamoeba invadens
TNKLS

SEQ ID NO: 2915117 - protein, 4 aa, Entamoeba invadens
TNKM

SEQ ID NO: 2915118 - protein, 5 aa, Entamoeba invadens
TNKNI

SEQ ID NO: 2915119 - protein, 7 aa, Entamoeba invadens
TNKNKFG

SEQ ID NO: 2915120 - protein, 27 aa, Entamoeba invadens
TNKPFQRRGGSKRQQKKKGKKKSEVVK

SEQ ID NO: 2915121 - protein, 9 aa, Entamoeba invadens
TNKPSFSQI

SEQ ID NO: 2915122 - protein, 7 aa, Entamoeba invadens
TNKQKEF

SEQ ID NO: 2915123 - protein, 5 aa, Entamoeba invadens
TNKQN

SEQ ID NO: 2915124 - protein, 16 aa, Entamoeba invadens
TNKQTGVKNEKADSQP

SEQ ID NO: 2915125 - protein, 11 aa, Entamoeba invadens
TNKQTPTKDDN

SEQ ID NO: 2915126 - protein, 9 aa, Entamoeba invadens
TNKRSINAS

SEQ ID NO: 2915127 - protein, 5 aa, Entamoeba invadens
TNKRT

SEQ ID NO: 2915128 - protein, 6 aa, Entamoeba invadens
TNKRTE

SEQ ID NO: 2915129 - protein, 23 aa, Entamoeba invadens
TNKSAALNIQNTQQSVSPSAPIS

SEQ ID NO: 2915130 - protein, 8 aa, Entamoeba invadens
TNKSEFTE

SEQ ID NO: 2915131 - protein, 5 aa, Entamoeba invadens
TNKTH

SEQ ID NO: 2915132 - protein, 7 aa, Entamoeba invadens
TNKTIPI

SEQ ID NO: 2915133 - protein, 14 aa, Entamoeba invadens
TNKTLEAKPPTPGM

SEQ ID NO: 2915134 - protein, 11 aa, Entamoeba invadens
TNKTLNTPKNA

SEQ ID NO: 2915135 - protein, 9 aa, Entamoeba invadens
TNKTPGLED

SEQ ID NO: 2915136 - protein, 5 aa, Entamoeba invadens
TNKTQ

SEQ ID NO: 2915137 - protein, 20 aa, Entamoeba invadens
TNKTSSQLSPLTETVERPIQ

SEQ ID NO: 2915138 - protein, 10 aa, Entamoeba invadens
TNKTTAEIQN

SEQ ID NO: 2915139 - protein, 9 aa, Entamoeba invadens
TNKTVSPNH

SEQ ID NO: 2915140 - protein, 6 aa, Entamoeba invadens
TNKTYE

SEQ ID NO: 2915141 - protein, 5 aa, Entamoeba invadens
TNKVA

SEQ ID NO: 2915142 - protein, 6 aa, Entamoeba invadens
TNKVTE

SEQ ID NO: 2915143 - protein, 11 aa, Entamoeba invadens
TNKVTKERRLP

SEQ ID NO: 2915144 - protein, 7 aa, Entamoeba invadens
TNKYDGP

SEQ ID NO: 2915145 - protein, 64 aa, Entamoeba invadens
TNLADSANSTPANTTTLTTPTTTGTSTSTVGDATTTPNAGTSTTTTTTTQHPAATASKDTTTIG

SEQ ID NO: 2915146 - protein, 4 aa, Entamoeba invadens
TNLD

SEQ ID NO: 2915147 - protein, 16 aa, Entamoeba invadens
TNLDEDLSTQKDTIKN

SEQ ID NO: 2915148 - protein, 6 aa, Entamoeba invadens
TNLDEG

SEQ ID NO: 2915149 - protein, 14 aa, Entamoeba invadens
TNLDGTKDDTIESN

SEQ ID NO: 2915150 - protein, 10 aa, Entamoeba invadens
TNLENKNNED

SEQ ID NO: 2915151 - protein, 4 aa, Entamoeba invadens
TNLF

SEQ ID NO: 2915152 - protein, 5 aa, Entamoeba invadens
TNLGN

SEQ ID NO: 2915153 - protein, 9 aa, Entamoeba invadens
TNLKGGLEN

SEQ ID NO: 2915154 - protein, 6 aa, Entamoeba invadens
TNLPEN

SEQ ID NO: 2915155 - protein, 7 aa, Entamoeba invadens
TNLPEYD

SEQ ID NO: 2915156 - protein, 5 aa, Entamoeba invadens
TNLPP

SEQ ID NO: 2915157 - protein, 5 aa, Entamoeba invadens
TNLPT

SEQ ID NO: 2915158 - protein, 4 aa, Entamoeba invadens
TNLS

SEQ ID NO: 2915159 - protein, 11 aa, Entamoeba invadens
TNLSGGEKTLS

SEQ ID NO: 2915160 - protein, 6 aa, Entamoeba invadens
TNMGGT

SEQ ID NO: 2915161 - protein, 6 aa, Entamoeba invadens
TNMKEL

SEQ ID NO: 2915162 - protein, 4 aa, Entamoeba invadens
TNMS

SEQ ID NO: 2915163 - protein, 12 aa, Entamoeba invadens
TNMSSGQARTEP

SEQ ID NO: 2915164 - protein, 28 aa, Entamoeba invadens
TNMSVGAPQNTGRLSTDSSQSDDAETAN

SEQ ID NO: 2915165 - protein, 10 aa, Entamoeba invadens
TNMTQSQKEI

SEQ ID NO: 2915166 - protein, 11 aa, Entamoeba invadens
TNMYPSPDTGK

SEQ ID NO: 2915167 - protein, 6 aa, Entamoeba invadens
TNNAGE

SEQ ID NO: 2915168 - protein, 6 aa, Entamoeba invadens
TNNAPI

SEQ ID NO: 2915169 - protein, 5 aa, Entamoeba invadens
TNNDQ

SEQ ID NO: 2915170 - protein, 5 aa, Entamoeba invadens
TNNEK

SEQ ID NO: 2915171 - protein, 11 aa, Entamoeba invadens
TNNENDTPNTF

SEQ ID NO: 2915172 - protein, 12 aa, Entamoeba invadens
TNNENSAPPDCG

SEQ ID NO: 2915173 - protein, 8 aa, Entamoeba invadens
TNNEPPKV

SEQ ID NO: 2915174 - protein, 5 aa, Entamoeba invadens
TNNER

SEQ ID NO: 2915175 - protein, 8 aa, Entamoeba invadens
TNNERFKE

SEQ ID NO: 2915176 - protein, 7 aa, Entamoeba invadens
TNNETTQ

SEQ ID NO: 2915177 - protein, 8 aa, Entamoeba invadens
TNNFSESY

SEQ ID NO: 2915178 - protein, 9 aa, Entamoeba invadens
TNNGCNNTT

SEQ ID NO: 2915179 - protein, 6 aa, Entamoeba invadens
TNNIEG

SEQ ID NO: 2915180 - protein, 9 aa, Entamoeba invadens
TNNKASNAE

SEQ ID NO: 2915181 - protein, 17 aa, Entamoeba invadens
TNNKDPVKTEMSGEAAA

SEQ ID NO: 2915182 - protein, 4 aa, Entamoeba invadens
TNNL

SEQ ID NO: 2915183 - protein, 6 aa, Entamoeba invadens
TNNLGF

SEQ ID NO: 2915184 - protein, 5 aa, Entamoeba invadens
TNNNF

SEQ ID NO: 2915185 - protein, 10 aa, Entamoeba invadens
TNNNGTLEKK

SEQ ID NO: 2915186 - protein, 7 aa, Entamoeba invadens
TNNNKFG

SEQ ID NO: 2915187 - protein, 16 aa, Entamoeba invadens
TNNNMGNLDTKTETVN

SEQ ID NO: 2915188 - protein, 17 aa, Entamoeba invadens
TNNNMRNLDTKTETFET

SEQ ID NO: 2915189 - protein, 6 aa, Entamoeba invadens
TNNNRF

SEQ ID NO: 2915190 - protein, 8 aa, Entamoeba invadens
TNNNRGQT

SEQ ID NO: 2915191 - protein, 8 aa, Entamoeba invadens
TNNPISTH

SEQ ID NO: 2915192 - protein, 13 aa, Entamoeba invadens
TNNSRSPRVYRPH

SEQ ID NO: 2915193 - protein, 10 aa, Entamoeba invadens
TNNSTDSDRM

SEQ ID NO: 2915194 - protein, 9 aa, Entamoeba invadens
TNNSTPGMK

SEQ ID NO: 2915195 - protein, 9 aa, Entamoeba invadens
TNNSTREVR

SEQ ID NO: 2915196 - protein, 8 aa, Entamoeba invadens
TNNSYSPL

SEQ ID NO: 2915197 - protein, 6 aa, Entamoeba invadens
TNNTAN

SEQ ID NO: 2915198 - protein, 6 aa, Entamoeba invadens
TNNTLT

SEQ ID NO: 2915199 - protein, 5 aa, Entamoeba invadens
TNNTP

SEQ ID NO: 2915200 - protein, 5 aa, Entamoeba invadens
TNNTR

SEQ ID NO: 2915201 - protein, 8 aa, Entamoeba invadens
TNNTTQSK

SEQ ID NO: 2915202 - protein, 4 aa, Entamoeba invadens
TNNV

SEQ ID NO: 2915203 - protein, 11 aa, Entamoeba invadens
TNNVDDKSNEI

SEQ ID NO: 2915204 - protein, 8 aa, Entamoeba invadens
TNNVTNKK

SEQ ID NO: 2915205 - protein, 5 aa, Entamoeba invadens
TNPDA

SEQ ID NO: 2915206 - protein, 5 aa, Entamoeba invadens
TNPDD

SEQ ID NO: 2915207 - protein, 7 aa, Entamoeba invadens
TNPDELP

SEQ ID NO: 2915208 - protein, 8 aa, Entamoeba invadens
TNPDRPSL

SEQ ID NO: 2915209 - protein, 6 aa, Entamoeba invadens
TNPDSC

SEQ ID NO: 2915210 - protein, 5 aa, Entamoeba invadens
TNPDV

SEQ ID NO: 2915211 - protein, 12 aa, Entamoeba invadens
TNPEDALKESLS

SEQ ID NO: 2915212 - protein, 6 aa, Entamoeba invadens
TNPEKI

SEQ ID NO: 2915213 - protein, 10 aa, Entamoeba invadens
TNPEKRPTFT

SEQ ID NO: 2915214 - protein, 9 aa, Entamoeba invadens
TNPELGQSS

SEQ ID NO: 2915215 - protein, 11 aa, Entamoeba invadens
TNPENDPSELS

SEQ ID NO: 2915216 - protein, 5 aa, Entamoeba invadens
TNPEQ

SEQ ID NO: 2915217 - protein, 10 aa, Entamoeba invadens
TNPGAKSTIK

SEQ ID NO: 2915218 - protein, 11 aa, Entamoeba invadens
TNPGNGPETLK

SEQ ID NO: 2915219 - protein, 7 aa, Entamoeba invadens
TNPGRSA

SEQ ID NO: 2915220 - protein, 9 aa, Entamoeba invadens
TNPIGEGGT

SEQ ID NO: 2915221 - protein, 9 aa, Entamoeba invadens
TNPIKEEKV

SEQ ID NO: 2915222 - protein, 10 aa, Entamoeba invadens
TNPKAKYISG

SEQ ID NO: 2915223 - protein, 6 aa, Entamoeba invadens
TNPKTV

SEQ ID NO: 2915224 - protein, 10 aa, Entamoeba invadens
TNPLKESQEY

SEQ ID NO: 2915225 - protein, 7 aa, Entamoeba invadens
TNPLSKD

SEQ ID NO: 2915226 - protein, 4 aa, Entamoeba invadens
TNPN

SEQ ID NO: 2915227 - protein, 5 aa, Entamoeba invadens
TNPND

SEQ ID NO: 2915228 - protein, 6 aa, Entamoeba invadens
TNPNEI

SEQ ID NO: 2915229 - protein, 11 aa, Entamoeba invadens
TNPNRKAYQQE

SEQ ID NO: 2915230 - protein, 5 aa, Entamoeba invadens
TNPQG

SEQ ID NO: 2915231 - protein, 6 aa, Entamoeba invadens
TNPQMD

SEQ ID NO: 2915232 - protein, 11 aa, Entamoeba invadens
TNPQNWNDHQK

SEQ ID NO: 2915233 - protein, 5 aa, Entamoeba invadens
TNPQP

SEQ ID NO: 2915234 - protein, 7 aa, Entamoeba invadens
TNPQSGD

SEQ ID NO: 2915235 - protein, 12 aa, Entamoeba invadens
TNPQSLTNFAIK

SEQ ID NO: 2915236 - protein, 5 aa, Entamoeba invadens
TNPQT

SEQ ID NO: 2915237 - protein, 4 aa, Entamoeba invadens
TNPS

SEQ ID NO: 2915238 - protein, 7 aa, Entamoeba invadens
TNPSEGN

SEQ ID NO: 2915239 - protein, 9 aa, Entamoeba invadens
TNPSEVERR

SEQ ID NO: 2915240 - protein, 8 aa, Entamoeba invadens
TNPSSDKP

SEQ ID NO: 2915241 - protein, 9 aa, Entamoeba invadens
TNPSTEGFS

SEQ ID NO: 2915242 - protein, 16 aa, Entamoeba invadens
TNPSTPTHNNGLDNEG

SEQ ID NO: 2915243 - protein, 6 aa, Entamoeba invadens
TNPTIT

SEQ ID NO: 2915244 - protein, 29 aa, Entamoeba invadens
TNPTPPVDSSPQSQQTQPSGDISQHRRSH

SEQ ID NO: 2915245 - protein, 8 aa, Entamoeba invadens
TNPTYGTM

SEQ ID NO: 2915246 - protein, 19 aa, Entamoeba invadens
TNPTYPTIPKTESPTSFEK

SEQ ID NO: 2915247 - protein, 8 aa, Entamoeba invadens
TNPYEDDK

SEQ ID NO: 2915248 - protein, 13 aa, Entamoeba invadens
TNPYTEKKPGWPD

SEQ ID NO: 2915249 - protein, 22 aa, Entamoeba invadens
TNQCNIKKRTRVKIETDTESGI

SEQ ID NO: 2915250 - protein, 6 aa, Entamoeba invadens
TNQCVT

SEQ ID NO: 2915251 - protein, 11 aa, Entamoeba invadens
TNQDDLVEEEI

SEQ ID NO: 2915252 - protein, 13 aa, Entamoeba invadens
TNQELGLDPPKYP

SEQ ID NO: 2915253 - protein, 13 aa, Entamoeba invadens
TNQESGCKSPINR

SEQ ID NO: 2915254 - protein, 12 aa, Entamoeba invadens
TNQEYIGGDRIT

SEQ ID NO: 2915255 - protein, 4 aa, Entamoeba invadens
TNQL

SEQ ID NO: 2915256 - protein, 5 aa, Entamoeba invadens
TNQLD

SEQ ID NO: 2915257 - protein, 5 aa, Entamoeba invadens
TNQLG

SEQ ID NO: 2915258 - protein, 5 aa, Entamoeba invadens
TNQNK

SEQ ID NO: 2915259 - protein, 4 aa, Entamoeba invadens
TNQQ

SEQ ID NO: 2915260 - protein, 31 aa, Entamoeba invadens
TNQQQTQGGITAPTNSLFPSNTATQQQGTNL

SEQ ID NO: 2915261 - protein, 4 aa, Entamoeba invadens
TNQS

SEQ ID NO: 2915262 - protein, 12 aa, Entamoeba invadens
TNQSNPKEEIDA

SEQ ID NO: 2915263 - protein, 7 aa, Entamoeba invadens
TNQSSPF

SEQ ID NO: 2915264 - protein, 8 aa, Entamoeba invadens
TNQSTRID

SEQ ID NO: 2915265 - protein, 14 aa, Entamoeba invadens
TNQTLTGDDRDANC

SEQ ID NO: 2915266 - protein, 8 aa, Entamoeba invadens
TNQTQTSN

SEQ ID NO: 2915267 - protein, 13 aa, Entamoeba invadens
TNQVFSTSGVTAT

SEQ ID NO: 2915268 - protein, 10 aa, Entamoeba invadens
TNQVSQMKSK

SEQ ID NO: 2915269 - protein, 16 aa, Entamoeba invadens
TNRDEIRDKLNQPDFT

SEQ ID NO: 2915270 - protein, 5 aa, Entamoeba invadens
TNRDG

SEQ ID NO: 2915271 - protein, 6 aa, Entamoeba invadens
TNRGRF

SEQ ID NO: 2915272 - protein, 10 aa, Entamoeba invadens
TNRKIAQKAM

SEQ ID NO: 2915273 - protein, 12 aa, Entamoeba invadens
TNRNGSNPTQQF

SEQ ID NO: 2915274 - protein, 9 aa, Entamoeba invadens
TNRNKTKRC

SEQ ID NO: 2915275 - protein, 5 aa, Entamoeba invadens
TNRNS

SEQ ID NO: 2915276 - protein, 14 aa, Entamoeba invadens
TNRNVSVDRERLSN

SEQ ID NO: 2915277 - protein, 6 aa, Entamoeba invadens
TNRPDL

SEQ ID NO: 2915278 - protein, 11 aa, Entamoeba invadens
TNRPDSLDPAL

SEQ ID NO: 2915279 - protein, 8 aa, Entamoeba invadens
TNRPNSID

SEQ ID NO: 2915280 - protein, 8 aa, Entamoeba invadens
TNRPNTID

SEQ ID NO: 2915281 - protein, 13 aa, Entamoeba invadens
TNRPQEIDEAARR

SEQ ID NO: 2915282 - protein, 14 aa, Entamoeba invadens
TNRQETSKKGEVDM

SEQ ID NO: 2915283 - protein, 4 aa, Entamoeba invadens
TNRR

SEQ ID NO: 2915284 - protein, 13 aa, Entamoeba invadens
TNRTEKVKNGEKN

SEQ ID NO: 2915285 - protein, 8 aa, Entamoeba invadens
TNRYNNTN

SEQ ID NO: 2915286 - protein, 64 aa, Entamoeba invadens
TNSAKPNLNDGSKNSEMSDQAFKQNEVEDIRDKTTTEKGTDNDKKELEHSQSPSPPVYKNRNLV

SEQ ID NO: 2915287 - protein, 21 aa, Entamoeba invadens
TNSASGSNVDESNITQSQESY

SEQ ID NO: 2915288 - protein, 5 aa, Entamoeba invadens
TNSCE

SEQ ID NO: 2915289 - protein, 8 aa, Entamoeba invadens
TNSCSNES

SEQ ID NO: 2915290 - protein, 11 aa, Entamoeba invadens
TNSDEMEDGVI

SEQ ID NO: 2915291 - protein, 25 aa, Entamoeba invadens
TNSDESEKSAESQVSTQKSAETNLK

SEQ ID NO: 2915292 - protein, 13 aa, Entamoeba invadens
TNSDGNEEITTQA

SEQ ID NO: 2915293 - protein, 9 aa, Entamoeba invadens
TNSDGTQKE

SEQ ID NO: 2915294 - protein, 7 aa, Entamoeba invadens
TNSDNDL

SEQ ID NO: 2915295 - protein, 7 aa, Entamoeba invadens
TNSDNEF

SEQ ID NO: 2915296 - protein, 7 aa, Entamoeba invadens
TNSDRNY

SEQ ID NO: 2915297 - protein, 7 aa, Entamoeba invadens
TNSDVKS

SEQ ID NO: 2915298 - protein, 5 aa, Entamoeba invadens
TNSDY

SEQ ID NO: 2915299 - protein, 4 aa, Entamoeba invadens
TNSE

SEQ ID NO: 2915300 - protein, 10 aa, Entamoeba invadens
TNSEGGRPTL

SEQ ID NO: 2915301 - protein, 17 aa, Entamoeba invadens
TNSEIGTAAKDKEIETV

SEQ ID NO: 2915302 - protein, 5 aa, Entamoeba invadens
TNSFE

SEQ ID NO: 2915303 - protein, 5 aa, Entamoeba invadens
TNSFK

SEQ ID NO: 2915304 - protein, 7 aa, Entamoeba invadens
TNSFPDT

SEQ ID NO: 2915305 - protein, 5 aa, Entamoeba invadens
TNSGA

SEQ ID NO: 2915306 - protein, 22 aa, Entamoeba invadens
TNSGSCEPWPPYNPKEKVTCPS

SEQ ID NO: 2915307 - protein, 4 aa, Entamoeba invadens
TNSI

SEQ ID NO: 2915308 - protein, 15 aa, Entamoeba invadens
TNSIEKKGEKFLVNA

SEQ ID NO: 2915309 - protein, 6 aa, Entamoeba invadens
TNSIPD

SEQ ID NO: 2915310 - protein, 10 aa, Entamoeba invadens
TNSKEAMNQP

SEQ ID NO: 2915311 - protein, 5 aa, Entamoeba invadens
TNSKF

SEQ ID NO: 2915312 - protein, 10 aa, Entamoeba invadens
TNSKGSLVPT

SEQ ID NO: 2915313 - protein, 13 aa, Entamoeba invadens
TNSKISHPSDPSI

SEQ ID NO: 2915314 - protein, 10 aa, Entamoeba invadens
TNSKTLKSTY

SEQ ID NO: 2915315 - protein, 5 aa, Entamoeba invadens
TNSKV

SEQ ID NO: 2915316 - protein, 11 aa, Entamoeba invadens
TNSKYDELTGE

SEQ ID NO: 2915317 - protein, 4 aa, Entamoeba invadens
TNSL

SEQ ID NO: 2915318 - protein, 5 aa, Entamoeba invadens
TNSLK

SEQ ID NO: 2915319 - protein, 14 aa, Entamoeba invadens
TNSLKGADVDNREL

SEQ ID NO: 2915320 - protein, 6 aa, Entamoeba invadens
TNSLQP

SEQ ID NO: 2915321 - protein, 7 aa, Entamoeba invadens
TNSMKEK

SEQ ID NO: 2915322 - protein, 31 aa, Entamoeba invadens
TNSNASPKPMKKEKSKKAISDTKHKKPEIGR

SEQ ID NO: 2915323 - protein, 13 aa, Entamoeba invadens
TNSNFTKKDLEER

SEQ ID NO: 2915324 - protein, 8 aa, Entamoeba invadens
TNSNKYDP

SEQ ID NO: 2915325 - protein, 12 aa, Entamoeba invadens
TNSNSSSSKTSL

SEQ ID NO: 2915326 - protein, 8 aa, Entamoeba invadens
TNSNVKTQ

SEQ ID NO: 2915327 - protein, 8 aa, Entamoeba invadens
TNSNYTSD

SEQ ID NO: 2915328 - protein, 8 aa, Entamoeba invadens
TNSPKLNS

SEQ ID NO: 2915329 - protein, 7 aa, Entamoeba invadens
TNSPLNE

SEQ ID NO: 2915330 - protein, 8 aa, Entamoeba invadens
TNSPSDSV

SEQ ID NO: 2915331 - protein, 6 aa, Entamoeba invadens
TNSPVE

SEQ ID NO: 2915332 - protein, 5 aa, Entamoeba invadens
TNSPY

SEQ ID NO: 2915333 - protein, 21 aa, Entamoeba invadens
TNSQQSVVENTPQFTQATQNT

SEQ ID NO: 2915334 - protein, 49 aa, Entamoeba invadens
TNSRKPSATGSEKPQPVSVKEQNSTQPKQQEQNTTTEPPNDADDDYEEI

SEQ ID NO: 2915335 - protein, 10 aa, Entamoeba invadens
TNSRVSAVKE

SEQ ID NO: 2915336 - protein, 24 aa, Entamoeba invadens
TNSSKTQYVPKETKGKTKEEVHTY

SEQ ID NO: 2915337 - protein, 7 aa, Entamoeba invadens
TNSSNIK

SEQ ID NO: 2915338 - protein, 10 aa, Entamoeba invadens
TNSSSHSPRV

SEQ ID NO: 2915339 - protein, 20 aa, Entamoeba invadens
TNSSYESSYSNTLKASTAYQ

SEQ ID NO: 2915340 - protein, 10 aa, Entamoeba invadens
TNSTNETIQG

SEQ ID NO: 2915341 - protein, 6 aa, Entamoeba invadens
TNSTSG

SEQ ID NO: 2915342 - protein, 9 aa, Entamoeba invadens
TNSTTDKTS

SEQ ID NO: 2915343 - protein, 5 aa, Entamoeba invadens
TNSTV

SEQ ID NO: 2915344 - protein, 4 aa, Entamoeba invadens
TNSV

SEQ ID NO: 2915345 - protein, 14 aa, Entamoeba invadens
TNSVTSSEPHSDRV

SEQ ID NO: 2915346 - protein, 8 aa, Entamoeba invadens
TNSWTTDP

SEQ ID NO: 2915347 - protein, 7 aa, Entamoeba invadens
TNSYTDK

SEQ ID NO: 2915348 - protein, 25 aa, Entamoeba invadens
TNTAAAPASTTTTPATDTKPAGDLN

SEQ ID NO: 2915349 - protein, 16 aa, Entamoeba invadens
TNTADTLKQSTPQPQR

SEQ ID NO: 2915350 - protein, 7 aa, Entamoeba invadens
TNTANEL

SEQ ID NO: 2915351 - protein, 5 aa, Entamoeba invadens
TNTAS

SEQ ID NO: 2915352 - protein, 7 aa, Entamoeba invadens
TNTASED

SEQ ID NO: 2915353 - protein, 8 aa, Entamoeba invadens
TNTASGTK

SEQ ID NO: 2915354 - protein, 4 aa, Entamoeba invadens
TNTD

SEQ ID NO: 2915355 - protein, 9 aa, Entamoeba invadens
TNTDFGDDN

SEQ ID NO: 2915356 - protein, 15 aa, Entamoeba invadens
TNTDKQVVHSNVSLT

SEQ ID NO: 2915357 - protein, 6 aa, Entamoeba invadens
TNTDQY

SEQ ID NO: 2915358 - protein, 14 aa, Entamoeba invadens
TNTEEKVDNENKTV

SEQ ID NO: 2915359 - protein, 11 aa, Entamoeba invadens
TNTEENEDCEN

SEQ ID NO: 2915360 - protein, 18 aa, Entamoeba invadens
TNTEENEDCENENSENGV

SEQ ID NO: 2915361 - protein, 5 aa, Entamoeba invadens
TNTEI

SEQ ID NO: 2915362 - protein, 7 aa, Entamoeba invadens
TNTEISG

SEQ ID NO: 2915363 - protein, 6 aa, Entamoeba invadens
TNTEKE

SEQ ID NO: 2915364 - protein, 16 aa, Entamoeba invadens
TNTELDKKQDECDKLE

SEQ ID NO: 2915365 - protein, 8 aa, Entamoeba invadens
TNTFETRT

SEQ ID NO: 2915366 - protein, 5 aa, Entamoeba invadens
TNTFN

SEQ ID NO: 2915367 - protein, 6 aa, Entamoeba invadens
TNTGIK

SEQ ID NO: 2915368 - protein, 16 aa, Entamoeba invadens
TNTGNAAKRSSTPQRI

SEQ ID NO: 2915369 - protein, 10 aa, Entamoeba invadens
TNTGNTSLGT

SEQ ID NO: 2915370 - protein, 12 aa, Entamoeba invadens
TNTIAPPLSPRF

SEQ ID NO: 2915371 - protein, 5 aa, Entamoeba invadens
TNTIS

SEQ ID NO: 2915372 - protein, 5 aa, Entamoeba invadens
TNTIY

SEQ ID NO: 2915373 - protein, 7 aa, Entamoeba invadens
TNTKASK

SEQ ID NO: 2915374 - protein, 10 aa, Entamoeba invadens
TNTKENEDIE

SEQ ID NO: 2915375 - protein, 6 aa, Entamoeba invadens
TNTKQR

SEQ ID NO: 2915376 - protein, 5 aa, Entamoeba invadens
TNTKS

SEQ ID NO: 2915377 - protein, 21 aa, Entamoeba invadens
TNTKSEGTLLTESKSKENIGY

SEQ ID NO: 2915378 - protein, 33 aa, Entamoeba invadens
TNTKSPKTPKQSMSPQLSKKSSSKERTKDGYKE

SEQ ID NO: 2915379 - protein, 8 aa, Entamoeba invadens
TNTKVTDG

SEQ ID NO: 2915380 - protein, 5 aa, Entamoeba invadens
TNTKY

SEQ ID NO: 2915381 - protein, 18 aa, Entamoeba invadens
TNTLSQKELKQESKSWEA

SEQ ID NO: 2915382 - protein, 4 aa, Entamoeba invadens
TNTN

SEQ ID NO: 2915383 - protein, 12 aa, Entamoeba invadens
TNTNPRIESKRK

SEQ ID NO: 2915384 - protein, 8 aa, Entamoeba invadens
TNTNTKLE

SEQ ID NO: 2915385 - protein, 13 aa, Entamoeba invadens
TNTNTNEDCENKS

SEQ ID NO: 2915386 - protein, 4 aa, Entamoeba invadens
TNTP

SEQ ID NO: 2915387 - protein, 18 aa, Entamoeba invadens
TNTPEVEFGGTKKREEED

SEQ ID NO: 2915388 - protein, 25 aa, Entamoeba invadens
TNTPLREHTGSSRQSRVQSPTKPQF

SEQ ID NO: 2915389 - protein, 6 aa, Entamoeba invadens
TNTPSD

SEQ ID NO: 2915390 - protein, 9 aa, Entamoeba invadens
TNTPTCDNL

SEQ ID NO: 2915391 - protein, 13 aa, Entamoeba invadens
TNTPTCDNNNDNC

SEQ ID NO: 2915392 - protein, 4 aa, Entamoeba invadens
TNTQ

SEQ ID NO: 2915393 - protein, 5 aa, Entamoeba invadens
TNTQD

SEQ ID NO: 2915394 - protein, 5 aa, Entamoeba invadens
TNTQK

SEQ ID NO: 2915395 - protein, 6 aa, Entamoeba invadens
TNTQSF

SEQ ID NO: 2915396 - protein, 7 aa, Entamoeba invadens
TNTRAKQ

SEQ ID NO: 2915397 - protein, 14 aa, Entamoeba invadens
TNTRANARWEERTN

SEQ ID NO: 2915398 - protein, 17 aa, Entamoeba invadens
TNTRETVTKPTKAPPGG

SEQ ID NO: 2915399 - protein, 8 aa, Entamoeba invadens
TNTSERKI

SEQ ID NO: 2915400 - protein, 13 aa, Entamoeba invadens
TNTSNNSKSNPLV

SEQ ID NO: 2915401 - protein, 7 aa, Entamoeba invadens
TNTSTIT

SEQ ID NO: 2915402 - protein, 7 aa, Entamoeba invadens
TNTSTVT

SEQ ID NO: 2915403 - protein, 5 aa, Entamoeba invadens
TNTTD

SEQ ID NO: 2915404 - protein, 6 aa, Entamoeba invadens
TNTTDG

SEQ ID NO: 2915405 - protein, 8 aa, Entamoeba invadens
TNTTGDFD

SEQ ID NO: 2915406 - protein, 14 aa, Entamoeba invadens
TNTTGGAVNVADGN

SEQ ID NO: 2915407 - protein, 12 aa, Entamoeba invadens
TNTTKNSDSSKC

SEQ ID NO: 2915408 - protein, 24 aa, Entamoeba invadens
TNTTQQQEEEDKNCASDRTANKIN

SEQ ID NO: 2915409 - protein, 9 aa, Entamoeba invadens
TNTVETDKE

SEQ ID NO: 2915410 - protein, 4 aa, Entamoeba invadens
TNTY

SEQ ID NO: 2915411 - protein, 9 aa, Entamoeba invadens
TNVDKFPNE

SEQ ID NO: 2915412 - protein, 5 aa, Entamoeba invadens
TNVEN

SEQ ID NO: 2915413 - protein, 7 aa, Entamoeba invadens
TNVGKSS

SEQ ID NO: 2915414 - protein, 9 aa, Entamoeba invadens
TNVGSGSKV

SEQ ID NO: 2915415 - protein, 5 aa, Entamoeba invadens
TNVKS

SEQ ID NO: 2915416 - protein, 11 aa, Entamoeba invadens
TNVNDKIESEN

SEQ ID NO: 2915417 - protein, 25 aa, Entamoeba invadens
TNVNENDVKRVTKEEGSVKDRIKMF

SEQ ID NO: 2915418 - protein, 9 aa, Entamoeba invadens
TNVNGSDEE

SEQ ID NO: 2915419 - protein, 6 aa, Entamoeba invadens
TNVPDN

SEQ ID NO: 2915420 - protein, 5 aa, Entamoeba invadens
TNVQG

SEQ ID NO: 2915421 - protein, 19 aa, Entamoeba invadens
TNVSNSTFSRFSSSTRLPN

SEQ ID NO: 2915422 - protein, 9 aa, Entamoeba invadens
TNVSTATSV

SEQ ID NO: 2915423 - protein, 17 aa, Entamoeba invadens
TNVSYDAGDLARGNEGQ

SEQ ID NO: 2915424 - protein, 6 aa, Entamoeba invadens
TNVTDQ

SEQ ID NO: 2915425 - protein, 8 aa, Entamoeba invadens
TNVTPTSF

SEQ ID NO: 2915426 - protein, 5 aa, Entamoeba invadens
TNVTT

SEQ ID NO: 2915427 - protein, 13 aa, Entamoeba invadens
TNVTTLEKRGFSN

SEQ ID NO: 2915428 - protein, 6 aa, Entamoeba invadens
TNVVNR

SEQ ID NO: 2915429 - protein, 5 aa, Entamoeba invadens
TNYDN

SEQ ID NO: 2915430 - protein, 10 aa, Entamoeba invadens
TNYDNIESTD

SEQ ID NO: 2915431 - protein, 7 aa, Entamoeba invadens
TNYDTQR

SEQ ID NO: 2915432 - protein, 4 aa, Entamoeba invadens
TNYE

SEQ ID NO: 2915433 - protein, 7 aa, Entamoeba invadens
TNYEESV

SEQ ID NO: 2915434 - protein, 25 aa, Entamoeba invadens
TNYEKREENVEYKPKEEERVGIEPT

SEQ ID NO: 2915435 - protein, 7 aa, Entamoeba invadens
TNYEQSY

SEQ ID NO: 2915436 - protein, 20 aa, Entamoeba invadens
TNYKEALSKKQEKISSLRKK

SEQ ID NO: 2915437 - protein, 5 aa, Entamoeba invadens
TNYKT

SEQ ID NO: 2915438 - protein, 15 aa, Entamoeba invadens
TNYKTSNGDCLPRSS

SEQ ID NO: 2915439 - protein, 16 aa, Entamoeba invadens
TNYKTSNGDCLSRSSI

SEQ ID NO: 2915440 - protein, 20 aa, Entamoeba invadens
TNYNTSSPGDKYTKKDIENA

SEQ ID NO: 2915441 - protein, 15 aa, Entamoeba invadens
TNYPTVGQPDLKTKK

SEQ ID NO: 2915442 - protein, 8 aa, Entamoeba invadens
TNYQQGHA

SEQ ID NO: 2915443 - protein, 6 aa, Entamoeba invadens
TNYRAK

SEQ ID NO: 2915444 - protein, 12 aa, Entamoeba invadens
TNYRKTVKEQLK

SEQ ID NO: 2915445 - protein, 14 aa, Entamoeba invadens
TNYTNGSYKANSYH

SEQ ID NO: 2915446 - protein, 7 aa, Entamoeba invadens
TNYTSGD

SEQ ID NO: 2915447 - protein, 4 aa, Entamoeba invadens
TNYV

SEQ ID NO: 2915448 - protein, 5 aa, Entamoeba invadens
TNYYG

SEQ ID NO: 2915449 - protein, 11 aa, Entamoeba invadens
TNYYPDTSTDF

SEQ ID NO: 2915450 - protein, 4 aa, Entamoeba invadens
TPAA

SEQ ID NO: 2915451 - protein, 5 aa, Entamoeba invadens
TPACH

SEQ ID NO: 2915452 - protein, 12 aa, Entamoeba invadens
TPAEAVKNEDIP

SEQ ID NO: 2915453 - protein, 9 aa, Entamoeba invadens
TPAHDPNDY

SEQ ID NO: 2915454 - protein, 7 aa, Entamoeba invadens
TPAINDK

SEQ ID NO: 2915455 - protein, 7 aa, Entamoeba invadens
TPAISND

SEQ ID NO: 2915456 - protein, 4 aa, Entamoeba invadens
TPAK

SEQ ID NO: 2915457 - protein, 7 aa, Entamoeba invadens
TPAKTGV

SEQ ID NO: 2915458 - protein, 8 aa, Entamoeba invadens
TPAKTKDV

SEQ ID NO: 2915459 - protein, 4 aa, Entamoeba invadens
TPAL

SEQ ID NO: 2915460 - protein, 11 aa, Entamoeba invadens
TPANPTNKISD

SEQ ID NO: 2915461 - protein, 12 aa, Entamoeba invadens
TPANPTNKISDI

SEQ ID NO: 2915462 - protein, 5 aa, Entamoeba invadens
TPAPF

SEQ ID NO: 2915463 - protein, 6 aa, Entamoeba invadens
TPASEI

SEQ ID NO: 2915464 - protein, 12 aa, Entamoeba invadens
TPATALRDSDAE

SEQ ID NO: 2915465 - protein, 22 aa, Entamoeba invadens
TPATPAVQTPSQSAFTNVNQTP

SEQ ID NO: 2915466 - protein, 7 aa, Entamoeba invadens
TPATPTL

SEQ ID NO: 2915467 - protein, 11 aa, Entamoeba invadens
TPATSSTETKL

SEQ ID NO: 2915468 - protein, 6 aa, Entamoeba invadens
TPAVNR

SEQ ID NO: 2915469 - protein, 5 aa, Entamoeba invadens
TPAYL

SEQ ID NO: 2915470 - protein, 6 aa, Entamoeba invadens
TPCHNT

SEQ ID NO: 2915471 - protein, 10 aa, Entamoeba invadens
TPDAKIEPDV

SEQ ID NO: 2915472 - protein, 5 aa, Entamoeba invadens
TPDAN

SEQ ID NO: 2915473 - protein, 10 aa, Entamoeba invadens
TPDEATKPVI

SEQ ID NO: 2915474 - protein, 8 aa, Entamoeba invadens
TPDELEAS

SEQ ID NO: 2915475 - protein, 6 aa, Entamoeba invadens
TPDETS

SEQ ID NO: 2915476 - protein, 6 aa, Entamoeba invadens
TPDFTK

SEQ ID NO: 2915477 - protein, 6 aa, Entamoeba invadens
TPDGAP

SEQ ID NO: 2915478 - protein, 8 aa, Entamoeba invadens
TPDGERTF

SEQ ID NO: 2915479 - protein, 13 aa, Entamoeba invadens
TPDGNVQKDGPVD

SEQ ID NO: 2915480 - protein, 4 aa, Entamoeba invadens
TPDI

SEQ ID NO: 2915481 - protein, 10 aa, Entamoeba invadens
TPDIYPKPSA

SEQ ID NO: 2915482 - protein, 30 aa, Entamoeba invadens
TPDKNNDNKKEEKNQGGQHVDTKEDKNDWK

SEQ ID NO: 2915483 - protein, 7 aa, Entamoeba invadens
TPDLNGK

SEQ ID NO: 2915484 - protein, 4 aa, Entamoeba invadens
TPDM

SEQ ID NO: 2915485 - protein, 4 aa, Entamoeba invadens
TPDN

SEQ ID NO: 2915486 - protein, 5 aa, Entamoeba invadens
TPDNT

SEQ ID NO: 2915487 - protein, 5 aa, Entamoeba invadens
TPDPV

SEQ ID NO: 2915488 - protein, 4 aa, Entamoeba invadens
TPDQ

SEQ ID NO: 2915489 - protein, 6 aa, Entamoeba invadens
TPDSVR

SEQ ID NO: 2915490 - protein, 4 aa, Entamoeba invadens
TPDT

SEQ ID NO: 2915491 - protein, 8 aa, Entamoeba invadens
TPDTEAPA

SEQ ID NO: 2915492 - protein, 9 aa, Entamoeba invadens
TPDTKIATY

SEQ ID NO: 2915493 - protein, 52 aa, Entamoeba invadens
TPDTPQRTQDYRQNDRQPPQEEAQQQDRQGYQDRPRQQPYQKRTNHSDHREK

SEQ ID NO: 2915494 - protein, 20 aa, Entamoeba invadens
TPDTSDENTKSSSEQKQATS

SEQ ID NO: 2915495 - protein, 6 aa, Entamoeba invadens
TPDYDV

SEQ ID NO: 2915496 - protein, 5 aa, Entamoeba invadens
TPDYN

SEQ ID NO: 2915497 - protein, 9 aa, Entamoeba invadens
TPDYSGRGK

SEQ ID NO: 2915498 - protein, 5 aa, Entamoeba invadens
TPEAV

SEQ ID NO: 2915499 - protein, 7 aa, Entamoeba invadens
TPEDKPL

SEQ ID NO: 2915500 - protein, 8 aa, Entamoeba invadens
TPEDMQKG

SEQ ID NO: 2915501 - protein, 5 aa, Entamoeba invadens
TPEDP

SEQ ID NO: 2915502 - protein, 15 aa, Entamoeba invadens
TPEDSSSGQKVAKNV

SEQ ID NO: 2915503 - protein, 4 aa, Entamoeba invadens
TPEE

SEQ ID NO: 2915504 - protein, 21 aa, Entamoeba invadens
TPEEKQGALTEKHKEKRLEGI

SEQ ID NO: 2915505 - protein, 9 aa, Entamoeba invadens
TPEELKEGF

SEQ ID NO: 2915506 - protein, 15 aa, Entamoeba invadens
TPEERQKAQRGWSDG

SEQ ID NO: 2915507 - protein, 21 aa, Entamoeba invadens
TPEESPNEKKTAKTTEEIKER

SEQ ID NO: 2915508 - protein, 5 aa, Entamoeba invadens
TPEFP

SEQ ID NO: 2915509 - protein, 6 aa, Entamoeba invadens
TPEGAA

SEQ ID NO: 2915510 - protein, 8 aa, Entamoeba invadens
TPEGGEGK

SEQ ID NO: 2915511 - protein, 4 aa, Entamoeba invadens
TPEH

SEQ ID NO: 2915512 - protein, 6 aa, Entamoeba invadens
TPEITT

SEQ ID NO: 2915513 - protein, 4 aa, Entamoeba invadens
TPEK

SEQ ID NO: 2915514 - protein, 6 aa, Entamoeba invadens
TPEKKN

SEQ ID NO: 2915515 - protein, 6 aa, Entamoeba invadens
TPEKPH

SEQ ID NO: 2915516 - protein, 5 aa, Entamoeba invadens
TPEKV

SEQ ID NO: 2915517 - protein, 6 aa, Entamoeba invadens
TPEKWD

SEQ ID NO: 2915518 - protein, 12 aa, Entamoeba invadens
TPEKYSENEPIW

SEQ ID NO: 2915519 - protein, 4 aa, Entamoeba invadens
TPEL

SEQ ID NO: 2915520 - protein, 8 aa, Entamoeba invadens
TPELTSKS

SEQ ID NO: 2915521 - protein, 7 aa, Entamoeba invadens
TPENFPD

SEQ ID NO: 2915522 - protein, 6 aa, Entamoeba invadens
TPENKS

SEQ ID NO: 2915523 - protein, 21 aa, Entamoeba invadens
TPENLAEAEAKREKSLAELNK

SEQ ID NO: 2915524 - protein, 8 aa, Entamoeba invadens
TPENSDLL

SEQ ID NO: 2915525 - protein, 8 aa, Entamoeba invadens
TPENSDYE

SEQ ID NO: 2915526 - protein, 5 aa, Entamoeba invadens
TPENT

SEQ ID NO: 2915527 - protein, 4 aa, Entamoeba invadens
TPEQ

SEQ ID NO: 2915528 - protein, 20 aa, Entamoeba invadens
TPEQEPQISENQVPTINSNS

SEQ ID NO: 2915529 - protein, 5 aa, Entamoeba invadens
TPEQT

SEQ ID NO: 2915530 - protein, 11 aa, Entamoeba invadens
TPERAQRKSDE

SEQ ID NO: 2915531 - protein, 8 aa, Entamoeba invadens
TPESANNS

SEQ ID NO: 2915532 - protein, 13 aa, Entamoeba invadens
TPESTNTANPAAA

SEQ ID NO: 2915533 - protein, 8 aa, Entamoeba invadens
TPETEAPA

SEQ ID NO: 2915534 - protein, 5 aa, Entamoeba invadens
TPETI

SEQ ID NO: 2915535 - protein, 4 aa, Entamoeba invadens
TPEV

SEQ ID NO: 2915536 - protein, 11 aa, Entamoeba invadens
TPEVAQEEYGA

SEQ ID NO: 2915537 - protein, 5 aa, Entamoeba invadens
TPEYT

SEQ ID NO: 2915538 - protein, 5 aa, Entamoeba invadens
TPFAQ

SEQ ID NO: 2915539 - protein, 4 aa, Entamoeba invadens
TPFD

SEQ ID NO: 2915540 - protein, 5 aa, Entamoeba invadens
TPFDY

SEQ ID NO: 2915541 - protein, 6 aa, Entamoeba invadens
TPFEDG

SEQ ID NO: 2915542 - protein, 8 aa, Entamoeba invadens
TPFETRDR

SEQ ID NO: 2915543 - protein, 7 aa, Entamoeba invadens
TPFKPTS

SEQ ID NO: 2915544 - protein, 5 aa, Entamoeba invadens
TPFPE

SEQ ID NO: 2915545 - protein, 5 aa, Entamoeba invadens
TPFPT

SEQ ID NO: 2915546 - protein, 6 aa, Entamoeba invadens
TPFSEA

SEQ ID NO: 2915547 - protein, 5 aa, Entamoeba invadens
TPFTQ

SEQ ID NO: 2915548 - protein, 8 aa, Entamoeba invadens
TPGAEAPS

SEQ ID NO: 2915549 - protein, 9 aa, Entamoeba invadens
TPGAYPSFE

SEQ ID NO: 2915550 - protein, 5 aa, Entamoeba invadens
TPGCS

SEQ ID NO: 2915551 - protein, 20 aa, Entamoeba invadens
TPGEELPITNDEPAKHVGGF

SEQ ID NO: 2915552 - protein, 7 aa, Entamoeba invadens
TPGEVGK

SEQ ID NO: 2915553 - protein, 7 aa, Entamoeba invadens
TPGEVSK

SEQ ID NO: 2915554 - protein, 11 aa, Entamoeba invadens
TPGFSSSENGY

SEQ ID NO: 2915555 - protein, 5 aa, Entamoeba invadens
TPGGI

SEQ ID NO: 2915556 - protein, 52 aa, Entamoeba invadens
TPGHSPALSPKMSPKVSPKASPKASPKVSPKSSPKNSPRINPKKSLTSSTDA

SEQ ID NO: 2915557 - protein, 8 aa, Entamoeba invadens
TPGHSPGS

SEQ ID NO: 2915558 - protein, 7 aa, Entamoeba invadens
TPGIQGT

SEQ ID NO: 2915559 - protein, 5 aa, Entamoeba invadens
TPGIS

SEQ ID NO: 2915560 - protein, 5 aa, Entamoeba invadens
TPGIT

SEQ ID NO: 2915561 - protein, 8 aa, Entamoeba invadens
TPGKDTIR

SEQ ID NO: 2915562 - protein, 20 aa, Entamoeba invadens
TPGKDTMKPCPQGMCEYLTK

SEQ ID NO: 2915563 - protein, 12 aa, Entamoeba invadens
TPGKLKAGKAVK

SEQ ID NO: 2915564 - protein, 5 aa, Entamoeba invadens
TPGLT

SEQ ID NO: 2915565 - protein, 4 aa, Entamoeba invadens
TPGN

SEQ ID NO: 2915566 - protein, 5 aa, Entamoeba invadens
TPGNI

SEQ ID NO: 2915567 - protein, 9 aa, Entamoeba invadens
TPGQNSNAV

SEQ ID NO: 2915568 - protein, 17 aa, Entamoeba invadens
TPGTEVKDKTEPGQKKK

SEQ ID NO: 2915569 - protein, 14 aa, Entamoeba invadens
TPGVDGKEARLNHD

SEQ ID NO: 2915570 - protein, 7 aa, Entamoeba invadens
TPGVPSH

SEQ ID NO: 2915571 - protein, 9 aa, Entamoeba invadens
TPGVSVKES

SEQ ID NO: 2915572 - protein, 15 aa, Entamoeba invadens
TPHDPVTPEDKHERE

SEQ ID NO: 2915573 - protein, 9 aa, Entamoeba invadens
TPHEVSPTL

SEQ ID NO: 2915574 - protein, 4 aa, Entamoeba invadens
TPHF

SEQ ID NO: 2915575 - protein, 4 aa, Entamoeba invadens
TPHG

SEQ ID NO: 2915576 - protein, 9 aa, Entamoeba invadens
TPHHETNPE

SEQ ID NO: 2915577 - protein, 8 aa, Entamoeba invadens
TPHNKNNY

SEQ ID NO: 2915578 - protein, 8 aa, Entamoeba invadens
TPHNRNRL

SEQ ID NO: 2915579 - protein, 28 aa, Entamoeba invadens
TPHNTPQKTEKESEKPTKQLTNSGNLVK

SEQ ID NO: 2915580 - protein, 4 aa, Entamoeba invadens
TPHP

SEQ ID NO: 2915581 - protein, 5 aa, Entamoeba invadens
TPHPL

SEQ ID NO: 2915582 - protein, 6 aa, Entamoeba invadens
TPHPPC

SEQ ID NO: 2915583 - protein, 5 aa, Entamoeba invadens
TPHPV

SEQ ID NO: 2915584 - protein, 4 aa, Entamoeba invadens
TPHQ

SEQ ID NO: 2915585 - protein, 5 aa, Entamoeba invadens
TPHSI

SEQ ID NO: 2915586 - protein, 20 aa, Entamoeba invadens
TPIAAPSANLSTKPSPTLGS

SEQ ID NO: 2915587 - protein, 5 aa, Entamoeba invadens
TPIDE

SEQ ID NO: 2915588 - protein, 11 aa, Entamoeba invadens
TPIDEKNAPKI

SEQ ID NO: 2915589 - protein, 5 aa, Entamoeba invadens
TPIDL

SEQ ID NO: 2915590 - protein, 24 aa, Entamoeba invadens
TPIDSKTTSKDINSISKTVNSIST

SEQ ID NO: 2915591 - protein, 14 aa, Entamoeba invadens
TPIEPSTPSKTLAT

SEQ ID NO: 2915592 - protein, 10 aa, Entamoeba invadens
TPIKGAPKSL

SEQ ID NO: 2915593 - protein, 6 aa, Entamoeba invadens
TPIKHP

SEQ ID NO: 2915594 - protein, 10 aa, Entamoeba invadens
TPINAGDTDV

SEQ ID NO: 2915595 - protein, 5 aa, Entamoeba invadens
TPINK

SEQ ID NO: 2915596 - protein, 29 aa, Entamoeba invadens
TPINSSLPTSDDITPLKNVSTTNTTAAKL

SEQ ID NO: 2915597 - protein, 8 aa, Entamoeba invadens
TPINTEKS

SEQ ID NO: 2915598 - protein, 10 aa, Entamoeba invadens
TPINTNGKRA

SEQ ID NO: 2915599 - protein, 5 aa, Entamoeba invadens
TPIPG

SEQ ID NO: 2915600 - protein, 9 aa, Entamoeba invadens
TPIPPQQQI

SEQ ID NO: 2915601 - protein, 6 aa, Entamoeba invadens
TPIPQQ

SEQ ID NO: 2915602 - protein, 6 aa, Entamoeba invadens
TPIQNE

SEQ ID NO: 2915603 - protein, 6 aa, Entamoeba invadens
TPIQNN

SEQ ID NO: 2915604 - protein, 15 aa, Entamoeba invadens
TPIQNNQTTFDENGN

SEQ ID NO: 2915605 - protein, 8 aa, Entamoeba invadens
TPIQNNTD

SEQ ID NO: 2915606 - protein, 16 aa, Entamoeba invadens
TPIQSSTDDISSKAEQ

SEQ ID NO: 2915607 - protein, 4 aa, Entamoeba invadens
TPIS

SEQ ID NO: 2915608 - protein, 10 aa, Entamoeba invadens
TPISREITSK

SEQ ID NO: 2915609 - protein, 14 aa, Entamoeba invadens
TPISTKGKTVKLAP

SEQ ID NO: 2915610 - protein, 14 aa, Entamoeba invadens
TPITPTQPNETKFE

SEQ ID NO: 2915611 - protein, 21 aa, Entamoeba invadens
TPITRSSPRMSPATPNPNYAQ

SEQ ID NO: 2915612 - protein, 20 aa, Entamoeba invadens
TPKADATSNAAPNMGGMPGM

SEQ ID NO: 2915613 - protein, 17 aa, Entamoeba invadens
TPKALDSAEKKHSQTPK

SEQ ID NO: 2915614 - protein, 7 aa, Entamoeba invadens
TPKASNW

SEQ ID NO: 2915615 - protein, 8 aa, Entamoeba invadens
TPKAVTYK

SEQ ID NO: 2915616 - protein, 4 aa, Entamoeba invadens
TPKD

SEQ ID NO: 2915617 - protein, 8 aa, Entamoeba invadens
TPKDRKRT

SEQ ID NO: 2915618 - protein, 12 aa, Entamoeba invadens
TPKDVDLNTNMP

SEQ ID NO: 2915619 - protein, 8 aa, Entamoeba invadens
TPKEELKT

SEQ ID NO: 2915620 - protein, 8 aa, Entamoeba invadens
TPKEGGCS

SEQ ID NO: 2915621 - protein, 7 aa, Entamoeba invadens
TPKEISE

SEQ ID NO: 2915622 - protein, 10 aa, Entamoeba invadens
TPKEKAKQVK

SEQ ID NO: 2915623 - protein, 13 aa, Entamoeba invadens
TPKEKYGKDDSIT

SEQ ID NO: 2915624 - protein, 6 aa, Entamoeba invadens
TPKELK

SEQ ID NO: 2915625 - protein, 8 aa, Entamoeba invadens
TPKEPPID

SEQ ID NO: 2915626 - protein, 5 aa, Entamoeba invadens
TPKES

SEQ ID NO: 2915627 - protein, 11 aa, Entamoeba invadens
TPKFEGSNVKA

SEQ ID NO: 2915628 - protein, 5 aa, Entamoeba invadens
TPKFN

SEQ ID NO: 2915629 - protein, 6 aa, Entamoeba invadens
TPKFTS

SEQ ID NO: 2915630 - protein, 8 aa, Entamoeba invadens
TPKGTRDY

SEQ ID NO: 2915631 - protein, 10 aa, Entamoeba invadens
TPKHSQNNSQ

SEQ ID NO: 2915632 - protein, 13 aa, Entamoeba invadens
TPKHTQNTISGNT

SEQ ID NO: 2915633 - protein, 17 aa, Entamoeba invadens
TPKKCTSPLKQKHSPLL

SEQ ID NO: 2915634 - protein, 9 aa, Entamoeba invadens
TPKKERSVE

SEQ ID NO: 2915635 - protein, 7 aa, Entamoeba invadens
TPKKPQG

SEQ ID NO: 2915636 - protein, 12 aa, Entamoeba invadens
TPKKPQSNKTAG

SEQ ID NO: 2915637 - protein, 13 aa, Entamoeba invadens
TPKKRSEATVSSN

SEQ ID NO: 2915638 - protein, 9 aa, Entamoeba invadens
TPKKTPEQH

SEQ ID NO: 2915639 - protein, 4 aa, Entamoeba invadens
TPKL

SEQ ID NO: 2915640 - protein, 15 aa, Entamoeba invadens
TPKLTTSKVHNTHPT

SEQ ID NO: 2915641 - protein, 10 aa, Entamoeba invadens
TPKMDYSQQY

SEQ ID NO: 2915642 - protein, 6 aa, Entamoeba invadens
TPKPIS

SEQ ID NO: 2915643 - protein, 19 aa, Entamoeba invadens
TPKPLDNASLQPTQKKEGC

SEQ ID NO: 2915644 - protein, 13 aa, Entamoeba invadens
TPKPLTSQSPSTL

SEQ ID NO: 2915645 - protein, 18 aa, Entamoeba invadens
TPKPSIKETTTPFKRQRT

SEQ ID NO: 2915646 - protein, 7 aa, Entamoeba invadens
TPKPTSL

SEQ ID NO: 2915647 - protein, 18 aa, Entamoeba invadens
TPKPTTGVKSWTTGEESQ

SEQ ID NO: 2915648 - protein, 8 aa, Entamoeba invadens
TPKPVHGR

SEQ ID NO: 2915649 - protein, 7 aa, Entamoeba invadens
TPKQEDC

SEQ ID NO: 2915650 - protein, 8 aa, Entamoeba invadens
TPKQIEPS

SEQ ID NO: 2915651 - protein, 8 aa, Entamoeba invadens
TPKQRSSW

SEQ ID NO: 2915652 - protein, 26 aa, Entamoeba invadens
TPKRENTTQYNNDITPSNDKINSLTP

SEQ ID NO: 2915653 - protein, 12 aa, Entamoeba invadens
TPKSDVVSNYNL

SEQ ID NO: 2915654 - protein, 11 aa, Entamoeba invadens
TPKSECSQTKR

SEQ ID NO: 2915655 - protein, 11 aa, Entamoeba invadens
TPKSFTYSTDQ

SEQ ID NO: 2915656 - protein, 8 aa, Entamoeba invadens
TPKSHNDY

SEQ ID NO: 2915657 - protein, 7 aa, Entamoeba invadens
TPKSIED

SEQ ID NO: 2915658 - protein, 6 aa, Entamoeba invadens
TPKSKN

SEQ ID NO: 2915659 - protein, 13 aa, Entamoeba invadens
TPKSPESAGSGKT

SEQ ID NO: 2915660 - protein, 7 aa, Entamoeba invadens
TPKSTFQ

SEQ ID NO: 2915661 - protein, 9 aa, Entamoeba invadens
TPKTAEDLT

SEQ ID NO: 2915662 - protein, 8 aa, Entamoeba invadens
TPKTEDPL

SEQ ID NO: 2915663 - protein, 12 aa, Entamoeba invadens
TPKTLNDVKGGT

SEQ ID NO: 2915664 - protein, 5 aa, Entamoeba invadens
TPKTR

SEQ ID NO: 2915665 - protein, 4 aa, Entamoeba invadens
TPKV

SEQ ID NO: 2915666 - protein, 8 aa, Entamoeba invadens
TPKYTVST

SEQ ID NO: 2915667 - protein, 10 aa, Entamoeba invadens
TPLADKSKKM

SEQ ID NO: 2915668 - protein, 5 aa, Entamoeba invadens
TPLAE

SEQ ID NO: 2915669 - protein, 4 aa, Entamoeba invadens
TPLD

SEQ ID NO: 2915670 - protein, 38 aa, Entamoeba invadens
TPLDEDTNTKTEKSPSPSAPSGKTAKKVVKGATSGKMC

SEQ ID NO: 2915671 - protein, 12 aa, Entamoeba invadens
TPLDNSGASGKV

SEQ ID NO: 2915672 - protein, 11 aa, Entamoeba invadens
TPLEQRRTDRI

SEQ ID NO: 2915673 - protein, 4 aa, Entamoeba invadens
TPLG

SEQ ID NO: 2915674 - protein, 8 aa, Entamoeba invadens
TPLGKKNE

SEQ ID NO: 2915675 - protein, 4 aa, Entamoeba invadens
TPLI

SEQ ID NO: 2915676 - protein, 6 aa, Entamoeba invadens
TPLKAE

SEQ ID NO: 2915677 - protein, 12 aa, Entamoeba invadens
TPLKDEEKKSEV

SEQ ID NO: 2915678 - protein, 11 aa, Entamoeba invadens
TPLKTTMDTER

SEQ ID NO: 2915679 - protein, 4 aa, Entamoeba invadens
TPLL

SEQ ID NO: 2915680 - protein, 6 aa, Entamoeba invadens
TPLNAA

SEQ ID NO: 2915681 - protein, 14 aa, Entamoeba invadens
TPLNNKSKTQNRPI

SEQ ID NO: 2915682 - protein, 4 aa, Entamoeba invadens
TPLP

SEQ ID NO: 2915683 - protein, 17 aa, Entamoeba invadens
TPLPTISPKSDNDSQQL

SEQ ID NO: 2915684 - protein, 6 aa, Entamoeba invadens
TPLPTS

SEQ ID NO: 2915685 - protein, 5 aa, Entamoeba invadens
TPLQN

SEQ ID NO: 2915686 - protein, 6 aa, Entamoeba invadens
TPLQNT

SEQ ID NO: 2915687 - protein, 4 aa, Entamoeba invadens
TPLR

SEQ ID NO: 2915688 - protein, 4 aa, Entamoeba invadens
TPLS

SEQ ID NO: 2915689 - protein, 5 aa, Entamoeba invadens
TPLSC

SEQ ID NO: 2915690 - protein, 6 aa, Entamoeba invadens
TPLTDQ

SEQ ID NO: 2915691 - protein, 9 aa, Entamoeba invadens
TPMDDPQYL

SEQ ID NO: 2915692 - protein, 5 aa, Entamoeba invadens
TPMDG

SEQ ID NO: 2915693 - protein, 4 aa, Entamoeba invadens
TPME

SEQ ID NO: 2915694 - protein, 5 aa, Entamoeba invadens
TPMET

SEQ ID NO: 2915695 - protein, 8 aa, Entamoeba invadens
TPMGKAKQ

SEQ ID NO: 2915696 - protein, 8 aa, Entamoeba invadens
TPMNTGPI

SEQ ID NO: 2915697 - protein, 5 aa, Entamoeba invadens
TPNAT

SEQ ID NO: 2915698 - protein, 9 aa, Entamoeba invadens
TPNATGADI

SEQ ID NO: 2915699 - protein, 9 aa, Entamoeba invadens
TPNDETKIK

SEQ ID NO: 2915700 - protein, 5 aa, Entamoeba invadens
TPNDF

SEQ ID NO: 2915701 - protein, 5 aa, Entamoeba invadens
TPNEI

SEQ ID NO: 2915702 - protein, 12 aa, Entamoeba invadens
TPNENDTNEDLK

SEQ ID NO: 2915703 - protein, 7 aa, Entamoeba invadens
TPNEQEL

SEQ ID NO: 2915704 - protein, 6 aa, Entamoeba invadens
TPNHKG

SEQ ID NO: 2915705 - protein, 5 aa, Entamoeba invadens
TPNHT

SEQ ID NO: 2915706 - protein, 15 aa, Entamoeba invadens
TPNHVSEEDTTQSLQ

SEQ ID NO: 2915707 - protein, 6 aa, Entamoeba invadens
TPNIDA

SEQ ID NO: 2915708 - protein, 8 aa, Entamoeba invadens
TPNIPDNY

SEQ ID NO: 2915709 - protein, 11 aa, Entamoeba invadens
TPNKEYKGSDL

SEQ ID NO: 2915710 - protein, 14 aa, Entamoeba invadens
TPNKNPRTQKNDIE

SEQ ID NO: 2915711 - protein, 7 aa, Entamoeba invadens
TPNKRPG

SEQ ID NO: 2915712 - protein, 14 aa, Entamoeba invadens
TPNMEDPKRELETK

SEQ ID NO: 2915713 - protein, 4 aa, Entamoeba invadens
TPNN

SEQ ID NO: 2915714 - protein, 12 aa, Entamoeba invadens
TPNNGNNTTPPI

SEQ ID NO: 2915715 - protein, 4 aa, Entamoeba invadens
TPNP

SEQ ID NO: 2915716 - protein, 7 aa, Entamoeba invadens
TPNPTCN

SEQ ID NO: 2915717 - protein, 7 aa, Entamoeba invadens
TPNQCVT

SEQ ID NO: 2915718 - protein, 6 aa, Entamoeba invadens
TPNQNN

SEQ ID NO: 2915719 - protein, 5 aa, Entamoeba invadens
TPNQV

SEQ ID NO: 2915720 - protein, 9 aa, Entamoeba invadens
TPNSEEVPK

SEQ ID NO: 2915721 - protein, 12 aa, Entamoeba invadens
TPNSKSMVSPSS

SEQ ID NO: 2915722 - protein, 5 aa, Entamoeba invadens
TPNVQ

SEQ ID NO: 2915723 - protein, 6 aa, Entamoeba invadens
TPNYLP

SEQ ID NO: 2915724 - protein, 6 aa, Entamoeba invadens
TPPAFN

SEQ ID NO: 2915725 - protein, 4 aa, Entamoeba invadens
TPPC

SEQ ID NO: 2915726 - protein, 27 aa, Entamoeba invadens
TPPCEEEKKCGDSKTREGEGDDCEINR

SEQ ID NO: 2915727 - protein, 12 aa, Entamoeba invadens
TPPDNVSEDSVQ

SEQ ID NO: 2915728 - protein, 6 aa, Entamoeba invadens
TPPEET

SEQ ID NO: 2915729 - protein, 8 aa, Entamoeba invadens
TPPEKEEV

SEQ ID NO: 2915730 - protein, 6 aa, Entamoeba invadens
TPPERV

SEQ ID NO: 2915731 - protein, 5 aa, Entamoeba invadens
TPPGA

SEQ ID NO: 2915732 - protein, 10 aa, Entamoeba invadens
TPPGKSAVTQ

SEQ ID NO: 2915733 - protein, 6 aa, Entamoeba invadens
TPPHYQ

SEQ ID NO: 2915734 - protein, 5 aa, Entamoeba invadens
TPPKD

SEQ ID NO: 2915735 - protein, 15 aa, Entamoeba invadens
TPPKNTKADKNERIE

SEQ ID NO: 2915736 - protein, 8 aa, Entamoeba invadens
TPPKPNWE

SEQ ID NO: 2915737 - protein, 5 aa, Entamoeba invadens
TPPKQ

SEQ ID NO: 2915738 - protein, 7 aa, Entamoeba invadens
TPPKTTV

SEQ ID NO: 2915739 - protein, 6 aa, Entamoeba invadens
TPPKYT

SEQ ID NO: 2915740 - protein, 4 aa, Entamoeba invadens
TPPL

SEQ ID NO: 2915741 - protein, 5 aa, Entamoeba invadens
TPPLP

SEQ ID NO: 2915742 - protein, 5 aa, Entamoeba invadens
TPPNL

SEQ ID NO: 2915743 - protein, 27 aa, Entamoeba invadens
TPPNTKTKNQRIQRSYQTTQKTTNQQV

SEQ ID NO: 2915744 - protein, 10 aa, Entamoeba invadens
TPPPLTKSAP

SEQ ID NO: 2915745 - protein, 5 aa, Entamoeba invadens
TPPPN

SEQ ID NO: 2915746 - protein, 17 aa, Entamoeba invadens
TPPPPPSRKQAASYTSS

SEQ ID NO: 2915747 - protein, 15 aa, Entamoeba invadens
TPPPPSKSHASQQID

SEQ ID NO: 2915748 - protein, 8 aa, Entamoeba invadens
TPPPSPSE

SEQ ID NO: 2915749 - protein, 5 aa, Entamoeba invadens
TPPPY

SEQ ID NO: 2915750 - protein, 11 aa, Entamoeba invadens
TPPQDQIQTTT

SEQ ID NO: 2915751 - protein, 7 aa, Entamoeba invadens
TPPQKKM

SEQ ID NO: 2915752 - protein, 5 aa, Entamoeba invadens
TPPSL

SEQ ID NO: 2915753 - protein, 4 aa, Entamoeba invadens
TPPT

SEQ ID NO: 2915754 - protein, 6 aa, Entamoeba invadens
TPPTKE

SEQ ID NO: 2915755 - protein, 35 aa, Entamoeba invadens
TPPTKQYSRPKKNGHGHAKVAKDKSAKSEKPQKSD

SEQ ID NO: 2915756 - protein, 6 aa, Entamoeba invadens
TPPTLS

SEQ ID NO: 2915757 - protein, 8 aa, Entamoeba invadens
TPPTPTSL

SEQ ID NO: 2915758 - protein, 4 aa, Entamoeba invadens
TPPV

SEQ ID NO: 2915759 - protein, 9 aa, Entamoeba invadens
TPPVNDAET

SEQ ID NO: 2915760 - protein, 4 aa, Entamoeba invadens
TPPY

SEQ ID NO: 2915761 - protein, 4 aa, Entamoeba invadens
TPQA

SEQ ID NO: 2915762 - protein, 6 aa, Entamoeba invadens
TPQDLV

SEQ ID NO: 2915763 - protein, 9 aa, Entamoeba invadens
TPQDNTFGN

SEQ ID NO: 2915764 - protein, 9 aa, Entamoeba invadens
TPQDTTQNE

SEQ ID NO: 2915765 - protein, 7 aa, Entamoeba invadens
TPQEEGW

SEQ ID NO: 2915766 - protein, 9 aa, Entamoeba invadens
TPQEGQTTI

SEQ ID NO: 2915767 - protein, 7 aa, Entamoeba invadens
TPQETLE

SEQ ID NO: 2915768 - protein, 8 aa, Entamoeba invadens
TPQGKSYT

SEQ ID NO: 2915769 - protein, 7 aa, Entamoeba invadens
TPQGSVK

SEQ ID NO: 2915770 - protein, 5 aa, Entamoeba invadens
TPQGT

SEQ ID NO: 2915771 - protein, 16 aa, Entamoeba invadens
TPQITQPEITQQPIQE

SEQ ID NO: 2915772 - protein, 10 aa, Entamoeba invadens
TPQKKQEKRI

SEQ ID NO: 2915773 - protein, 7 aa, Entamoeba invadens
TPQLNEE

SEQ ID NO: 2915774 - protein, 23 aa, Entamoeba invadens
TPQLTKRESSTELEQPTQSEFPS

SEQ ID NO: 2915775 - protein, 12 aa, Entamoeba invadens
TPQMGTSASFDK

SEQ ID NO: 2915776 - protein, 6 aa, Entamoeba invadens
TPQMKE

SEQ ID NO: 2915777 - protein, 5 aa, Entamoeba invadens
TPQNL

SEQ ID NO: 2915778 - protein, 17 aa, Entamoeba invadens
TPQNTGTPMEEDDIEND

SEQ ID NO: 2915779 - protein, 5 aa, Entamoeba invadens
TPQPF

SEQ ID NO: 2915780 - protein, 6 aa, Entamoeba invadens
TPQPTL

SEQ ID NO: 2915781 - protein, 15 aa, Entamoeba invadens
TPQRAESVDNTNKKK

SEQ ID NO: 2915782 - protein, 5 aa, Entamoeba invadens
TPQRG

SEQ ID NO: 2915783 - protein, 5 aa, Entamoeba invadens
TPQRL

SEQ ID NO: 2915784 - protein, 13 aa, Entamoeba invadens
TPQRYDTQETNPL

SEQ ID NO: 2915785 - protein, 6 aa, Entamoeba invadens
TPQSHP

SEQ ID NO: 2915786 - protein, 4 aa, Entamoeba invadens
TPQT

SEQ ID NO: 2915787 - protein, 6 aa, Entamoeba invadens
TPQTST

SEQ ID NO: 2915788 - protein, 11 aa, Entamoeba invadens
TPQVISTKQTE

SEQ ID NO: 2915789 - protein, 206 aa, Entamoeba invadens
TPQVQPQNDKNSGKTTTTESKEKTEKVDVPKPKTPRKEVQEDKKSNDKTKDLETISKEKEEQDKKKKEEEATKQREKQRQEEEDKKKKEKEKADLEKQKKEEEVKKQKAKDDAKKQIEKEKAEAEKKKNEQKEKEEKAKEKAKEKQKDEEEKKKKQKEKDKEQEKKAKEKQKEEEKKKEEKAKKEKEKKKEEEKKRKEKEEKEKKK

SEQ ID NO: 2915790 - protein, 4 aa, Entamoeba invadens
TPQY

SEQ ID NO: 2915791 - protein, 32 aa, Entamoeba invadens
TPRDMSPVPKLGGATPAPVTPYKAAPTPQNNV

SEQ ID NO: 2915792 - protein, 12 aa, Entamoeba invadens
TPRDSNNSSVCA

SEQ ID NO: 2915793 - protein, 6 aa, Entamoeba invadens
TPREFT

SEQ ID NO: 2915794 - protein, 6 aa, Entamoeba invadens
TPREQM

SEQ ID NO: 2915795 - protein, 19 aa, Entamoeba invadens
TPRGVQKSQQQTHKFSAES

SEQ ID NO: 2915796 - protein, 11 aa, Entamoeba invadens
TPRMQETPEPV

SEQ ID NO: 2915797 - protein, 5 aa, Entamoeba invadens
TPRNE

SEQ ID NO: 2915798 - protein, 12 aa, Entamoeba invadens
TPRNRPQKKVTE

SEQ ID NO: 2915799 - protein, 5 aa, Entamoeba invadens
TPRNS

SEQ ID NO: 2915800 - protein, 13 aa, Entamoeba invadens
TPRPNTIIQPSPH

SEQ ID NO: 2915801 - protein, 8 aa, Entamoeba invadens
TPRQTDLS

SEQ ID NO: 2915802 - protein, 14 aa, Entamoeba invadens
TPRRHAPKRNLGRT

SEQ ID NO: 2915803 - protein, 4 aa, Entamoeba invadens
TPRS

SEQ ID NO: 2915804 - protein, 5 aa, Entamoeba invadens
TPRSK

SEQ ID NO: 2915805 - protein, 7 aa, Entamoeba invadens
TPRSTQA

SEQ ID NO: 2915806 - protein, 7 aa, Entamoeba invadens
TPRTASR

SEQ ID NO: 2915807 - protein, 33 aa, Entamoeba invadens
TPRTIQNENATHVDYSQATDNESQNTNDSTKEE

SEQ ID NO: 2915808 - protein, 12 aa, Entamoeba invadens
TPRTIQNENSIN

SEQ ID NO: 2915809 - protein, 55 aa, Entamoeba invadens
TPRVDSGAENTDITPPPIPPSPRSGPKPNGAPPKPSSRPNGAPPKPAPRRGTGAA

SEQ ID NO: 2915810 - protein, 5 aa, Entamoeba invadens
TPRVG

SEQ ID NO: 2915811 - protein, 5 aa, Entamoeba invadens
TPRYQ

SEQ ID NO: 2915812 - protein, 4 aa, Entamoeba invadens
TPSA

SEQ ID NO: 2915813 - protein, 9 aa, Entamoeba invadens
TPSAETEEA

SEQ ID NO: 2915814 - protein, 8 aa, Entamoeba invadens
TPSAFSKR

SEQ ID NO: 2915815 - protein, 6 aa, Entamoeba invadens
TPSDDD

SEQ ID NO: 2915816 - protein, 6 aa, Entamoeba invadens
TPSDDF

SEQ ID NO: 2915817 - protein, 6 aa, Entamoeba invadens
TPSDEL

SEQ ID NO: 2915818 - protein, 9 aa, Entamoeba invadens
TPSDFGPHQ

SEQ ID NO: 2915819 - protein, 6 aa, Entamoeba invadens
TPSDKT

SEQ ID NO: 2915820 - protein, 6 aa, Entamoeba invadens
TPSEEL

SEQ ID NO: 2915821 - protein, 6 aa, Entamoeba invadens
TPSEKL

SEQ ID NO: 2915822 - protein, 16 aa, Entamoeba invadens
TPSEQAALNYRKDAEK

SEQ ID NO: 2915823 - protein, 6 aa, Entamoeba invadens
TPSERL

SEQ ID NO: 2915824 - protein, 13 aa, Entamoeba invadens
TPSERLFSKSGCY

SEQ ID NO: 2915825 - protein, 5 aa, Entamoeba invadens
TPSFE

SEQ ID NO: 2915826 - protein, 7 aa, Entamoeba invadens
TPSGNCE

SEQ ID NO: 2915827 - protein, 7 aa, Entamoeba invadens
TPSIQNN

SEQ ID NO: 2915828 - protein, 4 aa, Entamoeba invadens
TPSK

SEQ ID NO: 2915829 - protein, 8 aa, Entamoeba invadens
TPSLDETP

SEQ ID NO: 2915830 - protein, 5 aa, Entamoeba invadens
TPSLG

SEQ ID NO: 2915831 - protein, 8 aa, Entamoeba invadens
TPSLNDQH

SEQ ID NO: 2915832 - protein, 7 aa, Entamoeba invadens
TPSLPYE

SEQ ID NO: 2915833 - protein, 13 aa, Entamoeba invadens
TPSNCPQMNAGPQ

SEQ ID NO: 2915834 - protein, 11 aa, Entamoeba invadens
TPSNDVYDQNK

SEQ ID NO: 2915835 - protein, 7 aa, Entamoeba invadens
TPSNETD

SEQ ID NO: 2915836 - protein, 9 aa, Entamoeba invadens
TPSPDKNSA

SEQ ID NO: 2915837 - protein, 17 aa, Entamoeba invadens
TPSPDYKTPFLREIAFT

SEQ ID NO: 2915838 - protein, 25 aa, Entamoeba invadens
TPSPENGANGRPFSAELPQNEASNG

SEQ ID NO: 2915839 - protein, 6 aa, Entamoeba invadens
TPSPIT

SEQ ID NO: 2915840 - protein, 22 aa, Entamoeba invadens
TPSPSPFPQTPKVPESVSTSPH

SEQ ID NO: 2915841 - protein, 5 aa, Entamoeba invadens
TPSQI

SEQ ID NO: 2915842 - protein, 27 aa, Entamoeba invadens
TPSQQEIYNNKTNNKKSDNDNFDAMST

SEQ ID NO: 2915843 - protein, 5 aa, Entamoeba invadens
TPSSE

SEQ ID NO: 2915844 - protein, 7 aa, Entamoeba invadens
TPSSKVV

SEQ ID NO: 2915845 - protein, 10 aa, Entamoeba invadens
TPSSQDTCTN

SEQ ID NO: 2915846 - protein, 8 aa, Entamoeba invadens
TPSSYASE

SEQ ID NO: 2915847 - protein, 7 aa, Entamoeba invadens
TPSTIGK

SEQ ID NO: 2915848 - protein, 12 aa, Entamoeba invadens
TPSTLGTNSEIG

SEQ ID NO: 2915849 - protein, 14 aa, Entamoeba invadens
TPSTLGTNSEIGRV

SEQ ID NO: 2915850 - protein, 22 aa, Entamoeba invadens
TPSTLSTNSEIGSDCSKRYDQH

SEQ ID NO: 2915851 - protein, 15 aa, Entamoeba invadens
TPSTQKQDPPQKKSI

SEQ ID NO: 2915852 - protein, 4 aa, Entamoeba invadens
TPSV

SEQ ID NO: 2915853 - protein, 5 aa, Entamoeba invadens
TPSVY

SEQ ID NO: 2915854 - protein, 14 aa, Entamoeba invadens
TPSYADSKKIPPQI

SEQ ID NO: 2915855 - protein, 12 aa, Entamoeba invadens
TPSYISSPTEAA

SEQ ID NO: 2915856 - protein, 4 aa, Entamoeba invadens
TPTA

SEQ ID NO: 2915857 - protein, 6 aa, Entamoeba invadens
TPTAPI

SEQ ID NO: 2915858 - protein, 35 aa, Entamoeba invadens
TPTASPPHSQNMTPDVSPRVPSHPVSPQISTPTQL

SEQ ID NO: 2915859 - protein, 13 aa, Entamoeba invadens
TPTDTENNKKGKL

SEQ ID NO: 2915860 - protein, 6 aa, Entamoeba invadens
TPTENA

SEQ ID NO: 2915861 - protein, 7 aa, Entamoeba invadens
TPTEPVS

SEQ ID NO: 2915862 - protein, 4 aa, Entamoeba invadens
TPTF

SEQ ID NO: 2915863 - protein, 4 aa, Entamoeba invadens
TPTH

SEQ ID NO: 2915864 - protein, 4 aa, Entamoeba invadens
TPTI

SEQ ID NO: 2915865 - protein, 6 aa, Entamoeba invadens
TPTIEG

SEQ ID NO: 2915866 - protein, 14 aa, Entamoeba invadens
TPTIPQTPTKTYSH

SEQ ID NO: 2915867 - protein, 9 aa, Entamoeba invadens
TPTKAKKGN

SEQ ID NO: 2915868 - protein, 10 aa, Entamoeba invadens
TPTKDYPDNK

SEQ ID NO: 2915869 - protein, 13 aa, Entamoeba invadens
TPTKKKSVCHSWA

SEQ ID NO: 2915870 - protein, 15 aa, Entamoeba invadens
TPTKPQHPRSNSTSL

SEQ ID NO: 2915871 - protein, 9 aa, Entamoeba invadens
TPTKVNQIQ

SEQ ID NO: 2915872 - protein, 4 aa, Entamoeba invadens
TPTL

SEQ ID NO: 2915873 - protein, 15 aa, Entamoeba invadens
TPTLQGKKLNDSVRH

SEQ ID NO: 2915874 - protein, 8 aa, Entamoeba invadens
TPTLTNPE

SEQ ID NO: 2915875 - protein, 4 aa, Entamoeba invadens
TPTN

SEQ ID NO: 2915876 - protein, 12 aa, Entamoeba invadens
TPTNAPSGSFSS

SEQ ID NO: 2915877 - protein, 5 aa, Entamoeba invadens
TPTNF

SEQ ID NO: 2915878 - protein, 5 aa, Entamoeba invadens
TPTNS

SEQ ID NO: 2915879 - protein, 5 aa, Entamoeba invadens
TPTNV

SEQ ID NO: 2915880 - protein, 7 aa, Entamoeba invadens
TPTNVPR

SEQ ID NO: 2915881 - protein, 10 aa, Entamoeba invadens
TPTPHPTDQT

SEQ ID NO: 2915882 - protein, 14 aa, Entamoeba invadens
TPTPLSRPSFFVKA

SEQ ID NO: 2915883 - protein, 67 aa, Entamoeba invadens
TPTPPGGTCTKEEQKQVCSNNEAEKEQEKQLPQKEETIEPPQKEEAKEKVAESQETKIAQPPRRRGF

SEQ ID NO: 2915884 - protein, 67 aa, Entamoeba invadens
TPTPPGGTCTKEEQKQVCSNNEAEKEQEKQVPQKEETIEPPQKEEANEKVAESQEPKIAQPPRRRGF

SEQ ID NO: 2915885 - protein, 9 aa, Entamoeba invadens
TPTPSPTPD

SEQ ID NO: 2915886 - protein, 4 aa, Entamoeba invadens
TPTQ

SEQ ID NO: 2915887 - protein, 7 aa, Entamoeba invadens
TPTQAET

SEQ ID NO: 2915888 - protein, 5 aa, Entamoeba invadens
TPTQN

SEQ ID NO: 2915889 - protein, 9 aa, Entamoeba invadens
TPTQTNQRL

SEQ ID NO: 2915890 - protein, 56 aa, Entamoeba invadens
TPTQTPLTNQDYPRFSRRRKNAKTGDEETDDDDDEAPAPLKEKPLTAPKAPTALPT

SEQ ID NO: 2915891 - protein, 5 aa, Entamoeba invadens
TPTQV

SEQ ID NO: 2915892 - protein, 9 aa, Entamoeba invadens
TPTRETGQS

SEQ ID NO: 2915893 - protein, 20 aa, Entamoeba invadens
TPTRGGIGQLRPPTACPRSS

SEQ ID NO: 2915894 - protein, 9 aa, Entamoeba invadens
TPTRPETGY

SEQ ID NO: 2915895 - protein, 87 aa, Entamoeba invadens
TPTRPNGDETVEFEDQAEDEEEEEIDEAQMEEDDEDQELYDENEDAGKEEEDNQTSSSDDDDKEEKEESEEPEEEEPEEEENEEELD

SEQ ID NO: 2915896 - protein, 13 aa, Entamoeba invadens
TPTRSDAERLKTQ

SEQ ID NO: 2915897 - protein, 8 aa, Entamoeba invadens
TPTRTKAD

SEQ ID NO: 2915898 - protein, 10 aa, Entamoeba invadens
TPTSHQTNTD

SEQ ID NO: 2915899 - protein, 7 aa, Entamoeba invadens
TPTSHTR

SEQ ID NO: 2915900 - protein, 15 aa, Entamoeba invadens
TPTSPSSQSYNIQKG

SEQ ID NO: 2915901 - protein, 17 aa, Entamoeba invadens
TPTSTIGAGQDSKVAAE

SEQ ID NO: 2915902 - protein, 4 aa, Entamoeba invadens
TPTT

SEQ ID NO: 2915903 - protein, 10 aa, Entamoeba invadens
TPTTENITEA

SEQ ID NO: 2915904 - protein, 9 aa, Entamoeba invadens
TPTVQESTY

SEQ ID NO: 2915905 - protein, 5 aa, Entamoeba invadens
TPVAP

SEQ ID NO: 2915906 - protein, 23 aa, Entamoeba invadens
TPVATPTKRRGVVTSSQPEESQT

SEQ ID NO: 2915907 - protein, 25 aa, Entamoeba invadens
TPVDEDMTTNSEHNNCSEMEDEKIE

SEQ ID NO: 2915908 - protein, 4 aa, Entamoeba invadens
TPVE

SEQ ID NO: 2915909 - protein, 8 aa, Entamoeba invadens
TPVEASPL

SEQ ID NO: 2915910 - protein, 12 aa, Entamoeba invadens
TPVEEEKHEKSA

SEQ ID NO: 2915911 - protein, 42 aa, Entamoeba invadens
TPVESEKSGAIEKDVKPHNEKGLDNTSGKVGQRKRKSARKDT

SEQ ID NO: 2915912 - protein, 9 aa, Entamoeba invadens
TPVESPKYE

SEQ ID NO: 2915913 - protein, 8 aa, Entamoeba invadens
TPVKEVTT

SEQ ID NO: 2915914 - protein, 10 aa, Entamoeba invadens
TPVKGDGNLK

SEQ ID NO: 2915915 - protein, 5 aa, Entamoeba invadens
TPVNA

SEQ ID NO: 2915916 - protein, 9 aa, Entamoeba invadens
TPVNERNFE

SEQ ID NO: 2915917 - protein, 9 aa, Entamoeba invadens
TPVPSEEIT

SEQ ID NO: 2915918 - protein, 5 aa, Entamoeba invadens
TPVQK

SEQ ID NO: 2915919 - protein, 6 aa, Entamoeba invadens
TPVQNG

SEQ ID NO: 2915920 - protein, 11 aa, Entamoeba invadens
TPVSKRPRRQG

SEQ ID NO: 2915921 - protein, 7 aa, Entamoeba invadens
TPVSQGN

SEQ ID NO: 2915922 - protein, 4 aa, Entamoeba invadens
TPVT

SEQ ID NO: 2915923 - protein, 14 aa, Entamoeba invadens
TPVTKSEKIDNKDK

SEQ ID NO: 2915924 - protein, 17 aa, Entamoeba invadens
TPVTPITPATSEQQIQT

SEQ ID NO: 2915925 - protein, 11 aa, Entamoeba invadens
TPWKKSKEVQG

SEQ ID NO: 2915926 - protein, 4 aa, Entamoeba invadens
TPYD

SEQ ID NO: 2915927 - protein, 5 aa, Entamoeba invadens
TPYDS

SEQ ID NO: 2915928 - protein, 8 aa, Entamoeba invadens
TPYGEKVP

SEQ ID NO: 2915929 - protein, 6 aa, Entamoeba invadens
TPYGKT

SEQ ID NO: 2915930 - protein, 11 aa, Entamoeba invadens
TPYKTAQEYAD

SEQ ID NO: 2915931 - protein, 8 aa, Entamoeba invadens
TPYNYNGN

SEQ ID NO: 2915932 - protein, 4 aa, Entamoeba invadens
TPYP

SEQ ID NO: 2915933 - protein, 5 aa, Entamoeba invadens
TPYPK

SEQ ID NO: 2915934 - protein, 35 aa, Entamoeba invadens
TPYPSPYQTTSPHIYPSPYQTLEKKNQPPNAYSPQ

SEQ ID NO: 2915935 - protein, 9 aa, Entamoeba invadens
TPYQPSTPY

SEQ ID NO: 2915936 - protein, 9 aa, Entamoeba invadens
TPYSSKSDL

SEQ ID NO: 2915937 - protein, 6 aa, Entamoeba invadens
TPYTTN

SEQ ID NO: 2915938 - protein, 10 aa, Entamoeba invadens
TQAANSTGVT

SEQ ID NO: 2915939 - protein, 4 aa, Entamoeba invadens
TQAD

SEQ ID NO: 2915940 - protein, 9 aa, Entamoeba invadens
TQADDEQQI

SEQ ID NO: 2915941 - protein, 16 aa, Entamoeba invadens
TQADLKKTQQSVKNGQ

SEQ ID NO: 2915942 - protein, 5 aa, Entamoeba invadens
TQADY

SEQ ID NO: 2915943 - protein, 9 aa, Entamoeba invadens
TQAEENKDK

SEQ ID NO: 2915944 - protein, 10 aa, Entamoeba invadens
TQAEKDVEEL

SEQ ID NO: 2915945 - protein, 7 aa, Entamoeba invadens
TQAEPRT

SEQ ID NO: 2915946 - protein, 7 aa, Entamoeba invadens
TQAESFQ

SEQ ID NO: 2915947 - protein, 18 aa, Entamoeba invadens
TQAINNDRVTLTRKVLHY

SEQ ID NO: 2915948 - protein, 6 aa, Entamoeba invadens
TQAKSP

SEQ ID NO: 2915949 - protein, 8 aa, Entamoeba invadens
TQAKTESE

SEQ ID NO: 2915950 - protein, 45 aa, Entamoeba invadens
TQANSQQNAQTTMQQAQQSQMSQWGQQKSNEDTAPQQQQQQDNNG

SEQ ID NO: 2915951 - protein, 21 aa, Entamoeba invadens
TQAPAPTQNMATQQPSTSAVS

SEQ ID NO: 2915952 - protein, 20 aa, Entamoeba invadens
TQAPEKTAPQIGVEPPQVTV

SEQ ID NO: 2915953 - protein, 12 aa, Entamoeba invadens
TQAPPTFFPQAP

SEQ ID NO: 2915954 - protein, 23 aa, Entamoeba invadens
TQAQAQANTSVKTANTKKMIPDN

SEQ ID NO: 2915955 - protein, 6 aa, Entamoeba invadens
TQAQRS

SEQ ID NO: 2915956 - protein, 22 aa, Entamoeba invadens
TQASQTPFRTHKRNASAIPKGL

SEQ ID NO: 2915957 - protein, 4 aa, Entamoeba invadens
TQCK

SEQ ID NO: 2915958 - protein, 13 aa, Entamoeba invadens
TQCNELNNNTKSY

SEQ ID NO: 2915959 - protein, 14 aa, Entamoeba invadens
TQCNTTNKNFNNIF

SEQ ID NO: 2915960 - protein, 5 aa, Entamoeba invadens
TQCPK

SEQ ID NO: 2915961 - protein, 5 aa, Entamoeba invadens
TQCQE

SEQ ID NO: 2915962 - protein, 12 aa, Entamoeba invadens
TQCSRDKRTLEA

SEQ ID NO: 2915963 - protein, 10 aa, Entamoeba invadens
TQDANKVADE

SEQ ID NO: 2915964 - protein, 5 aa, Entamoeba invadens
TQDDM

SEQ ID NO: 2915965 - protein, 24 aa, Entamoeba invadens
TQDDSLPQSVDNTTTNTPNTTHKT

SEQ ID NO: 2915966 - protein, 10 aa, Entamoeba invadens
TQDENNKNVL

SEQ ID NO: 2915967 - protein, 19 aa, Entamoeba invadens
TQDEVKNGPKQYNETPNDD

SEQ ID NO: 2915968 - protein, 8 aa, Entamoeba invadens
TQDGETLK

SEQ ID NO: 2915969 - protein, 5 aa, Entamoeba invadens
TQDIN

SEQ ID NO: 2915970 - protein, 6 aa, Entamoeba invadens
TQDKKF

SEQ ID NO: 2915971 - protein, 18 aa, Entamoeba invadens
TQDKKKNMNEGVQQLTGE

SEQ ID NO: 2915972 - protein, 6 aa, Entamoeba invadens
TQDKLR

SEQ ID NO: 2915973 - protein, 7 aa, Entamoeba invadens
TQDNEPA

SEQ ID NO: 2915974 - protein, 14 aa, Entamoeba invadens
TQDNRQSYGTQIPS

SEQ ID NO: 2915975 - protein, 19 aa, Entamoeba invadens
TQDQQHTQEEKTLKHSKNN

SEQ ID NO: 2915976 - protein, 10 aa, Entamoeba invadens
TQDRINEDES

SEQ ID NO: 2915977 - protein, 11 aa, Entamoeba invadens
TQDSENDSDAL

SEQ ID NO: 2915978 - protein, 7 aa, Entamoeba invadens
TQDSNTS

SEQ ID NO: 2915979 - protein, 5 aa, Entamoeba invadens
TQDST

SEQ ID NO: 2915980 - protein, 4 aa, Entamoeba invadens
TQDT

SEQ ID NO: 2915981 - protein, 7 aa, Entamoeba invadens
TQDVPHT

SEQ ID NO: 2915982 - protein, 9 aa, Entamoeba invadens
TQDVSEELA

SEQ ID NO: 2915983 - protein, 5 aa, Entamoeba invadens
TQDYP

SEQ ID NO: 2915984 - protein, 12 aa, Entamoeba invadens
TQEDFKKAKEKV

SEQ ID NO: 2915985 - protein, 4 aa, Entamoeba invadens
TQEE

SEQ ID NO: 2915986 - protein, 14 aa, Entamoeba invadens
TQEEAVGVQPDSNY

SEQ ID NO: 2915987 - protein, 6 aa, Entamoeba invadens
TQEEKN

SEQ ID NO: 2915988 - protein, 7 aa, Entamoeba invadens
TQEEKNQ

SEQ ID NO: 2915989 - protein, 6 aa, Entamoeba invadens
TQEEKQ

SEQ ID NO: 2915990 - protein, 13 aa, Entamoeba invadens
TQEERKPISSTVQ

SEQ ID NO: 2915991 - protein, 11 aa, Entamoeba invadens
TQEFSAQTKSE

SEQ ID NO: 2915992 - protein, 8 aa, Entamoeba invadens
TQEGPLPS

SEQ ID NO: 2915993 - protein, 19 aa, Entamoeba invadens
TQEKNNLSRAKATELQKLE

SEQ ID NO: 2915994 - protein, 12 aa, Entamoeba invadens
TQEKPEKQNENI

SEQ ID NO: 2915995 - protein, 6 aa, Entamoeba invadens
TQELTY

SEQ ID NO: 2915996 - protein, 16 aa, Entamoeba invadens
TQEMGETSPPKPLTEP

SEQ ID NO: 2915997 - protein, 10 aa, Entamoeba invadens
TQEMYNTKTN

SEQ ID NO: 2915998 - protein, 10 aa, Entamoeba invadens
TQENERVGKY

SEQ ID NO: 2915999 - protein, 8 aa, Entamoeba invadens
TQEPNAIE

SEQ ID NO: 2916000 - protein, 9 aa, Entamoeba invadens
TQEPTKDTL

SEQ ID NO: 2916001 - protein, 37 aa, Entamoeba invadens
TQEQKAPLPSQSLKPKSSEKVEKQKPQDPEPKPGQPK

SEQ ID NO: 2916002 - protein, 5 aa, Entamoeba invadens
TQEQN

SEQ ID NO: 2916003 - protein, 12 aa, Entamoeba invadens
TQESGTEPPFTN

SEQ ID NO: 2916004 - protein, 10 aa, Entamoeba invadens
TQESTPTQLP

SEQ ID NO: 2916005 - protein, 20 aa, Entamoeba invadens
TQESTPVNPSFSRTNESRSL

SEQ ID NO: 2916006 - protein, 57 aa, Entamoeba invadens
TQETGEKVQETSNDEGGKKKRTKKKKAEKDEKSGKKGGMLKPPMPTPLDTEKTKKSF

SEQ ID NO: 2916007 - protein, 6 aa, Entamoeba invadens
TQETGS

SEQ ID NO: 2916008 - protein, 11 aa, Entamoeba invadens
TQETTNKPVEL

SEQ ID NO: 2916009 - protein, 5 aa, Entamoeba invadens
TQEWT

SEQ ID NO: 2916010 - protein, 5 aa, Entamoeba invadens
TQFDD

SEQ ID NO: 2916011 - protein, 13 aa, Entamoeba invadens
TQFSQLTSNENPK

SEQ ID NO: 2916012 - protein, 4 aa, Entamoeba invadens
TQFT

SEQ ID NO: 2916013 - protein, 6 aa, Entamoeba invadens
TQFTDP

SEQ ID NO: 2916014 - protein, 4 aa, Entamoeba invadens
TQFY

SEQ ID NO: 2916015 - protein, 5 aa, Entamoeba invadens
TQGAK

SEQ ID NO: 2916016 - protein, 7 aa, Entamoeba invadens
TQGDIEN

SEQ ID NO: 2916017 - protein, 5 aa, Entamoeba invadens
TQGDL

SEQ ID NO: 2916018 - protein, 8 aa, Entamoeba invadens
TQGETPPI

SEQ ID NO: 2916019 - protein, 8 aa, Entamoeba invadens
TQGGIPKK

SEQ ID NO: 2916020 - protein, 7 aa, Entamoeba invadens
TQGKSIT

SEQ ID NO: 2916021 - protein, 6 aa, Entamoeba invadens
TQGNLE

SEQ ID NO: 2916022 - protein, 9 aa, Entamoeba invadens
TQGSKKVTL

SEQ ID NO: 2916023 - protein, 5 aa, Entamoeba invadens
TQGST

SEQ ID NO: 2916024 - protein, 8 aa, Entamoeba invadens
TQGTPQHE

SEQ ID NO: 2916025 - protein, 5 aa, Entamoeba invadens
TQHEK

SEQ ID NO: 2916026 - protein, 8 aa, Entamoeba invadens
TQHKSKMN

SEQ ID NO: 2916027 - protein, 4 aa, Entamoeba invadens
TQHR

SEQ ID NO: 2916028 - protein, 7 aa, Entamoeba invadens
TQHRGPL

SEQ ID NO: 2916029 - protein, 13 aa, Entamoeba invadens
TQHSKNAKNTRPM

SEQ ID NO: 2916030 - protein, 51 aa, Entamoeba invadens
TQHSPRRNELKRESEGILSPRSPVISPRSLQNSSSLSPRGGAHSPPNNTPR

SEQ ID NO: 2916031 - protein, 4 aa, Entamoeba invadens
TQIA

SEQ ID NO: 2916032 - protein, 6 aa, Entamoeba invadens
TQIEEK

SEQ ID NO: 2916033 - protein, 6 aa, Entamoeba invadens
TQIESK

SEQ ID NO: 2916034 - protein, 4 aa, Entamoeba invadens
TQIG

SEQ ID NO: 2916035 - protein, 6 aa, Entamoeba invadens
TQIGED

SEQ ID NO: 2916036 - protein, 7 aa, Entamoeba invadens
TQIGNSK

SEQ ID NO: 2916037 - protein, 7 aa, Entamoeba invadens
TQIKPNT

SEQ ID NO: 2916038 - protein, 8 aa, Entamoeba invadens
TQIKTRPR

SEQ ID NO: 2916039 - protein, 5 aa, Entamoeba invadens
TQINK

SEQ ID NO: 2916040 - protein, 13 aa, Entamoeba invadens
TQINTPTKPGTHT

SEQ ID NO: 2916041 - protein, 6 aa, Entamoeba invadens
TQIPQS

SEQ ID NO: 2916042 - protein, 36 aa, Entamoeba invadens
TQIQEDQKKLEDKIKSIEKKVNTQIQTQLPKSHRDE

SEQ ID NO: 2916043 - protein, 8 aa, Entamoeba invadens
TQIQNEYG

SEQ ID NO: 2916044 - protein, 6 aa, Entamoeba invadens
TQISAE

SEQ ID NO: 2916045 - protein, 6 aa, Entamoeba invadens
TQITSR

SEQ ID NO: 2916046 - protein, 18 aa, Entamoeba invadens
TQITTEASNVNLTEETAQ

SEQ ID NO: 2916047 - protein, 6 aa, Entamoeba invadens
TQKADD

SEQ ID NO: 2916048 - protein, 8 aa, Entamoeba invadens
TQKAENKT

SEQ ID NO: 2916049 - protein, 7 aa, Entamoeba invadens
TQKAQGG

SEQ ID NO: 2916050 - protein, 9 aa, Entamoeba invadens
TQKAQTKVG

SEQ ID NO: 2916051 - protein, 5 aa, Entamoeba invadens
TQKDD

SEQ ID NO: 2916052 - protein, 17 aa, Entamoeba invadens
TQKDDSQQLTKKRHVGN

SEQ ID NO: 2916053 - protein, 6 aa, Entamoeba invadens
TQKDDT

SEQ ID NO: 2916054 - protein, 9 aa, Entamoeba invadens
TQKDLQKQI

SEQ ID NO: 2916055 - protein, 14 aa, Entamoeba invadens
TQKDQNGKCLSNQP

SEQ ID NO: 2916056 - protein, 9 aa, Entamoeba invadens
TQKDTELRR

SEQ ID NO: 2916057 - protein, 23 aa, Entamoeba invadens
TQKDYDVAEQCQNASDMAEEEPV

SEQ ID NO: 2916058 - protein, 21 aa, Entamoeba invadens
TQKDYDVAEQCQSASDMAEEE

SEQ ID NO: 2916059 - protein, 25 aa, Entamoeba invadens
TQKDYEVEESCQNASDIAEEEPETV

SEQ ID NO: 2916060 - protein, 6 aa, Entamoeba invadens
TQKEHP

SEQ ID NO: 2916061 - protein, 8 aa, Entamoeba invadens
TQKEHTKN

SEQ ID NO: 2916062 - protein, 5 aa, Entamoeba invadens
TQKEI

SEQ ID NO: 2916063 - protein, 7 aa, Entamoeba invadens
TQKETDS

SEQ ID NO: 2916064 - protein, 4 aa, Entamoeba invadens
TQKF

SEQ ID NO: 2916065 - protein, 8 aa, Entamoeba invadens
TQKGEKYD

SEQ ID NO: 2916066 - protein, 10 aa, Entamoeba invadens
TQKGGMDEKH

SEQ ID NO: 2916067 - protein, 8 aa, Entamoeba invadens
TQKGGVRP

SEQ ID NO: 2916068 - protein, 8 aa, Entamoeba invadens
TQKGKKIN

SEQ ID NO: 2916069 - protein, 22 aa, Entamoeba invadens
TQKGKTVPPPIKSKKQGGKCAL

SEQ ID NO: 2916070 - protein, 6 aa, Entamoeba invadens
TQKGMS

SEQ ID NO: 2916071 - protein, 5 aa, Entamoeba invadens
TQKGT

SEQ ID NO: 2916072 - protein, 4 aa, Entamoeba invadens
TQKI

SEQ ID NO: 2916073 - protein, 5 aa, Entamoeba invadens
TQKIK

SEQ ID NO: 2916074 - protein, 13 aa, Entamoeba invadens
TQKITNEKKTPIV

SEQ ID NO: 2916075 - protein, 13 aa, Entamoeba invadens
TQKKEDFAKSGFT

SEQ ID NO: 2916076 - protein, 14 aa, Entamoeba invadens
TQKLENETQRQKEQ

SEQ ID NO: 2916077 - protein, 5 aa, Entamoeba invadens
TQKLN

SEQ ID NO: 2916078 - protein, 8 aa, Entamoeba invadens
TQKLNAPL

SEQ ID NO: 2916079 - protein, 8 aa, Entamoeba invadens
TQKNTNNY

SEQ ID NO: 2916080 - protein, 12 aa, Entamoeba invadens
TQKPEEAAPSTV

SEQ ID NO: 2916081 - protein, 11 aa, Entamoeba invadens
TQKQEEQEKMA

SEQ ID NO: 2916082 - protein, 20 aa, Entamoeba invadens
TQKQENEKIAGKLKNTEGEI

SEQ ID NO: 2916083 - protein, 13 aa, Entamoeba invadens
TQKQGLKGFQPGN

SEQ ID NO: 2916084 - protein, 11 aa, Entamoeba invadens
TQKQKKWQDGY

SEQ ID NO: 2916085 - protein, 8 aa, Entamoeba invadens
TQKQNTSI

SEQ ID NO: 2916086 - protein, 9 aa, Entamoeba invadens
TQKQPSHNN

SEQ ID NO: 2916087 - protein, 7 aa, Entamoeba invadens
TQKQRTL

SEQ ID NO: 2916088 - protein, 5 aa, Entamoeba invadens
TQKQS

SEQ ID NO: 2916089 - protein, 4 aa, Entamoeba invadens
TQKR

SEQ ID NO: 2916090 - protein, 10 aa, Entamoeba invadens
TQKREDEQDI

SEQ ID NO: 2916091 - protein, 10 aa, Entamoeba invadens
TQKRETRVER

SEQ ID NO: 2916092 - protein, 6 aa, Entamoeba invadens
TQKRKK

SEQ ID NO: 2916093 - protein, 8 aa, Entamoeba invadens
TQKSDTDL

SEQ ID NO: 2916094 - protein, 14 aa, Entamoeba invadens
TQKSISKDGAVEED

SEQ ID NO: 2916095 - protein, 7 aa, Entamoeba invadens
TQKSMNE

SEQ ID NO: 2916096 - protein, 9 aa, Entamoeba invadens
TQKSSNFKS

SEQ ID NO: 2916097 - protein, 4 aa, Entamoeba invadens
TQKT

SEQ ID NO: 2916098 - protein, 12 aa, Entamoeba invadens
TQKTDGSTLPEK

SEQ ID NO: 2916099 - protein, 8 aa, Entamoeba invadens
TQKTPSEL

SEQ ID NO: 2916100 - protein, 13 aa, Entamoeba invadens
TQKTSLGKVEQNG

SEQ ID NO: 2916101 - protein, 6 aa, Entamoeba invadens
TQKTVG

SEQ ID NO: 2916102 - protein, 15 aa, Entamoeba invadens
TQKVVGTTQHTNKDD

SEQ ID NO: 2916103 - protein, 4 aa, Entamoeba invadens
TQKY

SEQ ID NO: 2916104 - protein, 6 aa, Entamoeba invadens
TQKYNS

SEQ ID NO: 2916105 - protein, 7 aa, Entamoeba invadens
TQKYPST

SEQ ID NO: 2916106 - protein, 25 aa, Entamoeba invadens
TQLDEERQKVYSADAARKAAESKLL

SEQ ID NO: 2916107 - protein, 13 aa, Entamoeba invadens
TQLEEKLKKKDEL

SEQ ID NO: 2916108 - protein, 23 aa, Entamoeba invadens
TQLEGNAKTGSVNTDTSETIDSP

SEQ ID NO: 2916109 - protein, 12 aa, Entamoeba invadens
TQLETKTCTVNS

SEQ ID NO: 2916110 - protein, 7 aa, Entamoeba invadens
TQLGQQA

SEQ ID NO: 2916111 - protein, 13 aa, Entamoeba invadens
TQLHEKEDDIADL

SEQ ID NO: 2916112 - protein, 10 aa, Entamoeba invadens
TQLKESNGSA

SEQ ID NO: 2916113 - protein, 11 aa, Entamoeba invadens
TQLKNRTYGTE

SEQ ID NO: 2916114 - protein, 21 aa, Entamoeba invadens
TQLNAEKEKTLKEKTSELEKV

SEQ ID NO: 2916115 - protein, 4 aa, Entamoeba invadens
TQLP

SEQ ID NO: 2916116 - protein, 8 aa, Entamoeba invadens
TQLPSLKT

SEQ ID NO: 2916117 - protein, 7 aa, Entamoeba invadens
TQLQDQR

SEQ ID NO: 2916118 - protein, 4 aa, Entamoeba invadens
TQLR

SEQ ID NO: 2916119 - protein, 16 aa, Entamoeba invadens
TQLSTYSKPTPSQFTQ

SEQ ID NO: 2916120 - protein, 9 aa, Entamoeba invadens
TQLTPKQQV

SEQ ID NO: 2916121 - protein, 23 aa, Entamoeba invadens
TQLTREKGEKKLKCEKSEFGTTN

SEQ ID NO: 2916122 - protein, 4 aa, Entamoeba invadens
TQLV

SEQ ID NO: 2916123 - protein, 11 aa, Entamoeba invadens
TQMGTSASFDK

SEQ ID NO: 2916124 - protein, 8 aa, Entamoeba invadens
TQMKPSEL

SEQ ID NO: 2916125 - protein, 7 aa, Entamoeba invadens
TQMPQPN

SEQ ID NO: 2916126 - protein, 10 aa, Entamoeba invadens
TQMQKDNDEV

SEQ ID NO: 2916127 - protein, 23 aa, Entamoeba invadens
TQNAAAAQKATKGKHKKGKKCVV

SEQ ID NO: 2916128 - protein, 9 aa, Entamoeba invadens
TQNAPTPYK

SEQ ID NO: 2916129 - protein, 30 aa, Entamoeba invadens
TQNAQQTGNTFGSNFGGANSAFTAKPQSGL

SEQ ID NO: 2916130 - protein, 10 aa, Entamoeba invadens
TQNATSKMTS

SEQ ID NO: 2916131 - protein, 9 aa, Entamoeba invadens
TQNCRNYSN

SEQ ID NO: 2916132 - protein, 46 aa, Entamoeba invadens
TQNDEHNDDKMELENEDEKEEEQEEASKEDQNVKSGQESVEESVQP

SEQ ID NO: 2916133 - protein, 6 aa, Entamoeba invadens
TQNDKT

SEQ ID NO: 2916134 - protein, 8 aa, Entamoeba invadens
TQNDREKF

SEQ ID NO: 2916135 - protein, 11 aa, Entamoeba invadens
TQNDSNSSGLY

SEQ ID NO: 2916136 - protein, 6 aa, Entamoeba invadens
TQNDTS

SEQ ID NO: 2916137 - protein, 11 aa, Entamoeba invadens
TQNDTTRDTYK

SEQ ID NO: 2916138 - protein, 23 aa, Entamoeba invadens
TQNDYEVTEQCQNASDMAEEEPV

SEQ ID NO: 2916139 - protein, 10 aa, Entamoeba invadens
TQNECSSYKT

SEQ ID NO: 2916140 - protein, 10 aa, Entamoeba invadens
TQNEDFSETH

SEQ ID NO: 2916141 - protein, 5 aa, Entamoeba invadens
TQNFR

SEQ ID NO: 2916142 - protein, 4 aa, Entamoeba invadens
TQNG

SEQ ID NO: 2916143 - protein, 10 aa, Entamoeba invadens
TQNGCNRCQD

SEQ ID NO: 2916144 - protein, 10 aa, Entamoeba invadens
TQNGCSKCQN

SEQ ID NO: 2916145 - protein, 9 aa, Entamoeba invadens
TQNGEFSVT

SEQ ID NO: 2916146 - protein, 6 aa, Entamoeba invadens
TQNIEA

SEQ ID NO: 2916147 - protein, 9 aa, Entamoeba invadens
TQNKDGDFT

SEQ ID NO: 2916148 - protein, 7 aa, Entamoeba invadens
TQNLTAN

SEQ ID NO: 2916149 - protein, 6 aa, Entamoeba invadens
TQNMRE

SEQ ID NO: 2916150 - protein, 7 aa, Entamoeba invadens
TQNNAEV

SEQ ID NO: 2916151 - protein, 5 aa, Entamoeba invadens
TQNNI

SEQ ID NO: 2916152 - protein, 12 aa, Entamoeba invadens
TQNNKDVGTEQC

SEQ ID NO: 2916153 - protein, 6 aa, Entamoeba invadens
TQNNKF

SEQ ID NO: 2916154 - protein, 9 aa, Entamoeba invadens
TQNNQTKQG

SEQ ID NO: 2916155 - protein, 5 aa, Entamoeba invadens
TQNNS

SEQ ID NO: 2916156 - protein, 8 aa, Entamoeba invadens
TQNPEERF

SEQ ID NO: 2916157 - protein, 15 aa, Entamoeba invadens
TQNPERKTEEFSLSN

SEQ ID NO: 2916158 - protein, 12 aa, Entamoeba invadens
TQNPEYANNPTL

SEQ ID NO: 2916159 - protein, 5 aa, Entamoeba invadens
TQNPL

SEQ ID NO: 2916160 - protein, 24 aa, Entamoeba invadens
TQNPLNGYSSQFTNRNRTRTISTT

SEQ ID NO: 2916161 - protein, 9 aa, Entamoeba invadens
TQNREIQNS

SEQ ID NO: 2916162 - protein, 7 aa, Entamoeba invadens
TQNSRFG

SEQ ID NO: 2916163 - protein, 7 aa, Entamoeba invadens
TQNSSAS

SEQ ID NO: 2916164 - protein, 7 aa, Entamoeba invadens
TQNTEVE

SEQ ID NO: 2916165 - protein, 8 aa, Entamoeba invadens
TQNTGEAL

SEQ ID NO: 2916166 - protein, 11 aa, Entamoeba invadens
TQNTLKRDNEF

SEQ ID NO: 2916167 - protein, 6 aa, Entamoeba invadens
TQNTPI

SEQ ID NO: 2916168 - protein, 12 aa, Entamoeba invadens
TQNTRDNDGNTA

SEQ ID NO: 2916169 - protein, 4 aa, Entamoeba invadens
TQNV

SEQ ID NO: 2916170 - protein, 12 aa, Entamoeba invadens
TQNYPDSPHHEE

SEQ ID NO: 2916171 - protein, 8 aa, Entamoeba invadens
TQPAQPLG

SEQ ID NO: 2916172 - protein, 10 aa, Entamoeba invadens
TQPDTSKIKL

SEQ ID NO: 2916173 - protein, 4 aa, Entamoeba invadens
TQPE

SEQ ID NO: 2916174 - protein, 9 aa, Entamoeba invadens
TQPGDTIKT

SEQ ID NO: 2916175 - protein, 18 aa, Entamoeba invadens
TQPGFKSKKCSYESPEEA

SEQ ID NO: 2916176 - protein, 5 aa, Entamoeba invadens
TQPGI

SEQ ID NO: 2916177 - protein, 7 aa, Entamoeba invadens
TQPGQRL

SEQ ID NO: 2916178 - protein, 9 aa, Entamoeba invadens
TQPGVISPD

SEQ ID NO: 2916179 - protein, 10 aa, Entamoeba invadens
TQPISKTEFD

SEQ ID NO: 2916180 - protein, 4 aa, Entamoeba invadens
TQPK

SEQ ID NO: 2916181 - protein, 6 aa, Entamoeba invadens
TQPKRS

SEQ ID NO: 2916182 - protein, 16 aa, Entamoeba invadens
TQPLQEREINDQSPGH

SEQ ID NO: 2916183 - protein, 4 aa, Entamoeba invadens
TQPM

SEQ ID NO: 2916184 - protein, 4 aa, Entamoeba invadens
TQPN

SEQ ID NO: 2916185 - protein, 11 aa, Entamoeba invadens
TQPNKKDSQVS

SEQ ID NO: 2916186 - protein, 48 aa, Entamoeba invadens
TQPNRHRNTQSFTQPTQRKPLTQTTQTVQAKNTQIQQKKNPKQEKEDF

SEQ ID NO: 2916187 - protein, 6 aa, Entamoeba invadens
TQPPQC

SEQ ID NO: 2916188 - protein, 9 aa, Entamoeba invadens
TQPQEGVRI

SEQ ID NO: 2916189 - protein, 5 aa, Entamoeba invadens
TQPQM

SEQ ID NO: 2916190 - protein, 14 aa, Entamoeba invadens
TQPQQIQTTNVPPS

SEQ ID NO: 2916191 - protein, 5 aa, Entamoeba invadens
TQPRR

SEQ ID NO: 2916192 - protein, 6 aa, Entamoeba invadens
TQPRRI

SEQ ID NO: 2916193 - protein, 10 aa, Entamoeba invadens
TQPSKKSDFS

SEQ ID NO: 2916194 - protein, 7 aa, Entamoeba invadens
TQPTIPM

SEQ ID NO: 2916195 - protein, 7 aa, Entamoeba invadens
TQPTNIK

SEQ ID NO: 2916196 - protein, 22 aa, Entamoeba invadens
TQPTQQQYQQPVQQRQQQNTTD

SEQ ID NO: 2916197 - protein, 5 aa, Entamoeba invadens
TQPTV

SEQ ID NO: 2916198 - protein, 14 aa, Entamoeba invadens
TQQDETDAKRLSYT

SEQ ID NO: 2916199 - protein, 8 aa, Entamoeba invadens
TQQDHKTS

SEQ ID NO: 2916200 - protein, 11 aa, Entamoeba invadens
TQQDSDYSETE

SEQ ID NO: 2916201 - protein, 8 aa, Entamoeba invadens
TQQECGEN

SEQ ID NO: 2916202 - protein, 9 aa, Entamoeba invadens
TQQEGQDGN

SEQ ID NO: 2916203 - protein, 10 aa, Entamoeba invadens
TQQEIDSNQI

SEQ ID NO: 2916204 - protein, 6 aa, Entamoeba invadens
TQQEIS

SEQ ID NO: 2916205 - protein, 13 aa, Entamoeba invadens
TQQEKEEAYEKYS

SEQ ID NO: 2916206 - protein, 6 aa, Entamoeba invadens
TQQELN

SEQ ID NO: 2916207 - protein, 7 aa, Entamoeba invadens
TQQENKE

SEQ ID NO: 2916208 - protein, 7 aa, Entamoeba invadens
TQQGDEV

SEQ ID NO: 2916209 - protein, 7 aa, Entamoeba invadens
TQQGLSD

SEQ ID NO: 2916210 - protein, 22 aa, Entamoeba invadens
TQQKDDEKYEAKQEQRKRKKRE

SEQ ID NO: 2916211 - protein, 6 aa, Entamoeba invadens
TQQKDS

SEQ ID NO: 2916212 - protein, 15 aa, Entamoeba invadens
TQQKKNKDIPEGGSK

SEQ ID NO: 2916213 - protein, 9 aa, Entamoeba invadens
TQQKKSIGS

SEQ ID NO: 2916214 - protein, 25 aa, Entamoeba invadens
TQQKSDKKELSGNEKLNDGNTSPHI

SEQ ID NO: 2916215 - protein, 22 aa, Entamoeba invadens
TQQKTENEKSTAPTQNDGLSVG

SEQ ID NO: 2916216 - protein, 21 aa, Entamoeba invadens
TQQLEETTKQKEENDKKVEEI

SEQ ID NO: 2916217 - protein, 29 aa, Entamoeba invadens
TQQMDEVKEQKSETETPTLPDSPKECEAD

SEQ ID NO: 2916218 - protein, 6 aa, Entamoeba invadens
TQQMNG

SEQ ID NO: 2916219 - protein, 8 aa, Entamoeba invadens
TQQNNKTL

SEQ ID NO: 2916220 - protein, 8 aa, Entamoeba invadens
TQQNTSES

SEQ ID NO: 2916221 - protein, 12 aa, Entamoeba invadens
TQQNVQNTPSEI

SEQ ID NO: 2916222 - protein, 29 aa, Entamoeba invadens
TQQQEDTIQNTITPNKTKMEECTGSDDFD

SEQ ID NO: 2916223 - protein, 18 aa, Entamoeba invadens
TQQQETKSTSEVSQPSSC

SEQ ID NO: 2916224 - protein, 15 aa, Entamoeba invadens
TQQQITKKKIETSEG

SEQ ID NO: 2916225 - protein, 9 aa, Entamoeba invadens
TQQQKDEYR

SEQ ID NO: 2916226 - protein, 12 aa, Entamoeba invadens
TQQQKEKQMNEK

SEQ ID NO: 2916227 - protein, 9 aa, Entamoeba invadens
TQQQPQQQF

SEQ ID NO: 2916228 - protein, 22 aa, Entamoeba invadens
TQQQPQQQQQQPQQQQQQTNSL

SEQ ID NO: 2916229 - protein, 8 aa, Entamoeba invadens
TQQQPSLP

SEQ ID NO: 2916230 - protein, 10 aa, Entamoeba invadens
TQQQQNVSQP

SEQ ID NO: 2916231 - protein, 19 aa, Entamoeba invadens
TQQRLQKTSSRVKGSSDNL

SEQ ID NO: 2916232 - protein, 8 aa, Entamoeba invadens
TQQRQLPL

SEQ ID NO: 2916233 - protein, 10 aa, Entamoeba invadens
TQQSAQITSS

SEQ ID NO: 2916234 - protein, 4 aa, Entamoeba invadens
TQQT

SEQ ID NO: 2916235 - protein, 10 aa, Entamoeba invadens
TQQTNSNPLS

SEQ ID NO: 2916236 - protein, 13 aa, Entamoeba invadens
TQQTSQPQQSQQA

SEQ ID NO: 2916237 - protein, 18 aa, Entamoeba invadens
TQQTTGEDVVNESDDRTI

SEQ ID NO: 2916238 - protein, 6 aa, Entamoeba invadens
TQQYNE

SEQ ID NO: 2916239 - protein, 16 aa, Entamoeba invadens
TQRADQQTQSSFISPR

SEQ ID NO: 2916240 - protein, 8 aa, Entamoeba invadens
TQRCPKNR

SEQ ID NO: 2916241 - protein, 4 aa, Entamoeba invadens
TQRD

SEQ ID NO: 2916242 - protein, 7 aa, Entamoeba invadens
TQREIQK

SEQ ID NO: 2916243 - protein, 6 aa, Entamoeba invadens
TQRESN

SEQ ID NO: 2916244 - protein, 5 aa, Entamoeba invadens
TQRFD

SEQ ID NO: 2916245 - protein, 14 aa, Entamoeba invadens
TQRGDSGKTLPSIN

SEQ ID NO: 2916246 - protein, 10 aa, Entamoeba invadens
TQRGKDKSGL

SEQ ID NO: 2916247 - protein, 9 aa, Entamoeba invadens
TQRGQTEID

SEQ ID NO: 2916248 - protein, 7 aa, Entamoeba invadens
TQRGREQ

SEQ ID NO: 2916249 - protein, 19 aa, Entamoeba invadens
TQRKIKGNFSDHKLNSQNE

SEQ ID NO: 2916250 - protein, 39 aa, Entamoeba invadens
TQRKLEGIETEKKEAQNTAAKAKKQAKQYARKVEEAERK

SEQ ID NO: 2916251 - protein, 6 aa, Entamoeba invadens
TQRKNQ

SEQ ID NO: 2916252 - protein, 13 aa, Entamoeba invadens
TQRKRKGKPEVEI

SEQ ID NO: 2916253 - protein, 7 aa, Entamoeba invadens
TQRLNEK

SEQ ID NO: 2916254 - protein, 8 aa, Entamoeba invadens
TQRLTQEN

SEQ ID NO: 2916255 - protein, 7 aa, Entamoeba invadens
TQRNISE

SEQ ID NO: 2916256 - protein, 7 aa, Entamoeba invadens
TQRNTRI

SEQ ID NO: 2916257 - protein, 6 aa, Entamoeba invadens
TQRPDA

SEQ ID NO: 2916258 - protein, 11 aa, Entamoeba invadens
TQRPSNVPQTI

SEQ ID NO: 2916259 - protein, 6 aa, Entamoeba invadens
TQRPTW

SEQ ID NO: 2916260 - protein, 4 aa, Entamoeba invadens
TQRQ

SEQ ID NO: 2916261 - protein, 8 aa, Entamoeba invadens
TQRRTTPE

SEQ ID NO: 2916262 - protein, 21 aa, Entamoeba invadens
TQRSVESGQPEKDDDAIPQGR

SEQ ID NO: 2916263 - protein, 7 aa, Entamoeba invadens
TQRYSNL

SEQ ID NO: 2916264 - protein, 23 aa, Entamoeba invadens
TQSDETKKNEDQSGGDTPSDGSM

SEQ ID NO: 2916265 - protein, 11 aa, Entamoeba invadens
TQSDKQKIEES

SEQ ID NO: 2916266 - protein, 30 aa, Entamoeba invadens
TQSDNLKKKQLQNEADEKKYRSNNIAYNTP

SEQ ID NO: 2916267 - protein, 8 aa, Entamoeba invadens
TQSDPQQG

SEQ ID NO: 2916268 - protein, 12 aa, Entamoeba invadens
TQSEKNGFYCTR

SEQ ID NO: 2916269 - protein, 6 aa, Entamoeba invadens
TQSGKI

SEQ ID NO: 2916270 - protein, 23 aa, Entamoeba invadens
TQSGMEKSFGSTCHGAGRKLSRV

SEQ ID NO: 2916271 - protein, 9 aa, Entamoeba invadens
TQSHSEKEY

SEQ ID NO: 2916272 - protein, 9 aa, Entamoeba invadens
TQSHSQKAE

SEQ ID NO: 2916273 - protein, 11 aa, Entamoeba invadens
TQSKKQENNEK

SEQ ID NO: 2916274 - protein, 5 aa, Entamoeba invadens
TQSKN

SEQ ID NO: 2916275 - protein, 10 aa, Entamoeba invadens
TQSNGHTKTL

SEQ ID NO: 2916276 - protein, 8 aa, Entamoeba invadens
TQSNTLPE

SEQ ID NO: 2916277 - protein, 7 aa, Entamoeba invadens
TQSPHDT

SEQ ID NO: 2916278 - protein, 6 aa, Entamoeba invadens
TQSPQH

SEQ ID NO: 2916279 - protein, 8 aa, Entamoeba invadens
TQSPRPSF

SEQ ID NO: 2916280 - protein, 7 aa, Entamoeba invadens
TQSPSVE

SEQ ID NO: 2916281 - protein, 12 aa, Entamoeba invadens
TQSPTEEDKSNL

SEQ ID NO: 2916282 - protein, 7 aa, Entamoeba invadens
TQSQSGY

SEQ ID NO: 2916283 - protein, 15 aa, Entamoeba invadens
TQSQSQSQSQNTNRL

SEQ ID NO: 2916284 - protein, 32 aa, Entamoeba invadens
TQSQTMTATNNTNTESTQIPIKKRKEKTEVYS

SEQ ID NO: 2916285 - protein, 13 aa, Entamoeba invadens
TQSRSTKLYAGEK

SEQ ID NO: 2916286 - protein, 8 aa, Entamoeba invadens
TQSSAGVS

SEQ ID NO: 2916287 - protein, 8 aa, Entamoeba invadens
TQSSAKDS

SEQ ID NO: 2916288 - protein, 5 aa, Entamoeba invadens
TQSSE

SEQ ID NO: 2916289 - protein, 9 aa, Entamoeba invadens
TQSSKNINL

SEQ ID NO: 2916290 - protein, 22 aa, Entamoeba invadens
TQSSKYKLNEKTTVDDLPSQFP

SEQ ID NO: 2916291 - protein, 7 aa, Entamoeba invadens
TQSSNDA

SEQ ID NO: 2916292 - protein, 5 aa, Entamoeba invadens
TQSSS

SEQ ID NO: 2916293 - protein, 9 aa, Entamoeba invadens
TQSSTREAN

SEQ ID NO: 2916294 - protein, 37 aa, Entamoeba invadens
TQSSVSPLTITKPQKIETTNSEVVNKGQTYSRKRSPK

SEQ ID NO: 2916295 - protein, 8 aa, Entamoeba invadens
TQSTGKTA

SEQ ID NO: 2916296 - protein, 5 aa, Entamoeba invadens
TQSTH

SEQ ID NO: 2916297 - protein, 9 aa, Entamoeba invadens
TQSTKCKSC

SEQ ID NO: 2916298 - protein, 10 aa, Entamoeba invadens
TQSTKRLDTL

SEQ ID NO: 2916299 - protein, 5 aa, Entamoeba invadens
TQSTN

SEQ ID NO: 2916300 - protein, 12 aa, Entamoeba invadens
TQSTNCESCTDF

SEQ ID NO: 2916301 - protein, 9 aa, Entamoeba invadens
TQSTSSAKN

SEQ ID NO: 2916302 - protein, 8 aa, Entamoeba invadens
TQTAGRRR

SEQ ID NO: 2916303 - protein, 7 aa, Entamoeba invadens
TQTANTL

SEQ ID NO: 2916304 - protein, 7 aa, Entamoeba invadens
TQTCGKN

SEQ ID NO: 2916305 - protein, 8 aa, Entamoeba invadens
TQTDKVED

SEQ ID NO: 2916306 - protein, 9 aa, Entamoeba invadens
TQTDLTSTK

SEQ ID NO: 2916307 - protein, 6 aa, Entamoeba invadens
TQTDNQ

SEQ ID NO: 2916308 - protein, 10 aa, Entamoeba invadens
TQTEKCDTKP

SEQ ID NO: 2916309 - protein, 5 aa, Entamoeba invadens
TQTES

SEQ ID NO: 2916310 - protein, 8 aa, Entamoeba invadens
TQTETGDI

SEQ ID NO: 2916311 - protein, 5 aa, Entamoeba invadens
TQTGC

SEQ ID NO: 2916312 - protein, 11 aa, Entamoeba invadens
TQTGNYPTLQS

SEQ ID NO: 2916313 - protein, 9 aa, Entamoeba invadens
TQTHRDSNF

SEQ ID NO: 2916314 - protein, 6 aa, Entamoeba invadens
TQTKSV

SEQ ID NO: 2916315 - protein, 13 aa, Entamoeba invadens
TQTKTQQDVTPPS

SEQ ID NO: 2916316 - protein, 6 aa, Entamoeba invadens
TQTLNE

SEQ ID NO: 2916317 - protein, 5 aa, Entamoeba invadens
TQTLP

SEQ ID NO: 2916318 - protein, 4 aa, Entamoeba invadens
TQTN

SEQ ID NO: 2916319 - protein, 5 aa, Entamoeba invadens
TQTNC

SEQ ID NO: 2916320 - protein, 8 aa, Entamoeba invadens
TQTNPQLL

SEQ ID NO: 2916321 - protein, 5 aa, Entamoeba invadens
TQTNV

SEQ ID NO: 2916322 - protein, 74 aa, Entamoeba invadens
TQTPAFANEQNSPQKSPVKLQPTLPQRNASKDNTQMGTPTIEKTSPQMTQHKTSYNKPLPSTTTDQHQSPQPLY

SEQ ID NO: 2916323 - protein, 5 aa, Entamoeba invadens
TQTPQ

SEQ ID NO: 2916324 - protein, 21 aa, Entamoeba invadens
TQTPQPITTTYDTKLTTRTEV

SEQ ID NO: 2916325 - protein, 9 aa, Entamoeba invadens
TQTQDMKNN

SEQ ID NO: 2916326 - protein, 7 aa, Entamoeba invadens
TQTQQEI

SEQ ID NO: 2916327 - protein, 10 aa, Entamoeba invadens
TQTQSSEVTK

SEQ ID NO: 2916328 - protein, 6 aa, Entamoeba invadens
TQTQTL

SEQ ID NO: 2916329 - protein, 10 aa, Entamoeba invadens
TQTQTPAEVS

SEQ ID NO: 2916330 - protein, 9 aa, Entamoeba invadens
TQTQTTNRI

SEQ ID NO: 2916331 - protein, 7 aa, Entamoeba invadens
TQTRISS

SEQ ID NO: 2916332 - protein, 9 aa, Entamoeba invadens
TQTRNTEKQ

SEQ ID NO: 2916333 - protein, 6 aa, Entamoeba invadens
TQTSEL

SEQ ID NO: 2916334 - protein, 5 aa, Entamoeba invadens
TQTSF

SEQ ID NO: 2916335 - protein, 11 aa, Entamoeba invadens
TQTSPKPTQIG

SEQ ID NO: 2916336 - protein, 9 aa, Entamoeba invadens
TQTSQPKKV

SEQ ID NO: 2916337 - protein, 17 aa, Entamoeba invadens
TQTTAANTLNTTNDDTK

SEQ ID NO: 2916338 - protein, 13 aa, Entamoeba invadens
TQTTEEGSTTSTF

SEQ ID NO: 2916339 - protein, 5 aa, Entamoeba invadens
TQTTR

SEQ ID NO: 2916340 - protein, 10 aa, Entamoeba invadens
TQTTYNDGTP

SEQ ID NO: 2916341 - protein, 7 aa, Entamoeba invadens
TQTVESQ

SEQ ID NO: 2916342 - protein, 6 aa, Entamoeba invadens
TQTVPL

SEQ ID NO: 2916343 - protein, 4 aa, Entamoeba invadens
TQTY

SEQ ID NO: 2916344 - protein, 6 aa, Entamoeba invadens
TQVAER

SEQ ID NO: 2916345 - protein, 7 aa, Entamoeba invadens
TQVDEEK

SEQ ID NO: 2916346 - protein, 17 aa, Entamoeba invadens
TQVDTENALKKYSNDKD

SEQ ID NO: 2916347 - protein, 13 aa, Entamoeba invadens
TQVDTLKKKESTL

SEQ ID NO: 2916348 - protein, 26 aa, Entamoeba invadens
TQVEGSNPFSDLPPAVKQTSPGLGRS

SEQ ID NO: 2916349 - protein, 33 aa, Entamoeba invadens
TQVGDTNSEKASIADGKVNTAYYGTKDCSGTAI

SEQ ID NO: 2916350 - protein, 5 aa, Entamoeba invadens
TQVNG

SEQ ID NO: 2916351 - protein, 25 aa, Entamoeba invadens
TQVSIPKPDPTERAQPGNPTDMSPY

SEQ ID NO: 2916352 - protein, 6 aa, Entamoeba invadens
TQWSSP

SEQ ID NO: 2916353 - protein, 6 aa, Entamoeba invadens
TQYDNT

SEQ ID NO: 2916354 - protein, 8 aa, Entamoeba invadens
TQYGEQET

SEQ ID NO: 2916355 - protein, 15 aa, Entamoeba invadens
TQYNRDGVSNTPEQW

SEQ ID NO: 2916356 - protein, 5 aa, Entamoeba invadens
TQYPR

SEQ ID NO: 2916357 - protein, 11 aa, Entamoeba invadens
TQYYSSQRSEQ

SEQ ID NO: 2916358 - protein, 9 aa, Entamoeba invadens
TRAATNGIS

SEQ ID NO: 2916359 - protein, 4 aa, Entamoeba invadens
TRAE

SEQ ID NO: 2916360 - protein, 10 aa, Entamoeba invadens
TRAERSGNYV

SEQ ID NO: 2916361 - protein, 8 aa, Entamoeba invadens
TRAGMGRC

SEQ ID NO: 2916362 - protein, 43 aa, Entamoeba invadens
TRAGVTQPVAEPEPQFTRTTTTTKEEDDTEPQLDDEEEEEKRR

SEQ ID NO: 2916363 - protein, 6 aa, Entamoeba invadens
TRAHQN

SEQ ID NO: 2916364 - protein, 19 aa, Entamoeba invadens
TRALTEPSTPQHNQNKDNL

SEQ ID NO: 2916365 - protein, 8 aa, Entamoeba invadens
TRANTPKY

SEQ ID NO: 2916366 - protein, 9 aa, Entamoeba invadens
TRAPQTPGE

SEQ ID NO: 2916367 - protein, 8 aa, Entamoeba invadens
TRAQRRYD

SEQ ID NO: 2916368 - protein, 5 aa, Entamoeba invadens
TRATD

SEQ ID NO: 2916369 - protein, 19 aa, Entamoeba invadens
TRCEQSQKDKMKESDSRKI

SEQ ID NO: 2916370 - protein, 4 aa, Entamoeba invadens
TRCG

SEQ ID NO: 2916371 - protein, 4 aa, Entamoeba invadens
TRCP

SEQ ID NO: 2916372 - protein, 6 aa, Entamoeba invadens
TRDDWS

SEQ ID NO: 2916373 - protein, 9 aa, Entamoeba invadens
TRDEAYSKI

SEQ ID NO: 2916374 - protein, 15 aa, Entamoeba invadens
TRDEFEGMKGEKEKL

SEQ ID NO: 2916375 - protein, 9 aa, Entamoeba invadens
TRDERDDEF

SEQ ID NO: 2916376 - protein, 9 aa, Entamoeba invadens
TRDESDGVV

SEQ ID NO: 2916377 - protein, 6 aa, Entamoeba invadens
TRDGDN

SEQ ID NO: 2916378 - protein, 6 aa, Entamoeba invadens
TRDGEI

SEQ ID NO: 2916379 - protein, 34 aa, Entamoeba invadens
TRDGRNDSQREFGREPNQMRDSLKDSKDLKREEF

SEQ ID NO: 2916380 - protein, 8 aa, Entamoeba invadens
TRDKTTQK

SEQ ID NO: 2916381 - protein, 4 aa, Entamoeba invadens
TRDM

SEQ ID NO: 2916382 - protein, 8 aa, Entamoeba invadens
TRDPHNTN

SEQ ID NO: 2916383 - protein, 12 aa, Entamoeba invadens
TRDQSDRNRTSP

SEQ ID NO: 2916384 - protein, 12 aa, Entamoeba invadens
TRDSDQAKYERK

SEQ ID NO: 2916385 - protein, 14 aa, Entamoeba invadens
TRDSLERGYTAKKT

SEQ ID NO: 2916386 - protein, 11 aa, Entamoeba invadens
TRDSVSSLAEK

SEQ ID NO: 2916387 - protein, 8 aa, Entamoeba invadens
TRDTISNH

SEQ ID NO: 2916388 - protein, 9 aa, Entamoeba invadens
TRDTRYDGV

SEQ ID NO: 2916389 - protein, 8 aa, Entamoeba invadens
TRDTTPTK

SEQ ID NO: 2916390 - protein, 15 aa, Entamoeba invadens
TRDTTQEQKDATTFE

SEQ ID NO: 2916391 - protein, 4 aa, Entamoeba invadens
TRED

SEQ ID NO: 2916392 - protein, 19 aa, Entamoeba invadens
TREDADYAKRALDKTQVDG

SEQ ID NO: 2916393 - protein, 13 aa, Entamoeba invadens
TREDRQKYGDTIP

SEQ ID NO: 2916394 - protein, 16 aa, Entamoeba invadens
TREDSKIDEEQDNEKT

SEQ ID NO: 2916395 - protein, 16 aa, Entamoeba invadens
TREEKVKVDGSQVRQR

SEQ ID NO: 2916396 - protein, 4 aa, Entamoeba invadens
TREG

SEQ ID NO: 2916397 - protein, 6 aa, Entamoeba invadens
TREGDE

SEQ ID NO: 2916398 - protein, 5 aa, Entamoeba invadens
TREGQ

SEQ ID NO: 2916399 - protein, 6 aa, Entamoeba invadens
TREHKT

SEQ ID NO: 2916400 - protein, 9 aa, Entamoeba invadens
TREKYDAEG

SEQ ID NO: 2916401 - protein, 11 aa, Entamoeba invadens
TRELATQSENV

SEQ ID NO: 2916402 - protein, 7 aa, Entamoeba invadens
TRELGQQ

SEQ ID NO: 2916403 - protein, 5 aa, Entamoeba invadens
TRELK

SEQ ID NO: 2916404 - protein, 9 aa, Entamoeba invadens
TRENPNMKS

SEQ ID NO: 2916405 - protein, 4 aa, Entamoeba invadens
TREP

SEQ ID NO: 2916406 - protein, 5 aa, Entamoeba invadens
TREPS

SEQ ID NO: 2916407 - protein, 6 aa, Entamoeba invadens
TRESRV

SEQ ID NO: 2916408 - protein, 8 aa, Entamoeba invadens
TRESVANE

SEQ ID NO: 2916409 - protein, 9 aa, Entamoeba invadens
TRESYVGEE

SEQ ID NO: 2916410 - protein, 8 aa, Entamoeba invadens
TRETLEHK

SEQ ID NO: 2916411 - protein, 14 aa, Entamoeba invadens
TREVSGKKVTERVS

SEQ ID NO: 2916412 - protein, 10 aa, Entamoeba invadens
TRFENNDMGN

SEQ ID NO: 2916413 - protein, 7 aa, Entamoeba invadens
TRFGSQD

SEQ ID NO: 2916414 - protein, 4 aa, Entamoeba invadens
TRFS

SEQ ID NO: 2916415 - protein, 5 aa, Entamoeba invadens
TRGCT

SEQ ID NO: 2916416 - protein, 5 aa, Entamoeba invadens
TRGDV

SEQ ID NO: 2916417 - protein, 12 aa, Entamoeba invadens
TRGGISKQTDTT

SEQ ID NO: 2916418 - protein, 5 aa, Entamoeba invadens
TRGGK

SEQ ID NO: 2916419 - protein, 6 aa, Entamoeba invadens
TRGGSE

SEQ ID NO: 2916420 - protein, 5 aa, Entamoeba invadens
TRGNV

SEQ ID NO: 2916421 - protein, 4 aa, Entamoeba invadens
TRGQ

SEQ ID NO: 2916422 - protein, 8 aa, Entamoeba invadens
TRGSPEQR

SEQ ID NO: 2916423 - protein, 5 aa, Entamoeba invadens
TRGSV

SEQ ID NO: 2916424 - protein, 13 aa, Entamoeba invadens
TRGSVNETTNPFQ

SEQ ID NO: 2916425 - protein, 9 aa, Entamoeba invadens
TRHETTSVF

SEQ ID NO: 2916426 - protein, 21 aa, Entamoeba invadens
TRHNEEFQKNEQTKSKEPSKR

SEQ ID NO: 2916427 - protein, 17 aa, Entamoeba invadens
TRIEQSGENNTPQNAGN

SEQ ID NO: 2916428 - protein, 9 aa, Entamoeba invadens
TRIGNGSFQ

SEQ ID NO: 2916429 - protein, 19 aa, Entamoeba invadens
TRIRAGEAAPKEDGESPGI

SEQ ID NO: 2916430 - protein, 25 aa, Entamoeba invadens
TRISAGESAPKDDDKKYEEDDNDRI

SEQ ID NO: 2916431 - protein, 14 aa, Entamoeba invadens
TRITTGKGKKKEIR

SEQ ID NO: 2916432 - protein, 8 aa, Entamoeba invadens
TRIVENGN

SEQ ID NO: 2916433 - protein, 9 aa, Entamoeba invadens
TRKAEENPL

SEQ ID NO: 2916434 - protein, 14 aa, Entamoeba invadens
TRKAGVGSKQYASL

SEQ ID NO: 2916435 - protein, 86 aa, Entamoeba invadens
TRKALNPVSASRAQTMKNPKSLQNSPRVQQENQIKSQKPSLPTRPKPQTPTKPVQTQQTMQDEKTTSAGSPRQNVSSLARKFAQQT

SEQ ID NO: 2916436 - protein, 4 aa, Entamoeba invadens
TRKD

SEQ ID NO: 2916437 - protein, 9 aa, Entamoeba invadens
TRKDTAAGI

SEQ ID NO: 2916438 - protein, 7 aa, Entamoeba invadens
TRKEDGK

SEQ ID NO: 2916439 - protein, 8 aa, Entamoeba invadens
TRKELTTQ

SEQ ID NO: 2916440 - protein, 4 aa, Entamoeba invadens
TRKG

SEQ ID NO: 2916441 - protein, 10 aa, Entamoeba invadens
TRKGKEKEGT

SEQ ID NO: 2916442 - protein, 16 aa, Entamoeba invadens
TRKIEENLDSDNNTKA

SEQ ID NO: 2916443 - protein, 7 aa, Entamoeba invadens
TRKKDEI

SEQ ID NO: 2916444 - protein, 21 aa, Entamoeba invadens
TRKNKGSPEILSESGETPDKV

SEQ ID NO: 2916445 - protein, 8 aa, Entamoeba invadens
TRKPPKYE

SEQ ID NO: 2916446 - protein, 22 aa, Entamoeba invadens
TRKPSAPIRKKSSRVLSVQSDL

SEQ ID NO: 2916447 - protein, 128 aa, Entamoeba invadens
TRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENEKTRKRENYI

SEQ ID NO: 2916448 - protein, 60 aa, Entamoeba invadens
TRKRSTSDEDSDSDSVQMPKKSKLESKEEEEKVGIEEEKEKVKPEERKISKKGKDPLSKN

SEQ ID NO: 2916449 - protein, 9 aa, Entamoeba invadens
TRKSDGKQI

SEQ ID NO: 2916450 - protein, 7 aa, Entamoeba invadens
TRKSGGV

SEQ ID NO: 2916451 - protein, 10 aa, Entamoeba invadens
TRKSKTPHSF

SEQ ID NO: 2916452 - protein, 4 aa, Entamoeba invadens
TRKT

SEQ ID NO: 2916453 - protein, 7 aa, Entamoeba invadens
TRKTETL

SEQ ID NO: 2916454 - protein, 9 aa, Entamoeba invadens
TRKTKSITN

SEQ ID NO: 2916455 - protein, 13 aa, Entamoeba invadens
TRKTQAQRSQMNS

SEQ ID NO: 2916456 - protein, 23 aa, Entamoeba invadens
TRKTQQRKKKNKVRVEESGIGDD

SEQ ID NO: 2916457 - protein, 5 aa, Entamoeba invadens
TRKTS

SEQ ID NO: 2916458 - protein, 5 aa, Entamoeba invadens
TRKTV

SEQ ID NO: 2916459 - protein, 6 aa, Entamoeba invadens
TRLAES

SEQ ID NO: 2916460 - protein, 11 aa, Entamoeba invadens
TRLDDENLEKI

SEQ ID NO: 2916461 - protein, 8 aa, Entamoeba invadens
TRLDPDSL

SEQ ID NO: 2916462 - protein, 9 aa, Entamoeba invadens
TRLENAEEV

SEQ ID NO: 2916463 - protein, 14 aa, Entamoeba invadens
TRLESTSSEKEPEL

SEQ ID NO: 2916464 - protein, 6 aa, Entamoeba invadens
TRLGAA

SEQ ID NO: 2916465 - protein, 5 aa, Entamoeba invadens
TRLHQ

SEQ ID NO: 2916466 - protein, 13 aa, Entamoeba invadens
TRLNKSKTKTMVD

SEQ ID NO: 2916467 - protein, 6 aa, Entamoeba invadens
TRLQTL

SEQ ID NO: 2916468 - protein, 11 aa, Entamoeba invadens
TRLQTPQTKAA

SEQ ID NO: 2916469 - protein, 13 aa, Entamoeba invadens
TRLSNASSQAQKL

SEQ ID NO: 2916470 - protein, 13 aa, Entamoeba invadens
TRLTEEKNCDSNK

SEQ ID NO: 2916471 - protein, 5 aa, Entamoeba invadens
TRMDN

SEQ ID NO: 2916472 - protein, 8 aa, Entamoeba invadens
TRMSEEPA

SEQ ID NO: 2916473 - protein, 13 aa, Entamoeba invadens
TRMSQSAEGNPME

SEQ ID NO: 2916474 - protein, 9 aa, Entamoeba invadens
TRNANDPSY

SEQ ID NO: 2916475 - protein, 5 aa, Entamoeba invadens
TRNAT

SEQ ID NO: 2916476 - protein, 4 aa, Entamoeba invadens
TRNE

SEQ ID NO: 2916477 - protein, 9 aa, Entamoeba invadens
TRNENVEEN

SEQ ID NO: 2916478 - protein, 5 aa, Entamoeba invadens
TRNFA

SEQ ID NO: 2916479 - protein, 5 aa, Entamoeba invadens
TRNGE

SEQ ID NO: 2916480 - protein, 12 aa, Entamoeba invadens
TRNGNDVDKAEL

SEQ ID NO: 2916481 - protein, 7 aa, Entamoeba invadens
TRNGTIN

SEQ ID NO: 2916482 - protein, 5 aa, Entamoeba invadens
TRNHD

SEQ ID NO: 2916483 - protein, 10 aa, Entamoeba invadens
TRNHSQTAQG

SEQ ID NO: 2916484 - protein, 5 aa, Entamoeba invadens
TRNKQ

SEQ ID NO: 2916485 - protein, 4 aa, Entamoeba invadens
TRNL

SEQ ID NO: 2916486 - protein, 8 aa, Entamoeba invadens
TRNLATTN

SEQ ID NO: 2916487 - protein, 4 aa, Entamoeba invadens
TRNN

SEQ ID NO: 2916488 - protein, 5 aa, Entamoeba invadens
TRNNR

SEQ ID NO: 2916489 - protein, 7 aa, Entamoeba invadens
TRNNRAA

SEQ ID NO: 2916490 - protein, 7 aa, Entamoeba invadens
TRNPQWN

SEQ ID NO: 2916491 - protein, 8 aa, Entamoeba invadens
TRNRNYPT

SEQ ID NO: 2916492 - protein, 11 aa, Entamoeba invadens
TRNSEISSINS

SEQ ID NO: 2916493 - protein, 6 aa, Entamoeba invadens
TRNSTA

SEQ ID NO: 2916494 - protein, 16 aa, Entamoeba invadens
TRNTFNGNANQNTRET

SEQ ID NO: 2916495 - protein, 11 aa, Entamoeba invadens
TRNTQPTEDTK

SEQ ID NO: 2916496 - protein, 17 aa, Entamoeba invadens
TRNTRQQQTHGLERPKP

SEQ ID NO: 2916497 - protein, 9 aa, Entamoeba invadens
TRNTTEANR

SEQ ID NO: 2916498 - protein, 5 aa, Entamoeba invadens
TRNTV

SEQ ID NO: 2916499 - protein, 4 aa, Entamoeba invadens
TRNY

SEQ ID NO: 2916500 - protein, 29 aa, Entamoeba invadens
TRPDFDKPKDADETEDEITETTEDTIDEV

SEQ ID NO: 2916501 - protein, 17 aa, Entamoeba invadens
TRPDHTTCVTQQKTKYP

SEQ ID NO: 2916502 - protein, 9 aa, Entamoeba invadens
TRPDKPARN

SEQ ID NO: 2916503 - protein, 10 aa, Entamoeba invadens
TRPDNYKDFE

SEQ ID NO: 2916504 - protein, 6 aa, Entamoeba invadens
TRPDTY

SEQ ID NO: 2916505 - protein, 5 aa, Entamoeba invadens
TRPDV

SEQ ID NO: 2916506 - protein, 15 aa, Entamoeba invadens
TRPESDDEEDPYDET

SEQ ID NO: 2916507 - protein, 4 aa, Entamoeba invadens
TRPK

SEQ ID NO: 2916508 - protein, 80 aa, Entamoeba invadens
TRPKHDDADTENDNENDHMSEDENPEDNEDEGELYQSEGEDGEELEVDEEDNEEVDEELTKPSKKPTPKQRAEKTMTKKE

SEQ ID NO: 2916509 - protein, 5 aa, Entamoeba invadens
TRPQI

SEQ ID NO: 2916510 - protein, 7 aa, Entamoeba invadens
TRPSLQN

SEQ ID NO: 2916511 - protein, 4 aa, Entamoeba invadens
TRPV

SEQ ID NO: 2916512 - protein, 5 aa, Entamoeba invadens
TRPYC

SEQ ID NO: 2916513 - protein, 14 aa, Entamoeba invadens
TRPYNLEASRGTSY

SEQ ID NO: 2916514 - protein, 140 aa, Entamoeba invadens
TRQDKKGESQKKVTEELQTEKKPKTQEEKKEDRKEDKKEKLEKKETKLIKKDKSGKITKVGRKVKESLKESEDVGSEEEKVDKLEEKLKSEKIISKPEKKVTTKGTKEVKTEKKPRKLKSSKSLKSLKEESSASKLKSTF

SEQ ID NO: 2916515 - protein, 5 aa, Entamoeba invadens
TRQDM

SEQ ID NO: 2916516 - protein, 8 aa, Entamoeba invadens
TRQELEEA

SEQ ID NO: 2916517 - protein, 9 aa, Entamoeba invadens
TRQERSSAY

SEQ ID NO: 2916518 - protein, 4 aa, Entamoeba invadens
TRQI

SEQ ID NO: 2916519 - protein, 9 aa, Entamoeba invadens
TRQKTEVAK

SEQ ID NO: 2916520 - protein, 10 aa, Entamoeba invadens
TRQKTVDLGR

SEQ ID NO: 2916521 - protein, 14 aa, Entamoeba invadens
TRQKVEEKKLNKDL

SEQ ID NO: 2916522 - protein, 6 aa, Entamoeba invadens
TRQNTP

SEQ ID NO: 2916523 - protein, 9 aa, Entamoeba invadens
TRQNTTSKT

SEQ ID NO: 2916524 - protein, 15 aa, Entamoeba invadens
TRQPLEGRSRDGGLR

SEQ ID NO: 2916525 - protein, 7 aa, Entamoeba invadens
TRQQQTG

SEQ ID NO: 2916526 - protein, 6 aa, Entamoeba invadens
TRQRGF

SEQ ID NO: 2916527 - protein, 10 aa, Entamoeba invadens
TRQSECADLE

SEQ ID NO: 2916528 - protein, 7 aa, Entamoeba invadens
TRQSEVE

SEQ ID NO: 2916529 - protein, 21 aa, Entamoeba invadens
TRQSFKGSKTLLNTSNTLDKA

SEQ ID NO: 2916530 - protein, 19 aa, Entamoeba invadens
TRQSSPSQATKNDFSSPCK

SEQ ID NO: 2916531 - protein, 7 aa, Entamoeba invadens
TRQYNPT

SEQ ID NO: 2916532 - protein, 11 aa, Entamoeba invadens
TRRDDNEDPIY

SEQ ID NO: 2916533 - protein, 7 aa, Entamoeba invadens
TRREEEA

SEQ ID NO: 2916534 - protein, 6 aa, Entamoeba invadens
TRREEM

SEQ ID NO: 2916535 - protein, 4 aa, Entamoeba invadens
TRRG

SEQ ID NO: 2916536 - protein, 8 aa, Entamoeba invadens
TRRGENNR

SEQ ID NO: 2916537 - protein, 7 aa, Entamoeba invadens
TRRGKGV

SEQ ID NO: 2916538 - protein, 27 aa, Entamoeba invadens
TRRGQEVAEADEELETVKKDKFAKEIE

SEQ ID NO: 2916539 - protein, 15 aa, Entamoeba invadens
TRRGQEVAEANEEYE

SEQ ID NO: 2916540 - protein, 5 aa, Entamoeba invadens
TRRGT

SEQ ID NO: 2916541 - protein, 9 aa, Entamoeba invadens
TRRGVKGND

SEQ ID NO: 2916542 - protein, 17 aa, Entamoeba invadens
TRRKSEKTRREAKNHEF

SEQ ID NO: 2916543 - protein, 10 aa, Entamoeba invadens
TRRKYEDEIE

SEQ ID NO: 2916544 - protein, 7 aa, Entamoeba invadens
TRRQTTV

SEQ ID NO: 2916545 - protein, 4 aa, Entamoeba invadens
TRRR

SEQ ID NO: 2916546 - protein, 10 aa, Entamoeba invadens
TRRRTHEPRL

SEQ ID NO: 2916547 - protein, 9 aa, Entamoeba invadens
TRRSNTKLK

SEQ ID NO: 2916548 - protein, 6 aa, Entamoeba invadens
TRRTDG

SEQ ID NO: 2916549 - protein, 11 aa, Entamoeba invadens
TRSAKDAFSPD

SEQ ID NO: 2916550 - protein, 4 aa, Entamoeba invadens
TRSD

SEQ ID NO: 2916551 - protein, 7 aa, Entamoeba invadens
TRSDCPG

SEQ ID NO: 2916552 - protein, 4 aa, Entamoeba invadens
TRSE

SEQ ID NO: 2916553 - protein, 7 aa, Entamoeba invadens
TRSEDSW

SEQ ID NO: 2916554 - protein, 23 aa, Entamoeba invadens
TRSEKKSTLSNKEKKLKKKKGIS

SEQ ID NO: 2916555 - protein, 7 aa, Entamoeba invadens
TRSGKWK

SEQ ID NO: 2916556 - protein, 13 aa, Entamoeba invadens
TRSGLSSLQNTME

SEQ ID NO: 2916557 - protein, 9 aa, Entamoeba invadens
TRSHETRIR

SEQ ID NO: 2916558 - protein, 6 aa, Entamoeba invadens
TRSHPD

SEQ ID NO: 2916559 - protein, 5 aa, Entamoeba invadens
TRSIQ

SEQ ID NO: 2916560 - protein, 11 aa, Entamoeba invadens
TRSKAKRNTVV

SEQ ID NO: 2916561 - protein, 42 aa, Entamoeba invadens
TRSKTQKQKKSHREKKERKPKTKQQLSSSDFDTSKSSESWSS

SEQ ID NO: 2916562 - protein, 10 aa, Entamoeba invadens
TRSLRSSQIL

SEQ ID NO: 2916563 - protein, 33 aa, Entamoeba invadens
TRSNEQAQHEYKTGNTTQKTAKRRIQPTKRREE

SEQ ID NO: 2916564 - protein, 9 aa, Entamoeba invadens
TRSNGKNET

SEQ ID NO: 2916565 - protein, 11 aa, Entamoeba invadens
TRSNSTKSKIE

SEQ ID NO: 2916566 - protein, 9 aa, Entamoeba invadens
TRSPEKIDE

SEQ ID NO: 2916567 - protein, 10 aa, Entamoeba invadens
TRSPEKMEDI

SEQ ID NO: 2916568 - protein, 8 aa, Entamoeba invadens
TRSPEMKK

SEQ ID NO: 2916569 - protein, 10 aa, Entamoeba invadens
TRSPHRPNNI

SEQ ID NO: 2916570 - protein, 6 aa, Entamoeba invadens
TRSQAE

SEQ ID NO: 2916571 - protein, 7 aa, Entamoeba invadens
TRSQAHD

SEQ ID NO: 2916572 - protein, 9 aa, Entamoeba invadens
TRSQSIPNA

SEQ ID NO: 2916573 - protein, 14 aa, Entamoeba invadens
TRSSEEKGTSFSNA

SEQ ID NO: 2916574 - protein, 7 aa, Entamoeba invadens
TRSSEVR

SEQ ID NO: 2916575 - protein, 10 aa, Entamoeba invadens
TRSSKGSKIY

SEQ ID NO: 2916576 - protein, 11 aa, Entamoeba invadens
TRSSPLIQRGN

SEQ ID NO: 2916577 - protein, 10 aa, Entamoeba invadens
TRSSSKSVKR

SEQ ID NO: 2916578 - protein, 5 aa, Entamoeba invadens
TRSSY

SEQ ID NO: 2916579 - protein, 13 aa, Entamoeba invadens
TRSSYTEYKPGEF

SEQ ID NO: 2916580 - protein, 11 aa, Entamoeba invadens
TRSTSPSKIKE

SEQ ID NO: 2916581 - protein, 6 aa, Entamoeba invadens
TRSTTW

SEQ ID NO: 2916582 - protein, 7 aa, Entamoeba invadens
TRSVEGT

SEQ ID NO: 2916583 - protein, 4 aa, Entamoeba invadens
TRTA

SEQ ID NO: 2916584 - protein, 6 aa, Entamoeba invadens
TRTDGE

SEQ ID NO: 2916585 - protein, 8 aa, Entamoeba invadens
TRTGNQTP

SEQ ID NO: 2916586 - protein, 4 aa, Entamoeba invadens
TRTH

SEQ ID NO: 2916587 - protein, 7 aa, Entamoeba invadens
TRTHTYE

SEQ ID NO: 2916588 - protein, 4 aa, Entamoeba invadens
TRTI

SEQ ID NO: 2916589 - protein, 12 aa, Entamoeba invadens
TRTKEGSDFSKE

SEQ ID NO: 2916590 - protein, 9 aa, Entamoeba invadens
TRTKTGKLG

SEQ ID NO: 2916591 - protein, 7 aa, Entamoeba invadens
TRTLEDN

SEQ ID NO: 2916592 - protein, 7 aa, Entamoeba invadens
TRTLNDK

SEQ ID NO: 2916593 - protein, 10 aa, Entamoeba invadens
TRTLNGKDTT

SEQ ID NO: 2916594 - protein, 8 aa, Entamoeba invadens
TRTMTQPY

SEQ ID NO: 2916595 - protein, 4 aa, Entamoeba invadens
TRTN

SEQ ID NO: 2916596 - protein, 5 aa, Entamoeba invadens
TRTNN

SEQ ID NO: 2916597 - protein, 6 aa, Entamoeba invadens
TRTNNA

SEQ ID NO: 2916598 - protein, 8 aa, Entamoeba invadens
TRTNRVEK

SEQ ID NO: 2916599 - protein, 4 aa, Entamoeba invadens
TRTP

SEQ ID NO: 2916600 - protein, 9 aa, Entamoeba invadens
TRTPAQVRS

SEQ ID NO: 2916601 - protein, 8 aa, Entamoeba invadens
TRTQPYPE

SEQ ID NO: 2916602 - protein, 8 aa, Entamoeba invadens
TRTQSKIE

SEQ ID NO: 2916603 - protein, 12 aa, Entamoeba invadens
TRTRDGDTEQEL

SEQ ID NO: 2916604 - protein, 7 aa, Entamoeba invadens
TRTSENE

SEQ ID NO: 2916605 - protein, 7 aa, Entamoeba invadens
TRTSRSD

SEQ ID NO: 2916606 - protein, 9 aa, Entamoeba invadens
TRTSYRSTD

SEQ ID NO: 2916607 - protein, 9 aa, Entamoeba invadens
TRTTAQVRS

SEQ ID NO: 2916608 - protein, 9 aa, Entamoeba invadens
TRTTTCPGV

SEQ ID NO: 2916609 - protein, 10 aa, Entamoeba invadens
TRVGKDEKTA

SEQ ID NO: 2916610 - protein, 11 aa, Entamoeba invadens
TRVKNEVSRET

SEQ ID NO: 2916611 - protein, 4 aa, Entamoeba invadens
TRVP

SEQ ID NO: 2916612 - protein, 13 aa, Entamoeba invadens
TRVQENKTDAFPT

SEQ ID NO: 2916613 - protein, 13 aa, Entamoeba invadens
TRVSPSKSATPRN

SEQ ID NO: 2916614 - protein, 10 aa, Entamoeba invadens
TRVTTSDHKI

SEQ ID NO: 2916615 - protein, 14 aa, Entamoeba invadens
TRYARNKYSKNYTL

SEQ ID NO: 2916616 - protein, 4 aa, Entamoeba invadens
TRYE

SEQ ID NO: 2916617 - protein, 7 aa, Entamoeba invadens
TRYENDK

SEQ ID NO: 2916618 - protein, 10 aa, Entamoeba invadens
TRYKPGSDMS

SEQ ID NO: 2916619 - protein, 6 aa, Entamoeba invadens
TRYPRT

SEQ ID NO: 2916620 - protein, 13 aa, Entamoeba invadens
TSAARRSTSVPKN

SEQ ID NO: 2916621 - protein, 6 aa, Entamoeba invadens
TSADGF

SEQ ID NO: 2916622 - protein, 21 aa, Entamoeba invadens
TSADMNSSKMTTGMKDAKETL

SEQ ID NO: 2916623 - protein, 7 aa, Entamoeba invadens
TSAEATK

SEQ ID NO: 2916624 - protein, 6 aa, Entamoeba invadens
TSAEIS

SEQ ID NO: 2916625 - protein, 7 aa, Entamoeba invadens
TSAENNL

SEQ ID NO: 2916626 - protein, 7 aa, Entamoeba invadens
TSAENSF

SEQ ID NO: 2916627 - protein, 5 aa, Entamoeba invadens
TSAEY

SEQ ID NO: 2916628 - protein, 6 aa, Entamoeba invadens
TSAFKE

SEQ ID NO: 2916629 - protein, 12 aa, Entamoeba invadens
TSAFKEKTSKLS

SEQ ID NO: 2916630 - protein, 11 aa, Entamoeba invadens
TSAFKSSSTTF

SEQ ID NO: 2916631 - protein, 15 aa, Entamoeba invadens
TSAFPKDKTTDKPHL

SEQ ID NO: 2916632 - protein, 19 aa, Entamoeba invadens
TSAIPTQSFTQSSALPSEI

SEQ ID NO: 2916633 - protein, 9 aa, Entamoeba invadens
TSAITGEGI

SEQ ID NO: 2916634 - protein, 11 aa, Entamoeba invadens
TSAKAATKAVK

SEQ ID NO: 2916635 - protein, 9 aa, Entamoeba invadens
TSAKEGTNI

SEQ ID NO: 2916636 - protein, 9 aa, Entamoeba invadens
TSAKENCNV

SEQ ID NO: 2916637 - protein, 8 aa, Entamoeba invadens
TSAKENTQ

SEQ ID NO: 2916638 - protein, 9 aa, Entamoeba invadens
TSAKNGTNI

SEQ ID NO: 2916639 - protein, 10 aa, Entamoeba invadens
TSAKNNEGIK

SEQ ID NO: 2916640 - protein, 5 aa, Entamoeba invadens
TSAKQ

SEQ ID NO: 2916641 - protein, 10 aa, Entamoeba invadens
TSAKSGENVK

SEQ ID NO: 2916642 - protein, 9 aa, Entamoeba invadens
TSAKSGLAV

SEQ ID NO: 2916643 - protein, 10 aa, Entamoeba invadens
TSAKSGLAVE

SEQ ID NO: 2916644 - protein, 10 aa, Entamoeba invadens
TSAKTKKGVK

SEQ ID NO: 2916645 - protein, 8 aa, Entamoeba invadens
TSAKTNIN

SEQ ID NO: 2916646 - protein, 7 aa, Entamoeba invadens
TSAKTSF

SEQ ID NO: 2916647 - protein, 19 aa, Entamoeba invadens
TSALDDKEKQNDKLEGRIT

SEQ ID NO: 2916648 - protein, 12 aa, Entamoeba invadens
TSAMDDGDFDGA

SEQ ID NO: 2916649 - protein, 6 aa, Entamoeba invadens
TSAMQR

SEQ ID NO: 2916650 - protein, 4 aa, Entamoeba invadens
TSAN

SEQ ID NO: 2916651 - protein, 5 aa, Entamoeba invadens
TSANE

SEQ ID NO: 2916652 - protein, 5 aa, Entamoeba invadens
TSANQ

SEQ ID NO: 2916653 - protein, 7 aa, Entamoeba invadens
TSAPSMR

SEQ ID NO: 2916654 - protein, 8 aa, Entamoeba invadens
TSAPTATA

SEQ ID NO: 2916655 - protein, 7 aa, Entamoeba invadens
TSAPTLK

SEQ ID NO: 2916656 - protein, 29 aa, Entamoeba invadens
TSARKRVEKMEKQRELQKHAEKVRKATLQ

SEQ ID NO: 2916657 - protein, 9 aa, Entamoeba invadens
TSASTGVGV

SEQ ID NO: 2916658 - protein, 7 aa, Entamoeba invadens
TSATKMT

SEQ ID NO: 2916659 - protein, 6 aa, Entamoeba invadens
TSATPV

SEQ ID NO: 2916660 - protein, 12 aa, Entamoeba invadens
TSATSSKKEKEV

SEQ ID NO: 2916661 - protein, 15 aa, Entamoeba invadens
TSATTCEKCKSYNPS

SEQ ID NO: 2916662 - protein, 4 aa, Entamoeba invadens
TSAV

SEQ ID NO: 2916663 - protein, 5 aa, Entamoeba invadens
TSAVT

SEQ ID NO: 2916664 - protein, 7 aa, Entamoeba invadens
TSAVTTQ

SEQ ID NO: 2916665 - protein, 17 aa, Entamoeba invadens
TSAYPDVENHNKKAHKN

SEQ ID NO: 2916666 - protein, 4 aa, Entamoeba invadens
TSCD

SEQ ID NO: 2916667 - protein, 6 aa, Entamoeba invadens
TSCEHH

SEQ ID NO: 2916668 - protein, 18 aa, Entamoeba invadens
TSCERAKRTLSSAATANI

SEQ ID NO: 2916669 - protein, 18 aa, Entamoeba invadens
TSCERAKRTLSSAATTNI

SEQ ID NO: 2916670 - protein, 18 aa, Entamoeba invadens
TSCERAKRTQSNATTANI

SEQ ID NO: 2916671 - protein, 8 aa, Entamoeba invadens
TSCERANT

SEQ ID NO: 2916672 - protein, 11 aa, Entamoeba invadens
TSCGETPEDKL

SEQ ID NO: 2916673 - protein, 8 aa, Entamoeba invadens
TSCGNCDS

SEQ ID NO: 2916674 - protein, 19 aa, Entamoeba invadens
TSCGNCDSSCSSCDANGYC

SEQ ID NO: 2916675 - protein, 10 aa, Entamoeba invadens
TSCGNEGCVN

SEQ ID NO: 2916676 - protein, 9 aa, Entamoeba invadens
TSCHESGTK

SEQ ID NO: 2916677 - protein, 16 aa, Entamoeba invadens
TSCPDGPSSNTNINTS

SEQ ID NO: 2916678 - protein, 6 aa, Entamoeba invadens
TSCPHF

SEQ ID NO: 2916679 - protein, 7 aa, Entamoeba invadens
TSCRTPT

SEQ ID NO: 2916680 - protein, 5 aa, Entamoeba invadens
TSCSA

SEQ ID NO: 2916681 - protein, 9 aa, Entamoeba invadens
TSCVSTSSQ

SEQ ID NO: 2916682 - protein, 13 aa, Entamoeba invadens
TSDDDKPPQPQNI

SEQ ID NO: 2916683 - protein, 10 aa, Entamoeba invadens
TSDDEDTITL

SEQ ID NO: 2916684 - protein, 9 aa, Entamoeba invadens
TSDDEKALT

SEQ ID NO: 2916685 - protein, 9 aa, Entamoeba invadens
TSDDKEAKE

SEQ ID NO: 2916686 - protein, 8 aa, Entamoeba invadens
TSDDSQPV

SEQ ID NO: 2916687 - protein, 23 aa, Entamoeba invadens
TSDDTRKKAMNNDKERGKYSKME

SEQ ID NO: 2916688 - protein, 4 aa, Entamoeba invadens
TSDE

SEQ ID NO: 2916689 - protein, 17 aa, Entamoeba invadens
TSDEKCFADSSEDLRKS

SEQ ID NO: 2916690 - protein, 25 aa, Entamoeba invadens
TSDEKQEVENLNGNVEQKQPPQLPH

SEQ ID NO: 2916691 - protein, 7 aa, Entamoeba invadens
TSDEQTQ

SEQ ID NO: 2916692 - protein, 8 aa, Entamoeba invadens
TSDETDAI

SEQ ID NO: 2916693 - protein, 15 aa, Entamoeba invadens
TSDETPTEETISAQN

SEQ ID NO: 2916694 - protein, 5 aa, Entamoeba invadens
TSDEV

SEQ ID NO: 2916695 - protein, 6 aa, Entamoeba invadens
TSDFVN

SEQ ID NO: 2916696 - protein, 5 aa, Entamoeba invadens
TSDGF

SEQ ID NO: 2916697 - protein, 16 aa, Entamoeba invadens
TSDGKDVRKKVEKLKA

SEQ ID NO: 2916698 - protein, 11 aa, Entamoeba invadens
TSDGKNFSSEE

SEQ ID NO: 2916699 - protein, 7 aa, Entamoeba invadens
TSDGTSC

SEQ ID NO: 2916700 - protein, 6 aa, Entamoeba invadens
TSDGYD

SEQ ID NO: 2916701 - protein, 14 aa, Entamoeba invadens
TSDISLEDGTRKYT

SEQ ID NO: 2916702 - protein, 6 aa, Entamoeba invadens
TSDKIK

SEQ ID NO: 2916703 - protein, 9 aa, Entamoeba invadens
TSDKKYTIK

SEQ ID NO: 2916704 - protein, 6 aa, Entamoeba invadens
TSDKVK

SEQ ID NO: 2916705 - protein, 6 aa, Entamoeba invadens
TSDLEK

SEQ ID NO: 2916706 - protein, 17 aa, Entamoeba invadens
TSDLENGNSEDPIGTPN

SEQ ID NO: 2916707 - protein, 5 aa, Entamoeba invadens
TSDLK

SEQ ID NO: 2916708 - protein, 17 aa, Entamoeba invadens
TSDLSNGNSEDPIGTPN

SEQ ID NO: 2916709 - protein, 7 aa, Entamoeba invadens
TSDMENV

SEQ ID NO: 2916710 - protein, 15 aa, Entamoeba invadens
TSDNETTTLETLPRG

SEQ ID NO: 2916711 - protein, 14 aa, Entamoeba invadens
TSDNKKVYGSTIPT

SEQ ID NO: 2916712 - protein, 13 aa, Entamoeba invadens
TSDNQRKNEEKEI

SEQ ID NO: 2916713 - protein, 4 aa, Entamoeba invadens
TSDP

SEQ ID NO: 2916714 - protein, 16 aa, Entamoeba invadens
TSDPNKKIFSKEEAET

SEQ ID NO: 2916715 - protein, 5 aa, Entamoeba invadens
TSDPR

SEQ ID NO: 2916716 - protein, 7 aa, Entamoeba invadens
TSDPVRE

SEQ ID NO: 2916717 - protein, 4 aa, Entamoeba invadens
TSDQ

SEQ ID NO: 2916718 - protein, 6 aa, Entamoeba invadens
TSDQED

SEQ ID NO: 2916719 - protein, 10 aa, Entamoeba invadens
TSDQREGRTV

SEQ ID NO: 2916720 - protein, 11 aa, Entamoeba invadens
TSDSANTTQYI

SEQ ID NO: 2916721 - protein, 9 aa, Entamoeba invadens
TSDSATDQE

SEQ ID NO: 2916722 - protein, 5 aa, Entamoeba invadens
TSDSK

SEQ ID NO: 2916723 - protein, 5 aa, Entamoeba invadens
TSDSL

SEQ ID NO: 2916724 - protein, 10 aa, Entamoeba invadens
TSDSPDSCTS

SEQ ID NO: 2916725 - protein, 25 aa, Entamoeba invadens
TSDTEKKKLKEKTVKRRTAKSASAY

SEQ ID NO: 2916726 - protein, 36 aa, Entamoeba invadens
TSDTFSKTCNKPPLPSDFTRNTSLESQRQYKTPAKR

SEQ ID NO: 2916727 - protein, 8 aa, Entamoeba invadens
TSDTSFEK

SEQ ID NO: 2916728 - protein, 7 aa, Entamoeba invadens
TSDVENV

SEQ ID NO: 2916729 - protein, 5 aa, Entamoeba invadens
TSDYF

SEQ ID NO: 2916730 - protein, 4 aa, Entamoeba invadens
TSEA

SEQ ID NO: 2916731 - protein, 22 aa, Entamoeba invadens
TSEAKREMRKRGNSKISVGKGN

SEQ ID NO: 2916732 - protein, 9 aa, Entamoeba invadens
TSEASSLAG

SEQ ID NO: 2916733 - protein, 5 aa, Entamoeba invadens
TSEAV

SEQ ID NO: 2916734 - protein, 32 aa, Entamoeba invadens
TSECEESYSSEATESYSTSSSEDSIEEGKANS

SEQ ID NO: 2916735 - protein, 4 aa, Entamoeba invadens
TSED

SEQ ID NO: 2916736 - protein, 8 aa, Entamoeba invadens
TSEDGRKK

SEQ ID NO: 2916737 - protein, 9 aa, Entamoeba invadens
TSEDGSNTL

SEQ ID NO: 2916738 - protein, 6 aa, Entamoeba invadens
TSEDPT

SEQ ID NO: 2916739 - protein, 8 aa, Entamoeba invadens
TSEDTPTI

SEQ ID NO: 2916740 - protein, 11 aa, Entamoeba invadens
TSEDTVSPEEV

SEQ ID NO: 2916741 - protein, 6 aa, Entamoeba invadens
TSEDVE

SEQ ID NO: 2916742 - protein, 7 aa, Entamoeba invadens
TSEEAQQ

SEQ ID NO: 2916743 - protein, 6 aa, Entamoeba invadens
TSEEAR

SEQ ID NO: 2916744 - protein, 7 aa, Entamoeba invadens
TSEEEDE

SEQ ID NO: 2916745 - protein, 5 aa, Entamoeba invadens
TSEEI

SEQ ID NO: 2916746 - protein, 7 aa, Entamoeba invadens
TSEEMSS

SEQ ID NO: 2916747 - protein, 6 aa, Entamoeba invadens
TSEEYI

SEQ ID NO: 2916748 - protein, 8 aa, Entamoeba invadens
TSEEYSYQ

SEQ ID NO: 2916749 - protein, 6 aa, Entamoeba invadens
TSEFNK

SEQ ID NO: 2916750 - protein, 6 aa, Entamoeba invadens
TSEGRI

SEQ ID NO: 2916751 - protein, 5 aa, Entamoeba invadens
TSEHA

SEQ ID NO: 2916752 - protein, 21 aa, Entamoeba invadens
TSEHKTKKQRKVNWTKEEDEQ

SEQ ID NO: 2916753 - protein, 11 aa, Entamoeba invadens
TSEIDNDKTSY

SEQ ID NO: 2916754 - protein, 5 aa, Entamoeba invadens
TSEIG

SEQ ID NO: 2916755 - protein, 6 aa, Entamoeba invadens
TSEIGP

SEQ ID NO: 2916756 - protein, 12 aa, Entamoeba invadens
TSEKEDEKTTSD

SEQ ID NO: 2916757 - protein, 5 aa, Entamoeba invadens
TSEKI

SEQ ID NO: 2916758 - protein, 7 aa, Entamoeba invadens
TSEKNPY

SEQ ID NO: 2916759 - protein, 7 aa, Entamoeba invadens
TSEKRLS

SEQ ID NO: 2916760 - protein, 8 aa, Entamoeba invadens
TSEKRLSS

SEQ ID NO: 2916761 - protein, 12 aa, Entamoeba invadens
TSEKYSKEENSK

SEQ ID NO: 2916762 - protein, 4 aa, Entamoeba invadens
TSEL

SEQ ID NO: 2916763 - protein, 7 aa, Entamoeba invadens
TSELPKR

SEQ ID NO: 2916764 - protein, 5 aa, Entamoeba invadens
TSELR

SEQ ID NO: 2916765 - protein, 4 aa, Entamoeba invadens
TSEN

SEQ ID NO: 2916766 - protein, 5 aa, Entamoeba invadens
TSENA

SEQ ID NO: 2916767 - protein, 26 aa, Entamoeba invadens
TSENEKKKKKAEEEDQKEKEKQINNI

SEQ ID NO: 2916768 - protein, 7 aa, Entamoeba invadens
TSENGNK

SEQ ID NO: 2916769 - protein, 9 aa, Entamoeba invadens
TSENVTFGD

SEQ ID NO: 2916770 - protein, 7 aa, Entamoeba invadens
TSEPDRA

SEQ ID NO: 2916771 - protein, 8 aa, Entamoeba invadens
TSEQAQVR

SEQ ID NO: 2916772 - protein, 5 aa, Entamoeba invadens
TSEQF

SEQ ID NO: 2916773 - protein, 7 aa, Entamoeba invadens
TSEQRAA

SEQ ID NO: 2916774 - protein, 6 aa, Entamoeba invadens
TSEQSS

SEQ ID NO: 2916775 - protein, 7 aa, Entamoeba invadens
TSEQTWR

SEQ ID NO: 2916776 - protein, 4 aa, Entamoeba invadens
TSER

SEQ ID NO: 2916777 - protein, 16 aa, Entamoeba invadens
TSERRVPQVSSSISQD

SEQ ID NO: 2916778 - protein, 6 aa, Entamoeba invadens
TSERTN

SEQ ID NO: 2916779 - protein, 11 aa, Entamoeba invadens
TSESAKIGPSF

SEQ ID NO: 2916780 - protein, 8 aa, Entamoeba invadens
TSESARKA

SEQ ID NO: 2916781 - protein, 12 aa, Entamoeba invadens
TSESTTELSPQS

SEQ ID NO: 2916782 - protein, 4 aa, Entamoeba invadens
TSET

SEQ ID NO: 2916783 - protein, 6 aa, Entamoeba invadens
TSETKE

SEQ ID NO: 2916784 - protein, 6 aa, Entamoeba invadens
TSETRI

SEQ ID NO: 2916785 - protein, 14 aa, Entamoeba invadens
TSETTSTKTEIKDG

SEQ ID NO: 2916786 - protein, 7 aa, Entamoeba invadens
TSEVRPV

SEQ ID NO: 2916787 - protein, 27 aa, Entamoeba invadens
TSEYSLEATNKWKEDLDTKVSLNGEPI

SEQ ID NO: 2916788 - protein, 4 aa, Entamoeba invadens
TSFD

SEQ ID NO: 2916789 - protein, 11 aa, Entamoeba invadens
TSFDTTKKYFE

SEQ ID NO: 2916790 - protein, 29 aa, Entamoeba invadens
TSFDTTKNQISDSSEIRFDKNDKKRYWTE

SEQ ID NO: 2916791 - protein, 8 aa, Entamoeba invadens
TSFEEPKE

SEQ ID NO: 2916792 - protein, 7 aa, Entamoeba invadens
TSFENDY

SEQ ID NO: 2916793 - protein, 4 aa, Entamoeba invadens
TSFG

SEQ ID NO: 2916794 - protein, 7 aa, Entamoeba invadens
TSFGENA

SEQ ID NO: 2916795 - protein, 4 aa, Entamoeba invadens
TSFN

SEQ ID NO: 2916796 - protein, 8 aa, Entamoeba invadens
TSFNSNES

SEQ ID NO: 2916797 - protein, 4 aa, Entamoeba invadens
TSFP

SEQ ID NO: 2916798 - protein, 6 aa, Entamoeba invadens
TSFPAS

SEQ ID NO: 2916799 - protein, 22 aa, Entamoeba invadens
TSFPSKDVNSSKGEDKKSVMEE

SEQ ID NO: 2916800 - protein, 6 aa, Entamoeba invadens
TSFQNA

SEQ ID NO: 2916801 - protein, 4 aa, Entamoeba invadens
TSFR

SEQ ID NO: 2916802 - protein, 6 aa, Entamoeba invadens
TSFSEE

SEQ ID NO: 2916803 - protein, 14 aa, Entamoeba invadens
TSFSSKNKDKARDI

SEQ ID NO: 2916804 - protein, 7 aa, Entamoeba invadens
TSFSTNE

SEQ ID NO: 2916805 - protein, 18 aa, Entamoeba invadens
TSFSTTKTRKDHTSKCAI

SEQ ID NO: 2916806 - protein, 5 aa, Entamoeba invadens
TSFTP

SEQ ID NO: 2916807 - protein, 11 aa, Entamoeba invadens
TSFTPPKGVTS

SEQ ID NO: 2916808 - protein, 7 aa, Entamoeba invadens
TSGAEEF

SEQ ID NO: 2916809 - protein, 7 aa, Entamoeba invadens
TSGALSI

SEQ ID NO: 2916810 - protein, 14 aa, Entamoeba invadens
TSGAVQSDTELGTS

SEQ ID NO: 2916811 - protein, 8 aa, Entamoeba invadens
TSGDERYR

SEQ ID NO: 2916812 - protein, 5 aa, Entamoeba invadens
TSGDF

SEQ ID NO: 2916813 - protein, 16 aa, Entamoeba invadens
TSGDGNISKTPKDPMT

SEQ ID NO: 2916814 - protein, 7 aa, Entamoeba invadens
TSGEERF

SEQ ID NO: 2916815 - protein, 12 aa, Entamoeba invadens
TSGEEVKVEQTE

SEQ ID NO: 2916816 - protein, 16 aa, Entamoeba invadens
TSGENVESSENAVETK

SEQ ID NO: 2916817 - protein, 15 aa, Entamoeba invadens
TSGERKSIDDGISDI

SEQ ID NO: 2916818 - protein, 7 aa, Entamoeba invadens
TSGETQR

SEQ ID NO: 2916819 - protein, 8 aa, Entamoeba invadens
TSGFEGCE

SEQ ID NO: 2916820 - protein, 21 aa, Entamoeba invadens
TSGFENPVPNYGRPGNNPPWM

SEQ ID NO: 2916821 - protein, 8 aa, Entamoeba invadens
TSGGGKTT

SEQ ID NO: 2916822 - protein, 7 aa, Entamoeba invadens
TSGGKEV

SEQ ID NO: 2916823 - protein, 7 aa, Entamoeba invadens
TSGHENT

SEQ ID NO: 2916824 - protein, 7 aa, Entamoeba invadens
TSGHSVT

SEQ ID NO: 2916825 - protein, 14 aa, Entamoeba invadens
TSGKGSSAAGLTAA

SEQ ID NO: 2916826 - protein, 9 aa, Entamoeba invadens
TSGKPPPRY

SEQ ID NO: 2916827 - protein, 6 aa, Entamoeba invadens
TSGKPQ

SEQ ID NO: 2916828 - protein, 16 aa, Entamoeba invadens
TSGKRLEKKENMSDDQ

SEQ ID NO: 2916829 - protein, 9 aa, Entamoeba invadens
TSGKTGMGI

SEQ ID NO: 2916830 - protein, 6 aa, Entamoeba invadens
TSGLGT

SEQ ID NO: 2916831 - protein, 62 aa, Entamoeba invadens
TSGLNIPKNEKKSDDHVQSPDLQTDKLSEKENENVERNALNPSENGDLQTPQIDPQRLPPEL

SEQ ID NO: 2916832 - protein, 33 aa, Entamoeba invadens
TSGMPTDYKTPNLKTNEEIRKESHQKTPQPKEN

SEQ ID NO: 2916833 - protein, 6 aa, Entamoeba invadens
TSGNAL

SEQ ID NO: 2916834 - protein, 14 aa, Entamoeba invadens
TSGNDDLDQTRPLS

SEQ ID NO: 2916835 - protein, 7 aa, Entamoeba invadens
TSGNDRS

SEQ ID NO: 2916836 - protein, 7 aa, Entamoeba invadens
TSGNGNG

SEQ ID NO: 2916837 - protein, 9 aa, Entamoeba invadens
TSGNHVEKQ

SEQ ID NO: 2916838 - protein, 24 aa, Entamoeba invadens
TSGNYKCQSCSSTCGGACNGSNGI

SEQ ID NO: 2916839 - protein, 7 aa, Entamoeba invadens
TSGPHTE

SEQ ID NO: 2916840 - protein, 8 aa, Entamoeba invadens
TSGQIKND

SEQ ID NO: 2916841 - protein, 11 aa, Entamoeba invadens
TSGQNGAPITE

SEQ ID NO: 2916842 - protein, 9 aa, Entamoeba invadens
TSGQQITTN

SEQ ID NO: 2916843 - protein, 9 aa, Entamoeba invadens
TSGQQITTS

SEQ ID NO: 2916844 - protein, 10 aa, Entamoeba invadens
TSGQQTTTSV

SEQ ID NO: 2916845 - protein, 5 aa, Entamoeba invadens
TSGQS

SEQ ID NO: 2916846 - protein, 6 aa, Entamoeba invadens
TSGQTE

SEQ ID NO: 2916847 - protein, 16 aa, Entamoeba invadens
TSGRCQAEKNYNQRDE

SEQ ID NO: 2916848 - protein, 9 aa, Entamoeba invadens
TSGSTGEPK

SEQ ID NO: 2916849 - protein, 8 aa, Entamoeba invadens
TSGSTGIP

SEQ ID NO: 2916850 - protein, 9 aa, Entamoeba invadens
TSGSTGNPK

SEQ ID NO: 2916851 - protein, 9 aa, Entamoeba invadens
TSGTDLPNV

SEQ ID NO: 2916852 - protein, 9 aa, Entamoeba invadens
TSGVDNKQN

SEQ ID NO: 2916853 - protein, 7 aa, Entamoeba invadens
TSGVGKT

SEQ ID NO: 2916854 - protein, 6 aa, Entamoeba invadens
TSGYKS

SEQ ID NO: 2916855 - protein, 7 aa, Entamoeba invadens
TSHGESS

SEQ ID NO: 2916856 - protein, 14 aa, Entamoeba invadens
TSHGRTKTSATPTL

SEQ ID NO: 2916857 - protein, 20 aa, Entamoeba invadens
TSHGSSYDDNPICPNKECGA

SEQ ID NO: 2916858 - protein, 7 aa, Entamoeba invadens
TSHHPPI

SEQ ID NO: 2916859 - protein, 8 aa, Entamoeba invadens
TSHKHGGV

SEQ ID NO: 2916860 - protein, 6 aa, Entamoeba invadens
TSHLEN

SEQ ID NO: 2916861 - protein, 6 aa, Entamoeba invadens
TSHNNG

SEQ ID NO: 2916862 - protein, 6 aa, Entamoeba invadens
TSHPND

SEQ ID NO: 2916863 - protein, 8 aa, Entamoeba invadens
TSHSSDNL

SEQ ID NO: 2916864 - protein, 15 aa, Entamoeba invadens
TSIAQTASFDESTGL

SEQ ID NO: 2916865 - protein, 7 aa, Entamoeba invadens
TSIDEDQ

SEQ ID NO: 2916866 - protein, 7 aa, Entamoeba invadens
TSIESDE

SEQ ID NO: 2916867 - protein, 5 aa, Entamoeba invadens
TSIGD

SEQ ID NO: 2916868 - protein, 6 aa, Entamoeba invadens
TSIGES

SEQ ID NO: 2916869 - protein, 6 aa, Entamoeba invadens
TSIGKN

SEQ ID NO: 2916870 - protein, 5 aa, Entamoeba invadens
TSIGN

SEQ ID NO: 2916871 - protein, 5 aa, Entamoeba invadens
TSIKP

SEQ ID NO: 2916872 - protein, 7 aa, Entamoeba invadens
TSIKSGE

SEQ ID NO: 2916873 - protein, 7 aa, Entamoeba invadens
TSINEEL

SEQ ID NO: 2916874 - protein, 6 aa, Entamoeba invadens
TSINGD

SEQ ID NO: 2916875 - protein, 4 aa, Entamoeba invadens
TSIP

SEQ ID NO: 2916876 - protein, 22 aa, Entamoeba invadens
TSIPEDLSEQRAVGANGMGDGM

SEQ ID NO: 2916877 - protein, 6 aa, Entamoeba invadens
TSIPGS

SEQ ID NO: 2916878 - protein, 10 aa, Entamoeba invadens
TSIPKESFRG

SEQ ID NO: 2916879 - protein, 7 aa, Entamoeba invadens
TSIPQAE

SEQ ID NO: 2916880 - protein, 5 aa, Entamoeba invadens
TSIPR

SEQ ID NO: 2916881 - protein, 6 aa, Entamoeba invadens
TSIPTT

SEQ ID NO: 2916882 - protein, 8 aa, Entamoeba invadens
TSISEVKE

SEQ ID NO: 2916883 - protein, 8 aa, Entamoeba invadens
TSISPTGR

SEQ ID NO: 2916884 - protein, 16 aa, Entamoeba invadens
TSITCDEESSSYEEHP

SEQ ID NO: 2916885 - protein, 7 aa, Entamoeba invadens
TSITGER

SEQ ID NO: 2916886 - protein, 14 aa, Entamoeba invadens
TSITNNENDTPNTF

SEQ ID NO: 2916887 - protein, 7 aa, Entamoeba invadens
TSKAETQ

SEQ ID NO: 2916888 - protein, 6 aa, Entamoeba invadens
TSKCEG

SEQ ID NO: 2916889 - protein, 11 aa, Entamoeba invadens
TSKDASPESLS

SEQ ID NO: 2916890 - protein, 14 aa, Entamoeba invadens
TSKDDLIKSRGDRD

SEQ ID NO: 2916891 - protein, 9 aa, Entamoeba invadens
TSKDIEKWE

SEQ ID NO: 2916892 - protein, 9 aa, Entamoeba invadens
TSKDKKGNI

SEQ ID NO: 2916893 - protein, 5 aa, Entamoeba invadens
TSKDL

SEQ ID NO: 2916894 - protein, 7 aa, Entamoeba invadens
TSKDMKG

SEQ ID NO: 2916895 - protein, 14 aa, Entamoeba invadens
TSKDRRDASPREPE

SEQ ID NO: 2916896 - protein, 9 aa, Entamoeba invadens
TSKEDVEEY

SEQ ID NO: 2916897 - protein, 7 aa, Entamoeba invadens
TSKEEVK

SEQ ID NO: 2916898 - protein, 12 aa, Entamoeba invadens
TSKESFNDVPNS

SEQ ID NO: 2916899 - protein, 8 aa, Entamoeba invadens
TSKESGLK

SEQ ID NO: 2916900 - protein, 4 aa, Entamoeba invadens
TSKF

SEQ ID NO: 2916901 - protein, 8 aa, Entamoeba invadens
TSKFDVNE

SEQ ID NO: 2916902 - protein, 8 aa, Entamoeba invadens
TSKGAVEN

SEQ ID NO: 2916903 - protein, 7 aa, Entamoeba invadens
TSKGEQM

SEQ ID NO: 2916904 - protein, 7 aa, Entamoeba invadens
TSKGGTH

SEQ ID NO: 2916905 - protein, 12 aa, Entamoeba invadens
TSKGGVKKQKVK

SEQ ID NO: 2916906 - protein, 9 aa, Entamoeba invadens
TSKGVSQAV

SEQ ID NO: 2916907 - protein, 6 aa, Entamoeba invadens
TSKHSL

SEQ ID NO: 2916908 - protein, 5 aa, Entamoeba invadens
TSKIG

SEQ ID NO: 2916909 - protein, 22 aa, Entamoeba invadens
TSKIGDSGNHLDYQKTSEKCGE

SEQ ID NO: 2916910 - protein, 12 aa, Entamoeba invadens
TSKINEKYLPDK

SEQ ID NO: 2916911 - protein, 13 aa, Entamoeba invadens
TSKIPKDSKIEEH

SEQ ID NO: 2916912 - protein, 7 aa, Entamoeba invadens
TSKIPTT

SEQ ID NO: 2916913 - protein, 20 aa, Entamoeba invadens
TSKKELKNARKEDLAGTTNM

SEQ ID NO: 2916914 - protein, 8 aa, Entamoeba invadens
TSKKERKF

SEQ ID NO: 2916915 - protein, 11 aa, Entamoeba invadens
TSKKKNTLKQC

SEQ ID NO: 2916916 - protein, 7 aa, Entamoeba invadens
TSKKNVQ

SEQ ID NO: 2916917 - protein, 9 aa, Entamoeba invadens
TSKKPTGVE

SEQ ID NO: 2916918 - protein, 7 aa, Entamoeba invadens
TSKKTGT

SEQ ID NO: 2916919 - protein, 11 aa, Entamoeba invadens
TSKKTQNSAEE

SEQ ID NO: 2916920 - protein, 6 aa, Entamoeba invadens
TSKKYN

SEQ ID NO: 2916921 - protein, 8 aa, Entamoeba invadens
TSKLATKV

SEQ ID NO: 2916922 - protein, 22 aa, Entamoeba invadens
TSKLQSKSKKGSDSKVDKLLMT

SEQ ID NO: 2916923 - protein, 9 aa, Entamoeba invadens
TSKMTKAQQ

SEQ ID NO: 2916924 - protein, 4 aa, Entamoeba invadens
TSKN

SEQ ID NO: 2916925 - protein, 8 aa, Entamoeba invadens
TSKNEKSL

SEQ ID NO: 2916926 - protein, 31 aa, Entamoeba invadens
TSKNERTTQLEKKQKQENDEKDTDDIECSSV

SEQ ID NO: 2916927 - protein, 7 aa, Entamoeba invadens
TSKNFTA

SEQ ID NO: 2916928 - protein, 15 aa, Entamoeba invadens
TSKNLDELRGHSGPI

SEQ ID NO: 2916929 - protein, 18 aa, Entamoeba invadens
TSKNPEVVAQKKSEWNSF

SEQ ID NO: 2916930 - protein, 6 aa, Entamoeba invadens
TSKNRI

SEQ ID NO: 2916931 - protein, 7 aa, Entamoeba invadens
TSKNRSI

SEQ ID NO: 2916932 - protein, 6 aa, Entamoeba invadens
TSKPAT

SEQ ID NO: 2916933 - protein, 5 aa, Entamoeba invadens
TSKQF

SEQ ID NO: 2916934 - protein, 8 aa, Entamoeba invadens
TSKQINTN

SEQ ID NO: 2916935 - protein, 5 aa, Entamoeba invadens
TSKQL

SEQ ID NO: 2916936 - protein, 33 aa, Entamoeba invadens
TSKQTKEKKPRKAQQPLKHEKSVKLNKTTRKET

SEQ ID NO: 2916937 - protein, 4 aa, Entamoeba invadens
TSKR

SEQ ID NO: 2916938 - protein, 7 aa, Entamoeba invadens
TSKSAKK

SEQ ID NO: 2916939 - protein, 8 aa, Entamoeba invadens
TSKSDIEK

SEQ ID NO: 2916940 - protein, 9 aa, Entamoeba invadens
TSKSPQQCK

SEQ ID NO: 2916941 - protein, 8 aa, Entamoeba invadens
TSKSPQYY

SEQ ID NO: 2916942 - protein, 16 aa, Entamoeba invadens
TSKSQGKNGIAKSETI

SEQ ID NO: 2916943 - protein, 5 aa, Entamoeba invadens
TSKSR

SEQ ID NO: 2916944 - protein, 8 aa, Entamoeba invadens
TSKSSMES

SEQ ID NO: 2916945 - protein, 9 aa, Entamoeba invadens
TSKSTLEST

SEQ ID NO: 2916946 - protein, 7 aa, Entamoeba invadens
TSKTASF

SEQ ID NO: 2916947 - protein, 9 aa, Entamoeba invadens
TSKTDTETV

SEQ ID NO: 2916948 - protein, 8 aa, Entamoeba invadens
TSKTIENK

SEQ ID NO: 2916949 - protein, 7 aa, Entamoeba invadens
TSKTKEV

SEQ ID NO: 2916950 - protein, 7 aa, Entamoeba invadens
TSKTNEK

SEQ ID NO: 2916951 - protein, 9 aa, Entamoeba invadens
TSKTPNIEE

SEQ ID NO: 2916952 - protein, 6 aa, Entamoeba invadens
TSKTPR

SEQ ID NO: 2916953 - protein, 13 aa, Entamoeba invadens
TSKTQDLCNTQTS

SEQ ID NO: 2916954 - protein, 11 aa, Entamoeba invadens
TSKTSSDKKIS

SEQ ID NO: 2916955 - protein, 6 aa, Entamoeba invadens
TSKTVH

SEQ ID NO: 2916956 - protein, 10 aa, Entamoeba invadens
TSKVDVSRDG

SEQ ID NO: 2916957 - protein, 7 aa, Entamoeba invadens
TSKVKGD

SEQ ID NO: 2916958 - protein, 7 aa, Entamoeba invadens
TSKVNHK

SEQ ID NO: 2916959 - protein, 36 aa, Entamoeba invadens
TSKYQHDEKFEKENNKISQEKTYKKIQPHEKERNDR

SEQ ID NO: 2916960 - protein, 11 aa, Entamoeba invadens
TSKYSSDYSNS

SEQ ID NO: 2916961 - protein, 18 aa, Entamoeba invadens
TSLAPSQVQTTPAEYEGP

SEQ ID NO: 2916962 - protein, 16 aa, Entamoeba invadens
TSLAQNPKQETKIEKV

SEQ ID NO: 2916963 - protein, 7 aa, Entamoeba invadens
TSLDASQ

SEQ ID NO: 2916964 - protein, 4 aa, Entamoeba invadens
TSLE

SEQ ID NO: 2916965 - protein, 6 aa, Entamoeba invadens
TSLEKT

SEQ ID NO: 2916966 - protein, 6 aa, Entamoeba invadens
TSLENN

SEQ ID NO: 2916967 - protein, 18 aa, Entamoeba invadens
TSLEQKIDTTTQTIQTET

SEQ ID NO: 2916968 - protein, 4 aa, Entamoeba invadens
TSLG

SEQ ID NO: 2916969 - protein, 8 aa, Entamoeba invadens
TSLGDDRK

SEQ ID NO: 2916970 - protein, 6 aa, Entamoeba invadens
TSLGEE

SEQ ID NO: 2916971 - protein, 9 aa, Entamoeba invadens
TSLGESQEC

SEQ ID NO: 2916972 - protein, 7 aa, Entamoeba invadens
TSLGSTI

SEQ ID NO: 2916973 - protein, 6 aa, Entamoeba invadens
TSLHTT

SEQ ID NO: 2916974 - protein, 10 aa, Entamoeba invadens
TSLKEDTAKF

SEQ ID NO: 2916975 - protein, 20 aa, Entamoeba invadens
TSLKNRTNLGRQRNQKEDKK

SEQ ID NO: 2916976 - protein, 15 aa, Entamoeba invadens
TSLKRKVKSVESPFQ

SEQ ID NO: 2916977 - protein, 4 aa, Entamoeba invadens
TSLN

SEQ ID NO: 2916978 - protein, 4 aa, Entamoeba invadens
TSLP

SEQ ID NO: 2916979 - protein, 5 aa, Entamoeba invadens
TSLPF

SEQ ID NO: 2916980 - protein, 8 aa, Entamoeba invadens
TSLPLSDR

SEQ ID NO: 2916981 - protein, 7 aa, Entamoeba invadens
TSLPPHY

SEQ ID NO: 2916982 - protein, 7 aa, Entamoeba invadens
TSLPPPH

SEQ ID NO: 2916983 - protein, 6 aa, Entamoeba invadens
TSLPSP

SEQ ID NO: 2916984 - protein, 4 aa, Entamoeba invadens
TSLQ

SEQ ID NO: 2916985 - protein, 6 aa, Entamoeba invadens
TSLRNP

SEQ ID NO: 2916986 - protein, 9 aa, Entamoeba invadens
TSLSKDKKT

SEQ ID NO: 2916987 - protein, 6 aa, Entamoeba invadens
TSLSKR

SEQ ID NO: 2916988 - protein, 5 aa, Entamoeba invadens
TSLSP

SEQ ID NO: 2916989 - protein, 11 aa, Entamoeba invadens
TSLSRKKEKIE

SEQ ID NO: 2916990 - protein, 6 aa, Entamoeba invadens
TSLSSL

SEQ ID NO: 2916991 - protein, 10 aa, Entamoeba invadens
TSLTQQPHPD

SEQ ID NO: 2916992 - protein, 17 aa, Entamoeba invadens
TSLTRARKRVPFKSMVS

SEQ ID NO: 2916993 - protein, 13 aa, Entamoeba invadens
TSLTRSKEDQDKF

SEQ ID NO: 2916994 - protein, 13 aa, Entamoeba invadens
TSLTRSKEDQEKF

SEQ ID NO: 2916995 - protein, 5 aa, Entamoeba invadens
TSLTS

SEQ ID NO: 2916996 - protein, 4 aa, Entamoeba invadens
TSLY

SEQ ID NO: 2916997 - protein, 6 aa, Entamoeba invadens
TSLYPH

SEQ ID NO: 2916998 - protein, 10 aa, Entamoeba invadens
TSMGTNFTKT

SEQ ID NO: 2916999 - protein, 4 aa, Entamoeba invadens
TSMK

SEQ ID NO: 2917000 - protein, 11 aa, Entamoeba invadens
TSMSSRKNEIM

SEQ ID NO: 2917001 - protein, 18 aa, Entamoeba invadens
TSMTERDGSGRNDMERSI

SEQ ID NO: 2917002 - protein, 8 aa, Entamoeba invadens
TSNANDDY

SEQ ID NO: 2917003 - protein, 8 aa, Entamoeba invadens
TSNASKGY

SEQ ID NO: 2917004 - protein, 7 aa, Entamoeba invadens
TSNDGTA

SEQ ID NO: 2917005 - protein, 7 aa, Entamoeba invadens
TSNDRAD

SEQ ID NO: 2917006 - protein, 15 aa, Entamoeba invadens
TSNDSEHSTSDAEIR

SEQ ID NO: 2917007 - protein, 5 aa, Entamoeba invadens
TSNDV

SEQ ID NO: 2917008 - protein, 4 aa, Entamoeba invadens
TSNE

SEQ ID NO: 2917009 - protein, 5 aa, Entamoeba invadens
TSNEF

SEQ ID NO: 2917010 - protein, 5 aa, Entamoeba invadens
TSNEI

SEQ ID NO: 2917011 - protein, 21 aa, Entamoeba invadens
TSNEQDEFKDSSSSNTDTSYD

SEQ ID NO: 2917012 - protein, 11 aa, Entamoeba invadens
TSNETGQSLDQ

SEQ ID NO: 2917013 - protein, 5 aa, Entamoeba invadens
TSNFN

SEQ ID NO: 2917014 - protein, 12 aa, Entamoeba invadens
TSNFSSRLFYGI

SEQ ID NO: 2917015 - protein, 5 aa, Entamoeba invadens
TSNGD

SEQ ID NO: 2917016 - protein, 6 aa, Entamoeba invadens
TSNGGN

SEQ ID NO: 2917017 - protein, 9 aa, Entamoeba invadens
TSNGPCPKS

SEQ ID NO: 2917018 - protein, 16 aa, Entamoeba invadens
TSNGSVVNKFEQLYQS

SEQ ID NO: 2917019 - protein, 10 aa, Entamoeba invadens
TSNGVNSGTI

SEQ ID NO: 2917020 - protein, 4 aa, Entamoeba invadens
TSNH

SEQ ID NO: 2917021 - protein, 15 aa, Entamoeba invadens
TSNIDKTKVIKKDNQ

SEQ ID NO: 2917022 - protein, 9 aa, Entamoeba invadens
TSNIEKDIS

SEQ ID NO: 2917023 - protein, 6 aa, Entamoeba invadens
TSNISS

SEQ ID NO: 2917024 - protein, 6 aa, Entamoeba invadens
TSNITK

SEQ ID NO: 2917025 - protein, 9 aa, Entamoeba invadens
TSNKDRAED

SEQ ID NO: 2917026 - protein, 5 aa, Entamoeba invadens
TSNKE

SEQ ID NO: 2917027 - protein, 8 aa, Entamoeba invadens
TSNKEFNE

SEQ ID NO: 2917028 - protein, 6 aa, Entamoeba invadens
TSNKEM

SEQ ID NO: 2917029 - protein, 8 aa, Entamoeba invadens
TSNKERDE

SEQ ID NO: 2917030 - protein, 6 aa, Entamoeba invadens
TSNKEV

SEQ ID NO: 2917031 - protein, 8 aa, Entamoeba invadens
TSNKGTQV

SEQ ID NO: 2917032 - protein, 8 aa, Entamoeba invadens
TSNKIFEK

SEQ ID NO: 2917033 - protein, 10 aa, Entamoeba invadens
TSNKSSLSGL

SEQ ID NO: 2917034 - protein, 14 aa, Entamoeba invadens
TSNKTPKNEENKEI

SEQ ID NO: 2917035 - protein, 4 aa, Entamoeba invadens
TSNN

SEQ ID NO: 2917036 - protein, 8 aa, Entamoeba invadens
TSNNEDVT

SEQ ID NO: 2917037 - protein, 6 aa, Entamoeba invadens
TSNNKF

SEQ ID NO: 2917038 - protein, 10 aa, Entamoeba invadens
TSNNSKPLKN

SEQ ID NO: 2917039 - protein, 12 aa, Entamoeba invadens
TSNPHPEGKTRE

SEQ ID NO: 2917040 - protein, 5 aa, Entamoeba invadens
TSNPN

SEQ ID NO: 2917041 - protein, 5 aa, Entamoeba invadens
TSNPS

SEQ ID NO: 2917042 - protein, 20 aa, Entamoeba invadens
TSNPTQAKMNARDYTRRFAH

SEQ ID NO: 2917043 - protein, 16 aa, Entamoeba invadens
TSNQATIGPYKTEEGL

SEQ ID NO: 2917044 - protein, 7 aa, Entamoeba invadens
TSNQTEI

SEQ ID NO: 2917045 - protein, 6 aa, Entamoeba invadens
TSNRGT

SEQ ID NO: 2917046 - protein, 7 aa, Entamoeba invadens
TSNRRSI

SEQ ID NO: 2917047 - protein, 7 aa, Entamoeba invadens
TSNRTLT

SEQ ID NO: 2917048 - protein, 6 aa, Entamoeba invadens
TSNSAI

SEQ ID NO: 2917049 - protein, 8 aa, Entamoeba invadens
TSNSPKTY

SEQ ID NO: 2917050 - protein, 13 aa, Entamoeba invadens
TSNSSKSKVKPTH

SEQ ID NO: 2917051 - protein, 18 aa, Entamoeba invadens
TSNTKHKKKDSASSEKVA

SEQ ID NO: 2917052 - protein, 12 aa, Entamoeba invadens
TSNTQTKTIQSL

SEQ ID NO: 2917053 - protein, 11 aa, Entamoeba invadens
TSNTTEFKSRP

SEQ ID NO: 2917054 - protein, 6 aa, Entamoeba invadens
TSNTTF

SEQ ID NO: 2917055 - protein, 14 aa, Entamoeba invadens
TSNVRKAEAENSNL

SEQ ID NO: 2917056 - protein, 10 aa, Entamoeba invadens
TSNYDKSVSQ

SEQ ID NO: 2917057 - protein, 7 aa, Entamoeba invadens
TSPAPMY

SEQ ID NO: 2917058 - protein, 5 aa, Entamoeba invadens
TSPAQ

SEQ ID NO: 2917059 - protein, 14 aa, Entamoeba invadens
TSPDDLSTTSSYTP

SEQ ID NO: 2917060 - protein, 8 aa, Entamoeba invadens
TSPDFRED

SEQ ID NO: 2917061 - protein, 9 aa, Entamoeba invadens
TSPDMNWTS

SEQ ID NO: 2917062 - protein, 6 aa, Entamoeba invadens
TSPDSI

SEQ ID NO: 2917063 - protein, 4 aa, Entamoeba invadens
TSPE

SEQ ID NO: 2917064 - protein, 10 aa, Entamoeba invadens
TSPEASGEHV

SEQ ID NO: 2917065 - protein, 6 aa, Entamoeba invadens
TSPEKI

SEQ ID NO: 2917066 - protein, 5 aa, Entamoeba invadens
TSPEL

SEQ ID NO: 2917067 - protein, 33 aa, Entamoeba invadens
TSPELPSPIRSQTLSPRIGSDASTIRKSSTEDL

SEQ ID NO: 2917068 - protein, 11 aa, Entamoeba invadens
TSPFFDDNESA

SEQ ID NO: 2917069 - protein, 5 aa, Entamoeba invadens
TSPFH

SEQ ID NO: 2917070 - protein, 8 aa, Entamoeba invadens
TSPGEHGF

SEQ ID NO: 2917071 - protein, 4 aa, Entamoeba invadens
TSPH

SEQ ID NO: 2917072 - protein, 5 aa, Entamoeba invadens
TSPID

SEQ ID NO: 2917073 - protein, 8 aa, Entamoeba invadens
TSPIGGGE

SEQ ID NO: 2917074 - protein, 43 aa, Entamoeba invadens
TSPIGKDKEEDKNKGSPNTKIKKEEITKKKKSAKLENLLKEYS

SEQ ID NO: 2917075 - protein, 6 aa, Entamoeba invadens
TSPINA

SEQ ID NO: 2917076 - protein, 13 aa, Entamoeba invadens
TSPINDGKRGLEL

SEQ ID NO: 2917077 - protein, 5 aa, Entamoeba invadens
TSPIT

SEQ ID NO: 2917078 - protein, 5 aa, Entamoeba invadens
TSPKD

SEQ ID NO: 2917079 - protein, 6 aa, Entamoeba invadens
TSPKGM

SEQ ID NO: 2917080 - protein, 37 aa, Entamoeba invadens
TSPKPEGSEAPTAVPRADSPLELDSRKSFGSTEESAQ

SEQ ID NO: 2917081 - protein, 11 aa, Entamoeba invadens
TSPKPSRTSPK

SEQ ID NO: 2917082 - protein, 9 aa, Entamoeba invadens
TSPKSLTSV

SEQ ID NO: 2917083 - protein, 8 aa, Entamoeba invadens
TSPKTTAA

SEQ ID NO: 2917084 - protein, 10 aa, Entamoeba invadens
TSPLEEESEE

SEQ ID NO: 2917085 - protein, 6 aa, Entamoeba invadens
TSPLKE

SEQ ID NO: 2917086 - protein, 7 aa, Entamoeba invadens
TSPLKEG

SEQ ID NO: 2917087 - protein, 5 aa, Entamoeba invadens
TSPLS

SEQ ID NO: 2917088 - protein, 5 aa, Entamoeba invadens
TSPNP

SEQ ID NO: 2917089 - protein, 8 aa, Entamoeba invadens
TSPNQNTI

SEQ ID NO: 2917090 - protein, 7 aa, Entamoeba invadens
TSPNSVK

SEQ ID NO: 2917091 - protein, 11 aa, Entamoeba invadens
TSPNVNTSAPK

SEQ ID NO: 2917092 - protein, 6 aa, Entamoeba invadens
TSPNWQ

SEQ ID NO: 2917093 - protein, 6 aa, Entamoeba invadens
TSPPEN

SEQ ID NO: 2917094 - protein, 7 aa, Entamoeba invadens
TSPPPYD

SEQ ID NO: 2917095 - protein, 8 aa, Entamoeba invadens
TSPPQPIS

SEQ ID NO: 2917096 - protein, 12 aa, Entamoeba invadens
TSPPSQKNRAVV

SEQ ID NO: 2917097 - protein, 9 aa, Entamoeba invadens
TSPQNYRTA

SEQ ID NO: 2917098 - protein, 16 aa, Entamoeba invadens
TSPSEVSEKKRDNKES

SEQ ID NO: 2917099 - protein, 10 aa, Entamoeba invadens
TSPSKDTANE

SEQ ID NO: 2917100 - protein, 7 aa, Entamoeba invadens
TSPSKKC

SEQ ID NO: 2917101 - protein, 10 aa, Entamoeba invadens
TSPSKPEDMP

SEQ ID NO: 2917102 - protein, 23 aa, Entamoeba invadens
TSPSLPSTEKKDLLRRKSPLECK

SEQ ID NO: 2917103 - protein, 7 aa, Entamoeba invadens
TSPSPIR

SEQ ID NO: 2917104 - protein, 21 aa, Entamoeba invadens
TSPSPRVRSSSLGKINEQKEW

SEQ ID NO: 2917105 - protein, 11 aa, Entamoeba invadens
TSPSYEKLRNR

SEQ ID NO: 2917106 - protein, 6 aa, Entamoeba invadens
TSPTKW

SEQ ID NO: 2917107 - protein, 5 aa, Entamoeba invadens
TSPTR

SEQ ID NO: 2917108 - protein, 7 aa, Entamoeba invadens
TSPTSKM

SEQ ID NO: 2917109 - protein, 17 aa, Entamoeba invadens
TSPTSKTCQKCSDFDSK

SEQ ID NO: 2917110 - protein, 30 aa, Entamoeba invadens
TSPTSNNEFSPNKKSLNSTPCIESSTELSV

SEQ ID NO: 2917111 - protein, 4 aa, Entamoeba invadens
TSPV

SEQ ID NO: 2917112 - protein, 5 aa, Entamoeba invadens
TSPVD

SEQ ID NO: 2917113 - protein, 14 aa, Entamoeba invadens
TSPVKSRKGSYSLD

SEQ ID NO: 2917114 - protein, 5 aa, Entamoeba invadens
TSPVQ

SEQ ID NO: 2917115 - protein, 4 aa, Entamoeba invadens
TSPY

SEQ ID NO: 2917116 - protein, 5 aa, Entamoeba invadens
TSPYT

SEQ ID NO: 2917117 - protein, 8 aa, Entamoeba invadens
TSQAPGSA

SEQ ID NO: 2917118 - protein, 13 aa, Entamoeba invadens
TSQAQKEQKQEEI

SEQ ID NO: 2917119 - protein, 8 aa, Entamoeba invadens
TSQDPSIK

SEQ ID NO: 2917120 - protein, 10 aa, Entamoeba invadens
TSQDSNRASP

SEQ ID NO: 2917121 - protein, 10 aa, Entamoeba invadens
TSQGSSSYAI

SEQ ID NO: 2917122 - protein, 13 aa, Entamoeba invadens
TSQKEEKRDLEEF

SEQ ID NO: 2917123 - protein, 5 aa, Entamoeba invadens
TSQKR

SEQ ID NO: 2917124 - protein, 8 aa, Entamoeba invadens
TSQKRNYQ

SEQ ID NO: 2917125 - protein, 11 aa, Entamoeba invadens
TSQKSATKAVK

SEQ ID NO: 2917126 - protein, 7 aa, Entamoeba invadens
TSQLSKT

SEQ ID NO: 2917127 - protein, 8 aa, Entamoeba invadens
TSQNDEQK

SEQ ID NO: 2917128 - protein, 7 aa, Entamoeba invadens
TSQNNAP

SEQ ID NO: 2917129 - protein, 19 aa, Entamoeba invadens
TSQNNKKKMKNNTEECEDK

SEQ ID NO: 2917130 - protein, 9 aa, Entamoeba invadens
TSQNSSSRG

SEQ ID NO: 2917131 - protein, 8 aa, Entamoeba invadens
TSQNTRSI

SEQ ID NO: 2917132 - protein, 5 aa, Entamoeba invadens
TSQPK

SEQ ID NO: 2917133 - protein, 4 aa, Entamoeba invadens
TSQQ

SEQ ID NO: 2917134 - protein, 12 aa, Entamoeba invadens
TSQQMKTNTERI

SEQ ID NO: 2917135 - protein, 9 aa, Entamoeba invadens
TSQQNKGNF

SEQ ID NO: 2917136 - protein, 9 aa, Entamoeba invadens
TSQQPAINE

SEQ ID NO: 2917137 - protein, 8 aa, Entamoeba invadens
TSQREHPL

SEQ ID NO: 2917138 - protein, 5 aa, Entamoeba invadens
TSQRH

SEQ ID NO: 2917139 - protein, 7 aa, Entamoeba invadens
TSQSDEH

SEQ ID NO: 2917140 - protein, 8 aa, Entamoeba invadens
TSQSDKDL

SEQ ID NO: 2917141 - protein, 12 aa, Entamoeba invadens
TSQSDSNTNNDA

SEQ ID NO: 2917142 - protein, 8 aa, Entamoeba invadens
TSQSEVPK

SEQ ID NO: 2917143 - protein, 7 aa, Entamoeba invadens
TSQSLND

SEQ ID NO: 2917144 - protein, 5 aa, Entamoeba invadens
TSQSN

SEQ ID NO: 2917145 - protein, 9 aa, Entamoeba invadens
TSQSPAVSY

SEQ ID NO: 2917146 - protein, 14 aa, Entamoeba invadens
TSQSPEKLESETSE

SEQ ID NO: 2917147 - protein, 24 aa, Entamoeba invadens
TSQSPSPKSTAISSHKHTTSQPFD

SEQ ID NO: 2917148 - protein, 8 aa, Entamoeba invadens
TSQSTRID

SEQ ID NO: 2917149 - protein, 9 aa, Entamoeba invadens
TSQTGEEPC

SEQ ID NO: 2917150 - protein, 9 aa, Entamoeba invadens
TSQTPNEIT

SEQ ID NO: 2917151 - protein, 7 aa, Entamoeba invadens
TSQTTNL

SEQ ID NO: 2917152 - protein, 5 aa, Entamoeba invadens
TSQVQ

SEQ ID NO: 2917153 - protein, 5 aa, Entamoeba invadens
TSRAE

SEQ ID NO: 2917154 - protein, 6 aa, Entamoeba invadens
TSRAIA

SEQ ID NO: 2917155 - protein, 12 aa, Entamoeba invadens
TSRAKQSSLNFP

SEQ ID NO: 2917156 - protein, 4 aa, Entamoeba invadens
TSRD

SEQ ID NO: 2917157 - protein, 9 aa, Entamoeba invadens
TSRDKSDIV

SEQ ID NO: 2917158 - protein, 13 aa, Entamoeba invadens
TSRDPSSKLKEFS

SEQ ID NO: 2917159 - protein, 7 aa, Entamoeba invadens
TSRDSTR

SEQ ID NO: 2917160 - protein, 4 aa, Entamoeba invadens
TSRE

SEQ ID NO: 2917161 - protein, 7 aa, Entamoeba invadens
TSREESN

SEQ ID NO: 2917162 - protein, 5 aa, Entamoeba invadens
TSREG

SEQ ID NO: 2917163 - protein, 19 aa, Entamoeba invadens
TSRGNGRGVYTGKDKALAN

SEQ ID NO: 2917164 - protein, 6 aa, Entamoeba invadens
TSRGRC

SEQ ID NO: 2917165 - protein, 4 aa, Entamoeba invadens
TSRH

SEQ ID NO: 2917166 - protein, 10 aa, Entamoeba invadens
TSRLGQGYHG

SEQ ID NO: 2917167 - protein, 6 aa, Entamoeba invadens
TSRNDT

SEQ ID NO: 2917168 - protein, 7 aa, Entamoeba invadens
TSRNGTG

SEQ ID NO: 2917169 - protein, 4 aa, Entamoeba invadens
TSRP

SEQ ID NO: 2917170 - protein, 4 aa, Entamoeba invadens
TSRQ

SEQ ID NO: 2917171 - protein, 6 aa, Entamoeba invadens
TSRRDN

SEQ ID NO: 2917172 - protein, 10 aa, Entamoeba invadens
TSRRYKAANP

SEQ ID NO: 2917173 - protein, 6 aa, Entamoeba invadens
TSRSDQ

SEQ ID NO: 2917174 - protein, 6 aa, Entamoeba invadens
TSRSFK

SEQ ID NO: 2917175 - protein, 13 aa, Entamoeba invadens
TSRSFSGVANRHL

SEQ ID NO: 2917176 - protein, 5 aa, Entamoeba invadens
TSRSS

SEQ ID NO: 2917177 - protein, 11 aa, Entamoeba invadens
TSRTEPSQYEK

SEQ ID NO: 2917178 - protein, 7 aa, Entamoeba invadens
TSRTKVD

SEQ ID NO: 2917179 - protein, 8 aa, Entamoeba invadens
TSRTRQGQ

SEQ ID NO: 2917180 - protein, 7 aa, Entamoeba invadens
TSRYPEA

SEQ ID NO: 2917181 - protein, 6 aa, Entamoeba invadens
TSRYTE

SEQ ID NO: 2917182 - protein, 11 aa, Entamoeba invadens
TSSAERKRQRM

SEQ ID NO: 2917183 - protein, 14 aa, Entamoeba invadens
TSSAIRNKITENTF

SEQ ID NO: 2917184 - protein, 8 aa, Entamoeba invadens
TSSARLQE

SEQ ID NO: 2917185 - protein, 10 aa, Entamoeba invadens
TSSATLEQSA

SEQ ID NO: 2917186 - protein, 4 aa, Entamoeba invadens
TSSC

SEQ ID NO: 2917187 - protein, 6 aa, Entamoeba invadens
TSSDDL

SEQ ID NO: 2917188 - protein, 8 aa, Entamoeba invadens
TSSDEEPL

SEQ ID NO: 2917189 - protein, 6 aa, Entamoeba invadens
TSSDEI

SEQ ID NO: 2917190 - protein, 7 aa, Entamoeba invadens
TSSDGAI

SEQ ID NO: 2917191 - protein, 9 aa, Entamoeba invadens
TSSDPIQSI

SEQ ID NO: 2917192 - protein, 11 aa, Entamoeba invadens
TSSEEKSPMEE

SEQ ID NO: 2917193 - protein, 6 aa, Entamoeba invadens
TSSEEV

SEQ ID NO: 2917194 - protein, 6 aa, Entamoeba invadens
TSSEEW

SEQ ID NO: 2917195 - protein, 19 aa, Entamoeba invadens
TSSEFTNTKAMQDPFFGDA

SEQ ID NO: 2917196 - protein, 6 aa, Entamoeba invadens
TSSEHP

SEQ ID NO: 2917197 - protein, 10 aa, Entamoeba invadens
TSSELKTDPL

SEQ ID NO: 2917198 - protein, 27 aa, Entamoeba invadens
TSSFDDARTEKSSNSEERRSEKGERIE

SEQ ID NO: 2917199 - protein, 6 aa, Entamoeba invadens
TSSFEN

SEQ ID NO: 2917200 - protein, 7 aa, Entamoeba invadens
TSSFQSY

SEQ ID NO: 2917201 - protein, 5 aa, Entamoeba invadens
TSSGA

SEQ ID NO: 2917202 - protein, 8 aa, Entamoeba invadens
TSSGDNTY

SEQ ID NO: 2917203 - protein, 7 aa, Entamoeba invadens
TSSGDSV

SEQ ID NO: 2917204 - protein, 6 aa, Entamoeba invadens
TSSGQD

SEQ ID NO: 2917205 - protein, 12 aa, Entamoeba invadens
TSSGSTKGEAVK

SEQ ID NO: 2917206 - protein, 6 aa, Entamoeba invadens
TSSGWE

SEQ ID NO: 2917207 - protein, 4 aa, Entamoeba invadens
TSSH

SEQ ID NO: 2917208 - protein, 7 aa, Entamoeba invadens
TSSHFKS

SEQ ID NO: 2917209 - protein, 4 aa, Entamoeba invadens
TSSI

SEQ ID NO: 2917210 - protein, 8 aa, Entamoeba invadens
TSSIAQNE

SEQ ID NO: 2917211 - protein, 9 aa, Entamoeba invadens
TSSKASEKR

SEQ ID NO: 2917212 - protein, 5 aa, Entamoeba invadens
TSSKD

SEQ ID NO: 2917213 - protein, 7 aa, Entamoeba invadens
TSSKDGY

SEQ ID NO: 2917214 - protein, 10 aa, Entamoeba invadens
TSSKDQSLPL

SEQ ID NO: 2917215 - protein, 11 aa, Entamoeba invadens
TSSKDSKRVKA

SEQ ID NO: 2917216 - protein, 7 aa, Entamoeba invadens
TSSKGLN

SEQ ID NO: 2917217 - protein, 10 aa, Entamoeba invadens
TSSKKDLNID

SEQ ID NO: 2917218 - protein, 6 aa, Entamoeba invadens
TSSKKW

SEQ ID NO: 2917219 - protein, 14 aa, Entamoeba invadens
TSSKMKKEKKGNYE

SEQ ID NO: 2917220 - protein, 28 aa, Entamoeba invadens
TSSKPSSHKSSKKIKKSEAPSQPSYPRE

SEQ ID NO: 2917221 - protein, 8 aa, Entamoeba invadens
TSSKRLPV

SEQ ID NO: 2917222 - protein, 10 aa, Entamoeba invadens
TSSKTGKGVD

SEQ ID NO: 2917223 - protein, 22 aa, Entamoeba invadens
TSSKYGHSRFQTTAEKKARLGA

SEQ ID NO: 2917224 - protein, 4 aa, Entamoeba invadens
TSSL

SEQ ID NO: 2917225 - protein, 6 aa, Entamoeba invadens
TSSLEN

SEQ ID NO: 2917226 - protein, 6 aa, Entamoeba invadens
TSSLNK

SEQ ID NO: 2917227 - protein, 17 aa, Entamoeba invadens
TSSLTDTKFKDDLSQTL

SEQ ID NO: 2917228 - protein, 19 aa, Entamoeba invadens
TSSMNESDNSYTPQEQNEL

SEQ ID NO: 2917229 - protein, 14 aa, Entamoeba invadens
TSSMNNKTERSARS

SEQ ID NO: 2917230 - protein, 9 aa, Entamoeba invadens
TSSNATDKR

SEQ ID NO: 2917231 - protein, 7 aa, Entamoeba invadens
TSSNGTF

SEQ ID NO: 2917232 - protein, 15 aa, Entamoeba invadens
TSSNTISDQNTYSDL

SEQ ID NO: 2917233 - protein, 5 aa, Entamoeba invadens
TSSNV

SEQ ID NO: 2917234 - protein, 9 aa, Entamoeba invadens
TSSNYPTEE

SEQ ID NO: 2917235 - protein, 20 aa, Entamoeba invadens
TSSPNPTDAPQAITNNTIDS

SEQ ID NO: 2917236 - protein, 18 aa, Entamoeba invadens
TSSQNLTSSTPKSGLVPE

SEQ ID NO: 2917237 - protein, 4 aa, Entamoeba invadens
TSSR

SEQ ID NO: 2917238 - protein, 8 aa, Entamoeba invadens
TSSRDRTI

SEQ ID NO: 2917239 - protein, 7 aa, Entamoeba invadens
TSSRGTL

SEQ ID NO: 2917240 - protein, 11 aa, Entamoeba invadens
TSSRKKKNTAF

SEQ ID NO: 2917241 - protein, 10 aa, Entamoeba invadens
TSSRSLQLGD

SEQ ID NO: 2917242 - protein, 8 aa, Entamoeba invadens
TSSSENQS

SEQ ID NO: 2917243 - protein, 10 aa, Entamoeba invadens
TSSSFGGSDI

SEQ ID NO: 2917244 - protein, 5 aa, Entamoeba invadens
TSSSQ

SEQ ID NO: 2917245 - protein, 30 aa, Entamoeba invadens
TSSSSEHSENEDEYDDEDEDEDEENADPYY

SEQ ID NO: 2917246 - protein, 8 aa, Entamoeba invadens
TSSSSTQL

SEQ ID NO: 2917247 - protein, 6 aa, Entamoeba invadens
TSSSTL

SEQ ID NO: 2917248 - protein, 8 aa, Entamoeba invadens
TSSTDGSY

SEQ ID NO: 2917249 - protein, 5 aa, Entamoeba invadens
TSSTH

SEQ ID NO: 2917250 - protein, 6 aa, Entamoeba invadens
TSSTPL

SEQ ID NO: 2917251 - protein, 9 aa, Entamoeba invadens
TSSTSEAKA

SEQ ID NO: 2917252 - protein, 7 aa, Entamoeba invadens
TSSTTPH

SEQ ID NO: 2917253 - protein, 5 aa, Entamoeba invadens
TSTAF

SEQ ID NO: 2917254 - protein, 6 aa, Entamoeba invadens
TSTAFR

SEQ ID NO: 2917255 - protein, 10 aa, Entamoeba invadens
TSTAQRSKSV

SEQ ID NO: 2917256 - protein, 4 aa, Entamoeba invadens
TSTD

SEQ ID NO: 2917257 - protein, 5 aa, Entamoeba invadens
TSTDG

SEQ ID NO: 2917258 - protein, 11 aa, Entamoeba invadens
TSTDGKAQPLT

SEQ ID NO: 2917259 - protein, 10 aa, Entamoeba invadens
TSTDSPFVGE

SEQ ID NO: 2917260 - protein, 26 aa, Entamoeba invadens
TSTENREELSRDQSNSSVNVHEENEI

SEQ ID NO: 2917261 - protein, 11 aa, Entamoeba invadens
TSTETFTPGEL

SEQ ID NO: 2917262 - protein, 14 aa, Entamoeba invadens
TSTETKKEETDAEV

SEQ ID NO: 2917263 - protein, 16 aa, Entamoeba invadens
TSTETVGKGTSASLAR

SEQ ID NO: 2917264 - protein, 4 aa, Entamoeba invadens
TSTF

SEQ ID NO: 2917265 - protein, 13 aa, Entamoeba invadens
TSTFEASSTPELS

SEQ ID NO: 2917266 - protein, 6 aa, Entamoeba invadens
TSTGEV

SEQ ID NO: 2917267 - protein, 5 aa, Entamoeba invadens
TSTGN

SEQ ID NO: 2917268 - protein, 7 aa, Entamoeba invadens
TSTGRHT

SEQ ID NO: 2917269 - protein, 7 aa, Entamoeba invadens
TSTHQDT

SEQ ID NO: 2917270 - protein, 12 aa, Entamoeba invadens
TSTHSNLMTIKM

SEQ ID NO: 2917271 - protein, 5 aa, Entamoeba invadens
TSTHT

SEQ ID NO: 2917272 - protein, 4 aa, Entamoeba invadens
TSTI

SEQ ID NO: 2917273 - protein, 10 aa, Entamoeba invadens
TSTIQDENGR

SEQ ID NO: 2917274 - protein, 5 aa, Entamoeba invadens
TSTIR

SEQ ID NO: 2917275 - protein, 10 aa, Entamoeba invadens
TSTKDRGTYA

SEQ ID NO: 2917276 - protein, 8 aa, Entamoeba invadens
TSTKKHPE

SEQ ID NO: 2917277 - protein, 18 aa, Entamoeba invadens
TSTKLPPAPSVKKDRYKV

SEQ ID NO: 2917278 - protein, 14 aa, Entamoeba invadens
TSTKNTKAKRNSTN

SEQ ID NO: 2917279 - protein, 6 aa, Entamoeba invadens
TSTKQL

SEQ ID NO: 2917280 - protein, 4 aa, Entamoeba invadens
TSTL

SEQ ID NO: 2917281 - protein, 15 aa, Entamoeba invadens
TSTLAISPTKDRTAI

SEQ ID NO: 2917282 - protein, 5 aa, Entamoeba invadens
TSTLS

SEQ ID NO: 2917283 - protein, 43 aa, Entamoeba invadens
TSTLSSSARPLSKGKSSFFEENKSRKDDDSKIGFDSDKKITGF

SEQ ID NO: 2917284 - protein, 13 aa, Entamoeba invadens
TSTNELKKDNAEI

SEQ ID NO: 2917285 - protein, 6 aa, Entamoeba invadens
TSTNNK

SEQ ID NO: 2917286 - protein, 6 aa, Entamoeba invadens
TSTNSG

SEQ ID NO: 2917287 - protein, 7 aa, Entamoeba invadens
TSTNSYV

SEQ ID NO: 2917288 - protein, 42 aa, Entamoeba invadens
TSTNTPQGTLSSETNTPSNQITQQPTVTTGESVGTNSINANN

SEQ ID NO: 2917289 - protein, 9 aa, Entamoeba invadens
TSTNVDDPK

SEQ ID NO: 2917290 - protein, 10 aa, Entamoeba invadens
TSTPFRTSAT

SEQ ID NO: 2917291 - protein, 8 aa, Entamoeba invadens
TSTPPQRL

SEQ ID NO: 2917292 - protein, 9 aa, Entamoeba invadens
TSTPQKIKT

SEQ ID NO: 2917293 - protein, 15 aa, Entamoeba invadens
TSTPVLSPTPMSPKP

SEQ ID NO: 2917294 - protein, 8 aa, Entamoeba invadens
TSTQKDVP

SEQ ID NO: 2917295 - protein, 5 aa, Entamoeba invadens
TSTQN

SEQ ID NO: 2917296 - protein, 6 aa, Entamoeba invadens
TSTQNR

SEQ ID NO: 2917297 - protein, 9 aa, Entamoeba invadens
TSTQPKDFI

SEQ ID NO: 2917298 - protein, 11 aa, Entamoeba invadens
TSTQTCKNTNV

SEQ ID NO: 2917299 - protein, 7 aa, Entamoeba invadens
TSTRQSE

SEQ ID NO: 2917300 - protein, 6 aa, Entamoeba invadens
TSTRYR

SEQ ID NO: 2917301 - protein, 4 aa, Entamoeba invadens
TSTS

SEQ ID NO: 2917302 - protein, 17 aa, Entamoeba invadens
TSTSATKRCCGGNSKDV

SEQ ID NO: 2917303 - protein, 6 aa, Entamoeba invadens
TSTSEE

SEQ ID NO: 2917304 - protein, 5 aa, Entamoeba invadens
TSTSL

SEQ ID NO: 2917305 - protein, 17 aa, Entamoeba invadens
TSTSVTPRMYRENISDA

SEQ ID NO: 2917306 - protein, 28 aa, Entamoeba invadens
TSTSWSQWEKQKDSFKAPKTDDKDPQAG

SEQ ID NO: 2917307 - protein, 7 aa, Entamoeba invadens
TSTTDQN

SEQ ID NO: 2917308 - protein, 6 aa, Entamoeba invadens
TSTTFD

SEQ ID NO: 2917309 - protein, 5 aa, Entamoeba invadens
TSTTH

SEQ ID NO: 2917310 - protein, 14 aa, Entamoeba invadens
TSTTHNNIQTHEDI

SEQ ID NO: 2917311 - protein, 7 aa, Entamoeba invadens
TSTTKEV

SEQ ID NO: 2917312 - protein, 7 aa, Entamoeba invadens
TSTTQTP

SEQ ID NO: 2917313 - protein, 5 aa, Entamoeba invadens
TSTVP

SEQ ID NO: 2917314 - protein, 5 aa, Entamoeba invadens
TSTYT

SEQ ID NO: 2917315 - protein, 5 aa, Entamoeba invadens
TSVAA

SEQ ID NO: 2917316 - protein, 11 aa, Entamoeba invadens
TSVAGNSISET

SEQ ID NO: 2917317 - protein, 10 aa, Entamoeba invadens
TSVANSTPNF

SEQ ID NO: 2917318 - protein, 5 aa, Entamoeba invadens
TSVDD

SEQ ID NO: 2917319 - protein, 6 aa, Entamoeba invadens
TSVDSF

SEQ ID NO: 2917320 - protein, 4 aa, Entamoeba invadens
TSVE

SEQ ID NO: 2917321 - protein, 21 aa, Entamoeba invadens
TSVEHQKTLQEGSGGASKSVS

SEQ ID NO: 2917322 - protein, 24 aa, Entamoeba invadens
TSVENSFKKSQKTCVGSGGKSDKF

SEQ ID NO: 2917323 - protein, 9 aa, Entamoeba invadens
TSVERSDGL

SEQ ID NO: 2917324 - protein, 8 aa, Entamoeba invadens
TSVGGETL

SEQ ID NO: 2917325 - protein, 13 aa, Entamoeba invadens
TSVGSIAGGGRYD

SEQ ID NO: 2917326 - protein, 26 aa, Entamoeba invadens
TSVHGNGAAPSKECGTRLNNGSDTFQ

SEQ ID NO: 2917327 - protein, 7 aa, Entamoeba invadens
TSVHQEQ

SEQ ID NO: 2917328 - protein, 4 aa, Entamoeba invadens
TSVK

SEQ ID NO: 2917329 - protein, 5 aa, Entamoeba invadens
TSVKG

SEQ ID NO: 2917330 - protein, 173 aa, Entamoeba invadens
TSVKGGKAPQQNQCGQYPPQQGGYGQYLPQQGQQQGGYAQQGAYPGYPPQGQQQGYPPQQGAYPPQQGAYGQPPQPAYPQQGYPPQQGGQNYPPQQQQGAYPGYPPQQGYGQQPQGQPAYSQQGYPPQQGGYGQYPPQQGYGQQQGYPPVQGGYGQQYGYPPQQGAYPPQQPS

SEQ ID NO: 2917331 - protein, 27 aa, Entamoeba invadens
TSVKSHYSLPDSNDTHVAQPHQVKKPP

SEQ ID NO: 2917332 - protein, 8 aa, Entamoeba invadens
TSVNEEKI

SEQ ID NO: 2917333 - protein, 7 aa, Entamoeba invadens
TSVQDSC

SEQ ID NO: 2917334 - protein, 14 aa, Entamoeba invadens
TSVQTRSGDYVLLF

SEQ ID NO: 2917335 - protein, 4 aa, Entamoeba invadens
TSVR

SEQ ID NO: 2917336 - protein, 11 aa, Entamoeba invadens
TSVRETIDSLK

SEQ ID NO: 2917337 - protein, 6 aa, Entamoeba invadens
TSVRSI

SEQ ID NO: 2917338 - protein, 10 aa, Entamoeba invadens
TSVSKDGNFQ

SEQ ID NO: 2917339 - protein, 5 aa, Entamoeba invadens
TSVSR

SEQ ID NO: 2917340 - protein, 9 aa, Entamoeba invadens
TSVSVNQKT

SEQ ID NO: 2917341 - protein, 17 aa, Entamoeba invadens
TSVTEINNKPLTSKSDM

SEQ ID NO: 2917342 - protein, 18 aa, Entamoeba invadens
TSVTKNIQNTIQESKRYI

SEQ ID NO: 2917343 - protein, 9 aa, Entamoeba invadens
TSVTSIQNN

SEQ ID NO: 2917344 - protein, 22 aa, Entamoeba invadens
TSWKDPREESAKVPQHVQRHSK

SEQ ID NO: 2917345 - protein, 7 aa, Entamoeba invadens
TSYDGVN

SEQ ID NO: 2917346 - protein, 9 aa, Entamoeba invadens
TSYEEKETN

SEQ ID NO: 2917347 - protein, 5 aa, Entamoeba invadens
TSYET

SEQ ID NO: 2917348 - protein, 4 aa, Entamoeba invadens
TSYG

SEQ ID NO: 2917349 - protein, 9 aa, Entamoeba invadens
TSYPPTSKS

SEQ ID NO: 2917350 - protein, 15 aa, Entamoeba invadens
TSYQVDTNSNSLPSL

SEQ ID NO: 2917351 - protein, 11 aa, Entamoeba invadens
TSYTKTGKNGV

SEQ ID NO: 2917352 - protein, 11 aa, Entamoeba invadens
TSYTKVGKNGI

SEQ ID NO: 2917353 - protein, 9 aa, Entamoeba invadens
TSYTQTTTL

SEQ ID NO: 2917354 - protein, 14 aa, Entamoeba invadens
TTADTIDEDFDSSS

SEQ ID NO: 2917355 - protein, 9 aa, Entamoeba invadens
TTAEHTKDE

SEQ ID NO: 2917356 - protein, 11 aa, Entamoeba invadens
TTAETDIKEDD

SEQ ID NO: 2917357 - protein, 10 aa, Entamoeba invadens
TTAGENPLKI

SEQ ID NO: 2917358 - protein, 37 aa, Entamoeba invadens
TTAIQSPRDLKSKKDSSATSLPLTPNSYSSKYSSFSE

SEQ ID NO: 2917359 - protein, 7 aa, Entamoeba invadens
TTAKEFK

SEQ ID NO: 2917360 - protein, 8 aa, Entamoeba invadens
TTAKETNP

SEQ ID NO: 2917361 - protein, 9 aa, Entamoeba invadens
TTAKPTELR

SEQ ID NO: 2917362 - protein, 20 aa, Entamoeba invadens
TTAKQTKQEVLQRPDSNLTT

SEQ ID NO: 2917363 - protein, 6 aa, Entamoeba invadens
TTAPDI

SEQ ID NO: 2917364 - protein, 9 aa, Entamoeba invadens
TTAPPPTRL

SEQ ID NO: 2917365 - protein, 5 aa, Entamoeba invadens
TTAPR

SEQ ID NO: 2917366 - protein, 13 aa, Entamoeba invadens
TTAPSTAIDPDEL

SEQ ID NO: 2917367 - protein, 12 aa, Entamoeba invadens
TTAQYTAKNGTD

SEQ ID NO: 2917368 - protein, 5 aa, Entamoeba invadens
TTARF

SEQ ID NO: 2917369 - protein, 10 aa, Entamoeba invadens
TTASKEEYDV

SEQ ID NO: 2917370 - protein, 6 aa, Entamoeba invadens
TTASPR

SEQ ID NO: 2917371 - protein, 9 aa, Entamoeba invadens
TTATPENNV

SEQ ID NO: 2917372 - protein, 5 aa, Entamoeba invadens
TTATS

SEQ ID NO: 2917373 - protein, 10 aa, Entamoeba invadens
TTATSITSEY

SEQ ID NO: 2917374 - protein, 10 aa, Entamoeba invadens
TTAVNSEESY

SEQ ID NO: 2917375 - protein, 19 aa, Entamoeba invadens
TTCERQTDRCTSCEEGYTI

SEQ ID NO: 2917376 - protein, 10 aa, Entamoeba invadens
TTCETSKKRF

SEQ ID NO: 2917377 - protein, 18 aa, Entamoeba invadens
TTCGGQCNTISGKCTGCQ

SEQ ID NO: 2917378 - protein, 7 aa, Entamoeba invadens
TTCGGSC

SEQ ID NO: 2917379 - protein, 17 aa, Entamoeba invadens
TTCGGSCDQTDGHCTSC

SEQ ID NO: 2917380 - protein, 17 aa, Entamoeba invadens
TTCGGSCDQTDGNCTSC

SEQ ID NO: 2917381 - protein, 10 aa, Entamoeba invadens
TTCKSGKGEV

SEQ ID NO: 2917382 - protein, 5 aa, Entamoeba invadens
TTCNT

SEQ ID NO: 2917383 - protein, 6 aa, Entamoeba invadens
TTCSQT

SEQ ID NO: 2917384 - protein, 5 aa, Entamoeba invadens
TTDAG

SEQ ID NO: 2917385 - protein, 5 aa, Entamoeba invadens
TTDAR

SEQ ID NO: 2917386 - protein, 11 aa, Entamoeba invadens
TTDDKNTKVDI

SEQ ID NO: 2917387 - protein, 6 aa, Entamoeba invadens
TTDDNK

SEQ ID NO: 2917388 - protein, 8 aa, Entamoeba invadens
TTDDRTYF

SEQ ID NO: 2917389 - protein, 9 aa, Entamoeba invadens
TTDDSTEHN

SEQ ID NO: 2917390 - protein, 5 aa, Entamoeba invadens
TTDEP

SEQ ID NO: 2917391 - protein, 7 aa, Entamoeba invadens
TTDERSN

SEQ ID NO: 2917392 - protein, 9 aa, Entamoeba invadens
TTDEVPEEA

SEQ ID NO: 2917393 - protein, 5 aa, Entamoeba invadens
TTDEY

SEQ ID NO: 2917394 - protein, 4 aa, Entamoeba invadens
TTDF

SEQ ID NO: 2917395 - protein, 5 aa, Entamoeba invadens
TTDFR

SEQ ID NO: 2917396 - protein, 11 aa, Entamoeba invadens
TTDGAATCAGL

SEQ ID NO: 2917397 - protein, 12 aa, Entamoeba invadens
TTDGAATCSGLD

SEQ ID NO: 2917398 - protein, 12 aa, Entamoeba invadens
TTDGAPAKLSGE

SEQ ID NO: 2917399 - protein, 17 aa, Entamoeba invadens
TTDGASVCSGLDGGHSV

SEQ ID NO: 2917400 - protein, 9 aa, Entamoeba invadens
TTDGDNFAN

SEQ ID NO: 2917401 - protein, 8 aa, Entamoeba invadens
TTDGGVSV

SEQ ID NO: 2917402 - protein, 8 aa, Entamoeba invadens
TTDGNGCS

SEQ ID NO: 2917403 - protein, 11 aa, Entamoeba invadens
TTDHRPSNPLE

SEQ ID NO: 2917404 - protein, 4 aa, Entamoeba invadens
TTDK

SEQ ID NO: 2917405 - protein, 5 aa, Entamoeba invadens
TTDKD

SEQ ID NO: 2917406 - protein, 10 aa, Entamoeba invadens
TTDKGETLAN

SEQ ID NO: 2917407 - protein, 6 aa, Entamoeba invadens
TTDKGK

SEQ ID NO: 2917408 - protein, 13 aa, Entamoeba invadens
TTDKHYRTNTFVI

SEQ ID NO: 2917409 - protein, 10 aa, Entamoeba invadens
TTDKLNEEIS

SEQ ID NO: 2917410 - protein, 9 aa, Entamoeba invadens
TTDKVAGDS

SEQ ID NO: 2917411 - protein, 15 aa, Entamoeba invadens
TTDKYGYKINGEAEP

SEQ ID NO: 2917412 - protein, 13 aa, Entamoeba invadens
TTDLDTKDVKLES

SEQ ID NO: 2917413 - protein, 6 aa, Entamoeba invadens
TTDMTK

SEQ ID NO: 2917414 - protein, 8 aa, Entamoeba invadens
TTDNHEKE

SEQ ID NO: 2917415 - protein, 8 aa, Entamoeba invadens
TTDNHSHN

SEQ ID NO: 2917416 - protein, 6 aa, Entamoeba invadens
TTDNIS

SEQ ID NO: 2917417 - protein, 10 aa, Entamoeba invadens
TTDNQEERKK

SEQ ID NO: 2917418 - protein, 8 aa, Entamoeba invadens
TTDPIKSP

SEQ ID NO: 2917419 - protein, 8 aa, Entamoeba invadens
TTDPKYPF

SEQ ID NO: 2917420 - protein, 4 aa, Entamoeba invadens
TTDQ

SEQ ID NO: 2917421 - protein, 5 aa, Entamoeba invadens
TTDQS

SEQ ID NO: 2917422 - protein, 30 aa, Entamoeba invadens
TTDRKNKITEKKNQKIEGSKRTRRANVNNR

SEQ ID NO: 2917423 - protein, 5 aa, Entamoeba invadens
TTDRN

SEQ ID NO: 2917424 - protein, 13 aa, Entamoeba invadens
TTDSEIPDMLLAL

SEQ ID NO: 2917425 - protein, 8 aa, Entamoeba invadens
TTDSISKD

SEQ ID NO: 2917426 - protein, 9 aa, Entamoeba invadens
TTDSSLSAE

SEQ ID NO: 2917427 - protein, 9 aa, Entamoeba invadens
TTDSTTSRS

SEQ ID NO: 2917428 - protein, 4 aa, Entamoeba invadens
TTDT

SEQ ID NO: 2917429 - protein, 7 aa, Entamoeba invadens
TTDTCST

SEQ ID NO: 2917430 - protein, 9 aa, Entamoeba invadens
TTDTESSLN

SEQ ID NO: 2917431 - protein, 12 aa, Entamoeba invadens
TTDTNHPPVEST

SEQ ID NO: 2917432 - protein, 9 aa, Entamoeba invadens
TTDTNKTDV

SEQ ID NO: 2917433 - protein, 9 aa, Entamoeba invadens
TTDVKSSIK

SEQ ID NO: 2917434 - protein, 18 aa, Entamoeba invadens
TTDVNEKTKISEQKEKVT

SEQ ID NO: 2917435 - protein, 7 aa, Entamoeba invadens
TTDVPSV

SEQ ID NO: 2917436 - protein, 4 aa, Entamoeba invadens
TTDY

SEQ ID NO: 2917437 - protein, 8 aa, Entamoeba invadens
TTEATDSE

SEQ ID NO: 2917438 - protein, 12 aa, Entamoeba invadens
TTEDEKDKIEKE

SEQ ID NO: 2917439 - protein, 9 aa, Entamoeba invadens
TTEDGTSIQ

SEQ ID NO: 2917440 - protein, 17 aa, Entamoeba invadens
TTEDIEKYGSKIPEEIS

SEQ ID NO: 2917441 - protein, 18 aa, Entamoeba invadens
TTEDRKKSKKRRKRVENN

SEQ ID NO: 2917442 - protein, 6 aa, Entamoeba invadens
TTEDSY

SEQ ID NO: 2917443 - protein, 16 aa, Entamoeba invadens
TTEDTTQVSQVDNDYE

SEQ ID NO: 2917444 - protein, 7 aa, Entamoeba invadens
TTEEEKI

SEQ ID NO: 2917445 - protein, 7 aa, Entamoeba invadens
TTEEGKK

SEQ ID NO: 2917446 - protein, 6 aa, Entamoeba invadens
TTEEGL

SEQ ID NO: 2917447 - protein, 8 aa, Entamoeba invadens
TTEEIDRS

SEQ ID NO: 2917448 - protein, 6 aa, Entamoeba invadens
TTEEIT

SEQ ID NO: 2917449 - protein, 5 aa, Entamoeba invadens
TTEEK

SEQ ID NO: 2917450 - protein, 8 aa, Entamoeba invadens
TTEEQINE

SEQ ID NO: 2917451 - protein, 6 aa, Entamoeba invadens
TTEESE

SEQ ID NO: 2917452 - protein, 11 aa, Entamoeba invadens
TTEETYAPKTE

SEQ ID NO: 2917453 - protein, 4 aa, Entamoeba invadens
TTEF

SEQ ID NO: 2917454 - protein, 8 aa, Entamoeba invadens
TTEGHGTT

SEQ ID NO: 2917455 - protein, 4 aa, Entamoeba invadens
TTEH

SEQ ID NO: 2917456 - protein, 52 aa, Entamoeba invadens
TTEHHEKVETRKIEDPLAEESTEKVEVHTPSGINISSKPKFQPPKSPHEITE

SEQ ID NO: 2917457 - protein, 7 aa, Entamoeba invadens
TTEHRKT

SEQ ID NO: 2917458 - protein, 4 aa, Entamoeba invadens
TTEI

SEQ ID NO: 2917459 - protein, 18 aa, Entamoeba invadens
TTEINENKTKADNARKPV

SEQ ID NO: 2917460 - protein, 14 aa, Entamoeba invadens
TTEIPQDATLGQPD

SEQ ID NO: 2917461 - protein, 6 aa, Entamoeba invadens
TTEIQK

SEQ ID NO: 2917462 - protein, 8 aa, Entamoeba invadens
TTEKCDKT

SEQ ID NO: 2917463 - protein, 10 aa, Entamoeba invadens
TTEKIEAPKP

SEQ ID NO: 2917464 - protein, 8 aa, Entamoeba invadens
TTEKPQSF

SEQ ID NO: 2917465 - protein, 16 aa, Entamoeba invadens
TTEKSEFPSPPNKEEL

SEQ ID NO: 2917466 - protein, 5 aa, Entamoeba invadens
TTENC

SEQ ID NO: 2917467 - protein, 9 aa, Entamoeba invadens
TTENESKEK

SEQ ID NO: 2917468 - protein, 9 aa, Entamoeba invadens
TTENKTVDP

SEQ ID NO: 2917469 - protein, 5 aa, Entamoeba invadens
TTENL

SEQ ID NO: 2917470 - protein, 9 aa, Entamoeba invadens
TTENNENGV

SEQ ID NO: 2917471 - protein, 6 aa, Entamoeba invadens
TTENRA

SEQ ID NO: 2917472 - protein, 13 aa, Entamoeba invadens
TTENSEKIYQSEE

SEQ ID NO: 2917473 - protein, 23 aa, Entamoeba invadens
TTENSTKLDYDELKEDKKLGEGS

SEQ ID NO: 2917474 - protein, 4 aa, Entamoeba invadens
TTEP

SEQ ID NO: 2917475 - protein, 6 aa, Entamoeba invadens
TTEPMA

SEQ ID NO: 2917476 - protein, 8 aa, Entamoeba invadens
TTEPPSIT

SEQ ID NO: 2917477 - protein, 9 aa, Entamoeba invadens
TTEPVTQKD

SEQ ID NO: 2917478 - protein, 4 aa, Entamoeba invadens
TTER

SEQ ID NO: 2917479 - protein, 10 aa, Entamoeba invadens
TTEREVGSNV

SEQ ID NO: 2917480 - protein, 7 aa, Entamoeba invadens
TTERIKR

SEQ ID NO: 2917481 - protein, 5 aa, Entamoeba invadens
TTERS

SEQ ID NO: 2917482 - protein, 25 aa, Entamoeba invadens
TTERSVTSSVDDRFNTQTLQENTDD

SEQ ID NO: 2917483 - protein, 10 aa, Entamoeba invadens
TTESADDRLS

SEQ ID NO: 2917484 - protein, 12 aa, Entamoeba invadens
TTESGEKKLETL

SEQ ID NO: 2917485 - protein, 9 aa, Entamoeba invadens
TTESNASGV

SEQ ID NO: 2917486 - protein, 17 aa, Entamoeba invadens
TTESSISHTNYNRTTGD

SEQ ID NO: 2917487 - protein, 6 aa, Entamoeba invadens
TTESYD

SEQ ID NO: 2917488 - protein, 5 aa, Entamoeba invadens
TTETF

SEQ ID NO: 2917489 - protein, 8 aa, Entamoeba invadens
TTETSQVK

SEQ ID NO: 2917490 - protein, 5 aa, Entamoeba invadens
TTEVR

SEQ ID NO: 2917491 - protein, 4 aa, Entamoeba invadens
TTFD

SEQ ID NO: 2917492 - protein, 5 aa, Entamoeba invadens
TTFDD

SEQ ID NO: 2917493 - protein, 4 aa, Entamoeba invadens
TTFE

SEQ ID NO: 2917494 - protein, 6 aa, Entamoeba invadens
TTFEEK

SEQ ID NO: 2917495 - protein, 5 aa, Entamoeba invadens
TTFEN

SEQ ID NO: 2917496 - protein, 38 aa, Entamoeba invadens
TTFESSDKTTTPKFEEDKSSYSGFDDFGNSEEFGSSSL

SEQ ID NO: 2917497 - protein, 6 aa, Entamoeba invadens
TTFGKE

SEQ ID NO: 2917498 - protein, 6 aa, Entamoeba invadens
TTFGTG

SEQ ID NO: 2917499 - protein, 11 aa, Entamoeba invadens
TTFNPATNTIS

SEQ ID NO: 2917500 - protein, 20 aa, Entamoeba invadens
TTFNQKKSNNEHFKQKRCLI

SEQ ID NO: 2917501 - protein, 5 aa, Entamoeba invadens
TTFNT

SEQ ID NO: 2917502 - protein, 46 aa, Entamoeba invadens
TTFNTSKHNENTQQSHLKENNKHNTSDDAEDSEKHSISADDEKLNQ

SEQ ID NO: 2917503 - protein, 5 aa, Entamoeba invadens
TTFPK

SEQ ID NO: 2917504 - protein, 12 aa, Entamoeba invadens
TTFPQTQMSQDT

SEQ ID NO: 2917505 - protein, 9 aa, Entamoeba invadens
TTFPTPLST

SEQ ID NO: 2917506 - protein, 5 aa, Entamoeba invadens
TTFRP

SEQ ID NO: 2917507 - protein, 5 aa, Entamoeba invadens
TTFRS

SEQ ID NO: 2917508 - protein, 4 aa, Entamoeba invadens
TTFS

SEQ ID NO: 2917509 - protein, 7 aa, Entamoeba invadens
TTFSDAS

SEQ ID NO: 2917510 - protein, 5 aa, Entamoeba invadens
TTFSK

SEQ ID NO: 2917511 - protein, 12 aa, Entamoeba invadens
TTFTSNKKSVVQ

SEQ ID NO: 2917512 - protein, 5 aa, Entamoeba invadens
TTFTT

SEQ ID NO: 2917513 - protein, 5 aa, Entamoeba invadens
TTFWQ

SEQ ID NO: 2917514 - protein, 12 aa, Entamoeba invadens
TTGAKGSKVNHS

SEQ ID NO: 2917515 - protein, 10 aa, Entamoeba invadens
TTGATGNKMR

SEQ ID NO: 2917516 - protein, 17 aa, Entamoeba invadens
TTGCSKCSAASTCTGCS

SEQ ID NO: 2917517 - protein, 6 aa, Entamoeba invadens
TTGEDG

SEQ ID NO: 2917518 - protein, 7 aa, Entamoeba invadens
TTGEKWD

SEQ ID NO: 2917519 - protein, 6 aa, Entamoeba invadens
TTGETV

SEQ ID NO: 2917520 - protein, 5 aa, Entamoeba invadens
TTGEY

SEQ ID NO: 2917521 - protein, 8 aa, Entamoeba invadens
TTGKDGKS

SEQ ID NO: 2917522 - protein, 10 aa, Entamoeba invadens
TTGKQNTTSI

SEQ ID NO: 2917523 - protein, 4 aa, Entamoeba invadens
TTGM

SEQ ID NO: 2917524 - protein, 9 aa, Entamoeba invadens
TTGMDEAAL

SEQ ID NO: 2917525 - protein, 4 aa, Entamoeba invadens
TTGN

SEQ ID NO: 2917526 - protein, 9 aa, Entamoeba invadens
TTGNKQQID

SEQ ID NO: 2917527 - protein, 10 aa, Entamoeba invadens
TTGPKSVAEL

SEQ ID NO: 2917528 - protein, 10 aa, Entamoeba invadens
TTGRGSTAVG

SEQ ID NO: 2917529 - protein, 7 aa, Entamoeba invadens
TTGSAQF

SEQ ID NO: 2917530 - protein, 4 aa, Entamoeba invadens
TTGT

SEQ ID NO: 2917531 - protein, 6 aa, Entamoeba invadens
TTGTIE

SEQ ID NO: 2917532 - protein, 5 aa, Entamoeba invadens
TTGVD

SEQ ID NO: 2917533 - protein, 5 aa, Entamoeba invadens
TTGYG

SEQ ID NO: 2917534 - protein, 4 aa, Entamoeba invadens
TTHD

SEQ ID NO: 2917535 - protein, 8 aa, Entamoeba invadens
TTHETSLV

SEQ ID NO: 2917536 - protein, 4 aa, Entamoeba invadens
TTHK

SEQ ID NO: 2917537 - protein, 16 aa, Entamoeba invadens
TTHKQKKQEATARVPT

SEQ ID NO: 2917538 - protein, 13 aa, Entamoeba invadens
TTHNEKIQSDFNE

SEQ ID NO: 2917539 - protein, 9 aa, Entamoeba invadens
TTHNTTEKL

SEQ ID NO: 2917540 - protein, 6 aa, Entamoeba invadens
TTHPID

SEQ ID NO: 2917541 - protein, 9 aa, Entamoeba invadens
TTHPKETVQ

SEQ ID NO: 2917542 - protein, 9 aa, Entamoeba invadens
TTHPSITEQ

SEQ ID NO: 2917543 - protein, 7 aa, Entamoeba invadens
TTHPTPL

SEQ ID NO: 2917544 - protein, 6 aa, Entamoeba invadens
TTHPTT

SEQ ID NO: 2917545 - protein, 4 aa, Entamoeba invadens
TTHR

SEQ ID NO: 2917546 - protein, 4 aa, Entamoeba invadens
TTHS

SEQ ID NO: 2917547 - protein, 4 aa, Entamoeba invadens
TTHT

SEQ ID NO: 2917548 - protein, 11 aa, Entamoeba invadens
TTIAKKDSVIT

SEQ ID NO: 2917549 - protein, 10 aa, Entamoeba invadens
TTIDDSTKQK

SEQ ID NO: 2917550 - protein, 19 aa, Entamoeba invadens
TTIDDSTKQRLINVLSKPI

SEQ ID NO: 2917551 - protein, 6 aa, Entamoeba invadens
TTIDNC

SEQ ID NO: 2917552 - protein, 7 aa, Entamoeba invadens
TTIGDKT

SEQ ID NO: 2917553 - protein, 6 aa, Entamoeba invadens
TTIGRN

SEQ ID NO: 2917554 - protein, 13 aa, Entamoeba invadens
TTIGSGVVTEIKD

SEQ ID NO: 2917555 - protein, 14 aa, Entamoeba invadens
TTIGSNGDIKISEE

SEQ ID NO: 2917556 - protein, 10 aa, Entamoeba invadens
TTIKGQEPPM

SEQ ID NO: 2917557 - protein, 16 aa, Entamoeba invadens
TTIKRPEQHSNDTTNV

SEQ ID NO: 2917558 - protein, 15 aa, Entamoeba invadens
TTINEKGHEYEADER

SEQ ID NO: 2917559 - protein, 11 aa, Entamoeba invadens
TTIPENYKESE

SEQ ID NO: 2917560 - protein, 7 aa, Entamoeba invadens
TTIPKEE

SEQ ID NO: 2917561 - protein, 21 aa, Entamoeba invadens
TTIPNIKNRKGKSEEKVPSPF

SEQ ID NO: 2917562 - protein, 8 aa, Entamoeba invadens
TTIPPPPV

SEQ ID NO: 2917563 - protein, 6 aa, Entamoeba invadens
TTIPTR

SEQ ID NO: 2917564 - protein, 4 aa, Entamoeba invadens
TTIQ

SEQ ID NO: 2917565 - protein, 18 aa, Entamoeba invadens
TTIQELTDAKSQLETQVE

SEQ ID NO: 2917566 - protein, 12 aa, Entamoeba invadens
TTIQENESNFNG

SEQ ID NO: 2917567 - protein, 4 aa, Entamoeba invadens
TTIS

SEQ ID NO: 2917568 - protein, 6 aa, Entamoeba invadens
TTISEI

SEQ ID NO: 2917569 - protein, 6 aa, Entamoeba invadens
TTISSC

SEQ ID NO: 2917570 - protein, 4 aa, Entamoeba invadens
TTIT

SEQ ID NO: 2917571 - protein, 11 aa, Entamoeba invadens
TTITKNANEKM

SEQ ID NO: 2917572 - protein, 4 aa, Entamoeba invadens
TTKA

SEQ ID NO: 2917573 - protein, 6 aa, Entamoeba invadens
TTKAAA

SEQ ID NO: 2917574 - protein, 6 aa, Entamoeba invadens
TTKAEI

SEQ ID NO: 2917575 - protein, 7 aa, Entamoeba invadens
TTKAGET

SEQ ID NO: 2917576 - protein, 9 aa, Entamoeba invadens
TTKAKQGGL

SEQ ID NO: 2917577 - protein, 9 aa, Entamoeba invadens
TTKAQRNTK

SEQ ID NO: 2917578 - protein, 6 aa, Entamoeba invadens
TTKDCT

SEQ ID NO: 2917579 - protein, 9 aa, Entamoeba invadens
TTKDETKKL

SEQ ID NO: 2917580 - protein, 7 aa, Entamoeba invadens
TTKDFSK

SEQ ID NO: 2917581 - protein, 7 aa, Entamoeba invadens
TTKDGKI

SEQ ID NO: 2917582 - protein, 5 aa, Entamoeba invadens
TTKDK

SEQ ID NO: 2917583 - protein, 16 aa, Entamoeba invadens
TTKDKCDKYKIRTEPQ

SEQ ID NO: 2917584 - protein, 10 aa, Entamoeba invadens
TTKDKVDGKD

SEQ ID NO: 2917585 - protein, 4 aa, Entamoeba invadens
TTKE

SEQ ID NO: 2917586 - protein, 20 aa, Entamoeba invadens
TTKEEFKKQKKEAEKKEESM

SEQ ID NO: 2917587 - protein, 8 aa, Entamoeba invadens
TTKEEIEK

SEQ ID NO: 2917588 - protein, 15 aa, Entamoeba invadens
TTKEGCDKYSIRTEP

SEQ ID NO: 2917589 - protein, 7 aa, Entamoeba invadens
TTKEGLQ

SEQ ID NO: 2917590 - protein, 9 aa, Entamoeba invadens
TTKEGRKLA

SEQ ID NO: 2917591 - protein, 5 aa, Entamoeba invadens
TTKEI

SEQ ID NO: 2917592 - protein, 6 aa, Entamoeba invadens
TTKEIP

SEQ ID NO: 2917593 - protein, 10 aa, Entamoeba invadens
TTKENCDKYT

SEQ ID NO: 2917594 - protein, 9 aa, Entamoeba invadens
TTKENNQRE

SEQ ID NO: 2917595 - protein, 6 aa, Entamoeba invadens
TTKESQ

SEQ ID NO: 2917596 - protein, 9 aa, Entamoeba invadens
TTKESTKSC

SEQ ID NO: 2917597 - protein, 11 aa, Entamoeba invadens
TTKETQKQADV

SEQ ID NO: 2917598 - protein, 5 aa, Entamoeba invadens
TTKFE

SEQ ID NO: 2917599 - protein, 10 aa, Entamoeba invadens
TTKGKKGTMK

SEQ ID NO: 2917600 - protein, 11 aa, Entamoeba invadens
TTKGKKQKSRG

SEQ ID NO: 2917601 - protein, 7 aa, Entamoeba invadens
TTKGKTE

SEQ ID NO: 2917602 - protein, 5 aa, Entamoeba invadens
TTKGL

SEQ ID NO: 2917603 - protein, 18 aa, Entamoeba invadens
TTKGTYVPEGKPVPAGTQ

SEQ ID NO: 2917604 - protein, 25 aa, Entamoeba invadens
TTKGVERKKERTSGRSIPSPTPNHT

SEQ ID NO: 2917605 - protein, 10 aa, Entamoeba invadens
TTKHGDPPDF

SEQ ID NO: 2917606 - protein, 4 aa, Entamoeba invadens
TTKI

SEQ ID NO: 2917607 - protein, 7 aa, Entamoeba invadens
TTKITST

SEQ ID NO: 2917608 - protein, 8 aa, Entamoeba invadens
TTKKEDID

SEQ ID NO: 2917609 - protein, 21 aa, Entamoeba invadens
TTKKEFKDKNSKESKEQKKRY

SEQ ID NO: 2917610 - protein, 6 aa, Entamoeba invadens
TTKKQE

SEQ ID NO: 2917611 - protein, 11 aa, Entamoeba invadens
TTKKSQEVKQY

SEQ ID NO: 2917612 - protein, 10 aa, Entamoeba invadens
TTKKTKLSKA

SEQ ID NO: 2917613 - protein, 11 aa, Entamoeba invadens
TTKKYEKKQDK

SEQ ID NO: 2917614 - protein, 5 aa, Entamoeba invadens
TTKLG

SEQ ID NO: 2917615 - protein, 8 aa, Entamoeba invadens
TTKNENNV

SEQ ID NO: 2917616 - protein, 6 aa, Entamoeba invadens
TTKNFP

SEQ ID NO: 2917617 - protein, 8 aa, Entamoeba invadens
TTKNGETH

SEQ ID NO: 2917618 - protein, 9 aa, Entamoeba invadens
TTKNIDPEK

SEQ ID NO: 2917619 - protein, 25 aa, Entamoeba invadens
TTKNKKDDKMQTEVSKAKTPMGTSS

SEQ ID NO: 2917620 - protein, 16 aa, Entamoeba invadens
TTKNPNLTQKQVENNT

SEQ ID NO: 2917621 - protein, 7 aa, Entamoeba invadens
TTKNQCD

SEQ ID NO: 2917622 - protein, 8 aa, Entamoeba invadens
TTKNSSID

SEQ ID NO: 2917623 - protein, 9 aa, Entamoeba invadens
TTKPQSKTA

SEQ ID NO: 2917624 - protein, 4 aa, Entamoeba invadens
TTKQ

SEQ ID NO: 2917625 - protein, 9 aa, Entamoeba invadens
TTKQDKTSF

SEQ ID NO: 2917626 - protein, 5 aa, Entamoeba invadens
TTKQN

SEQ ID NO: 2917627 - protein, 6 aa, Entamoeba invadens
TTKQNV

SEQ ID NO: 2917628 - protein, 6 aa, Entamoeba invadens
TTKQPV

SEQ ID NO: 2917629 - protein, 7 aa, Entamoeba invadens
TTKQSVD

SEQ ID NO: 2917630 - protein, 10 aa, Entamoeba invadens
TTKREVGGGW

SEQ ID NO: 2917631 - protein, 9 aa, Entamoeba invadens
TTKRGWKGK

SEQ ID NO: 2917632 - protein, 18 aa, Entamoeba invadens
TTKRIKRPQLTQDGRKTF

SEQ ID NO: 2917633 - protein, 14 aa, Entamoeba invadens
TTKRKSEVAERESE

SEQ ID NO: 2917634 - protein, 8 aa, Entamoeba invadens
TTKSEGNY

SEQ ID NO: 2917635 - protein, 8 aa, Entamoeba invadens
TTKSEYKS

SEQ ID NO: 2917636 - protein, 7 aa, Entamoeba invadens
TTKSFLS

SEQ ID NO: 2917637 - protein, 9 aa, Entamoeba invadens
TTKSGNYKY

SEQ ID NO: 2917638 - protein, 28 aa, Entamoeba invadens
TTKSKTKRDSKKEEEQSDDGHNSADSDK

SEQ ID NO: 2917639 - protein, 5 aa, Entamoeba invadens
TTKSQ

SEQ ID NO: 2917640 - protein, 6 aa, Entamoeba invadens
TTKSSS

SEQ ID NO: 2917641 - protein, 4 aa, Entamoeba invadens
TTKT

SEQ ID NO: 2917642 - protein, 24 aa, Entamoeba invadens
TTKTAGESVSIGEANSGKSGAQEI

SEQ ID NO: 2917643 - protein, 8 aa, Entamoeba invadens
TTKTAQKL

SEQ ID NO: 2917644 - protein, 19 aa, Entamoeba invadens
TTKTEPTVSKETEHKQHDV

SEQ ID NO: 2917645 - protein, 6 aa, Entamoeba invadens
TTKTNA

SEQ ID NO: 2917646 - protein, 7 aa, Entamoeba invadens
TTKTNEK

SEQ ID NO: 2917647 - protein, 9 aa, Entamoeba invadens
TTKTSESLK

SEQ ID NO: 2917648 - protein, 8 aa, Entamoeba invadens
TTKTVKEK

SEQ ID NO: 2917649 - protein, 40 aa, Entamoeba invadens
TTKVEEPQQLKTPEKSHSHKEEKSDGNGEASEKPVERTKR

SEQ ID NO: 2917650 - protein, 9 aa, Entamoeba invadens
TTKVNETTT

SEQ ID NO: 2917651 - protein, 4 aa, Entamoeba invadens
TTKY

SEQ ID NO: 2917652 - protein, 11 aa, Entamoeba invadens
TTKYPDETTGM

SEQ ID NO: 2917653 - protein, 7 aa, Entamoeba invadens
TTKYSTE

SEQ ID NO: 2917654 - protein, 9 aa, Entamoeba invadens
TTLADTNAK

SEQ ID NO: 2917655 - protein, 21 aa, Entamoeba invadens
TTLDGQPRAEERSYTSNGKEL

SEQ ID NO: 2917656 - protein, 6 aa, Entamoeba invadens
TTLDPS

SEQ ID NO: 2917657 - protein, 5 aa, Entamoeba invadens
TTLEE

SEQ ID NO: 2917658 - protein, 8 aa, Entamoeba invadens
TTLEGREQ

SEQ ID NO: 2917659 - protein, 13 aa, Entamoeba invadens
TTLEQTEKEEEDI

SEQ ID NO: 2917660 - protein, 12 aa, Entamoeba invadens
TTLGTKYDEPRI

SEQ ID NO: 2917661 - protein, 6 aa, Entamoeba invadens
TTLKAN

SEQ ID NO: 2917662 - protein, 11 aa, Entamoeba invadens
TTLKNKNSANL

SEQ ID NO: 2917663 - protein, 6 aa, Entamoeba invadens
TTLKPG

SEQ ID NO: 2917664 - protein, 4 aa, Entamoeba invadens
TTLN

SEQ ID NO: 2917665 - protein, 10 aa, Entamoeba invadens
TTLNGTTVEN

SEQ ID NO: 2917666 - protein, 6 aa, Entamoeba invadens
TTLNRE

SEQ ID NO: 2917667 - protein, 12 aa, Entamoeba invadens
TTLNRENFKIIF

SEQ ID NO: 2917668 - protein, 13 aa, Entamoeba invadens
TTLNSSLKNSSDL

SEQ ID NO: 2917669 - protein, 7 aa, Entamoeba invadens
TTLPGYE

SEQ ID NO: 2917670 - protein, 25 aa, Entamoeba invadens
TTLPHNENIDKTKSFDNLPKTPVQL

SEQ ID NO: 2917671 - protein, 8 aa, Entamoeba invadens
TTLPRNQR

SEQ ID NO: 2917672 - protein, 5 aa, Entamoeba invadens
TTLPS

SEQ ID NO: 2917673 - protein, 18 aa, Entamoeba invadens
TTLPSGIGLSSKQNETQH

SEQ ID NO: 2917674 - protein, 8 aa, Entamoeba invadens
TTLPTPEQ

SEQ ID NO: 2917675 - protein, 6 aa, Entamoeba invadens
TTLQPK

SEQ ID NO: 2917676 - protein, 4 aa, Entamoeba invadens
TTLS

SEQ ID NO: 2917677 - protein, 6 aa, Entamoeba invadens
TTLSGL

SEQ ID NO: 2917678 - protein, 7 aa, Entamoeba invadens
TTLSSSR

SEQ ID NO: 2917679 - protein, 7 aa, Entamoeba invadens
TTLSTKN

SEQ ID NO: 2917680 - protein, 6 aa, Entamoeba invadens
TTLTKE

SEQ ID NO: 2917681 - protein, 7 aa, Entamoeba invadens
TTLTTKD

SEQ ID NO: 2917682 - protein, 8 aa, Entamoeba invadens
TTLVNDQE

SEQ ID NO: 2917683 - protein, 5 aa, Entamoeba invadens
TTMDD

SEQ ID NO: 2917684 - protein, 6 aa, Entamoeba invadens
TTMDPQ

SEQ ID NO: 2917685 - protein, 17 aa, Entamoeba invadens
TTMEESKPKATGRTKQV

SEQ ID NO: 2917686 - protein, 5 aa, Entamoeba invadens
TTMEL

SEQ ID NO: 2917687 - protein, 11 aa, Entamoeba invadens
TTMKSELNGLS

SEQ ID NO: 2917688 - protein, 7 aa, Entamoeba invadens
TTMPAYT

SEQ ID NO: 2917689 - protein, 9 aa, Entamoeba invadens
TTMSETGMT

SEQ ID NO: 2917690 - protein, 4 aa, Entamoeba invadens
TTNC

SEQ ID NO: 2917691 - protein, 4 aa, Entamoeba invadens
TTND

SEQ ID NO: 2917692 - protein, 5 aa, Entamoeba invadens
TTNDN

SEQ ID NO: 2917693 - protein, 13 aa, Entamoeba invadens
TTNDNVIQRFLCT

SEQ ID NO: 2917694 - protein, 7 aa, Entamoeba invadens
TTNEEDA

SEQ ID NO: 2917695 - protein, 19 aa, Entamoeba invadens
TTNEKNNEKRNENQSKALP

SEQ ID NO: 2917696 - protein, 9 aa, Entamoeba invadens
TTNEKTKNC

SEQ ID NO: 2917697 - protein, 5 aa, Entamoeba invadens
TTNEL

SEQ ID NO: 2917698 - protein, 9 aa, Entamoeba invadens
TTNELGKDD

SEQ ID NO: 2917699 - protein, 8 aa, Entamoeba invadens
TTNELGRD

SEQ ID NO: 2917700 - protein, 7 aa, Entamoeba invadens
TTNENCT

SEQ ID NO: 2917701 - protein, 5 aa, Entamoeba invadens
TTNEP

SEQ ID NO: 2917702 - protein, 9 aa, Entamoeba invadens
TTNESDKER

SEQ ID NO: 2917703 - protein, 5 aa, Entamoeba invadens
TTNET

SEQ ID NO: 2917704 - protein, 8 aa, Entamoeba invadens
TTNFKSQN

SEQ ID NO: 2917705 - protein, 5 aa, Entamoeba invadens
TTNFS

SEQ ID NO: 2917706 - protein, 15 aa, Entamoeba invadens
TTNGERNEVSFDETK

SEQ ID NO: 2917707 - protein, 13 aa, Entamoeba invadens
TTNGKNGANRLDT

SEQ ID NO: 2917708 - protein, 7 aa, Entamoeba invadens
TTNGPKS

SEQ ID NO: 2917709 - protein, 7 aa, Entamoeba invadens
TTNGRNV

SEQ ID NO: 2917710 - protein, 11 aa, Entamoeba invadens
TTNGTSLPYRP

SEQ ID NO: 2917711 - protein, 4 aa, Entamoeba invadens
TTNH

SEQ ID NO: 2917712 - protein, 5 aa, Entamoeba invadens
TTNKE

SEQ ID NO: 2917713 - protein, 9 aa, Entamoeba invadens
TTNKETFER

SEQ ID NO: 2917714 - protein, 33 aa, Entamoeba invadens
TTNKTAKKETNQKDEKTDTLSIGDESKREAYDT

SEQ ID NO: 2917715 - protein, 6 aa, Entamoeba invadens
TTNKYD

SEQ ID NO: 2917716 - protein, 8 aa, Entamoeba invadens
TTNKYTHD

SEQ ID NO: 2917717 - protein, 7 aa, Entamoeba invadens
TTNLRDL

SEQ ID NO: 2917718 - protein, 17 aa, Entamoeba invadens
TTNLTAEEREKIQKQTE

SEQ ID NO: 2917719 - protein, 4 aa, Entamoeba invadens
TTNM

SEQ ID NO: 2917720 - protein, 10 aa, Entamoeba invadens
TTNMRSEGQI

SEQ ID NO: 2917721 - protein, 12 aa, Entamoeba invadens
TTNNAKYPTDVQ

SEQ ID NO: 2917722 - protein, 8 aa, Entamoeba invadens
TTNNNVAS

SEQ ID NO: 2917723 - protein, 4 aa, Entamoeba invadens
TTNP

SEQ ID NO: 2917724 - protein, 5 aa, Entamoeba invadens
TTNPA

SEQ ID NO: 2917725 - protein, 14 aa, Entamoeba invadens
TTNPDKIKTIPEAI

SEQ ID NO: 2917726 - protein, 8 aa, Entamoeba invadens
TTNPEASD

SEQ ID NO: 2917727 - protein, 13 aa, Entamoeba invadens
TTNPNDTSTYSTV

SEQ ID NO: 2917728 - protein, 6 aa, Entamoeba invadens
TTNPNK

SEQ ID NO: 2917729 - protein, 27 aa, Entamoeba invadens
TTNPQQQKSIEALEAKRESRNRDAAQQ

SEQ ID NO: 2917730 - protein, 10 aa, Entamoeba invadens
TTNPTYVTSS

SEQ ID NO: 2917731 - protein, 6 aa, Entamoeba invadens
TTNQNI

SEQ ID NO: 2917732 - protein, 4 aa, Entamoeba invadens
TTNR

SEQ ID NO: 2917733 - protein, 11 aa, Entamoeba invadens
TTNRPNLTKDE

SEQ ID NO: 2917734 - protein, 5 aa, Entamoeba invadens
TTNRQ

SEQ ID NO: 2917735 - protein, 4 aa, Entamoeba invadens
TTNS

SEQ ID NO: 2917736 - protein, 9 aa, Entamoeba invadens
TTNSFGNNE

SEQ ID NO: 2917737 - protein, 10 aa, Entamoeba invadens
TTNSNNLKTE

SEQ ID NO: 2917738 - protein, 9 aa, Entamoeba invadens
TTNSSQKLK

SEQ ID NO: 2917739 - protein, 9 aa, Entamoeba invadens
TTNTGFPAY

SEQ ID NO: 2917740 - protein, 5 aa, Entamoeba invadens
TTNTN

SEQ ID NO: 2917741 - protein, 9 aa, Entamoeba invadens
TTNTNTKLT

SEQ ID NO: 2917742 - protein, 8 aa, Entamoeba invadens
TTNTSAHQ

SEQ ID NO: 2917743 - protein, 7 aa, Entamoeba invadens
TTNTTAV

SEQ ID NO: 2917744 - protein, 8 aa, Entamoeba invadens
TTNVSYGK

SEQ ID NO: 2917745 - protein, 4 aa, Entamoeba invadens
TTNY

SEQ ID NO: 2917746 - protein, 6 aa, Entamoeba invadens
TTPAYP

SEQ ID NO: 2917747 - protein, 12 aa, Entamoeba invadens
TTPCNSEEKVSQ

SEQ ID NO: 2917748 - protein, 15 aa, Entamoeba invadens
TTPCSTQGQVEELTN

SEQ ID NO: 2917749 - protein, 11 aa, Entamoeba invadens
TTPCTKDSSRY

SEQ ID NO: 2917750 - protein, 7 aa, Entamoeba invadens
TTPDSDT

SEQ ID NO: 2917751 - protein, 9 aa, Entamoeba invadens
TTPDTMSND

SEQ ID NO: 2917752 - protein, 6 aa, Entamoeba invadens
TTPEAS

SEQ ID NO: 2917753 - protein, 7 aa, Entamoeba invadens
TTPEEME

SEQ ID NO: 2917754 - protein, 6 aa, Entamoeba invadens
TTPEIK

SEQ ID NO: 2917755 - protein, 6 aa, Entamoeba invadens
TTPEML

SEQ ID NO: 2917756 - protein, 5 aa, Entamoeba invadens
TTPEN

SEQ ID NO: 2917757 - protein, 12 aa, Entamoeba invadens
TTPESSGIETEV

SEQ ID NO: 2917758 - protein, 4 aa, Entamoeba invadens
TTPF

SEQ ID NO: 2917759 - protein, 13 aa, Entamoeba invadens
TTPGTNQSYNRNL

SEQ ID NO: 2917760 - protein, 14 aa, Entamoeba invadens
TTPIDVEKENEEIK

SEQ ID NO: 2917761 - protein, 6 aa, Entamoeba invadens
TTPIKG

SEQ ID NO: 2917762 - protein, 6 aa, Entamoeba invadens
TTPIQQ

SEQ ID NO: 2917763 - protein, 6 aa, Entamoeba invadens
TTPIRE

SEQ ID NO: 2917764 - protein, 4 aa, Entamoeba invadens
TTPK

SEQ ID NO: 2917765 - protein, 9 aa, Entamoeba invadens
TTPKEAQEI

SEQ ID NO: 2917766 - protein, 7 aa, Entamoeba invadens
TTPKFSS

SEQ ID NO: 2917767 - protein, 5 aa, Entamoeba invadens
TTPKI

SEQ ID NO: 2917768 - protein, 4 aa, Entamoeba invadens
TTPL

SEQ ID NO: 2917769 - protein, 6 aa, Entamoeba invadens
TTPLNG

SEQ ID NO: 2917770 - protein, 9 aa, Entamoeba invadens
TTPLPEQES

SEQ ID NO: 2917771 - protein, 21 aa, Entamoeba invadens
TTPLPSSSKKTTKSPHKLNPQ

SEQ ID NO: 2917772 - protein, 6 aa, Entamoeba invadens
TTPLRA

SEQ ID NO: 2917773 - protein, 10 aa, Entamoeba invadens
TTPLSTRNEE

SEQ ID NO: 2917774 - protein, 5 aa, Entamoeba invadens
TTPNG

SEQ ID NO: 2917775 - protein, 7 aa, Entamoeba invadens
TTPNNTD

SEQ ID NO: 2917776 - protein, 10 aa, Entamoeba invadens
TTPNTTTNTF

SEQ ID NO: 2917777 - protein, 11 aa, Entamoeba invadens
TTPNTVQPQTK

SEQ ID NO: 2917778 - protein, 8 aa, Entamoeba invadens
TTPPPNHY

SEQ ID NO: 2917779 - protein, 8 aa, Entamoeba invadens
TTPPPQLR

SEQ ID NO: 2917780 - protein, 7 aa, Entamoeba invadens
TTPPPSL

SEQ ID NO: 2917781 - protein, 6 aa, Entamoeba invadens
TTPPRE

SEQ ID NO: 2917782 - protein, 4 aa, Entamoeba invadens
TTPQ

SEQ ID NO: 2917783 - protein, 9 aa, Entamoeba invadens
TTPQGKFNV

SEQ ID NO: 2917784 - protein, 6 aa, Entamoeba invadens
TTPQKD

SEQ ID NO: 2917785 - protein, 4 aa, Entamoeba invadens
TTPR

SEQ ID NO: 2917786 - protein, 6 aa, Entamoeba invadens
TTPRAL

SEQ ID NO: 2917787 - protein, 30 aa, Entamoeba invadens
TTPRCYSSDYSKELKLSKSDNLKKKGQLSH

SEQ ID NO: 2917788 - protein, 7 aa, Entamoeba invadens
TTPRDGV

SEQ ID NO: 2917789 - protein, 12 aa, Entamoeba invadens
TTPRKDTTIPTR

SEQ ID NO: 2917790 - protein, 6 aa, Entamoeba invadens
TTPRSI

SEQ ID NO: 2917791 - protein, 5 aa, Entamoeba invadens
TTPSK

SEQ ID NO: 2917792 - protein, 8 aa, Entamoeba invadens
TTPSTDPL

SEQ ID NO: 2917793 - protein, 5 aa, Entamoeba invadens
TTPSV

SEQ ID NO: 2917794 - protein, 4 aa, Entamoeba invadens
TTPT

SEQ ID NO: 2917795 - protein, 6 aa, Entamoeba invadens
TTPTIT

SEQ ID NO: 2917796 - protein, 11 aa, Entamoeba invadens
TTPTKTIYTPP

SEQ ID NO: 2917797 - protein, 6 aa, Entamoeba invadens
TTPTPC

SEQ ID NO: 2917798 - protein, 18 aa, Entamoeba invadens
TTPTQPSKSVDEFSSVEE

SEQ ID NO: 2917799 - protein, 7 aa, Entamoeba invadens
TTPTQRT

SEQ ID NO: 2917800 - protein, 6 aa, Entamoeba invadens
TTPTTC

SEQ ID NO: 2917801 - protein, 4 aa, Entamoeba invadens
TTPV

SEQ ID NO: 2917802 - protein, 5 aa, Entamoeba invadens
TTPWA

SEQ ID NO: 2917803 - protein, 12 aa, Entamoeba invadens
TTPYNADFDGDE

SEQ ID NO: 2917804 - protein, 6 aa, Entamoeba invadens
TTPYTN

SEQ ID NO: 2917805 - protein, 12 aa, Entamoeba invadens
TTQAKTRATAEK

SEQ ID NO: 2917806 - protein, 6 aa, Entamoeba invadens
TTQASK

SEQ ID NO: 2917807 - protein, 4 aa, Entamoeba invadens
TTQE

SEQ ID NO: 2917808 - protein, 13 aa, Entamoeba invadens
TTQEKNPSKVAEE

SEQ ID NO: 2917809 - protein, 5 aa, Entamoeba invadens
TTQES

SEQ ID NO: 2917810 - protein, 5 aa, Entamoeba invadens
TTQET

SEQ ID NO: 2917811 - protein, 4 aa, Entamoeba invadens
TTQF

SEQ ID NO: 2917812 - protein, 10 aa, Entamoeba invadens
TTQFRSNGTL

SEQ ID NO: 2917813 - protein, 10 aa, Entamoeba invadens
TTQGAASSVS

SEQ ID NO: 2917814 - protein, 9 aa, Entamoeba invadens
TTQGTKCSE

SEQ ID NO: 2917815 - protein, 8 aa, Entamoeba invadens
TTQGVHSA

SEQ ID NO: 2917816 - protein, 5 aa, Entamoeba invadens
TTQGY

SEQ ID NO: 2917817 - protein, 6 aa, Entamoeba invadens
TTQHEN

SEQ ID NO: 2917818 - protein, 8 aa, Entamoeba invadens
TTQHNTLT

SEQ ID NO: 2917819 - protein, 17 aa, Entamoeba invadens
TTQIADTHAQKKSYYES

SEQ ID NO: 2917820 - protein, 4 aa, Entamoeba invadens
TTQK

SEQ ID NO: 2917821 - protein, 9 aa, Entamoeba invadens
TTQKEKISS

SEQ ID NO: 2917822 - protein, 11 aa, Entamoeba invadens
TTQKNPPEKYE

SEQ ID NO: 2917823 - protein, 10 aa, Entamoeba invadens
TTQKPSSVYS

SEQ ID NO: 2917824 - protein, 23 aa, Entamoeba invadens
TTQKRAQNMQPQTTQPKKQSHFT

SEQ ID NO: 2917825 - protein, 6 aa, Entamoeba invadens
TTQLQK

SEQ ID NO: 2917826 - protein, 9 aa, Entamoeba invadens
TTQNDEEKF

SEQ ID NO: 2917827 - protein, 7 aa, Entamoeba invadens
TTQNSAQ

SEQ ID NO: 2917828 - protein, 6 aa, Entamoeba invadens
TTQNSC

SEQ ID NO: 2917829 - protein, 8 aa, Entamoeba invadens
TTQPEPIQ

SEQ ID NO: 2917830 - protein, 9 aa, Entamoeba invadens
TTQPGQSTH

SEQ ID NO: 2917831 - protein, 6 aa, Entamoeba invadens
TTQPGV

SEQ ID NO: 2917832 - protein, 5 aa, Entamoeba invadens
TTQPQ

SEQ ID NO: 2917833 - protein, 4 aa, Entamoeba invadens
TTQQ

SEQ ID NO: 2917834 - protein, 5 aa, Entamoeba invadens
TTQQI

SEQ ID NO: 2917835 - protein, 8 aa, Entamoeba invadens
TTQQQTIE

SEQ ID NO: 2917836 - protein, 6 aa, Entamoeba invadens
TTQQSE

SEQ ID NO: 2917837 - protein, 6 aa, Entamoeba invadens
TTQSEL

SEQ ID NO: 2917838 - protein, 20 aa, Entamoeba invadens
TTQSELEQKRREESEGKKEI

SEQ ID NO: 2917839 - protein, 32 aa, Entamoeba invadens
TTQSEVNQLTQRSLTNSQNNSQSTHIAQSQQS

SEQ ID NO: 2917840 - protein, 10 aa, Entamoeba invadens
TTQSPNTEMP

SEQ ID NO: 2917841 - protein, 6 aa, Entamoeba invadens
TTQTKA

SEQ ID NO: 2917842 - protein, 5 aa, Entamoeba invadens
TTQTT

SEQ ID NO: 2917843 - protein, 16 aa, Entamoeba invadens
TTQVPPPTTYQNGHPF

SEQ ID NO: 2917844 - protein, 6 aa, Entamoeba invadens
TTRAET

SEQ ID NO: 2917845 - protein, 8 aa, Entamoeba invadens
TTRARELR

SEQ ID NO: 2917846 - protein, 11 aa, Entamoeba invadens
TTREISNTEVT

SEQ ID NO: 2917847 - protein, 6 aa, Entamoeba invadens
TTREKR

SEQ ID NO: 2917848 - protein, 5 aa, Entamoeba invadens
TTREN

SEQ ID NO: 2917849 - protein, 15 aa, Entamoeba invadens
TTRGPGKSEKYKNYR

SEQ ID NO: 2917850 - protein, 6 aa, Entamoeba invadens
TTRGTL

SEQ ID NO: 2917851 - protein, 5 aa, Entamoeba invadens
TTRIK

SEQ ID NO: 2917852 - protein, 5 aa, Entamoeba invadens
TTRIR

SEQ ID NO: 2917853 - protein, 15 aa, Entamoeba invadens
TTRKIGEIEKGNKDG

SEQ ID NO: 2917854 - protein, 6 aa, Entamoeba invadens
TTRKPT

SEQ ID NO: 2917855 - protein, 11 aa, Entamoeba invadens
TTRKTTPVGVP

SEQ ID NO: 2917856 - protein, 12 aa, Entamoeba invadens
TTRNKDKDGSMR

SEQ ID NO: 2917857 - protein, 7 aa, Entamoeba invadens
TTRPSKV

SEQ ID NO: 2917858 - protein, 7 aa, Entamoeba invadens
TTRPSQV

SEQ ID NO: 2917859 - protein, 9 aa, Entamoeba invadens
TTRREDENY

SEQ ID NO: 2917860 - protein, 14 aa, Entamoeba invadens
TTRRTPCGEGSKTW

SEQ ID NO: 2917861 - protein, 8 aa, Entamoeba invadens
TTRSKEKL

SEQ ID NO: 2917862 - protein, 7 aa, Entamoeba invadens
TTRTGIP

SEQ ID NO: 2917863 - protein, 13 aa, Entamoeba invadens
TTRTSTTSNGHEI

SEQ ID NO: 2917864 - protein, 4 aa, Entamoeba invadens
TTRV

SEQ ID NO: 2917865 - protein, 8 aa, Entamoeba invadens
TTSAKVGN

SEQ ID NO: 2917866 - protein, 9 aa, Entamoeba invadens
TTSAQKEDV

SEQ ID NO: 2917867 - protein, 9 aa, Entamoeba invadens
TTSATAKPV

SEQ ID NO: 2917868 - protein, 9 aa, Entamoeba invadens
TTSCQESRN

SEQ ID NO: 2917869 - protein, 9 aa, Entamoeba invadens
TTSDEGLAS

SEQ ID NO: 2917870 - protein, 10 aa, Entamoeba invadens
TTSDNAEIKK

SEQ ID NO: 2917871 - protein, 9 aa, Entamoeba invadens
TTSDNYNDE

SEQ ID NO: 2917872 - protein, 6 aa, Entamoeba invadens
TTSDQL

SEQ ID NO: 2917873 - protein, 5 aa, Entamoeba invadens
TTSDS

SEQ ID NO: 2917874 - protein, 28 aa, Entamoeba invadens
TTSDSKTEGTLTGNVGEKKVTLTSTEKM

SEQ ID NO: 2917875 - protein, 28 aa, Entamoeba invadens
TTSDSKVEGTLTGNVGEKKVTLTSTEKV

SEQ ID NO: 2917876 - protein, 29 aa, Entamoeba invadens
TTSDSKVEGTLTGNVGEKKVTLTSTEKVR

SEQ ID NO: 2917877 - protein, 11 aa, Entamoeba invadens
TTSDSSVSPPK

SEQ ID NO: 2917878 - protein, 16 aa, Entamoeba invadens
TTSEAQPESITPQRSL

SEQ ID NO: 2917879 - protein, 8 aa, Entamoeba invadens
TTSEESLQ

SEQ ID NO: 2917880 - protein, 6 aa, Entamoeba invadens
TTSENK

SEQ ID NO: 2917881 - protein, 6 aa, Entamoeba invadens
TTSEQI

SEQ ID NO: 2917882 - protein, 6 aa, Entamoeba invadens
TTSESY

SEQ ID NO: 2917883 - protein, 11 aa, Entamoeba invadens
TTSFAKRNPKI

SEQ ID NO: 2917884 - protein, 11 aa, Entamoeba invadens
TTSFPQQDQLK

SEQ ID NO: 2917885 - protein, 4 aa, Entamoeba invadens
TTSG

SEQ ID NO: 2917886 - protein, 10 aa, Entamoeba invadens
TTSGKMDEHE

SEQ ID NO: 2917887 - protein, 7 aa, Entamoeba invadens
TTSGKRP

SEQ ID NO: 2917888 - protein, 7 aa, Entamoeba invadens
TTSGRTL

SEQ ID NO: 2917889 - protein, 9 aa, Entamoeba invadens
TTSGTGSEV

SEQ ID NO: 2917890 - protein, 4 aa, Entamoeba invadens
TTSH

SEQ ID NO: 2917891 - protein, 8 aa, Entamoeba invadens
TTSHKGGV

SEQ ID NO: 2917892 - protein, 41 aa, Entamoeba invadens
TTSHSSHNSYSSHSSQRSPKESPRIPHGYESPRKCYTSEVN

SEQ ID NO: 2917893 - protein, 7 aa, Entamoeba invadens
TTSKEKI

SEQ ID NO: 2917894 - protein, 6 aa, Entamoeba invadens
TTSKGF

SEQ ID NO: 2917895 - protein, 13 aa, Entamoeba invadens
TTSKTKRQELEEK

SEQ ID NO: 2917896 - protein, 10 aa, Entamoeba invadens
TTSLYGGSVN

SEQ ID NO: 2917897 - protein, 5 aa, Entamoeba invadens
TTSNE

SEQ ID NO: 2917898 - protein, 10 aa, Entamoeba invadens
TTSNIEKELK

SEQ ID NO: 2917899 - protein, 7 aa, Entamoeba invadens
TTSNNTI

SEQ ID NO: 2917900 - protein, 4 aa, Entamoeba invadens
TTSP

SEQ ID NO: 2917901 - protein, 7 aa, Entamoeba invadens
TTSPGDL

SEQ ID NO: 2917902 - protein, 9 aa, Entamoeba invadens
TTSPNTSVN

SEQ ID NO: 2917903 - protein, 5 aa, Entamoeba invadens
TTSPQ

SEQ ID NO: 2917904 - protein, 9 aa, Entamoeba invadens
TTSPYQTET

SEQ ID NO: 2917905 - protein, 18 aa, Entamoeba invadens
TTSQNDENSLNKSTENQD

SEQ ID NO: 2917906 - protein, 8 aa, Entamoeba invadens
TTSQVEAT

SEQ ID NO: 2917907 - protein, 8 aa, Entamoeba invadens
TTSRLQSQ

SEQ ID NO: 2917908 - protein, 7 aa, Entamoeba invadens
TTSRQTH

SEQ ID NO: 2917909 - protein, 20 aa, Entamoeba invadens
TTSSDIAKKLTSKSDMTKFS

SEQ ID NO: 2917910 - protein, 9 aa, Entamoeba invadens
TTSSDTTAE

SEQ ID NO: 2917911 - protein, 5 aa, Entamoeba invadens
TTSSE

SEQ ID NO: 2917912 - protein, 6 aa, Entamoeba invadens
TTSSFG

SEQ ID NO: 2917913 - protein, 7 aa, Entamoeba invadens
TTSSIEQ

SEQ ID NO: 2917914 - protein, 16 aa, Entamoeba invadens
TTSSISPSNPKYSQAL

SEQ ID NO: 2917915 - protein, 6 aa, Entamoeba invadens
TTSSKE

SEQ ID NO: 2917916 - protein, 16 aa, Entamoeba invadens
TTSSQTKIAPKITDKQ

SEQ ID NO: 2917917 - protein, 5 aa, Entamoeba invadens
TTSSR

SEQ ID NO: 2917918 - protein, 16 aa, Entamoeba invadens
TTSSSVISPVANSRGS

SEQ ID NO: 2917919 - protein, 36 aa, Entamoeba invadens
TTSSYDSLSERKTTKRSKDKSKKYLNQKNDLKSFES

SEQ ID NO: 2917920 - protein, 4 aa, Entamoeba invadens
TTST

SEQ ID NO: 2917921 - protein, 9 aa, Entamoeba invadens
TTSTNGSLE

SEQ ID NO: 2917922 - protein, 27 aa, Entamoeba invadens
TTSTPGIPKDHDSTESSYSPREENAEK

SEQ ID NO: 2917923 - protein, 22 aa, Entamoeba invadens
TTSTYKEGKREYNNITTQRDAQ

SEQ ID NO: 2917924 - protein, 4 aa, Entamoeba invadens
TTSV

SEQ ID NO: 2917925 - protein, 5 aa, Entamoeba invadens
TTSVG

SEQ ID NO: 2917926 - protein, 14 aa, Entamoeba invadens
TTSVHKKVNDGSNP

SEQ ID NO: 2917927 - protein, 5 aa, Entamoeba invadens
TTSVT

SEQ ID NO: 2917928 - protein, 16 aa, Entamoeba invadens
TTTADSVQGTKTEQSK

SEQ ID NO: 2917929 - protein, 6 aa, Entamoeba invadens
TTTAER

SEQ ID NO: 2917930 - protein, 17 aa, Entamoeba invadens
TTTAPTRSSAPMKREPI

SEQ ID NO: 2917931 - protein, 4 aa, Entamoeba invadens
TTTC

SEQ ID NO: 2917932 - protein, 5 aa, Entamoeba invadens
TTTDE

SEQ ID NO: 2917933 - protein, 16 aa, Entamoeba invadens
TTTDGEKYGKKIPNNI

SEQ ID NO: 2917934 - protein, 15 aa, Entamoeba invadens
TTTDRYDTAQFESDN

SEQ ID NO: 2917935 - protein, 7 aa, Entamoeba invadens
TTTDTYQ

SEQ ID NO: 2917936 - protein, 6 aa, Entamoeba invadens
TTTDVA

SEQ ID NO: 2917937 - protein, 6 aa, Entamoeba invadens
TTTDYS

SEQ ID NO: 2917938 - protein, 4 aa, Entamoeba invadens
TTTE

SEQ ID NO: 2917939 - protein, 17 aa, Entamoeba invadens
TTTEDTPDEKRDELPPI

SEQ ID NO: 2917940 - protein, 6 aa, Entamoeba invadens
TTTEEL

SEQ ID NO: 2917941 - protein, 14 aa, Entamoeba invadens
TTTEYKTKSLQEDS

SEQ ID NO: 2917942 - protein, 5 aa, Entamoeba invadens
TTTGD

SEQ ID NO: 2917943 - protein, 7 aa, Entamoeba invadens
TTTGEGL

SEQ ID NO: 2917944 - protein, 6 aa, Entamoeba invadens
TTTGLS

SEQ ID NO: 2917945 - protein, 5 aa, Entamoeba invadens
TTTGQ

SEQ ID NO: 2917946 - protein, 9 aa, Entamoeba invadens
TTTGRPYPT

SEQ ID NO: 2917947 - protein, 15 aa, Entamoeba invadens
TTTHMKGAGSYRSID

SEQ ID NO: 2917948 - protein, 7 aa, Entamoeba invadens
TTTIDQN

SEQ ID NO: 2917949 - protein, 9 aa, Entamoeba invadens
TTTIRDDGE

SEQ ID NO: 2917950 - protein, 13 aa, Entamoeba invadens
TTTKQSNDGITDT

SEQ ID NO: 2917951 - protein, 11 aa, Entamoeba invadens
TTTKRKEKSVQ

SEQ ID NO: 2917952 - protein, 9 aa, Entamoeba invadens
TTTKSSTIK

SEQ ID NO: 2917953 - protein, 6 aa, Entamoeba invadens
TTTKYL

SEQ ID NO: 2917954 - protein, 4 aa, Entamoeba invadens
TTTL

SEQ ID NO: 2917955 - protein, 5 aa, Entamoeba invadens
TTTLT

SEQ ID NO: 2917956 - protein, 5 aa, Entamoeba invadens
TTTNF

SEQ ID NO: 2917957 - protein, 6 aa, Entamoeba invadens
TTTNGT

SEQ ID NO: 2917958 - protein, 8 aa, Entamoeba invadens
TTTNNKKE

SEQ ID NO: 2917959 - protein, 5 aa, Entamoeba invadens
TTTNP

SEQ ID NO: 2917960 - protein, 15 aa, Entamoeba invadens
TTTNPPKPAEKQNEM

SEQ ID NO: 2917961 - protein, 14 aa, Entamoeba invadens
TTTPETPKGIPPLN

SEQ ID NO: 2917962 - protein, 29 aa, Entamoeba invadens
TTTPPPLPPKPKFKRQLPKTEVSKSCDSL

SEQ ID NO: 2917963 - protein, 7 aa, Entamoeba invadens
TTTPYEQ

SEQ ID NO: 2917964 - protein, 4 aa, Entamoeba invadens
TTTQ

SEQ ID NO: 2917965 - protein, 11 aa, Entamoeba invadens
TTTQKAGNNYN

SEQ ID NO: 2917966 - protein, 5 aa, Entamoeba invadens
TTTQM

SEQ ID NO: 2917967 - protein, 23 aa, Entamoeba invadens
TTTQPVTTRPPLQPPQQPSLAKQ

SEQ ID NO: 2917968 - protein, 11 aa, Entamoeba invadens
TTTQSMKGGDL

SEQ ID NO: 2917969 - protein, 4 aa, Entamoeba invadens
TTTR

SEQ ID NO: 2917970 - protein, 24 aa, Entamoeba invadens
TTTRDDLKSAVEGLEKTAEEKKNE

SEQ ID NO: 2917971 - protein, 13 aa, Entamoeba invadens
TTTRNIPSEITAD

SEQ ID NO: 2917972 - protein, 5 aa, Entamoeba invadens
TTTRT

SEQ ID NO: 2917973 - protein, 14 aa, Entamoeba invadens
TTTSGGKSKSDFYK

SEQ ID NO: 2917974 - protein, 5 aa, Entamoeba invadens
TTTSL

SEQ ID NO: 2917975 - protein, 8 aa, Entamoeba invadens
TTTSNDNT

SEQ ID NO: 2917976 - protein, 6 aa, Entamoeba invadens
TTTSNI

SEQ ID NO: 2917977 - protein, 9 aa, Entamoeba invadens
TTTSQDELD

SEQ ID NO: 2917978 - protein, 8 aa, Entamoeba invadens
TTTSTNPL

SEQ ID NO: 2917979 - protein, 19 aa, Entamoeba invadens
TTTTAPQPTQSENKTDTNN

SEQ ID NO: 2917980 - protein, 9 aa, Entamoeba invadens
TTTTESIDS

SEQ ID NO: 2917981 - protein, 27 aa, Entamoeba invadens
TTTTIKRDGVKGKEKEVETKDEKAVGE

SEQ ID NO: 2917982 - protein, 34 aa, Entamoeba invadens
TTTTLESPDCPPQLPHSSTQQNALEKPPELTATP

SEQ ID NO: 2917983 - protein, 6 aa, Entamoeba invadens
TTTTLN

SEQ ID NO: 2917984 - protein, 10 aa, Entamoeba invadens
TTTTPTHNSS

SEQ ID NO: 2917985 - protein, 10 aa, Entamoeba invadens
TTTTSQSQNV

SEQ ID NO: 2917986 - protein, 7 aa, Entamoeba invadens
TTTTSYK

SEQ ID NO: 2917987 - protein, 6 aa, Entamoeba invadens
TTTVDD

SEQ ID NO: 2917988 - protein, 5 aa, Entamoeba invadens
TTTVS

SEQ ID NO: 2917989 - protein, 11 aa, Entamoeba invadens
TTVDTPQTPPL

SEQ ID NO: 2917990 - protein, 4 aa, Entamoeba invadens
TTVE

SEQ ID NO: 2917991 - protein, 22 aa, Entamoeba invadens
TTVEEGKSCEEKQEEVQPSQVS

SEQ ID NO: 2917992 - protein, 32 aa, Entamoeba invadens
TTVENKAQQKQIMEEEKTTEKVNLKESPTNGL

SEQ ID NO: 2917993 - protein, 5 aa, Entamoeba invadens
TTVES

SEQ ID NO: 2917994 - protein, 10 aa, Entamoeba invadens
TTVETPSEKV

SEQ ID NO: 2917995 - protein, 23 aa, Entamoeba invadens
TTVKRSESLMKGNDKENKEKKII

SEQ ID NO: 2917996 - protein, 12 aa, Entamoeba invadens
TTVLNSRNACVI

SEQ ID NO: 2917997 - protein, 5 aa, Entamoeba invadens
TTVNG

SEQ ID NO: 2917998 - protein, 4 aa, Entamoeba invadens
TTVP

SEQ ID NO: 2917999 - protein, 6 aa, Entamoeba invadens
TTVPNG

SEQ ID NO: 2918000 - protein, 5 aa, Entamoeba invadens
TTVPV

SEQ ID NO: 2918001 - protein, 5 aa, Entamoeba invadens
TTVSG

SEQ ID NO: 2918002 - protein, 5 aa, Entamoeba invadens
TTVSI

SEQ ID NO: 2918003 - protein, 4 aa, Entamoeba invadens
TTVT

SEQ ID NO: 2918004 - protein, 5 aa, Entamoeba invadens
TTVTN

SEQ ID NO: 2918005 - protein, 15 aa, Entamoeba invadens
TTVTNCKRYGAQNTN

SEQ ID NO: 2918006 - protein, 12 aa, Entamoeba invadens
TTVTQPNTLTTQ

SEQ ID NO: 2918007 - protein, 5 aa, Entamoeba invadens
TTVTS

SEQ ID NO: 2918008 - protein, 10 aa, Entamoeba invadens
TTVTSETAGQ

SEQ ID NO: 2918009 - protein, 6 aa, Entamoeba invadens
TTVTTG

SEQ ID NO: 2918010 - protein, 6 aa, Entamoeba invadens
TTYDSI

SEQ ID NO: 2918011 - protein, 10 aa, Entamoeba invadens
TTYEGKDGPF

SEQ ID NO: 2918012 - protein, 9 aa, Entamoeba invadens
TTYENKEKE

SEQ ID NO: 2918013 - protein, 11 aa, Entamoeba invadens
TTYGLSGSSTT

SEQ ID NO: 2918014 - protein, 8 aa, Entamoeba invadens
TTYGPTEI

SEQ ID NO: 2918015 - protein, 4 aa, Entamoeba invadens
TTYP

SEQ ID NO: 2918016 - protein, 9 aa, Entamoeba invadens
TTYPSVEIG

SEQ ID NO: 2918017 - protein, 6 aa, Entamoeba invadens
TTYQTE

SEQ ID NO: 2918018 - protein, 5 aa, Entamoeba invadens
TTYSD

SEQ ID NO: 2918019 - protein, 9 aa, Entamoeba invadens
TTYSTAGSL

SEQ ID NO: 2918020 - protein, 9 aa, Entamoeba invadens
TTYSTVNKR

SEQ ID NO: 2918021 - protein, 4 aa, Entamoeba invadens
TTYT

SEQ ID NO: 2918022 - protein, 12 aa, Entamoeba invadens
TTYTKAAYNSNV

SEQ ID NO: 2918023 - protein, 9 aa, Entamoeba invadens
TVADFSKTE

SEQ ID NO: 2918024 - protein, 11 aa, Entamoeba invadens
TVAEQQDPSIT

SEQ ID NO: 2918025 - protein, 10 aa, Entamoeba invadens
TVAKKDTKTT

SEQ ID NO: 2918026 - protein, 10 aa, Entamoeba invadens
TVAKNKDNFE

SEQ ID NO: 2918027 - protein, 5 aa, Entamoeba invadens
TVAKV

SEQ ID NO: 2918028 - protein, 7 aa, Entamoeba invadens
TVANPNN

SEQ ID NO: 2918029 - protein, 40 aa, Entamoeba invadens
TVAPPPQPAPVQQPTPVQPTPQPVPVQQPVQPQQPASNPV

SEQ ID NO: 2918030 - protein, 6 aa, Entamoeba invadens
TVDDKD

SEQ ID NO: 2918031 - protein, 5 aa, Entamoeba invadens
TVDED

SEQ ID NO: 2918032 - protein, 5 aa, Entamoeba invadens
TVDEN

SEQ ID NO: 2918033 - protein, 6 aa, Entamoeba invadens
TVDESK

SEQ ID NO: 2918034 - protein, 12 aa, Entamoeba invadens
TVDESNKKYQKL

SEQ ID NO: 2918035 - protein, 6 aa, Entamoeba invadens
TVDGFE

SEQ ID NO: 2918036 - protein, 7 aa, Entamoeba invadens
TVDGGDT

SEQ ID NO: 2918037 - protein, 8 aa, Entamoeba invadens
TVDGSRKI

SEQ ID NO: 2918038 - protein, 4 aa, Entamoeba invadens
TVDK

SEQ ID NO: 2918039 - protein, 7 aa, Entamoeba invadens
TVDKNKC

SEQ ID NO: 2918040 - protein, 9 aa, Entamoeba invadens
TVDKNKDRN

SEQ ID NO: 2918041 - protein, 10 aa, Entamoeba invadens
TVDKNKTQNI

SEQ ID NO: 2918042 - protein, 10 aa, Entamoeba invadens
TVDKNNGKNI

SEQ ID NO: 2918043 - protein, 10 aa, Entamoeba invadens
TVDKNNGRNI

SEQ ID NO: 2918044 - protein, 10 aa, Entamoeba invadens
TVDKNNSRNI

SEQ ID NO: 2918045 - protein, 10 aa, Entamoeba invadens
TVDKSKPVLE

SEQ ID NO: 2918046 - protein, 9 aa, Entamoeba invadens
TVDKTQTKM

SEQ ID NO: 2918047 - protein, 4 aa, Entamoeba invadens
TVDN

SEQ ID NO: 2918048 - protein, 8 aa, Entamoeba invadens
TVDPISPG

SEQ ID NO: 2918049 - protein, 12 aa, Entamoeba invadens
TVDPKDKRKQIQ

SEQ ID NO: 2918050 - protein, 4 aa, Entamoeba invadens
TVDQ

SEQ ID NO: 2918051 - protein, 15 aa, Entamoeba invadens
TVDQGTKKEVLDTLL

SEQ ID NO: 2918052 - protein, 10 aa, Entamoeba invadens
TVDRNKQRNI

SEQ ID NO: 2918053 - protein, 10 aa, Entamoeba invadens
TVDRNKSRDI

SEQ ID NO: 2918054 - protein, 10 aa, Entamoeba invadens
TVDRNKSRNL

SEQ ID NO: 2918055 - protein, 10 aa, Entamoeba invadens
TVDRNSSRNI

SEQ ID NO: 2918056 - protein, 6 aa, Entamoeba invadens
TVDSER

SEQ ID NO: 2918057 - protein, 11 aa, Entamoeba invadens
TVDSKKRTDNI

SEQ ID NO: 2918058 - protein, 10 aa, Entamoeba invadens
TVDTNSNKNI

SEQ ID NO: 2918059 - protein, 7 aa, Entamoeba invadens
TVDTTEA

SEQ ID NO: 2918060 - protein, 25 aa, Entamoeba invadens
TVEAQTSNSIESASTEVVQQNPQTV

SEQ ID NO: 2918061 - protein, 5 aa, Entamoeba invadens
TVEED

SEQ ID NO: 2918062 - protein, 7 aa, Entamoeba invadens
TVEEGDM

SEQ ID NO: 2918063 - protein, 10 aa, Entamoeba invadens
TVEEHKESQT

SEQ ID NO: 2918064 - protein, 7 aa, Entamoeba invadens
TVEERTE

SEQ ID NO: 2918065 - protein, 11 aa, Entamoeba invadens
TVEGNKINEIE

SEQ ID NO: 2918066 - protein, 29 aa, Entamoeba invadens
TVEKDEKDEKIENSEKVELSKNEKIEHAK

SEQ ID NO: 2918067 - protein, 27 aa, Entamoeba invadens
TVEKEEKVEISKEVKEQRNEATNPVVT

SEQ ID NO: 2918068 - protein, 26 aa, Entamoeba invadens
TVEKEGDKKKRKMPIANPNQPALSSK

SEQ ID NO: 2918069 - protein, 7 aa, Entamoeba invadens
TVEKGDS

SEQ ID NO: 2918070 - protein, 25 aa, Entamoeba invadens
TVEKKKQLLSGKNSMKKLKEDEKQS

SEQ ID NO: 2918071 - protein, 9 aa, Entamoeba invadens
TVEKNKDRN

SEQ ID NO: 2918072 - protein, 9 aa, Entamoeba invadens
TVEKQISNQ

SEQ ID NO: 2918073 - protein, 9 aa, Entamoeba invadens
TVEKQKEKI

SEQ ID NO: 2918074 - protein, 10 aa, Entamoeba invadens
TVEKQKEKIE

SEQ ID NO: 2918075 - protein, 20 aa, Entamoeba invadens
TVEKSSFKRQLRQKQNPNIK

SEQ ID NO: 2918076 - protein, 9 aa, Entamoeba invadens
TVEKSYTAN

SEQ ID NO: 2918077 - protein, 11 aa, Entamoeba invadens
TVENNKSQNIE

SEQ ID NO: 2918078 - protein, 4 aa, Entamoeba invadens
TVEP

SEQ ID NO: 2918079 - protein, 9 aa, Entamoeba invadens
TVEQKREEI

SEQ ID NO: 2918080 - protein, 7 aa, Entamoeba invadens
TVEREHE

SEQ ID NO: 2918081 - protein, 5 aa, Entamoeba invadens
TVERP

SEQ ID NO: 2918082 - protein, 8 aa, Entamoeba invadens
TVESEKEY

SEQ ID NO: 2918083 - protein, 10 aa, Entamoeba invadens
TVESESRLTL

SEQ ID NO: 2918084 - protein, 5 aa, Entamoeba invadens
TVESL

SEQ ID NO: 2918085 - protein, 14 aa, Entamoeba invadens
TVESRVQATQSPFH

SEQ ID NO: 2918086 - protein, 11 aa, Entamoeba invadens
TVESTEQGLNE

SEQ ID NO: 2918087 - protein, 12 aa, Entamoeba invadens
TVETANPEKEVE

SEQ ID NO: 2918088 - protein, 41 aa, Entamoeba invadens
TVETIEKNDNTKMEEEVKEVQKTKVEGENLEENKKETETPV

SEQ ID NO: 2918089 - protein, 9 aa, Entamoeba invadens
TVETKTMAE

SEQ ID NO: 2918090 - protein, 17 aa, Entamoeba invadens
TVFGSPASSPFNAPQET

SEQ ID NO: 2918091 - protein, 7 aa, Entamoeba invadens
TVGDDKK

SEQ ID NO: 2918092 - protein, 6 aa, Entamoeba invadens
TVGDKK

SEQ ID NO: 2918093 - protein, 17 aa, Entamoeba invadens
TVGDQAKVKAAGGIRTY

SEQ ID NO: 2918094 - protein, 13 aa, Entamoeba invadens
TVGDSNEVLVTKA

SEQ ID NO: 2918095 - protein, 15 aa, Entamoeba invadens
TVGEECYKGDKNKLT

SEQ ID NO: 2918096 - protein, 5 aa, Entamoeba invadens
TVGEN

SEQ ID NO: 2918097 - protein, 15 aa, Entamoeba invadens
TVGGSKKQSTKVPST

SEQ ID NO: 2918098 - protein, 13 aa, Entamoeba invadens
TVGKKPTRHTRDD

SEQ ID NO: 2918099 - protein, 17 aa, Entamoeba invadens
TVGKPYKATVDNSQNRA

SEQ ID NO: 2918100 - protein, 7 aa, Entamoeba invadens
TVGKREE

SEQ ID NO: 2918101 - protein, 18 aa, Entamoeba invadens
TVGLDTNTVNKISGAANT

SEQ ID NO: 2918102 - protein, 4 aa, Entamoeba invadens
TVGP

SEQ ID NO: 2918103 - protein, 5 aa, Entamoeba invadens
TVGQE

SEQ ID NO: 2918104 - protein, 11 aa, Entamoeba invadens
TVGRGKNKMKQ

SEQ ID NO: 2918105 - protein, 8 aa, Entamoeba invadens
TVGSPTIQ

SEQ ID NO: 2918106 - protein, 10 aa, Entamoeba invadens
TVGTSPDGET

SEQ ID NO: 2918107 - protein, 5 aa, Entamoeba invadens
TVGVN

SEQ ID NO: 2918108 - protein, 6 aa, Entamoeba invadens
TVGYSD

SEQ ID NO: 2918109 - protein, 14 aa, Entamoeba invadens
TVIPQEKSEGEDTK

SEQ ID NO: 2918110 - protein, 23 aa, Entamoeba invadens
TVIPTAQGQLPKTQLSTDDIDES

SEQ ID NO: 2918111 - protein, 14 aa, Entamoeba invadens
TVIQGTEKLENSED

SEQ ID NO: 2918112 - protein, 9 aa, Entamoeba invadens
TVITPGESS

SEQ ID NO: 2918113 - protein, 4 aa, Entamoeba invadens
TVKE

SEQ ID NO: 2918114 - protein, 6 aa, Entamoeba invadens
TVKEES

SEQ ID NO: 2918115 - protein, 12 aa, Entamoeba invadens
TVKGEEVDITRK

SEQ ID NO: 2918116 - protein, 9 aa, Entamoeba invadens
TVKGKSQLT

SEQ ID NO: 2918117 - protein, 19 aa, Entamoeba invadens
TVKKDEHEKINDVTDRTDI

SEQ ID NO: 2918118 - protein, 8 aa, Entamoeba invadens
TVKKEQTS

SEQ ID NO: 2918119 - protein, 10 aa, Entamoeba invadens
TVKPDRKGRG

SEQ ID NO: 2918120 - protein, 9 aa, Entamoeba invadens
TVKPQVSSA

SEQ ID NO: 2918121 - protein, 8 aa, Entamoeba invadens
TVKQKDSI

SEQ ID NO: 2918122 - protein, 5 aa, Entamoeba invadens
TVKQR

SEQ ID NO: 2918123 - protein, 6 aa, Entamoeba invadens
TVKQRI

SEQ ID NO: 2918124 - protein, 10 aa, Entamoeba invadens
TVKRRKDLNR

SEQ ID NO: 2918125 - protein, 7 aa, Entamoeba invadens
TVKSGKY

SEQ ID NO: 2918126 - protein, 6 aa, Entamoeba invadens
TVKSIG

SEQ ID NO: 2918127 - protein, 8 aa, Entamoeba invadens
TVKSIGDS

SEQ ID NO: 2918128 - protein, 14 aa, Entamoeba invadens
TVKTPGKDRWTLPG

SEQ ID NO: 2918129 - protein, 8 aa, Entamoeba invadens
TVKTTPTR

SEQ ID NO: 2918130 - protein, 9 aa, Entamoeba invadens
TVLAESEEV

SEQ ID NO: 2918131 - protein, 22 aa, Entamoeba invadens
TVLAKDKKKKKKKQLDEESTSN

SEQ ID NO: 2918132 - protein, 8 aa, Entamoeba invadens
TVLGRSSQ

SEQ ID NO: 2918133 - protein, 4 aa, Entamoeba invadens
TVLS

SEQ ID NO: 2918134 - protein, 8 aa, Entamoeba invadens
TVLSPDGG

SEQ ID NO: 2918135 - protein, 11 aa, Entamoeba invadens
TVMSGSADGSI

SEQ ID NO: 2918136 - protein, 17 aa, Entamoeba invadens
TVMSTNANDKKSPKTNY

SEQ ID NO: 2918137 - protein, 16 aa, Entamoeba invadens
TVMTPQTVRNSNEQQQ

SEQ ID NO: 2918138 - protein, 9 aa, Entamoeba invadens
TVNGITDEQ

SEQ ID NO: 2918139 - protein, 7 aa, Entamoeba invadens
TVNGNEC

SEQ ID NO: 2918140 - protein, 7 aa, Entamoeba invadens
TVNGNKI

SEQ ID NO: 2918141 - protein, 4 aa, Entamoeba invadens
TVNN

SEQ ID NO: 2918142 - protein, 6 aa, Entamoeba invadens
TVNNSG

SEQ ID NO: 2918143 - protein, 27 aa, Entamoeba invadens
TVNPKEYGETIGEERQVNGGDGWGGLG

SEQ ID NO: 2918144 - protein, 65 aa, Entamoeba invadens
TVNPSNENEDQKTIEGTPEQSKQEESQQEETKEEQPKQDEKAQEESKEPEIEGKKIRQRKQGNLP

SEQ ID NO: 2918145 - protein, 5 aa, Entamoeba invadens
TVNPT

SEQ ID NO: 2918146 - protein, 7 aa, Entamoeba invadens
TVNPTNV

SEQ ID NO: 2918147 - protein, 8 aa, Entamoeba invadens
TVNQQQYK

SEQ ID NO: 2918148 - protein, 6 aa, Entamoeba invadens
TVNQQT

SEQ ID NO: 2918149 - protein, 14 aa, Entamoeba invadens
TVNSGDLKNLKNGE

SEQ ID NO: 2918150 - protein, 13 aa, Entamoeba invadens
TVNSTNALPNQKR

SEQ ID NO: 2918151 - protein, 6 aa, Entamoeba invadens
TVNTEE

SEQ ID NO: 2918152 - protein, 13 aa, Entamoeba invadens
TVNTKSVDKEKDG

SEQ ID NO: 2918153 - protein, 10 aa, Entamoeba invadens
TVNTNKSRNI

SEQ ID NO: 2918154 - protein, 12 aa, Entamoeba invadens
TVNTPNKQINAS

SEQ ID NO: 2918155 - protein, 15 aa, Entamoeba invadens
TVNTTETKVTEVPEE

SEQ ID NO: 2918156 - protein, 5 aa, Entamoeba invadens
TVPAC

SEQ ID NO: 2918157 - protein, 57 aa, Entamoeba invadens
TVPADSGTVQNEEGKVEAKVDSKVDSKEFSHKEKERLGDDEEEKAMHRSRTKTSQLR

SEQ ID NO: 2918158 - protein, 7 aa, Entamoeba invadens
TVPDQNK

SEQ ID NO: 2918159 - protein, 8 aa, Entamoeba invadens
TVPEEKES

SEQ ID NO: 2918160 - protein, 5 aa, Entamoeba invadens
TVPEI

SEQ ID NO: 2918161 - protein, 15 aa, Entamoeba invadens
TVPEKESDKNEVKSE

SEQ ID NO: 2918162 - protein, 7 aa, Entamoeba invadens
TVPIQGQ

SEQ ID NO: 2918163 - protein, 6 aa, Entamoeba invadens
TVPKGA

SEQ ID NO: 2918164 - protein, 30 aa, Entamoeba invadens
TVPKKESKKQVDSDDQSDKDDEKDEKKNKI

SEQ ID NO: 2918165 - protein, 7 aa, Entamoeba invadens
TVPKNEA

SEQ ID NO: 2918166 - protein, 9 aa, Entamoeba invadens
TVPLSNPRW

SEQ ID NO: 2918167 - protein, 7 aa, Entamoeba invadens
TVPNPTY

SEQ ID NO: 2918168 - protein, 14 aa, Entamoeba invadens
TVPNTGKVFSSKKK

SEQ ID NO: 2918169 - protein, 11 aa, Entamoeba invadens
TVPPKQSQGEL

SEQ ID NO: 2918170 - protein, 16 aa, Entamoeba invadens
TVPPNAETKESAMQQV

SEQ ID NO: 2918171 - protein, 13 aa, Entamoeba invadens
TVPPPRSVRGSTP

SEQ ID NO: 2918172 - protein, 8 aa, Entamoeba invadens
TVPPQCDG

SEQ ID NO: 2918173 - protein, 8 aa, Entamoeba invadens
TVPPVNGT

SEQ ID NO: 2918174 - protein, 11 aa, Entamoeba invadens
TVPQKESAVKN

SEQ ID NO: 2918175 - protein, 9 aa, Entamoeba invadens
TVPQQQNSQ

SEQ ID NO: 2918176 - protein, 5 aa, Entamoeba invadens
TVPSG

SEQ ID NO: 2918177 - protein, 9 aa, Entamoeba invadens
TVPSNKSIK

SEQ ID NO: 2918178 - protein, 5 aa, Entamoeba invadens
TVPSQ

SEQ ID NO: 2918179 - protein, 7 aa, Entamoeba invadens
TVPTGSY

SEQ ID NO: 2918180 - protein, 7 aa, Entamoeba invadens
TVPTKQD

SEQ ID NO: 2918181 - protein, 6 aa, Entamoeba invadens
TVPTTQ

SEQ ID NO: 2918182 - protein, 7 aa, Entamoeba invadens
TVPVTQK

SEQ ID NO: 2918183 - protein, 6 aa, Entamoeba invadens
TVQDTV

SEQ ID NO: 2918184 - protein, 5 aa, Entamoeba invadens
TVQED

SEQ ID NO: 2918185 - protein, 12 aa, Entamoeba invadens
TVQEGTPQQNIT

SEQ ID NO: 2918186 - protein, 16 aa, Entamoeba invadens
TVQEKDEKCNETKNEI

SEQ ID NO: 2918187 - protein, 11 aa, Entamoeba invadens
TVQGSRKAVYA

SEQ ID NO: 2918188 - protein, 11 aa, Entamoeba invadens
TVQKAEDELPA

SEQ ID NO: 2918189 - protein, 27 aa, Entamoeba invadens
TVQKGDKLDTTPPSNPPPIPDTIITVT

SEQ ID NO: 2918190 - protein, 6 aa, Entamoeba invadens
TVQKGS

SEQ ID NO: 2918191 - protein, 9 aa, Entamoeba invadens
TVQPAAESF

SEQ ID NO: 2918192 - protein, 7 aa, Entamoeba invadens
TVQPKGK

SEQ ID NO: 2918193 - protein, 26 aa, Entamoeba invadens
TVQQKSPVIQTSPRENEQIDPCPSPR

SEQ ID NO: 2918194 - protein, 7 aa, Entamoeba invadens
TVQVTTN

SEQ ID NO: 2918195 - protein, 10 aa, Entamoeba invadens
TVRSSKDSNI

SEQ ID NO: 2918196 - protein, 8 aa, Entamoeba invadens
TVRTASGK

SEQ ID NO: 2918197 - protein, 4 aa, Entamoeba invadens
TVSA

SEQ ID NO: 2918198 - protein, 15 aa, Entamoeba invadens
TVSATQDAMSKIPEH

SEQ ID NO: 2918199 - protein, 9 aa, Entamoeba invadens
TVSATQDVQ

SEQ ID NO: 2918200 - protein, 8 aa, Entamoeba invadens
TVSDDNLR

SEQ ID NO: 2918201 - protein, 9 aa, Entamoeba invadens
TVSEEAQRK

SEQ ID NO: 2918202 - protein, 9 aa, Entamoeba invadens
TVSEKDKVI

SEQ ID NO: 2918203 - protein, 18 aa, Entamoeba invadens
TVSESDNENWYGGKTNAN

SEQ ID NO: 2918204 - protein, 14 aa, Entamoeba invadens
TVSGGGKSEISKNI

SEQ ID NO: 2918205 - protein, 14 aa, Entamoeba invadens
TVSGGGKSEISKSI

SEQ ID NO: 2918206 - protein, 8 aa, Entamoeba invadens
TVSGKRGD

SEQ ID NO: 2918207 - protein, 7 aa, Entamoeba invadens
TVSGRTP

SEQ ID NO: 2918208 - protein, 10 aa, Entamoeba invadens
TVSHNSRAEY

SEQ ID NO: 2918209 - protein, 13 aa, Entamoeba invadens
TVSITQSKKVTRE

SEQ ID NO: 2918210 - protein, 32 aa, Entamoeba invadens
TVSKETKIEAQKREEEEVVSRNESELESRNNE

SEQ ID NO: 2918211 - protein, 36 aa, Entamoeba invadens
TVSKLTPDLQAAKDNIKALQKQNKDLLEKNDDLQHE

SEQ ID NO: 2918212 - protein, 8 aa, Entamoeba invadens
TVSLNRSQ

SEQ ID NO: 2918213 - protein, 7 aa, Entamoeba invadens
TVSNKEA

SEQ ID NO: 2918214 - protein, 6 aa, Entamoeba invadens
TVSNVD

SEQ ID NO: 2918215 - protein, 6 aa, Entamoeba invadens
TVSPNT

SEQ ID NO: 2918216 - protein, 14 aa, Entamoeba invadens
TVSPPIAYSFFNFP

SEQ ID NO: 2918217 - protein, 10 aa, Entamoeba invadens
TVSPSTTQTE

SEQ ID NO: 2918218 - protein, 23 aa, Entamoeba invadens
TVSRGEDTKVSGTIGTLTAKAEE

SEQ ID NO: 2918219 - protein, 9 aa, Entamoeba invadens
TVSSESPDF

SEQ ID NO: 2918220 - protein, 7 aa, Entamoeba invadens
TVSSGMD

SEQ ID NO: 2918221 - protein, 7 aa, Entamoeba invadens
TVSSGNK

SEQ ID NO: 2918222 - protein, 16 aa, Entamoeba invadens
TVSSPSYTQKRVTLGK

SEQ ID NO: 2918223 - protein, 8 aa, Entamoeba invadens
TVSSTTSP

SEQ ID NO: 2918224 - protein, 9 aa, Entamoeba invadens
TVSTDLKSL

SEQ ID NO: 2918225 - protein, 9 aa, Entamoeba invadens
TVSTESKIQ

SEQ ID NO: 2918226 - protein, 12 aa, Entamoeba invadens
TVSTPDSPEKIK

SEQ ID NO: 2918227 - protein, 28 aa, Entamoeba invadens
TVSTPQKDDSNLELSKSETQKSETSQVQ

SEQ ID NO: 2918228 - protein, 9 aa, Entamoeba invadens
TVSYPDAKK

SEQ ID NO: 2918229 - protein, 8 aa, Entamoeba invadens
TVTASNGV

SEQ ID NO: 2918230 - protein, 8 aa, Entamoeba invadens
TVTATKSS

SEQ ID NO: 2918231 - protein, 8 aa, Entamoeba invadens
TVTENDEI

SEQ ID NO: 2918232 - protein, 5 aa, Entamoeba invadens
TVTES

SEQ ID NO: 2918233 - protein, 8 aa, Entamoeba invadens
TVTETQEV

SEQ ID NO: 2918234 - protein, 7 aa, Entamoeba invadens
TVTGQGI

SEQ ID NO: 2918235 - protein, 5 aa, Entamoeba invadens
TVTGT

SEQ ID NO: 2918236 - protein, 13 aa, Entamoeba invadens
TVTIKGPKPFPPQ

SEQ ID NO: 2918237 - protein, 7 aa, Entamoeba invadens
TVTNENE

SEQ ID NO: 2918238 - protein, 14 aa, Entamoeba invadens
TVTPEFTDEQYNTV

SEQ ID NO: 2918239 - protein, 10 aa, Entamoeba invadens
TVTPQKIGTY

SEQ ID NO: 2918240 - protein, 5 aa, Entamoeba invadens
TVTQN

SEQ ID NO: 2918241 - protein, 4 aa, Entamoeba invadens
TVTR

SEQ ID NO: 2918242 - protein, 9 aa, Entamoeba invadens
TVTRNNKSE

SEQ ID NO: 2918243 - protein, 6 aa, Entamoeba invadens
TVTRPG

SEQ ID NO: 2918244 - protein, 5 aa, Entamoeba invadens
TVTSL

SEQ ID NO: 2918245 - protein, 6 aa, Entamoeba invadens
TVTSNE

SEQ ID NO: 2918246 - protein, 6 aa, Entamoeba invadens
TVTSVG

SEQ ID NO: 2918247 - protein, 7 aa, Entamoeba invadens
TVTTEYD

SEQ ID NO: 2918248 - protein, 12 aa, Entamoeba invadens
TVTTEYDKNNNI

SEQ ID NO: 2918249 - protein, 6 aa, Entamoeba invadens
TVTTKE

SEQ ID NO: 2918250 - protein, 5 aa, Entamoeba invadens
TVTTR

SEQ ID NO: 2918251 - protein, 11 aa, Entamoeba invadens
TVTTRKDVANG

SEQ ID NO: 2918252 - protein, 11 aa, Entamoeba invadens
TVTTRYDKNNN

SEQ ID NO: 2918253 - protein, 13 aa, Entamoeba invadens
TVTTTSPPSKNKK

SEQ ID NO: 2918254 - protein, 8 aa, Entamoeba invadens
TVTVNGTT

SEQ ID NO: 2918255 - protein, 5 aa, Entamoeba invadens
TVTYP

SEQ ID NO: 2918256 - protein, 37 aa, Entamoeba invadens
TVVPDTQQTDNGYLSTNPRVISPQNPNGQRQPSEPQL

SEQ ID NO: 2918257 - protein, 4 aa, Entamoeba invadens
TVYK

SEQ ID NO: 2918258 - protein, 9 aa, Entamoeba invadens
TVYSPKGDK

SEQ ID NO: 2918259 - protein, 9 aa, Entamoeba invadens
TVYSYSTTG

SEQ ID NO: 2918260 - protein, 5 aa, Entamoeba invadens
TWEDE

SEQ ID NO: 2918261 - protein, 11 aa, Entamoeba invadens
TWEGHPDGKTL

SEQ ID NO: 2918262 - protein, 12 aa, Entamoeba invadens
TWKQSKEDVSKS

SEQ ID NO: 2918263 - protein, 11 aa, Entamoeba invadens
TWNGTDGKAHS

SEQ ID NO: 2918264 - protein, 8 aa, Entamoeba invadens
TWREKKGL

SEQ ID NO: 2918265 - protein, 6 aa, Entamoeba invadens
TWTPSN

SEQ ID NO: 2918266 - protein, 12 aa, Entamoeba invadens
TYAETSASNDIG

SEQ ID NO: 2918267 - protein, 110 aa, Entamoeba invadens
TYALDDKDGYGSPIRTSGSCDLTPDKPKRIEKEKTKESIKASPRKDRKEEKKKEKEKEKEKKKEEKEKKQDELRKSKQLAPSDPKTRTDKKLEKRKSDVSEAKKEKKNIE

SEQ ID NO: 2918268 - protein, 5 aa, Entamoeba invadens
TYAPM

SEQ ID NO: 2918269 - protein, 12 aa, Entamoeba invadens
TYASHRDEEIPK

SEQ ID NO: 2918270 - protein, 11 aa, Entamoeba invadens
TYASNGPTKLR

SEQ ID NO: 2918271 - protein, 4 aa, Entamoeba invadens
TYCS

SEQ ID NO: 2918272 - protein, 34 aa, Entamoeba invadens
TYDDISEKKTTNSNVFDDEKEGELVEKNGSGFTT

SEQ ID NO: 2918273 - protein, 4 aa, Entamoeba invadens
TYDE

SEQ ID NO: 2918274 - protein, 8 aa, Entamoeba invadens
TYDLPQTK

SEQ ID NO: 2918275 - protein, 32 aa, Entamoeba invadens
TYDNEINYDESSEGEQQKVQGSRLQKDSTSLL

SEQ ID NO: 2918276 - protein, 24 aa, Entamoeba invadens
TYDPYKPKSHQSSVASNSTRPRNL

SEQ ID NO: 2918277 - protein, 6 aa, Entamoeba invadens
TYEARK

SEQ ID NO: 2918278 - protein, 5 aa, Entamoeba invadens
TYEDK

SEQ ID NO: 2918279 - protein, 5 aa, Entamoeba invadens
TYEDP

SEQ ID NO: 2918280 - protein, 5 aa, Entamoeba invadens
TYEED

SEQ ID NO: 2918281 - protein, 15 aa, Entamoeba invadens
TYEGNINEAQNEITK

SEQ ID NO: 2918282 - protein, 6 aa, Entamoeba invadens
TYEKEL

SEQ ID NO: 2918283 - protein, 8 aa, Entamoeba invadens
TYEKETDT

SEQ ID NO: 2918284 - protein, 6 aa, Entamoeba invadens
TYEKKR

SEQ ID NO: 2918285 - protein, 17 aa, Entamoeba invadens
TYEKQNSIGGGLPYNEK

SEQ ID NO: 2918286 - protein, 4 aa, Entamoeba invadens
TYEN

SEQ ID NO: 2918287 - protein, 5 aa, Entamoeba invadens
TYENT

SEQ ID NO: 2918288 - protein, 9 aa, Entamoeba invadens
TYEPRSEKE

SEQ ID NO: 2918289 - protein, 12 aa, Entamoeba invadens
TYEPTLALSQFK

SEQ ID NO: 2918290 - protein, 17 aa, Entamoeba invadens
TYESGELNTTDNTTGGI

SEQ ID NO: 2918291 - protein, 18 aa, Entamoeba invadens
TYESQNKNEMTSIPSTPK

SEQ ID NO: 2918292 - protein, 6 aa, Entamoeba invadens
TYESTN

SEQ ID NO: 2918293 - protein, 7 aa, Entamoeba invadens
TYETPQS

SEQ ID NO: 2918294 - protein, 4 aa, Entamoeba invadens
TYGE

SEQ ID NO: 2918295 - protein, 7 aa, Entamoeba invadens
TYGEIGK

SEQ ID NO: 2918296 - protein, 5 aa, Entamoeba invadens
TYGEQ

SEQ ID NO: 2918297 - protein, 7 aa, Entamoeba invadens
TYGESQS

SEQ ID NO: 2918298 - protein, 4 aa, Entamoeba invadens
TYGG

SEQ ID NO: 2918299 - protein, 6 aa, Entamoeba invadens
TYGGGN

SEQ ID NO: 2918300 - protein, 17 aa, Entamoeba invadens
TYGPPPAYTDLIAELNN

SEQ ID NO: 2918301 - protein, 13 aa, Entamoeba invadens
TYGPTDPKEAENI

SEQ ID NO: 2918302 - protein, 5 aa, Entamoeba invadens
TYGSH

SEQ ID NO: 2918303 - protein, 5 aa, Entamoeba invadens
TYGSY

SEQ ID NO: 2918304 - protein, 9 aa, Entamoeba invadens
TYGTNDDEL

SEQ ID NO: 2918305 - protein, 5 aa, Entamoeba invadens
TYGVE

SEQ ID NO: 2918306 - protein, 7 aa, Entamoeba invadens
TYHTSGK

SEQ ID NO: 2918307 - protein, 4 aa, Entamoeba invadens
TYIR

SEQ ID NO: 2918308 - protein, 12 aa, Entamoeba invadens
TYISTTPEYTAL

SEQ ID NO: 2918309 - protein, 11 aa, Entamoeba invadens
TYKEKDINEGM

SEQ ID NO: 2918310 - protein, 9 aa, Entamoeba invadens
TYKERRSNH

SEQ ID NO: 2918311 - protein, 7 aa, Entamoeba invadens
TYKKSEK

SEQ ID NO: 2918312 - protein, 4 aa, Entamoeba invadens
TYKN

SEQ ID NO: 2918313 - protein, 14 aa, Entamoeba invadens
TYKPTSKEFTTEDP

SEQ ID NO: 2918314 - protein, 7 aa, Entamoeba invadens
TYKSGRF

SEQ ID NO: 2918315 - protein, 6 aa, Entamoeba invadens
TYKTEQ

SEQ ID NO: 2918316 - protein, 13 aa, Entamoeba invadens
TYLPNTSKYSEIY

SEQ ID NO: 2918317 - protein, 23 aa, Entamoeba invadens
TYLTNQNTCDSCGGSNAVCSTQN

SEQ ID NO: 2918318 - protein, 5 aa, Entamoeba invadens
TYMST

SEQ ID NO: 2918319 - protein, 6 aa, Entamoeba invadens
TYNERA

SEQ ID NO: 2918320 - protein, 30 aa, Entamoeba invadens
TYNERNNLDEEEDEEDEDESDNNSDDSYEE

SEQ ID NO: 2918321 - protein, 6 aa, Entamoeba invadens
TYNGVG

SEQ ID NO: 2918322 - protein, 13 aa, Entamoeba invadens
TYNKNDREQFGNT

SEQ ID NO: 2918323 - protein, 6 aa, Entamoeba invadens
TYNKNN

SEQ ID NO: 2918324 - protein, 6 aa, Entamoeba invadens
TYNNEP

SEQ ID NO: 2918325 - protein, 6 aa, Entamoeba invadens
TYNNKK

SEQ ID NO: 2918326 - protein, 5 aa, Entamoeba invadens
TYNNR

SEQ ID NO: 2918327 - protein, 9 aa, Entamoeba invadens
TYNPENHTK

SEQ ID NO: 2918328 - protein, 5 aa, Entamoeba invadens
TYNPI

SEQ ID NO: 2918329 - protein, 6 aa, Entamoeba invadens
TYNPTD

SEQ ID NO: 2918330 - protein, 5 aa, Entamoeba invadens
TYNSG

SEQ ID NO: 2918331 - protein, 11 aa, Entamoeba invadens
TYPDKGTQEDV

SEQ ID NO: 2918332 - protein, 5 aa, Entamoeba invadens
TYPDT

SEQ ID NO: 2918333 - protein, 9 aa, Entamoeba invadens
TYPEELDKT

SEQ ID NO: 2918334 - protein, 7 aa, Entamoeba invadens
TYPELKD

SEQ ID NO: 2918335 - protein, 4 aa, Entamoeba invadens
TYPF

SEQ ID NO: 2918336 - protein, 5 aa, Entamoeba invadens
TYPGK

SEQ ID NO: 2918337 - protein, 6 aa, Entamoeba invadens
TYPIPS

SEQ ID NO: 2918338 - protein, 5 aa, Entamoeba invadens
TYPKE

SEQ ID NO: 2918339 - protein, 6 aa, Entamoeba invadens
TYPKKS

SEQ ID NO: 2918340 - protein, 6 aa, Entamoeba invadens
TYPKPE

SEQ ID NO: 2918341 - protein, 7 aa, Entamoeba invadens
TYPKTFT

SEQ ID NO: 2918342 - protein, 41 aa, Entamoeba invadens
TYPPEFPDWSETSSTSSNDTDSNSTDSDDLLDSKKHTKSIN

SEQ ID NO: 2918343 - protein, 41 aa, Entamoeba invadens
TYPPEFPETSSTSSDDTDSNSTDSDDSEDSKKHTKSTNKVE

SEQ ID NO: 2918344 - protein, 6 aa, Entamoeba invadens
TYPSIN

SEQ ID NO: 2918345 - protein, 6 aa, Entamoeba invadens
TYPSSK

SEQ ID NO: 2918346 - protein, 4 aa, Entamoeba invadens
TYPT

SEQ ID NO: 2918347 - protein, 21 aa, Entamoeba invadens
TYPYRNEKKMGDPICDKGKGA

SEQ ID NO: 2918348 - protein, 4 aa, Entamoeba invadens
TYQD

SEQ ID NO: 2918349 - protein, 6 aa, Entamoeba invadens
TYQGKD

SEQ ID NO: 2918350 - protein, 11 aa, Entamoeba invadens
TYQPSATPKNL

SEQ ID NO: 2918351 - protein, 4 aa, Entamoeba invadens
TYQR

SEQ ID NO: 2918352 - protein, 5 aa, Entamoeba invadens
TYQST

SEQ ID NO: 2918353 - protein, 12 aa, Entamoeba invadens
TYRAMKNEKSNQ

SEQ ID NO: 2918354 - protein, 5 aa, Entamoeba invadens
TYREP

SEQ ID NO: 2918355 - protein, 5 aa, Entamoeba invadens
TYRGR

SEQ ID NO: 2918356 - protein, 6 aa, Entamoeba invadens
TYRITP

SEQ ID NO: 2918357 - protein, 7 aa, Entamoeba invadens
TYRNSTD

SEQ ID NO: 2918358 - protein, 5 aa, Entamoeba invadens
TYRPI

SEQ ID NO: 2918359 - protein, 15 aa, Entamoeba invadens
TYRQTQLESICLNAK

SEQ ID NO: 2918360 - protein, 15 aa, Entamoeba invadens
TYRSALENGKAKFKR

SEQ ID NO: 2918361 - protein, 18 aa, Entamoeba invadens
TYRSDNGDNNKNVTKLGE

SEQ ID NO: 2918362 - protein, 6 aa, Entamoeba invadens
TYSDTI

SEQ ID NO: 2918363 - protein, 10 aa, Entamoeba invadens
TYSDTNKMSS

SEQ ID NO: 2918364 - protein, 5 aa, Entamoeba invadens
TYSEE

SEQ ID NO: 2918365 - protein, 6 aa, Entamoeba invadens
TYSEFS

SEQ ID NO: 2918366 - protein, 5 aa, Entamoeba invadens
TYSER

SEQ ID NO: 2918367 - protein, 13 aa, Entamoeba invadens
TYSGKQGKITNTL

SEQ ID NO: 2918368 - protein, 13 aa, Entamoeba invadens
TYSGSEHRRRGIE

SEQ ID NO: 2918369 - protein, 4 aa, Entamoeba invadens
TYSI

SEQ ID NO: 2918370 - protein, 10 aa, Entamoeba invadens
TYSLTGSSGC

SEQ ID NO: 2918371 - protein, 6 aa, Entamoeba invadens
TYSNNN

SEQ ID NO: 2918372 - protein, 12 aa, Entamoeba invadens
TYSNSPRNLGQK

SEQ ID NO: 2918373 - protein, 6 aa, Entamoeba invadens
TYSPRY

SEQ ID NO: 2918374 - protein, 11 aa, Entamoeba invadens
TYSSEYKTTIG

SEQ ID NO: 2918375 - protein, 5 aa, Entamoeba invadens
TYSSF

SEQ ID NO: 2918376 - protein, 6 aa, Entamoeba invadens
TYSSSE

SEQ ID NO: 2918377 - protein, 4 aa, Entamoeba invadens
TYST

SEQ ID NO: 2918378 - protein, 6 aa, Entamoeba invadens
TYSTDT

SEQ ID NO: 2918379 - protein, 7 aa, Entamoeba invadens
TYSTPGR

SEQ ID NO: 2918380 - protein, 5 aa, Entamoeba invadens
TYSTR

SEQ ID NO: 2918381 - protein, 5 aa, Entamoeba invadens
TYTAS

SEQ ID NO: 2918382 - protein, 4 aa, Entamoeba invadens
TYTD

SEQ ID NO: 2918383 - protein, 13 aa, Entamoeba invadens
TYTDNDRNKYGNN

SEQ ID NO: 2918384 - protein, 5 aa, Entamoeba invadens
TYTEA

SEQ ID NO: 2918385 - protein, 10 aa, Entamoeba invadens
TYTENDRKKF

SEQ ID NO: 2918386 - protein, 13 aa, Entamoeba invadens
TYTENDRKKFGNN

SEQ ID NO: 2918387 - protein, 12 aa, Entamoeba invadens
TYTENDRKKYGY

SEQ ID NO: 2918388 - protein, 10 aa, Entamoeba invadens
TYTENDRNKY

SEQ ID NO: 2918389 - protein, 6 aa, Entamoeba invadens
TYTETV

SEQ ID NO: 2918390 - protein, 20 aa, Entamoeba invadens
TYTKEDKKEYGNTLPNNVNS

SEQ ID NO: 2918391 - protein, 13 aa, Entamoeba invadens
TYTKEDREKYGPI

SEQ ID NO: 2918392 - protein, 9 aa, Entamoeba invadens
TYTKEDVDN

SEQ ID NO: 2918393 - protein, 16 aa, Entamoeba invadens
TYTKKDRQKFGNNLPP

SEQ ID NO: 2918394 - protein, 13 aa, Entamoeba invadens
TYTKNDREKFGNK

SEQ ID NO: 2918395 - protein, 14 aa, Entamoeba invadens
TYTKNDREKFGNNI

SEQ ID NO: 2918396 - protein, 21 aa, Entamoeba invadens
TYTKNDREKFGNNIPSSVTSI

SEQ ID NO: 2918397 - protein, 21 aa, Entamoeba invadens
TYTKNDRKKFGNDIPSSVTSI

SEQ ID NO: 2918398 - protein, 13 aa, Entamoeba invadens
TYTKNDRKKFGNN

SEQ ID NO: 2918399 - protein, 19 aa, Entamoeba invadens
TYTKNDRKKFGNNIPPTVT

SEQ ID NO: 2918400 - protein, 20 aa, Entamoeba invadens
TYTKNDRKKFGNNIPSSVKS

SEQ ID NO: 2918401 - protein, 21 aa, Entamoeba invadens
TYTKNDRKKFGNNIPSSVTSI

SEQ ID NO: 2918402 - protein, 13 aa, Entamoeba invadens
TYTKNNREKFGNK

SEQ ID NO: 2918403 - protein, 10 aa, Entamoeba invadens
TYTKNNRKKF

SEQ ID NO: 2918404 - protein, 10 aa, Entamoeba invadens
TYTKSDRNAF

SEQ ID NO: 2918405 - protein, 9 aa, Entamoeba invadens
TYTKTDREM

SEQ ID NO: 2918406 - protein, 5 aa, Entamoeba invadens
TYTNR

SEQ ID NO: 2918407 - protein, 9 aa, Entamoeba invadens
TYTPIPNTF

SEQ ID NO: 2918408 - protein, 7 aa, Entamoeba invadens
TYTPTHR

SEQ ID NO: 2918409 - protein, 6 aa, Entamoeba invadens
TYTPTV

SEQ ID NO: 2918410 - protein, 22 aa, Entamoeba invadens
TYTQKDREKFGNNIPSSSTSIG

SEQ ID NO: 2918411 - protein, 17 aa, Entamoeba invadens
TYTQKNREKFGNNIPSS

SEQ ID NO: 2918412 - protein, 21 aa, Entamoeba invadens
TYTQKNREKFGNNIPSSVTSI

SEQ ID NO: 2918413 - protein, 13 aa, Entamoeba invadens
TYTQNDREKFGNN

SEQ ID NO: 2918414 - protein, 29 aa, Entamoeba invadens
TYTQNDREKFGNNIPSGVKSIGVVSVNVV

SEQ ID NO: 2918415 - protein, 19 aa, Entamoeba invadens
TYTQNDRKKFGKNIPPTVT

SEQ ID NO: 2918416 - protein, 21 aa, Entamoeba invadens
TYTQNDRKKFGNKIPSSVTSI

SEQ ID NO: 2918417 - protein, 14 aa, Entamoeba invadens
TYTQNDRKKFGNNI

SEQ ID NO: 2918418 - protein, 20 aa, Entamoeba invadens
TYTQNDRKKFGNNIPSSVTS

SEQ ID NO: 2918419 - protein, 23 aa, Entamoeba invadens
TYTQNDRKKFGNNIPSSVTSIGD

SEQ ID NO: 2918420 - protein, 15 aa, Entamoeba invadens
TYTQNDRKKSGNNIP

SEQ ID NO: 2918421 - protein, 10 aa, Entamoeba invadens
TYTQNDRNKF

SEQ ID NO: 2918422 - protein, 12 aa, Entamoeba invadens
TYTQNDRNKYGY

SEQ ID NO: 2918423 - protein, 5 aa, Entamoeba invadens
TYTQR

SEQ ID NO: 2918424 - protein, 6 aa, Entamoeba invadens
TYTRNN

SEQ ID NO: 2918425 - protein, 16 aa, Entamoeba invadens
TYTSENREGISGDVKI

SEQ ID NO: 2918426 - protein, 12 aa, Entamoeba invadens
TYTSRPKYTQYD

SEQ ID NO: 2918427 - protein, 8 aa, Entamoeba invadens
TYTSSAKN

SEQ ID NO: 2918428 - protein, 13 aa, Entamoeba invadens
TYTTDGKNGVVRA

SEQ ID NO: 2918429 - protein, 5 aa, Entamoeba invadens
TYTTG

SEQ ID NO: 2918430 - protein, 7 aa, Entamoeba invadens
TYTTKDV

SEQ ID NO: 2918431 - protein, 8 aa, Entamoeba invadens
TYTTPSRS

SEQ ID NO: 2918432 - protein, 8 aa, Entamoeba invadens
TYTTTTGD

SEQ ID NO: 2918433 - protein, 8 aa, Entamoeba invadens
TYVPSNTN

SEQ ID NO: 2918434 - protein, 11 aa, Entamoeba invadens
TYYKPSNSISV

SEQ ID NO: 2918435 - protein, 15 aa, Entamoeba invadens
TYYKPSNSVSVDEHL

SEQ ID NO: 2918436 - protein, 16 aa, Entamoeba invadens
TYYKPSNSVSVDEHLF

SEQ ID NO: 2918437 - protein, 7 aa, Entamoeba invadens
TYYRGSD

SEQ ID NO: 2918438 - protein, 16 aa, Entamoeba invadens
TYYSYKENKTFESKTK

SEQ ID NO: 2918439 - protein, 17 aa, Entamoeba invadens
VAADGRHLEQTEIGERH

SEQ ID NO: 2918440 - protein, 19 aa, Entamoeba invadens
VAADVTRRSVARSGAKISP

SEQ ID NO: 2918441 - protein, 21 aa, Entamoeba invadens
VAAEGETSETTENFKKYTSSK

SEQ ID NO: 2918442 - protein, 16 aa, Entamoeba invadens
VAAHTGLDDGVSQEKI

SEQ ID NO: 2918443 - protein, 10 aa, Entamoeba invadens
VAANDKTRQI

SEQ ID NO: 2918444 - protein, 16 aa, Entamoeba invadens
VAANMDSDWREDTLSP

SEQ ID NO: 2918445 - protein, 6 aa, Entamoeba invadens
VAANPR

SEQ ID NO: 2918446 - protein, 6 aa, Entamoeba invadens
VAANSS

SEQ ID NO: 2918447 - protein, 8 aa, Entamoeba invadens
VAAQQDYQ

SEQ ID NO: 2918448 - protein, 11 aa, Entamoeba invadens
VAAQTEKIGKL

SEQ ID NO: 2918449 - protein, 7 aa, Entamoeba invadens
VAASEFR

SEQ ID NO: 2918450 - protein, 50 aa, Entamoeba invadens
VAASIEKSEEKKEEKHDDEKDRIEKEKKEKAEQEKKTFGKKFDRDAYGFK

SEQ ID NO: 2918451 - protein, 7 aa, Entamoeba invadens
VAATEFR

SEQ ID NO: 2918452 - protein, 7 aa, Entamoeba invadens
VAATSEA

SEQ ID NO: 2918453 - protein, 8 aa, Entamoeba invadens
VAATTRTK

SEQ ID NO: 2918454 - protein, 13 aa, Entamoeba invadens
VADAVRTSLGPRG

SEQ ID NO: 2918455 - protein, 6 aa, Entamoeba invadens
VADDKV

SEQ ID NO: 2918456 - protein, 12 aa, Entamoeba invadens
VADDPSQYSLPK

SEQ ID NO: 2918457 - protein, 9 aa, Entamoeba invadens
VADDRIKSE

SEQ ID NO: 2918458 - protein, 13 aa, Entamoeba invadens
VADEKEKDELNGE

SEQ ID NO: 2918459 - protein, 12 aa, Entamoeba invadens
VADGYKKSHGDC

SEQ ID NO: 2918460 - protein, 5 aa, Entamoeba invadens
VADKS

SEQ ID NO: 2918461 - protein, 8 aa, Entamoeba invadens
VADPTMAD

SEQ ID NO: 2918462 - protein, 13 aa, Entamoeba invadens
VADRKRTKEEKEV

SEQ ID NO: 2918463 - protein, 8 aa, Entamoeba invadens
VAEADAAR

SEQ ID NO: 2918464 - protein, 4 aa, Entamoeba invadens
VAED

SEQ ID NO: 2918465 - protein, 14 aa, Entamoeba invadens
VAEDERAKRERNKK

SEQ ID NO: 2918466 - protein, 7 aa, Entamoeba invadens
VAEDHGK

SEQ ID NO: 2918467 - protein, 25 aa, Entamoeba invadens
VAEDIKQELSSTYKSVSEEIEKTKD

SEQ ID NO: 2918468 - protein, 4 aa, Entamoeba invadens
VAEE

SEQ ID NO: 2918469 - protein, 12 aa, Entamoeba invadens
VAEEDNSKDLET

SEQ ID NO: 2918470 - protein, 25 aa, Entamoeba invadens
VAEEDNSKDLETQLHEKEDDIADLE

SEQ ID NO: 2918471 - protein, 33 aa, Entamoeba invadens
VAEEDNSKDLETQLHEKEDDIANLEKQTKTAAL

SEQ ID NO: 2918472 - protein, 43 aa, Entamoeba invadens
VAEEDNSKNLETQLHEKEDDIADLEKQTKTAALTSAKNANDKK

SEQ ID NO: 2918473 - protein, 10 aa, Entamoeba invadens
VAEEDTKAIP

SEQ ID NO: 2918474 - protein, 6 aa, Entamoeba invadens
VAEEDV

SEQ ID NO: 2918475 - protein, 10 aa, Entamoeba invadens
VAEEEYPNGK

SEQ ID NO: 2918476 - protein, 10 aa, Entamoeba invadens
VAEEKKETAV

SEQ ID NO: 2918477 - protein, 13 aa, Entamoeba invadens
VAEGDNSKDLETQ

SEQ ID NO: 2918478 - protein, 6 aa, Entamoeba invadens
VAEGEK

SEQ ID NO: 2918479 - protein, 12 aa, Entamoeba invadens
VAEGRLSGKVDG

SEQ ID NO: 2918480 - protein, 7 aa, Entamoeba invadens
VAEGTPK

SEQ ID NO: 2918481 - protein, 16 aa, Entamoeba invadens
VAEGTSLSTNENRRQS

SEQ ID NO: 2918482 - protein, 22 aa, Entamoeba invadens
VAEKEGKKKAAVRMTGDENAEF

SEQ ID NO: 2918483 - protein, 25 aa, Entamoeba invadens
VAEKEGKKKAAVRMTGNEDAEFDPS

SEQ ID NO: 2918484 - protein, 10 aa, Entamoeba invadens
VAEKRKEDFD

SEQ ID NO: 2918485 - protein, 12 aa, Entamoeba invadens
VAEKRKEDFDYA

SEQ ID NO: 2918486 - protein, 8 aa, Entamoeba invadens
VAENEDVD

SEQ ID NO: 2918487 - protein, 23 aa, Entamoeba invadens
VAEPQEEVASQEPPTLPPQRRQR

SEQ ID NO: 2918488 - protein, 14 aa, Entamoeba invadens
VAEQDRMKSEKSFK

SEQ ID NO: 2918489 - protein, 15 aa, Entamoeba invadens
VAEQKKKSAKKHKKD

SEQ ID NO: 2918490 - protein, 5 aa, Entamoeba invadens
VAEQT

SEQ ID NO: 2918491 - protein, 17 aa, Entamoeba invadens
VAESKLETLEKSNHKMQ

SEQ ID NO: 2918492 - protein, 10 aa, Entamoeba invadens
VAESLKAQTL

SEQ ID NO: 2918493 - protein, 10 aa, Entamoeba invadens
VAESNDPQIP

SEQ ID NO: 2918494 - protein, 10 aa, Entamoeba invadens
VAETGSGKTI

SEQ ID NO: 2918495 - protein, 12 aa, Entamoeba invadens
VAETKSDDKKVL

SEQ ID NO: 2918496 - protein, 63 aa, Entamoeba invadens
VAETNVEANSNDSDEGKTTEETTENNKEEDLTGKAEELNAEKELEHAENKAKMKKNVYTDTLD

SEQ ID NO: 2918497 - protein, 7 aa, Entamoeba invadens
VAETSLT

SEQ ID NO: 2918498 - protein, 4 aa, Entamoeba invadens
VAEY

SEQ ID NO: 2918499 - protein, 4 aa, Entamoeba invadens
VAGD

SEQ ID NO: 2918500 - protein, 6 aa, Entamoeba invadens
VAGEPC

SEQ ID NO: 2918501 - protein, 9 aa, Entamoeba invadens
VAGGNNPID

SEQ ID NO: 2918502 - protein, 7 aa, Entamoeba invadens
VAGGSNK

SEQ ID NO: 2918503 - protein, 8 aa, Entamoeba invadens
VAGKNDAD

SEQ ID NO: 2918504 - protein, 6 aa, Entamoeba invadens
VAGKTD

SEQ ID NO: 2918505 - protein, 6 aa, Entamoeba invadens
VAGLEK

SEQ ID NO: 2918506 - protein, 11 aa, Entamoeba invadens
VAGMNEGGSDR

SEQ ID NO: 2918507 - protein, 10 aa, Entamoeba invadens
VAGNRENGIG

SEQ ID NO: 2918508 - protein, 15 aa, Entamoeba invadens
VAGPQEVMSLMKSMG

SEQ ID NO: 2918509 - protein, 10 aa, Entamoeba invadens
VAGRNNVSNK

SEQ ID NO: 2918510 - protein, 7 aa, Entamoeba invadens
VAGSDIT

SEQ ID NO: 2918511 - protein, 7 aa, Entamoeba invadens
VAGSRKF

SEQ ID NO: 2918512 - protein, 8 aa, Entamoeba invadens
VAGTSVPH

SEQ ID NO: 2918513 - protein, 4 aa, Entamoeba invadens
VAGV

SEQ ID NO: 2918514 - protein, 11 aa, Entamoeba invadens
VAHGSDPYFDP

SEQ ID NO: 2918515 - protein, 4 aa, Entamoeba invadens
VAIN

SEQ ID NO: 2918516 - protein, 10 aa, Entamoeba invadens
VAIPNPPKIG

SEQ ID NO: 2918517 - protein, 12 aa, Entamoeba invadens
VAKAGPRRMPHR

SEQ ID NO: 2918518 - protein, 14 aa, Entamoeba invadens
VAKEECNVQADSSR

SEQ ID NO: 2918519 - protein, 10 aa, Entamoeba invadens
VAKEEGHAQI

SEQ ID NO: 2918520 - protein, 9 aa, Entamoeba invadens
VAKEGVDSN

SEQ ID NO: 2918521 - protein, 8 aa, Entamoeba invadens
VAKEHQNE

SEQ ID NO: 2918522 - protein, 9 aa, Entamoeba invadens
VAKESKANF

SEQ ID NO: 2918523 - protein, 25 aa, Entamoeba invadens
VAKGKKEKVGESVKQTNNNKNLEEN

SEQ ID NO: 2918524 - protein, 12 aa, Entamoeba invadens
VAKGKRPNFDEG

SEQ ID NO: 2918525 - protein, 33 aa, Entamoeba invadens
VAKKAGENWKAMGEEDKKPYQDKADKAKETWKT

SEQ ID NO: 2918526 - protein, 10 aa, Entamoeba invadens
VAKKKKDTKC

SEQ ID NO: 2918527 - protein, 8 aa, Entamoeba invadens
VAKNGRSK

SEQ ID NO: 2918528 - protein, 12 aa, Entamoeba invadens
VAKPIDSGDDIT

SEQ ID NO: 2918529 - protein, 13 aa, Entamoeba invadens
VAKPRKSKKWDKQ

SEQ ID NO: 2918530 - protein, 16 aa, Entamoeba invadens
VAKQNAEKLLAKTPKI

SEQ ID NO: 2918531 - protein, 16 aa, Entamoeba invadens
VAKSKEEKEDMDREKK

SEQ ID NO: 2918532 - protein, 13 aa, Entamoeba invadens
VAKSNSETPAPEK

SEQ ID NO: 2918533 - protein, 8 aa, Entamoeba invadens
VAKSPRIY

SEQ ID NO: 2918534 - protein, 6 aa, Entamoeba invadens
VAKSRD

SEQ ID NO: 2918535 - protein, 8 aa, Entamoeba invadens
VAKTDDLS

SEQ ID NO: 2918536 - protein, 8 aa, Entamoeba invadens
VAKTSREY

SEQ ID NO: 2918537 - protein, 10 aa, Entamoeba invadens
VAKTTGAGCT

SEQ ID NO: 2918538 - protein, 14 aa, Entamoeba invadens
VAKVPELKSSKTDV

SEQ ID NO: 2918539 - protein, 4 aa, Entamoeba invadens
VAKY

SEQ ID NO: 2918540 - protein, 4 aa, Entamoeba invadens
VALG

SEQ ID NO: 2918541 - protein, 16 aa, Entamoeba invadens
VANEEKRMNEENSHTI

SEQ ID NO: 2918542 - protein, 7 aa, Entamoeba invadens
VANENTD

SEQ ID NO: 2918543 - protein, 7 aa, Entamoeba invadens
VANETSA

SEQ ID NO: 2918544 - protein, 8 aa, Entamoeba invadens
VANKEELE

SEQ ID NO: 2918545 - protein, 11 aa, Entamoeba invadens
VANNSTDPAEV

SEQ ID NO: 2918546 - protein, 19 aa, Entamoeba invadens
VANSGQKVIATKRSAVNIS

SEQ ID NO: 2918547 - protein, 13 aa, Entamoeba invadens
VANSQTDVPQQSY

SEQ ID NO: 2918548 - protein, 6 aa, Entamoeba invadens
VANSWG

SEQ ID NO: 2918549 - protein, 10 aa, Entamoeba invadens
VAPAAKGFSP

SEQ ID NO: 2918550 - protein, 8 aa, Entamoeba invadens
VAPEAAEA

SEQ ID NO: 2918551 - protein, 12 aa, Entamoeba invadens
VAPEDGSDDVED

SEQ ID NO: 2918552 - protein, 10 aa, Entamoeba invadens
VAPENTGFNQ

SEQ ID NO: 2918553 - protein, 5 aa, Entamoeba invadens
VAPES

SEQ ID NO: 2918554 - protein, 5 aa, Entamoeba invadens
VAPET

SEQ ID NO: 2918555 - protein, 7 aa, Entamoeba invadens
VAPGDFV

SEQ ID NO: 2918556 - protein, 5 aa, Entamoeba invadens
VAPHD

SEQ ID NO: 2918557 - protein, 9 aa, Entamoeba invadens
VAPKSNSVF

SEQ ID NO: 2918558 - protein, 17 aa, Entamoeba invadens
VAPKSRSFSVDSHSTEA

SEQ ID NO: 2918559 - protein, 8 aa, Entamoeba invadens
VAPNPTAM

SEQ ID NO: 2918560 - protein, 5 aa, Entamoeba invadens
VAPPA

SEQ ID NO: 2918561 - protein, 9 aa, Entamoeba invadens
VAPPKCNPL

SEQ ID NO: 2918562 - protein, 74 aa, Entamoeba invadens
VAPPLPPKGHKNKSLPPLPPQEQQEGPPPPLPPKKYEGYKKKDLPPCPQPEEIEQQEQYEEHNTEQNEYQTQTN

SEQ ID NO: 2918563 - protein, 7 aa, Entamoeba invadens
VAPPPQS

SEQ ID NO: 2918564 - protein, 22 aa, Entamoeba invadens
VAPPTNSIAPGAAPRRHAPTAR

SEQ ID NO: 2918565 - protein, 13 aa, Entamoeba invadens
VAPRAKMNQQRAR

SEQ ID NO: 2918566 - protein, 14 aa, Entamoeba invadens
VAPRAKMNQQRARR

SEQ ID NO: 2918567 - protein, 8 aa, Entamoeba invadens
VAPRSSLT

SEQ ID NO: 2918568 - protein, 5 aa, Entamoeba invadens
VAPSG

SEQ ID NO: 2918569 - protein, 10 aa, Entamoeba invadens
VAPSKGTVAF

SEQ ID NO: 2918570 - protein, 8 aa, Entamoeba invadens
VAQASDEI

SEQ ID NO: 2918571 - protein, 9 aa, Entamoeba invadens
VAQNPKEVR

SEQ ID NO: 2918572 - protein, 31 aa, Entamoeba invadens
VAQPTQQPSVTTQRYSQQNINSYTSSTPQFR

SEQ ID NO: 2918573 - protein, 6 aa, Entamoeba invadens
VAQSEY

SEQ ID NO: 2918574 - protein, 8 aa, Entamoeba invadens
VAQSRSFA

SEQ ID NO: 2918575 - protein, 14 aa, Entamoeba invadens
VAQTPLQKASAIQR

SEQ ID NO: 2918576 - protein, 7 aa, Entamoeba invadens
VAQTQDS

SEQ ID NO: 2918577 - protein, 5 aa, Entamoeba invadens
VARDE

SEQ ID NO: 2918578 - protein, 8 aa, Entamoeba invadens
VAREENEK

SEQ ID NO: 2918579 - protein, 18 aa, Entamoeba invadens
VAREGKNKALKAKTLKGI

SEQ ID NO: 2918580 - protein, 19 aa, Entamoeba invadens
VARENGIDYDGDFDWYNTK

SEQ ID NO: 2918581 - protein, 9 aa, Entamoeba invadens
VARGNDKSI

SEQ ID NO: 2918582 - protein, 9 aa, Entamoeba invadens
VARKSLDSF

SEQ ID NO: 2918583 - protein, 20 aa, Entamoeba invadens
VARPVGADESSSSGDEGDDL

SEQ ID NO: 2918584 - protein, 26 aa, Entamoeba invadens
VARSPQRVGKEHKLDDEDVLQIIKGG

SEQ ID NO: 2918585 - protein, 17 aa, Entamoeba invadens
VARTNKKSAVIKTQDGN

SEQ ID NO: 2918586 - protein, 7 aa, Entamoeba invadens
VARTQKE

SEQ ID NO: 2918587 - protein, 6 aa, Entamoeba invadens
VASEAN

SEQ ID NO: 2918588 - protein, 8 aa, Entamoeba invadens
VASEISAG

SEQ ID NO: 2918589 - protein, 11 aa, Entamoeba invadens
VASEKPAKVER

SEQ ID NO: 2918590 - protein, 8 aa, Entamoeba invadens
VASEPAAF

SEQ ID NO: 2918591 - protein, 9 aa, Entamoeba invadens
VASEQDDQR

SEQ ID NO: 2918592 - protein, 7 aa, Entamoeba invadens
VASESDA

SEQ ID NO: 2918593 - protein, 4 aa, Entamoeba invadens
VASG

SEQ ID NO: 2918594 - protein, 5 aa, Entamoeba invadens
VASGD

SEQ ID NO: 2918595 - protein, 7 aa, Entamoeba invadens
VASGDKL

SEQ ID NO: 2918596 - protein, 26 aa, Entamoeba invadens
VASGELPKQVEQTTQQTKLTQLTKPR

SEQ ID NO: 2918597 - protein, 7 aa, Entamoeba invadens
VASGIST

SEQ ID NO: 2918598 - protein, 5 aa, Entamoeba invadens
VASGN

SEQ ID NO: 2918599 - protein, 8 aa, Entamoeba invadens
VASGNTMR

SEQ ID NO: 2918600 - protein, 9 aa, Entamoeba invadens
VASGRSGGR

SEQ ID NO: 2918601 - protein, 7 aa, Entamoeba invadens
VASKGAL

SEQ ID NO: 2918602 - protein, 19 aa, Entamoeba invadens
VASKYSQSLSEIKKSNTLF

SEQ ID NO: 2918603 - protein, 6 aa, Entamoeba invadens
VASNDQ

SEQ ID NO: 2918604 - protein, 7 aa, Entamoeba invadens
VASNEKL

SEQ ID NO: 2918605 - protein, 13 aa, Entamoeba invadens
VASPGNSPTTSES

SEQ ID NO: 2918606 - protein, 7 aa, Entamoeba invadens
VASSESV

SEQ ID NO: 2918607 - protein, 6 aa, Entamoeba invadens
VASSIQ

SEQ ID NO: 2918608 - protein, 20 aa, Entamoeba invadens
VASTEAEDSPQTPSAFKPLT

SEQ ID NO: 2918609 - protein, 8 aa, Entamoeba invadens
VASTETKL

SEQ ID NO: 2918610 - protein, 20 aa, Entamoeba invadens
VASTGRKISRVKKPKSAELK

SEQ ID NO: 2918611 - protein, 12 aa, Entamoeba invadens
VASYSAKINKNK

SEQ ID NO: 2918612 - protein, 9 aa, Entamoeba invadens
VATEADSTF

SEQ ID NO: 2918613 - protein, 15 aa, Entamoeba invadens
VATEKPTRCLFLYYI

SEQ ID NO: 2918614 - protein, 8 aa, Entamoeba invadens
VATESKSN

SEQ ID NO: 2918615 - protein, 7 aa, Entamoeba invadens
VATEYKE

SEQ ID NO: 2918616 - protein, 6 aa, Entamoeba invadens
VATGKK

SEQ ID NO: 2918617 - protein, 4 aa, Entamoeba invadens
VATI

SEQ ID NO: 2918618 - protein, 8 aa, Entamoeba invadens
VATPEDGK

SEQ ID NO: 2918619 - protein, 5 aa, Entamoeba invadens
VATPI

SEQ ID NO: 2918620 - protein, 15 aa, Entamoeba invadens
VATPTQPQQQSAEQF

SEQ ID NO: 2918621 - protein, 31 aa, Entamoeba invadens
VATQHKTQQLSRSQEEELSITNAKKEAEKME

SEQ ID NO: 2918622 - protein, 10 aa, Entamoeba invadens
VATQQEKEIQ

SEQ ID NO: 2918623 - protein, 7 aa, Entamoeba invadens
VATQSAT

SEQ ID NO: 2918624 - protein, 7 aa, Entamoeba invadens
VATSDND

SEQ ID NO: 2918625 - protein, 5 aa, Entamoeba invadens
VATSF

SEQ ID NO: 2918626 - protein, 8 aa, Entamoeba invadens
VATSGITD

SEQ ID NO: 2918627 - protein, 7 aa, Entamoeba invadens
VATSNTP

SEQ ID NO: 2918628 - protein, 9 aa, Entamoeba invadens
VATTGNKLD

SEQ ID NO: 2918629 - protein, 7 aa, Entamoeba invadens
VATTTRV

SEQ ID NO: 2918630 - protein, 8 aa, Entamoeba invadens
VATYTSNG

SEQ ID NO: 2918631 - protein, 6 aa, Entamoeba invadens
VAVNKD

SEQ ID NO: 2918632 - protein, 7 aa, Entamoeba invadens
VAVPPSL

SEQ ID NO: 2918633 - protein, 11 aa, Entamoeba invadens
VAYDAKSTNVR

SEQ ID NO: 2918634 - protein, 11 aa, Entamoeba invadens
VAYKGDKEEIR

SEQ ID NO: 2918635 - protein, 17 aa, Entamoeba invadens
VAYPKTDRSNVRTKLPQ

SEQ ID NO: 2918636 - protein, 7 aa, Entamoeba invadens
VCDDEKD

SEQ ID NO: 2918637 - protein, 15 aa, Entamoeba invadens
VCDDKPCDVTTPRAR

SEQ ID NO: 2918638 - protein, 7 aa, Entamoeba invadens
VCDRTPE

SEQ ID NO: 2918639 - protein, 8 aa, Entamoeba invadens
VCDTSDPN

SEQ ID NO: 2918640 - protein, 6 aa, Entamoeba invadens
VCDTSS

SEQ ID NO: 2918641 - protein, 4 aa, Entamoeba invadens
VCED

SEQ ID NO: 2918642 - protein, 10 aa, Entamoeba invadens
VCEEKESQIK

SEQ ID NO: 2918643 - protein, 14 aa, Entamoeba invadens
VCEPPDEAINKLLS

SEQ ID NO: 2918644 - protein, 5 aa, Entamoeba invadens
VCEQQ

SEQ ID NO: 2918645 - protein, 9 aa, Entamoeba invadens
VCNESGETF

SEQ ID NO: 2918646 - protein, 21 aa, Entamoeba invadens
VCNSENPSQVFPTDTISETKN

SEQ ID NO: 2918647 - protein, 6 aa, Entamoeba invadens
VCQPTK

SEQ ID NO: 2918648 - protein, 5 aa, Entamoeba invadens
VCSGD

SEQ ID NO: 2918649 - protein, 7 aa, Entamoeba invadens
VCTETEG

SEQ ID NO: 2918650 - protein, 7 aa, Entamoeba invadens
VCTSTYK

SEQ ID NO: 2918651 - protein, 11 aa, Entamoeba invadens
VDAARSAQLEI

SEQ ID NO: 2918652 - protein, 4 aa, Entamoeba invadens
VDAE

SEQ ID NO: 2918653 - protein, 15 aa, Entamoeba invadens
VDAGATGASIAKLKA

SEQ ID NO: 2918654 - protein, 5 aa, Entamoeba invadens
VDAGV

SEQ ID NO: 2918655 - protein, 5 aa, Entamoeba invadens
VDAPA

SEQ ID NO: 2918656 - protein, 17 aa, Entamoeba invadens
VDAPKQNSNVKNAENEE

SEQ ID NO: 2918657 - protein, 46 aa, Entamoeba invadens
VDAPPTTPAFSKPKPPTLPKRPNFKAPMPPSGSQKVERKSSQTVSP

SEQ ID NO: 2918658 - protein, 6 aa, Entamoeba invadens
VDAPTS

SEQ ID NO: 2918659 - protein, 9 aa, Entamoeba invadens
VDAREPTIL

SEQ ID NO: 2918660 - protein, 5 aa, Entamoeba invadens
VDASA

SEQ ID NO: 2918661 - protein, 11 aa, Entamoeba invadens
VDASATGASIA

SEQ ID NO: 2918662 - protein, 8 aa, Entamoeba invadens
VDASDEED

SEQ ID NO: 2918663 - protein, 6 aa, Entamoeba invadens
VDATEK

SEQ ID NO: 2918664 - protein, 13 aa, Entamoeba invadens
VDAVRNKDNDRED

SEQ ID NO: 2918665 - protein, 9 aa, Entamoeba invadens
VDCDERNKR

SEQ ID NO: 2918666 - protein, 5 aa, Entamoeba invadens
VDDDG

SEQ ID NO: 2918667 - protein, 12 aa, Entamoeba invadens
VDDDSEECKDYS

SEQ ID NO: 2918668 - protein, 16 aa, Entamoeba invadens
VDDEENMKKINQEENE

SEQ ID NO: 2918669 - protein, 31 aa, Entamoeba invadens
VDDEPDLTISEDEKQQEEEEEEDFSDDGYTF

SEQ ID NO: 2918670 - protein, 6 aa, Entamoeba invadens
VDDETY

SEQ ID NO: 2918671 - protein, 45 aa, Entamoeba invadens
VDDGDDEEDLSTDLSSEEDDESSSEEEEDDSGESWSDLEKQAMKD

SEQ ID NO: 2918672 - protein, 8 aa, Entamoeba invadens
VDDKEELR

SEQ ID NO: 2918673 - protein, 6 aa, Entamoeba invadens
VDDKEV

SEQ ID NO: 2918674 - protein, 8 aa, Entamoeba invadens
VDDKSSEC

SEQ ID NO: 2918675 - protein, 14 aa, Entamoeba invadens
VDDLKKKLATQRPS

SEQ ID NO: 2918676 - protein, 8 aa, Entamoeba invadens
VDDLRKSK

SEQ ID NO: 2918677 - protein, 5 aa, Entamoeba invadens
VDDMS

SEQ ID NO: 2918678 - protein, 11 aa, Entamoeba invadens
VDDNKYPVQNG

SEQ ID NO: 2918679 - protein, 10 aa, Entamoeba invadens
VDDQETLAKQ

SEQ ID NO: 2918680 - protein, 8 aa, Entamoeba invadens
VDDSEKLK

SEQ ID NO: 2918681 - protein, 10 aa, Entamoeba invadens
VDDSERCNTQ

SEQ ID NO: 2918682 - protein, 17 aa, Entamoeba invadens
VDDSKQGVKENPRTFTF

SEQ ID NO: 2918683 - protein, 8 aa, Entamoeba invadens
VDDSKSNI

SEQ ID NO: 2918684 - protein, 8 aa, Entamoeba invadens
VDDSLKEQ

SEQ ID NO: 2918685 - protein, 8 aa, Entamoeba invadens
VDDSSETL

SEQ ID NO: 2918686 - protein, 6 aa, Entamoeba invadens
VDDTHY

SEQ ID NO: 2918687 - protein, 4 aa, Entamoeba invadens
VDDV

SEQ ID NO: 2918688 - protein, 5 aa, Entamoeba invadens
VDEAP

SEQ ID NO: 2918689 - protein, 10 aa, Entamoeba invadens
VDEDANTRVV

SEQ ID NO: 2918690 - protein, 11 aa, Entamoeba invadens
VDEDDAQPKVI

SEQ ID NO: 2918691 - protein, 10 aa, Entamoeba invadens
VDEEETSIKV

SEQ ID NO: 2918692 - protein, 14 aa, Entamoeba invadens
VDEELATKDKEFEA

SEQ ID NO: 2918693 - protein, 6 aa, Entamoeba invadens
VDEENY

SEQ ID NO: 2918694 - protein, 7 aa, Entamoeba invadens
VDEETQQ

SEQ ID NO: 2918695 - protein, 10 aa, Entamoeba invadens
VDEEVPKQDR

SEQ ID NO: 2918696 - protein, 17 aa, Entamoeba invadens
VDEEYTKSEESREKAEV

SEQ ID NO: 2918697 - protein, 7 aa, Entamoeba invadens
VDEFDDT

SEQ ID NO: 2918698 - protein, 4 aa, Entamoeba invadens
VDEG

SEQ ID NO: 2918699 - protein, 8 aa, Entamoeba invadens
VDEGATKS

SEQ ID NO: 2918700 - protein, 7 aa, Entamoeba invadens
VDEGDNG

SEQ ID NO: 2918701 - protein, 9 aa, Entamoeba invadens
VDEGKETEQ

SEQ ID NO: 2918702 - protein, 9 aa, Entamoeba invadens
VDEGTSEVS

SEQ ID NO: 2918703 - protein, 8 aa, Entamoeba invadens
VDEIDEDG

SEQ ID NO: 2918704 - protein, 5 aa, Entamoeba invadens
VDEIG

SEQ ID NO: 2918705 - protein, 4 aa, Entamoeba invadens
VDEK

SEQ ID NO: 2918706 - protein, 26 aa, Entamoeba invadens
VDEKDMSEESQKDDILSSDEETEDET

SEQ ID NO: 2918707 - protein, 9 aa, Entamoeba invadens
VDEKDNNSY

SEQ ID NO: 2918708 - protein, 7 aa, Entamoeba invadens
VDEKEQE

SEQ ID NO: 2918709 - protein, 7 aa, Entamoeba invadens
VDEKKNW

SEQ ID NO: 2918710 - protein, 7 aa, Entamoeba invadens
VDEKKSS

SEQ ID NO: 2918711 - protein, 11 aa, Entamoeba invadens
VDEKNKPTTKS

SEQ ID NO: 2918712 - protein, 16 aa, Entamoeba invadens
VDEKSKALVDKKNTYD

SEQ ID NO: 2918713 - protein, 7 aa, Entamoeba invadens
VDEKTSD

SEQ ID NO: 2918714 - protein, 4 aa, Entamoeba invadens
VDEL

SEQ ID NO: 2918715 - protein, 10 aa, Entamoeba invadens
VDENESTQKA

SEQ ID NO: 2918716 - protein, 7 aa, Entamoeba invadens
VDENGLK

SEQ ID NO: 2918717 - protein, 13 aa, Entamoeba invadens
VDENGTEATAATA

SEQ ID NO: 2918718 - protein, 20 aa, Entamoeba invadens
VDENKDGKISYEEFNKVFGE

SEQ ID NO: 2918719 - protein, 10 aa, Entamoeba invadens
VDENKMSSSN

SEQ ID NO: 2918720 - protein, 8 aa, Entamoeba invadens
VDEPPTQV

SEQ ID NO: 2918721 - protein, 6 aa, Entamoeba invadens
VDERED

SEQ ID NO: 2918722 - protein, 9 aa, Entamoeba invadens
VDERENDVD

SEQ ID NO: 2918723 - protein, 7 aa, Entamoeba invadens
VDERGKV

SEQ ID NO: 2918724 - protein, 11 aa, Entamoeba invadens
VDERSSKIGAE

SEQ ID NO: 2918725 - protein, 12 aa, Entamoeba invadens
VDERYAKIGSEV

SEQ ID NO: 2918726 - protein, 7 aa, Entamoeba invadens
VDESKSD

SEQ ID NO: 2918727 - protein, 74 aa, Entamoeba invadens
VDESNALRQKEKDREREKELRERREREEKENERQRKEKEMKDQRDREQRKQEEQSRLEKQRREEEKKKNESKIL

SEQ ID NO: 2918728 - protein, 12 aa, Entamoeba invadens
VDESSDEVFDTA

SEQ ID NO: 2918729 - protein, 13 aa, Entamoeba invadens
VDESSYRNVSSTE

SEQ ID NO: 2918730 - protein, 8 aa, Entamoeba invadens
VDETGPRL

SEQ ID NO: 2918731 - protein, 12 aa, Entamoeba invadens
VDETKYNEESIT

SEQ ID NO: 2918732 - protein, 6 aa, Entamoeba invadens
VDETTD

SEQ ID NO: 2918733 - protein, 4 aa, Entamoeba invadens
VDEV

SEQ ID NO: 2918734 - protein, 8 aa, Entamoeba invadens
VDEYGDDK

SEQ ID NO: 2918735 - protein, 15 aa, Entamoeba invadens
VDEYTRNMEDESTIR

SEQ ID NO: 2918736 - protein, 8 aa, Entamoeba invadens
VDFEESNS

SEQ ID NO: 2918737 - protein, 17 aa, Entamoeba invadens
VDFNSENDEIPVNTESR

SEQ ID NO: 2918738 - protein, 4 aa, Entamoeba invadens
VDGA

SEQ ID NO: 2918739 - protein, 8 aa, Entamoeba invadens
VDGCKEQI

SEQ ID NO: 2918740 - protein, 7 aa, Entamoeba invadens
VDGDEYS

SEQ ID NO: 2918741 - protein, 5 aa, Entamoeba invadens
VDGDG

SEQ ID NO: 2918742 - protein, 73 aa, Entamoeba invadens
VDGDNDDDEEDEDEDDCYDDQNEDEEGEDDNEDGEEEDEEEDEDNNDDDNEEEEVGDEETNNNYKDEENKTTN

SEQ ID NO: 2918743 - protein, 4 aa, Entamoeba invadens
VDGE

SEQ ID NO: 2918744 - protein, 8 aa, Entamoeba invadens
VDGEEDFK

SEQ ID NO: 2918745 - protein, 9 aa, Entamoeba invadens
VDGGTSAFL

SEQ ID NO: 2918746 - protein, 7 aa, Entamoeba invadens
VDGGVQG

SEQ ID NO: 2918747 - protein, 5 aa, Entamoeba invadens
VDGIE

SEQ ID NO: 2918748 - protein, 9 aa, Entamoeba invadens
VDGIEKNGF

SEQ ID NO: 2918749 - protein, 4 aa, Entamoeba invadens
VDGK

SEQ ID NO: 2918750 - protein, 14 aa, Entamoeba invadens
VDGKIEEKKDEAPL

SEQ ID NO: 2918751 - protein, 6 aa, Entamoeba invadens
VDGKQY

SEQ ID NO: 2918752 - protein, 11 aa, Entamoeba invadens
VDGKRKKNSLG

SEQ ID NO: 2918753 - protein, 4 aa, Entamoeba invadens
VDGL

SEQ ID NO: 2918754 - protein, 5 aa, Entamoeba invadens
VDGLN

SEQ ID NO: 2918755 - protein, 4 aa, Entamoeba invadens
VDGN

SEQ ID NO: 2918756 - protein, 15 aa, Entamoeba invadens
VDGNAINEKNTTDVA

SEQ ID NO: 2918757 - protein, 8 aa, Entamoeba invadens
VDGNGISE

SEQ ID NO: 2918758 - protein, 7 aa, Entamoeba invadens
VDGNSKG

SEQ ID NO: 2918759 - protein, 4 aa, Entamoeba invadens
VDGP

SEQ ID NO: 2918760 - protein, 5 aa, Entamoeba invadens
VDGPK

SEQ ID NO: 2918761 - protein, 4 aa, Entamoeba invadens
VDGQ

SEQ ID NO: 2918762 - protein, 19 aa, Entamoeba invadens
VDGQASMFGGDNKKPVGGN

SEQ ID NO: 2918763 - protein, 13 aa, Entamoeba invadens
VDGQGQKKKTVDD

SEQ ID NO: 2918764 - protein, 9 aa, Entamoeba invadens
VDGQPNQKI

SEQ ID NO: 2918765 - protein, 24 aa, Entamoeba invadens
VDGRTKKQCKERFTQKYDPSITRQ

SEQ ID NO: 2918766 - protein, 4 aa, Entamoeba invadens
VDGS

SEQ ID NO: 2918767 - protein, 5 aa, Entamoeba invadens
VDGSK

SEQ ID NO: 2918768 - protein, 11 aa, Entamoeba invadens
VDGSKLTQSHE

SEQ ID NO: 2918769 - protein, 8 aa, Entamoeba invadens
VDGTQNSD

SEQ ID NO: 2918770 - protein, 10 aa, Entamoeba invadens
VDGTQNSDEY

SEQ ID NO: 2918771 - protein, 7 aa, Entamoeba invadens
VDGTSNG

SEQ ID NO: 2918772 - protein, 10 aa, Entamoeba invadens
VDGTTDTAEV

SEQ ID NO: 2918773 - protein, 9 aa, Entamoeba invadens
VDGVEEKTK

SEQ ID NO: 2918774 - protein, 4 aa, Entamoeba invadens
VDGW

SEQ ID NO: 2918775 - protein, 15 aa, Entamoeba invadens
VDGWESRELNSKIEG

SEQ ID NO: 2918776 - protein, 7 aa, Entamoeba invadens
VDHNTTP

SEQ ID NO: 2918777 - protein, 13 aa, Entamoeba invadens
VDHQTSKEKYSSS

SEQ ID NO: 2918778 - protein, 10 aa, Entamoeba invadens
VDHSDIRSRE

SEQ ID NO: 2918779 - protein, 8 aa, Entamoeba invadens
VDHSGNTA

SEQ ID NO: 2918780 - protein, 9 aa, Entamoeba invadens
VDIANSDAL

SEQ ID NO: 2918781 - protein, 11 aa, Entamoeba invadens
VDIDTNSNDKY

SEQ ID NO: 2918782 - protein, 9 aa, Entamoeba invadens
VDIENEQLN

SEQ ID NO: 2918783 - protein, 24 aa, Entamoeba invadens
VDIEPLDKSNPTSEDTKKETTDGK

SEQ ID NO: 2918784 - protein, 8 aa, Entamoeba invadens
VDIGDDYK

SEQ ID NO: 2918785 - protein, 9 aa, Entamoeba invadens
VDINSNKNI

SEQ ID NO: 2918786 - protein, 4 aa, Entamoeba invadens
VDIP

SEQ ID NO: 2918787 - protein, 7 aa, Entamoeba invadens
VDIPEEG

SEQ ID NO: 2918788 - protein, 6 aa, Entamoeba invadens
VDIPNR

SEQ ID NO: 2918789 - protein, 11 aa, Entamoeba invadens
VDIPPSVSSMG

SEQ ID NO: 2918790 - protein, 5 aa, Entamoeba invadens
VDIPS

SEQ ID NO: 2918791 - protein, 6 aa, Entamoeba invadens
VDIPSS

SEQ ID NO: 2918792 - protein, 10 aa, Entamoeba invadens
VDKAGKPKAY

SEQ ID NO: 2918793 - protein, 7 aa, Entamoeba invadens
VDKDEDE

SEQ ID NO: 2918794 - protein, 6 aa, Entamoeba invadens
VDKDHE

SEQ ID NO: 2918795 - protein, 5 aa, Entamoeba invadens
VDKDS

SEQ ID NO: 2918796 - protein, 7 aa, Entamoeba invadens
VDKDTPI

SEQ ID NO: 2918797 - protein, 4 aa, Entamoeba invadens
VDKE

SEQ ID NO: 2918798 - protein, 5 aa, Entamoeba invadens
VDKEH

SEQ ID NO: 2918799 - protein, 7 aa, Entamoeba invadens
VDKEKDE

SEQ ID NO: 2918800 - protein, 9 aa, Entamoeba invadens
VDKENQNVD

SEQ ID NO: 2918801 - protein, 8 aa, Entamoeba invadens
VDKGDEKF

SEQ ID NO: 2918802 - protein, 20 aa, Entamoeba invadens
VDKHESDKETKSSQKTQNLL

SEQ ID NO: 2918803 - protein, 14 aa, Entamoeba invadens
VDKHKDWAEQFGQD

SEQ ID NO: 2918804 - protein, 16 aa, Entamoeba invadens
VDKKMGDSILNWAKSW

SEQ ID NO: 2918805 - protein, 9 aa, Entamoeba invadens
VDKKPSEIS

SEQ ID NO: 2918806 - protein, 5 aa, Entamoeba invadens
VDKLP

SEQ ID NO: 2918807 - protein, 10 aa, Entamoeba invadens
VDKLSGKKGE

SEQ ID NO: 2918808 - protein, 11 aa, Entamoeba invadens
VDKNGKITGQH

SEQ ID NO: 2918809 - protein, 8 aa, Entamoeba invadens
VDKNGNEI

SEQ ID NO: 2918810 - protein, 5 aa, Entamoeba invadens
VDKNN

SEQ ID NO: 2918811 - protein, 18 aa, Entamoeba invadens
VDKNRDGKISRAEFLTLA

SEQ ID NO: 2918812 - protein, 7 aa, Entamoeba invadens
VDKNVRD

SEQ ID NO: 2918813 - protein, 20 aa, Entamoeba invadens
VDKPKETKTDNEKKRKSRSN

SEQ ID NO: 2918814 - protein, 9 aa, Entamoeba invadens
VDKQRLRSS

SEQ ID NO: 2918815 - protein, 10 aa, Entamoeba invadens
VDKQTDLDSL

SEQ ID NO: 2918816 - protein, 14 aa, Entamoeba invadens
VDKQTKESSQPTTS

SEQ ID NO: 2918817 - protein, 17 aa, Entamoeba invadens
VDKRTTKRKKAVSHLKK

SEQ ID NO: 2918818 - protein, 7 aa, Entamoeba invadens
VDKSDDL

SEQ ID NO: 2918819 - protein, 6 aa, Entamoeba invadens
VDKSGN

SEQ ID NO: 2918820 - protein, 6 aa, Entamoeba invadens
VDKSGY

SEQ ID NO: 2918821 - protein, 7 aa, Entamoeba invadens
VDKSLQK

SEQ ID NO: 2918822 - protein, 50 aa, Entamoeba invadens
VDKSSDDDDNEENIIENNEENSEVNNEDNEEIDNVESSDRDSLTNSQDNT

SEQ ID NO: 2918823 - protein, 8 aa, Entamoeba invadens
VDKSSEDY

SEQ ID NO: 2918824 - protein, 8 aa, Entamoeba invadens
VDKTPNVA

SEQ ID NO: 2918825 - protein, 6 aa, Entamoeba invadens
VDKTSK

SEQ ID NO: 2918826 - protein, 7 aa, Entamoeba invadens
VDKTYPE

SEQ ID NO: 2918827 - protein, 8 aa, Entamoeba invadens
VDLATSDA

SEQ ID NO: 2918828 - protein, 4 aa, Entamoeba invadens
VDLD

SEQ ID NO: 2918829 - protein, 15 aa, Entamoeba invadens
VDLDDDEKEMLNETR

SEQ ID NO: 2918830 - protein, 5 aa, Entamoeba invadens
VDLDK

SEQ ID NO: 2918831 - protein, 8 aa, Entamoeba invadens
VDLEPGTI

SEQ ID NO: 2918832 - protein, 20 aa, Entamoeba invadens
VDLPPHQDYYPSNQGRKSDY

SEQ ID NO: 2918833 - protein, 17 aa, Entamoeba invadens
VDLPPPSEFYPTNGYVK

SEQ ID NO: 2918834 - protein, 19 aa, Entamoeba invadens
VDLRGSKEVEAKMRAEGKT

SEQ ID NO: 2918835 - protein, 6 aa, Entamoeba invadens
VDLSNN

SEQ ID NO: 2918836 - protein, 25 aa, Entamoeba invadens
VDLTEEKLKKDVEVRQKVNDEEAIE

SEQ ID NO: 2918837 - protein, 14 aa, Entamoeba invadens
VDLTEEKLKRDVEV

SEQ ID NO: 2918838 - protein, 25 aa, Entamoeba invadens
VDLTGEKLKKDVEVRQKVNDEETIE

SEQ ID NO: 2918839 - protein, 6 aa, Entamoeba invadens
VDLTTS

SEQ ID NO: 2918840 - protein, 9 aa, Entamoeba invadens
VDMNSNKNI

SEQ ID NO: 2918841 - protein, 9 aa, Entamoeba invadens
VDMPPPGTS

SEQ ID NO: 2918842 - protein, 5 aa, Entamoeba invadens
VDNAR

SEQ ID NO: 2918843 - protein, 7 aa, Entamoeba invadens
VDNEDKN

SEQ ID NO: 2918844 - protein, 7 aa, Entamoeba invadens
VDNEEDI

SEQ ID NO: 2918845 - protein, 6 aa, Entamoeba invadens
VDNEEG

SEQ ID NO: 2918846 - protein, 25 aa, Entamoeba invadens
VDNGEEDDDDGAMKRKKKKVSNSQQ

SEQ ID NO: 2918847 - protein, 8 aa, Entamoeba invadens
VDNGKDVD

SEQ ID NO: 2918848 - protein, 8 aa, Entamoeba invadens
VDNNKGRK

SEQ ID NO: 2918849 - protein, 10 aa, Entamoeba invadens
VDNPEVIQDA

SEQ ID NO: 2918850 - protein, 10 aa, Entamoeba invadens
VDNPLQSGTH

SEQ ID NO: 2918851 - protein, 6 aa, Entamoeba invadens
VDNPRV

SEQ ID NO: 2918852 - protein, 8 aa, Entamoeba invadens
VDNQQPTE

SEQ ID NO: 2918853 - protein, 5 aa, Entamoeba invadens
VDNRD

SEQ ID NO: 2918854 - protein, 11 aa, Entamoeba invadens
VDNREDSKRNV

SEQ ID NO: 2918855 - protein, 6 aa, Entamoeba invadens
VDNTAV

SEQ ID NO: 2918856 - protein, 6 aa, Entamoeba invadens
VDPDED

SEQ ID NO: 2918857 - protein, 8 aa, Entamoeba invadens
VDPDQQPF

SEQ ID NO: 2918858 - protein, 7 aa, Entamoeba invadens
VDPDSYT

SEQ ID NO: 2918859 - protein, 56 aa, Entamoeba invadens
VDPDTVDWGDSSTKGDEETESNSDYEFDRTGDDEESSCCDSTTDDSKSYDKISNGI

SEQ ID NO: 2918860 - protein, 9 aa, Entamoeba invadens
VDPDYNKPL

SEQ ID NO: 2918861 - protein, 6 aa, Entamoeba invadens
VDPEKV

SEQ ID NO: 2918862 - protein, 8 aa, Entamoeba invadens
VDPENAKK

SEQ ID NO: 2918863 - protein, 8 aa, Entamoeba invadens
VDPEQPSV

SEQ ID NO: 2918864 - protein, 5 aa, Entamoeba invadens
VDPET

SEQ ID NO: 2918865 - protein, 7 aa, Entamoeba invadens
VDPFNST

SEQ ID NO: 2918866 - protein, 10 aa, Entamoeba invadens
VDPGSKDTRT

SEQ ID NO: 2918867 - protein, 8 aa, Entamoeba invadens
VDPHTVTS

SEQ ID NO: 2918868 - protein, 6 aa, Entamoeba invadens
VDPIPS

SEQ ID NO: 2918869 - protein, 16 aa, Entamoeba invadens
VDPKFEMDNSKKTRTV

SEQ ID NO: 2918870 - protein, 10 aa, Entamoeba invadens
VDPKKGKITC

SEQ ID NO: 2918871 - protein, 37 aa, Entamoeba invadens
VDPKQKKENPFGDSSSDSEASKSSTKEEKKKPTFTES

SEQ ID NO: 2918872 - protein, 5 aa, Entamoeba invadens
VDPKT

SEQ ID NO: 2918873 - protein, 18 aa, Entamoeba invadens
VDPNEKKFPNTQVNPNII

SEQ ID NO: 2918874 - protein, 5 aa, Entamoeba invadens
VDPNI

SEQ ID NO: 2918875 - protein, 12 aa, Entamoeba invadens
VDPPELSRQKKM

SEQ ID NO: 2918876 - protein, 6 aa, Entamoeba invadens
VDPPEV

SEQ ID NO: 2918877 - protein, 6 aa, Entamoeba invadens
VDPPQN

SEQ ID NO: 2918878 - protein, 6 aa, Entamoeba invadens
VDPQGG

SEQ ID NO: 2918879 - protein, 9 aa, Entamoeba invadens
VDPRPPEQR

SEQ ID NO: 2918880 - protein, 9 aa, Entamoeba invadens
VDPRSNDTY

SEQ ID NO: 2918881 - protein, 10 aa, Entamoeba invadens
VDPSKRDSAV

SEQ ID NO: 2918882 - protein, 6 aa, Entamoeba invadens
VDPSNA

SEQ ID NO: 2918883 - protein, 14 aa, Entamoeba invadens
VDPTNQSSTTTTDI

SEQ ID NO: 2918884 - protein, 10 aa, Entamoeba invadens
VDPVTNTSNV

SEQ ID NO: 2918885 - protein, 11 aa, Entamoeba invadens
VDPYGVGEDNI

SEQ ID NO: 2918886 - protein, 20 aa, Entamoeba invadens
VDQGAKSRLCNAKSEEKEEV

SEQ ID NO: 2918887 - protein, 5 aa, Entamoeba invadens
VDQGQ

SEQ ID NO: 2918888 - protein, 10 aa, Entamoeba invadens
VDQGQEVAQE

SEQ ID NO: 2918889 - protein, 6 aa, Entamoeba invadens
VDQNET

SEQ ID NO: 2918890 - protein, 8 aa, Entamoeba invadens
VDQNTTSF

SEQ ID NO: 2918891 - protein, 9 aa, Entamoeba invadens
VDQQDGDLN

SEQ ID NO: 2918892 - protein, 9 aa, Entamoeba invadens
VDQRAPEVS

SEQ ID NO: 2918893 - protein, 7 aa, Entamoeba invadens
VDQSDKE

SEQ ID NO: 2918894 - protein, 17 aa, Entamoeba invadens
VDQTSEKKQWESSVAER

SEQ ID NO: 2918895 - protein, 6 aa, Entamoeba invadens
VDQTTV

SEQ ID NO: 2918896 - protein, 8 aa, Entamoeba invadens
VDRDGQYF

SEQ ID NO: 2918897 - protein, 4 aa, Entamoeba invadens
VDRE

SEQ ID NO: 2918898 - protein, 6 aa, Entamoeba invadens
VDRKNR

SEQ ID NO: 2918899 - protein, 9 aa, Entamoeba invadens
VDRKNSTRI

SEQ ID NO: 2918900 - protein, 16 aa, Entamoeba invadens
VDRKRAKGVQLTHSES

SEQ ID NO: 2918901 - protein, 10 aa, Entamoeba invadens
VDRLSEKVRE

SEQ ID NO: 2918902 - protein, 9 aa, Entamoeba invadens
VDRNNSRNI

SEQ ID NO: 2918903 - protein, 5 aa, Entamoeba invadens
VDRPE

SEQ ID NO: 2918904 - protein, 10 aa, Entamoeba invadens
VDRTNEYIED

SEQ ID NO: 2918905 - protein, 31 aa, Entamoeba invadens
VDSDEDESGNAESVHRDSQTSTMEHSSEKSE

SEQ ID NO: 2918906 - protein, 9 aa, Entamoeba invadens
VDSDESSRF

SEQ ID NO: 2918907 - protein, 9 aa, Entamoeba invadens
VDSDNSDSV

SEQ ID NO: 2918908 - protein, 8 aa, Entamoeba invadens
VDSEELEE

SEQ ID NO: 2918909 - protein, 22 aa, Entamoeba invadens
VDSEKFKKAREKVKGTGTKDGL

SEQ ID NO: 2918910 - protein, 6 aa, Entamoeba invadens
VDSETL

SEQ ID NO: 2918911 - protein, 5 aa, Entamoeba invadens
VDSEV

SEQ ID NO: 2918912 - protein, 24 aa, Entamoeba invadens
VDSFPHKAKSVSSSPKYVANKREL

SEQ ID NO: 2918913 - protein, 11 aa, Entamoeba invadens
VDSGKTLTSDE

SEQ ID NO: 2918914 - protein, 5 aa, Entamoeba invadens
VDSGN

SEQ ID NO: 2918915 - protein, 11 aa, Entamoeba invadens
VDSGRTDDNME

SEQ ID NO: 2918916 - protein, 6 aa, Entamoeba invadens
VDSHKP

SEQ ID NO: 2918917 - protein, 11 aa, Entamoeba invadens
VDSKRATQHMS

SEQ ID NO: 2918918 - protein, 8 aa, Entamoeba invadens
VDSKVPEF

SEQ ID NO: 2918919 - protein, 12 aa, Entamoeba invadens
VDSLTPRGSTAG

SEQ ID NO: 2918920 - protein, 6 aa, Entamoeba invadens
VDSNDI

SEQ ID NO: 2918921 - protein, 7 aa, Entamoeba invadens
VDSNSEK

SEQ ID NO: 2918922 - protein, 8 aa, Entamoeba invadens
VDSNTKQQ

SEQ ID NO: 2918923 - protein, 5 aa, Entamoeba invadens
VDSPA

SEQ ID NO: 2918924 - protein, 45 aa, Entamoeba invadens
VDSPHSTDSFESPTKDSKSIHQKNFESSHKTTSPEHKSQTEKTNV

SEQ ID NO: 2918925 - protein, 8 aa, Entamoeba invadens
VDSPKRTQ

SEQ ID NO: 2918926 - protein, 11 aa, Entamoeba invadens
VDSQLNSKGIP

SEQ ID NO: 2918927 - protein, 9 aa, Entamoeba invadens
VDSQQKQPL

SEQ ID NO: 2918928 - protein, 7 aa, Entamoeba invadens
VDSQSTL

SEQ ID NO: 2918929 - protein, 5 aa, Entamoeba invadens
VDSRI

SEQ ID NO: 2918930 - protein, 8 aa, Entamoeba invadens
VDSRSPRE

SEQ ID NO: 2918931 - protein, 5 aa, Entamoeba invadens
VDSRT

SEQ ID NO: 2918932 - protein, 4 aa, Entamoeba invadens
VDSS

SEQ ID NO: 2918933 - protein, 10 aa, Entamoeba invadens
VDSSAKGLEQ

SEQ ID NO: 2918934 - protein, 12 aa, Entamoeba invadens
VDSSASFEDDYT

SEQ ID NO: 2918935 - protein, 11 aa, Entamoeba invadens
VDSSKDPHKRE

SEQ ID NO: 2918936 - protein, 17 aa, Entamoeba invadens
VDSSSEDRKVNGDDDQL

SEQ ID NO: 2918937 - protein, 5 aa, Entamoeba invadens
VDSTG

SEQ ID NO: 2918938 - protein, 6 aa, Entamoeba invadens
VDSTGT

SEQ ID NO: 2918939 - protein, 29 aa, Entamoeba invadens
VDSTTEGVKMTAKKEVKVRNEEENEEVKP

SEQ ID NO: 2918940 - protein, 4 aa, Entamoeba invadens
VDSV

SEQ ID NO: 2918941 - protein, 10 aa, Entamoeba invadens
VDSYTKTSNE

SEQ ID NO: 2918942 - protein, 6 aa, Entamoeba invadens
VDTAED

SEQ ID NO: 2918943 - protein, 7 aa, Entamoeba invadens
VDTDGEI

SEQ ID NO: 2918944 - protein, 19 aa, Entamoeba invadens
VDTDKNSGFSIKKGDKVRA

SEQ ID NO: 2918945 - protein, 6 aa, Entamoeba invadens
VDTDTI

SEQ ID NO: 2918946 - protein, 6 aa, Entamoeba invadens
VDTDTT

SEQ ID NO: 2918947 - protein, 9 aa, Entamoeba invadens
VDTENEIEN

SEQ ID NO: 2918948 - protein, 4 aa, Entamoeba invadens
VDTG

SEQ ID NO: 2918949 - protein, 8 aa, Entamoeba invadens
VDTIGEGA

SEQ ID NO: 2918950 - protein, 6 aa, Entamoeba invadens
VDTIKQ

SEQ ID NO: 2918951 - protein, 12 aa, Entamoeba invadens
VDTKGKITLEKE

SEQ ID NO: 2918952 - protein, 4 aa, Entamoeba invadens
VDTL

SEQ ID NO: 2918953 - protein, 18 aa, Entamoeba invadens
VDTPSSQIKADGNRRTTS

SEQ ID NO: 2918954 - protein, 7 aa, Entamoeba invadens
VDTPTHG

SEQ ID NO: 2918955 - protein, 6 aa, Entamoeba invadens
VDTQNV

SEQ ID NO: 2918956 - protein, 7 aa, Entamoeba invadens
VDTQPLT

SEQ ID NO: 2918957 - protein, 7 aa, Entamoeba invadens
VDTSEEI

SEQ ID NO: 2918958 - protein, 7 aa, Entamoeba invadens
VDTSESR

SEQ ID NO: 2918959 - protein, 12 aa, Entamoeba invadens
VDTSGDSTLSKM

SEQ ID NO: 2918960 - protein, 8 aa, Entamoeba invadens
VDTSGEDD

SEQ ID NO: 2918961 - protein, 6 aa, Entamoeba invadens
VDTSQF

SEQ ID NO: 2918962 - protein, 12 aa, Entamoeba invadens
VDTTGAGDSYAG

SEQ ID NO: 2918963 - protein, 7 aa, Entamoeba invadens
VDTTGKL

SEQ ID NO: 2918964 - protein, 10 aa, Entamoeba invadens
VDTTKTTLSL

SEQ ID NO: 2918965 - protein, 5 aa, Entamoeba invadens
VDTTL

SEQ ID NO: 2918966 - protein, 34 aa, Entamoeba invadens
VDTTPISNTSDSKQNEEKESIETDETVKTQETVE

SEQ ID NO: 2918967 - protein, 6 aa, Entamoeba invadens
VDTTPV

SEQ ID NO: 2918968 - protein, 7 aa, Entamoeba invadens
VDTTRDK

SEQ ID NO: 2918969 - protein, 10 aa, Entamoeba invadens
VDTTSEVPNE

SEQ ID NO: 2918970 - protein, 5 aa, Entamoeba invadens
VDTTT

SEQ ID NO: 2918971 - protein, 8 aa, Entamoeba invadens
VDTYTAEK

SEQ ID NO: 2918972 - protein, 16 aa, Entamoeba invadens
VDTYTGDVQKAEKKHE

SEQ ID NO: 2918973 - protein, 5 aa, Entamoeba invadens
VDVDS

SEQ ID NO: 2918974 - protein, 7 aa, Entamoeba invadens
VDVEGQK

SEQ ID NO: 2918975 - protein, 7 aa, Entamoeba invadens
VDVEGTI

SEQ ID NO: 2918976 - protein, 10 aa, Entamoeba invadens
VDVEKENNIK

SEQ ID NO: 2918977 - protein, 9 aa, Entamoeba invadens
VDVENDPKE

SEQ ID NO: 2918978 - protein, 6 aa, Entamoeba invadens
VDVNEV

SEQ ID NO: 2918979 - protein, 9 aa, Entamoeba invadens
VDVNKNKNI

SEQ ID NO: 2918980 - protein, 11 aa, Entamoeba invadens
VDVPSSVTEIG

SEQ ID NO: 2918981 - protein, 6 aa, Entamoeba invadens
VDVQTQ

SEQ ID NO: 2918982 - protein, 26 aa, Entamoeba invadens
VDVRKDEMKEIETNKVKREEEEKDDV

SEQ ID NO: 2918983 - protein, 6 aa, Entamoeba invadens
VDVTSR

SEQ ID NO: 2918984 - protein, 7 aa, Entamoeba invadens
VDWNEKP

SEQ ID NO: 2918985 - protein, 7 aa, Entamoeba invadens
VDYETGS

SEQ ID NO: 2918986 - protein, 11 aa, Entamoeba invadens
VDYNEKTQKPL

SEQ ID NO: 2918987 - protein, 6 aa, Entamoeba invadens
VDYPTT

SEQ ID NO: 2918988 - protein, 8 aa, Entamoeba invadens
VDYQQQYR

SEQ ID NO: 2918989 - protein, 8 aa, Entamoeba invadens
VDYSESRF

SEQ ID NO: 2918990 - protein, 6 aa, Entamoeba invadens
VDYSNI

SEQ ID NO: 2918991 - protein, 14 aa, Entamoeba invadens
VDYTTTPLPTAIPP

SEQ ID NO: 2918992 - protein, 13 aa, Entamoeba invadens
VEAAKKANSTRTW

SEQ ID NO: 2918993 - protein, 10 aa, Entamoeba invadens
VEAARPQIHQ

SEQ ID NO: 2918994 - protein, 11 aa, Entamoeba invadens
VEAARPQLHQD

SEQ ID NO: 2918995 - protein, 8 aa, Entamoeba invadens
VEADKKYQ

SEQ ID NO: 2918996 - protein, 7 aa, Entamoeba invadens
VEADPMA

SEQ ID NO: 2918997 - protein, 8 aa, Entamoeba invadens
VEAETDSA

SEQ ID NO: 2918998 - protein, 5 aa, Entamoeba invadens
VEAFP

SEQ ID NO: 2918999 - protein, 7 aa, Entamoeba invadens
VEAKEGA

SEQ ID NO: 2919000 - protein, 49 aa, Entamoeba invadens
VEAPKEEKKEEEPTEPKPEGKEASDEAQTEGVTQEVKEEEPPKVEPPRI

SEQ ID NO: 2919001 - protein, 37 aa, Entamoeba invadens
VEAPNISGKVGKRVTSGKVCKGQTKVLEEASSQVSAI

SEQ ID NO: 2919002 - protein, 12 aa, Entamoeba invadens
VEAPQPAQAEKT

SEQ ID NO: 2919003 - protein, 12 aa, Entamoeba invadens
VEAQEDEVKGTC

SEQ ID NO: 2919004 - protein, 13 aa, Entamoeba invadens
VEAQKKGEEMNKR

SEQ ID NO: 2919005 - protein, 11 aa, Entamoeba invadens
VEASEELQTEI

SEQ ID NO: 2919006 - protein, 23 aa, Entamoeba invadens
VEASQKEKTEEAKRDEELPRAIE

SEQ ID NO: 2919007 - protein, 10 aa, Entamoeba invadens
VEASTPMAKT

SEQ ID NO: 2919008 - protein, 20 aa, Entamoeba invadens
VEATPKGGASPPKLSQTIAT

SEQ ID NO: 2919009 - protein, 22 aa, Entamoeba invadens
VEATVSKKYKEERKKKKSAYDD

SEQ ID NO: 2919010 - protein, 10 aa, Entamoeba invadens
VECETPQENS

SEQ ID NO: 2919011 - protein, 15 aa, Entamoeba invadens
VECPRSPDDKEKSAA

SEQ ID NO: 2919012 - protein, 11 aa, Entamoeba invadens
VEDARKNAELN

SEQ ID NO: 2919013 - protein, 10 aa, Entamoeba invadens
VEDDENDEIG

SEQ ID NO: 2919014 - protein, 12 aa, Entamoeba invadens
VEDDSDDKENPQ

SEQ ID NO: 2919015 - protein, 10 aa, Entamoeba invadens
VEDDSEDDLK

SEQ ID NO: 2919016 - protein, 15 aa, Entamoeba invadens
VEDDSEELKYNPPYL

SEQ ID NO: 2919017 - protein, 9 aa, Entamoeba invadens
VEDDSLGSE

SEQ ID NO: 2919018 - protein, 10 aa, Entamoeba invadens
VEDEKPLNKI

SEQ ID NO: 2919019 - protein, 19 aa, Entamoeba invadens
VEDEPEVEAPKNSLQSELN

SEQ ID NO: 2919020 - protein, 7 aa, Entamoeba invadens
VEDGGVG

SEQ ID NO: 2919021 - protein, 9 aa, Entamoeba invadens
VEDGRRNQM

SEQ ID NO: 2919022 - protein, 9 aa, Entamoeba invadens
VEDKGEEDD

SEQ ID NO: 2919023 - protein, 7 aa, Entamoeba invadens
VEDKGGV

SEQ ID NO: 2919024 - protein, 36 aa, Entamoeba invadens
VEDKNNNLKSIKDEKKDETNQKDDKKAKESQEIQRE

SEQ ID NO: 2919025 - protein, 4 aa, Entamoeba invadens
VEDM

SEQ ID NO: 2919026 - protein, 5 aa, Entamoeba invadens
VEDNE

SEQ ID NO: 2919027 - protein, 102 aa, Entamoeba invadens
VEDPPQSQSPNVNLPQNDVNEDQDNNNNNNYNNDNGDNNMEEEEHYKEGEEQQNNEEERKEENTESEERNDTTEEEENNKQEDEEGSELHNDASLDNGESWY

SEQ ID NO: 2919028 - protein, 9 aa, Entamoeba invadens
VEDPSVSDF

SEQ ID NO: 2919029 - protein, 9 aa, Entamoeba invadens
VEDPTNPKA

SEQ ID NO: 2919030 - protein, 5 aa, Entamoeba invadens
VEDQV

SEQ ID NO: 2919031 - protein, 4 aa, Entamoeba invadens
VEDS

SEQ ID NO: 2919032 - protein, 8 aa, Entamoeba invadens
VEDSGGRI

SEQ ID NO: 2919033 - protein, 4 aa, Entamoeba invadens
VEDT

SEQ ID NO: 2919034 - protein, 8 aa, Entamoeba invadens
VEDTHTTF

SEQ ID NO: 2919035 - protein, 9 aa, Entamoeba invadens
VEDTQAKYQ

SEQ ID NO: 2919036 - protein, 8 aa, Entamoeba invadens
VEDTSLSD

SEQ ID NO: 2919037 - protein, 8 aa, Entamoeba invadens
VEDTSMEQ

SEQ ID NO: 2919038 - protein, 4 aa, Entamoeba invadens
VEDV

SEQ ID NO: 2919039 - protein, 14 aa, Entamoeba invadens
VEDYSTKDNMKEQN

SEQ ID NO: 2919040 - protein, 5 aa, Entamoeba invadens
VEEAS

SEQ ID NO: 2919041 - protein, 10 aa, Entamoeba invadens
VEEDEDERKF

SEQ ID NO: 2919042 - protein, 15 aa, Entamoeba invadens
VEEDEESDSEQETRK

SEQ ID NO: 2919043 - protein, 24 aa, Entamoeba invadens
VEEDNSKDLETQLHEKEDDIGDLE

SEQ ID NO: 2919044 - protein, 11 aa, Entamoeba invadens
VEEDQPPNKKN

SEQ ID NO: 2919045 - protein, 12 aa, Entamoeba invadens
VEEDTGMKVESP

SEQ ID NO: 2919046 - protein, 7 aa, Entamoeba invadens
VEEDTKK

SEQ ID NO: 2919047 - protein, 4 aa, Entamoeba invadens
VEEE

SEQ ID NO: 2919048 - protein, 16 aa, Entamoeba invadens
VEEECQKQYELDSREM

SEQ ID NO: 2919049 - protein, 6 aa, Entamoeba invadens
VEEEDI

SEQ ID NO: 2919050 - protein, 52 aa, Entamoeba invadens
VEEEHNEKEEKVTTKSGKITKKKVTKKTGTEGDKKQKAVLRKKPSKEELHPP

SEQ ID NO: 2919051 - protein, 15 aa, Entamoeba invadens
VEEEKQKGRANDTNF

SEQ ID NO: 2919052 - protein, 10 aa, Entamoeba invadens
VEEEKQRNAQ

SEQ ID NO: 2919053 - protein, 16 aa, Entamoeba invadens
VEEENNKSSGLTDNEM

SEQ ID NO: 2919054 - protein, 11 aa, Entamoeba invadens
VEEEQNTKEPC

SEQ ID NO: 2919055 - protein, 9 aa, Entamoeba invadens
VEEERKRES

SEQ ID NO: 2919056 - protein, 23 aa, Entamoeba invadens
VEEEWSKSEENDTKTCSKKEYEE

SEQ ID NO: 2919057 - protein, 4 aa, Entamoeba invadens
VEEF

SEQ ID NO: 2919058 - protein, 8 aa, Entamoeba invadens
VEEGHQDE

SEQ ID NO: 2919059 - protein, 5 aa, Entamoeba invadens
VEEGT

SEQ ID NO: 2919060 - protein, 12 aa, Entamoeba invadens
VEEHSMNTSTKM

SEQ ID NO: 2919061 - protein, 13 aa, Entamoeba invadens
VEEHTNKPNPIVP

SEQ ID NO: 2919062 - protein, 13 aa, Entamoeba invadens
VEEIQKSVTEVSE

SEQ ID NO: 2919063 - protein, 11 aa, Entamoeba invadens
VEEKDDDDTIR

SEQ ID NO: 2919064 - protein, 6 aa, Entamoeba invadens
VEEKDT

SEQ ID NO: 2919065 - protein, 16 aa, Entamoeba invadens
VEEKDTAQFAENSEEY

SEQ ID NO: 2919066 - protein, 43 aa, Entamoeba invadens
VEEKEKEKPKTSNVNNSSSVVKPTQNKKLLPQAETKTAPVYQR

SEQ ID NO: 2919067 - protein, 8 aa, Entamoeba invadens
VEEKEYKE

SEQ ID NO: 2919068 - protein, 15 aa, Entamoeba invadens
VEEKKEEKKEEKPQN

SEQ ID NO: 2919069 - protein, 17 aa, Entamoeba invadens
VEEKKEKKHTEESEIEE

SEQ ID NO: 2919070 - protein, 17 aa, Entamoeba invadens
VEEKNEEINEEVKEEVK

SEQ ID NO: 2919071 - protein, 13 aa, Entamoeba invadens
VEEKQEELKRREE

SEQ ID NO: 2919072 - protein, 10 aa, Entamoeba invadens
VEEKQPAQIV

SEQ ID NO: 2919073 - protein, 16 aa, Entamoeba invadens
VEEKTKKAKETVTETS

SEQ ID NO: 2919074 - protein, 20 aa, Entamoeba invadens
VEEKVEKAEPTDETKKKRIA

SEQ ID NO: 2919075 - protein, 4 aa, Entamoeba invadens
VEEL

SEQ ID NO: 2919076 - protein, 12 aa, Entamoeba invadens
VEELNKDINTAN

SEQ ID NO: 2919077 - protein, 18 aa, Entamoeba invadens
VEEMSSNKNMKDVEKKVT

SEQ ID NO: 2919078 - protein, 10 aa, Entamoeba invadens
VEENDKAKFQ

SEQ ID NO: 2919079 - protein, 19 aa, Entamoeba invadens
VEENEDEKMEDQDVEKKRC

SEQ ID NO: 2919080 - protein, 6 aa, Entamoeba invadens
VEENIE

SEQ ID NO: 2919081 - protein, 11 aa, Entamoeba invadens
VEENKGEYVKQ

SEQ ID NO: 2919082 - protein, 48 aa, Entamoeba invadens
VEENKKTDDSAKHHHKAAKTHQKSPSDSKETAQSKDKLMATQKTLPKT

SEQ ID NO: 2919083 - protein, 11 aa, Entamoeba invadens
VEENKTEDTEI

SEQ ID NO: 2919084 - protein, 6 aa, Entamoeba invadens
VEENPS

SEQ ID NO: 2919085 - protein, 23 aa, Entamoeba invadens
VEENVEEQKKVQSQNVISPNPTV

SEQ ID NO: 2919086 - protein, 53 aa, Entamoeba invadens
VEENVNEKDLEDDDQDGEKDDDDDLEEKESEQDESDDDDVEQDDDEKREKLET

SEQ ID NO: 2919087 - protein, 5 aa, Entamoeba invadens
VEEPD

SEQ ID NO: 2919088 - protein, 6 aa, Entamoeba invadens
VEEQAV

SEQ ID NO: 2919089 - protein, 42 aa, Entamoeba invadens
VEEQHNEKVEEMPQRKRKEGGVADLEPKQSVRKLTREEGCKN

SEQ ID NO: 2919090 - protein, 5 aa, Entamoeba invadens
VEEQN

SEQ ID NO: 2919091 - protein, 8 aa, Entamoeba invadens
VEEQRKRK

SEQ ID NO: 2919092 - protein, 6 aa, Entamoeba invadens
VEEQTE

SEQ ID NO: 2919093 - protein, 4 aa, Entamoeba invadens
VEER

SEQ ID NO: 2919094 - protein, 6 aa, Entamoeba invadens
VEERDA

SEQ ID NO: 2919095 - protein, 7 aa, Entamoeba invadens
VEEREKK

SEQ ID NO: 2919096 - protein, 7 aa, Entamoeba invadens
VEERGQI

SEQ ID NO: 2919097 - protein, 8 aa, Entamoeba invadens
VEERNTQV

SEQ ID NO: 2919098 - protein, 17 aa, Entamoeba invadens
VEERRQNTVMESSSRVC

SEQ ID NO: 2919099 - protein, 4 aa, Entamoeba invadens
VEES

SEQ ID NO: 2919100 - protein, 6 aa, Entamoeba invadens
VEESEA

SEQ ID NO: 2919101 - protein, 98 aa, Entamoeba invadens
VEESEEEEEKKPKKTAKKGKKEEKEEKPKKSAKKETKSKKEEKEEKPKKTTKKETKKEAKTPKKDEKKPAKKEEKEAKTPKKETKKEKKETKTPKKSK

SEQ ID NO: 2919102 - protein, 24 aa, Entamoeba invadens
VEESEKSRVSTSFGENESYSETQR

SEQ ID NO: 2919103 - protein, 18 aa, Entamoeba invadens
VEESHQSQNEGSQTDVTA

SEQ ID NO: 2919104 - protein, 10 aa, Entamoeba invadens
VEESKVPKST

SEQ ID NO: 2919105 - protein, 22 aa, Entamoeba invadens
VEESLKKGSMDNHTAIVVFFKW

SEQ ID NO: 2919106 - protein, 6 aa, Entamoeba invadens
VEESLT

SEQ ID NO: 2919107 - protein, 10 aa, Entamoeba invadens
VEESQRYASE

SEQ ID NO: 2919108 - protein, 34 aa, Entamoeba invadens
VEESQVSNPSNQPTELSTGKLSHNSKSSDTDKLI

SEQ ID NO: 2919109 - protein, 7 aa, Entamoeba invadens
VEETAST

SEQ ID NO: 2919110 - protein, 35 aa, Entamoeba invadens
VEETDKSERLEKANKALENHKEEMKPRSDKGKAYK

SEQ ID NO: 2919111 - protein, 8 aa, Entamoeba invadens
VEETDPEN

SEQ ID NO: 2919112 - protein, 6 aa, Entamoeba invadens
VEETEC

SEQ ID NO: 2919113 - protein, 6 aa, Entamoeba invadens
VEETIQ

SEQ ID NO: 2919114 - protein, 12 aa, Entamoeba invadens
VEETKKEEPTRK

SEQ ID NO: 2919115 - protein, 12 aa, Entamoeba invadens
VEETKKTYKELY

SEQ ID NO: 2919116 - protein, 7 aa, Entamoeba invadens
VEETKSI

SEQ ID NO: 2919117 - protein, 8 aa, Entamoeba invadens
VEETPNCS

SEQ ID NO: 2919118 - protein, 7 aa, Entamoeba invadens
VEETPSG

SEQ ID NO: 2919119 - protein, 13 aa, Entamoeba invadens
VEETRNKKGDETK

SEQ ID NO: 2919120 - protein, 8 aa, Entamoeba invadens
VEETTNTF

SEQ ID NO: 2919121 - protein, 6 aa, Entamoeba invadens
VEETYR

SEQ ID NO: 2919122 - protein, 18 aa, Entamoeba invadens
VEEVEKKKGKKGKKINDV

SEQ ID NO: 2919123 - protein, 9 aa, Entamoeba invadens
VEEYTTTTQ

SEQ ID NO: 2919124 - protein, 7 aa, Entamoeba invadens
VEFDNKE

SEQ ID NO: 2919125 - protein, 24 aa, Entamoeba invadens
VEFGESSTLSLKGYSSISSETPFG

SEQ ID NO: 2919126 - protein, 8 aa, Entamoeba invadens
VEFSESRR

SEQ ID NO: 2919127 - protein, 8 aa, Entamoeba invadens
VEFSRSEV

SEQ ID NO: 2919128 - protein, 5 aa, Entamoeba invadens
VEFTG

SEQ ID NO: 2919129 - protein, 39 aa, Entamoeba invadens
VEGADDQPVQAPQPGSSKPKAFDDGDDDDDDDIVNRIAN

SEQ ID NO: 2919130 - protein, 4 aa, Entamoeba invadens
VEGD

SEQ ID NO: 2919131 - protein, 15 aa, Entamoeba invadens
VEGDDKKLIANEVLC

SEQ ID NO: 2919132 - protein, 4 aa, Entamoeba invadens
VEGE

SEQ ID NO: 2919133 - protein, 10 aa, Entamoeba invadens
VEGEKELEEL

SEQ ID NO: 2919134 - protein, 9 aa, Entamoeba invadens
VEGEKELEV

SEQ ID NO: 2919135 - protein, 5 aa, Entamoeba invadens
VEGEY

SEQ ID NO: 2919136 - protein, 6 aa, Entamoeba invadens
VEGGAY

SEQ ID NO: 2919137 - protein, 5 aa, Entamoeba invadens
VEGGD

SEQ ID NO: 2919138 - protein, 7 aa, Entamoeba invadens
VEGGKGW

SEQ ID NO: 2919139 - protein, 7 aa, Entamoeba invadens
VEGGKKA

SEQ ID NO: 2919140 - protein, 6 aa, Entamoeba invadens
VEGGMN

SEQ ID NO: 2919141 - protein, 11 aa, Entamoeba invadens
VEGGSDEFQES

SEQ ID NO: 2919142 - protein, 6 aa, Entamoeba invadens
VEGGTY

SEQ ID NO: 2919143 - protein, 6 aa, Entamoeba invadens
VEGIDP

SEQ ID NO: 2919144 - protein, 8 aa, Entamoeba invadens
VEGINGIP

SEQ ID NO: 2919145 - protein, 5 aa, Entamoeba invadens
VEGIT

SEQ ID NO: 2919146 - protein, 11 aa, Entamoeba invadens
VEGKATSTQTN

SEQ ID NO: 2919147 - protein, 10 aa, Entamoeba invadens
VEGKDEKHHG

SEQ ID NO: 2919148 - protein, 13 aa, Entamoeba invadens
VEGKGKFESEHAE

SEQ ID NO: 2919149 - protein, 6 aa, Entamoeba invadens
VEGKTE

SEQ ID NO: 2919150 - protein, 10 aa, Entamoeba invadens
VEGLTNGMGK

SEQ ID NO: 2919151 - protein, 9 aa, Entamoeba invadens
VEGNERESI

SEQ ID NO: 2919152 - protein, 14 aa, Entamoeba invadens
VEGNPAIEVGKIRI

SEQ ID NO: 2919153 - protein, 9 aa, Entamoeba invadens
VEGNPERNN

SEQ ID NO: 2919154 - protein, 5 aa, Entamoeba invadens
VEGNS

SEQ ID NO: 2919155 - protein, 4 aa, Entamoeba invadens
VEGP

SEQ ID NO: 2919156 - protein, 12 aa, Entamoeba invadens
VEGQKHTSDSTQ

SEQ ID NO: 2919157 - protein, 9 aa, Entamoeba invadens
VEGSGVGEG

SEQ ID NO: 2919158 - protein, 14 aa, Entamoeba invadens
VEGSKGKRNTMPDD

SEQ ID NO: 2919159 - protein, 8 aa, Entamoeba invadens
VEGSQLQA

SEQ ID NO: 2919160 - protein, 8 aa, Entamoeba invadens
VEGSSLKT

SEQ ID NO: 2919161 - protein, 4 aa, Entamoeba invadens
VEGT

SEQ ID NO: 2919162 - protein, 8 aa, Entamoeba invadens
VEGTDEKL

SEQ ID NO: 2919163 - protein, 5 aa, Entamoeba invadens
VEGTE

SEQ ID NO: 2919164 - protein, 15 aa, Entamoeba invadens
VEGTETRVNASESCD

SEQ ID NO: 2919165 - protein, 73 aa, Entamoeba invadens
VEGTRKKQQQGGSGRGRGYQGTSLRGRGSDRRDFREDNRRVDYRDDRRGADRRDDRRDDYRRDDRHDDYRRDA

SEQ ID NO: 2919166 - protein, 6 aa, Entamoeba invadens
VEGTSG

SEQ ID NO: 2919167 - protein, 11 aa, Entamoeba invadens
VEHKKEEELKE

SEQ ID NO: 2919168 - protein, 4 aa, Entamoeba invadens
VEHN

SEQ ID NO: 2919169 - protein, 6 aa, Entamoeba invadens
VEHPGL

SEQ ID NO: 2919170 - protein, 10 aa, Entamoeba invadens
VEHSPQRVNS

SEQ ID NO: 2919171 - protein, 4 aa, Entamoeba invadens
VEHT

SEQ ID NO: 2919172 - protein, 5 aa, Entamoeba invadens
VEHTM

SEQ ID NO: 2919173 - protein, 11 aa, Entamoeba invadens
VEIAPKGTNRF

SEQ ID NO: 2919174 - protein, 46 aa, Entamoeba invadens
VEIEKKRKEENERQVKLEEEKRRKEKEEKEKKEEEEKAKREAEERD

SEQ ID NO: 2919175 - protein, 7 aa, Entamoeba invadens
VEIKRQS

SEQ ID NO: 2919176 - protein, 4 aa, Entamoeba invadens
VEIN

SEQ ID NO: 2919177 - protein, 6 aa, Entamoeba invadens
VEINQS

SEQ ID NO: 2919178 - protein, 6 aa, Entamoeba invadens
VEIPEN

SEQ ID NO: 2919179 - protein, 6 aa, Entamoeba invadens
VEIPGS

SEQ ID NO: 2919180 - protein, 4 aa, Entamoeba invadens
VEKA

SEQ ID NO: 2919181 - protein, 8 aa, Entamoeba invadens
VEKARQTI

SEQ ID NO: 2919182 - protein, 4 aa, Entamoeba invadens
VEKD

SEQ ID NO: 2919183 - protein, 9 aa, Entamoeba invadens
VEKDEEKRY

SEQ ID NO: 2919184 - protein, 14 aa, Entamoeba invadens
VEKDNKETKPVKKV

SEQ ID NO: 2919185 - protein, 14 aa, Entamoeba invadens
VEKDTADENILNYL

SEQ ID NO: 2919186 - protein, 15 aa, Entamoeba invadens
VEKEDTNGGDPNIKK

SEQ ID NO: 2919187 - protein, 10 aa, Entamoeba invadens
VEKEEDDSVN

SEQ ID NO: 2919188 - protein, 293 aa, Entamoeba invadens
VEKEEKDKKDKKNTKKDKHEEEEDKQKIEKEAAEAKAKKEEEEKVAKEKEAAEQKAKEEAAEKEKLEKEKAEKDAEEAKKKEEEAAKEKEAKEKAEKEEQEKAAAEAKEKEEAAMKAKQEAEEKEKKEAAEKAAAEAKEKEEQEKAEYEKQEADKKKAEEEAAKKKEEEEAAAKKAEEEKPKETPQEATGLGLGAQPSGLGLGAPSGGLGLGAQPTGLGLGAPTGGLGLGGAPTGLGLGAPSSGLGLGAPSGGLGLGGAPSGGLGLGAPSSGLGLGAPSGGLGLGGAPMGGMG

SEQ ID NO: 2919189 - protein, 18 aa, Entamoeba invadens
VEKEEKIKEAVKEENSAV

SEQ ID NO: 2919190 - protein, 27 aa, Entamoeba invadens
VEKEEPAEVDEPLNEAKENAEIKDGQP

SEQ ID NO: 2919191 - protein, 8 aa, Entamoeba invadens
VEKERAKQ

SEQ ID NO: 2919192 - protein, 9 aa, Entamoeba invadens
VEKESKPVQ

SEQ ID NO: 2919193 - protein, 5 aa, Entamoeba invadens
VEKEV

SEQ ID NO: 2919194 - protein, 14 aa, Entamoeba invadens
VEKEVDKKKTKETL

SEQ ID NO: 2919195 - protein, 12 aa, Entamoeba invadens
VEKFEKRGDLQS

SEQ ID NO: 2919196 - protein, 7 aa, Entamoeba invadens
VEKGETT

SEQ ID NO: 2919197 - protein, 8 aa, Entamoeba invadens
VEKGGDDK

SEQ ID NO: 2919198 - protein, 5 aa, Entamoeba invadens
VEKGN

SEQ ID NO: 2919199 - protein, 24 aa, Entamoeba invadens
VEKGSEPNDKVEKIENMEEKKCRK

SEQ ID NO: 2919200 - protein, 12 aa, Entamoeba invadens
VEKGVEEYVDSQ

SEQ ID NO: 2919201 - protein, 9 aa, Entamoeba invadens
VEKKDDEWV

SEQ ID NO: 2919202 - protein, 10 aa, Entamoeba invadens
VEKKDDGSLV

SEQ ID NO: 2919203 - protein, 15 aa, Entamoeba invadens
VEKKDTKEVESGSVT

SEQ ID NO: 2919204 - protein, 15 aa, Entamoeba invadens
VEKKEEKKEVAPPSF

SEQ ID NO: 2919205 - protein, 12 aa, Entamoeba invadens
VEKKEESPMKKE

SEQ ID NO: 2919206 - protein, 8 aa, Entamoeba invadens
VEKKEVGN

SEQ ID NO: 2919207 - protein, 15 aa, Entamoeba invadens
VEKKNKSSGLTDNEM

SEQ ID NO: 2919208 - protein, 8 aa, Entamoeba invadens
VEKKRPKV

SEQ ID NO: 2919209 - protein, 17 aa, Entamoeba invadens
VEKKRSKSEERKAEDKV

SEQ ID NO: 2919210 - protein, 10 aa, Entamoeba invadens
VEKKRTNKMG

SEQ ID NO: 2919211 - protein, 14 aa, Entamoeba invadens
VEKKSGKVFGGETN

SEQ ID NO: 2919212 - protein, 20 aa, Entamoeba invadens
VEKKTEKKIEKPVENPMESA

SEQ ID NO: 2919213 - protein, 4 aa, Entamoeba invadens
VEKM

SEQ ID NO: 2919214 - protein, 5 aa, Entamoeba invadens
VEKMG

SEQ ID NO: 2919215 - protein, 9 aa, Entamoeba invadens
VEKNDEKHL

SEQ ID NO: 2919216 - protein, 11 aa, Entamoeba invadens
VEKNDTISMQN

SEQ ID NO: 2919217 - protein, 20 aa, Entamoeba invadens
VEKNEKEEFEVDQEKDQMGL

SEQ ID NO: 2919218 - protein, 6 aa, Entamoeba invadens
VEKNEN

SEQ ID NO: 2919219 - protein, 22 aa, Entamoeba invadens
VEKPEKSESTSENSQSPTTKEA

SEQ ID NO: 2919220 - protein, 60 aa, Entamoeba invadens
VEKPERTEQGVKPEITESLQENIEDDWQDSKTGKSGKHNQKRKNKKTQKRSKISKEHDTV

SEQ ID NO: 2919221 - protein, 31 aa, Entamoeba invadens
VEKPKATKKVESESPSSTEESKESEESSDEV

SEQ ID NO: 2919222 - protein, 10 aa, Entamoeba invadens
VEKPKDEADA

SEQ ID NO: 2919223 - protein, 10 aa, Entamoeba invadens
VEKPKEEEEV

SEQ ID NO: 2919224 - protein, 20 aa, Entamoeba invadens
VEKPKWQNATIGQKAAPEHD

SEQ ID NO: 2919225 - protein, 6 aa, Entamoeba invadens
VEKQEE

SEQ ID NO: 2919226 - protein, 16 aa, Entamoeba invadens
VEKQESSDSEETFKPF

SEQ ID NO: 2919227 - protein, 16 aa, Entamoeba invadens
VEKQGERSERPHTPNI

SEQ ID NO: 2919228 - protein, 12 aa, Entamoeba invadens
VEKQKKERKKIE

SEQ ID NO: 2919229 - protein, 21 aa, Entamoeba invadens
VEKQKPVETPQEEIPKEEGAP

SEQ ID NO: 2919230 - protein, 37 aa, Entamoeba invadens
VEKQQVEAQVKPQTIKNDQKTEIPKRRPPPPPPQKMK

SEQ ID NO: 2919231 - protein, 4 aa, Entamoeba invadens
VEKR

SEQ ID NO: 2919232 - protein, 17 aa, Entamoeba invadens
VEKRGVPANPFSRSAES

SEQ ID NO: 2919233 - protein, 10 aa, Entamoeba invadens
VEKSGAVKFE

SEQ ID NO: 2919234 - protein, 8 aa, Entamoeba invadens
VEKSISSA

SEQ ID NO: 2919235 - protein, 7 aa, Entamoeba invadens
VEKSKEN

SEQ ID NO: 2919236 - protein, 16 aa, Entamoeba invadens
VEKSPEKVEHDEEDGF

SEQ ID NO: 2919237 - protein, 15 aa, Entamoeba invadens
VEKTDADTYRSQADK

SEQ ID NO: 2919238 - protein, 37 aa, Entamoeba invadens
VEKTEKTATVPAHQSPLQEGQLKQKLTKPRRSKTERM

SEQ ID NO: 2919239 - protein, 5 aa, Entamoeba invadens
VEKTH

SEQ ID NO: 2919240 - protein, 9 aa, Entamoeba invadens
VEKTNQVTC

SEQ ID NO: 2919241 - protein, 7 aa, Entamoeba invadens
VEKTVNP

SEQ ID NO: 2919242 - protein, 26 aa, Entamoeba invadens
VEKTYEKAEGLKVTPPSSTTTATNTI

SEQ ID NO: 2919243 - protein, 4 aa, Entamoeba invadens
VEKV

SEQ ID NO: 2919244 - protein, 12 aa, Entamoeba invadens
VEKVEESTLPIQ

SEQ ID NO: 2919245 - protein, 25 aa, Entamoeba invadens
VEKVSEKKCEQFNTEKTSTSRLPFT

SEQ ID NO: 2919246 - protein, 4 aa, Entamoeba invadens
VEKY

SEQ ID NO: 2919247 - protein, 5 aa, Entamoeba invadens
VEKYK

SEQ ID NO: 2919248 - protein, 7 aa, Entamoeba invadens
VEKYPNE

SEQ ID NO: 2919249 - protein, 4 aa, Entamoeba invadens
VELD

SEQ ID NO: 2919250 - protein, 8 aa, Entamoeba invadens
VELDSTTI

SEQ ID NO: 2919251 - protein, 7 aa, Entamoeba invadens
VELEPDK

SEQ ID NO: 2919252 - protein, 15 aa, Entamoeba invadens
VELKTTKPIFKEKTE

SEQ ID NO: 2919253 - protein, 4 aa, Entamoeba invadens
VELP

SEQ ID NO: 2919254 - protein, 8 aa, Entamoeba invadens
VELPQPQK

SEQ ID NO: 2919255 - protein, 4 aa, Entamoeba invadens
VELR

SEQ ID NO: 2919256 - protein, 6 aa, Entamoeba invadens
VELSET

SEQ ID NO: 2919257 - protein, 12 aa, Entamoeba invadens
VELTSKDKKQYS

SEQ ID NO: 2919258 - protein, 37 aa, Entamoeba invadens
VEMETQQVENVETVKTSQTIENPQETIKEEVKEEIKD

SEQ ID NO: 2919259 - protein, 5 aa, Entamoeba invadens
VEMPG

SEQ ID NO: 2919260 - protein, 11 aa, Entamoeba invadens
VEMPIPSRSSI

SEQ ID NO: 2919261 - protein, 4 aa, Entamoeba invadens
VEMS

SEQ ID NO: 2919262 - protein, 5 aa, Entamoeba invadens
VEMSE

SEQ ID NO: 2919263 - protein, 27 aa, Entamoeba invadens
VENAEKEIRERADLEKKRQTEITEQKE

SEQ ID NO: 2919264 - protein, 14 aa, Entamoeba invadens
VENDDTQNSQSVDD

SEQ ID NO: 2919265 - protein, 23 aa, Entamoeba invadens
VENDELRKQIDENTKNASEESKR

SEQ ID NO: 2919266 - protein, 17 aa, Entamoeba invadens
VENDKENDMDEESPQIL

SEQ ID NO: 2919267 - protein, 8 aa, Entamoeba invadens
VENDLKDN

SEQ ID NO: 2919268 - protein, 8 aa, Entamoeba invadens
VENDPQQI

SEQ ID NO: 2919269 - protein, 8 aa, Entamoeba invadens
VENDTENL

SEQ ID NO: 2919270 - protein, 4 aa, Entamoeba invadens
VENE

SEQ ID NO: 2919271 - protein, 18 aa, Entamoeba invadens
VENEANNVETESVQEVNP

SEQ ID NO: 2919272 - protein, 16 aa, Entamoeba invadens
VENEKKEEEKRKREEK

SEQ ID NO: 2919273 - protein, 8 aa, Entamoeba invadens
VENEKNQT

SEQ ID NO: 2919274 - protein, 8 aa, Entamoeba invadens
VENEKVAD

SEQ ID NO: 2919275 - protein, 8 aa, Entamoeba invadens
VENERKRM

SEQ ID NO: 2919276 - protein, 15 aa, Entamoeba invadens
VENESKSPSPKPCSY

SEQ ID NO: 2919277 - protein, 12 aa, Entamoeba invadens
VENFESNYGGTN

SEQ ID NO: 2919278 - protein, 7 aa, Entamoeba invadens
VENGASA

SEQ ID NO: 2919279 - protein, 10 aa, Entamoeba invadens
VENGDNNAFV

SEQ ID NO: 2919280 - protein, 9 aa, Entamoeba invadens
VENGKQTVD

SEQ ID NO: 2919281 - protein, 6 aa, Entamoeba invadens
VENGKR

SEQ ID NO: 2919282 - protein, 22 aa, Entamoeba invadens
VENHPKEEKIENLQTKPEPLAV

SEQ ID NO: 2919283 - protein, 4 aa, Entamoeba invadens
VENI

SEQ ID NO: 2919284 - protein, 11 aa, Entamoeba invadens
VENKDQINGNM

SEQ ID NO: 2919285 - protein, 11 aa, Entamoeba invadens
VENKKDPKGFS

SEQ ID NO: 2919286 - protein, 10 aa, Entamoeba invadens
VENLKEEKVV

SEQ ID NO: 2919287 - protein, 8 aa, Entamoeba invadens
VENNDDND

SEQ ID NO: 2919288 - protein, 11 aa, Entamoeba invadens
VENNEETKKEV

SEQ ID NO: 2919289 - protein, 7 aa, Entamoeba invadens
VENNEQC

SEQ ID NO: 2919290 - protein, 9 aa, Entamoeba invadens
VENNGEAAE

SEQ ID NO: 2919291 - protein, 14 aa, Entamoeba invadens
VENPGDARKRLQPE

SEQ ID NO: 2919292 - protein, 10 aa, Entamoeba invadens
VENPNEAARE

SEQ ID NO: 2919293 - protein, 12 aa, Entamoeba invadens
VENPNTGNQFSF

SEQ ID NO: 2919294 - protein, 6 aa, Entamoeba invadens
VENPSN

SEQ ID NO: 2919295 - protein, 11 aa, Entamoeba invadens
VENQKYTDGSA

SEQ ID NO: 2919296 - protein, 6 aa, Entamoeba invadens
VENRSV

SEQ ID NO: 2919297 - protein, 8 aa, Entamoeba invadens
VENSEDGY

SEQ ID NO: 2919298 - protein, 6 aa, Entamoeba invadens
VENSER

SEQ ID NO: 2919299 - protein, 5 aa, Entamoeba invadens
VENSS

SEQ ID NO: 2919300 - protein, 8 aa, Entamoeba invadens
VENSTQGL

SEQ ID NO: 2919301 - protein, 8 aa, Entamoeba invadens
VENTADSS

SEQ ID NO: 2919302 - protein, 5 aa, Entamoeba invadens
VENTN

SEQ ID NO: 2919303 - protein, 8 aa, Entamoeba invadens
VENTSNST

SEQ ID NO: 2919304 - protein, 8 aa, Entamoeba invadens
VENTSNTL

SEQ ID NO: 2919305 - protein, 9 aa, Entamoeba invadens
VENTVDELS

SEQ ID NO: 2919306 - protein, 12 aa, Entamoeba invadens
VENTYENKLTEL

SEQ ID NO: 2919307 - protein, 17 aa, Entamoeba invadens
VEPAPPKVEPKKISPTD

SEQ ID NO: 2919308 - protein, 15 aa, Entamoeba invadens
VEPEGGAKEPKKAGP

SEQ ID NO: 2919309 - protein, 8 aa, Entamoeba invadens
VEPEKDGS

SEQ ID NO: 2919310 - protein, 19 aa, Entamoeba invadens
VEPEQPKRADSVDTTKKKK

SEQ ID NO: 2919311 - protein, 4 aa, Entamoeba invadens
VEPG

SEQ ID NO: 2919312 - protein, 5 aa, Entamoeba invadens
VEPGD

SEQ ID NO: 2919313 - protein, 7 aa, Entamoeba invadens
VEPGGEE

SEQ ID NO: 2919314 - protein, 13 aa, Entamoeba invadens
VEPISDPTENTGY

SEQ ID NO: 2919315 - protein, 6 aa, Entamoeba invadens
VEPKAI

SEQ ID NO: 2919316 - protein, 5 aa, Entamoeba invadens
VEPKE

SEQ ID NO: 2919317 - protein, 6 aa, Entamoeba invadens
VEPKIE

SEQ ID NO: 2919318 - protein, 13 aa, Entamoeba invadens
VEPKIGEPKQEVK

SEQ ID NO: 2919319 - protein, 10 aa, Entamoeba invadens
VEPKTTENGG

SEQ ID NO: 2919320 - protein, 7 aa, Entamoeba invadens
VEPKTTR

SEQ ID NO: 2919321 - protein, 22 aa, Entamoeba invadens
VEPPIEKKDNPEQLSQTQEEQV

SEQ ID NO: 2919322 - protein, 11 aa, Entamoeba invadens
VEPPKPETMSA

SEQ ID NO: 2919323 - protein, 19 aa, Entamoeba invadens
VEPPTCKDCGDKKATLDGD

SEQ ID NO: 2919324 - protein, 4 aa, Entamoeba invadens
VEPQ

SEQ ID NO: 2919325 - protein, 14 aa, Entamoeba invadens
VEPQEPKDEDVNET

SEQ ID NO: 2919326 - protein, 5 aa, Entamoeba invadens
VEPRY

SEQ ID NO: 2919327 - protein, 9 aa, Entamoeba invadens
VEPSDTTKR

SEQ ID NO: 2919328 - protein, 5 aa, Entamoeba invadens
VEPSE

SEQ ID NO: 2919329 - protein, 8 aa, Entamoeba invadens
VEPSKLPE

SEQ ID NO: 2919330 - protein, 4 aa, Entamoeba invadens
VEPT

SEQ ID NO: 2919331 - protein, 8 aa, Entamoeba invadens
VEPTQENI

SEQ ID NO: 2919332 - protein, 5 aa, Entamoeba invadens
VEPTR

SEQ ID NO: 2919333 - protein, 6 aa, Entamoeba invadens
VEPTSN

SEQ ID NO: 2919334 - protein, 29 aa, Entamoeba invadens
VEPYAPYQAYQSTTYPQYTQSQEQQPYTT

SEQ ID NO: 2919335 - protein, 6 aa, Entamoeba invadens
VEQEND

SEQ ID NO: 2919336 - protein, 20 aa, Entamoeba invadens
VEQHNTNDKEQKLTEEQKNS

SEQ ID NO: 2919337 - protein, 12 aa, Entamoeba invadens
VEQKEGDSLPDY

SEQ ID NO: 2919338 - protein, 7 aa, Entamoeba invadens
VEQKEGV

SEQ ID NO: 2919339 - protein, 14 aa, Entamoeba invadens
VEQKGELSDLQNEQ

SEQ ID NO: 2919340 - protein, 11 aa, Entamoeba invadens
VEQKNDDIARG

SEQ ID NO: 2919341 - protein, 11 aa, Entamoeba invadens
VEQKQKDVVEE

SEQ ID NO: 2919342 - protein, 8 aa, Entamoeba invadens
VEQKRYKE

SEQ ID NO: 2919343 - protein, 6 aa, Entamoeba invadens
VEQKSD

SEQ ID NO: 2919344 - protein, 12 aa, Entamoeba invadens
VEQKTAETAEDS

SEQ ID NO: 2919345 - protein, 11 aa, Entamoeba invadens
VEQNEEHIKQD

SEQ ID NO: 2919346 - protein, 14 aa, Entamoeba invadens
VEQNISKNLPNDTE

SEQ ID NO: 2919347 - protein, 11 aa, Entamoeba invadens
VEQNNTSSPSW

SEQ ID NO: 2919348 - protein, 6 aa, Entamoeba invadens
VEQPPQ

SEQ ID NO: 2919349 - protein, 15 aa, Entamoeba invadens
VEQSAVKTSELSTKN

SEQ ID NO: 2919350 - protein, 11 aa, Entamoeba invadens
VEQSKNRLNRA

SEQ ID NO: 2919351 - protein, 14 aa, Entamoeba invadens
VEQSKTVKQSDGGW

SEQ ID NO: 2919352 - protein, 11 aa, Entamoeba invadens
VEQSPSVNNPA

SEQ ID NO: 2919353 - protein, 7 aa, Entamoeba invadens
VEQTGGS

SEQ ID NO: 2919354 - protein, 12 aa, Entamoeba invadens
VEQTPEGSVVTS

SEQ ID NO: 2919355 - protein, 5 aa, Entamoeba invadens
VEQTV

SEQ ID NO: 2919356 - protein, 5 aa, Entamoeba invadens
VEREA

SEQ ID NO: 2919357 - protein, 24 aa, Entamoeba invadens
VEREPTPPVEDMSEETQNDQETED

SEQ ID NO: 2919358 - protein, 5 aa, Entamoeba invadens
VERGE

SEQ ID NO: 2919359 - protein, 6 aa, Entamoeba invadens
VERNEE

SEQ ID NO: 2919360 - protein, 19 aa, Entamoeba invadens
VERNKSTFGESELGEITSK

SEQ ID NO: 2919361 - protein, 10 aa, Entamoeba invadens
VERNRENERL

SEQ ID NO: 2919362 - protein, 14 aa, Entamoeba invadens
VERNTTSTTVQHVF

SEQ ID NO: 2919363 - protein, 11 aa, Entamoeba invadens
VERPSFSTSPL

SEQ ID NO: 2919364 - protein, 6 aa, Entamoeba invadens
VERPTQ

SEQ ID NO: 2919365 - protein, 6 aa, Entamoeba invadens
VERRQT

SEQ ID NO: 2919366 - protein, 14 aa, Entamoeba invadens
VERTGGEEEQMKPE

SEQ ID NO: 2919367 - protein, 9 aa, Entamoeba invadens
VERTNAQTL

SEQ ID NO: 2919368 - protein, 12 aa, Entamoeba invadens
VERYGEVHDSNN

SEQ ID NO: 2919369 - protein, 4 aa, Entamoeba invadens
VESA

SEQ ID NO: 2919370 - protein, 13 aa, Entamoeba invadens
VESAGRKEKNVQS

SEQ ID NO: 2919371 - protein, 4 aa, Entamoeba invadens
VESD

SEQ ID NO: 2919372 - protein, 12 aa, Entamoeba invadens
VESDESGGDRKW

SEQ ID NO: 2919373 - protein, 6 aa, Entamoeba invadens
VESDRD

SEQ ID NO: 2919374 - protein, 9 aa, Entamoeba invadens
VESDTNSIN

SEQ ID NO: 2919375 - protein, 8 aa, Entamoeba invadens
VESEGLPC

SEQ ID NO: 2919376 - protein, 9 aa, Entamoeba invadens
VESEGRKLG

SEQ ID NO: 2919377 - protein, 10 aa, Entamoeba invadens
VESEKNLPQI

SEQ ID NO: 2919378 - protein, 13 aa, Entamoeba invadens
VESEKQTDTSLAN

SEQ ID NO: 2919379 - protein, 8 aa, Entamoeba invadens
VESEPKDT

SEQ ID NO: 2919380 - protein, 25 aa, Entamoeba invadens
VESESSDLRSESLRERIQKSPTEFN

SEQ ID NO: 2919381 - protein, 11 aa, Entamoeba invadens
VESETKSLDKS

SEQ ID NO: 2919382 - protein, 5 aa, Entamoeba invadens
VESEW

SEQ ID NO: 2919383 - protein, 6 aa, Entamoeba invadens
VESGGE

SEQ ID NO: 2919384 - protein, 6 aa, Entamoeba invadens
VESGGT

SEQ ID NO: 2919385 - protein, 10 aa, Entamoeba invadens
VESGSDALPE

SEQ ID NO: 2919386 - protein, 13 aa, Entamoeba invadens
VESINNQNADQPK

SEQ ID NO: 2919387 - protein, 16 aa, Entamoeba invadens
VESKELEELTQPTTEP

SEQ ID NO: 2919388 - protein, 11 aa, Entamoeba invadens
VESKGEVNNTK

SEQ ID NO: 2919389 - protein, 5 aa, Entamoeba invadens
VESNG

SEQ ID NO: 2919390 - protein, 30 aa, Entamoeba invadens
VESNKLTNSTDTQRPRQNTVVEPQKITEEK

SEQ ID NO: 2919391 - protein, 88 aa, Entamoeba invadens
VESNQNKYTNFDSNNNNNNNNNNNNNNNNNNNNNNNNNNNNNNNNNNNNNNNNNNNNNNNNNNNNNNNNNNNNNNNNNNNNNNNNNNN

SEQ ID NO: 2919392 - protein, 8 aa, Entamoeba invadens
VESNRGDN

SEQ ID NO: 2919393 - protein, 12 aa, Entamoeba invadens
VESPKTEESENI

SEQ ID NO: 2919394 - protein, 18 aa, Entamoeba invadens
VESPRPGLSTKGINEIKH

SEQ ID NO: 2919395 - protein, 16 aa, Entamoeba invadens
VESQTEHQQKQVKYGT

SEQ ID NO: 2919396 - protein, 22 aa, Entamoeba invadens
VESRERAVTSLTGSKLNDREIT

SEQ ID NO: 2919397 - protein, 5 aa, Entamoeba invadens
VESRT

SEQ ID NO: 2919398 - protein, 12 aa, Entamoeba invadens
VESSAKSSAGVT

SEQ ID NO: 2919399 - protein, 13 aa, Entamoeba invadens
VESSGKWNDLSQG

SEQ ID NO: 2919400 - protein, 8 aa, Entamoeba invadens
VESSNNQG

SEQ ID NO: 2919401 - protein, 6 aa, Entamoeba invadens
VESTAG

SEQ ID NO: 2919402 - protein, 5 aa, Entamoeba invadens
VESTV

SEQ ID NO: 2919403 - protein, 4 aa, Entamoeba invadens
VESV

SEQ ID NO: 2919404 - protein, 5 aa, Entamoeba invadens
VESVP

SEQ ID NO: 2919405 - protein, 6 aa, Entamoeba invadens
VESVRE

SEQ ID NO: 2919406 - protein, 6 aa, Entamoeba invadens
VETALN

SEQ ID NO: 2919407 - protein, 5 aa, Entamoeba invadens
VETAN

SEQ ID NO: 2919408 - protein, 17 aa, Entamoeba invadens
VETANSKCSKCSFWHVP

SEQ ID NO: 2919409 - protein, 4 aa, Entamoeba invadens
VETC

SEQ ID NO: 2919410 - protein, 11 aa, Entamoeba invadens
VETDNGLQPMY

SEQ ID NO: 2919411 - protein, 5 aa, Entamoeba invadens
VETDS

SEQ ID NO: 2919412 - protein, 6 aa, Entamoeba invadens
VETEGC

SEQ ID NO: 2919413 - protein, 75 aa, Entamoeba invadens
VETEKTESVTTQTVDERSEDFSPKKIEKVEKIEPKEAPKADVIPATPEIETITQKKSEEVREKDSPVTNNPQQPN

SEQ ID NO: 2919414 - protein, 19 aa, Entamoeba invadens
VETEQTQKENKENDENEGL

SEQ ID NO: 2919415 - protein, 8 aa, Entamoeba invadens
VETESDSV

SEQ ID NO: 2919416 - protein, 13 aa, Entamoeba invadens
VETESKSKIGDKL

SEQ ID NO: 2919417 - protein, 44 aa, Entamoeba invadens
VETESSKKMDESLSLQPEKVEKEEKIEKEDKEDNEMDEESITHP

SEQ ID NO: 2919418 - protein, 15 aa, Entamoeba invadens
VETETPSLCLLVCIF

SEQ ID NO: 2919419 - protein, 11 aa, Entamoeba invadens
VETFPKELKER

SEQ ID NO: 2919420 - protein, 9 aa, Entamoeba invadens
VETGGKKNM

SEQ ID NO: 2919421 - protein, 4 aa, Entamoeba invadens
VETH

SEQ ID NO: 2919422 - protein, 20 aa, Entamoeba invadens
VETHPVESLSTEKPKELVGV

SEQ ID NO: 2919423 - protein, 8 aa, Entamoeba invadens
VETIPNAA

SEQ ID NO: 2919424 - protein, 6 aa, Entamoeba invadens
VETKAR

SEQ ID NO: 2919425 - protein, 7 aa, Entamoeba invadens
VETKEGL

SEQ ID NO: 2919426 - protein, 10 aa, Entamoeba invadens
VETKEPDMHK

SEQ ID NO: 2919427 - protein, 9 aa, Entamoeba invadens
VETKGNIET

SEQ ID NO: 2919428 - protein, 8 aa, Entamoeba invadens
VETKKFEE

SEQ ID NO: 2919429 - protein, 6 aa, Entamoeba invadens
VETKNA

SEQ ID NO: 2919430 - protein, 24 aa, Entamoeba invadens
VETKPEMKSINKPSNKVETNSLER

SEQ ID NO: 2919431 - protein, 12 aa, Entamoeba invadens
VETKSQSPAESA

SEQ ID NO: 2919432 - protein, 5 aa, Entamoeba invadens
VETKY

SEQ ID NO: 2919433 - protein, 5 aa, Entamoeba invadens
VETLP

SEQ ID NO: 2919434 - protein, 4 aa, Entamoeba invadens
VETM

SEQ ID NO: 2919435 - protein, 8 aa, Entamoeba invadens
VETNEEID

SEQ ID NO: 2919436 - protein, 39 aa, Entamoeba invadens
VETNESQVSQQIKNKDEHSSCTPLSSDNSEEDKYQETEQ

SEQ ID NO: 2919437 - protein, 7 aa, Entamoeba invadens
VETNGQT

SEQ ID NO: 2919438 - protein, 6 aa, Entamoeba invadens
VETNHE

SEQ ID NO: 2919439 - protein, 22 aa, Entamoeba invadens
VETNKKDENRENKMDEEPPKRE

SEQ ID NO: 2919440 - protein, 5 aa, Entamoeba invadens
VETNL

SEQ ID NO: 2919441 - protein, 7 aa, Entamoeba invadens
VETNSDV

SEQ ID NO: 2919442 - protein, 14 aa, Entamoeba invadens
VETNSKSNEGFDLS

SEQ ID NO: 2919443 - protein, 5 aa, Entamoeba invadens
VETNT

SEQ ID NO: 2919444 - protein, 4 aa, Entamoeba invadens
VETP

SEQ ID NO: 2919445 - protein, 5 aa, Entamoeba invadens
VETPF

SEQ ID NO: 2919446 - protein, 16 aa, Entamoeba invadens
VETPKTKRRTRAAPRN

SEQ ID NO: 2919447 - protein, 21 aa, Entamoeba invadens
VETQEKVPKEENTAVETLEEK

SEQ ID NO: 2919448 - protein, 6 aa, Entamoeba invadens
VETRHN

SEQ ID NO: 2919449 - protein, 11 aa, Entamoeba invadens
VETRKNEISEE

SEQ ID NO: 2919450 - protein, 4 aa, Entamoeba invadens
VETS

SEQ ID NO: 2919451 - protein, 18 aa, Entamoeba invadens
VETSDSGLSTIKTQEDYK

SEQ ID NO: 2919452 - protein, 5 aa, Entamoeba invadens
VETSK

SEQ ID NO: 2919453 - protein, 14 aa, Entamoeba invadens
VETSQDVDKNSQEM

SEQ ID NO: 2919454 - protein, 15 aa, Entamoeba invadens
VETSSLKEEKFGDNI

SEQ ID NO: 2919455 - protein, 5 aa, Entamoeba invadens
VETTA

SEQ ID NO: 2919456 - protein, 7 aa, Entamoeba invadens
VETTNKR

SEQ ID NO: 2919457 - protein, 5 aa, Entamoeba invadens
VETVT

SEQ ID NO: 2919458 - protein, 8 aa, Entamoeba invadens
VETVTKGS

SEQ ID NO: 2919459 - protein, 4 aa, Entamoeba invadens
VETY

SEQ ID NO: 2919460 - protein, 11 aa, Entamoeba invadens
VEVDKDETKSF

SEQ ID NO: 2919461 - protein, 4 aa, Entamoeba invadens
VEVE

SEQ ID NO: 2919462 - protein, 9 aa, Entamoeba invadens
VEVEKTEQG

SEQ ID NO: 2919463 - protein, 30 aa, Entamoeba invadens
VEVKGENKELEVEPPKVEEIKKENETKIEE

SEQ ID NO: 2919464 - protein, 20 aa, Entamoeba invadens
VEVPEKTATPVLTQKEEKPV

SEQ ID NO: 2919465 - protein, 7 aa, Entamoeba invadens
VEVPSTL

SEQ ID NO: 2919466 - protein, 13 aa, Entamoeba invadens
VEYGDKVQRETGA

SEQ ID NO: 2919467 - protein, 22 aa, Entamoeba invadens
VEYSNDEKDEDGDIQAYMYKEE

SEQ ID NO: 2919468 - protein, 7 aa, Entamoeba invadens
VEYTGAP

SEQ ID NO: 2919469 - protein, 10 aa, Entamoeba invadens
VFDDPKGKTC

SEQ ID NO: 2919470 - protein, 10 aa, Entamoeba invadens
VFDERKTNDI

SEQ ID NO: 2919471 - protein, 9 aa, Entamoeba invadens
VFDNNTNLN

SEQ ID NO: 2919472 - protein, 7 aa, Entamoeba invadens
VFEDPPS

SEQ ID NO: 2919473 - protein, 14 aa, Entamoeba invadens
VFNEGSDSKKREKE

SEQ ID NO: 2919474 - protein, 4 aa, Entamoeba invadens
VFNS

SEQ ID NO: 2919475 - protein, 11 aa, Entamoeba invadens
VFNSDKGCSDK

SEQ ID NO: 2919476 - protein, 9 aa, Entamoeba invadens
VFNTDGSEP

SEQ ID NO: 2919477 - protein, 6 aa, Entamoeba invadens
VFPEDG

SEQ ID NO: 2919478 - protein, 8 aa, Entamoeba invadens
VFPQPKNS

SEQ ID NO: 2919479 - protein, 26 aa, Entamoeba invadens
VFQDPKEVRKAQIRQRQKGSRERQQD

SEQ ID NO: 2919480 - protein, 12 aa, Entamoeba invadens
VFQSNNKSAFNT

SEQ ID NO: 2919481 - protein, 11 aa, Entamoeba invadens
VFQTESVNKAL

SEQ ID NO: 2919482 - protein, 4 aa, Entamoeba invadens
VFSE

SEQ ID NO: 2919483 - protein, 10 aa, Entamoeba invadens
VFSEPKSNKC

SEQ ID NO: 2919484 - protein, 12 aa, Entamoeba invadens
VFSGTNEQLKDE

SEQ ID NO: 2919485 - protein, 7 aa, Entamoeba invadens
VFSTTNS

SEQ ID NO: 2919486 - protein, 7 aa, Entamoeba invadens
VFTPEPS

SEQ ID NO: 2919487 - protein, 10 aa, Entamoeba invadens
VFTPTDAVQQ

SEQ ID NO: 2919488 - protein, 10 aa, Entamoeba invadens
VGADGVDRGK

SEQ ID NO: 2919489 - protein, 5 aa, Entamoeba invadens
VGADY

SEQ ID NO: 2919490 - protein, 7 aa, Entamoeba invadens
VGAGDSF

SEQ ID NO: 2919491 - protein, 11 aa, Entamoeba invadens
VGAGENDKALR

SEQ ID NO: 2919492 - protein, 25 aa, Entamoeba invadens
VGAGQKTVDSDVQYSKTKLGESHKK

SEQ ID NO: 2919493 - protein, 9 aa, Entamoeba invadens
VGAKAKKCV

SEQ ID NO: 2919494 - protein, 6 aa, Entamoeba invadens
VGAKDS

SEQ ID NO: 2919495 - protein, 7 aa, Entamoeba invadens
VGAPGLR

SEQ ID NO: 2919496 - protein, 6 aa, Entamoeba invadens
VGATQE

SEQ ID NO: 2919497 - protein, 4 aa, Entamoeba invadens
VGCE

SEQ ID NO: 2919498 - protein, 12 aa, Entamoeba invadens
VGCGTKNDAFPK

SEQ ID NO: 2919499 - protein, 17 aa, Entamoeba invadens
VGCTTKVAEKQKTHTKN

SEQ ID NO: 2919500 - protein, 8 aa, Entamoeba invadens
VGDDELGR

SEQ ID NO: 2919501 - protein, 30 aa, Entamoeba invadens
VGDDNQKEKEKLEKEAKKAAAKNAKKTTKK

SEQ ID NO: 2919502 - protein, 7 aa, Entamoeba invadens
VGDDRKK

SEQ ID NO: 2919503 - protein, 11 aa, Entamoeba invadens
VGDEDDEEGKY

SEQ ID NO: 2919504 - protein, 7 aa, Entamoeba invadens
VGDETEE

SEQ ID NO: 2919505 - protein, 8 aa, Entamoeba invadens
VGDGANDL

SEQ ID NO: 2919506 - protein, 12 aa, Entamoeba invadens
VGDGQKKWSKME

SEQ ID NO: 2919507 - protein, 7 aa, Entamoeba invadens
VGDIKNK

SEQ ID NO: 2919508 - protein, 4 aa, Entamoeba invadens
VGDL

SEQ ID NO: 2919509 - protein, 10 aa, Entamoeba invadens
VGDNSQAGCD

SEQ ID NO: 2919510 - protein, 6 aa, Entamoeba invadens
VGDNTG

SEQ ID NO: 2919511 - protein, 9 aa, Entamoeba invadens
VGDPSNCQS

SEQ ID NO: 2919512 - protein, 5 aa, Entamoeba invadens
VGDRV

SEQ ID NO: 2919513 - protein, 9 aa, Entamoeba invadens
VGDSTNREF

SEQ ID NO: 2919514 - protein, 9 aa, Entamoeba invadens
VGDTSLDIP

SEQ ID NO: 2919515 - protein, 9 aa, Entamoeba invadens
VGDTTPLDN

SEQ ID NO: 2919516 - protein, 8 aa, Entamoeba invadens
VGDVKSKP

SEQ ID NO: 2919517 - protein, 20 aa, Entamoeba invadens
VGEAPQHTTHQQYPTEIPNI

SEQ ID NO: 2919518 - protein, 14 aa, Entamoeba invadens
VGEDAKNEKLAKNK

SEQ ID NO: 2919519 - protein, 5 aa, Entamoeba invadens
VGEDE

SEQ ID NO: 2919520 - protein, 5 aa, Entamoeba invadens
VGEDQ

SEQ ID NO: 2919521 - protein, 16 aa, Entamoeba invadens
VGEDQTSNDADDGGSE

SEQ ID NO: 2919522 - protein, 30 aa, Entamoeba invadens
VGEEEGMTFGDKKELDSAFKPVSKELFQVI

SEQ ID NO: 2919523 - protein, 12 aa, Entamoeba invadens
VGEEESANSVPK

SEQ ID NO: 2919524 - protein, 17 aa, Entamoeba invadens
VGEEITKTPPLSRTNSL

SEQ ID NO: 2919525 - protein, 7 aa, Entamoeba invadens
VGEENQV

SEQ ID NO: 2919526 - protein, 6 aa, Entamoeba invadens
VGEENV

SEQ ID NO: 2919527 - protein, 10 aa, Entamoeba invadens
VGEESSTQER

SEQ ID NO: 2919528 - protein, 8 aa, Entamoeba invadens
VGEETKTQ

SEQ ID NO: 2919529 - protein, 9 aa, Entamoeba invadens
VGEETYERH

SEQ ID NO: 2919530 - protein, 4 aa, Entamoeba invadens
VGEG

SEQ ID NO: 2919531 - protein, 6 aa, Entamoeba invadens
VGEGAK

SEQ ID NO: 2919532 - protein, 14 aa, Entamoeba invadens
VGEGEEVKEVGEGL

SEQ ID NO: 2919533 - protein, 12 aa, Entamoeba invadens
VGEGRNDKERRI

SEQ ID NO: 2919534 - protein, 5 aa, Entamoeba invadens
VGEKG

SEQ ID NO: 2919535 - protein, 5 aa, Entamoeba invadens
VGEKK

SEQ ID NO: 2919536 - protein, 8 aa, Entamoeba invadens
VGEKNGGH

SEQ ID NO: 2919537 - protein, 22 aa, Entamoeba invadens
VGELEKEIREREGHISSLKDSF

SEQ ID NO: 2919538 - protein, 8 aa, Entamoeba invadens
VGENEETK

SEQ ID NO: 2919539 - protein, 18 aa, Entamoeba invadens
VGENESFDDDVKDKEEII

SEQ ID NO: 2919540 - protein, 16 aa, Entamoeba invadens
VGEPENLQQISLDGEI

SEQ ID NO: 2919541 - protein, 6 aa, Entamoeba invadens
VGEPKA

SEQ ID NO: 2919542 - protein, 5 aa, Entamoeba invadens
VGEPV

SEQ ID NO: 2919543 - protein, 25 aa, Entamoeba invadens
VGEQPAPPQEIKPESTHGKKCSCVL

SEQ ID NO: 2919544 - protein, 10 aa, Entamoeba invadens
VGERNRTYSA

SEQ ID NO: 2919545 - protein, 7 aa, Entamoeba invadens
VGERPID

SEQ ID NO: 2919546 - protein, 10 aa, Entamoeba invadens
VGERSESKDY

SEQ ID NO: 2919547 - protein, 9 aa, Entamoeba invadens
VGESDETRL

SEQ ID NO: 2919548 - protein, 8 aa, Entamoeba invadens
VGESPTAV

SEQ ID NO: 2919549 - protein, 5 aa, Entamoeba invadens
VGESV

SEQ ID NO: 2919550 - protein, 7 aa, Entamoeba invadens
VGETEGK

SEQ ID NO: 2919551 - protein, 12 aa, Entamoeba invadens
VGETERKTQKTF

SEQ ID NO: 2919552 - protein, 13 aa, Entamoeba invadens
VGETVSGKEENEE

SEQ ID NO: 2919553 - protein, 12 aa, Entamoeba invadens
VGEVKGKPVEYK

SEQ ID NO: 2919554 - protein, 12 aa, Entamoeba invadens
VGFEQEKRKIEP

SEQ ID NO: 2919555 - protein, 22 aa, Entamoeba invadens
VGFPKRETAERKREKRGGIKEE

SEQ ID NO: 2919556 - protein, 14 aa, Entamoeba invadens
VGGAADKKADPSIV

SEQ ID NO: 2919557 - protein, 5 aa, Entamoeba invadens
VGGCG

SEQ ID NO: 2919558 - protein, 5 aa, Entamoeba invadens
VGGCS

SEQ ID NO: 2919559 - protein, 8 aa, Entamoeba invadens
VGGDQITN

SEQ ID NO: 2919560 - protein, 10 aa, Entamoeba invadens
VGGDYGEERT

SEQ ID NO: 2919561 - protein, 10 aa, Entamoeba invadens
VGGEEDKVEL

SEQ ID NO: 2919562 - protein, 4 aa, Entamoeba invadens
VGGG

SEQ ID NO: 2919563 - protein, 8 aa, Entamoeba invadens
VGGGGAVR

SEQ ID NO: 2919564 - protein, 7 aa, Entamoeba invadens
VGGGQDK

SEQ ID NO: 2919565 - protein, 8 aa, Entamoeba invadens
VGGGRNGN

SEQ ID NO: 2919566 - protein, 6 aa, Entamoeba invadens
VGGHQG

SEQ ID NO: 2919567 - protein, 10 aa, Entamoeba invadens
VGGKAAATRV

SEQ ID NO: 2919568 - protein, 6 aa, Entamoeba invadens
VGGKGN

SEQ ID NO: 2919569 - protein, 17 aa, Entamoeba invadens
VGGKLQKTTRKGGREEQ

SEQ ID NO: 2919570 - protein, 12 aa, Entamoeba invadens
VGGKSEKEDVKA

SEQ ID NO: 2919571 - protein, 7 aa, Entamoeba invadens
VGGLEQQ

SEQ ID NO: 2919572 - protein, 5 aa, Entamoeba invadens
VGGNG

SEQ ID NO: 2919573 - protein, 11 aa, Entamoeba invadens
VGGNKGEETIN

SEQ ID NO: 2919574 - protein, 8 aa, Entamoeba invadens
VGGRDPQQ

SEQ ID NO: 2919575 - protein, 13 aa, Entamoeba invadens
VGGSFNADPTWKN

SEQ ID NO: 2919576 - protein, 10 aa, Entamoeba invadens
VGGSQSKINV

SEQ ID NO: 2919577 - protein, 17 aa, Entamoeba invadens
VGGSSEAEVGERKDRIE

SEQ ID NO: 2919578 - protein, 5 aa, Entamoeba invadens
VGGTP

SEQ ID NO: 2919579 - protein, 12 aa, Entamoeba invadens
VGGTRDDLDPTE

SEQ ID NO: 2919580 - protein, 16 aa, Entamoeba invadens
VGGTRFQDDTGESEVQ

SEQ ID NO: 2919581 - protein, 13 aa, Entamoeba invadens
VGGTRSRKYQERS

SEQ ID NO: 2919582 - protein, 5 aa, Entamoeba invadens
VGGTY

SEQ ID NO: 2919583 - protein, 6 aa, Entamoeba invadens
VGGVRE

SEQ ID NO: 2919584 - protein, 8 aa, Entamoeba invadens
VGGYGKTV

SEQ ID NO: 2919585 - protein, 9 aa, Entamoeba invadens
VGHDGVEME

SEQ ID NO: 2919586 - protein, 5 aa, Entamoeba invadens
VGIDG

SEQ ID NO: 2919587 - protein, 12 aa, Entamoeba invadens
VGIKGELQEDER

SEQ ID NO: 2919588 - protein, 12 aa, Entamoeba invadens
VGISKEDREAME

SEQ ID NO: 2919589 - protein, 12 aa, Entamoeba invadens
VGISKGKSELNK

SEQ ID NO: 2919590 - protein, 6 aa, Entamoeba invadens
VGITAS

SEQ ID NO: 2919591 - protein, 4 aa, Entamoeba invadens
VGKD

SEQ ID NO: 2919592 - protein, 27 aa, Entamoeba invadens
VGKDHKPNQQDEKDRILKDGGTIDDVN

SEQ ID NO: 2919593 - protein, 6 aa, Entamoeba invadens
VGKEEV

SEQ ID NO: 2919594 - protein, 8 aa, Entamoeba invadens
VGKERIEN

SEQ ID NO: 2919595 - protein, 6 aa, Entamoeba invadens
VGKGGE

SEQ ID NO: 2919596 - protein, 5 aa, Entamoeba invadens
VGKHT

SEQ ID NO: 2919597 - protein, 7 aa, Entamoeba invadens
VGKIDPK

SEQ ID NO: 2919598 - protein, 15 aa, Entamoeba invadens
VGKIENMDPVKRKEA

SEQ ID NO: 2919599 - protein, 9 aa, Entamoeba invadens
VGKKDGKNL

SEQ ID NO: 2919600 - protein, 12 aa, Entamoeba invadens
VGKKEKKTLQLN

SEQ ID NO: 2919601 - protein, 9 aa, Entamoeba invadens
VGKKGDGKR

SEQ ID NO: 2919602 - protein, 10 aa, Entamoeba invadens
VGKKPGEDGC

SEQ ID NO: 2919603 - protein, 13 aa, Entamoeba invadens
VGKKVSKRTIANS

SEQ ID NO: 2919604 - protein, 5 aa, Entamoeba invadens
VGKNE

SEQ ID NO: 2919605 - protein, 6 aa, Entamoeba invadens
VGKNGR

SEQ ID NO: 2919606 - protein, 7 aa, Entamoeba invadens
VGKPEKI

SEQ ID NO: 2919607 - protein, 9 aa, Entamoeba invadens
VGKPENRVP

SEQ ID NO: 2919608 - protein, 6 aa, Entamoeba invadens
VGKPID

SEQ ID NO: 2919609 - protein, 12 aa, Entamoeba invadens
VGKQKKNSQYSR

SEQ ID NO: 2919610 - protein, 9 aa, Entamoeba invadens
VGKQTDEGF

SEQ ID NO: 2919611 - protein, 7 aa, Entamoeba invadens
VGKRDSK

SEQ ID NO: 2919612 - protein, 6 aa, Entamoeba invadens
VGKREE

SEQ ID NO: 2919613 - protein, 8 aa, Entamoeba invadens
VGKSEEST

SEQ ID NO: 2919614 - protein, 9 aa, Entamoeba invadens
VGKSGTVKA

SEQ ID NO: 2919615 - protein, 7 aa, Entamoeba invadens
VGKSKFK

SEQ ID NO: 2919616 - protein, 7 aa, Entamoeba invadens
VGKSNDS

SEQ ID NO: 2919617 - protein, 8 aa, Entamoeba invadens
VGKSSTIN

SEQ ID NO: 2919618 - protein, 8 aa, Entamoeba invadens
VGKSTSLS

SEQ ID NO: 2919619 - protein, 7 aa, Entamoeba invadens
VGKTEEM

SEQ ID NO: 2919620 - protein, 11 aa, Entamoeba invadens
VGKTPSPIQSR

SEQ ID NO: 2919621 - protein, 5 aa, Entamoeba invadens
VGKTS

SEQ ID NO: 2919622 - protein, 6 aa, Entamoeba invadens
VGKTSI

SEQ ID NO: 2919623 - protein, 10 aa, Entamoeba invadens
VGKYTQPFKT

SEQ ID NO: 2919624 - protein, 6 aa, Entamoeba invadens
VGLNDP

SEQ ID NO: 2919625 - protein, 7 aa, Entamoeba invadens
VGLPQQN

SEQ ID NO: 2919626 - protein, 12 aa, Entamoeba invadens
VGLSSMSSSLGT

SEQ ID NO: 2919627 - protein, 12 aa, Entamoeba invadens
VGMKGNQFADGQ

SEQ ID NO: 2919628 - protein, 5 aa, Entamoeba invadens
VGMNE

SEQ ID NO: 2919629 - protein, 66 aa, Entamoeba invadens
VGNANPTMKQKANTLNEDYKRAAKEDEEAAERGVYTTPSIPKNTSEQAYEKKTKGTKKLGKGKEKY

SEQ ID NO: 2919630 - protein, 11 aa, Entamoeba invadens
VGNDANEKKNL

SEQ ID NO: 2919631 - protein, 8 aa, Entamoeba invadens
VGNDEERT

SEQ ID NO: 2919632 - protein, 5 aa, Entamoeba invadens
VGNDN

SEQ ID NO: 2919633 - protein, 5 aa, Entamoeba invadens
VGNED

SEQ ID NO: 2919634 - protein, 7 aa, Entamoeba invadens
VGNEPKC

SEQ ID NO: 2919635 - protein, 4 aa, Entamoeba invadens
VGNG

SEQ ID NO: 2919636 - protein, 21 aa, Entamoeba invadens
VGNGPTAGNYKPVNDTYEGKN

SEQ ID NO: 2919637 - protein, 28 aa, Entamoeba invadens
VGNGQPLASKQPPKRRKKRTVLFPSLAE

SEQ ID NO: 2919638 - protein, 6 aa, Entamoeba invadens
VGNGSF

SEQ ID NO: 2919639 - protein, 5 aa, Entamoeba invadens
VGNIE

SEQ ID NO: 2919640 - protein, 4 aa, Entamoeba invadens
VGNK

SEQ ID NO: 2919641 - protein, 9 aa, Entamoeba invadens
VGNKPSIPL

SEQ ID NO: 2919642 - protein, 8 aa, Entamoeba invadens
VGNNPNDF

SEQ ID NO: 2919643 - protein, 5 aa, Entamoeba invadens
VGNPH

SEQ ID NO: 2919644 - protein, 17 aa, Entamoeba invadens
VGNPSSHDTNINSKNTI

SEQ ID NO: 2919645 - protein, 11 aa, Entamoeba invadens
VGNQERQDTRK

SEQ ID NO: 2919646 - protein, 7 aa, Entamoeba invadens
VGNQETM

SEQ ID NO: 2919647 - protein, 9 aa, Entamoeba invadens
VGNSGNGSE

SEQ ID NO: 2919648 - protein, 10 aa, Entamoeba invadens
VGNSGNGSEL

SEQ ID NO: 2919649 - protein, 5 aa, Entamoeba invadens
VGNSM

SEQ ID NO: 2919650 - protein, 5 aa, Entamoeba invadens
VGNSN

SEQ ID NO: 2919651 - protein, 11 aa, Entamoeba invadens
VGPAFRTSDED

SEQ ID NO: 2919652 - protein, 7 aa, Entamoeba invadens
VGPEDKD

SEQ ID NO: 2919653 - protein, 7 aa, Entamoeba invadens
VGPGAVE

SEQ ID NO: 2919654 - protein, 7 aa, Entamoeba invadens
VGPGKEA

SEQ ID NO: 2919655 - protein, 9 aa, Entamoeba invadens
VGPKAESDQ

SEQ ID NO: 2919656 - protein, 12 aa, Entamoeba invadens
VGPLGYDDEDGL

SEQ ID NO: 2919657 - protein, 10 aa, Entamoeba invadens
VGPNGATQKA

SEQ ID NO: 2919658 - protein, 10 aa, Entamoeba invadens
VGPNGTGKST

SEQ ID NO: 2919659 - protein, 12 aa, Entamoeba invadens
VGPNGVGKEEWK

SEQ ID NO: 2919660 - protein, 14 aa, Entamoeba invadens
VGPNNKKYSSDVVP

SEQ ID NO: 2919661 - protein, 7 aa, Entamoeba invadens
VGPPAKY

SEQ ID NO: 2919662 - protein, 4 aa, Entamoeba invadens
VGPT

SEQ ID NO: 2919663 - protein, 8 aa, Entamoeba invadens
VGPYEKPT

SEQ ID NO: 2919664 - protein, 8 aa, Entamoeba invadens
VGQDGQRV

SEQ ID NO: 2919665 - protein, 18 aa, Entamoeba invadens
VGQGEKQKESSSERKDRT

SEQ ID NO: 2919666 - protein, 4 aa, Entamoeba invadens
VGQK

SEQ ID NO: 2919667 - protein, 7 aa, Entamoeba invadens
VGQKRGQ

SEQ ID NO: 2919668 - protein, 9 aa, Entamoeba invadens
VGQKTKEEY

SEQ ID NO: 2919669 - protein, 8 aa, Entamoeba invadens
VGQPGGKV

SEQ ID NO: 2919670 - protein, 12 aa, Entamoeba invadens
VGQTETPDADTS

SEQ ID NO: 2919671 - protein, 12 aa, Entamoeba invadens
VGQTIGNLIDSY

SEQ ID NO: 2919672 - protein, 10 aa, Entamoeba invadens
VGRDANESAV

SEQ ID NO: 2919673 - protein, 7 aa, Entamoeba invadens
VGRDGFG

SEQ ID NO: 2919674 - protein, 5 aa, Entamoeba invadens
VGRDK

SEQ ID NO: 2919675 - protein, 10 aa, Entamoeba invadens
VGRGKNKMKQ

SEQ ID NO: 2919676 - protein, 29 aa, Entamoeba invadens
VGRGSKKLLTSTGSGVLNSASKIGNTLAT

SEQ ID NO: 2919677 - protein, 6 aa, Entamoeba invadens
VGRKEK

SEQ ID NO: 2919678 - protein, 10 aa, Entamoeba invadens
VGRKGVADKV

SEQ ID NO: 2919679 - protein, 18 aa, Entamoeba invadens
VGRPSSQSYQVDNEELKE

SEQ ID NO: 2919680 - protein, 27 aa, Entamoeba invadens
VGRREEDQEPEKPQPIEINKKQANGGC

SEQ ID NO: 2919681 - protein, 11 aa, Entamoeba invadens
VGRSANDVKNR

SEQ ID NO: 2919682 - protein, 5 aa, Entamoeba invadens
VGRTN

SEQ ID NO: 2919683 - protein, 11 aa, Entamoeba invadens
VGRTSSPSSLT

SEQ ID NO: 2919684 - protein, 5 aa, Entamoeba invadens
VGRVT

SEQ ID NO: 2919685 - protein, 8 aa, Entamoeba invadens
VGSATSIE

SEQ ID NO: 2919686 - protein, 5 aa, Entamoeba invadens
VGSDE

SEQ ID NO: 2919687 - protein, 8 aa, Entamoeba invadens
VGSDGQVN

SEQ ID NO: 2919688 - protein, 4 aa, Entamoeba invadens
VGSE

SEQ ID NO: 2919689 - protein, 6 aa, Entamoeba invadens
VGSEGT

SEQ ID NO: 2919690 - protein, 13 aa, Entamoeba invadens
VGSEPEPTTFRPK

SEQ ID NO: 2919691 - protein, 5 aa, Entamoeba invadens
VGSET

SEQ ID NO: 2919692 - protein, 8 aa, Entamoeba invadens
VGSETDPT

SEQ ID NO: 2919693 - protein, 28 aa, Entamoeba invadens
VGSETTSEESQSVNQQQRQCVGDEQLTE

SEQ ID NO: 2919694 - protein, 5 aa, Entamoeba invadens
VGSGG

SEQ ID NO: 2919695 - protein, 8 aa, Entamoeba invadens
VGSGKKSL

SEQ ID NO: 2919696 - protein, 9 aa, Entamoeba invadens
VGSHTKNFE

SEQ ID NO: 2919697 - protein, 4 aa, Entamoeba invadens
VGSK

SEQ ID NO: 2919698 - protein, 15 aa, Entamoeba invadens
VGSKKGKLYVFKGVS

SEQ ID NO: 2919699 - protein, 11 aa, Entamoeba invadens
VGSKYRNVDGK

SEQ ID NO: 2919700 - protein, 4 aa, Entamoeba invadens
VGSN

SEQ ID NO: 2919701 - protein, 20 aa, Entamoeba invadens
VGSNSNSSTPTSESSITTQS

SEQ ID NO: 2919702 - protein, 26 aa, Entamoeba invadens
VGSPEMKEKSETFKEVETSEQEVKSK

SEQ ID NO: 2919703 - protein, 9 aa, Entamoeba invadens
VGSPERRGS

SEQ ID NO: 2919704 - protein, 15 aa, Entamoeba invadens
VGSQRSGLETKDEGI

SEQ ID NO: 2919705 - protein, 4 aa, Entamoeba invadens
VGSR

SEQ ID NO: 2919706 - protein, 5 aa, Entamoeba invadens
VGSRR

SEQ ID NO: 2919707 - protein, 8 aa, Entamoeba invadens
VGSSEGEL

SEQ ID NO: 2919708 - protein, 6 aa, Entamoeba invadens
VGSSIG

SEQ ID NO: 2919709 - protein, 9 aa, Entamoeba invadens
VGSSQNPAW

SEQ ID NO: 2919710 - protein, 8 aa, Entamoeba invadens
VGSSTDKS

SEQ ID NO: 2919711 - protein, 14 aa, Entamoeba invadens
VGSSYSDTKTASNI

SEQ ID NO: 2919712 - protein, 10 aa, Entamoeba invadens
VGSTDAEKMR

SEQ ID NO: 2919713 - protein, 8 aa, Entamoeba invadens
VGSTEDIS

SEQ ID NO: 2919714 - protein, 9 aa, Entamoeba invadens
VGSTEKCEE

SEQ ID NO: 2919715 - protein, 5 aa, Entamoeba invadens
VGSYT

SEQ ID NO: 2919716 - protein, 7 aa, Entamoeba invadens
VGTDPDN

SEQ ID NO: 2919717 - protein, 7 aa, Entamoeba invadens
VGTDSEH

SEQ ID NO: 2919718 - protein, 7 aa, Entamoeba invadens
VGTDTTP

SEQ ID NO: 2919719 - protein, 6 aa, Entamoeba invadens
VGTGFS

SEQ ID NO: 2919720 - protein, 6 aa, Entamoeba invadens
VGTGNG

SEQ ID NO: 2919721 - protein, 17 aa, Entamoeba invadens
VGTKRYDAQSGGEKEIQ

SEQ ID NO: 2919722 - protein, 17 aa, Entamoeba invadens
VGTKVNTDLDLDDTSKA

SEQ ID NO: 2919723 - protein, 5 aa, Entamoeba invadens
VGTLQ

SEQ ID NO: 2919724 - protein, 5 aa, Entamoeba invadens
VGTMT

SEQ ID NO: 2919725 - protein, 8 aa, Entamoeba invadens
VGTNGNSK

SEQ ID NO: 2919726 - protein, 4 aa, Entamoeba invadens
VGTP

SEQ ID NO: 2919727 - protein, 5 aa, Entamoeba invadens
VGTPD

SEQ ID NO: 2919728 - protein, 6 aa, Entamoeba invadens
VGTPKY

SEQ ID NO: 2919729 - protein, 8 aa, Entamoeba invadens
VGTPSGQC

SEQ ID NO: 2919730 - protein, 7 aa, Entamoeba invadens
VGTPTIE

SEQ ID NO: 2919731 - protein, 6 aa, Entamoeba invadens
VGTPTY

SEQ ID NO: 2919732 - protein, 5 aa, Entamoeba invadens
VGTQE

SEQ ID NO: 2919733 - protein, 11 aa, Entamoeba invadens
VGTRSRKQCRE

SEQ ID NO: 2919734 - protein, 6 aa, Entamoeba invadens
VGTSNF

SEQ ID NO: 2919735 - protein, 6 aa, Entamoeba invadens
VGTSSK

SEQ ID NO: 2919736 - protein, 4 aa, Entamoeba invadens
VGTT

SEQ ID NO: 2919737 - protein, 14 aa, Entamoeba invadens
VGTTQKGFDEFKNT

SEQ ID NO: 2919738 - protein, 19 aa, Entamoeba invadens
VGTTRSNHRAKTDEQRVKK

SEQ ID NO: 2919739 - protein, 5 aa, Entamoeba invadens
VGTVA

SEQ ID NO: 2919740 - protein, 7 aa, Entamoeba invadens
VGVAKTG

SEQ ID NO: 2919741 - protein, 12 aa, Entamoeba invadens
VGVETASEDETE

SEQ ID NO: 2919742 - protein, 5 aa, Entamoeba invadens
VGVGK

SEQ ID NO: 2919743 - protein, 6 aa, Entamoeba invadens
VGVGKT

SEQ ID NO: 2919744 - protein, 13 aa, Entamoeba invadens
VGVGNNSQPIPIT

SEQ ID NO: 2919745 - protein, 8 aa, Entamoeba invadens
VGVGSTSL

SEQ ID NO: 2919746 - protein, 7 aa, Entamoeba invadens
VGVQTDA

SEQ ID NO: 2919747 - protein, 11 aa, Entamoeba invadens
VGVSDGKESYD

SEQ ID NO: 2919748 - protein, 6 aa, Entamoeba invadens
VGVTDE

SEQ ID NO: 2919749 - protein, 9 aa, Entamoeba invadens
VGYASDTYS

SEQ ID NO: 2919750 - protein, 15 aa, Entamoeba invadens
VGYEEAQKVGGEVQR

SEQ ID NO: 2919751 - protein, 7 aa, Entamoeba invadens
VGYEENK

SEQ ID NO: 2919752 - protein, 20 aa, Entamoeba invadens
VGYIDETGKHIEPKKENAIK

SEQ ID NO: 2919753 - protein, 7 aa, Entamoeba invadens
VGYKDSK

SEQ ID NO: 2919754 - protein, 4 aa, Entamoeba invadens
VGYP

SEQ ID NO: 2919755 - protein, 14 aa, Entamoeba invadens
VGYSEEEENVKEDE

SEQ ID NO: 2919756 - protein, 13 aa, Entamoeba invadens
VGYSIPSNVPENV

SEQ ID NO: 2919757 - protein, 14 aa, Entamoeba invadens
VGYTGGTTVNPTYD

SEQ ID NO: 2919758 - protein, 20 aa, Entamoeba invadens
VHDEKIKKEVPTAESATIDA

SEQ ID NO: 2919759 - protein, 14 aa, Entamoeba invadens
VHDGGSASLLENSE

SEQ ID NO: 2919760 - protein, 8 aa, Entamoeba invadens
VHDSKTSI

SEQ ID NO: 2919761 - protein, 19 aa, Entamoeba invadens
VHEETHPIDNNSEKNKEVI

SEQ ID NO: 2919762 - protein, 10 aa, Entamoeba invadens
VHENRKREEE

SEQ ID NO: 2919763 - protein, 7 aa, Entamoeba invadens
VHETGDV

SEQ ID NO: 2919764 - protein, 11 aa, Entamoeba invadens
VHGKKTTVKGE

SEQ ID NO: 2919765 - protein, 12 aa, Entamoeba invadens
VHGRATGPYATL

SEQ ID NO: 2919766 - protein, 4 aa, Entamoeba invadens
VHGS

SEQ ID NO: 2919767 - protein, 17 aa, Entamoeba invadens
VHGSSEIGAIPSTFTSS

SEQ ID NO: 2919768 - protein, 6 aa, Entamoeba invadens
VHNDKT

SEQ ID NO: 2919769 - protein, 31 aa, Entamoeba invadens
VHNPYDDKNSISSEKTENTEKSEKNEKKGWN

SEQ ID NO: 2919770 - protein, 7 aa, Entamoeba invadens
VHNSPTN

SEQ ID NO: 2919771 - protein, 17 aa, Entamoeba invadens
VHNTSEIQTLSSKNEEL

SEQ ID NO: 2919772 - protein, 6 aa, Entamoeba invadens
VHPKYK

SEQ ID NO: 2919773 - protein, 18 aa, Entamoeba invadens
VHPNTDSKHNLKNFLFWY

SEQ ID NO: 2919774 - protein, 7 aa, Entamoeba invadens
VHPSCSS

SEQ ID NO: 2919775 - protein, 9 aa, Entamoeba invadens
VHPTRTNEL

SEQ ID NO: 2919776 - protein, 12 aa, Entamoeba invadens
VHRGGRTARMGT

SEQ ID NO: 2919777 - protein, 17 aa, Entamoeba invadens
VHSASCPSSPLPQNNIP

SEQ ID NO: 2919778 - protein, 13 aa, Entamoeba invadens
VHSEDGTKELTQS

SEQ ID NO: 2919779 - protein, 9 aa, Entamoeba invadens
VHSPGEGEH

SEQ ID NO: 2919780 - protein, 5 aa, Entamoeba invadens
VHSPV

SEQ ID NO: 2919781 - protein, 19 aa, Entamoeba invadens
VHSRRDQFDGADKDEGDSR

SEQ ID NO: 2919782 - protein, 7 aa, Entamoeba invadens
VHSTSTQ

SEQ ID NO: 2919783 - protein, 14 aa, Entamoeba invadens
VHSTVTPFTETDRL

SEQ ID NO: 2919784 - protein, 7 aa, Entamoeba invadens
VHTKEMG

SEQ ID NO: 2919785 - protein, 7 aa, Entamoeba invadens
VHTPQET

SEQ ID NO: 2919786 - protein, 10 aa, Entamoeba invadens
VIDDGRDSCH

SEQ ID NO: 2919787 - protein, 14 aa, Entamoeba invadens
VIDESQRAPPKTKS

SEQ ID NO: 2919788 - protein, 13 aa, Entamoeba invadens
VIDESQTVQTQTP

SEQ ID NO: 2919789 - protein, 8 aa, Entamoeba invadens
VIDPNTTS

SEQ ID NO: 2919790 - protein, 10 aa, Entamoeba invadens
VIDQPPEHQT

SEQ ID NO: 2919791 - protein, 14 aa, Entamoeba invadens
VIEEGGKKEQMRRV

SEQ ID NO: 2919792 - protein, 6 aa, Entamoeba invadens
VIESKN

SEQ ID NO: 2919793 - protein, 10 aa, Entamoeba invadens
VIGGEGNGGV

SEQ ID NO: 2919794 - protein, 5 aa, Entamoeba invadens
VIGGP

SEQ ID NO: 2919795 - protein, 7 aa, Entamoeba invadens
VIGKEGK

SEQ ID NO: 2919796 - protein, 5 aa, Entamoeba invadens
VIGRG

SEQ ID NO: 2919797 - protein, 18 aa, Entamoeba invadens
VIGTAPHEDDVCDTKIEK

SEQ ID NO: 2919798 - protein, 67 aa, Entamoeba invadens
VIKEDTSDDAPLEISSRKEDNILPEETSPKKDENDIKTTPPPITTQSVPTAQQKVTESTLEKRERKI

SEQ ID NO: 2919799 - protein, 61 aa, Entamoeba invadens
VIKEEKVKQAEEEEDPFENIGEEEENLKEVEKEKIEAPQDEKEEVKEDEEKEYVESEEDGL

SEQ ID NO: 2919800 - protein, 36 aa, Entamoeba invadens
VIPAQRSQHITADPSMNSITDNENVPFDSKRTNPRS

SEQ ID NO: 2919801 - protein, 11 aa, Entamoeba invadens
VIPAQRSQQIT

SEQ ID NO: 2919802 - protein, 33 aa, Entamoeba invadens
VIPAQRSQQITADRSMNSITDNENVLSTQRGQT

SEQ ID NO: 2919803 - protein, 4 aa, Entamoeba invadens
VIPD

SEQ ID NO: 2919804 - protein, 82 aa, Entamoeba invadens
VIPETPKSPTKKITTKSPTENNEKETKTSNEMPFENTENDAQKEKSKEKQKERDDKIEAKKEIRRPQKRIARKDVKKNERRM

SEQ ID NO: 2919805 - protein, 4 aa, Entamoeba invadens
VIPI

SEQ ID NO: 2919806 - protein, 10 aa, Entamoeba invadens
VIPKNQGGKA

SEQ ID NO: 2919807 - protein, 7 aa, Entamoeba invadens
VIPKTKY

SEQ ID NO: 2919808 - protein, 11 aa, Entamoeba invadens
VIPLGKDGRDI

SEQ ID NO: 2919809 - protein, 4 aa, Entamoeba invadens
VIPN

SEQ ID NO: 2919810 - protein, 11 aa, Entamoeba invadens
VIPNEGYEGTY

SEQ ID NO: 2919811 - protein, 10 aa, Entamoeba invadens
VIPNSEKTGY

SEQ ID NO: 2919812 - protein, 12 aa, Entamoeba invadens
VIPNSSGEKWNT

SEQ ID NO: 2919813 - protein, 7 aa, Entamoeba invadens
VIPPEEY

SEQ ID NO: 2919814 - protein, 12 aa, Entamoeba invadens
VIPPRTLKPTRS

SEQ ID NO: 2919815 - protein, 7 aa, Entamoeba invadens
VIPPSGD

SEQ ID NO: 2919816 - protein, 35 aa, Entamoeba invadens
VIPPSQPVSQVQAPPPLTQPYVPEQTLEAQPPIPQ

SEQ ID NO: 2919817 - protein, 5 aa, Entamoeba invadens
VIPQN

SEQ ID NO: 2919818 - protein, 5 aa, Entamoeba invadens
VIPQT

SEQ ID NO: 2919819 - protein, 15 aa, Entamoeba invadens
VIPSDSDTSMEKTEI

SEQ ID NO: 2919820 - protein, 12 aa, Entamoeba invadens
VIPSNKGGKSFD

SEQ ID NO: 2919821 - protein, 23 aa, Entamoeba invadens
VIQNSKNPCPPKAISAFKKINCF

SEQ ID NO: 2919822 - protein, 5 aa, Entamoeba invadens
VIQPN

SEQ ID NO: 2919823 - protein, 17 aa, Entamoeba invadens
VIRNPNDSSFQDDESGV

SEQ ID NO: 2919824 - protein, 12 aa, Entamoeba invadens
VISDEGNYISGD

SEQ ID NO: 2919825 - protein, 12 aa, Entamoeba invadens
VISEKDAETTIS

SEQ ID NO: 2919826 - protein, 8 aa, Entamoeba invadens
VISRSGDE

SEQ ID NO: 2919827 - protein, 7 aa, Entamoeba invadens
VISTTDG

SEQ ID NO: 2919828 - protein, 11 aa, Entamoeba invadens
VITENNELQDE

SEQ ID NO: 2919829 - protein, 6 aa, Entamoeba invadens
VITSTS

SEQ ID NO: 2919830 - protein, 40 aa, Entamoeba invadens
VKAAEAEAKRITEEKERQEKEAAEQKRIEEERLNNERKQL

SEQ ID NO: 2919831 - protein, 8 aa, Entamoeba invadens
VKADTEKL

SEQ ID NO: 2919832 - protein, 7 aa, Entamoeba invadens
VKAEADR

SEQ ID NO: 2919833 - protein, 8 aa, Entamoeba invadens
VKAENEAL

SEQ ID NO: 2919834 - protein, 12 aa, Entamoeba invadens
VKAGGEVSKEAT

SEQ ID NO: 2919835 - protein, 10 aa, Entamoeba invadens
VKAKAKNLNY

SEQ ID NO: 2919836 - protein, 12 aa, Entamoeba invadens
VKAKGKKPEAVE

SEQ ID NO: 2919837 - protein, 14 aa, Entamoeba invadens
VKAKQSAKEEQKVE

SEQ ID NO: 2919838 - protein, 41 aa, Entamoeba invadens
VKANDKKVEEGNTETEKKEEPPVEEKKDENQEEKSKAQVEV

SEQ ID NO: 2919839 - protein, 10 aa, Entamoeba invadens
VKAQIENNKA

SEQ ID NO: 2919840 - protein, 12 aa, Entamoeba invadens
VKAQTKIKANEM

SEQ ID NO: 2919841 - protein, 4 aa, Entamoeba invadens
VKAS

SEQ ID NO: 2919842 - protein, 9 aa, Entamoeba invadens
VKASDEEQF

SEQ ID NO: 2919843 - protein, 7 aa, Entamoeba invadens
VKASKLL

SEQ ID NO: 2919844 - protein, 7 aa, Entamoeba invadens
VKASNNN

SEQ ID NO: 2919845 - protein, 19 aa, Entamoeba invadens
VKASPDPTYSFDPKGSNLT

SEQ ID NO: 2919846 - protein, 16 aa, Entamoeba invadens
VKASSTGPSGSKKEQV

SEQ ID NO: 2919847 - protein, 7 aa, Entamoeba invadens
VKATKST

SEQ ID NO: 2919848 - protein, 8 aa, Entamoeba invadens
VKCEESGE

SEQ ID NO: 2919849 - protein, 9 aa, Entamoeba invadens
VKCSDTGYT

SEQ ID NO: 2919850 - protein, 8 aa, Entamoeba invadens
VKCTSSGG

SEQ ID NO: 2919851 - protein, 6 aa, Entamoeba invadens
VKDAGA

SEQ ID NO: 2919852 - protein, 8 aa, Entamoeba invadens
VKDASELL

SEQ ID NO: 2919853 - protein, 5 aa, Entamoeba invadens
VKDDE

SEQ ID NO: 2919854 - protein, 5 aa, Entamoeba invadens
VKDDL

SEQ ID NO: 2919855 - protein, 6 aa, Entamoeba invadens
VKDDSS

SEQ ID NO: 2919856 - protein, 4 aa, Entamoeba invadens
VKDE

SEQ ID NO: 2919857 - protein, 13 aa, Entamoeba invadens
VKDEDDVENISTE

SEQ ID NO: 2919858 - protein, 16 aa, Entamoeba invadens
VKDEDEDIDISKEQSM

SEQ ID NO: 2919859 - protein, 19 aa, Entamoeba invadens
VKDEDGKTNAECQQNKSSY

SEQ ID NO: 2919860 - protein, 8 aa, Entamoeba invadens
VKDEEDNY

SEQ ID NO: 2919861 - protein, 15 aa, Entamoeba invadens
VKDEEIKKEDEDGKM

SEQ ID NO: 2919862 - protein, 8 aa, Entamoeba invadens
VKDEFRKD

SEQ ID NO: 2919863 - protein, 9 aa, Entamoeba invadens
VKDEKTANR

SEQ ID NO: 2919864 - protein, 11 aa, Entamoeba invadens
VKDELSEEDKE

SEQ ID NO: 2919865 - protein, 8 aa, Entamoeba invadens
VKDENEDY

SEQ ID NO: 2919866 - protein, 9 aa, Entamoeba invadens
VKDEPNTIE

SEQ ID NO: 2919867 - protein, 7 aa, Entamoeba invadens
VKDIGEE

SEQ ID NO: 2919868 - protein, 7 aa, Entamoeba invadens
VKDKDGN

SEQ ID NO: 2919869 - protein, 6 aa, Entamoeba invadens
VKDKNE

SEQ ID NO: 2919870 - protein, 10 aa, Entamoeba invadens
VKDNEDGTYD

SEQ ID NO: 2919871 - protein, 10 aa, Entamoeba invadens
VKDNGDGTYG

SEQ ID NO: 2919872 - protein, 10 aa, Entamoeba invadens
VKDNGDGTYS

SEQ ID NO: 2919873 - protein, 10 aa, Entamoeba invadens
VKDNGNGTYD

SEQ ID NO: 2919874 - protein, 7 aa, Entamoeba invadens
VKDNKEF

SEQ ID NO: 2919875 - protein, 9 aa, Entamoeba invadens
VKDNTNTTN

SEQ ID NO: 2919876 - protein, 7 aa, Entamoeba invadens
VKDPEFD

SEQ ID NO: 2919877 - protein, 7 aa, Entamoeba invadens
VKDPEHH

SEQ ID NO: 2919878 - protein, 14 aa, Entamoeba invadens
VKDPNKNTKAKGQK

SEQ ID NO: 2919879 - protein, 22 aa, Entamoeba invadens
VKDPQHQKVEEKQQISSQLSPE

SEQ ID NO: 2919880 - protein, 8 aa, Entamoeba invadens
VKDPQSVT

SEQ ID NO: 2919881 - protein, 11 aa, Entamoeba invadens
VKDPRTKEEKT

SEQ ID NO: 2919882 - protein, 6 aa, Entamoeba invadens
VKDPSL

SEQ ID NO: 2919883 - protein, 8 aa, Entamoeba invadens
VKDREEHE

SEQ ID NO: 2919884 - protein, 13 aa, Entamoeba invadens
VKDSDDDDDDVNV

SEQ ID NO: 2919885 - protein, 9 aa, Entamoeba invadens
VKDSDVDAD

SEQ ID NO: 2919886 - protein, 17 aa, Entamoeba invadens
VKDSKDKNSPQDKDFTQ

SEQ ID NO: 2919887 - protein, 7 aa, Entamoeba invadens
VKDSNGK

SEQ ID NO: 2919888 - protein, 8 aa, Entamoeba invadens
VKDSTNEV

SEQ ID NO: 2919889 - protein, 9 aa, Entamoeba invadens
VKDSVDGVY

SEQ ID NO: 2919890 - protein, 8 aa, Entamoeba invadens
VKDTNAKL

SEQ ID NO: 2919891 - protein, 23 aa, Entamoeba invadens
VKDVEDSDNGKNGFQIKTPQKSA

SEQ ID NO: 2919892 - protein, 7 aa, Entamoeba invadens
VKDVSRG

SEQ ID NO: 2919893 - protein, 13 aa, Entamoeba invadens
VKEANNSLQKKLN

SEQ ID NO: 2919894 - protein, 7 aa, Entamoeba invadens
VKEDKVK

SEQ ID NO: 2919895 - protein, 6 aa, Entamoeba invadens
VKEDNV

SEQ ID NO: 2919896 - protein, 6 aa, Entamoeba invadens
VKEDTV

SEQ ID NO: 2919897 - protein, 5 aa, Entamoeba invadens
VKEEF

SEQ ID NO: 2919898 - protein, 10 aa, Entamoeba invadens
VKEEKETHVS

SEQ ID NO: 2919899 - protein, 10 aa, Entamoeba invadens
VKEEKGKSVD

SEQ ID NO: 2919900 - protein, 12 aa, Entamoeba invadens
VKEEKKEDKDLT

SEQ ID NO: 2919901 - protein, 12 aa, Entamoeba invadens
VKEENKEAHVET

SEQ ID NO: 2919902 - protein, 10 aa, Entamoeba invadens
VKEEQKTKNP

SEQ ID NO: 2919903 - protein, 6 aa, Entamoeba invadens
VKEESI

SEQ ID NO: 2919904 - protein, 7 aa, Entamoeba invadens
VKEESPF

SEQ ID NO: 2919905 - protein, 5 aa, Entamoeba invadens
VKEET

SEQ ID NO: 2919906 - protein, 7 aa, Entamoeba invadens
VKEETNP

SEQ ID NO: 2919907 - protein, 22 aa, Entamoeba invadens
VKEETQEPKELKELKETKQEKL

SEQ ID NO: 2919908 - protein, 4 aa, Entamoeba invadens
VKEG

SEQ ID NO: 2919909 - protein, 9 aa, Entamoeba invadens
VKEGGEPQV

SEQ ID NO: 2919910 - protein, 5 aa, Entamoeba invadens
VKEGK

SEQ ID NO: 2919911 - protein, 21 aa, Entamoeba invadens
VKEHPEDKKAKKNAEKKLDEL

SEQ ID NO: 2919912 - protein, 10 aa, Entamoeba invadens
VKEHQKEKSL

SEQ ID NO: 2919913 - protein, 10 aa, Entamoeba invadens
VKEKEDTVNG

SEQ ID NO: 2919914 - protein, 8 aa, Entamoeba invadens
VKEKENGM

SEQ ID NO: 2919915 - protein, 16 aa, Entamoeba invadens
VKEKEVGKEGIPPPLN

SEQ ID NO: 2919916 - protein, 14 aa, Entamoeba invadens
VKEKHKKTKSGCVV

SEQ ID NO: 2919917 - protein, 12 aa, Entamoeba invadens
VKEKKSPPQEIS

SEQ ID NO: 2919918 - protein, 10 aa, Entamoeba invadens
VKEKPDNREL

SEQ ID NO: 2919919 - protein, 32 aa, Entamoeba invadens
VKEKPRKQLTRKPLHKTKKAKIAEEKADIPEG

SEQ ID NO: 2919920 - protein, 12 aa, Entamoeba invadens
VKEKQPTRLGSF

SEQ ID NO: 2919921 - protein, 22 aa, Entamoeba invadens
VKEKRTCASPNSGFLEQLSQYK

SEQ ID NO: 2919922 - protein, 15 aa, Entamoeba invadens
VKEKSIRPTKENKHN

SEQ ID NO: 2919923 - protein, 50 aa, Entamoeba invadens
VKEKSSPKEPAKTAPGSKRESLNKEEQHVEDSNTTQSVKESKNVTRPQSV

SEQ ID NO: 2919924 - protein, 14 aa, Entamoeba invadens
VKEKTELCKQLGIS

SEQ ID NO: 2919925 - protein, 7 aa, Entamoeba invadens
VKEKTSD

SEQ ID NO: 2919926 - protein, 8 aa, Entamoeba invadens
VKEKVTKE

SEQ ID NO: 2919927 - protein, 9 aa, Entamoeba invadens
VKEKYKDSS

SEQ ID NO: 2919928 - protein, 17 aa, Entamoeba invadens
VKELESNTTKVKTMEEQ

SEQ ID NO: 2919929 - protein, 7 aa, Entamoeba invadens
VKELKGK

SEQ ID NO: 2919930 - protein, 8 aa, Entamoeba invadens
VKENADEG

SEQ ID NO: 2919931 - protein, 10 aa, Entamoeba invadens
VKENDTQRTE

SEQ ID NO: 2919932 - protein, 7 aa, Entamoeba invadens
VKENEAK

SEQ ID NO: 2919933 - protein, 8 aa, Entamoeba invadens
VKENFGPY

SEQ ID NO: 2919934 - protein, 7 aa, Entamoeba invadens
VKENPGK

SEQ ID NO: 2919935 - protein, 4 aa, Entamoeba invadens
VKEP

SEQ ID NO: 2919936 - protein, 7 aa, Entamoeba invadens
VKEPGKY

SEQ ID NO: 2919937 - protein, 6 aa, Entamoeba invadens
VKEPLD

SEQ ID NO: 2919938 - protein, 10 aa, Entamoeba invadens
VKEPRTQNRQ

SEQ ID NO: 2919939 - protein, 27 aa, Entamoeba invadens
VKEPSSVESAPIKQEEQLNKEMEERPI

SEQ ID NO: 2919940 - protein, 7 aa, Entamoeba invadens
VKEPSTI

SEQ ID NO: 2919941 - protein, 8 aa, Entamoeba invadens
VKEQKEKL

SEQ ID NO: 2919942 - protein, 8 aa, Entamoeba invadens
VKEQKQQL

SEQ ID NO: 2919943 - protein, 9 aa, Entamoeba invadens
VKERAQKNR

SEQ ID NO: 2919944 - protein, 11 aa, Entamoeba invadens
VKEREQKDQTA

SEQ ID NO: 2919945 - protein, 6 aa, Entamoeba invadens
VKERGT

SEQ ID NO: 2919946 - protein, 14 aa, Entamoeba invadens
VKERKQVDHTKAEK

SEQ ID NO: 2919947 - protein, 8 aa, Entamoeba invadens
VKERTRQC

SEQ ID NO: 2919948 - protein, 34 aa, Entamoeba invadens
VKESDKKKKKEKKESSSSSSSDSSEEEKEGEVDE

SEQ ID NO: 2919949 - protein, 6 aa, Entamoeba invadens
VKESGV

SEQ ID NO: 2919950 - protein, 7 aa, Entamoeba invadens
VKESKCE

SEQ ID NO: 2919951 - protein, 13 aa, Entamoeba invadens
VKESKHEDKGSPI

SEQ ID NO: 2919952 - protein, 8 aa, Entamoeba invadens
VKESLSAN

SEQ ID NO: 2919953 - protein, 7 aa, Entamoeba invadens
VKESQLP

SEQ ID NO: 2919954 - protein, 25 aa, Entamoeba invadens
VKESTQPAYKTPFSHSESNMESPSI

SEQ ID NO: 2919955 - protein, 7 aa, Entamoeba invadens
VKETGGL

SEQ ID NO: 2919956 - protein, 6 aa, Entamoeba invadens
VKETNL

SEQ ID NO: 2919957 - protein, 24 aa, Entamoeba invadens
VKETPIQEAEDDDATITEDDADIR

SEQ ID NO: 2919958 - protein, 9 aa, Entamoeba invadens
VKETSESLE

SEQ ID NO: 2919959 - protein, 17 aa, Entamoeba invadens
VKEVEASQETIDKQTTA

SEQ ID NO: 2919960 - protein, 8 aa, Entamoeba invadens
VKEVEENT

SEQ ID NO: 2919961 - protein, 7 aa, Entamoeba invadens
VKEVGDE

SEQ ID NO: 2919962 - protein, 13 aa, Entamoeba invadens
VKEVTKAKEEERV

SEQ ID NO: 2919963 - protein, 6 aa, Entamoeba invadens
VKEYST

SEQ ID NO: 2919964 - protein, 9 aa, Entamoeba invadens
VKFDNGNNP

SEQ ID NO: 2919965 - protein, 16 aa, Entamoeba invadens
VKFGAGKNVNKKQMSR

SEQ ID NO: 2919966 - protein, 9 aa, Entamoeba invadens
VKFNPDATN

SEQ ID NO: 2919967 - protein, 7 aa, Entamoeba invadens
VKFSPSI

SEQ ID NO: 2919968 - protein, 5 aa, Entamoeba invadens
VKGAV

SEQ ID NO: 2919969 - protein, 4 aa, Entamoeba invadens
VKGC

SEQ ID NO: 2919970 - protein, 8 aa, Entamoeba invadens
VKGDETPK

SEQ ID NO: 2919971 - protein, 6 aa, Entamoeba invadens
VKGDTV

SEQ ID NO: 2919972 - protein, 5 aa, Entamoeba invadens
VKGDY

SEQ ID NO: 2919973 - protein, 4 aa, Entamoeba invadens
VKGE

SEQ ID NO: 2919974 - protein, 11 aa, Entamoeba invadens
VKGETRPKSMK

SEQ ID NO: 2919975 - protein, 6 aa, Entamoeba invadens
VKGEVR

SEQ ID NO: 2919976 - protein, 4 aa, Entamoeba invadens
VKGF

SEQ ID NO: 2919977 - protein, 21 aa, Entamoeba invadens
VKGFSGAKYKSYPSREDAEEA

SEQ ID NO: 2919978 - protein, 4 aa, Entamoeba invadens
VKGG

SEQ ID NO: 2919979 - protein, 7 aa, Entamoeba invadens
VKGGEKV

SEQ ID NO: 2919980 - protein, 7 aa, Entamoeba invadens
VKGGKQQ

SEQ ID NO: 2919981 - protein, 32 aa, Entamoeba invadens
VKGHAAKAGINGNLKREEIKKEEIQTTDTNDI

SEQ ID NO: 2919982 - protein, 4 aa, Entamoeba invadens
VKGK

SEQ ID NO: 2919983 - protein, 12 aa, Entamoeba invadens
VKGKDIDRSNKV

SEQ ID NO: 2919984 - protein, 6 aa, Entamoeba invadens
VKGKGT

SEQ ID NO: 2919985 - protein, 11 aa, Entamoeba invadens
VKGKKDTVNPL

SEQ ID NO: 2919986 - protein, 9 aa, Entamoeba invadens
VKGKSKMAG

SEQ ID NO: 2919987 - protein, 16 aa, Entamoeba invadens
VKGKSVNKEEGDKEGM

SEQ ID NO: 2919988 - protein, 9 aa, Entamoeba invadens
VKGKYSDKV

SEQ ID NO: 2919989 - protein, 6 aa, Entamoeba invadens
VKGKYT

SEQ ID NO: 2919990 - protein, 9 aa, Entamoeba invadens
VKGNDEDVS

SEQ ID NO: 2919991 - protein, 9 aa, Entamoeba invadens
VKGNENSVN

SEQ ID NO: 2919992 - protein, 8 aa, Entamoeba invadens
VKGNNLEF

SEQ ID NO: 2919993 - protein, 7 aa, Entamoeba invadens
VKGNPLG

SEQ ID NO: 2919994 - protein, 6 aa, Entamoeba invadens
VKGNTS

SEQ ID NO: 2919995 - protein, 8 aa, Entamoeba invadens
VKGPEDTH

SEQ ID NO: 2919996 - protein, 13 aa, Entamoeba invadens
VKGPRTLKHNRGS

SEQ ID NO: 2919997 - protein, 6 aa, Entamoeba invadens
VKGQKL

SEQ ID NO: 2919998 - protein, 9 aa, Entamoeba invadens
VKGRDTRSR

SEQ ID NO: 2919999 - protein, 8 aa, Entamoeba invadens
VKGSKKTL

SEQ ID NO: 2920000 - protein, 5 aa, Entamoeba invadens
VKGTI

SEQ ID NO: 2920001 - protein, 10 aa, Entamoeba invadens
VKGTPHEGDI

SEQ ID NO: 2920002 - protein, 8 aa, Entamoeba invadens
VKGTSATA

SEQ ID NO: 2920003 - protein, 6 aa, Entamoeba invadens
VKGVER

SEQ ID NO: 2920004 - protein, 7 aa, Entamoeba invadens
VKGVTGK

SEQ ID NO: 2920005 - protein, 19 aa, Entamoeba invadens
VKGYSANAIKERKMKDETC

SEQ ID NO: 2920006 - protein, 12 aa, Entamoeba invadens
VKHSDVDDPVGR

SEQ ID NO: 2920007 - protein, 8 aa, Entamoeba invadens
VKHTSDPV

SEQ ID NO: 2920008 - protein, 7 aa, Entamoeba invadens
VKIEDKE

SEQ ID NO: 2920009 - protein, 22 aa, Entamoeba invadens
VKIEKDEKTEIIKTPEKKSKIV

SEQ ID NO: 2920010 - protein, 24 aa, Entamoeba invadens
VKIEKEKKEAERHEQMKEKKALPK

SEQ ID NO: 2920011 - protein, 17 aa, Entamoeba invadens
VKIPSKNVQIGKTRNSV

SEQ ID NO: 2920012 - protein, 12 aa, Entamoeba invadens
VKISDGYAQNTG

SEQ ID NO: 2920013 - protein, 9 aa, Entamoeba invadens
VKISEKKGN

SEQ ID NO: 2920014 - protein, 4 aa, Entamoeba invadens
VKIT

SEQ ID NO: 2920015 - protein, 18 aa, Entamoeba invadens
VKKAPGSTDALKEIIGMS

SEQ ID NO: 2920016 - protein, 19 aa, Entamoeba invadens
VKKAQKEAEKAQKAAGKKK

SEQ ID NO: 2920017 - protein, 13 aa, Entamoeba invadens
VKKCGEERKEGSD

SEQ ID NO: 2920018 - protein, 70 aa, Entamoeba invadens
VKKDGKVKIEDNKYGKKDKKKDKKKDFKKDKKKDKHKKSDSSDSSEEYSSSDSDSSSISSSSDLSYSSSS

SEQ ID NO: 2920019 - protein, 9 aa, Entamoeba invadens
VKKDNDENM

SEQ ID NO: 2920020 - protein, 8 aa, Entamoeba invadens
VKKEEDMQ

SEQ ID NO: 2920021 - protein, 20 aa, Entamoeba invadens
VKKEEEKEKKKKEKKEEKEI

SEQ ID NO: 2920022 - protein, 53 aa, Entamoeba invadens
VKKEEPKAKEHKHEEKKQDKKQTQKDTKKEVKKEVKKNENKHHHDDKKGKSTR

SEQ ID NO: 2920023 - protein, 20 aa, Entamoeba invadens
VKKEEQNKVQPKVEKAKEII

SEQ ID NO: 2920024 - protein, 16 aa, Entamoeba invadens
VKKEEVEKKEDIPSDQ

SEQ ID NO: 2920025 - protein, 9 aa, Entamoeba invadens
VKKEGAPTY

SEQ ID NO: 2920026 - protein, 27 aa, Entamoeba invadens
VKKEGNTLPERRRDKEKCEIDKKSEAD

SEQ ID NO: 2920027 - protein, 9 aa, Entamoeba invadens
VKKEHSLDS

SEQ ID NO: 2920028 - protein, 5 aa, Entamoeba invadens
VKKEK

SEQ ID NO: 2920029 - protein, 14 aa, Entamoeba invadens
VKKEKKSLSPAGTS

SEQ ID NO: 2920030 - protein, 7 aa, Entamoeba invadens
VKKENIE

SEQ ID NO: 2920031 - protein, 7 aa, Entamoeba invadens
VKKENTD

SEQ ID NO: 2920032 - protein, 15 aa, Entamoeba invadens
VKKESTEEDKEDRGK

SEQ ID NO: 2920033 - protein, 10 aa, Entamoeba invadens
VKKETEKQRN

SEQ ID NO: 2920034 - protein, 10 aa, Entamoeba invadens
VKKETSIAKE

SEQ ID NO: 2920035 - protein, 12 aa, Entamoeba invadens
VKKGVAKPTAFR

SEQ ID NO: 2920036 - protein, 10 aa, Entamoeba invadens
VKKIGDDKTP

SEQ ID NO: 2920037 - protein, 7 aa, Entamoeba invadens
VKKIRSD

SEQ ID NO: 2920038 - protein, 15 aa, Entamoeba invadens
VKKKEDEDNNSTQLR

SEQ ID NO: 2920039 - protein, 16 aa, Entamoeba invadens
VKKKEDVLQSDKEDLG

SEQ ID NO: 2920040 - protein, 40 aa, Entamoeba invadens
VKKKKQKKNGWEKSEFPPLGALPQKGEKVEKKDKIVEPPK

SEQ ID NO: 2920041 - protein, 16 aa, Entamoeba invadens
VKKKNNKKKKTESATL

SEQ ID NO: 2920042 - protein, 8 aa, Entamoeba invadens
VKKKPYVE

SEQ ID NO: 2920043 - protein, 20 aa, Entamoeba invadens
VKKKTESATLTGVKIPETPN

SEQ ID NO: 2920044 - protein, 7 aa, Entamoeba invadens
VKKNAES

SEQ ID NO: 2920045 - protein, 8 aa, Entamoeba invadens
VKKNDPTI

SEQ ID NO: 2920046 - protein, 11 aa, Entamoeba invadens
VKKNGTKIPKE

SEQ ID NO: 2920047 - protein, 8 aa, Entamoeba invadens
VKKNHPEL

SEQ ID NO: 2920048 - protein, 7 aa, Entamoeba invadens
VKKNNDT

SEQ ID NO: 2920049 - protein, 10 aa, Entamoeba invadens
VKKPDNNGGF

SEQ ID NO: 2920050 - protein, 28 aa, Entamoeba invadens
VKKQKSAKVVNHSASKSIKTHAPKEKNL

SEQ ID NO: 2920051 - protein, 13 aa, Entamoeba invadens
VKKRGKTKDVPEE

SEQ ID NO: 2920052 - protein, 9 aa, Entamoeba invadens
VKKSEEKIK

SEQ ID NO: 2920053 - protein, 72 aa, Entamoeba invadens
VKKSETDATAPTPVDRPKNPPQPQDTSKELSQKQKQPLSLEKTRAEKKKKKQKKQKKSKNPKNKGKHEEELE

SEQ ID NO: 2920054 - protein, 7 aa, Entamoeba invadens
VKKSSVA

SEQ ID NO: 2920055 - protein, 4 aa, Entamoeba invadens
VKKT

SEQ ID NO: 2920056 - protein, 5 aa, Entamoeba invadens
VKKTG

SEQ ID NO: 2920057 - protein, 14 aa, Entamoeba invadens
VKKTTAMKEAREKV

SEQ ID NO: 2920058 - protein, 8 aa, Entamoeba invadens
VKKVEDKK

SEQ ID NO: 2920059 - protein, 5 aa, Entamoeba invadens
VKKVS

SEQ ID NO: 2920060 - protein, 8 aa, Entamoeba invadens
VKLPEPKF

SEQ ID NO: 2920061 - protein, 12 aa, Entamoeba invadens
VKLPSKKSTNTL

SEQ ID NO: 2920062 - protein, 5 aa, Entamoeba invadens
VKLTS

SEQ ID NO: 2920063 - protein, 4 aa, Entamoeba invadens
VKMY

SEQ ID NO: 2920064 - protein, 9 aa, Entamoeba invadens
VKNASGSKF

SEQ ID NO: 2920065 - protein, 4 aa, Entamoeba invadens
VKNC

SEQ ID NO: 2920066 - protein, 8 aa, Entamoeba invadens
VKNDLSKK

SEQ ID NO: 2920067 - protein, 9 aa, Entamoeba invadens
VKNESQSRF

SEQ ID NO: 2920068 - protein, 6 aa, Entamoeba invadens
VKNFPE

SEQ ID NO: 2920069 - protein, 8 aa, Entamoeba invadens
VKNGCDGK

SEQ ID NO: 2920070 - protein, 7 aa, Entamoeba invadens
VKNGEDV

SEQ ID NO: 2920071 - protein, 7 aa, Entamoeba invadens
VKNGEVQ

SEQ ID NO: 2920072 - protein, 27 aa, Entamoeba invadens
VKNHEKKKEKEEKCCQKDKAKRSSFNH

SEQ ID NO: 2920073 - protein, 8 aa, Entamoeba invadens
VKNHQQNN

SEQ ID NO: 2920074 - protein, 6 aa, Entamoeba invadens
VKNIGN

SEQ ID NO: 2920075 - protein, 11 aa, Entamoeba invadens
VKNKKNEIQYD

SEQ ID NO: 2920076 - protein, 11 aa, Entamoeba invadens
VKNKTKELKDD

SEQ ID NO: 2920077 - protein, 24 aa, Entamoeba invadens
VKNLANDKNQLSSEKKKLQDEYDQ

SEQ ID NO: 2920078 - protein, 25 aa, Entamoeba invadens
VKNLANDRYQLSSEKKKLQDEYDQL

SEQ ID NO: 2920079 - protein, 9 aa, Entamoeba invadens
VKNNGGIDS

SEQ ID NO: 2920080 - protein, 7 aa, Entamoeba invadens
VKNNGKV

SEQ ID NO: 2920081 - protein, 8 aa, Entamoeba invadens
VKNNGPFT

SEQ ID NO: 2920082 - protein, 5 aa, Entamoeba invadens
VKNNI

SEQ ID NO: 2920083 - protein, 6 aa, Entamoeba invadens
VKNNNM

SEQ ID NO: 2920084 - protein, 23 aa, Entamoeba invadens
VKNPEGEVQTPKVNDKKNGTYDV

SEQ ID NO: 2920085 - protein, 11 aa, Entamoeba invadens
VKNPSQQSIEQ

SEQ ID NO: 2920086 - protein, 10 aa, Entamoeba invadens
VKNREGEDSL

SEQ ID NO: 2920087 - protein, 12 aa, Entamoeba invadens
VKNSRKEASEDP

SEQ ID NO: 2920088 - protein, 4 aa, Entamoeba invadens
VKNT

SEQ ID NO: 2920089 - protein, 8 aa, Entamoeba invadens
VKNTIESE

SEQ ID NO: 2920090 - protein, 8 aa, Entamoeba invadens
VKNTKEST

SEQ ID NO: 2920091 - protein, 8 aa, Entamoeba invadens
VKNTTGVE

SEQ ID NO: 2920092 - protein, 6 aa, Entamoeba invadens
VKPDNT

SEQ ID NO: 2920093 - protein, 10 aa, Entamoeba invadens
VKPDQTEDEI

SEQ ID NO: 2920094 - protein, 6 aa, Entamoeba invadens
VKPEET

SEQ ID NO: 2920095 - protein, 5 aa, Entamoeba invadens
VKPEV

SEQ ID NO: 2920096 - protein, 18 aa, Entamoeba invadens
VKPEVSTQQEEPQKVEEH

SEQ ID NO: 2920097 - protein, 12 aa, Entamoeba invadens
VKPGSKIEELEE

SEQ ID NO: 2920098 - protein, 4 aa, Entamoeba invadens
VKPI

SEQ ID NO: 2920099 - protein, 9 aa, Entamoeba invadens
VKPKAVKTT

SEQ ID NO: 2920100 - protein, 9 aa, Entamoeba invadens
VKPKDMSEQ

SEQ ID NO: 2920101 - protein, 7 aa, Entamoeba invadens
VKPKEIE

SEQ ID NO: 2920102 - protein, 6 aa, Entamoeba invadens
VKPKNF

SEQ ID NO: 2920103 - protein, 9 aa, Entamoeba invadens
VKPKPLKRP

SEQ ID NO: 2920104 - protein, 9 aa, Entamoeba invadens
VKPNDNGRR

SEQ ID NO: 2920105 - protein, 4 aa, Entamoeba invadens
VKPQ

SEQ ID NO: 2920106 - protein, 9 aa, Entamoeba invadens
VKPQRPTTL

SEQ ID NO: 2920107 - protein, 9 aa, Entamoeba invadens
VKPRGQNGF

SEQ ID NO: 2920108 - protein, 7 aa, Entamoeba invadens
VKPRKGV

SEQ ID NO: 2920109 - protein, 6 aa, Entamoeba invadens
VKPSDV

SEQ ID NO: 2920110 - protein, 10 aa, Entamoeba invadens
VKPSGKMAVT

SEQ ID NO: 2920111 - protein, 11 aa, Entamoeba invadens
VKPSSNKTTYN

SEQ ID NO: 2920112 - protein, 4 aa, Entamoeba invadens
VKPT

SEQ ID NO: 2920113 - protein, 10 aa, Entamoeba invadens
VKPTPKYDED

SEQ ID NO: 2920114 - protein, 14 aa, Entamoeba invadens
VKPTPQKHKKYKNY

SEQ ID NO: 2920115 - protein, 14 aa, Entamoeba invadens
VKPVEEDNIKESTK

SEQ ID NO: 2920116 - protein, 9 aa, Entamoeba invadens
VKQASRKVD

SEQ ID NO: 2920117 - protein, 12 aa, Entamoeba invadens
VKQEKVKKEYFS

SEQ ID NO: 2920118 - protein, 13 aa, Entamoeba invadens
VKQELTQKALEED

SEQ ID NO: 2920119 - protein, 5 aa, Entamoeba invadens
VKQFG

SEQ ID NO: 2920120 - protein, 31 aa, Entamoeba invadens
VKQIEKEKQENDEKYKNENQQLRNEKIEKEK

SEQ ID NO: 2920121 - protein, 16 aa, Entamoeba invadens
VKQNISSELNMEITRF

SEQ ID NO: 2920122 - protein, 7 aa, Entamoeba invadens
VKQNKGE

SEQ ID NO: 2920123 - protein, 8 aa, Entamoeba invadens
VKQNKMRE

SEQ ID NO: 2920124 - protein, 14 aa, Entamoeba invadens
VKQPELKTRDADNL

SEQ ID NO: 2920125 - protein, 8 aa, Entamoeba invadens
VKQPGSLT

SEQ ID NO: 2920126 - protein, 10 aa, Entamoeba invadens
VKQQGNTDLI

SEQ ID NO: 2920127 - protein, 10 aa, Entamoeba invadens
VKQQQQQRVV

SEQ ID NO: 2920128 - protein, 27 aa, Entamoeba invadens
VKQRKEKSKNNLKASREAAKAKKAAES

SEQ ID NO: 2920129 - protein, 11 aa, Entamoeba invadens
VKQSATRLEQS

SEQ ID NO: 2920130 - protein, 17 aa, Entamoeba invadens
VKQSPHNTSNTSPQPFL

SEQ ID NO: 2920131 - protein, 11 aa, Entamoeba invadens
VKQSSATNSLP

SEQ ID NO: 2920132 - protein, 5 aa, Entamoeba invadens
VKQTQ

SEQ ID NO: 2920133 - protein, 7 aa, Entamoeba invadens
VKRAKPF

SEQ ID NO: 2920134 - protein, 12 aa, Entamoeba invadens
VKREQPDSKVSY

SEQ ID NO: 2920135 - protein, 11 aa, Entamoeba invadens
VKREQPDSRVS

SEQ ID NO: 2920136 - protein, 13 aa, Entamoeba invadens
VKRERYGNKTEKM

SEQ ID NO: 2920137 - protein, 15 aa, Entamoeba invadens
VKRESTEKDKEERGK

SEQ ID NO: 2920138 - protein, 7 aa, Entamoeba invadens
VKRETIK

SEQ ID NO: 2920139 - protein, 6 aa, Entamoeba invadens
VKRGDS

SEQ ID NO: 2920140 - protein, 6 aa, Entamoeba invadens
VKRGRE

SEQ ID NO: 2920141 - protein, 6 aa, Entamoeba invadens
VKRIKQ

SEQ ID NO: 2920142 - protein, 12 aa, Entamoeba invadens
VKRNKKQSVTKI

SEQ ID NO: 2920143 - protein, 8 aa, Entamoeba invadens
VKRNQVKN

SEQ ID NO: 2920144 - protein, 14 aa, Entamoeba invadens
VKRPETQNRIDPSF

SEQ ID NO: 2920145 - protein, 18 aa, Entamoeba invadens
VKRPLPKPPLSTLNQTSY

SEQ ID NO: 2920146 - protein, 5 aa, Entamoeba invadens
VKRSE

SEQ ID NO: 2920147 - protein, 14 aa, Entamoeba invadens
VKRSLSKKKIEPEN

SEQ ID NO: 2920148 - protein, 6 aa, Entamoeba invadens
VKRTEY

SEQ ID NO: 2920149 - protein, 4 aa, Entamoeba invadens
VKSA

SEQ ID NO: 2920150 - protein, 8 aa, Entamoeba invadens
VKSAEDVA

SEQ ID NO: 2920151 - protein, 10 aa, Entamoeba invadens
VKSAKKTLQM

SEQ ID NO: 2920152 - protein, 8 aa, Entamoeba invadens
VKSAPAQD

SEQ ID NO: 2920153 - protein, 11 aa, Entamoeba invadens
VKSAPKKDDLD

SEQ ID NO: 2920154 - protein, 8 aa, Entamoeba invadens
VKSATQSI

SEQ ID NO: 2920155 - protein, 6 aa, Entamoeba invadens
VKSDDR

SEQ ID NO: 2920156 - protein, 11 aa, Entamoeba invadens
VKSDKNSLTPI

SEQ ID NO: 2920157 - protein, 17 aa, Entamoeba invadens
VKSEESVEEKTDENKRY

SEQ ID NO: 2920158 - protein, 9 aa, Entamoeba invadens
VKSEKGRLT

SEQ ID NO: 2920159 - protein, 6 aa, Entamoeba invadens
VKSENV

SEQ ID NO: 2920160 - protein, 18 aa, Entamoeba invadens
VKSGDKVTRVQRKVDSSL

SEQ ID NO: 2920161 - protein, 8 aa, Entamoeba invadens
VKSGGKKI

SEQ ID NO: 2920162 - protein, 7 aa, Entamoeba invadens
VKSGLST

SEQ ID NO: 2920163 - protein, 6 aa, Entamoeba invadens
VKSIGD

SEQ ID NO: 2920164 - protein, 7 aa, Entamoeba invadens
VKSIGES

SEQ ID NO: 2920165 - protein, 8 aa, Entamoeba invadens
VKSIGESS

SEQ ID NO: 2920166 - protein, 7 aa, Entamoeba invadens
VKSIGNS

SEQ ID NO: 2920167 - protein, 4 aa, Entamoeba invadens
VKSK

SEQ ID NO: 2920168 - protein, 7 aa, Entamoeba invadens
VKSKKFN

SEQ ID NO: 2920169 - protein, 26 aa, Entamoeba invadens
VKSKNSEEVSEEKIQETKMKNTAKNI

SEQ ID NO: 2920170 - protein, 9 aa, Entamoeba invadens
VKSKTEISQ

SEQ ID NO: 2920171 - protein, 4 aa, Entamoeba invadens
VKSL

SEQ ID NO: 2920172 - protein, 4 aa, Entamoeba invadens
VKSM

SEQ ID NO: 2920173 - protein, 9 aa, Entamoeba invadens
VKSNEENVQ

SEQ ID NO: 2920174 - protein, 12 aa, Entamoeba invadens
VKSNKVKEEKYK

SEQ ID NO: 2920175 - protein, 9 aa, Entamoeba invadens
VKSNMPSAE

SEQ ID NO: 2920176 - protein, 7 aa, Entamoeba invadens
VKSNRMS

SEQ ID NO: 2920177 - protein, 8 aa, Entamoeba invadens
VKSNTTEK

SEQ ID NO: 2920178 - protein, 26 aa, Entamoeba invadens
VKSPETAEDEGASKITPETPKEERAV

SEQ ID NO: 2920179 - protein, 5 aa, Entamoeba invadens
VKSPI

SEQ ID NO: 2920180 - protein, 9 aa, Entamoeba invadens
VKSPNLKPS

SEQ ID NO: 2920181 - protein, 34 aa, Entamoeba invadens
VKSRISKRMRRSRKPQKEKGIKTKKEKNGNYEKI

SEQ ID NO: 2920182 - protein, 9 aa, Entamoeba invadens
VKSRRSGGL

SEQ ID NO: 2920183 - protein, 4 aa, Entamoeba invadens
VKSS

SEQ ID NO: 2920184 - protein, 7 aa, Entamoeba invadens
VKSSEVS

SEQ ID NO: 2920185 - protein, 19 aa, Entamoeba invadens
VKSSMEGSSEKEEEDSEIK

SEQ ID NO: 2920186 - protein, 9 aa, Entamoeba invadens
VKSSRDKSC

SEQ ID NO: 2920187 - protein, 56 aa, Entamoeba invadens
VKSSTTNNTLSGTNRGNTARDKTKNTTKNNTTGNLSATVRDKTAAEKQMDKKMDEF

SEQ ID NO: 2920188 - protein, 9 aa, Entamoeba invadens
VKSTNGSLY

SEQ ID NO: 2920189 - protein, 7 aa, Entamoeba invadens
VKSTVSE

SEQ ID NO: 2920190 - protein, 12 aa, Entamoeba invadens
VKSTYQKEAERT

SEQ ID NO: 2920191 - protein, 14 aa, Entamoeba invadens
VKSVGNKAFSENKN

SEQ ID NO: 2920192 - protein, 53 aa, Entamoeba invadens
VKTAANTDGLAGCQEAPYKGTDGQNVNKPLPHVNEAENVKEDVTPVEEKPQII

SEQ ID NO: 2920193 - protein, 8 aa, Entamoeba invadens
VKTAETGY

SEQ ID NO: 2920194 - protein, 8 aa, Entamoeba invadens
VKTANSGY

SEQ ID NO: 2920195 - protein, 8 aa, Entamoeba invadens
VKTARRDV

SEQ ID NO: 2920196 - protein, 11 aa, Entamoeba invadens
VKTEAKPTADT

SEQ ID NO: 2920197 - protein, 7 aa, Entamoeba invadens
VKTEGPI

SEQ ID NO: 2920198 - protein, 7 aa, Entamoeba invadens
VKTEKDL

SEQ ID NO: 2920199 - protein, 7 aa, Entamoeba invadens
VKTEKKY

SEQ ID NO: 2920200 - protein, 75 aa, Entamoeba invadens
VKTEKMSESSSSDSSESSDSSSEEEKPKKMEIEKPKKVSEDESSSESSSSDSESSSSEAGKRKKKSTKGKEEKRR

SEQ ID NO: 2920201 - protein, 12 aa, Entamoeba invadens
VKTEKNNKEMVE

SEQ ID NO: 2920202 - protein, 17 aa, Entamoeba invadens
VKTEKVEDEKNEKDTIL

SEQ ID NO: 2920203 - protein, 14 aa, Entamoeba invadens
VKTETSKEPKKQGP

SEQ ID NO: 2920204 - protein, 10 aa, Entamoeba invadens
VKTGQNKNKG

SEQ ID NO: 2920205 - protein, 13 aa, Entamoeba invadens
VKTGTTGKYSYTN

SEQ ID NO: 2920206 - protein, 4 aa, Entamoeba invadens
VKTI

SEQ ID NO: 2920207 - protein, 36 aa, Entamoeba invadens
VKTKEDCNKIEQQLDSKRKENEEQREENNKLKNEIK

SEQ ID NO: 2920208 - protein, 17 aa, Entamoeba invadens
VKTKGRKTFSVDEKEKN

SEQ ID NO: 2920209 - protein, 12 aa, Entamoeba invadens
VKTKPAPVTLGP

SEQ ID NO: 2920210 - protein, 18 aa, Entamoeba invadens
VKTKTAALTSAKNASDKK

SEQ ID NO: 2920211 - protein, 5 aa, Entamoeba invadens
VKTLG

SEQ ID NO: 2920212 - protein, 15 aa, Entamoeba invadens
VKTLTNKQDENGPQT

SEQ ID NO: 2920213 - protein, 28 aa, Entamoeba invadens
VKTNEDFDDDDDDTKQPQASELPSLPLP

SEQ ID NO: 2920214 - protein, 5 aa, Entamoeba invadens
VKTNS

SEQ ID NO: 2920215 - protein, 10 aa, Entamoeba invadens
VKTPKDLSRQ

SEQ ID NO: 2920216 - protein, 8 aa, Entamoeba invadens
VKTPKGGL

SEQ ID NO: 2920217 - protein, 8 aa, Entamoeba invadens
VKTPPHPL

SEQ ID NO: 2920218 - protein, 9 aa, Entamoeba invadens
VKTQDNTKY

SEQ ID NO: 2920219 - protein, 8 aa, Entamoeba invadens
VKTQETQI

SEQ ID NO: 2920220 - protein, 12 aa, Entamoeba invadens
VKTQKQKFESLD

SEQ ID NO: 2920221 - protein, 6 aa, Entamoeba invadens
VKTQNS

SEQ ID NO: 2920222 - protein, 15 aa, Entamoeba invadens
VKTQRNQCQNKQSSV

SEQ ID NO: 2920223 - protein, 7 aa, Entamoeba invadens
VKTRAPA

SEQ ID NO: 2920224 - protein, 12 aa, Entamoeba invadens
VKTRPLKEGEEY

SEQ ID NO: 2920225 - protein, 5 aa, Entamoeba invadens
VKTRV

SEQ ID NO: 2920226 - protein, 5 aa, Entamoeba invadens
VKTSD

SEQ ID NO: 2920227 - protein, 10 aa, Entamoeba invadens
VKTSDKAVDL

SEQ ID NO: 2920228 - protein, 11 aa, Entamoeba invadens
VKTSEEYNSTP

SEQ ID NO: 2920229 - protein, 12 aa, Entamoeba invadens
VKTSGDPEQRKA

SEQ ID NO: 2920230 - protein, 10 aa, Entamoeba invadens
VKTSNGGPEV

SEQ ID NO: 2920231 - protein, 7 aa, Entamoeba invadens
VKTSTGD

SEQ ID NO: 2920232 - protein, 53 aa, Entamoeba invadens
VKTTGDLSSSKALEVEESSVPKSTHRVARGGKGRKKATKNAFKVGSKDLKEED

SEQ ID NO: 2920233 - protein, 18 aa, Entamoeba invadens
VKTTGGRLGPVEGDLPEL

SEQ ID NO: 2920234 - protein, 8 aa, Entamoeba invadens
VKTTKGVS

SEQ ID NO: 2920235 - protein, 24 aa, Entamoeba invadens
VKTTKKSKKSSSSKPIEKRSTVKL

SEQ ID NO: 2920236 - protein, 5 aa, Entamoeba invadens
VKTTS

SEQ ID NO: 2920237 - protein, 11 aa, Entamoeba invadens
VKTTTEESPLM

SEQ ID NO: 2920238 - protein, 5 aa, Entamoeba invadens
VKTVD

SEQ ID NO: 2920239 - protein, 44 aa, Entamoeba invadens
VKVAASPKSCVEDKKMQSGAKQTVPPKSEVKKEERKAPVLPTRG

SEQ ID NO: 2920240 - protein, 25 aa, Entamoeba invadens
VKVDESEDEKKAAEQKEKDNEELSK

SEQ ID NO: 2920241 - protein, 12 aa, Entamoeba invadens
VKVEEKPIEDIK

SEQ ID NO: 2920242 - protein, 5 aa, Entamoeba invadens
VKVEG

SEQ ID NO: 2920243 - protein, 6 aa, Entamoeba invadens
VKVESS

SEQ ID NO: 2920244 - protein, 7 aa, Entamoeba invadens
VKVPKVD

SEQ ID NO: 2920245 - protein, 10 aa, Entamoeba invadens
VKVPQQKNGI

SEQ ID NO: 2920246 - protein, 9 aa, Entamoeba invadens
VKVRRPKDF

SEQ ID NO: 2920247 - protein, 5 aa, Entamoeba invadens
VKWSD

SEQ ID NO: 2920248 - protein, 10 aa, Entamoeba invadens
VKYDPQKGSI

SEQ ID NO: 2920249 - protein, 6 aa, Entamoeba invadens
VKYEEK

SEQ ID NO: 2920250 - protein, 17 aa, Entamoeba invadens
VKYRTKTTSSSNPKFEE

SEQ ID NO: 2920251 - protein, 7 aa, Entamoeba invadens
VKYTKED

SEQ ID NO: 2920252 - protein, 11 aa, Entamoeba invadens
VLDEEKDPKIA

SEQ ID NO: 2920253 - protein, 42 aa, Entamoeba invadens
VLEEERRKEEEELEQKRKELENEEKKLREEEESRKRAIEERK

SEQ ID NO: 2920254 - protein, 5 aa, Entamoeba invadens
VLENN

SEQ ID NO: 2920255 - protein, 26 aa, Entamoeba invadens
VLETQSEKKAEKEKTSKKVDKQDVEI

SEQ ID NO: 2920256 - protein, 12 aa, Entamoeba invadens
VLGGEGIPDNSK

SEQ ID NO: 2920257 - protein, 10 aa, Entamoeba invadens
VLGGKEISDL

SEQ ID NO: 2920258 - protein, 5 aa, Entamoeba invadens
VLGNR

SEQ ID NO: 2920259 - protein, 9 aa, Entamoeba invadens
VLGQPGANE

SEQ ID NO: 2920260 - protein, 6 aa, Entamoeba invadens
VLGTPS

SEQ ID NO: 2920261 - protein, 10 aa, Entamoeba invadens
VLKDSSEVQY

SEQ ID NO: 2920262 - protein, 13 aa, Entamoeba invadens
VLKGTKKTQMDKD

SEQ ID NO: 2920263 - protein, 13 aa, Entamoeba invadens
VLKPKKYTKKDTM

SEQ ID NO: 2920264 - protein, 41 aa, Entamoeba invadens
VLKRSDDEIEKEDGTESDEEKPKRKTRKREPVEIKKGSSGV

SEQ ID NO: 2920265 - protein, 9 aa, Entamoeba invadens
VLKSDNDEV

SEQ ID NO: 2920266 - protein, 5 aa, Entamoeba invadens
VLKTE

SEQ ID NO: 2920267 - protein, 25 aa, Entamoeba invadens
VLNEPSNEKSQEETQPIEKKQELPV

SEQ ID NO: 2920268 - protein, 5 aa, Entamoeba invadens
VLNTQ

SEQ ID NO: 2920269 - protein, 15 aa, Entamoeba invadens
VLNTQNKVETSPQPL

SEQ ID NO: 2920270 - protein, 6 aa, Entamoeba invadens
VLPDPT

SEQ ID NO: 2920271 - protein, 10 aa, Entamoeba invadens
VLPENNSGLK

SEQ ID NO: 2920272 - protein, 17 aa, Entamoeba invadens
VLPKTAKRRLESNRLTE

SEQ ID NO: 2920273 - protein, 61 aa, Entamoeba invadens
VLPPPGLVPPPPGILPPSEANAPALPPPRGPSLADQLKQGKSSLTAAKVTEEKTPPPHEEN

SEQ ID NO: 2920274 - protein, 6 aa, Entamoeba invadens
VLPPQP

SEQ ID NO: 2920275 - protein, 19 aa, Entamoeba invadens
VLPSKPKRLSQNKNIHPLN

SEQ ID NO: 2920276 - protein, 10 aa, Entamoeba invadens
VLPSKSAQQF

SEQ ID NO: 2920277 - protein, 20 aa, Entamoeba invadens
VLPSPPTQSPLGPSPRVDTP

SEQ ID NO: 2920278 - protein, 5 aa, Entamoeba invadens
VLPTD

SEQ ID NO: 2920279 - protein, 15 aa, Entamoeba invadens
VLPTDSNTPDDVKTR

SEQ ID NO: 2920280 - protein, 5 aa, Entamoeba invadens
VLPTE

SEQ ID NO: 2920281 - protein, 15 aa, Entamoeba invadens
VLQDDADLKRHSGSK

SEQ ID NO: 2920282 - protein, 6 aa, Entamoeba invadens
VLQTTR

SEQ ID NO: 2920283 - protein, 7 aa, Entamoeba invadens
VLREQKG

SEQ ID NO: 2920284 - protein, 10 aa, Entamoeba invadens
VLSAPKKKSL

SEQ ID NO: 2920285 - protein, 7 aa, Entamoeba invadens
VLSESDK

SEQ ID NO: 2920286 - protein, 9 aa, Entamoeba invadens
VLSKPEINQ

SEQ ID NO: 2920287 - protein, 10 aa, Entamoeba invadens
VLSNQKPTDI

SEQ ID NO: 2920288 - protein, 11 aa, Entamoeba invadens
VLSQSTEQIKQ

SEQ ID NO: 2920289 - protein, 33 aa, Entamoeba invadens
VLSREKKRPDKRKTKTTNPTTPQMPSRRNYQQE

SEQ ID NO: 2920290 - protein, 4 aa, Entamoeba invadens
VLSS

SEQ ID NO: 2920291 - protein, 7 aa, Entamoeba invadens
VLSSSDG

SEQ ID NO: 2920292 - protein, 20 aa, Entamoeba invadens
VLSSTDDEFKYSPTNLGEEG

SEQ ID NO: 2920293 - protein, 11 aa, Entamoeba invadens
VLSTNKPDEDT

SEQ ID NO: 2920294 - protein, 6 aa, Entamoeba invadens
VLTGNR

SEQ ID NO: 2920295 - protein, 7 aa, Entamoeba invadens
VLTKKSH

SEQ ID NO: 2920296 - protein, 6 aa, Entamoeba invadens
VLTKPQ

SEQ ID NO: 2920297 - protein, 10 aa, Entamoeba invadens
VLTSRKNDFI

SEQ ID NO: 2920298 - protein, 9 aa, Entamoeba invadens
VLTTQDDKN

SEQ ID NO: 2920299 - protein, 5 aa, Entamoeba invadens
VMETQ

SEQ ID NO: 2920300 - protein, 17 aa, Entamoeba invadens
VMKSQEQLSMEARSQED

SEQ ID NO: 2920301 - protein, 16 aa, Entamoeba invadens
VMNSDPKHKLNETHKN

SEQ ID NO: 2920302 - protein, 7 aa, Entamoeba invadens
VMNTGNR

SEQ ID NO: 2920303 - protein, 17 aa, Entamoeba invadens
VMPNDNDSTQTKVSQRD

SEQ ID NO: 2920304 - protein, 17 aa, Entamoeba invadens
VMPNDNDSTQTKVSQSD

SEQ ID NO: 2920305 - protein, 7 aa, Entamoeba invadens
VMPSEEG

SEQ ID NO: 2920306 - protein, 9 aa, Entamoeba invadens
VMSTDRRDG

SEQ ID NO: 2920307 - protein, 11 aa, Entamoeba invadens
VMTGSSDRTLK

SEQ ID NO: 2920308 - protein, 20 aa, Entamoeba invadens
VMTKEKKKKKKGLDEDTTST

SEQ ID NO: 2920309 - protein, 14 aa, Entamoeba invadens
VNAAVTEKSLLLTS

SEQ ID NO: 2920310 - protein, 7 aa, Entamoeba invadens
VNADDGA

SEQ ID NO: 2920311 - protein, 7 aa, Entamoeba invadens
VNADISA

SEQ ID NO: 2920312 - protein, 11 aa, Entamoeba invadens
VNADNGEDYPY

SEQ ID NO: 2920313 - protein, 12 aa, Entamoeba invadens
VNAEGKIVKSTK

SEQ ID NO: 2920314 - protein, 20 aa, Entamoeba invadens
VNAEIQKDQDRMKKEEELYQ

SEQ ID NO: 2920315 - protein, 14 aa, Entamoeba invadens
VNAENGDNNTNEFD

SEQ ID NO: 2920316 - protein, 5 aa, Entamoeba invadens
VNAGH

SEQ ID NO: 2920317 - protein, 7 aa, Entamoeba invadens
VNAGPTT

SEQ ID NO: 2920318 - protein, 6 aa, Entamoeba invadens
VNAGTT

SEQ ID NO: 2920319 - protein, 12 aa, Entamoeba invadens
VNAGVQVKTAKR

SEQ ID NO: 2920320 - protein, 30 aa, Entamoeba invadens
VNAQKEDSGAVLNDTKDDLANTKNDLKKTQ

SEQ ID NO: 2920321 - protein, 4 aa, Entamoeba invadens
VNAS

SEQ ID NO: 2920322 - protein, 16 aa, Entamoeba invadens
VNATNKPQYYKAGSEL

SEQ ID NO: 2920323 - protein, 8 aa, Entamoeba invadens
VNATPESD

SEQ ID NO: 2920324 - protein, 6 aa, Entamoeba invadens
VNATYQ

SEQ ID NO: 2920325 - protein, 5 aa, Entamoeba invadens
VNAYG

SEQ ID NO: 2920326 - protein, 5 aa, Entamoeba invadens
VNAYN

SEQ ID NO: 2920327 - protein, 14 aa, Entamoeba invadens
VNCKRTSQSGCAQC

SEQ ID NO: 2920328 - protein, 11 aa, Entamoeba invadens
VNCTDGSKFGS

SEQ ID NO: 2920329 - protein, 15 aa, Entamoeba invadens
VNDDDTNAMITKDGK

SEQ ID NO: 2920330 - protein, 4 aa, Entamoeba invadens
VNDE

SEQ ID NO: 2920331 - protein, 9 aa, Entamoeba invadens
VNDEDVNGR

SEQ ID NO: 2920332 - protein, 10 aa, Entamoeba invadens
VNDEQVENTP

SEQ ID NO: 2920333 - protein, 7 aa, Entamoeba invadens
VNDERVN

SEQ ID NO: 2920334 - protein, 42 aa, Entamoeba invadens
VNDETTKSHLKEEKNESDEEFDDDLGEEDTNTKNDTGSSDDM

SEQ ID NO: 2920335 - protein, 7 aa, Entamoeba invadens
VNDGDTL

SEQ ID NO: 2920336 - protein, 9 aa, Entamoeba invadens
VNDGSTDQS

SEQ ID NO: 2920337 - protein, 12 aa, Entamoeba invadens
VNDKGETITPDD

SEQ ID NO: 2920338 - protein, 5 aa, Entamoeba invadens
VNDKR

SEQ ID NO: 2920339 - protein, 11 aa, Entamoeba invadens
VNDKSRVGAEL

SEQ ID NO: 2920340 - protein, 5 aa, Entamoeba invadens
VNDNH

SEQ ID NO: 2920341 - protein, 5 aa, Entamoeba invadens
VNDPN

SEQ ID NO: 2920342 - protein, 15 aa, Entamoeba invadens
VNDPTKNLDQQITDK

SEQ ID NO: 2920343 - protein, 5 aa, Entamoeba invadens
VNDQT

SEQ ID NO: 2920344 - protein, 11 aa, Entamoeba invadens
VNDRKEQLKEL

SEQ ID NO: 2920345 - protein, 13 aa, Entamoeba invadens
VNDSPRKKTGKRL

SEQ ID NO: 2920346 - protein, 4 aa, Entamoeba invadens
VNDT

SEQ ID NO: 2920347 - protein, 9 aa, Entamoeba invadens
VNDTNAQQI

SEQ ID NO: 2920348 - protein, 11 aa, Entamoeba invadens
VNEASPPDLKN

SEQ ID NO: 2920349 - protein, 9 aa, Entamoeba invadens
VNEATKLPA

SEQ ID NO: 2920350 - protein, 6 aa, Entamoeba invadens
VNEATN

SEQ ID NO: 2920351 - protein, 10 aa, Entamoeba invadens
VNEDKQGRVS

SEQ ID NO: 2920352 - protein, 10 aa, Entamoeba invadens
VNEDNPERET

SEQ ID NO: 2920353 - protein, 10 aa, Entamoeba invadens
VNEDPQREKQ

SEQ ID NO: 2920354 - protein, 19 aa, Entamoeba invadens
VNEDTPLQKPTNPYGHTKA

SEQ ID NO: 2920355 - protein, 7 aa, Entamoeba invadens
VNEDVTP

SEQ ID NO: 2920356 - protein, 4 aa, Entamoeba invadens
VNEE

SEQ ID NO: 2920357 - protein, 13 aa, Entamoeba invadens
VNEEAEQQRIQGK

SEQ ID NO: 2920358 - protein, 22 aa, Entamoeba invadens
VNEEGNAENLTTSVSDLQDNQH

SEQ ID NO: 2920359 - protein, 8 aa, Entamoeba invadens
VNEGNYKS

SEQ ID NO: 2920360 - protein, 5 aa, Entamoeba invadens
VNEGR

SEQ ID NO: 2920361 - protein, 7 aa, Entamoeba invadens
VNEHSKE

SEQ ID NO: 2920362 - protein, 9 aa, Entamoeba invadens
VNEKEDESY

SEQ ID NO: 2920363 - protein, 6 aa, Entamoeba invadens
VNEKKR

SEQ ID NO: 2920364 - protein, 9 aa, Entamoeba invadens
VNEKNDFKN

SEQ ID NO: 2920365 - protein, 11 aa, Entamoeba invadens
VNEKSSEKMTN

SEQ ID NO: 2920366 - protein, 9 aa, Entamoeba invadens
VNEKTSDAQ

SEQ ID NO: 2920367 - protein, 8 aa, Entamoeba invadens
VNELPKEE

SEQ ID NO: 2920368 - protein, 8 aa, Entamoeba invadens
VNELREEN

SEQ ID NO: 2920369 - protein, 4 aa, Entamoeba invadens
VNEN

SEQ ID NO: 2920370 - protein, 8 aa, Entamoeba invadens
VNEPDAQV

SEQ ID NO: 2920371 - protein, 10 aa, Entamoeba invadens
VNEPLTKEKL

SEQ ID NO: 2920372 - protein, 6 aa, Entamoeba invadens
VNEPPT

SEQ ID NO: 2920373 - protein, 11 aa, Entamoeba invadens
VNEPVKAEPIE

SEQ ID NO: 2920374 - protein, 10 aa, Entamoeba invadens
VNEQKSDIVT

SEQ ID NO: 2920375 - protein, 4 aa, Entamoeba invadens
VNER

SEQ ID NO: 2920376 - protein, 6 aa, Entamoeba invadens
VNERKY

SEQ ID NO: 2920377 - protein, 6 aa, Entamoeba invadens
VNERVK

SEQ ID NO: 2920378 - protein, 6 aa, Entamoeba invadens
VNESIS

SEQ ID NO: 2920379 - protein, 9 aa, Entamoeba invadens
VNESKTEII

SEQ ID NO: 2920380 - protein, 16 aa, Entamoeba invadens
VNESTAPTAPPKRRVG

SEQ ID NO: 2920381 - protein, 4 aa, Entamoeba invadens
VNET

SEQ ID NO: 2920382 - protein, 7 aa, Entamoeba invadens
VNETDDK

SEQ ID NO: 2920383 - protein, 6 aa, Entamoeba invadens
VNETKD

SEQ ID NO: 2920384 - protein, 31 aa, Entamoeba invadens
VNEVKRSSVDLKKSKTPAADDIEKSEKDSKL

SEQ ID NO: 2920385 - protein, 32 aa, Entamoeba invadens
VNFNDSQTSSQTEKHQPTSSQKEASKTTEVSV

SEQ ID NO: 2920386 - protein, 15 aa, Entamoeba invadens
VNGAKQFVKEQKEKC

SEQ ID NO: 2920387 - protein, 13 aa, Entamoeba invadens
VNGAQIADDYTSA

SEQ ID NO: 2920388 - protein, 5 aa, Entamoeba invadens
VNGDQ

SEQ ID NO: 2920389 - protein, 6 aa, Entamoeba invadens
VNGDSN

SEQ ID NO: 2920390 - protein, 10 aa, Entamoeba invadens
VNGEKTYKFS

SEQ ID NO: 2920391 - protein, 5 aa, Entamoeba invadens
VNGER

SEQ ID NO: 2920392 - protein, 7 aa, Entamoeba invadens
VNGERTS

SEQ ID NO: 2920393 - protein, 7 aa, Entamoeba invadens
VNGESGS

SEQ ID NO: 2920394 - protein, 21 aa, Entamoeba invadens
VNGESQVEKAVDNEMEKEKSV

SEQ ID NO: 2920395 - protein, 12 aa, Entamoeba invadens
VNGETNQKWDTV

SEQ ID NO: 2920396 - protein, 4 aa, Entamoeba invadens
VNGG

SEQ ID NO: 2920397 - protein, 6 aa, Entamoeba invadens
VNGGGE

SEQ ID NO: 2920398 - protein, 5 aa, Entamoeba invadens
VNGGH

SEQ ID NO: 2920399 - protein, 5 aa, Entamoeba invadens
VNGHF

SEQ ID NO: 2920400 - protein, 5 aa, Entamoeba invadens
VNGKD

SEQ ID NO: 2920401 - protein, 8 aa, Entamoeba invadens
VNGKGGRK

SEQ ID NO: 2920402 - protein, 12 aa, Entamoeba invadens
VNGKKGNANLNI

SEQ ID NO: 2920403 - protein, 18 aa, Entamoeba invadens
VNGKKKTLKGETVKKIAS

SEQ ID NO: 2920404 - protein, 9 aa, Entamoeba invadens
VNGKSGQKY

SEQ ID NO: 2920405 - protein, 6 aa, Entamoeba invadens
VNGKSQ

SEQ ID NO: 2920406 - protein, 10 aa, Entamoeba invadens
VNGKSTELKQ

SEQ ID NO: 2920407 - protein, 19 aa, Entamoeba invadens
VNGNEEFVDGRGTANVVNE

SEQ ID NO: 2920408 - protein, 9 aa, Entamoeba invadens
VNGNSSNQL

SEQ ID NO: 2920409 - protein, 6 aa, Entamoeba invadens
VNGPKE

SEQ ID NO: 2920410 - protein, 6 aa, Entamoeba invadens
VNGPRP

SEQ ID NO: 2920411 - protein, 5 aa, Entamoeba invadens
VNGQT

SEQ ID NO: 2920412 - protein, 4 aa, Entamoeba invadens
VNGS

SEQ ID NO: 2920413 - protein, 10 aa, Entamoeba invadens
VNGSGDVVPS

SEQ ID NO: 2920414 - protein, 14 aa, Entamoeba invadens
VNGSGNFSVKKSSA

SEQ ID NO: 2920415 - protein, 6 aa, Entamoeba invadens
VNGTRK

SEQ ID NO: 2920416 - protein, 11 aa, Entamoeba invadens
VNGTSGGMSVT

SEQ ID NO: 2920417 - protein, 7 aa, Entamoeba invadens
VNGTYTG

SEQ ID NO: 2920418 - protein, 4 aa, Entamoeba invadens
VNGV

SEQ ID NO: 2920419 - protein, 5 aa, Entamoeba invadens
VNGVR

SEQ ID NO: 2920420 - protein, 5 aa, Entamoeba invadens
VNHPE

SEQ ID NO: 2920421 - protein, 4 aa, Entamoeba invadens
VNHT

SEQ ID NO: 2920422 - protein, 7 aa, Entamoeba invadens
VNIEDPS

SEQ ID NO: 2920423 - protein, 4 aa, Entamoeba invadens
VNIG

SEQ ID NO: 2920424 - protein, 8 aa, Entamoeba invadens
VNIPSNVK

SEQ ID NO: 2920425 - protein, 11 aa, Entamoeba invadens
VNIPSSVKSIS

SEQ ID NO: 2920426 - protein, 8 aa, Entamoeba invadens
VNIPSSVR

SEQ ID NO: 2920427 - protein, 13 aa, Entamoeba invadens
VNIPSSVTSVGNG

SEQ ID NO: 2920428 - protein, 8 aa, Entamoeba invadens
VNIPSTVT

SEQ ID NO: 2920429 - protein, 4 aa, Entamoeba invadens
VNIR

SEQ ID NO: 2920430 - protein, 15 aa, Entamoeba invadens
VNKAKKILKEDTSKL

SEQ ID NO: 2920431 - protein, 8 aa, Entamoeba invadens
VNKDETTL

SEQ ID NO: 2920432 - protein, 17 aa, Entamoeba invadens
VNKDIDDKTENDVSELK

SEQ ID NO: 2920433 - protein, 10 aa, Entamoeba invadens
VNKDSTTGEF

SEQ ID NO: 2920434 - protein, 12 aa, Entamoeba invadens
VNKEEKGKANKT

SEQ ID NO: 2920435 - protein, 5 aa, Entamoeba invadens
VNKEG

SEQ ID NO: 2920436 - protein, 7 aa, Entamoeba invadens
VNKENAQ

SEQ ID NO: 2920437 - protein, 12 aa, Entamoeba invadens
VNKGPKKVTQDD

SEQ ID NO: 2920438 - protein, 9 aa, Entamoeba invadens
VNKGSQKYE

SEQ ID NO: 2920439 - protein, 26 aa, Entamoeba invadens
VNKKEEGEMKSEEKPGKDDKSEQSDL

SEQ ID NO: 2920440 - protein, 9 aa, Entamoeba invadens
VNKKGKLQT

SEQ ID NO: 2920441 - protein, 13 aa, Entamoeba invadens
VNKKTEIKKETCN

SEQ ID NO: 2920442 - protein, 10 aa, Entamoeba invadens
VNKLKEEKTV

SEQ ID NO: 2920443 - protein, 8 aa, Entamoeba invadens
VNKNDTQF

SEQ ID NO: 2920444 - protein, 8 aa, Entamoeba invadens
VNKNTKKI

SEQ ID NO: 2920445 - protein, 11 aa, Entamoeba invadens
VNKPVKPKNQK

SEQ ID NO: 2920446 - protein, 8 aa, Entamoeba invadens
VNKQQNEM

SEQ ID NO: 2920447 - protein, 6 aa, Entamoeba invadens
VNKSPV

SEQ ID NO: 2920448 - protein, 13 aa, Entamoeba invadens
VNKSTEKPQTDSK

SEQ ID NO: 2920449 - protein, 5 aa, Entamoeba invadens
VNKTC

SEQ ID NO: 2920450 - protein, 5 aa, Entamoeba invadens
VNKTP

SEQ ID NO: 2920451 - protein, 10 aa, Entamoeba invadens
VNKTSQSTDQ

SEQ ID NO: 2920452 - protein, 9 aa, Entamoeba invadens
VNKYDVQSK

SEQ ID NO: 2920453 - protein, 13 aa, Entamoeba invadens
VNLEGRVERPPIH

SEQ ID NO: 2920454 - protein, 26 aa, Entamoeba invadens
VNLNDDGKDERDGEKVDESEKERGEK

SEQ ID NO: 2920455 - protein, 11 aa, Entamoeba invadens
VNLNKTSNIEK

SEQ ID NO: 2920456 - protein, 6 aa, Entamoeba invadens
VNLPPP

SEQ ID NO: 2920457 - protein, 4 aa, Entamoeba invadens
VNND

SEQ ID NO: 2920458 - protein, 7 aa, Entamoeba invadens
VNNDPLT

SEQ ID NO: 2920459 - protein, 21 aa, Entamoeba invadens
VNNGKVIDNDGKVEKIIKALG

SEQ ID NO: 2920460 - protein, 6 aa, Entamoeba invadens
VNNGPQ

SEQ ID NO: 2920461 - protein, 12 aa, Entamoeba invadens
VNNKNIKETQNV

SEQ ID NO: 2920462 - protein, 5 aa, Entamoeba invadens
VNNLP

SEQ ID NO: 2920463 - protein, 9 aa, Entamoeba invadens
VNNNRDIQY

SEQ ID NO: 2920464 - protein, 9 aa, Entamoeba invadens
VNNNTDPKD

SEQ ID NO: 2920465 - protein, 29 aa, Entamoeba invadens
VNNNTTEHKMGEEASGPSECGRCTGENGY

SEQ ID NO: 2920466 - protein, 12 aa, Entamoeba invadens
VNNPEHTRDASY

SEQ ID NO: 2920467 - protein, 9 aa, Entamoeba invadens
VNNPGPRSI

SEQ ID NO: 2920468 - protein, 5 aa, Entamoeba invadens
VNNQD

SEQ ID NO: 2920469 - protein, 10 aa, Entamoeba invadens
VNNQEEDDEE

SEQ ID NO: 2920470 - protein, 11 aa, Entamoeba invadens
VNNQPTTSVPG

SEQ ID NO: 2920471 - protein, 17 aa, Entamoeba invadens
VNNSETIKKPNTLPAQN

SEQ ID NO: 2920472 - protein, 9 aa, Entamoeba invadens
VNNTDNAES

SEQ ID NO: 2920473 - protein, 8 aa, Entamoeba invadens
VNNTQQSQ

SEQ ID NO: 2920474 - protein, 13 aa, Entamoeba invadens
VNNTTQQPQTNTM

SEQ ID NO: 2920475 - protein, 9 aa, Entamoeba invadens
VNNTTQSRQ

SEQ ID NO: 2920476 - protein, 7 aa, Entamoeba invadens
VNNYNPY

SEQ ID NO: 2920477 - protein, 9 aa, Entamoeba invadens
VNPADNDKI

SEQ ID NO: 2920478 - protein, 6 aa, Entamoeba invadens
VNPATI

SEQ ID NO: 2920479 - protein, 4 aa, Entamoeba invadens
VNPD

SEQ ID NO: 2920480 - protein, 5 aa, Entamoeba invadens
VNPDK

SEQ ID NO: 2920481 - protein, 6 aa, Entamoeba invadens
VNPEER

SEQ ID NO: 2920482 - protein, 5 aa, Entamoeba invadens
VNPET

SEQ ID NO: 2920483 - protein, 6 aa, Entamoeba invadens
VNPGEM

SEQ ID NO: 2920484 - protein, 10 aa, Entamoeba invadens
VNPGQPCSTL

SEQ ID NO: 2920485 - protein, 9 aa, Entamoeba invadens
VNPKKDVQS

SEQ ID NO: 2920486 - protein, 10 aa, Entamoeba invadens
VNPKPNADAV

SEQ ID NO: 2920487 - protein, 9 aa, Entamoeba invadens
VNPKRVVGE

SEQ ID NO: 2920488 - protein, 10 aa, Entamoeba invadens
VNPKSATGGY

SEQ ID NO: 2920489 - protein, 10 aa, Entamoeba invadens
VNPKTTEDTL

SEQ ID NO: 2920490 - protein, 8 aa, Entamoeba invadens
VNPKVTPQ

SEQ ID NO: 2920491 - protein, 4 aa, Entamoeba invadens
VNPN

SEQ ID NO: 2920492 - protein, 6 aa, Entamoeba invadens
VNPNGM

SEQ ID NO: 2920493 - protein, 8 aa, Entamoeba invadens
VNPPADRV

SEQ ID NO: 2920494 - protein, 10 aa, Entamoeba invadens
VNPPQRNGGG

SEQ ID NO: 2920495 - protein, 6 aa, Entamoeba invadens
VNPQND

SEQ ID NO: 2920496 - protein, 5 aa, Entamoeba invadens
VNPRD

SEQ ID NO: 2920497 - protein, 6 aa, Entamoeba invadens
VNPRNK

SEQ ID NO: 2920498 - protein, 4 aa, Entamoeba invadens
VNPS

SEQ ID NO: 2920499 - protein, 7 aa, Entamoeba invadens
VNPSGRL

SEQ ID NO: 2920500 - protein, 12 aa, Entamoeba invadens
VNPSGSRFSDGS

SEQ ID NO: 2920501 - protein, 9 aa, Entamoeba invadens
VNPSNSLDS

SEQ ID NO: 2920502 - protein, 8 aa, Entamoeba invadens
VNPSQNSV

SEQ ID NO: 2920503 - protein, 8 aa, Entamoeba invadens
VNPTEPEL

SEQ ID NO: 2920504 - protein, 7 aa, Entamoeba invadens
VNPTIDR

SEQ ID NO: 2920505 - protein, 7 aa, Entamoeba invadens
VNPTKVS

SEQ ID NO: 2920506 - protein, 24 aa, Entamoeba invadens
VNPVDDNGGEILPGNDDDVNVGNP

SEQ ID NO: 2920507 - protein, 23 aa, Entamoeba invadens
VNQARRDAKKAKKAAATKPVKKA

SEQ ID NO: 2920508 - protein, 23 aa, Entamoeba invadens
VNQARRDAKKAKKAAATKPVKKV

SEQ ID NO: 2920509 - protein, 19 aa, Entamoeba invadens
VNQDPKTGGYSIQFVQTPT

SEQ ID NO: 2920510 - protein, 6 aa, Entamoeba invadens
VNQEAN

SEQ ID NO: 2920511 - protein, 23 aa, Entamoeba invadens
VNQKEEAKKDVKEVKETPKANTC

SEQ ID NO: 2920512 - protein, 12 aa, Entamoeba invadens
VNQKKKTGFLFW

SEQ ID NO: 2920513 - protein, 14 aa, Entamoeba invadens
VNQLNARDGCGRTP

SEQ ID NO: 2920514 - protein, 9 aa, Entamoeba invadens
VNQNSSAVN

SEQ ID NO: 2920515 - protein, 7 aa, Entamoeba invadens
VNQSDFD

SEQ ID NO: 2920516 - protein, 20 aa, Entamoeba invadens
VNQSSFREGLDSINDKATSP

SEQ ID NO: 2920517 - protein, 7 aa, Entamoeba invadens
VNQTPKI

SEQ ID NO: 2920518 - protein, 9 aa, Entamoeba invadens
VNRDNEKSV

SEQ ID NO: 2920519 - protein, 13 aa, Entamoeba invadens
VNRINQSTKDLQQ

SEQ ID NO: 2920520 - protein, 9 aa, Entamoeba invadens
VNRKDAKQI

SEQ ID NO: 2920521 - protein, 15 aa, Entamoeba invadens
VNRKGGNLFPVKLEA

SEQ ID NO: 2920522 - protein, 10 aa, Entamoeba invadens
VNRKGKAQQK

SEQ ID NO: 2920523 - protein, 6 aa, Entamoeba invadens
VNRNKL

SEQ ID NO: 2920524 - protein, 9 aa, Entamoeba invadens
VNRNKNRNI

SEQ ID NO: 2920525 - protein, 9 aa, Entamoeba invadens
VNRNKSRNI

SEQ ID NO: 2920526 - protein, 12 aa, Entamoeba invadens
VNRQRGDGGRFC

SEQ ID NO: 2920527 - protein, 10 aa, Entamoeba invadens
VNRSRKQCRE

SEQ ID NO: 2920528 - protein, 11 aa, Entamoeba invadens
VNRTTIQSEGF

SEQ ID NO: 2920529 - protein, 5 aa, Entamoeba invadens
VNRVG

SEQ ID NO: 2920530 - protein, 10 aa, Entamoeba invadens
VNSAAKKYKS

SEQ ID NO: 2920531 - protein, 9 aa, Entamoeba invadens
VNSAASLAN

SEQ ID NO: 2920532 - protein, 12 aa, Entamoeba invadens
VNSDCKDNLTNC

SEQ ID NO: 2920533 - protein, 10 aa, Entamoeba invadens
VNSDQEHFEE

SEQ ID NO: 2920534 - protein, 11 aa, Entamoeba invadens
VNSEDTQKMHS

SEQ ID NO: 2920535 - protein, 11 aa, Entamoeba invadens
VNSEVASQIKS

SEQ ID NO: 2920536 - protein, 8 aa, Entamoeba invadens
VNSEVTTN

SEQ ID NO: 2920537 - protein, 12 aa, Entamoeba invadens
VNSGVTALTRSN

SEQ ID NO: 2920538 - protein, 28 aa, Entamoeba invadens
VNSISSKAFSKEDDDFDDDQDEEKNDSI

SEQ ID NO: 2920539 - protein, 14 aa, Entamoeba invadens
VNSKEPQTKTYPPL

SEQ ID NO: 2920540 - protein, 7 aa, Entamoeba invadens
VNSKNEK

SEQ ID NO: 2920541 - protein, 8 aa, Entamoeba invadens
VNSLDSDS

SEQ ID NO: 2920542 - protein, 14 aa, Entamoeba invadens
VNSLGSPVQGASIT

SEQ ID NO: 2920543 - protein, 10 aa, Entamoeba invadens
VNSNGKPFKV

SEQ ID NO: 2920544 - protein, 8 aa, Entamoeba invadens
VNSPSQTY

SEQ ID NO: 2920545 - protein, 6 aa, Entamoeba invadens
VNSQQR

SEQ ID NO: 2920546 - protein, 14 aa, Entamoeba invadens
VNSQTEESSQPTTS

SEQ ID NO: 2920547 - protein, 14 aa, Entamoeba invadens
VNSQTEESSQSTTS

SEQ ID NO: 2920548 - protein, 7 aa, Entamoeba invadens
VNSRGQS

SEQ ID NO: 2920549 - protein, 4 aa, Entamoeba invadens
VNSS

SEQ ID NO: 2920550 - protein, 13 aa, Entamoeba invadens
VNSSGSTTTTYKS

SEQ ID NO: 2920551 - protein, 18 aa, Entamoeba invadens
VNSTKKSEIENKLSSEKL

SEQ ID NO: 2920552 - protein, 10 aa, Entamoeba invadens
VNSTNRNNTV

SEQ ID NO: 2920553 - protein, 5 aa, Entamoeba invadens
VNSTT

SEQ ID NO: 2920554 - protein, 11 aa, Entamoeba invadens
VNSYSKSRESI

SEQ ID NO: 2920555 - protein, 6 aa, Entamoeba invadens
VNTAKY

SEQ ID NO: 2920556 - protein, 10 aa, Entamoeba invadens
VNTASPNDLT

SEQ ID NO: 2920557 - protein, 7 aa, Entamoeba invadens
VNTASSM

SEQ ID NO: 2920558 - protein, 17 aa, Entamoeba invadens
VNTDDKEIKDKLANGYD

SEQ ID NO: 2920559 - protein, 13 aa, Entamoeba invadens
VNTDSGLKPAPLR

SEQ ID NO: 2920560 - protein, 4 aa, Entamoeba invadens
VNTE

SEQ ID NO: 2920561 - protein, 19 aa, Entamoeba invadens
VNTEKGEEKKNVIREENLG

SEQ ID NO: 2920562 - protein, 25 aa, Entamoeba invadens
VNTEPVNGNRPVTNTASALKKQKKI

SEQ ID NO: 2920563 - protein, 10 aa, Entamoeba invadens
VNTEQSTKLN

SEQ ID NO: 2920564 - protein, 6 aa, Entamoeba invadens
VNTETR

SEQ ID NO: 2920565 - protein, 6 aa, Entamoeba invadens
VNTFSK

SEQ ID NO: 2920566 - protein, 8 aa, Entamoeba invadens
VNTFSSEG

SEQ ID NO: 2920567 - protein, 9 aa, Entamoeba invadens
VNTGGQGSF

SEQ ID NO: 2920568 - protein, 8 aa, Entamoeba invadens
VNTGQGLQ

SEQ ID NO: 2920569 - protein, 4 aa, Entamoeba invadens
VNTH

SEQ ID NO: 2920570 - protein, 6 aa, Entamoeba invadens
VNTIND

SEQ ID NO: 2920571 - protein, 14 aa, Entamoeba invadens
VNTKIKPEKGTTRG

SEQ ID NO: 2920572 - protein, 5 aa, Entamoeba invadens
VNTKN

SEQ ID NO: 2920573 - protein, 17 aa, Entamoeba invadens
VNTKRVSGENFYQFPIE

SEQ ID NO: 2920574 - protein, 23 aa, Entamoeba invadens
VNTKVSQLKEKKKAYQDKVKNKI

SEQ ID NO: 2920575 - protein, 7 aa, Entamoeba invadens
VNTNGEN

SEQ ID NO: 2920576 - protein, 5 aa, Entamoeba invadens
VNTNL

SEQ ID NO: 2920577 - protein, 56 aa, Entamoeba invadens
VNTNPFADAPPPVATTSANTNPFASESTTTTSATQLPLPAKPQVPPKSKTPKPQIA

SEQ ID NO: 2920578 - protein, 6 aa, Entamoeba invadens
VNTNQR

SEQ ID NO: 2920579 - protein, 7 aa, Entamoeba invadens
VNTPHPD

SEQ ID NO: 2920580 - protein, 7 aa, Entamoeba invadens
VNTPNPK

SEQ ID NO: 2920581 - protein, 60 aa, Entamoeba invadens
VNTPQNANKTLSQEKEEKEQATGKRKKRAKGRKDTKRKNESKDKAEKPKRKKEQKEATKA

SEQ ID NO: 2920582 - protein, 5 aa, Entamoeba invadens
VNTQL

SEQ ID NO: 2920583 - protein, 7 aa, Entamoeba invadens
VNTQRKK

SEQ ID NO: 2920584 - protein, 7 aa, Entamoeba invadens
VNTQSKS

SEQ ID NO: 2920585 - protein, 15 aa, Entamoeba invadens
VNTQTPQNVPSDRHV

SEQ ID NO: 2920586 - protein, 34 aa, Entamoeba invadens
VNTRENNDQLKRLKEKNTTPITTKQGAAKAKEIG

SEQ ID NO: 2920587 - protein, 7 aa, Entamoeba invadens
VNTRGVV

SEQ ID NO: 2920588 - protein, 6 aa, Entamoeba invadens
VNTSDS

SEQ ID NO: 2920589 - protein, 10 aa, Entamoeba invadens
VNTSPNPFEQ

SEQ ID NO: 2920590 - protein, 7 aa, Entamoeba invadens
VNTTDKS

SEQ ID NO: 2920591 - protein, 6 aa, Entamoeba invadens
VNTTED

SEQ ID NO: 2920592 - protein, 12 aa, Entamoeba invadens
VNTTIKQSAERL

SEQ ID NO: 2920593 - protein, 13 aa, Entamoeba invadens
VNTTKDQFSSQTH

SEQ ID NO: 2920594 - protein, 5 aa, Entamoeba invadens
VNTTL

SEQ ID NO: 2920595 - protein, 8 aa, Entamoeba invadens
VNTTPNVP

SEQ ID NO: 2920596 - protein, 9 aa, Entamoeba invadens
VNTTTESRQ

SEQ ID NO: 2920597 - protein, 11 aa, Entamoeba invadens
VNTTTTDNQTP

SEQ ID NO: 2920598 - protein, 4 aa, Entamoeba invadens
VNVK

SEQ ID NO: 2920599 - protein, 8 aa, Entamoeba invadens
VNVKGGSL

SEQ ID NO: 2920600 - protein, 15 aa, Entamoeba invadens
VNVKKSDKCDNDSIK

SEQ ID NO: 2920601 - protein, 4 aa, Entamoeba invadens
VNVP

SEQ ID NO: 2920602 - protein, 5 aa, Entamoeba invadens
VNVRK

SEQ ID NO: 2920603 - protein, 9 aa, Entamoeba invadens
VNVRSDTTV

SEQ ID NO: 2920604 - protein, 10 aa, Entamoeba invadens
VNYEDINKGR

SEQ ID NO: 2920605 - protein, 7 aa, Entamoeba invadens
VNYGEEK

SEQ ID NO: 2920606 - protein, 8 aa, Entamoeba invadens
VNYGENSK

SEQ ID NO: 2920607 - protein, 9 aa, Entamoeba invadens
VNYKSSNPA

SEQ ID NO: 2920608 - protein, 19 aa, Entamoeba invadens
VNYNTVDTTVKNTSSVSPL

SEQ ID NO: 2920609 - protein, 10 aa, Entamoeba invadens
VNYSKKDRNL

SEQ ID NO: 2920610 - protein, 6 aa, Entamoeba invadens
VNYSSY

SEQ ID NO: 2920611 - protein, 16 aa, Entamoeba invadens
VPADSRTNSCASEEMK

SEQ ID NO: 2920612 - protein, 6 aa, Entamoeba invadens
VPAGEN

SEQ ID NO: 2920613 - protein, 7 aa, Entamoeba invadens
VPAGLSV

SEQ ID NO: 2920614 - protein, 8 aa, Entamoeba invadens
VPAKGAKL

SEQ ID NO: 2920615 - protein, 14 aa, Entamoeba invadens
VPALSGRPGEWGVD

SEQ ID NO: 2920616 - protein, 19 aa, Entamoeba invadens
VPAPPNSVLKQEEKSVKCE

SEQ ID NO: 2920617 - protein, 14 aa, Entamoeba invadens
VPAQTPLSQLGPKD

SEQ ID NO: 2920618 - protein, 7 aa, Entamoeba invadens
VPATVKS

SEQ ID NO: 2920619 - protein, 11 aa, Entamoeba invadens
VPDASQSKMRN

SEQ ID NO: 2920620 - protein, 15 aa, Entamoeba invadens
VPDDDEKDKFETPLK

SEQ ID NO: 2920621 - protein, 17 aa, Entamoeba invadens
VPDEAQIEDHQKKSSIR

SEQ ID NO: 2920622 - protein, 15 aa, Entamoeba invadens
VPDEAQIEEHQKKSP

SEQ ID NO: 2920623 - protein, 5 aa, Entamoeba invadens
VPDEK

SEQ ID NO: 2920624 - protein, 36 aa, Entamoeba invadens
VPDEQTLKEQCAPPPKELKRSFSQNVQTNLKPKTIA

SEQ ID NO: 2920625 - protein, 7 aa, Entamoeba invadens
VPDETGR

SEQ ID NO: 2920626 - protein, 7 aa, Entamoeba invadens
VPDGAQR

SEQ ID NO: 2920627 - protein, 9 aa, Entamoeba invadens
VPDGTTPTE

SEQ ID NO: 2920628 - protein, 16 aa, Entamoeba invadens
VPDKEYEDAKQKLRQM

SEQ ID NO: 2920629 - protein, 5 aa, Entamoeba invadens
VPDNN

SEQ ID NO: 2920630 - protein, 6 aa, Entamoeba invadens
VPDNSL

SEQ ID NO: 2920631 - protein, 5 aa, Entamoeba invadens
VPDQK

SEQ ID NO: 2920632 - protein, 7 aa, Entamoeba invadens
VPDRAQG

SEQ ID NO: 2920633 - protein, 7 aa, Entamoeba invadens
VPDSKNT

SEQ ID NO: 2920634 - protein, 20 aa, Entamoeba invadens
VPDSPESAAEPPDEKESEKI

SEQ ID NO: 2920635 - protein, 6 aa, Entamoeba invadens
VPDSTY

SEQ ID NO: 2920636 - protein, 6 aa, Entamoeba invadens
VPDSVT

SEQ ID NO: 2920637 - protein, 47 aa, Entamoeba invadens
VPDTKDEAIPLEKQPAEEHKEVEKEKGEEEISKIENEKMPEEPIQDD

SEQ ID NO: 2920638 - protein, 10 aa, Entamoeba invadens
VPDTSDGDDV

SEQ ID NO: 2920639 - protein, 13 aa, Entamoeba invadens
VPEDATEEQMSNV

SEQ ID NO: 2920640 - protein, 41 aa, Entamoeba invadens
VPEDNTVPPLPSFSPSKDSDDSLSEPTLSSTSNCSTPSPHT

SEQ ID NO: 2920641 - protein, 10 aa, Entamoeba invadens
VPEDTKLDQQ

SEQ ID NO: 2920642 - protein, 5 aa, Entamoeba invadens
VPEDV

SEQ ID NO: 2920643 - protein, 30 aa, Entamoeba invadens
VPEEAKQIKRYDPNDDKKATTSKADSTEMY

SEQ ID NO: 2920644 - protein, 14 aa, Entamoeba invadens
VPEEEIDQQMEEDY

SEQ ID NO: 2920645 - protein, 6 aa, Entamoeba invadens
VPEEFP

SEQ ID NO: 2920646 - protein, 5 aa, Entamoeba invadens
VPEEG

SEQ ID NO: 2920647 - protein, 18 aa, Entamoeba invadens
VPEFDASEDIPNSPKNQL

SEQ ID NO: 2920648 - protein, 4 aa, Entamoeba invadens
VPEG

SEQ ID NO: 2920649 - protein, 11 aa, Entamoeba invadens
VPEGEEANYPR

SEQ ID NO: 2920650 - protein, 8 aa, Entamoeba invadens
VPEKRPQI

SEQ ID NO: 2920651 - protein, 4 aa, Entamoeba invadens
VPEN

SEQ ID NO: 2920652 - protein, 5 aa, Entamoeba invadens
VPENS

SEQ ID NO: 2920653 - protein, 5 aa, Entamoeba invadens
VPENT

SEQ ID NO: 2920654 - protein, 11 aa, Entamoeba invadens
VPEPGQKNKEI

SEQ ID NO: 2920655 - protein, 22 aa, Entamoeba invadens
VPEPKFSSQTKDKLVSSEVRAP

SEQ ID NO: 2920656 - protein, 6 aa, Entamoeba invadens
VPEPQE

SEQ ID NO: 2920657 - protein, 19 aa, Entamoeba invadens
VPEPTEAQQAQKPSEETFD

SEQ ID NO: 2920658 - protein, 14 aa, Entamoeba invadens
VPERSLNDKKPLRV

SEQ ID NO: 2920659 - protein, 11 aa, Entamoeba invadens
VPERSRLDTQP

SEQ ID NO: 2920660 - protein, 9 aa, Entamoeba invadens
VPERSRNSV

SEQ ID NO: 2920661 - protein, 4 aa, Entamoeba invadens
VPES

SEQ ID NO: 2920662 - protein, 10 aa, Entamoeba invadens
VPESKTPTKK

SEQ ID NO: 2920663 - protein, 5 aa, Entamoeba invadens
VPEST

SEQ ID NO: 2920664 - protein, 4 aa, Entamoeba invadens
VPET

SEQ ID NO: 2920665 - protein, 5 aa, Entamoeba invadens
VPETL

SEQ ID NO: 2920666 - protein, 8 aa, Entamoeba invadens
VPFENSKS

SEQ ID NO: 2920667 - protein, 5 aa, Entamoeba invadens
VPFNS

SEQ ID NO: 2920668 - protein, 11 aa, Entamoeba invadens
VPFNSEDGKKY

SEQ ID NO: 2920669 - protein, 4 aa, Entamoeba invadens
VPFP

SEQ ID NO: 2920670 - protein, 6 aa, Entamoeba invadens
VPFPET

SEQ ID NO: 2920671 - protein, 15 aa, Entamoeba invadens
VPFPKDKNYRPPQIS

SEQ ID NO: 2920672 - protein, 7 aa, Entamoeba invadens
VPFSNSP

SEQ ID NO: 2920673 - protein, 9 aa, Entamoeba invadens
VPGAQFEGE

SEQ ID NO: 2920674 - protein, 13 aa, Entamoeba invadens
VPGEFTGESENTE

SEQ ID NO: 2920675 - protein, 7 aa, Entamoeba invadens
VPGETRL

SEQ ID NO: 2920676 - protein, 4 aa, Entamoeba invadens
VPGI

SEQ ID NO: 2920677 - protein, 4 aa, Entamoeba invadens
VPGK

SEQ ID NO: 2920678 - protein, 12 aa, Entamoeba invadens
VPGKSSEKATEI

SEQ ID NO: 2920679 - protein, 11 aa, Entamoeba invadens
VPGKVTKEEGI

SEQ ID NO: 2920680 - protein, 7 aa, Entamoeba invadens
VPGQNEG

SEQ ID NO: 2920681 - protein, 7 aa, Entamoeba invadens
VPGSNPL

SEQ ID NO: 2920682 - protein, 5 aa, Entamoeba invadens
VPGSY

SEQ ID NO: 2920683 - protein, 4 aa, Entamoeba invadens
VPGY

SEQ ID NO: 2920684 - protein, 4 aa, Entamoeba invadens
VPHD

SEQ ID NO: 2920685 - protein, 6 aa, Entamoeba invadens
VPHDGA

SEQ ID NO: 2920686 - protein, 5 aa, Entamoeba invadens
VPHEG

SEQ ID NO: 2920687 - protein, 8 aa, Entamoeba invadens
VPHKPQQT

SEQ ID NO: 2920688 - protein, 18 aa, Entamoeba invadens
VPHPEDTGFIQTGYSQQY

SEQ ID NO: 2920689 - protein, 5 aa, Entamoeba invadens
VPIGN

SEQ ID NO: 2920690 - protein, 5 aa, Entamoeba invadens
VPIPN

SEQ ID NO: 2920691 - protein, 11 aa, Entamoeba invadens
VPIQTADRRFN

SEQ ID NO: 2920692 - protein, 6 aa, Entamoeba invadens
VPISDK

SEQ ID NO: 2920693 - protein, 15 aa, Entamoeba invadens
VPISRKEERTPTRDY

SEQ ID NO: 2920694 - protein, 5 aa, Entamoeba invadens
VPITD

SEQ ID NO: 2920695 - protein, 8 aa, Entamoeba invadens
VPKDDTPD

SEQ ID NO: 2920696 - protein, 28 aa, Entamoeba invadens
VPKDNGLQNQHQTAQETNQSQKTLGPQP

SEQ ID NO: 2920697 - protein, 10 aa, Entamoeba invadens
VPKDPSSFEQ

SEQ ID NO: 2920698 - protein, 8 aa, Entamoeba invadens
VPKDSIES

SEQ ID NO: 2920699 - protein, 8 aa, Entamoeba invadens
VPKEKGNW

SEQ ID NO: 2920700 - protein, 5 aa, Entamoeba invadens
VPKEN

SEQ ID NO: 2920701 - protein, 11 aa, Entamoeba invadens
VPKENKVIGKT

SEQ ID NO: 2920702 - protein, 24 aa, Entamoeba invadens
VPKEPSTSAQQDKPSDTKEEKHEQ

SEQ ID NO: 2920703 - protein, 15 aa, Entamoeba invadens
VPKEPTNESFLLGEV

SEQ ID NO: 2920704 - protein, 5 aa, Entamoeba invadens
VPKET

SEQ ID NO: 2920705 - protein, 8 aa, Entamoeba invadens
VPKEVGDQ

SEQ ID NO: 2920706 - protein, 8 aa, Entamoeba invadens
VPKGDMAS

SEQ ID NO: 2920707 - protein, 8 aa, Entamoeba invadens
VPKGITEL

SEQ ID NO: 2920708 - protein, 6 aa, Entamoeba invadens
VPKGYY

SEQ ID NO: 2920709 - protein, 21 aa, Entamoeba invadens
VPKKQLDNIKKRGRKGEENYD

SEQ ID NO: 2920710 - protein, 4 aa, Entamoeba invadens
VPKL

SEQ ID NO: 2920711 - protein, 8 aa, Entamoeba invadens
VPKNVTSI

SEQ ID NO: 2920712 - protein, 8 aa, Entamoeba invadens
VPKPDTKR

SEQ ID NO: 2920713 - protein, 12 aa, Entamoeba invadens
VPKPQKELTCCL

SEQ ID NO: 2920714 - protein, 6 aa, Entamoeba invadens
VPKPQS

SEQ ID NO: 2920715 - protein, 10 aa, Entamoeba invadens
VPKPSNESLN

SEQ ID NO: 2920716 - protein, 5 aa, Entamoeba invadens
VPKPV

SEQ ID NO: 2920717 - protein, 7 aa, Entamoeba invadens
VPKRQRD

SEQ ID NO: 2920718 - protein, 33 aa, Entamoeba invadens
VPKSEDIPKPTKMEEEEVKHEEPPKEEPKHEEI

SEQ ID NO: 2920719 - protein, 26 aa, Entamoeba invadens
VPKSPEHLGSPRSPKLSPSPEFDDSD

SEQ ID NO: 2920720 - protein, 11 aa, Entamoeba invadens
VPKSTNANRLK

SEQ ID NO: 2920721 - protein, 6 aa, Entamoeba invadens
VPKTDK

SEQ ID NO: 2920722 - protein, 15 aa, Entamoeba invadens
VPKTESTRHIVMRFK

SEQ ID NO: 2920723 - protein, 8 aa, Entamoeba invadens
VPKTRTFE

SEQ ID NO: 2920724 - protein, 5 aa, Entamoeba invadens
VPKTS

SEQ ID NO: 2920725 - protein, 14 aa, Entamoeba invadens
VPKVEEKKEENVEE

SEQ ID NO: 2920726 - protein, 5 aa, Entamoeba invadens
VPKYQ

SEQ ID NO: 2920727 - protein, 8 aa, Entamoeba invadens
VPLEGKGT

SEQ ID NO: 2920728 - protein, 8 aa, Entamoeba invadens
VPLGNPKE

SEQ ID NO: 2920729 - protein, 18 aa, Entamoeba invadens
VPLGQSSQNISNIPTQDT

SEQ ID NO: 2920730 - protein, 7 aa, Entamoeba invadens
VPLPSRA

SEQ ID NO: 2920731 - protein, 5 aa, Entamoeba invadens
VPLPT

SEQ ID NO: 2920732 - protein, 12 aa, Entamoeba invadens
VPLQDTKEVKDE

SEQ ID NO: 2920733 - protein, 5 aa, Entamoeba invadens
VPLRE

SEQ ID NO: 2920734 - protein, 9 aa, Entamoeba invadens
VPLTSSYKN

SEQ ID NO: 2920735 - protein, 14 aa, Entamoeba invadens
VPMEQQDDDDPEFT

SEQ ID NO: 2920736 - protein, 4 aa, Entamoeba invadens
VPMK

SEQ ID NO: 2920737 - protein, 4 aa, Entamoeba invadens
VPND

SEQ ID NO: 2920738 - protein, 10 aa, Entamoeba invadens
VPNDKGSDKF

SEQ ID NO: 2920739 - protein, 5 aa, Entamoeba invadens
VPNDL

SEQ ID NO: 2920740 - protein, 10 aa, Entamoeba invadens
VPNDSNSSLR

SEQ ID NO: 2920741 - protein, 9 aa, Entamoeba invadens
VPNDTGTKV

SEQ ID NO: 2920742 - protein, 19 aa, Entamoeba invadens
VPNDVSLNNTTDEETIETD

SEQ ID NO: 2920743 - protein, 4 aa, Entamoeba invadens
VPNE

SEQ ID NO: 2920744 - protein, 5 aa, Entamoeba invadens
VPNEE

SEQ ID NO: 2920745 - protein, 6 aa, Entamoeba invadens
VPNENY

SEQ ID NO: 2920746 - protein, 5 aa, Entamoeba invadens
VPNGS

SEQ ID NO: 2920747 - protein, 7 aa, Entamoeba invadens
VPNGTNR

SEQ ID NO: 2920748 - protein, 4 aa, Entamoeba invadens
VPNI

SEQ ID NO: 2920749 - protein, 8 aa, Entamoeba invadens
VPNKGSEE

SEQ ID NO: 2920750 - protein, 13 aa, Entamoeba invadens
VPNKQKLSYSERR

SEQ ID NO: 2920751 - protein, 8 aa, Entamoeba invadens
VPNKSDDV

SEQ ID NO: 2920752 - protein, 25 aa, Entamoeba invadens
VPNLSKNSKSHNSQSCEKLSPIPRK

SEQ ID NO: 2920753 - protein, 6 aa, Entamoeba invadens
VPNNGE

SEQ ID NO: 2920754 - protein, 17 aa, Entamoeba invadens
VPNNNTQPVQSETFKQN

SEQ ID NO: 2920755 - protein, 18 aa, Entamoeba invadens
VPNPEVNEKIEEKKRRKY

SEQ ID NO: 2920756 - protein, 6 aa, Entamoeba invadens
VPNPME

SEQ ID NO: 2920757 - protein, 7 aa, Entamoeba invadens
VPNQKDL

SEQ ID NO: 2920758 - protein, 40 aa, Entamoeba invadens
VPNQSEKKERTYSTPFSQKQPKQKKTIPFKTRDSQKPIEV

SEQ ID NO: 2920759 - protein, 4 aa, Entamoeba invadens
VPNR

SEQ ID NO: 2920760 - protein, 12 aa, Entamoeba invadens
VPNSPVPTFSSS

SEQ ID NO: 2920761 - protein, 7 aa, Entamoeba invadens
VPNSTNK

SEQ ID NO: 2920762 - protein, 8 aa, Entamoeba invadens
VPNSTNKR

SEQ ID NO: 2920763 - protein, 6 aa, Entamoeba invadens
VPNSVT

SEQ ID NO: 2920764 - protein, 4 aa, Entamoeba invadens
VPNT

SEQ ID NO: 2920765 - protein, 7 aa, Entamoeba invadens
VPNTADL

SEQ ID NO: 2920766 - protein, 11 aa, Entamoeba invadens
VPNTDTAPDVA

SEQ ID NO: 2920767 - protein, 5 aa, Entamoeba invadens
VPNTP

SEQ ID NO: 2920768 - protein, 4 aa, Entamoeba invadens
VPNV

SEQ ID NO: 2920769 - protein, 4 aa, Entamoeba invadens
VPNY

SEQ ID NO: 2920770 - protein, 18 aa, Entamoeba invadens
VPPDVKRRKNKRGGKRVK

SEQ ID NO: 2920771 - protein, 4 aa, Entamoeba invadens
VPPE

SEQ ID NO: 2920772 - protein, 9 aa, Entamoeba invadens
VPPEDGRFE

SEQ ID NO: 2920773 - protein, 14 aa, Entamoeba invadens
VPPEEDTIDQPAVT

SEQ ID NO: 2920774 - protein, 6 aa, Entamoeba invadens
VPPEFT

SEQ ID NO: 2920775 - protein, 17 aa, Entamoeba invadens
VPPEKSFSNDDVSPPIP

SEQ ID NO: 2920776 - protein, 9 aa, Entamoeba invadens
VPPETEPEL

SEQ ID NO: 2920777 - protein, 5 aa, Entamoeba invadens
VPPIT

SEQ ID NO: 2920778 - protein, 7 aa, Entamoeba invadens
VPPKGLN

SEQ ID NO: 2920779 - protein, 9 aa, Entamoeba invadens
VPPKPPVFG

SEQ ID NO: 2920780 - protein, 11 aa, Entamoeba invadens
VPPKRITDING

SEQ ID NO: 2920781 - protein, 6 aa, Entamoeba invadens
VPPKTF

SEQ ID NO: 2920782 - protein, 7 aa, Entamoeba invadens
VPPLGDK

SEQ ID NO: 2920783 - protein, 6 aa, Entamoeba invadens
VPPLSG

SEQ ID NO: 2920784 - protein, 4 aa, Entamoeba invadens
VPPN

SEQ ID NO: 2920785 - protein, 6 aa, Entamoeba invadens
VPPNTG

SEQ ID NO: 2920786 - protein, 4 aa, Entamoeba invadens
VPPP

SEQ ID NO: 2920787 - protein, 7 aa, Entamoeba invadens
VPPPIAQ

SEQ ID NO: 2920788 - protein, 6 aa, Entamoeba invadens
VPPPIQ

SEQ ID NO: 2920789 - protein, 9 aa, Entamoeba invadens
VPPPLNPIE

SEQ ID NO: 2920790 - protein, 9 aa, Entamoeba invadens
VPPPLPPQS

SEQ ID NO: 2920791 - protein, 6 aa, Entamoeba invadens
VPPPNL

SEQ ID NO: 2920792 - protein, 27 aa, Entamoeba invadens
VPPPPSHQEAPKLEPKHTDITTDTSIG

SEQ ID NO: 2920793 - protein, 16 aa, Entamoeba invadens
VPPPPVNSDTAYIEKD

SEQ ID NO: 2920794 - protein, 46 aa, Entamoeba invadens
VPPPQHPPPFPNAPKKEEKEMKESKEVNRREKKTEHTEMKDEPEMK

SEQ ID NO: 2920795 - protein, 32 aa, Entamoeba invadens
VPPPQQIDSTKEVNEQKETQQKVQDQTTGGVT

SEQ ID NO: 2920796 - protein, 21 aa, Entamoeba invadens
VPPPQSSKRKLYESFNRKEED

SEQ ID NO: 2920797 - protein, 6 aa, Entamoeba invadens
VPPPSV

SEQ ID NO: 2920798 - protein, 23 aa, Entamoeba invadens
VPPPVKQKPTKEPRPQTQPETQP

SEQ ID NO: 2920799 - protein, 26 aa, Entamoeba invadens
VPPQKSTPPASPIKKPQPKKNPDDKP

SEQ ID NO: 2920800 - protein, 16 aa, Entamoeba invadens
VPPQSLGSIATEKLTT

SEQ ID NO: 2920801 - protein, 69 aa, Entamoeba invadens
VPPRTDAPKNGTYSKDKKTQKPFNKKQGGFGQKHDQHPKKHEKTLEEKKKEEEIKKKKEEAKKKAEEKK

SEQ ID NO: 2920802 - protein, 7 aa, Entamoeba invadens
VPPRVSS

SEQ ID NO: 2920803 - protein, 8 aa, Entamoeba invadens
VPPRVSSV

SEQ ID NO: 2920804 - protein, 11 aa, Entamoeba invadens
VPPSEKIQRQD

SEQ ID NO: 2920805 - protein, 5 aa, Entamoeba invadens
VPPSQ

SEQ ID NO: 2920806 - protein, 8 aa, Entamoeba invadens
VPPTERTS

SEQ ID NO: 2920807 - protein, 5 aa, Entamoeba invadens
VPPTL

SEQ ID NO: 2920808 - protein, 6 aa, Entamoeba invadens
VPPTNT

SEQ ID NO: 2920809 - protein, 30 aa, Entamoeba invadens
VPPTQSSRYKPERERGKKDVDDTDKNEYKY

SEQ ID NO: 2920810 - protein, 6 aa, Entamoeba invadens
VPPTRR

SEQ ID NO: 2920811 - protein, 30 aa, Entamoeba invadens
VPPTRSSRYKPERERGKKDVDDTDKNEYKY

SEQ ID NO: 2920812 - protein, 8 aa, Entamoeba invadens
VPPTVTQT

SEQ ID NO: 2920813 - protein, 4 aa, Entamoeba invadens
VPPV

SEQ ID NO: 2920814 - protein, 21 aa, Entamoeba invadens
VPPVEHGASPFVESENPKDII

SEQ ID NO: 2920815 - protein, 18 aa, Entamoeba invadens
VPPVPLQGDTRCGVTGQE

SEQ ID NO: 2920816 - protein, 6 aa, Entamoeba invadens
VPPYEP

SEQ ID NO: 2920817 - protein, 6 aa, Entamoeba invadens
VPQADP

SEQ ID NO: 2920818 - protein, 20 aa, Entamoeba invadens
VPQDKQGKITNTKRIDSTIP

SEQ ID NO: 2920819 - protein, 11 aa, Entamoeba invadens
VPQDKTKELPM

SEQ ID NO: 2920820 - protein, 4 aa, Entamoeba invadens
VPQE

SEQ ID NO: 2920821 - protein, 5 aa, Entamoeba invadens
VPQEI

SEQ ID NO: 2920822 - protein, 6 aa, Entamoeba invadens
VPQEKA

SEQ ID NO: 2920823 - protein, 20 aa, Entamoeba invadens
VPQEQSQPTQITEQTPQKQV

SEQ ID NO: 2920824 - protein, 14 aa, Entamoeba invadens
VPQETTTPPLPEKK

SEQ ID NO: 2920825 - protein, 11 aa, Entamoeba invadens
VPQGNKGVAEP

SEQ ID NO: 2920826 - protein, 4 aa, Entamoeba invadens
VPQH

SEQ ID NO: 2920827 - protein, 9 aa, Entamoeba invadens
VPQKCEKSA

SEQ ID NO: 2920828 - protein, 24 aa, Entamoeba invadens
VPQKEVQEEVQEPEPIDQQTQLEP

SEQ ID NO: 2920829 - protein, 11 aa, Entamoeba invadens
VPQKKETTFSL

SEQ ID NO: 2920830 - protein, 8 aa, Entamoeba invadens
VPQKSELP

SEQ ID NO: 2920831 - protein, 6 aa, Entamoeba invadens
VPQKTA

SEQ ID NO: 2920832 - protein, 12 aa, Entamoeba invadens
VPQLGDDLTTDA

SEQ ID NO: 2920833 - protein, 4 aa, Entamoeba invadens
VPQN

SEQ ID NO: 2920834 - protein, 8 aa, Entamoeba invadens
VPQNRPEM

SEQ ID NO: 2920835 - protein, 5 aa, Entamoeba invadens
VPQNV

SEQ ID NO: 2920836 - protein, 6 aa, Entamoeba invadens
VPQPET

SEQ ID NO: 2920837 - protein, 8 aa, Entamoeba invadens
VPQPSNST

SEQ ID NO: 2920838 - protein, 8 aa, Entamoeba invadens
VPQPTLPA

SEQ ID NO: 2920839 - protein, 5 aa, Entamoeba invadens
VPQQN

SEQ ID NO: 2920840 - protein, 9 aa, Entamoeba invadens
VPQQPSISI

SEQ ID NO: 2920841 - protein, 11 aa, Entamoeba invadens
VPQRDFKANPR

SEQ ID NO: 2920842 - protein, 5 aa, Entamoeba invadens
VPQRE

SEQ ID NO: 2920843 - protein, 6 aa, Entamoeba invadens
VPQSDG

SEQ ID NO: 2920844 - protein, 13 aa, Entamoeba invadens
VPQSKSANLQPQV

SEQ ID NO: 2920845 - protein, 8 aa, Entamoeba invadens
VPQSNNSF

SEQ ID NO: 2920846 - protein, 22 aa, Entamoeba invadens
VPQSYQQYSTTPLQQYPDYTGY

SEQ ID NO: 2920847 - protein, 27 aa, Entamoeba invadens
VPQTNEEKAPAIVNEGEAEMRNENSQS

SEQ ID NO: 2920848 - protein, 17 aa, Entamoeba invadens
VPQTSTNPLTGKPNSEK

SEQ ID NO: 2920849 - protein, 12 aa, Entamoeba invadens
VPQTVTKEEGDL

SEQ ID NO: 2920850 - protein, 8 aa, Entamoeba invadens
VPQVQPKV

SEQ ID NO: 2920851 - protein, 5 aa, Entamoeba invadens
VPREA

SEQ ID NO: 2920852 - protein, 13 aa, Entamoeba invadens
VPREKDVQKCEDS

SEQ ID NO: 2920853 - protein, 8 aa, Entamoeba invadens
VPREQPWP

SEQ ID NO: 2920854 - protein, 7 aa, Entamoeba invadens
VPRNYKK

SEQ ID NO: 2920855 - protein, 12 aa, Entamoeba invadens
VPRRSGNRLPPS

SEQ ID NO: 2920856 - protein, 4 aa, Entamoeba invadens
VPRT

SEQ ID NO: 2920857 - protein, 14 aa, Entamoeba invadens
VPRTQQQQAQPTPL

SEQ ID NO: 2920858 - protein, 14 aa, Entamoeba invadens
VPSAKKIQENGQIS

SEQ ID NO: 2920859 - protein, 7 aa, Entamoeba invadens
VPSAQTF

SEQ ID NO: 2920860 - protein, 4 aa, Entamoeba invadens
VPSD

SEQ ID NO: 2920861 - protein, 6 aa, Entamoeba invadens
VPSEPI

SEQ ID NO: 2920862 - protein, 14 aa, Entamoeba invadens
VPSFGHTKHVIFAK

SEQ ID NO: 2920863 - protein, 5 aa, Entamoeba invadens
VPSFT

SEQ ID NO: 2920864 - protein, 6 aa, Entamoeba invadens
VPSGKD

SEQ ID NO: 2920865 - protein, 15 aa, Entamoeba invadens
VPSGVGTKASIDFKE

SEQ ID NO: 2920866 - protein, 10 aa, Entamoeba invadens
VPSHGQLQEK

SEQ ID NO: 2920867 - protein, 7 aa, Entamoeba invadens
VPSKGRD

SEQ ID NO: 2920868 - protein, 12 aa, Entamoeba invadens
VPSKPLPPRPPM

SEQ ID NO: 2920869 - protein, 17 aa, Entamoeba invadens
VPSKQPKHTEKSNSGIV

SEQ ID NO: 2920870 - protein, 5 aa, Entamoeba invadens
VPSKS

SEQ ID NO: 2920871 - protein, 8 aa, Entamoeba invadens
VPSLRTSF

SEQ ID NO: 2920872 - protein, 8 aa, Entamoeba invadens
VPSNEHFK

SEQ ID NO: 2920873 - protein, 6 aa, Entamoeba invadens
VPSNGE

SEQ ID NO: 2920874 - protein, 7 aa, Entamoeba invadens
VPSNPQQ

SEQ ID NO: 2920875 - protein, 6 aa, Entamoeba invadens
VPSNSF

SEQ ID NO: 2920876 - protein, 17 aa, Entamoeba invadens
VPSNSLKKKEREPSPVL

SEQ ID NO: 2920877 - protein, 8 aa, Entamoeba invadens
VPSNVTSI

SEQ ID NO: 2920878 - protein, 7 aa, Entamoeba invadens
VPSPCSS

SEQ ID NO: 2920879 - protein, 6 aa, Entamoeba invadens
VPSPED

SEQ ID NO: 2920880 - protein, 8 aa, Entamoeba invadens
VPSPKIKN

SEQ ID NO: 2920881 - protein, 17 aa, Entamoeba invadens
VPSPRKSQKKKHSLSQS

SEQ ID NO: 2920882 - protein, 8 aa, Entamoeba invadens
VPSPSPFE

SEQ ID NO: 2920883 - protein, 10 aa, Entamoeba invadens
VPSPTEDIDE

SEQ ID NO: 2920884 - protein, 11 aa, Entamoeba invadens
VPSPYSTPFST

SEQ ID NO: 2920885 - protein, 6 aa, Entamoeba invadens
VPSSIS

SEQ ID NO: 2920886 - protein, 10 aa, Entamoeba invadens
VPSSQKATVL

SEQ ID NO: 2920887 - protein, 15 aa, Entamoeba invadens
VPSSQYIDTKENKKS

SEQ ID NO: 2920888 - protein, 15 aa, Entamoeba invadens
VPSSTTPSEKKSNFV

SEQ ID NO: 2920889 - protein, 6 aa, Entamoeba invadens
VPSSVR

SEQ ID NO: 2920890 - protein, 4 aa, Entamoeba invadens
VPST

SEQ ID NO: 2920891 - protein, 12 aa, Entamoeba invadens
VPSTCDTSYRIE

SEQ ID NO: 2920892 - protein, 17 aa, Entamoeba invadens
VPSTLTSVGKDSFQGCN

SEQ ID NO: 2920893 - protein, 7 aa, Entamoeba invadens
VPSTNSI

SEQ ID NO: 2920894 - protein, 32 aa, Entamoeba invadens
VPSTRKVSQTTLKSTNPNDSTKICSSPSLPSI

SEQ ID NO: 2920895 - protein, 4 aa, Entamoeba invadens
VPSY

SEQ ID NO: 2920896 - protein, 4 aa, Entamoeba invadens
VPTA

SEQ ID NO: 2920897 - protein, 14 aa, Entamoeba invadens
VPTAEVASPKRELG

SEQ ID NO: 2920898 - protein, 11 aa, Entamoeba invadens
VPTAPQGNEIE

SEQ ID NO: 2920899 - protein, 12 aa, Entamoeba invadens
VPTAQTSQQQEN

SEQ ID NO: 2920900 - protein, 6 aa, Entamoeba invadens
VPTASA

SEQ ID NO: 2920901 - protein, 7 aa, Entamoeba invadens
VPTASSL

SEQ ID NO: 2920902 - protein, 4 aa, Entamoeba invadens
VPTD

SEQ ID NO: 2920903 - protein, 8 aa, Entamoeba invadens
VPTDADPN

SEQ ID NO: 2920904 - protein, 51 aa, Entamoeba invadens
VPTDKTADEEESDSEHLSQASDEHSEEDESKKKHYDAEKLKTPPNPEDCKT

SEQ ID NO: 2920905 - protein, 5 aa, Entamoeba invadens
VPTEK

SEQ ID NO: 2920906 - protein, 5 aa, Entamoeba invadens
VPTEL

SEQ ID NO: 2920907 - protein, 8 aa, Entamoeba invadens
VPTERPSF

SEQ ID NO: 2920908 - protein, 4 aa, Entamoeba invadens
VPTF

SEQ ID NO: 2920909 - protein, 7 aa, Entamoeba invadens
VPTGKIS

SEQ ID NO: 2920910 - protein, 8 aa, Entamoeba invadens
VPTGPKEG

SEQ ID NO: 2920911 - protein, 4 aa, Entamoeba invadens
VPTI

SEQ ID NO: 2920912 - protein, 7 aa, Entamoeba invadens
VPTISSD

SEQ ID NO: 2920913 - protein, 8 aa, Entamoeba invadens
VPTKKPAE

SEQ ID NO: 2920914 - protein, 20 aa, Entamoeba invadens
VPTKTEEKVATEKVEEQKPV

SEQ ID NO: 2920915 - protein, 5 aa, Entamoeba invadens
VPTLK

SEQ ID NO: 2920916 - protein, 4 aa, Entamoeba invadens
VPTN

SEQ ID NO: 2920917 - protein, 5 aa, Entamoeba invadens
VPTNG

SEQ ID NO: 2920918 - protein, 8 aa, Entamoeba invadens
VPTNPNAM

SEQ ID NO: 2920919 - protein, 13 aa, Entamoeba invadens
VPTPESSKAKSVK

SEQ ID NO: 2920920 - protein, 6 aa, Entamoeba invadens
VPTPIQ

SEQ ID NO: 2920921 - protein, 4 aa, Entamoeba invadens
VPTQ

SEQ ID NO: 2920922 - protein, 9 aa, Entamoeba invadens
VPTQSDGAY

SEQ ID NO: 2920923 - protein, 7 aa, Entamoeba invadens
VPTREGG

SEQ ID NO: 2920924 - protein, 8 aa, Entamoeba invadens
VPTSEETQ

SEQ ID NO: 2920925 - protein, 9 aa, Entamoeba invadens
VPTSPSVEE

SEQ ID NO: 2920926 - protein, 8 aa, Entamoeba invadens
VPTSTYKA

SEQ ID NO: 2920927 - protein, 7 aa, Entamoeba invadens
VPTTDTQ

SEQ ID NO: 2920928 - protein, 6 aa, Entamoeba invadens
VPTTGG

SEQ ID NO: 2920929 - protein, 8 aa, Entamoeba invadens
VPTTGTLH

SEQ ID NO: 2920930 - protein, 21 aa, Entamoeba invadens
VPTTKRSSKYNEVTKPREVEN

SEQ ID NO: 2920931 - protein, 5 aa, Entamoeba invadens
VPTTL

SEQ ID NO: 2920932 - protein, 6 aa, Entamoeba invadens
VPTTLS

SEQ ID NO: 2920933 - protein, 7 aa, Entamoeba invadens
VPTTQQT

SEQ ID NO: 2920934 - protein, 6 aa, Entamoeba invadens
VPTVSG

SEQ ID NO: 2920935 - protein, 5 aa, Entamoeba invadens
VPVDT

SEQ ID NO: 2920936 - protein, 8 aa, Entamoeba invadens
VPVGAGSY

SEQ ID NO: 2920937 - protein, 9 aa, Entamoeba invadens
VPVSPEDNS

SEQ ID NO: 2920938 - protein, 4 aa, Entamoeba invadens
VPVT

SEQ ID NO: 2920939 - protein, 6 aa, Entamoeba invadens
VPVTDK

SEQ ID NO: 2920940 - protein, 5 aa, Entamoeba invadens
VPVTQ

SEQ ID NO: 2920941 - protein, 6 aa, Entamoeba invadens
VPYETK

SEQ ID NO: 2920942 - protein, 4 aa, Entamoeba invadens
VPYG

SEQ ID NO: 2920943 - protein, 7 aa, Entamoeba invadens
VPYPPFP

SEQ ID NO: 2920944 - protein, 5 aa, Entamoeba invadens
VQAEK

SEQ ID NO: 2920945 - protein, 7 aa, Entamoeba invadens
VQAGNIP

SEQ ID NO: 2920946 - protein, 10 aa, Entamoeba invadens
VQAKENSTWT

SEQ ID NO: 2920947 - protein, 8 aa, Entamoeba invadens
VQAKPQQI

SEQ ID NO: 2920948 - protein, 7 aa, Entamoeba invadens
VQAKPTC

SEQ ID NO: 2920949 - protein, 5 aa, Entamoeba invadens
VQAQK

SEQ ID NO: 2920950 - protein, 13 aa, Entamoeba invadens
VQATKQKDKTPQV

SEQ ID NO: 2920951 - protein, 38 aa, Entamoeba invadens
VQDARQAREDEAKLNQAKIEAKKTEIQQNEETEESAKQ

SEQ ID NO: 2920952 - protein, 8 aa, Entamoeba invadens
VQDDINNE

SEQ ID NO: 2920953 - protein, 4 aa, Entamoeba invadens
VQDE

SEQ ID NO: 2920954 - protein, 5 aa, Entamoeba invadens
VQDEG

SEQ ID NO: 2920955 - protein, 15 aa, Entamoeba invadens
VQDENGFDNQEEDEN

SEQ ID NO: 2920956 - protein, 16 aa, Entamoeba invadens
VQDKTEMEKQTKETFD

SEQ ID NO: 2920957 - protein, 18 aa, Entamoeba invadens
VQDLEDRPVGTSNIDQTE

SEQ ID NO: 2920958 - protein, 18 aa, Entamoeba invadens
VQDLEDRQVGTSNIDQTE

SEQ ID NO: 2920959 - protein, 13 aa, Entamoeba invadens
VQDLTDAAKLGGF

SEQ ID NO: 2920960 - protein, 7 aa, Entamoeba invadens
VQDNGFK

SEQ ID NO: 2920961 - protein, 9 aa, Entamoeba invadens
VQDPKQRKR

SEQ ID NO: 2920962 - protein, 8 aa, Entamoeba invadens
VQDPPTAT

SEQ ID NO: 2920963 - protein, 7 aa, Entamoeba invadens
VQDQKRG

SEQ ID NO: 2920964 - protein, 4 aa, Entamoeba invadens
VQDS

SEQ ID NO: 2920965 - protein, 6 aa, Entamoeba invadens
VQDSIE

SEQ ID NO: 2920966 - protein, 9 aa, Entamoeba invadens
VQDSSEDAL

SEQ ID NO: 2920967 - protein, 12 aa, Entamoeba invadens
VQEDDDVDNNET

SEQ ID NO: 2920968 - protein, 7 aa, Entamoeba invadens
VQEDGGV

SEQ ID NO: 2920969 - protein, 6 aa, Entamoeba invadens
VQEDIK

SEQ ID NO: 2920970 - protein, 6 aa, Entamoeba invadens
VQEGPL

SEQ ID NO: 2920971 - protein, 7 aa, Entamoeba invadens
VQEKAGN

SEQ ID NO: 2920972 - protein, 8 aa, Entamoeba invadens
VQEKDGVD

SEQ ID NO: 2920973 - protein, 10 aa, Entamoeba invadens
VQEKSANNIT

SEQ ID NO: 2920974 - protein, 15 aa, Entamoeba invadens
VQENRDKLADPDNDD

SEQ ID NO: 2920975 - protein, 16 aa, Entamoeba invadens
VQENSRGISQKTALRR

SEQ ID NO: 2920976 - protein, 10 aa, Entamoeba invadens
VQENTPEQDI

SEQ ID NO: 2920977 - protein, 11 aa, Entamoeba invadens
VQEPPASQSAL

SEQ ID NO: 2920978 - protein, 17 aa, Entamoeba invadens
VQEPPSSVSAGNVPRTK

SEQ ID NO: 2920979 - protein, 6 aa, Entamoeba invadens
VQERGN

SEQ ID NO: 2920980 - protein, 24 aa, Entamoeba invadens
VQESGSAGSYPPLKKEQEGRTSPT

SEQ ID NO: 2920981 - protein, 10 aa, Entamoeba invadens
VQESTISPHS

SEQ ID NO: 2920982 - protein, 8 aa, Entamoeba invadens
VQGDEHTI

SEQ ID NO: 2920983 - protein, 5 aa, Entamoeba invadens
VQGES

SEQ ID NO: 2920984 - protein, 19 aa, Entamoeba invadens
VQGETPEQRVQREEKNNNE

SEQ ID NO: 2920985 - protein, 6 aa, Entamoeba invadens
VQGEYT

SEQ ID NO: 2920986 - protein, 5 aa, Entamoeba invadens
VQGGT

SEQ ID NO: 2920987 - protein, 10 aa, Entamoeba invadens
VQGGTTNPAF

SEQ ID NO: 2920988 - protein, 7 aa, Entamoeba invadens
VQGNENF

SEQ ID NO: 2920989 - protein, 23 aa, Entamoeba invadens
VQGNNTNDAISSERRGEEGKKKS

SEQ ID NO: 2920990 - protein, 9 aa, Entamoeba invadens
VQGNTDDDQ

SEQ ID NO: 2920991 - protein, 8 aa, Entamoeba invadens
VQGPAGTF

SEQ ID NO: 2920992 - protein, 5 aa, Entamoeba invadens
VQGRK

SEQ ID NO: 2920993 - protein, 4 aa, Entamoeba invadens
VQGS

SEQ ID NO: 2920994 - protein, 22 aa, Entamoeba invadens
VQGSDQKNTATKKAKKKTSRNR

SEQ ID NO: 2920995 - protein, 11 aa, Entamoeba invadens
VQGSGDIVRGG

SEQ ID NO: 2920996 - protein, 7 aa, Entamoeba invadens
VQGSGKN

SEQ ID NO: 2920997 - protein, 20 aa, Entamoeba invadens
VQHDDSSSESTTSSFSSPRK

SEQ ID NO: 2920998 - protein, 5 aa, Entamoeba invadens
VQHGE

SEQ ID NO: 2920999 - protein, 4 aa, Entamoeba invadens
VQHT

SEQ ID NO: 2921000 - protein, 6 aa, Entamoeba invadens
VQIEPD

SEQ ID NO: 2921001 - protein, 5 aa, Entamoeba invadens
VQIGS

SEQ ID NO: 2921002 - protein, 4 aa, Entamoeba invadens
VQIP

SEQ ID NO: 2921003 - protein, 7 aa, Entamoeba invadens
VQKDETM

SEQ ID NO: 2921004 - protein, 8 aa, Entamoeba invadens
VQKDETTL

SEQ ID NO: 2921005 - protein, 5 aa, Entamoeba invadens
VQKDG

SEQ ID NO: 2921006 - protein, 12 aa, Entamoeba invadens
VQKDGSPLPRLN

SEQ ID NO: 2921007 - protein, 5 aa, Entamoeba invadens
VQKDS

SEQ ID NO: 2921008 - protein, 7 aa, Entamoeba invadens
VQKDVSQ

SEQ ID NO: 2921009 - protein, 8 aa, Entamoeba invadens
VQKEATLR

SEQ ID NO: 2921010 - protein, 11 aa, Entamoeba invadens
VQKEDTAVTQV

SEQ ID NO: 2921011 - protein, 5 aa, Entamoeba invadens
VQKEG

SEQ ID NO: 2921012 - protein, 16 aa, Entamoeba invadens
VQKENSKSSELGRPTN

SEQ ID NO: 2921013 - protein, 7 aa, Entamoeba invadens
VQKESKL

SEQ ID NO: 2921014 - protein, 10 aa, Entamoeba invadens
VQKGKTKAGS

SEQ ID NO: 2921015 - protein, 10 aa, Entamoeba invadens
VQKGVQTMAN

SEQ ID NO: 2921016 - protein, 18 aa, Entamoeba invadens
VQKKSKEIEEKKPKKDID

SEQ ID NO: 2921017 - protein, 8 aa, Entamoeba invadens
VQKLEKEK

SEQ ID NO: 2921018 - protein, 26 aa, Entamoeba invadens
VQKQNKTLNNENPATQNTPKDVNEQN

SEQ ID NO: 2921019 - protein, 7 aa, Entamoeba invadens
VQKQNPE

SEQ ID NO: 2921020 - protein, 5 aa, Entamoeba invadens
VQKQP

SEQ ID NO: 2921021 - protein, 42 aa, Entamoeba invadens
VQKQSPTNSMRGVSSPHSSTSRKDTIRKGPMKQKRFSRQNSK

SEQ ID NO: 2921022 - protein, 9 aa, Entamoeba invadens
VQKSAGNQF

SEQ ID NO: 2921023 - protein, 5 aa, Entamoeba invadens
VQKSG

SEQ ID NO: 2921024 - protein, 5 aa, Entamoeba invadens
VQKSH

SEQ ID NO: 2921025 - protein, 10 aa, Entamoeba invadens
VQKTKSVQVD

SEQ ID NO: 2921026 - protein, 9 aa, Entamoeba invadens
VQKTSPPPF

SEQ ID NO: 2921027 - protein, 12 aa, Entamoeba invadens
VQKTYGNKGPEI

SEQ ID NO: 2921028 - protein, 6 aa, Entamoeba invadens
VQKVEQ

SEQ ID NO: 2921029 - protein, 9 aa, Entamoeba invadens
VQLDTSKQR

SEQ ID NO: 2921030 - protein, 15 aa, Entamoeba invadens
VQLEDKPKEPEKPKL

SEQ ID NO: 2921031 - protein, 9 aa, Entamoeba invadens
VQLNTKGSI

SEQ ID NO: 2921032 - protein, 9 aa, Entamoeba invadens
VQLRTEKEE

SEQ ID NO: 2921033 - protein, 7 aa, Entamoeba invadens
VQLTTDD

SEQ ID NO: 2921034 - protein, 9 aa, Entamoeba invadens
VQMTSPPSF

SEQ ID NO: 2921035 - protein, 11 aa, Entamoeba invadens
VQNAAKEKIGN

SEQ ID NO: 2921036 - protein, 5 aa, Entamoeba invadens
VQNDM

SEQ ID NO: 2921037 - protein, 9 aa, Entamoeba invadens
VQNDREMNE

SEQ ID NO: 2921038 - protein, 8 aa, Entamoeba invadens
VQNEEEEY

SEQ ID NO: 2921039 - protein, 11 aa, Entamoeba invadens
VQNEKNDTEDV

SEQ ID NO: 2921040 - protein, 9 aa, Entamoeba invadens
VQNETNERL

SEQ ID NO: 2921041 - protein, 38 aa, Entamoeba invadens
VQNGEKVKSDDPDKDKASEDQGRADAVSGSVLKDKPNV

SEQ ID NO: 2921042 - protein, 8 aa, Entamoeba invadens
VQNGRGKA

SEQ ID NO: 2921043 - protein, 14 aa, Entamoeba invadens
VQNGSKEKNFNRES

SEQ ID NO: 2921044 - protein, 10 aa, Entamoeba invadens
VQNGTPFQPG

SEQ ID NO: 2921045 - protein, 8 aa, Entamoeba invadens
VQNKYDGY

SEQ ID NO: 2921046 - protein, 5 aa, Entamoeba invadens
VQNLQ

SEQ ID NO: 2921047 - protein, 4 aa, Entamoeba invadens
VQNN

SEQ ID NO: 2921048 - protein, 10 aa, Entamoeba invadens
VQNNEEIKNE

SEQ ID NO: 2921049 - protein, 9 aa, Entamoeba invadens
VQNNKISDY

SEQ ID NO: 2921050 - protein, 12 aa, Entamoeba invadens
VQNPIQSDKPQN

SEQ ID NO: 2921051 - protein, 9 aa, Entamoeba invadens
VQNSSSTPL

SEQ ID NO: 2921052 - protein, 40 aa, Entamoeba invadens
VQPGTVEKTEQHEKAEKVKKSEPKMTETKEEVPSQQTHSH

SEQ ID NO: 2921053 - protein, 9 aa, Entamoeba invadens
VQPKTSPNF

SEQ ID NO: 2921054 - protein, 21 aa, Entamoeba invadens
VQPLPQKNITDEKTTNSCCVI

SEQ ID NO: 2921055 - protein, 12 aa, Entamoeba invadens
VQPPATRNIERS

SEQ ID NO: 2921056 - protein, 9 aa, Entamoeba invadens
VQPPPSLQY

SEQ ID NO: 2921057 - protein, 8 aa, Entamoeba invadens
VQPPQNKT

SEQ ID NO: 2921058 - protein, 4 aa, Entamoeba invadens
VQPQ

SEQ ID NO: 2921059 - protein, 6 aa, Entamoeba invadens
VQPRDD

SEQ ID NO: 2921060 - protein, 7 aa, Entamoeba invadens
VQPRETH

SEQ ID NO: 2921061 - protein, 10 aa, Entamoeba invadens
VQPSDTDKVN

SEQ ID NO: 2921062 - protein, 12 aa, Entamoeba invadens
VQPSKPNSMNVE

SEQ ID NO: 2921063 - protein, 12 aa, Entamoeba invadens
VQPSKSNSMNVE

SEQ ID NO: 2921064 - protein, 13 aa, Entamoeba invadens
VQPSKTNSINAES

SEQ ID NO: 2921065 - protein, 4 aa, Entamoeba invadens
VQPT

SEQ ID NO: 2921066 - protein, 8 aa, Entamoeba invadens
VQPTIDDT

SEQ ID NO: 2921067 - protein, 35 aa, Entamoeba invadens
VQPTNWKNSRKTAQVPLATSTITAEQISTPRDNTF

SEQ ID NO: 2921068 - protein, 10 aa, Entamoeba invadens
VQPTQADNNS

SEQ ID NO: 2921069 - protein, 11 aa, Entamoeba invadens
VQQEGKGVDGN

SEQ ID NO: 2921070 - protein, 19 aa, Entamoeba invadens
VQQEGQVDGKQQLQNTQIN

SEQ ID NO: 2921071 - protein, 10 aa, Entamoeba invadens
VQQEPNASID

SEQ ID NO: 2921072 - protein, 6 aa, Entamoeba invadens
VQQGDS

SEQ ID NO: 2921073 - protein, 9 aa, Entamoeba invadens
VQQGEPNCD

SEQ ID NO: 2921074 - protein, 7 aa, Entamoeba invadens
VQQGNEQ

SEQ ID NO: 2921075 - protein, 11 aa, Entamoeba invadens
VQQLSTSNVTN

SEQ ID NO: 2921076 - protein, 5 aa, Entamoeba invadens
VQQNR

SEQ ID NO: 2921077 - protein, 16 aa, Entamoeba invadens
VQQPEKPEEPSSKPHL

SEQ ID NO: 2921078 - protein, 7 aa, Entamoeba invadens
VQQPKLK

SEQ ID NO: 2921079 - protein, 11 aa, Entamoeba invadens
VQQPNGEKTCE

SEQ ID NO: 2921080 - protein, 7 aa, Entamoeba invadens
VQQPNTA

SEQ ID NO: 2921081 - protein, 11 aa, Entamoeba invadens
VQQPPQPFSHS

SEQ ID NO: 2921082 - protein, 13 aa, Entamoeba invadens
VQQPQNKTTEEKK

SEQ ID NO: 2921083 - protein, 6 aa, Entamoeba invadens
VQQQEQ

SEQ ID NO: 2921084 - protein, 20 aa, Entamoeba invadens
VQQQGNQPTGIDTMQSTNQH

SEQ ID NO: 2921085 - protein, 20 aa, Entamoeba invadens
VQQQSNAERVENKNKHKKVA

SEQ ID NO: 2921086 - protein, 4 aa, Entamoeba invadens
VQQR

SEQ ID NO: 2921087 - protein, 8 aa, Entamoeba invadens
VQQTQQTQ

SEQ ID NO: 2921088 - protein, 4 aa, Entamoeba invadens
VQRD

SEQ ID NO: 2921089 - protein, 5 aa, Entamoeba invadens
VQRKN

SEQ ID NO: 2921090 - protein, 10 aa, Entamoeba invadens
VQRMEGGKDL

SEQ ID NO: 2921091 - protein, 45 aa, Entamoeba invadens
VQRPNYPAKSPSPNTPKEQKKPSIPIRNTTKPTPSVPKNKKDDFA

SEQ ID NO: 2921092 - protein, 8 aa, Entamoeba invadens
VQRTSSSI

SEQ ID NO: 2921093 - protein, 14 aa, Entamoeba invadens
VQSANTHTSTSEIS

SEQ ID NO: 2921094 - protein, 24 aa, Entamoeba invadens
VQSDATKPKKVADDSKKREVKKNF

SEQ ID NO: 2921095 - protein, 14 aa, Entamoeba invadens
VQSEKTTETTTTQK

SEQ ID NO: 2921096 - protein, 6 aa, Entamoeba invadens
VQSEPV

SEQ ID NO: 2921097 - protein, 5 aa, Entamoeba invadens
VQSGK

SEQ ID NO: 2921098 - protein, 11 aa, Entamoeba invadens
VQSIESDMKEL

SEQ ID NO: 2921099 - protein, 8 aa, Entamoeba invadens
VQSKSPLK

SEQ ID NO: 2921100 - protein, 6 aa, Entamoeba invadens
VQSKTV

SEQ ID NO: 2921101 - protein, 14 aa, Entamoeba invadens
VQSLEEKKEEMENI

SEQ ID NO: 2921102 - protein, 10 aa, Entamoeba invadens
VQSLKEKKQK

SEQ ID NO: 2921103 - protein, 12 aa, Entamoeba invadens
VQSPGLTASPAI

SEQ ID NO: 2921104 - protein, 11 aa, Entamoeba invadens
VQSPKDDDYDI

SEQ ID NO: 2921105 - protein, 16 aa, Entamoeba invadens
VQSPLPTQLSTIENKK

SEQ ID NO: 2921106 - protein, 4 aa, Entamoeba invadens
VQSQ

SEQ ID NO: 2921107 - protein, 60 aa, Entamoeba invadens
VQSQNNDSTKNPFAPPPQQQQTRREAPTGITRKPPPTAVTAPTTSKDNSSHKPAAGKREP

SEQ ID NO: 2921108 - protein, 8 aa, Entamoeba invadens
VQSQTDEL

SEQ ID NO: 2921109 - protein, 21 aa, Entamoeba invadens
VQSSDSSRTISEQRDTPRSIP

SEQ ID NO: 2921110 - protein, 5 aa, Entamoeba invadens
VQSSI

SEQ ID NO: 2921111 - protein, 7 aa, Entamoeba invadens
VQSSNDF

SEQ ID NO: 2921112 - protein, 22 aa, Entamoeba invadens
VQSSQEEEFEGLSEEASKPLEE

SEQ ID NO: 2921113 - protein, 8 aa, Entamoeba invadens
VQSSQNLK

SEQ ID NO: 2921114 - protein, 8 aa, Entamoeba invadens
VQSTEIAS

SEQ ID NO: 2921115 - protein, 11 aa, Entamoeba invadens
VQTARNKNSLD

SEQ ID NO: 2921116 - protein, 18 aa, Entamoeba invadens
VQTDNTRNGNEDVVGTPN

SEQ ID NO: 2921117 - protein, 4 aa, Entamoeba invadens
VQTE

SEQ ID NO: 2921118 - protein, 8 aa, Entamoeba invadens
VQTEGTKL

SEQ ID NO: 2921119 - protein, 12 aa, Entamoeba invadens
VQTGASDNDQKA

SEQ ID NO: 2921120 - protein, 5 aa, Entamoeba invadens
VQTIT

SEQ ID NO: 2921121 - protein, 10 aa, Entamoeba invadens
VQTKGRGREE

SEQ ID NO: 2921122 - protein, 6 aa, Entamoeba invadens
VQTNEV

SEQ ID NO: 2921123 - protein, 8 aa, Entamoeba invadens
VQTNQEYS

SEQ ID NO: 2921124 - protein, 6 aa, Entamoeba invadens
VQTNSF

SEQ ID NO: 2921125 - protein, 8 aa, Entamoeba invadens
VQTNSGKS

SEQ ID NO: 2921126 - protein, 9 aa, Entamoeba invadens
VQTNTSSFN

SEQ ID NO: 2921127 - protein, 9 aa, Entamoeba invadens
VQTPNGYQN

SEQ ID NO: 2921128 - protein, 8 aa, Entamoeba invadens
VQTPSTVK

SEQ ID NO: 2921129 - protein, 33 aa, Entamoeba invadens
VQTQKSEPQQPSSNTSTANPPQPNQSNTSLTVQ

SEQ ID NO: 2921130 - protein, 5 aa, Entamoeba invadens
VQTQN

SEQ ID NO: 2921131 - protein, 6 aa, Entamoeba invadens
VQTQQA

SEQ ID NO: 2921132 - protein, 12 aa, Entamoeba invadens
VQTQQKVPEPVT

SEQ ID NO: 2921133 - protein, 7 aa, Entamoeba invadens
VQTRKKG

SEQ ID NO: 2921134 - protein, 10 aa, Entamoeba invadens
VQTSKQSDNC

SEQ ID NO: 2921135 - protein, 4 aa, Entamoeba invadens
VQTT

SEQ ID NO: 2921136 - protein, 7 aa, Entamoeba invadens
VQTVKDK

SEQ ID NO: 2921137 - protein, 9 aa, Entamoeba invadens
VQTYEVTSD

SEQ ID NO: 2921138 - protein, 11 aa, Entamoeba invadens
VQVNSSSDIDK

SEQ ID NO: 2921139 - protein, 8 aa, Entamoeba invadens
VQVQDSPK

SEQ ID NO: 2921140 - protein, 18 aa, Entamoeba invadens
VQVSKEQVETKKTTNTSF

SEQ ID NO: 2921141 - protein, 12 aa, Entamoeba invadens
VQYESKHQLSPR

SEQ ID NO: 2921142 - protein, 10 aa, Entamoeba invadens
VQYPENETKQ

SEQ ID NO: 2921143 - protein, 10 aa, Entamoeba invadens
VQYQNDDSFN

SEQ ID NO: 2921144 - protein, 4 aa, Entamoeba invadens
VQYS

SEQ ID NO: 2921145 - protein, 5 aa, Entamoeba invadens
VRAAG

SEQ ID NO: 2921146 - protein, 12 aa, Entamoeba invadens
VRAPTGSGKTLS

SEQ ID NO: 2921147 - protein, 17 aa, Entamoeba invadens
VRATKSLSLSLGSPVNF

SEQ ID NO: 2921148 - protein, 46 aa, Entamoeba invadens
  misc_feature (17)..(18): Xaa can be any naturally occurring amino acid
VRCEEGVGCEQRCCFRXXFDDDEEEDDANAMEEEEDDEEVFEDEDD

SEQ ID NO: 2921149 - protein, 16 aa, Entamoeba invadens
VRDNTSFNNVKSSDVL

SEQ ID NO: 2921150 - protein, 12 aa, Entamoeba invadens
VRDSDLTTTDLE

SEQ ID NO: 2921151 - protein, 8 aa, Entamoeba invadens
VRDTPKNE

SEQ ID NO: 2921152 - protein, 8 aa, Entamoeba invadens
VRDVKDNQ

SEQ ID NO: 2921153 - protein, 17 aa, Entamoeba invadens
VREAKEKNYEDDGGVPI

SEQ ID NO: 2921154 - protein, 7 aa, Entamoeba invadens
VREEAER

SEQ ID NO: 2921155 - protein, 12 aa, Entamoeba invadens
VREEKNKKSYGV

SEQ ID NO: 2921156 - protein, 12 aa, Entamoeba invadens
VREGEEQREATI

SEQ ID NO: 2921157 - protein, 8 aa, Entamoeba invadens
VREGGKPD

SEQ ID NO: 2921158 - protein, 8 aa, Entamoeba invadens
VREGSADD

SEQ ID NO: 2921159 - protein, 9 aa, Entamoeba invadens
VREKERSRV

SEQ ID NO: 2921160 - protein, 24 aa, Entamoeba invadens
VREKPHKTEQPPKAVPNHAEKEEI

SEQ ID NO: 2921161 - protein, 18 aa, Entamoeba invadens
VREKVERENGCDKAIEET

SEQ ID NO: 2921162 - protein, 24 aa, Entamoeba invadens
VRENRDSRSERDVREKRDGYDQAY

SEQ ID NO: 2921163 - protein, 5 aa, Entamoeba invadens
VREPM

SEQ ID NO: 2921164 - protein, 7 aa, Entamoeba invadens
VRESDGS

SEQ ID NO: 2921165 - protein, 9 aa, Entamoeba invadens
VRESESQVK

SEQ ID NO: 2921166 - protein, 19 aa, Entamoeba invadens
VRESTQTKTTCENSVASTP

SEQ ID NO: 2921167 - protein, 5 aa, Entamoeba invadens
VRETE

SEQ ID NO: 2921168 - protein, 6 aa, Entamoeba invadens
VREYTE

SEQ ID NO: 2921169 - protein, 6 aa, Entamoeba invadens
VRGDGA

SEQ ID NO: 2921170 - protein, 5 aa, Entamoeba invadens
VRGDL

SEQ ID NO: 2921171 - protein, 8 aa, Entamoeba invadens
VRGEEPIY

SEQ ID NO: 2921172 - protein, 7 aa, Entamoeba invadens
VRGEEVE

SEQ ID NO: 2921173 - protein, 5 aa, Entamoeba invadens
VRGET

SEQ ID NO: 2921174 - protein, 8 aa, Entamoeba invadens
VRGGGNPI

SEQ ID NO: 2921175 - protein, 9 aa, Entamoeba invadens
VRGKKTEKQ

SEQ ID NO: 2921176 - protein, 5 aa, Entamoeba invadens
VRGKT

SEQ ID NO: 2921177 - protein, 10 aa, Entamoeba invadens
VRGKTSNNQF

SEQ ID NO: 2921178 - protein, 7 aa, Entamoeba invadens
VRGNGNK

SEQ ID NO: 2921179 - protein, 13 aa, Entamoeba invadens
VRGQRPRADPTSL

SEQ ID NO: 2921180 - protein, 11 aa, Entamoeba invadens
VRGSDWKGTPY

SEQ ID NO: 2921181 - protein, 17 aa, Entamoeba invadens
VRGSKDNVTCVVIYLNW

SEQ ID NO: 2921182 - protein, 6 aa, Entamoeba invadens
VRGSNG

SEQ ID NO: 2921183 - protein, 7 aa, Entamoeba invadens
VRGTETP

SEQ ID NO: 2921184 - protein, 6 aa, Entamoeba invadens
VRGTMK

SEQ ID NO: 2921185 - protein, 8 aa, Entamoeba invadens
VRHNPTDC

SEQ ID NO: 2921186 - protein, 6 aa, Entamoeba invadens
VRHPSS

SEQ ID NO: 2921187 - protein, 4 aa, Entamoeba invadens
VRID

SEQ ID NO: 2921188 - protein, 8 aa, Entamoeba invadens
VRIDTSEY

SEQ ID NO: 2921189 - protein, 4 aa, Entamoeba invadens
VRKD

SEQ ID NO: 2921190 - protein, 10 aa, Entamoeba invadens
VRKDSEENLL

SEQ ID NO: 2921191 - protein, 5 aa, Entamoeba invadens
VRKEI

SEQ ID NO: 2921192 - protein, 5 aa, Entamoeba invadens
VRKEK

SEQ ID NO: 2921193 - protein, 4 aa, Entamoeba invadens
VRKI

SEQ ID NO: 2921194 - protein, 12 aa, Entamoeba invadens
VRKKKGALDGLR

SEQ ID NO: 2921195 - protein, 34 aa, Entamoeba invadens
VRKKRKERAKEERKKRKENGEELPKRTKIDENTV

SEQ ID NO: 2921196 - protein, 7 aa, Entamoeba invadens
VRKNGSV

SEQ ID NO: 2921197 - protein, 6 aa, Entamoeba invadens
VRKPGQ

SEQ ID NO: 2921198 - protein, 13 aa, Entamoeba invadens
VRKPNDKNDSAYT

SEQ ID NO: 2921199 - protein, 13 aa, Entamoeba invadens
VRKPSKQARITTQ

SEQ ID NO: 2921200 - protein, 21 aa, Entamoeba invadens
VRKQKSVDNTPYISPRKQEEK

SEQ ID NO: 2921201 - protein, 10 aa, Entamoeba invadens
VRKQSTSSVD

SEQ ID NO: 2921202 - protein, 22 aa, Entamoeba invadens
VRKREVDDARKPDADDGAEEAK

SEQ ID NO: 2921203 - protein, 6 aa, Entamoeba invadens
VRKSST

SEQ ID NO: 2921204 - protein, 9 aa, Entamoeba invadens
VRKVGKSAF

SEQ ID NO: 2921205 - protein, 13 aa, Entamoeba invadens
VRKYEDKEGSYNT

SEQ ID NO: 2921206 - protein, 46 aa, Entamoeba invadens
VRNDDDEEDDDENDDNEDVDDEIKNVEDKDDDDDIVKDVAKEGDVK

SEQ ID NO: 2921207 - protein, 24 aa, Entamoeba invadens
VRNDYTTEKIDYDAETEKLSKESK

SEQ ID NO: 2921208 - protein, 21 aa, Entamoeba invadens
VRNERGKYEREMSKGGEEKWW

SEQ ID NO: 2921209 - protein, 7 aa, Entamoeba invadens
VRNNKKG

SEQ ID NO: 2921210 - protein, 6 aa, Entamoeba invadens
VRNNSA

SEQ ID NO: 2921211 - protein, 10 aa, Entamoeba invadens
VRNPPLEKSD

SEQ ID NO: 2921212 - protein, 4 aa, Entamoeba invadens
VRNV

SEQ ID NO: 2921213 - protein, 5 aa, Entamoeba invadens
VRPKD

SEQ ID NO: 2921214 - protein, 10 aa, Entamoeba invadens
VRPKPAKPKK

SEQ ID NO: 2921215 - protein, 8 aa, Entamoeba invadens
VRPKSPKS

SEQ ID NO: 2921216 - protein, 11 aa, Entamoeba invadens
VRPKYNETDTY

SEQ ID NO: 2921217 - protein, 5 aa, Entamoeba invadens
VRPNK

SEQ ID NO: 2921218 - protein, 19 aa, Entamoeba invadens
VRPRSRKTSTGSTGSFSNP

SEQ ID NO: 2921219 - protein, 9 aa, Entamoeba invadens
VRPSPLPKQ

SEQ ID NO: 2921220 - protein, 7 aa, Entamoeba invadens
VRPSRGE

SEQ ID NO: 2921221 - protein, 14 aa, Entamoeba invadens
VRPSSKCDPKEDSA

SEQ ID NO: 2921222 - protein, 15 aa, Entamoeba invadens
VRPTKTKSKEENEQD

SEQ ID NO: 2921223 - protein, 5 aa, Entamoeba invadens
VRPTL

SEQ ID NO: 2921224 - protein, 5 aa, Entamoeba invadens
VRPTN

SEQ ID NO: 2921225 - protein, 9 aa, Entamoeba invadens
VRPTNGTNI

SEQ ID NO: 2921226 - protein, 6 aa, Entamoeba invadens
VRPTQN

SEQ ID NO: 2921227 - protein, 19 aa, Entamoeba invadens
VRPTSSTNSSSPKSPPQDK

SEQ ID NO: 2921228 - protein, 11 aa, Entamoeba invadens
VRPWDKEEDAR

SEQ ID NO: 2921229 - protein, 5 aa, Entamoeba invadens
VRQGE

SEQ ID NO: 2921230 - protein, 7 aa, Entamoeba invadens
VRQGGGA

SEQ ID NO: 2921231 - protein, 5 aa, Entamoeba invadens
VRQQD

SEQ ID NO: 2921232 - protein, 11 aa, Entamoeba invadens
VRQSSEDEEQV

SEQ ID NO: 2921233 - protein, 4 aa, Entamoeba invadens
VRQT

SEQ ID NO: 2921234 - protein, 14 aa, Entamoeba invadens
VRQYTAEKIPDEDV

SEQ ID NO: 2921235 - protein, 7 aa, Entamoeba invadens
VRRDDDQ

SEQ ID NO: 2921236 - protein, 18 aa, Entamoeba invadens
VRRDGAKKTMKVPKTTTI

SEQ ID NO: 2921237 - protein, 25 aa, Entamoeba invadens
VRRDSRSTVSNSTDWSGMSGTDGLI

SEQ ID NO: 2921238 - protein, 15 aa, Entamoeba invadens
VRREKSAEDGLPVTE

SEQ ID NO: 2921239 - protein, 4 aa, Entamoeba invadens
VRRK

SEQ ID NO: 2921240 - protein, 5 aa, Entamoeba invadens
VRRNK

SEQ ID NO: 2921241 - protein, 8 aa, Entamoeba invadens
VRRPAGNY

SEQ ID NO: 2921242 - protein, 36 aa, Entamoeba invadens
VRRRNRDVDDDAEDDVQFGKEPRQGINTISKNKEAY

SEQ ID NO: 2921243 - protein, 11 aa, Entamoeba invadens
VRRSQEQRTSI

SEQ ID NO: 2921244 - protein, 7 aa, Entamoeba invadens
VRRTNQS

SEQ ID NO: 2921245 - protein, 5 aa, Entamoeba invadens
VRRTS

SEQ ID NO: 2921246 - protein, 14 aa, Entamoeba invadens
VRSADTRKKSFYAQ

SEQ ID NO: 2921247 - protein, 7 aa, Entamoeba invadens
VRSAKNV

SEQ ID NO: 2921248 - protein, 6 aa, Entamoeba invadens
VRSAQT

SEQ ID NO: 2921249 - protein, 5 aa, Entamoeba invadens
VRSEG

SEQ ID NO: 2921250 - protein, 11 aa, Entamoeba invadens
VRSEKSPRNLS

SEQ ID NO: 2921251 - protein, 45 aa, Entamoeba invadens
VRSERSERKNTRDMDRRDDRPSQPSRRDDRRDDRDRYDDRRRYDD

SEQ ID NO: 2921252 - protein, 11 aa, Entamoeba invadens
VRSESQQAAQS

SEQ ID NO: 2921253 - protein, 14 aa, Entamoeba invadens
VRSGTIKGYTGKEF

SEQ ID NO: 2921254 - protein, 22 aa, Entamoeba invadens
VRSLAKNTTHGAASSVSGMSKS

SEQ ID NO: 2921255 - protein, 14 aa, Entamoeba invadens
VRSNDERSTKQTNV

SEQ ID NO: 2921256 - protein, 18 aa, Entamoeba invadens
VRSNSQDVSPGTTPKSEE

SEQ ID NO: 2921257 - protein, 5 aa, Entamoeba invadens
VRSPN

SEQ ID NO: 2921258 - protein, 7 aa, Entamoeba invadens
VRSPRNI

SEQ ID NO: 2921259 - protein, 28 aa, Entamoeba invadens
VRSPSADLLDSSSFDESENEIETKEREQ

SEQ ID NO: 2921260 - protein, 6 aa, Entamoeba invadens
VRSPTL

SEQ ID NO: 2921261 - protein, 10 aa, Entamoeba invadens
VRSPTQSPPL

SEQ ID NO: 2921262 - protein, 9 aa, Entamoeba invadens
VRSQNENKS

SEQ ID NO: 2921263 - protein, 4 aa, Entamoeba invadens
VRSR

SEQ ID NO: 2921264 - protein, 9 aa, Entamoeba invadens
VRSSSGDSH

SEQ ID NO: 2921265 - protein, 8 aa, Entamoeba invadens
VRSTGKKW

SEQ ID NO: 2921266 - protein, 7 aa, Entamoeba invadens
VRSVGDA

SEQ ID NO: 2921267 - protein, 11 aa, Entamoeba invadens
VRSYPEGDYSE

SEQ ID NO: 2921268 - protein, 8 aa, Entamoeba invadens
VRTAPPNS

SEQ ID NO: 2921269 - protein, 16 aa, Entamoeba invadens
VRTELDQEKKEHAKTQ

SEQ ID NO: 2921270 - protein, 6 aa, Entamoeba invadens
VRTGAR

SEQ ID NO: 2921271 - protein, 6 aa, Entamoeba invadens
VRTGGD

SEQ ID NO: 2921272 - protein, 4 aa, Entamoeba invadens
VRTK

SEQ ID NO: 2921273 - protein, 6 aa, Entamoeba invadens
VRTKGE

SEQ ID NO: 2921274 - protein, 18 aa, Entamoeba invadens
VRTPGPKTPSFTSPFAPP

SEQ ID NO: 2921275 - protein, 50 aa, Entamoeba invadens
VRTPQKPNSTKNTRSKLGESRGGQAKAKAASIKGSSVDVKDRHINKSSPI

SEQ ID NO: 2921276 - protein, 14 aa, Entamoeba invadens
VRTRASTKRKNSLD

SEQ ID NO: 2921277 - protein, 7 aa, Entamoeba invadens
VRTSGDP

SEQ ID NO: 2921278 - protein, 9 aa, Entamoeba invadens
VRTVEGKKR

SEQ ID NO: 2921279 - protein, 4 aa, Entamoeba invadens
VRYG

SEQ ID NO: 2921280 - protein, 6 aa, Entamoeba invadens
VRYGEV

SEQ ID NO: 2921281 - protein, 11 aa, Entamoeba invadens
VRYPPNTPSSI

SEQ ID NO: 2921282 - protein, 23 aa, Entamoeba invadens
VSAAPTKKQKDAEQLKKDEAEEA

SEQ ID NO: 2921283 - protein, 8 aa, Entamoeba invadens
VSAGHPDK

SEQ ID NO: 2921284 - protein, 7 aa, Entamoeba invadens
VSAGKDK

SEQ ID NO: 2921285 - protein, 8 aa, Entamoeba invadens
VSAKTKSR

SEQ ID NO: 2921286 - protein, 10 aa, Entamoeba invadens
VSANNDEKIG

SEQ ID NO: 2921287 - protein, 19 aa, Entamoeba invadens
VSANNVPSTAFDKSKHYRE

SEQ ID NO: 2921288 - protein, 6 aa, Entamoeba invadens
VSANSV

SEQ ID NO: 2921289 - protein, 4 aa, Entamoeba invadens
VSAP

SEQ ID NO: 2921290 - protein, 14 aa, Entamoeba invadens
VSAPASVPQEEEKN

SEQ ID NO: 2921291 - protein, 14 aa, Entamoeba invadens
VSAPEHAELKTWGK

SEQ ID NO: 2921292 - protein, 6 aa, Entamoeba invadens
VSAPEN

SEQ ID NO: 2921293 - protein, 11 aa, Entamoeba invadens
VSAPKVEPSVV

SEQ ID NO: 2921294 - protein, 6 aa, Entamoeba invadens
VSAPPN

SEQ ID NO: 2921295 - protein, 8 aa, Entamoeba invadens
VSAQRDPK

SEQ ID NO: 2921296 - protein, 8 aa, Entamoeba invadens
VSASDTLA

SEQ ID NO: 2921297 - protein, 20 aa, Entamoeba invadens
VSASHEKSEEEKAKEREMEE

SEQ ID NO: 2921298 - protein, 5 aa, Entamoeba invadens
VSATA

SEQ ID NO: 2921299 - protein, 10 aa, Entamoeba invadens
VSATSTSKIV

SEQ ID NO: 2921300 - protein, 6 aa, Entamoeba invadens
VSCNPR

SEQ ID NO: 2921301 - protein, 28 aa, Entamoeba invadens
VSDAEEVKDVKDVKDVKEKHEKKKGKSK

SEQ ID NO: 2921302 - protein, 4 aa, Entamoeba invadens
VSDD

SEQ ID NO: 2921303 - protein, 12 aa, Entamoeba invadens
VSDDEEDKMNDE

SEQ ID NO: 2921304 - protein, 12 aa, Entamoeba invadens
VSDDEGKRYAEK

SEQ ID NO: 2921305 - protein, 9 aa, Entamoeba invadens
VSDDGKRTI

SEQ ID NO: 2921306 - protein, 7 aa, Entamoeba invadens
VSDDKSI

SEQ ID NO: 2921307 - protein, 5 aa, Entamoeba invadens
VSDEC

SEQ ID NO: 2921308 - protein, 11 aa, Entamoeba invadens
VSDEDSRKPLK

SEQ ID NO: 2921309 - protein, 8 aa, Entamoeba invadens
VSDEEGLR

SEQ ID NO: 2921310 - protein, 6 aa, Entamoeba invadens
VSDEEK

SEQ ID NO: 2921311 - protein, 8 aa, Entamoeba invadens
VSDERKSL

SEQ ID NO: 2921312 - protein, 8 aa, Entamoeba invadens
VSDESVRS

SEQ ID NO: 2921313 - protein, 11 aa, Entamoeba invadens
VSDGGDKPELL

SEQ ID NO: 2921314 - protein, 5 aa, Entamoeba invadens
VSDGI

SEQ ID NO: 2921315 - protein, 7 aa, Entamoeba invadens
VSDGRVS

SEQ ID NO: 2921316 - protein, 5 aa, Entamoeba invadens
VSDHN

SEQ ID NO: 2921317 - protein, 5 aa, Entamoeba invadens
VSDIG

SEQ ID NO: 2921318 - protein, 4 aa, Entamoeba invadens
VSDK

SEQ ID NO: 2921319 - protein, 16 aa, Entamoeba invadens
VSDKASSSARPDSLNE

SEQ ID NO: 2921320 - protein, 27 aa, Entamoeba invadens
VSDKHDKEHTLKTPEDVIDGKSKDDFV

SEQ ID NO: 2921321 - protein, 7 aa, Entamoeba invadens
VSDKTAG

SEQ ID NO: 2921322 - protein, 7 aa, Entamoeba invadens
VSDKTKS

SEQ ID NO: 2921323 - protein, 14 aa, Entamoeba invadens
VSDKWKSVKNSAEN

SEQ ID NO: 2921324 - protein, 8 aa, Entamoeba invadens
VSDNEKAR

SEQ ID NO: 2921325 - protein, 4 aa, Entamoeba invadens
VSDP

SEQ ID NO: 2921326 - protein, 5 aa, Entamoeba invadens
VSDPR

SEQ ID NO: 2921327 - protein, 10 aa, Entamoeba invadens
VSDPSREATY

SEQ ID NO: 2921328 - protein, 8 aa, Entamoeba invadens
VSDQTTSI

SEQ ID NO: 2921329 - protein, 9 aa, Entamoeba invadens
VSDRPQEGS

SEQ ID NO: 2921330 - protein, 4 aa, Entamoeba invadens
VSDS

SEQ ID NO: 2921331 - protein, 5 aa, Entamoeba invadens
VSDSD

SEQ ID NO: 2921332 - protein, 7 aa, Entamoeba invadens
VSDSSCD

SEQ ID NO: 2921333 - protein, 97 aa, Entamoeba invadens
VSDSSDIEVTGDELSSQFKEKDKMRRKRRIERDEKTSNNTQTVSSNVSTSSTDDNPNAQSDDSETVSASSKLKKSKLKKSSRNFGKSKKSKLKKKVE

SEQ ID NO: 2921334 - protein, 9 aa, Entamoeba invadens
VSDTEIGDD

SEQ ID NO: 2921335 - protein, 8 aa, Entamoeba invadens
VSDTGNKR

SEQ ID NO: 2921336 - protein, 26 aa, Entamoeba invadens
VSDTQQDSISVTPKSREVESENVTNE

SEQ ID NO: 2921337 - protein, 7 aa, Entamoeba invadens
VSDVETL

SEQ ID NO: 2921338 - protein, 5 aa, Entamoeba invadens
VSDYP

SEQ ID NO: 2921339 - protein, 19 aa, Entamoeba invadens
VSEDKKHNKNKKESKTQRS

SEQ ID NO: 2921340 - protein, 18 aa, Entamoeba invadens
VSEDKSRGEVQSNSAENV

SEQ ID NO: 2921341 - protein, 16 aa, Entamoeba invadens
VSEDNPKEFKNEDNDF

SEQ ID NO: 2921342 - protein, 10 aa, Entamoeba invadens
VSEDPQREKQ

SEQ ID NO: 2921343 - protein, 10 aa, Entamoeba invadens
VSEDPRRDKQ

SEQ ID NO: 2921344 - protein, 7 aa, Entamoeba invadens
VSEDTKI

SEQ ID NO: 2921345 - protein, 8 aa, Entamoeba invadens
VSEDTKIA

SEQ ID NO: 2921346 - protein, 15 aa, Entamoeba invadens
VSEDTKIAFSSNDQV

SEQ ID NO: 2921347 - protein, 13 aa, Entamoeba invadens
VSEEAPVRKSSSE

SEQ ID NO: 2921348 - protein, 13 aa, Entamoeba invadens
VSEEDARKLRRGQ

SEQ ID NO: 2921349 - protein, 14 aa, Entamoeba invadens
VSEEDARKLRRGQK

SEQ ID NO: 2921350 - protein, 9 aa, Entamoeba invadens
VSEETGRQW

SEQ ID NO: 2921351 - protein, 7 aa, Entamoeba invadens
VSEETKI

SEQ ID NO: 2921352 - protein, 6 aa, Entamoeba invadens
VSEETV

SEQ ID NO: 2921353 - protein, 11 aa, Entamoeba invadens
VSEGKEPKQIQ

SEQ ID NO: 2921354 - protein, 11 aa, Entamoeba invadens
VSEGKNTKLDK

SEQ ID NO: 2921355 - protein, 7 aa, Entamoeba invadens
VSEGNPH

SEQ ID NO: 2921356 - protein, 7 aa, Entamoeba invadens
VSEGNYD

SEQ ID NO: 2921357 - protein, 14 aa, Entamoeba invadens
VSEGSDSSDEHTIS

SEQ ID NO: 2921358 - protein, 5 aa, Entamoeba invadens
VSEID

SEQ ID NO: 2921359 - protein, 10 aa, Entamoeba invadens
VSEIESTPSY

SEQ ID NO: 2921360 - protein, 17 aa, Entamoeba invadens
VSEIGPNRRAIEEASKY

SEQ ID NO: 2921361 - protein, 5 aa, Entamoeba invadens
VSEIN

SEQ ID NO: 2921362 - protein, 9 aa, Entamoeba invadens
VSEKAKEKV

SEQ ID NO: 2921363 - protein, 13 aa, Entamoeba invadens
VSEKEKPGPVMSY

SEQ ID NO: 2921364 - protein, 7 aa, Entamoeba invadens
VSEKGTA

SEQ ID NO: 2921365 - protein, 10 aa, Entamoeba invadens
VSEKSSYHHG

SEQ ID NO: 2921366 - protein, 8 aa, Entamoeba invadens
VSELDDED

SEQ ID NO: 2921367 - protein, 7 aa, Entamoeba invadens
VSELTQK

SEQ ID NO: 2921368 - protein, 5 aa, Entamoeba invadens
VSENS

SEQ ID NO: 2921369 - protein, 10 aa, Entamoeba invadens
VSENSTNPQV

SEQ ID NO: 2921370 - protein, 5 aa, Entamoeba invadens
VSENT

SEQ ID NO: 2921371 - protein, 8 aa, Entamoeba invadens
VSENTQEH

SEQ ID NO: 2921372 - protein, 12 aa, Entamoeba invadens
VSENVKSLNDPI

SEQ ID NO: 2921373 - protein, 7 aa, Entamoeba invadens
VSEPIKA

SEQ ID NO: 2921374 - protein, 7 aa, Entamoeba invadens
VSEPNPE

SEQ ID NO: 2921375 - protein, 15 aa, Entamoeba invadens
VSEPPTQRQSNANSY

SEQ ID NO: 2921376 - protein, 7 aa, Entamoeba invadens
VSEPSEI

SEQ ID NO: 2921377 - protein, 7 aa, Entamoeba invadens
VSEPTKP

SEQ ID NO: 2921378 - protein, 5 aa, Entamoeba invadens
VSEQE

SEQ ID NO: 2921379 - protein, 9 aa, Entamoeba invadens
VSEQSLEIP

SEQ ID NO: 2921380 - protein, 4 aa, Entamoeba invadens
VSER

SEQ ID NO: 2921381 - protein, 15 aa, Entamoeba invadens
VSERKKEEKSDKTKK

SEQ ID NO: 2921382 - protein, 7 aa, Entamoeba invadens
VSERTLT

SEQ ID NO: 2921383 - protein, 15 aa, Entamoeba invadens
VSESEETEDEEVETT

SEQ ID NO: 2921384 - protein, 7 aa, Entamoeba invadens
VSESYEI

SEQ ID NO: 2921385 - protein, 19 aa, Entamoeba invadens
VSETEGTKEHLNDEKRESF

SEQ ID NO: 2921386 - protein, 5 aa, Entamoeba invadens
VSETG

SEQ ID NO: 2921387 - protein, 8 aa, Entamoeba invadens
VSETSPES

SEQ ID NO: 2921388 - protein, 5 aa, Entamoeba invadens
VSETT

SEQ ID NO: 2921389 - protein, 7 aa, Entamoeba invadens
VSETVPK

SEQ ID NO: 2921390 - protein, 9 aa, Entamoeba invadens
VSEVNPEKL

SEQ ID NO: 2921391 - protein, 14 aa, Entamoeba invadens
VSEWREKHQTPTSV

SEQ ID NO: 2921392 - protein, 5 aa, Entamoeba invadens
VSEYK

SEQ ID NO: 2921393 - protein, 13 aa, Entamoeba invadens
VSFESQNKELQTR

SEQ ID NO: 2921394 - protein, 4 aa, Entamoeba invadens
VSFG

SEQ ID NO: 2921395 - protein, 10 aa, Entamoeba invadens
VSGDTEVNAN

SEQ ID NO: 2921396 - protein, 7 aa, Entamoeba invadens
VSGECTK

SEQ ID NO: 2921397 - protein, 5 aa, Entamoeba invadens
VSGEM

SEQ ID NO: 2921398 - protein, 4 aa, Entamoeba invadens
VSGF

SEQ ID NO: 2921399 - protein, 7 aa, Entamoeba invadens
VSGFDAR

SEQ ID NO: 2921400 - protein, 21 aa, Entamoeba invadens
VSGGDRYKSSDFTKYPSDKRK

SEQ ID NO: 2921401 - protein, 10 aa, Entamoeba invadens
VSGGKDSTAL

SEQ ID NO: 2921402 - protein, 7 aa, Entamoeba invadens
VSGGNEK

SEQ ID NO: 2921403 - protein, 7 aa, Entamoeba invadens
VSGGNND

SEQ ID NO: 2921404 - protein, 12 aa, Entamoeba invadens
VSGHGNKIVVWE

SEQ ID NO: 2921405 - protein, 7 aa, Entamoeba invadens
VSGIRGQ

SEQ ID NO: 2921406 - protein, 10 aa, Entamoeba invadens
VSGKKKKVTV

SEQ ID NO: 2921407 - protein, 7 aa, Entamoeba invadens
VSGKTKG

SEQ ID NO: 2921408 - protein, 32 aa, Entamoeba invadens
VSGKVSKKKVSHTSTQEEAETSFPEYKKATGK

SEQ ID NO: 2921409 - protein, 6 aa, Entamoeba invadens
VSGLAE

SEQ ID NO: 2921410 - protein, 7 aa, Entamoeba invadens
VSGNDMT

SEQ ID NO: 2921411 - protein, 5 aa, Entamoeba invadens
VSGNS

SEQ ID NO: 2921412 - protein, 14 aa, Entamoeba invadens
VSGQARVKYNEADV

SEQ ID NO: 2921413 - protein, 6 aa, Entamoeba invadens
VSGRTR

SEQ ID NO: 2921414 - protein, 7 aa, Entamoeba invadens
VSGSLND

SEQ ID NO: 2921415 - protein, 11 aa, Entamoeba invadens
VSGSLNDKIQS

SEQ ID NO: 2921416 - protein, 8 aa, Entamoeba invadens
VSGSRNSA

SEQ ID NO: 2921417 - protein, 10 aa, Entamoeba invadens
VSGSSDRKIR

SEQ ID NO: 2921418 - protein, 14 aa, Entamoeba invadens
VSGSSFTTSGIDQH

SEQ ID NO: 2921419 - protein, 10 aa, Entamoeba invadens
VSGTKIKGDM

SEQ ID NO: 2921420 - protein, 7 aa, Entamoeba invadens
VSGTPGR

SEQ ID NO: 2921421 - protein, 12 aa, Entamoeba invadens
VSGVSSHPGRTK

SEQ ID NO: 2921422 - protein, 4 aa, Entamoeba invadens
VSGY

SEQ ID NO: 2921423 - protein, 7 aa, Entamoeba invadens
VSGYPGT

SEQ ID NO: 2921424 - protein, 8 aa, Entamoeba invadens
VSHKPWSI

SEQ ID NO: 2921425 - protein, 6 aa, Entamoeba invadens
VSIAGE

SEQ ID NO: 2921426 - protein, 6 aa, Entamoeba invadens
VSIGKE

SEQ ID NO: 2921427 - protein, 9 aa, Entamoeba invadens
VSIGSNVRS

SEQ ID NO: 2921428 - protein, 18 aa, Entamoeba invadens
VSIKANKEYFGYSDSKAS

SEQ ID NO: 2921429 - protein, 21 aa, Entamoeba invadens
VSIKETSGDSLTSSEKKKRVF

SEQ ID NO: 2921430 - protein, 17 aa, Entamoeba invadens
VSINTAKEHQQKEQTTF

SEQ ID NO: 2921431 - protein, 6 aa, Entamoeba invadens
VSIPGE

SEQ ID NO: 2921432 - protein, 10 aa, Entamoeba invadens
VSIPSSINKI

SEQ ID NO: 2921433 - protein, 10 aa, Entamoeba invadens
VSIPSSVTSI

SEQ ID NO: 2921434 - protein, 12 aa, Entamoeba invadens
VSIRSSDDSNIV

SEQ ID NO: 2921435 - protein, 18 aa, Entamoeba invadens
VSISPPLSKRLQTQSEQF

SEQ ID NO: 2921436 - protein, 17 aa, Entamoeba invadens
VSITRTTSSSKTSGSIV

SEQ ID NO: 2921437 - protein, 4 aa, Entamoeba invadens
VSKD

SEQ ID NO: 2921438 - protein, 12 aa, Entamoeba invadens
VSKDTDNAEKYR

SEQ ID NO: 2921439 - protein, 12 aa, Entamoeba invadens
VSKEDGQALADK

SEQ ID NO: 2921440 - protein, 8 aa, Entamoeba invadens
VSKEEDEK

SEQ ID NO: 2921441 - protein, 7 aa, Entamoeba invadens
VSKEEEN

SEQ ID NO: 2921442 - protein, 41 aa, Entamoeba invadens
VSKEKDDEEKKKDKKKTEKKEETSPIKKEEKDEGGNITGTN

SEQ ID NO: 2921443 - protein, 7 aa, Entamoeba invadens
VSKETTK

SEQ ID NO: 2921444 - protein, 11 aa, Entamoeba invadens
VSKEVQKAIAE

SEQ ID NO: 2921445 - protein, 11 aa, Entamoeba invadens
VSKGEQNTIEG

SEQ ID NO: 2921446 - protein, 22 aa, Entamoeba invadens
VSKGKKGKNTKNEDDDLGNPDI

SEQ ID NO: 2921447 - protein, 6 aa, Entamoeba invadens
VSKGRV

SEQ ID NO: 2921448 - protein, 7 aa, Entamoeba invadens
VSKGSFD

SEQ ID NO: 2921449 - protein, 7 aa, Entamoeba invadens
VSKGVNG

SEQ ID NO: 2921450 - protein, 18 aa, Entamoeba invadens
VSKHPQNLPKSKTDFFEK

SEQ ID NO: 2921451 - protein, 8 aa, Entamoeba invadens
VSKKDAKK

SEQ ID NO: 2921452 - protein, 10 aa, Entamoeba invadens
VSKKNGYTIE

SEQ ID NO: 2921453 - protein, 8 aa, Entamoeba invadens
VSKKWPEN

SEQ ID NO: 2921454 - protein, 15 aa, Entamoeba invadens
VSKKYTNSPDATEIT

SEQ ID NO: 2921455 - protein, 13 aa, Entamoeba invadens
VSKNANDEDIKRA

SEQ ID NO: 2921456 - protein, 7 aa, Entamoeba invadens
VSKNEEV

SEQ ID NO: 2921457 - protein, 19 aa, Entamoeba invadens
VSKNEQSSYQQKKRHVGND

SEQ ID NO: 2921458 - protein, 7 aa, Entamoeba invadens
VSKNKVK

SEQ ID NO: 2921459 - protein, 17 aa, Entamoeba invadens
VSKPGMTGKTTEQRYDA

SEQ ID NO: 2921460 - protein, 9 aa, Entamoeba invadens
VSKPKVSRL

SEQ ID NO: 2921461 - protein, 7 aa, Entamoeba invadens
VSKPNCG

SEQ ID NO: 2921462 - protein, 8 aa, Entamoeba invadens
VSKQDGMD

SEQ ID NO: 2921463 - protein, 9 aa, Entamoeba invadens
VSKQIQSLD

SEQ ID NO: 2921464 - protein, 10 aa, Entamoeba invadens
VSKQLETNGL

SEQ ID NO: 2921465 - protein, 8 aa, Entamoeba invadens
VSKRDEKS

SEQ ID NO: 2921466 - protein, 22 aa, Entamoeba invadens
VSKRKNKPSAVTRALSTNGQLN

SEQ ID NO: 2921467 - protein, 9 aa, Entamoeba invadens
VSKRQKSLP

SEQ ID NO: 2921468 - protein, 7 aa, Entamoeba invadens
VSKSDLS

SEQ ID NO: 2921469 - protein, 8 aa, Entamoeba invadens
VSKSGSFT

SEQ ID NO: 2921470 - protein, 5 aa, Entamoeba invadens
VSKSS

SEQ ID NO: 2921471 - protein, 12 aa, Entamoeba invadens
VSKTAKENVEKY

SEQ ID NO: 2921472 - protein, 10 aa, Entamoeba invadens
VSKTAPSGEY

SEQ ID NO: 2921473 - protein, 13 aa, Entamoeba invadens
VSKTFSEDFSRKD

SEQ ID NO: 2921474 - protein, 14 aa, Entamoeba invadens
VSKTPDAEDKERAI

SEQ ID NO: 2921475 - protein, 35 aa, Entamoeba invadens
VSKTTLTINEKQKSAKQEEQSQKNKLGEIKFKGRN

SEQ ID NO: 2921476 - protein, 4 aa, Entamoeba invadens
VSKV

SEQ ID NO: 2921477 - protein, 9 aa, Entamoeba invadens
VSKYGDPGF

SEQ ID NO: 2921478 - protein, 5 aa, Entamoeba invadens
VSLAD

SEQ ID NO: 2921479 - protein, 8 aa, Entamoeba invadens
VSLDGRNS

SEQ ID NO: 2921480 - protein, 12 aa, Entamoeba invadens
VSLETKIESAPY

SEQ ID NO: 2921481 - protein, 5 aa, Entamoeba invadens
VSLGD

SEQ ID NO: 2921482 - protein, 7 aa, Entamoeba invadens
VSLPNTL

SEQ ID NO: 2921483 - protein, 4 aa, Entamoeba invadens
VSLS

SEQ ID NO: 2921484 - protein, 6 aa, Entamoeba invadens
VSLSAE

SEQ ID NO: 2921485 - protein, 6 aa, Entamoeba invadens
VSLSGE

SEQ ID NO: 2921486 - protein, 17 aa, Entamoeba invadens
VSMDGGNASNEDDLTTQ

SEQ ID NO: 2921487 - protein, 12 aa, Entamoeba invadens
VSNASEEAKKTL

SEQ ID NO: 2921488 - protein, 14 aa, Entamoeba invadens
VSNCKYQRNYKTQS

SEQ ID NO: 2921489 - protein, 5 aa, Entamoeba invadens
VSNDE

SEQ ID NO: 2921490 - protein, 6 aa, Entamoeba invadens
VSNDNA

SEQ ID NO: 2921491 - protein, 7 aa, Entamoeba invadens
VSNDPAF

SEQ ID NO: 2921492 - protein, 5 aa, Entamoeba invadens
VSNDQ

SEQ ID NO: 2921493 - protein, 6 aa, Entamoeba invadens
VSNEDL

SEQ ID NO: 2921494 - protein, 8 aa, Entamoeba invadens
VSNEETIQ

SEQ ID NO: 2921495 - protein, 6 aa, Entamoeba invadens
VSNEGS

SEQ ID NO: 2921496 - protein, 8 aa, Entamoeba invadens
VSNERNGY

SEQ ID NO: 2921497 - protein, 44 aa, Entamoeba invadens
VSNESSSSSSSEEEKEEEEQHTSNTFGNKKQDELEQTEKKLDEE

SEQ ID NO: 2921498 - protein, 4 aa, Entamoeba invadens
VSNF

SEQ ID NO: 2921499 - protein, 6 aa, Entamoeba invadens
VSNGDT

SEQ ID NO: 2921500 - protein, 5 aa, Entamoeba invadens
VSNGI

SEQ ID NO: 2921501 - protein, 13 aa, Entamoeba invadens
VSNGVTNKTPTVK

SEQ ID NO: 2921502 - protein, 4 aa, Entamoeba invadens
VSNI

SEQ ID NO: 2921503 - protein, 11 aa, Entamoeba invadens
VSNKEKKYSEL

SEQ ID NO: 2921504 - protein, 5 aa, Entamoeba invadens
VSNKS

SEQ ID NO: 2921505 - protein, 18 aa, Entamoeba invadens
VSNLDENAQKVPQEKPDI

SEQ ID NO: 2921506 - protein, 8 aa, Entamoeba invadens
VSNLQTSS

SEQ ID NO: 2921507 - protein, 4 aa, Entamoeba invadens
VSNM

SEQ ID NO: 2921508 - protein, 12 aa, Entamoeba invadens
VSNNATPVTENS

SEQ ID NO: 2921509 - protein, 6 aa, Entamoeba invadens
VSNNEN

SEQ ID NO: 2921510 - protein, 15 aa, Entamoeba invadens
VSNNNTLNTIEGTKN

SEQ ID NO: 2921511 - protein, 9 aa, Entamoeba invadens
VSNNPIAKI

SEQ ID NO: 2921512 - protein, 5 aa, Entamoeba invadens
VSNNR

SEQ ID NO: 2921513 - protein, 7 aa, Entamoeba invadens
VSNNRIG

SEQ ID NO: 2921514 - protein, 20 aa, Entamoeba invadens
VSNNRLGNSYEQTQKSHAQF

SEQ ID NO: 2921515 - protein, 12 aa, Entamoeba invadens
VSNNSTNDDTSE

SEQ ID NO: 2921516 - protein, 4 aa, Entamoeba invadens
VSNP

SEQ ID NO: 2921517 - protein, 5 aa, Entamoeba invadens
VSNPM

SEQ ID NO: 2921518 - protein, 7 aa, Entamoeba invadens
VSNPRTI

SEQ ID NO: 2921519 - protein, 5 aa, Entamoeba invadens
VSNQT

SEQ ID NO: 2921520 - protein, 5 aa, Entamoeba invadens
VSNRE

SEQ ID NO: 2921521 - protein, 9 aa, Entamoeba invadens
VSNRQTQTF

SEQ ID NO: 2921522 - protein, 15 aa, Entamoeba invadens
VSNSEPRNPTDQLST

SEQ ID NO: 2921523 - protein, 7 aa, Entamoeba invadens
VSNSLKE

SEQ ID NO: 2921524 - protein, 10 aa, Entamoeba invadens
VSNTEYSGDT

SEQ ID NO: 2921525 - protein, 14 aa, Entamoeba invadens
VSNTKEKEANTNIT

SEQ ID NO: 2921526 - protein, 7 aa, Entamoeba invadens
VSNTSEE

SEQ ID NO: 2921527 - protein, 8 aa, Entamoeba invadens
VSNTSKQI

SEQ ID NO: 2921528 - protein, 10 aa, Entamoeba invadens
VSNVENGEPL

SEQ ID NO: 2921529 - protein, 8 aa, Entamoeba invadens
VSNYQQNK

SEQ ID NO: 2921530 - protein, 17 aa, Entamoeba invadens
VSPAQGETPFPQTAAAP

SEQ ID NO: 2921531 - protein, 7 aa, Entamoeba invadens
VSPATTP

SEQ ID NO: 2921532 - protein, 4 aa, Entamoeba invadens
VSPD

SEQ ID NO: 2921533 - protein, 6 aa, Entamoeba invadens
VSPEDD

SEQ ID NO: 2921534 - protein, 5 aa, Entamoeba invadens
VSPEQ

SEQ ID NO: 2921535 - protein, 5 aa, Entamoeba invadens
VSPEV

SEQ ID NO: 2921536 - protein, 6 aa, Entamoeba invadens
VSPFPP

SEQ ID NO: 2921537 - protein, 8 aa, Entamoeba invadens
VSPFSDEV

SEQ ID NO: 2921538 - protein, 8 aa, Entamoeba invadens
VSPFTKSG

SEQ ID NO: 2921539 - protein, 9 aa, Entamoeba invadens
VSPFTKSGL

SEQ ID NO: 2921540 - protein, 9 aa, Entamoeba invadens
VSPHTNKKL

SEQ ID NO: 2921541 - protein, 13 aa, Entamoeba invadens
VSPIGKTSGVGLT

SEQ ID NO: 2921542 - protein, 10 aa, Entamoeba invadens
VSPKTEEDIM

SEQ ID NO: 2921543 - protein, 10 aa, Entamoeba invadens
VSPLREKERE

SEQ ID NO: 2921544 - protein, 5 aa, Entamoeba invadens
VSPLT

SEQ ID NO: 2921545 - protein, 8 aa, Entamoeba invadens
VSPLTEEG

SEQ ID NO: 2921546 - protein, 4 aa, Entamoeba invadens
VSPN

SEQ ID NO: 2921547 - protein, 5 aa, Entamoeba invadens
VSPNG

SEQ ID NO: 2921548 - protein, 8 aa, Entamoeba invadens
VSPNGLTA

SEQ ID NO: 2921549 - protein, 9 aa, Entamoeba invadens
VSPNKTLAE

SEQ ID NO: 2921550 - protein, 10 aa, Entamoeba invadens
VSPNRTPETL

SEQ ID NO: 2921551 - protein, 20 aa, Entamoeba invadens
VSPPASVAQKEKNNMLNAII

SEQ ID NO: 2921552 - protein, 10 aa, Entamoeba invadens
VSPPEEYSPR

SEQ ID NO: 2921553 - protein, 15 aa, Entamoeba invadens
VSPPGGDFSDPVTTA

SEQ ID NO: 2921554 - protein, 13 aa, Entamoeba invadens
VSPPKRKPDDDFD

SEQ ID NO: 2921555 - protein, 8 aa, Entamoeba invadens
VSPPPKVT

SEQ ID NO: 2921556 - protein, 7 aa, Entamoeba invadens
VSPPTID

SEQ ID NO: 2921557 - protein, 7 aa, Entamoeba invadens
VSPQLNL

SEQ ID NO: 2921558 - protein, 7 aa, Entamoeba invadens
VSPQLQS

SEQ ID NO: 2921559 - protein, 7 aa, Entamoeba invadens
VSPQQSD

SEQ ID NO: 2921560 - protein, 5 aa, Entamoeba invadens
VSPQT

SEQ ID NO: 2921561 - protein, 5 aa, Entamoeba invadens
VSPRT

SEQ ID NO: 2921562 - protein, 6 aa, Entamoeba invadens
VSPSDS

SEQ ID NO: 2921563 - protein, 8 aa, Entamoeba invadens
VSPSGKRT

SEQ ID NO: 2921564 - protein, 17 aa, Entamoeba invadens
VSPSGLSVKTKSVETMG

SEQ ID NO: 2921565 - protein, 9 aa, Entamoeba invadens
VSPSGVSAQ

SEQ ID NO: 2921566 - protein, 15 aa, Entamoeba invadens
VSPSHSHSDAHSTTS

SEQ ID NO: 2921567 - protein, 5 aa, Entamoeba invadens
VSPSS

SEQ ID NO: 2921568 - protein, 4 aa, Entamoeba invadens
VSPT

SEQ ID NO: 2921569 - protein, 6 aa, Entamoeba invadens
VSPTFE

SEQ ID NO: 2921570 - protein, 13 aa, Entamoeba invadens
VSPTLKDGGKKLT

SEQ ID NO: 2921571 - protein, 15 aa, Entamoeba invadens
VSPTPQEPQKTSGDI

SEQ ID NO: 2921572 - protein, 13 aa, Entamoeba invadens
VSPTTEPQEKIVV

SEQ ID NO: 2921573 - protein, 4 aa, Entamoeba invadens
VSPV

SEQ ID NO: 2921574 - protein, 23 aa, Entamoeba invadens
VSPVDNNVSSLTEEKEKPSSQNV

SEQ ID NO: 2921575 - protein, 8 aa, Entamoeba invadens
VSQADGER

SEQ ID NO: 2921576 - protein, 6 aa, Entamoeba invadens
VSQAGN

SEQ ID NO: 2921577 - protein, 7 aa, Entamoeba invadens
VSQDKRR

SEQ ID NO: 2921578 - protein, 5 aa, Entamoeba invadens
VSQED

SEQ ID NO: 2921579 - protein, 11 aa, Entamoeba invadens
VSQEEGEKLAS

SEQ ID NO: 2921580 - protein, 11 aa, Entamoeba invadens
VSQEHSSPSVL

SEQ ID NO: 2921581 - protein, 7 aa, Entamoeba invadens
VSQEPQE

SEQ ID NO: 2921582 - protein, 7 aa, Entamoeba invadens
VSQEQKE

SEQ ID NO: 2921583 - protein, 39 aa, Entamoeba invadens
VSQESKDKSSSKSSSKSWDEDDDEDDDVDKSDREPHKKN

SEQ ID NO: 2921584 - protein, 6 aa, Entamoeba invadens
VSQGEV

SEQ ID NO: 2921585 - protein, 8 aa, Entamoeba invadens
VSQGGSRQ

SEQ ID NO: 2921586 - protein, 5 aa, Entamoeba invadens
VSQKE

SEQ ID NO: 2921587 - protein, 24 aa, Entamoeba invadens
VSQLSAQGPISSNASESTESTSVN

SEQ ID NO: 2921588 - protein, 5 aa, Entamoeba invadens
VSQNG

SEQ ID NO: 2921589 - protein, 24 aa, Entamoeba invadens
VSQNSTGIIDSNTEPQTLLFQMPL

SEQ ID NO: 2921590 - protein, 18 aa, Entamoeba invadens
VSQPFSNETDPKTPRSGR

SEQ ID NO: 2921591 - protein, 19 aa, Entamoeba invadens
VSQPKINSSVKKQKTKEII

SEQ ID NO: 2921592 - protein, 8 aa, Entamoeba invadens
VSQPTEID

SEQ ID NO: 2921593 - protein, 4 aa, Entamoeba invadens
VSQQ

SEQ ID NO: 2921594 - protein, 11 aa, Entamoeba invadens
VSQQPTNPSIR

SEQ ID NO: 2921595 - protein, 7 aa, Entamoeba invadens
VSQQRES

SEQ ID NO: 2921596 - protein, 21 aa, Entamoeba invadens
VSQQYENKPVEVSHPHSENDG

SEQ ID NO: 2921597 - protein, 9 aa, Entamoeba invadens
VSQRCSSRY

SEQ ID NO: 2921598 - protein, 4 aa, Entamoeba invadens
VSQS

SEQ ID NO: 2921599 - protein, 11 aa, Entamoeba invadens
VSQSDNNPSQV

SEQ ID NO: 2921600 - protein, 9 aa, Entamoeba invadens
VSQSGNEDA

SEQ ID NO: 2921601 - protein, 15 aa, Entamoeba invadens
VSQSKRSDVETSSKM

SEQ ID NO: 2921602 - protein, 6 aa, Entamoeba invadens
VSQSVT

SEQ ID NO: 2921603 - protein, 11 aa, Entamoeba invadens
VSQTDQSVYTP

SEQ ID NO: 2921604 - protein, 23 aa, Entamoeba invadens
VSQTPPTRRRSHKSKQTTKKIKF

SEQ ID NO: 2921605 - protein, 7 aa, Entamoeba invadens
VSQYTTK

SEQ ID NO: 2921606 - protein, 4 aa, Entamoeba invadens
VSRD

SEQ ID NO: 2921607 - protein, 16 aa, Entamoeba invadens
VSRDQTEVNTKTVENT

SEQ ID NO: 2921608 - protein, 22 aa, Entamoeba invadens
VSREKSPTRVQSERPRNGKDKE

SEQ ID NO: 2921609 - protein, 8 aa, Entamoeba invadens
VSRGQSNG

SEQ ID NO: 2921610 - protein, 7 aa, Entamoeba invadens
VSRISEP

SEQ ID NO: 2921611 - protein, 4 aa, Entamoeba invadens
VSRP

SEQ ID NO: 2921612 - protein, 7 aa, Entamoeba invadens
VSRQDDL

SEQ ID NO: 2921613 - protein, 12 aa, Entamoeba invadens
VSRQSRSMKNNT

SEQ ID NO: 2921614 - protein, 7 aa, Entamoeba invadens
VSRRSNR

SEQ ID NO: 2921615 - protein, 5 aa, Entamoeba invadens
VSRSA

SEQ ID NO: 2921616 - protein, 5 aa, Entamoeba invadens
VSRSE

SEQ ID NO: 2921617 - protein, 4 aa, Entamoeba invadens
VSSA

SEQ ID NO: 2921618 - protein, 11 aa, Entamoeba invadens
VSSAPELKEKI

SEQ ID NO: 2921619 - protein, 14 aa, Entamoeba invadens
VSSDDEAESGSTMM

SEQ ID NO: 2921620 - protein, 10 aa, Entamoeba invadens
VSSDTLESET

SEQ ID NO: 2921621 - protein, 5 aa, Entamoeba invadens
VSSED

SEQ ID NO: 2921622 - protein, 6 aa, Entamoeba invadens
VSSEDA

SEQ ID NO: 2921623 - protein, 8 aa, Entamoeba invadens
VSSEDGKI

SEQ ID NO: 2921624 - protein, 7 aa, Entamoeba invadens
VSSEDSK

SEQ ID NO: 2921625 - protein, 15 aa, Entamoeba invadens
VSSEEQKVSEENTKT

SEQ ID NO: 2921626 - protein, 10 aa, Entamoeba invadens
VSSEKINSTD

SEQ ID NO: 2921627 - protein, 16 aa, Entamoeba invadens
VSSENQEKQNSSDTEV

SEQ ID NO: 2921628 - protein, 11 aa, Entamoeba invadens
VSSENSTITET

SEQ ID NO: 2921629 - protein, 8 aa, Entamoeba invadens
VSSFGNNA

SEQ ID NO: 2921630 - protein, 14 aa, Entamoeba invadens
VSSFPKQNNIPSTI

SEQ ID NO: 2921631 - protein, 10 aa, Entamoeba invadens
VSSGAPSAIN

SEQ ID NO: 2921632 - protein, 10 aa, Entamoeba invadens
VSSGAPSAIS

SEQ ID NO: 2921633 - protein, 7 aa, Entamoeba invadens
VSSGNGA

SEQ ID NO: 2921634 - protein, 6 aa, Entamoeba invadens
VSSGPM

SEQ ID NO: 2921635 - protein, 8 aa, Entamoeba invadens
VSSGSKDC

SEQ ID NO: 2921636 - protein, 7 aa, Entamoeba invadens
VSSGSTF

SEQ ID NO: 2921637 - protein, 9 aa, Entamoeba invadens
VSSHRSKIN

SEQ ID NO: 2921638 - protein, 13 aa, Entamoeba invadens
VSSIQDKTTRSAL

SEQ ID NO: 2921639 - protein, 8 aa, Entamoeba invadens
VSSKASIS

SEQ ID NO: 2921640 - protein, 5 aa, Entamoeba invadens
VSSKD

SEQ ID NO: 2921641 - protein, 8 aa, Entamoeba invadens
VSSKGDSA

SEQ ID NO: 2921642 - protein, 8 aa, Entamoeba invadens
VSSKKNLT

SEQ ID NO: 2921643 - protein, 6 aa, Entamoeba invadens
VSSKRI

SEQ ID NO: 2921644 - protein, 9 aa, Entamoeba invadens
VSSKTGDGI

SEQ ID NO: 2921645 - protein, 7 aa, Entamoeba invadens
VSSKVGS

SEQ ID NO: 2921646 - protein, 7 aa, Entamoeba invadens
VSSLGRK

SEQ ID NO: 2921647 - protein, 5 aa, Entamoeba invadens
VSSNA

SEQ ID NO: 2921648 - protein, 7 aa, Entamoeba invadens
VSSNEMD

SEQ ID NO: 2921649 - protein, 6 aa, Entamoeba invadens
VSSNEQ

SEQ ID NO: 2921650 - protein, 21 aa, Entamoeba invadens
VSSNFYKAKDKKVSLAEEVSG

SEQ ID NO: 2921651 - protein, 6 aa, Entamoeba invadens
VSSNKD

SEQ ID NO: 2921652 - protein, 9 aa, Entamoeba invadens
VSSNNLTEV

SEQ ID NO: 2921653 - protein, 12 aa, Entamoeba invadens
VSSNSPPTLSGP

SEQ ID NO: 2921654 - protein, 6 aa, Entamoeba invadens
VSSNTA

SEQ ID NO: 2921655 - protein, 16 aa, Entamoeba invadens
VSSNYTTSTAYRTESL

SEQ ID NO: 2921656 - protein, 5 aa, Entamoeba invadens
VSSPN

SEQ ID NO: 2921657 - protein, 8 aa, Entamoeba invadens
VSSPNTYC

SEQ ID NO: 2921658 - protein, 8 aa, Entamoeba invadens
VSSPNWKE

SEQ ID NO: 2921659 - protein, 22 aa, Entamoeba invadens
VSSPPTYKHANSSSNPNQMRNT

SEQ ID NO: 2921660 - protein, 16 aa, Entamoeba invadens
VSSPPVSNANSQVKYC

SEQ ID NO: 2921661 - protein, 5 aa, Entamoeba invadens
VSSPT

SEQ ID NO: 2921662 - protein, 8 aa, Entamoeba invadens
VSSQAKKD

SEQ ID NO: 2921663 - protein, 17 aa, Entamoeba invadens
VSSQSSETDEKSKTKEI

SEQ ID NO: 2921664 - protein, 5 aa, Entamoeba invadens
VSSQT

SEQ ID NO: 2921665 - protein, 5 aa, Entamoeba invadens
VSSRK

SEQ ID NO: 2921666 - protein, 7 aa, Entamoeba invadens
VSSSDKK

SEQ ID NO: 2921667 - protein, 8 aa, Entamoeba invadens
VSSSDNKV

SEQ ID NO: 2921668 - protein, 9 aa, Entamoeba invadens
VSSSDTKAI

SEQ ID NO: 2921669 - protein, 38 aa, Entamoeba invadens
VSSSEQKILSKSKELKKSKELKKSKEAIKSTDLNRSKS

SEQ ID NO: 2921670 - protein, 21 aa, Entamoeba invadens
VSSSKKEDATRLANMKKYFES

SEQ ID NO: 2921671 - protein, 10 aa, Entamoeba invadens
VSSSKNVQSE

SEQ ID NO: 2921672 - protein, 8 aa, Entamoeba invadens
VSSSNEEL

SEQ ID NO: 2921673 - protein, 14 aa, Entamoeba invadens
VSSSNRNSIYSNNS

SEQ ID NO: 2921674 - protein, 5 aa, Entamoeba invadens
VSSSQ

SEQ ID NO: 2921675 - protein, 9 aa, Entamoeba invadens
VSSSSNVNV

SEQ ID NO: 2921676 - protein, 20 aa, Entamoeba invadens
VSSSSSSSSSSSDSEDTPTF

SEQ ID NO: 2921677 - protein, 11 aa, Entamoeba invadens
VSSTIKKRGEM

SEQ ID NO: 2921678 - protein, 5 aa, Entamoeba invadens
VSSTT

SEQ ID NO: 2921679 - protein, 13 aa, Entamoeba invadens
VSSTTAPSGYSKS

SEQ ID NO: 2921680 - protein, 17 aa, Entamoeba invadens
VSSTYSEIEKDKNNTLQ

SEQ ID NO: 2921681 - protein, 7 aa, Entamoeba invadens
VSSVESI

SEQ ID NO: 2921682 - protein, 6 aa, Entamoeba invadens
VSSYEP

SEQ ID NO: 2921683 - protein, 8 aa, Entamoeba invadens
VSTAPIKV

SEQ ID NO: 2921684 - protein, 9 aa, Entamoeba invadens
VSTAPSLEQ

SEQ ID NO: 2921685 - protein, 38 aa, Entamoeba invadens
VSTAQQNSQGQGDGKPTGYPISPFNSSDEGLRERTRKA

SEQ ID NO: 2921686 - protein, 9 aa, Entamoeba invadens
VSTATESDY

SEQ ID NO: 2921687 - protein, 4 aa, Entamoeba invadens
VSTD

SEQ ID NO: 2921688 - protein, 7 aa, Entamoeba invadens
VSTDPNQ

SEQ ID NO: 2921689 - protein, 7 aa, Entamoeba invadens
VSTDRTI

SEQ ID NO: 2921690 - protein, 6 aa, Entamoeba invadens
VSTDTG

SEQ ID NO: 2921691 - protein, 6 aa, Entamoeba invadens
VSTEKG

SEQ ID NO: 2921692 - protein, 32 aa, Entamoeba invadens
VSTEKGIKGLTKKVRKSLGKIKEKSFGGEEES

SEQ ID NO: 2921693 - protein, 6 aa, Entamoeba invadens
VSTEKI

SEQ ID NO: 2921694 - protein, 13 aa, Entamoeba invadens
VSTEKKIEEHGGE

SEQ ID NO: 2921695 - protein, 5 aa, Entamoeba invadens
VSTEN

SEQ ID NO: 2921696 - protein, 5 aa, Entamoeba invadens
VSTER

SEQ ID NO: 2921697 - protein, 15 aa, Entamoeba invadens
VSTESNTSSSSTVSV

SEQ ID NO: 2921698 - protein, 4 aa, Entamoeba invadens
VSTG

SEQ ID NO: 2921699 - protein, 5 aa, Entamoeba invadens
VSTGF

SEQ ID NO: 2921700 - protein, 11 aa, Entamoeba invadens
VSTGKKAQFTR

SEQ ID NO: 2921701 - protein, 10 aa, Entamoeba invadens
VSTGKRPVTI

SEQ ID NO: 2921702 - protein, 8 aa, Entamoeba invadens
VSTHPPIN

SEQ ID NO: 2921703 - protein, 10 aa, Entamoeba invadens
VSTHSQIGSL

SEQ ID NO: 2921704 - protein, 4 aa, Entamoeba invadens
VSTI

SEQ ID NO: 2921705 - protein, 6 aa, Entamoeba invadens
VSTKGR

SEQ ID NO: 2921706 - protein, 14 aa, Entamoeba invadens
VSTKTDKDKVDDLQ

SEQ ID NO: 2921707 - protein, 8 aa, Entamoeba invadens
VSTKYSNV

SEQ ID NO: 2921708 - protein, 4 aa, Entamoeba invadens
VSTL

SEQ ID NO: 2921709 - protein, 5 aa, Entamoeba invadens
VSTNA

SEQ ID NO: 2921710 - protein, 37 aa, Entamoeba invadens
VSTNEIGEGGYQTEEQKKLRTQKDGFREKWDGANDSQ

SEQ ID NO: 2921711 - protein, 12 aa, Entamoeba invadens
VSTNGRGATGVG

SEQ ID NO: 2921712 - protein, 8 aa, Entamoeba invadens
VSTNGRKE

SEQ ID NO: 2921713 - protein, 6 aa, Entamoeba invadens
VSTPGK

SEQ ID NO: 2921714 - protein, 9 aa, Entamoeba invadens
VSTPKTPTL

SEQ ID NO: 2921715 - protein, 8 aa, Entamoeba invadens
VSTPQTSL

SEQ ID NO: 2921716 - protein, 26 aa, Entamoeba invadens
VSTPVQQTTSTQPGPLTQTTLNAPTH

SEQ ID NO: 2921717 - protein, 10 aa, Entamoeba invadens
VSTQEGQALA

SEQ ID NO: 2921718 - protein, 6 aa, Entamoeba invadens
VSTQEY

SEQ ID NO: 2921719 - protein, 11 aa, Entamoeba invadens
VSTQKEKNSWG

SEQ ID NO: 2921720 - protein, 6 aa, Entamoeba invadens
VSTQRI

SEQ ID NO: 2921721 - protein, 8 aa, Entamoeba invadens
VSTQTMQT

SEQ ID NO: 2921722 - protein, 10 aa, Entamoeba invadens
VSTRADTYSF

SEQ ID NO: 2921723 - protein, 11 aa, Entamoeba invadens
VSTRLSENTEI

SEQ ID NO: 2921724 - protein, 6 aa, Entamoeba invadens
VSTRVQ

SEQ ID NO: 2921725 - protein, 4 aa, Entamoeba invadens
VSTS

SEQ ID NO: 2921726 - protein, 6 aa, Entamoeba invadens
VSTSAG

SEQ ID NO: 2921727 - protein, 9 aa, Entamoeba invadens
VSTSEEEDV

SEQ ID NO: 2921728 - protein, 8 aa, Entamoeba invadens
VSTSEGTL

SEQ ID NO: 2921729 - protein, 10 aa, Entamoeba invadens
VSTSEQATNV

SEQ ID NO: 2921730 - protein, 11 aa, Entamoeba invadens
VSTSKQFVSER

SEQ ID NO: 2921731 - protein, 22 aa, Entamoeba invadens
VSTSNKLVSDKYGNGNTLQHPY

SEQ ID NO: 2921732 - protein, 8 aa, Entamoeba invadens
VSTTNSMN

SEQ ID NO: 2921733 - protein, 16 aa, Entamoeba invadens
VSTTQMDEENTKTIKP

SEQ ID NO: 2921734 - protein, 17 aa, Entamoeba invadens
VSTVGPTSPYVSFMEFK

SEQ ID NO: 2921735 - protein, 8 aa, Entamoeba invadens
VSTWASNS

SEQ ID NO: 2921736 - protein, 7 aa, Entamoeba invadens
VSVDENG

SEQ ID NO: 2921737 - protein, 27 aa, Entamoeba invadens
VSVDETRATLESRSESLSKKSQELDAE

SEQ ID NO: 2921738 - protein, 11 aa, Entamoeba invadens
VSVEYTEDEKK

SEQ ID NO: 2921739 - protein, 5 aa, Entamoeba invadens
VSVNG

SEQ ID NO: 2921740 - protein, 20 aa, Entamoeba invadens
VSVNGGTITRLSKENGGNFD

SEQ ID NO: 2921741 - protein, 4 aa, Entamoeba invadens
VSVQ

SEQ ID NO: 2921742 - protein, 6 aa, Entamoeba invadens
VSVSGT

SEQ ID NO: 2921743 - protein, 12 aa, Entamoeba invadens
VSVSNDQKVYEN

SEQ ID NO: 2921744 - protein, 9 aa, Entamoeba invadens
VSVSNTSST

SEQ ID NO: 2921745 - protein, 7 aa, Entamoeba invadens
VSVSPED

SEQ ID NO: 2921746 - protein, 6 aa, Entamoeba invadens
VSVSSQ

SEQ ID NO: 2921747 - protein, 5 aa, Entamoeba invadens
VSVTD

SEQ ID NO: 2921748 - protein, 5 aa, Entamoeba invadens
VSVTN

SEQ ID NO: 2921749 - protein, 5 aa, Entamoeba invadens
VSYDE

SEQ ID NO: 2921750 - protein, 12 aa, Entamoeba invadens
VSYDGKQNESPL

SEQ ID NO: 2921751 - protein, 7 aa, Entamoeba invadens
VSYEAEQ

SEQ ID NO: 2921752 - protein, 12 aa, Entamoeba invadens
VSYKGENREGIY

SEQ ID NO: 2921753 - protein, 19 aa, Entamoeba invadens
VSYKKGQKERCDKHDGRTK

SEQ ID NO: 2921754 - protein, 5 aa, Entamoeba invadens
VSYQS

SEQ ID NO: 2921755 - protein, 17 aa, Entamoeba invadens
VSYSKDEERAKESKDET

SEQ ID NO: 2921756 - protein, 5 aa, Entamoeba invadens
VSYTS

SEQ ID NO: 2921757 - protein, 10 aa, Entamoeba invadens
VSYVTKEKNE

SEQ ID NO: 2921758 - protein, 6 aa, Entamoeba invadens
VTAIGS

SEQ ID NO: 2921759 - protein, 9 aa, Entamoeba invadens
VTANSKGKC

SEQ ID NO: 2921760 - protein, 11 aa, Entamoeba invadens
VTANTLSDETL

SEQ ID NO: 2921761 - protein, 47 aa, Entamoeba invadens
VTAPAVAAAPRRERGEQRGEKRGFGNRRGGRGAPRGRGARKEGSGEW

SEQ ID NO: 2921762 - protein, 9 aa, Entamoeba invadens
VTAPENRDH

SEQ ID NO: 2921763 - protein, 7 aa, Entamoeba invadens
VTAPGVK

SEQ ID NO: 2921764 - protein, 7 aa, Entamoeba invadens
VTAPKEK

SEQ ID NO: 2921765 - protein, 34 aa, Entamoeba invadens
VTAPKERRPPPSNLSKENIPHQQAQQVQQTQQPN

SEQ ID NO: 2921766 - protein, 8 aa, Entamoeba invadens
VTAPPNGD

SEQ ID NO: 2921767 - protein, 13 aa, Entamoeba invadens
VTAPPNGDIAANM

SEQ ID NO: 2921768 - protein, 12 aa, Entamoeba invadens
VTAQSTRIDPDE

SEQ ID NO: 2921769 - protein, 10 aa, Entamoeba invadens
VTASAGIEGT

SEQ ID NO: 2921770 - protein, 9 aa, Entamoeba invadens
VTASDEKNL

SEQ ID NO: 2921771 - protein, 6 aa, Entamoeba invadens
VTASEE

SEQ ID NO: 2921772 - protein, 9 aa, Entamoeba invadens
VTASGKRTT

SEQ ID NO: 2921773 - protein, 8 aa, Entamoeba invadens
VTASSSKA

SEQ ID NO: 2921774 - protein, 9 aa, Entamoeba invadens
VTASSSKAF

SEQ ID NO: 2921775 - protein, 4 aa, Entamoeba invadens
VTAT

SEQ ID NO: 2921776 - protein, 7 aa, Entamoeba invadens
VTATERY

SEQ ID NO: 2921777 - protein, 6 aa, Entamoeba invadens
VTATSP

SEQ ID NO: 2921778 - protein, 75 aa, Entamoeba invadens
VTAVEEKKEEVKVPPKVKEKEKTLQNSPQKELKTPEQPKEKIKTEEPKIEELNQKAAENVSESTIETIKENEVEK

SEQ ID NO: 2921779 - protein, 5 aa, Entamoeba invadens
VTCDN

SEQ ID NO: 2921780 - protein, 4 aa, Entamoeba invadens
VTDA

SEQ ID NO: 2921781 - protein, 13 aa, Entamoeba invadens
VTDADVKDSISRL

SEQ ID NO: 2921782 - protein, 5 aa, Entamoeba invadens
VTDAE

SEQ ID NO: 2921783 - protein, 8 aa, Entamoeba invadens
VTDAESEG

SEQ ID NO: 2921784 - protein, 7 aa, Entamoeba invadens
VTDASSK

SEQ ID NO: 2921785 - protein, 4 aa, Entamoeba invadens
VTDD

SEQ ID NO: 2921786 - protein, 8 aa, Entamoeba invadens
VTDDENIE

SEQ ID NO: 2921787 - protein, 11 aa, Entamoeba invadens
VTDDKSLPKIT

SEQ ID NO: 2921788 - protein, 11 aa, Entamoeba invadens
VTDDLTDDQYN

SEQ ID NO: 2921789 - protein, 10 aa, Entamoeba invadens
VTDDPAKRNQ

SEQ ID NO: 2921790 - protein, 10 aa, Entamoeba invadens
VTDDSDTLDG

SEQ ID NO: 2921791 - protein, 4 aa, Entamoeba invadens
VTDE

SEQ ID NO: 2921792 - protein, 12 aa, Entamoeba invadens
VTDEEITREEAL

SEQ ID NO: 2921793 - protein, 10 aa, Entamoeba invadens
VTDEKAQTDM

SEQ ID NO: 2921794 - protein, 17 aa, Entamoeba invadens
VTDEKELAQQRKFKKNN

SEQ ID NO: 2921795 - protein, 30 aa, Entamoeba invadens
VTDEKKLAEQRKIKKSDSATVKQLSQRRAR

SEQ ID NO: 2921796 - protein, 17 aa, Entamoeba invadens
VTDENKEQPEQCVENDD

SEQ ID NO: 2921797 - protein, 12 aa, Entamoeba invadens
VTDGAEIDISKT

SEQ ID NO: 2921798 - protein, 10 aa, Entamoeba invadens
VTDGKNGAQV

SEQ ID NO: 2921799 - protein, 4 aa, Entamoeba invadens
VTDH

SEQ ID NO: 2921800 - protein, 10 aa, Entamoeba invadens
VTDKATNKKY

SEQ ID NO: 2921801 - protein, 6 aa, Entamoeba invadens
VTDKNI

SEQ ID NO: 2921802 - protein, 6 aa, Entamoeba invadens
VTDKNK

SEQ ID NO: 2921803 - protein, 5 aa, Entamoeba invadens
VTDPE

SEQ ID NO: 2921804 - protein, 6 aa, Entamoeba invadens
VTDPKF

SEQ ID NO: 2921805 - protein, 11 aa, Entamoeba invadens
VTDPNGNEVPV

SEQ ID NO: 2921806 - protein, 7 aa, Entamoeba invadens
VTDPNSR

SEQ ID NO: 2921807 - protein, 10 aa, Entamoeba invadens
VTDRNAPDGA

SEQ ID NO: 2921808 - protein, 10 aa, Entamoeba invadens
VTDRRSVRMP

SEQ ID NO: 2921809 - protein, 19 aa, Entamoeba invadens
VTDSKAKLVDAGATGASIA

SEQ ID NO: 2921810 - protein, 7 aa, Entamoeba invadens
VTDSRRH

SEQ ID NO: 2921811 - protein, 9 aa, Entamoeba invadens
VTDSTLEER

SEQ ID NO: 2921812 - protein, 8 aa, Entamoeba invadens
VTDTEQGS

SEQ ID NO: 2921813 - protein, 7 aa, Entamoeba invadens
VTDVEEM

SEQ ID NO: 2921814 - protein, 4 aa, Entamoeba invadens
VTEA

SEQ ID NO: 2921815 - protein, 7 aa, Entamoeba invadens
VTEAQDD

SEQ ID NO: 2921816 - protein, 11 aa, Entamoeba invadens
VTEARQVGDSL

SEQ ID NO: 2921817 - protein, 13 aa, Entamoeba invadens
VTEATEFDDAKTK

SEQ ID NO: 2921818 - protein, 4 aa, Entamoeba invadens
VTED

SEQ ID NO: 2921819 - protein, 6 aa, Entamoeba invadens
VTEDEV

SEQ ID NO: 2921820 - protein, 12 aa, Entamoeba invadens
VTEDQAKEFAKT

SEQ ID NO: 2921821 - protein, 15 aa, Entamoeba invadens
VTEEANKKVTRDRVE

SEQ ID NO: 2921822 - protein, 8 aa, Entamoeba invadens
VTEEDKKV

SEQ ID NO: 2921823 - protein, 7 aa, Entamoeba invadens
VTEEGKI

SEQ ID NO: 2921824 - protein, 36 aa, Entamoeba invadens
VTEEHNEKQIQQPKKQKRTTKRKTHTKPISQNHQAQ

SEQ ID NO: 2921825 - protein, 8 aa, Entamoeba invadens
VTEEPAEA

SEQ ID NO: 2921826 - protein, 9 aa, Entamoeba invadens
VTEEPLDGT

SEQ ID NO: 2921827 - protein, 7 aa, Entamoeba invadens
VTEEQRG

SEQ ID NO: 2921828 - protein, 7 aa, Entamoeba invadens
VTEESIN

SEQ ID NO: 2921829 - protein, 8 aa, Entamoeba invadens
VTEESQEV

SEQ ID NO: 2921830 - protein, 7 aa, Entamoeba invadens
VTEETAL

SEQ ID NO: 2921831 - protein, 13 aa, Entamoeba invadens
VTEFDSDDEDLNA

SEQ ID NO: 2921832 - protein, 11 aa, Entamoeba invadens
VTEGDLKDQRH

SEQ ID NO: 2921833 - protein, 15 aa, Entamoeba invadens
VTEGGDKEKVEEKAQ

SEQ ID NO: 2921834 - protein, 7 aa, Entamoeba invadens
VTEGKSI

SEQ ID NO: 2921835 - protein, 5 aa, Entamoeba invadens
VTEGN

SEQ ID NO: 2921836 - protein, 8 aa, Entamoeba invadens
VTEGNGVV

SEQ ID NO: 2921837 - protein, 14 aa, Entamoeba invadens
VTEGPKNKVEKVEK

SEQ ID NO: 2921838 - protein, 9 aa, Entamoeba invadens
VTEGTASRR

SEQ ID NO: 2921839 - protein, 6 aa, Entamoeba invadens
VTEGTE

SEQ ID NO: 2921840 - protein, 6 aa, Entamoeba invadens
VTEIGE

SEQ ID NO: 2921841 - protein, 7 aa, Entamoeba invadens
VTEIGEG

SEQ ID NO: 2921842 - protein, 10 aa, Entamoeba invadens
VTEKEYQSQL

SEQ ID NO: 2921843 - protein, 13 aa, Entamoeba invadens
VTEKPQKRYPSVK

SEQ ID NO: 2921844 - protein, 4 aa, Entamoeba invadens
VTEL

SEQ ID NO: 2921845 - protein, 4 aa, Entamoeba invadens
VTEN

SEQ ID NO: 2921846 - protein, 5 aa, Entamoeba invadens
VTEND

SEQ ID NO: 2921847 - protein, 11 aa, Entamoeba invadens
VTENEATGDVY

SEQ ID NO: 2921848 - protein, 4 aa, Entamoeba invadens
VTEQ

SEQ ID NO: 2921849 - protein, 12 aa, Entamoeba invadens
VTEQSELSRRRS

SEQ ID NO: 2921850 - protein, 4 aa, Entamoeba invadens
VTER

SEQ ID NO: 2921851 - protein, 6 aa, Entamoeba invadens
VTERDQ

SEQ ID NO: 2921852 - protein, 15 aa, Entamoeba invadens
VTERPEGKIAKYAES

SEQ ID NO: 2921853 - protein, 9 aa, Entamoeba invadens
VTESGRKEL

SEQ ID NO: 2921854 - protein, 6 aa, Entamoeba invadens
VTESTI

SEQ ID NO: 2921855 - protein, 74 aa, Entamoeba invadens
VTESTPLNDQKTTPNTETVPAQTTTTYQGIDNTKQDAPKEQKQAEGTHTPQPKGDAPVIEDRPNGKKEVVSGDK

SEQ ID NO: 2921856 - protein, 4 aa, Entamoeba invadens
VTET

SEQ ID NO: 2921857 - protein, 7 aa, Entamoeba invadens
VTETDSI

SEQ ID NO: 2921858 - protein, 10 aa, Entamoeba invadens
VTETEPTYKA

SEQ ID NO: 2921859 - protein, 6 aa, Entamoeba invadens
VTETKA

SEQ ID NO: 2921860 - protein, 6 aa, Entamoeba invadens
VTETLD

SEQ ID NO: 2921861 - protein, 8 aa, Entamoeba invadens
VTETLDED

SEQ ID NO: 2921862 - protein, 13 aa, Entamoeba invadens
VTETNETKESKKG

SEQ ID NO: 2921863 - protein, 6 aa, Entamoeba invadens
VTETNN

SEQ ID NO: 2921864 - protein, 7 aa, Entamoeba invadens
VTETPDC

SEQ ID NO: 2921865 - protein, 6 aa, Entamoeba invadens
VTETTK

SEQ ID NO: 2921866 - protein, 8 aa, Entamoeba invadens
VTETVPSI

SEQ ID NO: 2921867 - protein, 5 aa, Entamoeba invadens
VTEVE

SEQ ID NO: 2921868 - protein, 39 aa, Entamoeba invadens
VTEVGGQEITRKDKPLPKPPKEEIKKEQPQKVDKPVEVE

SEQ ID NO: 2921869 - protein, 5 aa, Entamoeba invadens
VTEVT

SEQ ID NO: 2921870 - protein, 9 aa, Entamoeba invadens
VTFETTPKM

SEQ ID NO: 2921871 - protein, 47 aa, Entamoeba invadens
VTGAKSPRKDGLVSPRKDGLLSPRKDGMVSPRKLSSNETIPNKTEEV

SEQ ID NO: 2921872 - protein, 14 aa, Entamoeba invadens
VTGDKADKKEKKHH

SEQ ID NO: 2921873 - protein, 9 aa, Entamoeba invadens
VTGDKKDWD

SEQ ID NO: 2921874 - protein, 4 aa, Entamoeba invadens
VTGE

SEQ ID NO: 2921875 - protein, 9 aa, Entamoeba invadens
VTGEGDKKD

SEQ ID NO: 2921876 - protein, 20 aa, Entamoeba invadens
VTGERKCTKCSTPNMYPNDT

SEQ ID NO: 2921877 - protein, 7 aa, Entamoeba invadens
VTGETQK

SEQ ID NO: 2921878 - protein, 6 aa, Entamoeba invadens
VTGGDD

SEQ ID NO: 2921879 - protein, 5 aa, Entamoeba invadens
VTGGK

SEQ ID NO: 2921880 - protein, 6 aa, Entamoeba invadens
VTGKEN

SEQ ID NO: 2921881 - protein, 8 aa, Entamoeba invadens
VTGKGCES

SEQ ID NO: 2921882 - protein, 10 aa, Entamoeba invadens
VTGKKCGEVE

SEQ ID NO: 2921883 - protein, 26 aa, Entamoeba invadens
VTGKNTDFETLQNESEKTQETFGGQE

SEQ ID NO: 2921884 - protein, 11 aa, Entamoeba invadens
VTGKNTSGDVE

SEQ ID NO: 2921885 - protein, 23 aa, Entamoeba invadens
VTGKRKCTKYSTPNMYPDDTSHT

SEQ ID NO: 2921886 - protein, 9 aa, Entamoeba invadens
VTGKSPDEI

SEQ ID NO: 2921887 - protein, 9 aa, Entamoeba invadens
VTGKTKKQC

SEQ ID NO: 2921888 - protein, 7 aa, Entamoeba invadens
VTGNDNG

SEQ ID NO: 2921889 - protein, 11 aa, Entamoeba invadens
VTGNNVPQKEL

SEQ ID NO: 2921890 - protein, 5 aa, Entamoeba invadens
VTGNR

SEQ ID NO: 2921891 - protein, 13 aa, Entamoeba invadens
VTGNSSASGTINS

SEQ ID NO: 2921892 - protein, 6 aa, Entamoeba invadens
VTGPYN

SEQ ID NO: 2921893 - protein, 12 aa, Entamoeba invadens
VTGRTPENFNQQ

SEQ ID NO: 2921894 - protein, 7 aa, Entamoeba invadens
VTGSESC

SEQ ID NO: 2921895 - protein, 13 aa, Entamoeba invadens
VTGSNDGVVYSTT

SEQ ID NO: 2921896 - protein, 8 aa, Entamoeba invadens
VTGSSDRT

SEQ ID NO: 2921897 - protein, 6 aa, Entamoeba invadens
VTGSYE

SEQ ID NO: 2921898 - protein, 14 aa, Entamoeba invadens
VTGTIGSADDEQML

SEQ ID NO: 2921899 - protein, 6 aa, Entamoeba invadens
VTGTNN

SEQ ID NO: 2921900 - protein, 11 aa, Entamoeba invadens
VTGTPDQPARV

SEQ ID NO: 2921901 - protein, 8 aa, Entamoeba invadens
VTGTSSGL

SEQ ID NO: 2921902 - protein, 8 aa, Entamoeba invadens
VTGTYTGK

SEQ ID NO: 2921903 - protein, 7 aa, Entamoeba invadens
VTGWSKT

SEQ ID NO: 2921904 - protein, 7 aa, Entamoeba invadens
VTGYDKK

SEQ ID NO: 2921905 - protein, 16 aa, Entamoeba invadens
VTGYQNTGQPGITPTT

SEQ ID NO: 2921906 - protein, 6 aa, Entamoeba invadens
VTHQNA

SEQ ID NO: 2921907 - protein, 78 aa, Entamoeba invadens
VTHSQKKSGNPFGVDSDDEDTKPTQVQTKETKPLANPFGDDSEEDVPVQKQPHRPSKGNANSFETSKTNTKTKTTTVT

SEQ ID NO: 2921908 - protein, 4 aa, Entamoeba invadens
VTHY

SEQ ID NO: 2921909 - protein, 24 aa, Entamoeba invadens
VTINGKTVTVTSNAAVGGKGNMRM

SEQ ID NO: 2921910 - protein, 5 aa, Entamoeba invadens
VTIPA

SEQ ID NO: 2921911 - protein, 5 aa, Entamoeba invadens
VTIPD

SEQ ID NO: 2921912 - protein, 5 aa, Entamoeba invadens
VTIPP

SEQ ID NO: 2921913 - protein, 9 aa, Entamoeba invadens
VTIPPGVTS

SEQ ID NO: 2921914 - protein, 9 aa, Entamoeba invadens
VTIPPSITS

SEQ ID NO: 2921915 - protein, 8 aa, Entamoeba invadens
VTIPQKVT

SEQ ID NO: 2921916 - protein, 6 aa, Entamoeba invadens
VTIPSG

SEQ ID NO: 2921917 - protein, 9 aa, Entamoeba invadens
VTIPSGVSS

SEQ ID NO: 2921918 - protein, 11 aa, Entamoeba invadens
VTIPSGVTSIG

SEQ ID NO: 2921919 - protein, 8 aa, Entamoeba invadens
VTIPSNVT

SEQ ID NO: 2921920 - protein, 11 aa, Entamoeba invadens
VTIPSSIKSIG

SEQ ID NO: 2921921 - protein, 8 aa, Entamoeba invadens
VTIPSSIT

SEQ ID NO: 2921922 - protein, 10 aa, Entamoeba invadens
VTIPSSVESI

SEQ ID NO: 2921923 - protein, 10 aa, Entamoeba invadens
VTIPSSVKTL

SEQ ID NO: 2921924 - protein, 13 aa, Entamoeba invadens
VTIPSSVSSIGEG

SEQ ID NO: 2921925 - protein, 11 aa, Entamoeba invadens
VTIPSSVTSNC

SEQ ID NO: 2921926 - protein, 10 aa, Entamoeba invadens
VTIPSTVTSI

SEQ ID NO: 2921927 - protein, 7 aa, Entamoeba invadens
VTIPTSV

SEQ ID NO: 2921928 - protein, 12 aa, Entamoeba invadens
VTISKTPSDVPK

SEQ ID NO: 2921929 - protein, 4 aa, Entamoeba invadens
VTKA

SEQ ID NO: 2921930 - protein, 9 aa, Entamoeba invadens
VTKDGDGTN

SEQ ID NO: 2921931 - protein, 7 aa, Entamoeba invadens
VTKDTNK

SEQ ID NO: 2921932 - protein, 13 aa, Entamoeba invadens
VTKEEAEDKAKKL

SEQ ID NO: 2921933 - protein, 14 aa, Entamoeba invadens
VTKEGEPPVKPEPS

SEQ ID NO: 2921934 - protein, 5 aa, Entamoeba invadens
VTKEI

SEQ ID NO: 2921935 - protein, 9 aa, Entamoeba invadens
VTKEMSGVE

SEQ ID NO: 2921936 - protein, 9 aa, Entamoeba invadens
VTKGGKQAL

SEQ ID NO: 2921937 - protein, 6 aa, Entamoeba invadens
VTKGST

SEQ ID NO: 2921938 - protein, 4 aa, Entamoeba invadens
VTKI

SEQ ID NO: 2921939 - protein, 9 aa, Entamoeba invadens
VTKKKDDEI

SEQ ID NO: 2921940 - protein, 10 aa, Entamoeba invadens
VTKNKSSVNL

SEQ ID NO: 2921941 - protein, 15 aa, Entamoeba invadens
VTKPIEKPKSPENLQ

SEQ ID NO: 2921942 - protein, 7 aa, Entamoeba invadens
VTKPKAK

SEQ ID NO: 2921943 - protein, 6 aa, Entamoeba invadens
VTKPLE

SEQ ID NO: 2921944 - protein, 34 aa, Entamoeba invadens
VTKPMKSPTNITSPKSPKSPKPLSPMNVSPKEMS

SEQ ID NO: 2921945 - protein, 7 aa, Entamoeba invadens
VTKQRQW

SEQ ID NO: 2921946 - protein, 14 aa, Entamoeba invadens
VTKRKERFVQALEM

SEQ ID NO: 2921947 - protein, 10 aa, Entamoeba invadens
VTKRLKSGGL

SEQ ID NO: 2921948 - protein, 9 aa, Entamoeba invadens
VTKRSGWVT

SEQ ID NO: 2921949 - protein, 10 aa, Entamoeba invadens
VTKSGYTKEP

SEQ ID NO: 2921950 - protein, 24 aa, Entamoeba invadens
VTKSTTSVKESEPKEDKPKRKKPM

SEQ ID NO: 2921951 - protein, 8 aa, Entamoeba invadens
VTKSVEQE

SEQ ID NO: 2921952 - protein, 5 aa, Entamoeba invadens
VTKTN

SEQ ID NO: 2921953 - protein, 10 aa, Entamoeba invadens
VTKTNPQQIK

SEQ ID NO: 2921954 - protein, 7 aa, Entamoeba invadens
VTKTTNL

SEQ ID NO: 2921955 - protein, 7 aa, Entamoeba invadens
VTKTTPP

SEQ ID NO: 2921956 - protein, 7 aa, Entamoeba invadens
VTKTTSC

SEQ ID NO: 2921957 - protein, 7 aa, Entamoeba invadens
VTKTTYL

SEQ ID NO: 2921958 - protein, 5 aa, Entamoeba invadens
VTKTV

SEQ ID NO: 2921959 - protein, 4 aa, Entamoeba invadens
VTKV

SEQ ID NO: 2921960 - protein, 4 aa, Entamoeba invadens
VTLP

SEQ ID NO: 2921961 - protein, 5 aa, Entamoeba invadens
VTLPE

SEQ ID NO: 2921962 - protein, 5 aa, Entamoeba invadens
VTLPS

SEQ ID NO: 2921963 - protein, 6 aa, Entamoeba invadens
VTLPST

SEQ ID NO: 2921964 - protein, 8 aa, Entamoeba invadens
VTLSDPSS

SEQ ID NO: 2921965 - protein, 9 aa, Entamoeba invadens
VTLSPLSTT

SEQ ID NO: 2921966 - protein, 12 aa, Entamoeba invadens
VTMKTSADLSNS

SEQ ID NO: 2921967 - protein, 4 aa, Entamoeba invadens
VTMP

SEQ ID NO: 2921968 - protein, 8 aa, Entamoeba invadens
VTNANDDL

SEQ ID NO: 2921969 - protein, 11 aa, Entamoeba invadens
VTNDDKDESAY

SEQ ID NO: 2921970 - protein, 8 aa, Entamoeba invadens
VTNDINTN

SEQ ID NO: 2921971 - protein, 8 aa, Entamoeba invadens
VTNEDEKV

SEQ ID NO: 2921972 - protein, 6 aa, Entamoeba invadens
VTNEEK

SEQ ID NO: 2921973 - protein, 17 aa, Entamoeba invadens
VTNEGPQEDEKDTKDDK

SEQ ID NO: 2921974 - protein, 8 aa, Entamoeba invadens
VTNEIREE

SEQ ID NO: 2921975 - protein, 15 aa, Entamoeba invadens
VTNENMRKTRKARRD

SEQ ID NO: 2921976 - protein, 11 aa, Entamoeba invadens
VTNGGNKSELK

SEQ ID NO: 2921977 - protein, 10 aa, Entamoeba invadens
VTNGGQKCGK

SEQ ID NO: 2921978 - protein, 9 aa, Entamoeba invadens
VTNGTKEMN

SEQ ID NO: 2921979 - protein, 6 aa, Entamoeba invadens
VTNNNI

SEQ ID NO: 2921980 - protein, 10 aa, Entamoeba invadens
VTNNVEDTQS

SEQ ID NO: 2921981 - protein, 12 aa, Entamoeba invadens
VTNPQVVSELGK

SEQ ID NO: 2921982 - protein, 24 aa, Entamoeba invadens
VTNRARLKRRASHDYNCNDGQLPQ

SEQ ID NO: 2921983 - protein, 8 aa, Entamoeba invadens
VTNSDKLT

SEQ ID NO: 2921984 - protein, 19 aa, Entamoeba invadens
VTNSEAKLADAGATGASIA

SEQ ID NO: 2921985 - protein, 16 aa, Entamoeba invadens
VTNSEAKLTDPDATGA

SEQ ID NO: 2921986 - protein, 11 aa, Entamoeba invadens
VTNSLKSVSQP

SEQ ID NO: 2921987 - protein, 7 aa, Entamoeba invadens
VTNSSRS

SEQ ID NO: 2921988 - protein, 8 aa, Entamoeba invadens
VTNTDNYV

SEQ ID NO: 2921989 - protein, 8 aa, Entamoeba invadens
VTNTEYPQ

SEQ ID NO: 2921990 - protein, 12 aa, Entamoeba invadens
VTNTKDTKMNSQ

SEQ ID NO: 2921991 - protein, 18 aa, Entamoeba invadens
VTNTPLKGHTKRTRTLST

SEQ ID NO: 2921992 - protein, 14 aa, Entamoeba invadens
VTNTQNDRKKFGNN

SEQ ID NO: 2921993 - protein, 20 aa, Entamoeba invadens
VTNVKKEKYSVEETTTQTLE

SEQ ID NO: 2921994 - protein, 4 aa, Entamoeba invadens
VTPA

SEQ ID NO: 2921995 - protein, 13 aa, Entamoeba invadens
VTPATQPETEELQ

SEQ ID NO: 2921996 - protein, 4 aa, Entamoeba invadens
VTPD

SEQ ID NO: 2921997 - protein, 6 aa, Entamoeba invadens
VTPDDE

SEQ ID NO: 2921998 - protein, 17 aa, Entamoeba invadens
VTPDPSQKDQQKRRCGF

SEQ ID NO: 2921999 - protein, 25 aa, Entamoeba invadens
VTPDPSQKDQQKRRRGFSTKGLTKK

SEQ ID NO: 2922000 - protein, 10 aa, Entamoeba invadens
VTPDRTEDKV

SEQ ID NO: 2922001 - protein, 24 aa, Entamoeba invadens
VTPEDEQKLTAYDKPTKTATKRCK

SEQ ID NO: 2922002 - protein, 14 aa, Entamoeba invadens
VTPEGKKCEKGGDT

SEQ ID NO: 2922003 - protein, 12 aa, Entamoeba invadens
VTPEGKKCTKGG

SEQ ID NO: 2922004 - protein, 11 aa, Entamoeba invadens
VTPEKAQRQTL

SEQ ID NO: 2922005 - protein, 5 aa, Entamoeba invadens
VTPET

SEQ ID NO: 2922006 - protein, 12 aa, Entamoeba invadens
VTPFDPRSLTSH

SEQ ID NO: 2922007 - protein, 4 aa, Entamoeba invadens
VTPG

SEQ ID NO: 2922008 - protein, 6 aa, Entamoeba invadens
VTPGED

SEQ ID NO: 2922009 - protein, 6 aa, Entamoeba invadens
VTPGTQ

SEQ ID NO: 2922010 - protein, 6 aa, Entamoeba invadens
VTPGTS

SEQ ID NO: 2922011 - protein, 9 aa, Entamoeba invadens
VTPGTTGAQ

SEQ ID NO: 2922012 - protein, 23 aa, Entamoeba invadens
VTPKAEQPIAPVATQPANTATQQ

SEQ ID NO: 2922013 - protein, 6 aa, Entamoeba invadens
VTPKGV

SEQ ID NO: 2922014 - protein, 10 aa, Entamoeba invadens
VTPKKCEPRE

SEQ ID NO: 2922015 - protein, 6 aa, Entamoeba invadens
VTPKNI

SEQ ID NO: 2922016 - protein, 11 aa, Entamoeba invadens
VTPKSTFSEDT

SEQ ID NO: 2922017 - protein, 6 aa, Entamoeba invadens
VTPKTD

SEQ ID NO: 2922018 - protein, 9 aa, Entamoeba invadens
VTPNGSSIS

SEQ ID NO: 2922019 - protein, 5 aa, Entamoeba invadens
VTPNS

SEQ ID NO: 2922020 - protein, 7 aa, Entamoeba invadens
VTPPAGF

SEQ ID NO: 2922021 - protein, 7 aa, Entamoeba invadens
VTPPPYP

SEQ ID NO: 2922022 - protein, 8 aa, Entamoeba invadens
VTPPQIDT

SEQ ID NO: 2922023 - protein, 7 aa, Entamoeba invadens
VTPPSKK

SEQ ID NO: 2922024 - protein, 4 aa, Entamoeba invadens
VTPQ

SEQ ID NO: 2922025 - protein, 13 aa, Entamoeba invadens
VTPQFDGPFGGRA

SEQ ID NO: 2922026 - protein, 38 aa, Entamoeba invadens
VTPQKQQNVQENNPTIQQGNQIKQNQPSNTSPLPENKV

SEQ ID NO: 2922027 - protein, 14 aa, Entamoeba invadens
VTPQKTKPLKHDPI

SEQ ID NO: 2922028 - protein, 12 aa, Entamoeba invadens
VTPQQGGDVSEV

SEQ ID NO: 2922029 - protein, 13 aa, Entamoeba invadens
VTPRDNVTENLTT

SEQ ID NO: 2922030 - protein, 13 aa, Entamoeba invadens
VTPRQSPTNEEMK

SEQ ID NO: 2922031 - protein, 15 aa, Entamoeba invadens
VTPSDISALIASAWN

SEQ ID NO: 2922032 - protein, 5 aa, Entamoeba invadens
VTPSL

SEQ ID NO: 2922033 - protein, 14 aa, Entamoeba invadens
VTPSNTKMGEETLP

SEQ ID NO: 2922034 - protein, 7 aa, Entamoeba invadens
VTPSPNK

SEQ ID NO: 2922035 - protein, 9 aa, Entamoeba invadens
VTPSQTEIL

SEQ ID NO: 2922036 - protein, 7 aa, Entamoeba invadens
VTPSSKK

SEQ ID NO: 2922037 - protein, 6 aa, Entamoeba invadens
VTPSSL

SEQ ID NO: 2922038 - protein, 4 aa, Entamoeba invadens
VTPT

SEQ ID NO: 2922039 - protein, 10 aa, Entamoeba invadens
VTPTESPNGI

SEQ ID NO: 2922040 - protein, 28 aa, Entamoeba invadens
VTPTISSGEDKIQEEMKEEVKPTPQDIQ

SEQ ID NO: 2922041 - protein, 11 aa, Entamoeba invadens
VTPTRRPNGDF

SEQ ID NO: 2922042 - protein, 9 aa, Entamoeba invadens
VTPTVKPSN

SEQ ID NO: 2922043 - protein, 8 aa, Entamoeba invadens
VTQANKTK

SEQ ID NO: 2922044 - protein, 16 aa, Entamoeba invadens
VTQDNQPPQPMDAQPP

SEQ ID NO: 2922045 - protein, 8 aa, Entamoeba invadens
VTQDSKWP

SEQ ID NO: 2922046 - protein, 6 aa, Entamoeba invadens
VTQENT

SEQ ID NO: 2922047 - protein, 14 aa, Entamoeba invadens
VTQGVKTKGELKGD

SEQ ID NO: 2922048 - protein, 7 aa, Entamoeba invadens
VTQHETD

SEQ ID NO: 2922049 - protein, 5 aa, Entamoeba invadens
VTQIE

SEQ ID NO: 2922050 - protein, 8 aa, Entamoeba invadens
VTQKNSEI

SEQ ID NO: 2922051 - protein, 5 aa, Entamoeba invadens
VTQKS

SEQ ID NO: 2922052 - protein, 5 aa, Entamoeba invadens
VTQNT

SEQ ID NO: 2922053 - protein, 13 aa, Entamoeba invadens
VTQPQKKTKDTKQ

SEQ ID NO: 2922054 - protein, 6 aa, Entamoeba invadens
VTQPRR

SEQ ID NO: 2922055 - protein, 13 aa, Entamoeba invadens
VTQQKIDTLQTQR

SEQ ID NO: 2922056 - protein, 14 aa, Entamoeba invadens
VTQQSQQPTQQQVQ

SEQ ID NO: 2922057 - protein, 7 aa, Entamoeba invadens
VTQSAKS

SEQ ID NO: 2922058 - protein, 18 aa, Entamoeba invadens
VTQSGKRTVKPKKVRKTH

SEQ ID NO: 2922059 - protein, 7 aa, Entamoeba invadens
VTQSKGK

SEQ ID NO: 2922060 - protein, 6 aa, Entamoeba invadens
VTQSNY

SEQ ID NO: 2922061 - protein, 7 aa, Entamoeba invadens
VTQSPWE

SEQ ID NO: 2922062 - protein, 8 aa, Entamoeba invadens
VTQSSAKC

SEQ ID NO: 2922063 - protein, 11 aa, Entamoeba invadens
VTQSTSKQEIE

SEQ ID NO: 2922064 - protein, 16 aa, Entamoeba invadens
VTRDQATFSHEARTDT

SEQ ID NO: 2922065 - protein, 7 aa, Entamoeba invadens
VTRGTPY

SEQ ID NO: 2922066 - protein, 6 aa, Entamoeba invadens
VTRIGP

SEQ ID NO: 2922067 - protein, 8 aa, Entamoeba invadens
VTRKGLDN

SEQ ID NO: 2922068 - protein, 8 aa, Entamoeba invadens
VTRKGPMC

SEQ ID NO: 2922069 - protein, 6 aa, Entamoeba invadens
VTRNDR

SEQ ID NO: 2922070 - protein, 27 aa, Entamoeba invadens
VTRNSYYKTETPSQGTQPKQISGVDSY

SEQ ID NO: 2922071 - protein, 9 aa, Entamoeba invadens
VTRPTQRRI

SEQ ID NO: 2922072 - protein, 11 aa, Entamoeba invadens
VTRRTQTRRRK

SEQ ID NO: 2922073 - protein, 10 aa, Entamoeba invadens
VTSATHEVKS

SEQ ID NO: 2922074 - protein, 25 aa, Entamoeba invadens
VTSDKEREKEKENDRNLQSQYTDGI

SEQ ID NO: 2922075 - protein, 13 aa, Entamoeba invadens
VTSDKKPTGTQQV

SEQ ID NO: 2922076 - protein, 5 aa, Entamoeba invadens
VTSDR

SEQ ID NO: 2922077 - protein, 10 aa, Entamoeba invadens
VTSDTDVRNG

SEQ ID NO: 2922078 - protein, 4 aa, Entamoeba invadens
VTSE

SEQ ID NO: 2922079 - protein, 4 aa, Entamoeba invadens
VTSF

SEQ ID NO: 2922080 - protein, 11 aa, Entamoeba invadens
VTSFTENSVTV

SEQ ID NO: 2922081 - protein, 7 aa, Entamoeba invadens
VTSGKSL

SEQ ID NO: 2922082 - protein, 6 aa, Entamoeba invadens
VTSGNT

SEQ ID NO: 2922083 - protein, 5 aa, Entamoeba invadens
VTSID

SEQ ID NO: 2922084 - protein, 14 aa, Entamoeba invadens
VTSIETNAFENSDL

SEQ ID NO: 2922085 - protein, 7 aa, Entamoeba invadens
VTSIGNK

SEQ ID NO: 2922086 - protein, 5 aa, Entamoeba invadens
VTSIS

SEQ ID NO: 2922087 - protein, 9 aa, Entamoeba invadens
VTSKDDTAM

SEQ ID NO: 2922088 - protein, 5 aa, Entamoeba invadens
VTSKN

SEQ ID NO: 2922089 - protein, 8 aa, Entamoeba invadens
VTSKNVQV

SEQ ID NO: 2922090 - protein, 8 aa, Entamoeba invadens
VTSKTADI

SEQ ID NO: 2922091 - protein, 6 aa, Entamoeba invadens
VTSNPN

SEQ ID NO: 2922092 - protein, 5 aa, Entamoeba invadens
VTSPD

SEQ ID NO: 2922093 - protein, 6 aa, Entamoeba invadens
VTSPES

SEQ ID NO: 2922094 - protein, 10 aa, Entamoeba invadens
VTSPKAKALG

SEQ ID NO: 2922095 - protein, 14 aa, Entamoeba invadens
VTSPTNKCDTCPTN

SEQ ID NO: 2922096 - protein, 20 aa, Entamoeba invadens
VTSQDQRKTENSVEREKDYT

SEQ ID NO: 2922097 - protein, 5 aa, Entamoeba invadens
VTSQS

SEQ ID NO: 2922098 - protein, 9 aa, Entamoeba invadens
VTSQSTRLD

SEQ ID NO: 2922099 - protein, 14 aa, Entamoeba invadens
VTSRKDPSSKMENT

SEQ ID NO: 2922100 - protein, 14 aa, Entamoeba invadens
VTSRKGGHTTSSGF

SEQ ID NO: 2922101 - protein, 9 aa, Entamoeba invadens
VTSSAYPIN

SEQ ID NO: 2922102 - protein, 7 aa, Entamoeba invadens
VTSSEFK

SEQ ID NO: 2922103 - protein, 12 aa, Entamoeba invadens
VTSSEKRSQSEV

SEQ ID NO: 2922104 - protein, 8 aa, Entamoeba invadens
VTSSGTIN

SEQ ID NO: 2922105 - protein, 17 aa, Entamoeba invadens
VTSSNDSKEKTQLSKAE

SEQ ID NO: 2922106 - protein, 5 aa, Entamoeba invadens
VTSSS

SEQ ID NO: 2922107 - protein, 6 aa, Entamoeba invadens
VTSTGL

SEQ ID NO: 2922108 - protein, 10 aa, Entamoeba invadens
VTSTKTKEDI

SEQ ID NO: 2922109 - protein, 13 aa, Entamoeba invadens
VTSTTTQMPSNAK

SEQ ID NO: 2922110 - protein, 4 aa, Entamoeba invadens
VTSV

SEQ ID NO: 2922111 - protein, 5 aa, Entamoeba invadens
VTSVG

SEQ ID NO: 2922112 - protein, 10 aa, Entamoeba invadens
VTSVPTHDTY

SEQ ID NO: 2922113 - protein, 5 aa, Entamoeba invadens
VTSYG

SEQ ID NO: 2922114 - protein, 11 aa, Entamoeba invadens
VTTANTYNGKT

SEQ ID NO: 2922115 - protein, 23 aa, Entamoeba invadens
VTTAPSGSINIENTPPPKKESGC

SEQ ID NO: 2922116 - protein, 8 aa, Entamoeba invadens
VTTAQIKE

SEQ ID NO: 2922117 - protein, 8 aa, Entamoeba invadens
VTTDGQDM

SEQ ID NO: 2922118 - protein, 9 aa, Entamoeba invadens
VTTDSDDQA

SEQ ID NO: 2922119 - protein, 15 aa, Entamoeba invadens
VTTEEAEEFAKKTGS

SEQ ID NO: 2922120 - protein, 10 aa, Entamoeba invadens
VTTEESTKLN

SEQ ID NO: 2922121 - protein, 24 aa, Entamoeba invadens
VTTEKSSKLNYKELEETSQIGEGS

SEQ ID NO: 2922122 - protein, 10 aa, Entamoeba invadens
VTTEKSTKLN

SEQ ID NO: 2922123 - protein, 10 aa, Entamoeba invadens
VTTEQSTKLN

SEQ ID NO: 2922124 - protein, 5 aa, Entamoeba invadens
VTTIG

SEQ ID NO: 2922125 - protein, 5 aa, Entamoeba invadens
VTTKG

SEQ ID NO: 2922126 - protein, 8 aa, Entamoeba invadens
VTTKPDDY

SEQ ID NO: 2922127 - protein, 4 aa, Entamoeba invadens
VTTL

SEQ ID NO: 2922128 - protein, 12 aa, Entamoeba invadens
VTTLQKKSETEK

SEQ ID NO: 2922129 - protein, 6 aa, Entamoeba invadens
VTTLTE

SEQ ID NO: 2922130 - protein, 4 aa, Entamoeba invadens
VTTM

SEQ ID NO: 2922131 - protein, 6 aa, Entamoeba invadens
VTTNGF

SEQ ID NO: 2922132 - protein, 6 aa, Entamoeba invadens
VTTNGL

SEQ ID NO: 2922133 - protein, 8 aa, Entamoeba invadens
VTTNNREV

SEQ ID NO: 2922134 - protein, 5 aa, Entamoeba invadens
VTTNT

SEQ ID NO: 2922135 - protein, 8 aa, Entamoeba invadens
VTTPENEI

SEQ ID NO: 2922136 - protein, 8 aa, Entamoeba invadens
VTTPNKQS

SEQ ID NO: 2922137 - protein, 7 aa, Entamoeba invadens
VTTPPLQ

SEQ ID NO: 2922138 - protein, 12 aa, Entamoeba invadens
VTTQKRAEGFSP

SEQ ID NO: 2922139 - protein, 11 aa, Entamoeba invadens
VTTQNGDNAEV

SEQ ID NO: 2922140 - protein, 7 aa, Entamoeba invadens
VTTQQGE

SEQ ID NO: 2922141 - protein, 11 aa, Entamoeba invadens
VTTQSALNNTN

SEQ ID NO: 2922142 - protein, 4 aa, Entamoeba invadens
VTTR

SEQ ID NO: 2922143 - protein, 5 aa, Entamoeba invadens
VTTRE

SEQ ID NO: 2922144 - protein, 5 aa, Entamoeba invadens
VTTRQ

SEQ ID NO: 2922145 - protein, 7 aa, Entamoeba invadens
VTTSDYQ

SEQ ID NO: 2922146 - protein, 15 aa, Entamoeba invadens
VTTSSGKKFSTSSTD

SEQ ID NO: 2922147 - protein, 10 aa, Entamoeba invadens
VTTSTGDSVR

SEQ ID NO: 2922148 - protein, 10 aa, Entamoeba invadens
VTTSTNDKIE

SEQ ID NO: 2922149 - protein, 5 aa, Entamoeba invadens
VTTSY

SEQ ID NO: 2922150 - protein, 4 aa, Entamoeba invadens
VTTT

SEQ ID NO: 2922151 - protein, 13 aa, Entamoeba invadens
VTTTDGGVTLFGF

SEQ ID NO: 2922152 - protein, 25 aa, Entamoeba invadens
VTTTLKEGEVLNTTRRGEELHPTKQ

SEQ ID NO: 2922153 - protein, 12 aa, Entamoeba invadens
VTVDSDEQLARQ

SEQ ID NO: 2922154 - protein, 7 aa, Entamoeba invadens
VTVGGND

SEQ ID NO: 2922155 - protein, 5 aa, Entamoeba invadens
VTVPN

SEQ ID NO: 2922156 - protein, 6 aa, Entamoeba invadens
VTVPSS

SEQ ID NO: 2922157 - protein, 13 aa, Entamoeba invadens
VTVTKDEKKELEE

SEQ ID NO: 2922158 - protein, 7 aa, Entamoeba invadens
VTYDKEN

SEQ ID NO: 2922159 - protein, 13 aa, Entamoeba invadens
VTYGDGHEDIKDK

SEQ ID NO: 2922160 - protein, 8 aa, Entamoeba invadens
VTYGEKSL

SEQ ID NO: 2922161 - protein, 20 aa, Entamoeba invadens
VTYKGKKGSRINKCDICYCY

SEQ ID NO: 2922162 - protein, 4 aa, Entamoeba invadens
VTYS

SEQ ID NO: 2922163 - protein, 11 aa, Entamoeba invadens
VTYSKKDREKY

SEQ ID NO: 2922164 - protein, 15 aa, Entamoeba invadens
VTYYKQSHPEDVEND

SEQ ID NO: 2922165 - protein, 10 aa, Entamoeba invadens
VVATENSIET

SEQ ID NO: 2922166 - protein, 26 aa, Entamoeba invadens
VVDEAKKKAHDLELETDSKKKLETFN

SEQ ID NO: 2922167 - protein, 9 aa, Entamoeba invadens
VVDPSNGQL

SEQ ID NO: 2922168 - protein, 6 aa, Entamoeba invadens
VVDTEH

SEQ ID NO: 2922169 - protein, 8 aa, Entamoeba invadens
VVEDKEAK

SEQ ID NO: 2922170 - protein, 17 aa, Entamoeba invadens
VVEGGEENEESTFDDKE

SEQ ID NO: 2922171 - protein, 5 aa, Entamoeba invadens
VVEGN

SEQ ID NO: 2922172 - protein, 8 aa, Entamoeba invadens
VVEPTHGE

SEQ ID NO: 2922173 - protein, 6 aa, Entamoeba invadens
VVEPYK

SEQ ID NO: 2922174 - protein, 5 aa, Entamoeba invadens
VVEQD

SEQ ID NO: 2922175 - protein, 6 aa, Entamoeba invadens
VVETNE

SEQ ID NO: 2922176 - protein, 7 aa, Entamoeba invadens
VVGEDSK

SEQ ID NO: 2922177 - protein, 7 aa, Entamoeba invadens
VVGESES

SEQ ID NO: 2922178 - protein, 7 aa, Entamoeba invadens
VVGETPF

SEQ ID NO: 2922179 - protein, 14 aa, Entamoeba invadens
VVGKEDIISKGSAI

SEQ ID NO: 2922180 - protein, 9 aa, Entamoeba invadens
VVGSGPAGL

SEQ ID NO: 2922181 - protein, 10 aa, Entamoeba invadens
VVKDKGTEYY

SEQ ID NO: 2922182 - protein, 23 aa, Entamoeba invadens
VVKENEEELPKVGKVGKIAKKKT

SEQ ID NO: 2922183 - protein, 9 aa, Entamoeba invadens
VVKGREPDF

SEQ ID NO: 2922184 - protein, 7 aa, Entamoeba invadens
VVKKDNV

SEQ ID NO: 2922185 - protein, 6 aa, Entamoeba invadens
VVKPEQ

SEQ ID NO: 2922186 - protein, 8 aa, Entamoeba invadens
VVKSGTDD

SEQ ID NO: 2922187 - protein, 4 aa, Entamoeba invadens
VVKT

SEQ ID NO: 2922188 - protein, 13 aa, Entamoeba invadens
VVKTEKSTQQVTQ

SEQ ID NO: 2922189 - protein, 9 aa, Entamoeba invadens
VVNNHNKNW

SEQ ID NO: 2922190 - protein, 4 aa, Entamoeba invadens
VVNS

SEQ ID NO: 2922191 - protein, 7 aa, Entamoeba invadens
VVNSAGS

SEQ ID NO: 2922192 - protein, 5 aa, Entamoeba invadens
VVNSD

SEQ ID NO: 2922193 - protein, 7 aa, Entamoeba invadens
VVPEGSY

SEQ ID NO: 2922194 - protein, 12 aa, Entamoeba invadens
VVPGRTRKQCRE

SEQ ID NO: 2922195 - protein, 11 aa, Entamoeba invadens
VVPNDRPSRIE

SEQ ID NO: 2922196 - protein, 7 aa, Entamoeba invadens
VVPNKNR

SEQ ID NO: 2922197 - protein, 7 aa, Entamoeba invadens
VVPNQDA

SEQ ID NO: 2922198 - protein, 13 aa, Entamoeba invadens
VVPPGVATVGEDA

SEQ ID NO: 2922199 - protein, 10 aa, Entamoeba invadens
VVPPPQSQSE

SEQ ID NO: 2922200 - protein, 7 aa, Entamoeba invadens
VVPPQGD

SEQ ID NO: 2922201 - protein, 122 aa, Entamoeba invadens
VVPPVESPKAEPVEEKNEEKVEEKEHKEEENLTEKVEEVPTASKVEVKEEQTKEDIKEEPKEELKEEVKPAEEVKEDKEGTSESKSSDKSGSTSSGSKSKSNSSKSSKDSKSSEKKVSTEKA

SEQ ID NO: 2922202 - protein, 12 aa, Entamoeba invadens
VVPTQTNFTQNR

SEQ ID NO: 2922203 - protein, 18 aa, Entamoeba invadens
VVQEQPKIEDQVKEVPQP

SEQ ID NO: 2922204 - protein, 10 aa, Entamoeba invadens
VVQKQHKERM

SEQ ID NO: 2922205 - protein, 19 aa, Entamoeba invadens
VVQSSSTDTSKEKEGRTVR

SEQ ID NO: 2922206 - protein, 4 aa, Entamoeba invadens
VVQT

SEQ ID NO: 2922207 - protein, 7 aa, Entamoeba invadens
VVRSDSR

SEQ ID NO: 2922208 - protein, 14 aa, Entamoeba invadens
VVSDAENRMKNQPA

SEQ ID NO: 2922209 - protein, 18 aa, Entamoeba invadens
VVSDDDATIEQNSEELKK

SEQ ID NO: 2922210 - protein, 8 aa, Entamoeba invadens
VVSDKDGS

SEQ ID NO: 2922211 - protein, 12 aa, Entamoeba invadens
VVSDTTSFNKKA

SEQ ID NO: 2922212 - protein, 40 aa, Entamoeba invadens
VVSGGNDFQRPTKNTNKSSRVSLKEQKTSNTKSSQKTEKV

SEQ ID NO: 2922213 - protein, 5 aa, Entamoeba invadens
VVSKE

SEQ ID NO: 2922214 - protein, 12 aa, Entamoeba invadens
VVSKEEQIRRNE

SEQ ID NO: 2922215 - protein, 6 aa, Entamoeba invadens
VVSNTS

SEQ ID NO: 2922216 - protein, 27 aa, Entamoeba invadens
VVSPTEKRKVKNVNRTEVDKETKPEFA

SEQ ID NO: 2922217 - protein, 4 aa, Entamoeba invadens
VVSS

SEQ ID NO: 2922218 - protein, 16 aa, Entamoeba invadens
VVSSEEQKVSEENTKT

SEQ ID NO: 2922219 - protein, 19 aa, Entamoeba invadens
VVSTDVKKAMDDHPLVHFE

SEQ ID NO: 2922220 - protein, 8 aa, Entamoeba invadens
VVSTEEGI

SEQ ID NO: 2922221 - protein, 8 aa, Entamoeba invadens
VVSTKNDY

SEQ ID NO: 2922222 - protein, 12 aa, Entamoeba invadens
VVTEGGDNFSLG

SEQ ID NO: 2922223 - protein, 7 aa, Entamoeba invadens
VVTGSQD

SEQ ID NO: 2922224 - protein, 7 aa, Entamoeba invadens
VVTKAQT

SEQ ID NO: 2922225 - protein, 13 aa, Entamoeba invadens
VVTPSSVKNTSKL

SEQ ID NO: 2922226 - protein, 34 aa, Entamoeba invadens
VVTQGTQKAVKKEEEELTRRAAPPPQQSMPEDDL

SEQ ID NO: 2922227 - protein, 18 aa, Entamoeba invadens
VVTQSPPKDEQSSFEEDS

SEQ ID NO: 2922228 - protein, 6 aa, Entamoeba invadens
VVTTSQ

SEQ ID NO: 2922229 - protein, 6 aa, Entamoeba invadens
VYADPQ

SEQ ID NO: 2922230 - protein, 4 aa, Entamoeba invadens
VYDE

SEQ ID NO: 2922231 - protein, 12 aa, Entamoeba invadens
VYDKGDKAFPQQ

SEQ ID NO: 2922232 - protein, 7 aa, Entamoeba invadens
VYDNERK

SEQ ID NO: 2922233 - protein, 9 aa, Entamoeba invadens
VYDRGSDEE

SEQ ID NO: 2922234 - protein, 17 aa, Entamoeba invadens
VYDSSSKPKDEKAKIKP

SEQ ID NO: 2922235 - protein, 6 aa, Entamoeba invadens
VYEDGK

SEQ ID NO: 2922236 - protein, 5 aa, Entamoeba invadens
VYEEK

SEQ ID NO: 2922237 - protein, 10 aa, Entamoeba invadens
VYEETKDKQN

SEQ ID NO: 2922238 - protein, 6 aa, Entamoeba invadens
VYEGPV

SEQ ID NO: 2922239 - protein, 4 aa, Entamoeba invadens
VYEK

SEQ ID NO: 2922240 - protein, 6 aa, Entamoeba invadens
VYESPD

SEQ ID NO: 2922241 - protein, 8 aa, Entamoeba invadens
VYGEDIPQ

SEQ ID NO: 2922242 - protein, 8 aa, Entamoeba invadens
VYGGEQSH

SEQ ID NO: 2922243 - protein, 7 aa, Entamoeba invadens
VYGSPVN

SEQ ID NO: 2922244 - protein, 12 aa, Entamoeba invadens
VYKSEKSYSGKR

SEQ ID NO: 2922245 - protein, 7 aa, Entamoeba invadens
VYKSGSR

SEQ ID NO: 2922246 - protein, 4 aa, Entamoeba invadens
VYNT

SEQ ID NO: 2922247 - protein, 12 aa, Entamoeba invadens
VYNTEDSINAGK

SEQ ID NO: 2922248 - protein, 33 aa, Entamoeba invadens
VYPDEPPVNLESDKKSDIQNAGMARENDDNLAK

SEQ ID NO: 2922249 - protein, 11 aa, Entamoeba invadens
VYPEDQSTEEI

SEQ ID NO: 2922250 - protein, 5 aa, Entamoeba invadens
VYPNA

SEQ ID NO: 2922251 - protein, 6 aa, Entamoeba invadens
VYPNQT

SEQ ID NO: 2922252 - protein, 8 aa, Entamoeba invadens
VYPTADQV

SEQ ID NO: 2922253 - protein, 6 aa, Entamoeba invadens
VYQSPD

SEQ ID NO: 2922254 - protein, 4 aa, Entamoeba invadens
VYRK

SEQ ID NO: 2922255 - protein, 12 aa, Entamoeba invadens
VYSEDNDEETIH

SEQ ID NO: 2922256 - protein, 10 aa, Entamoeba invadens
VYSGGKQQVV

SEQ ID NO: 2922257 - protein, 6 aa, Entamoeba invadens
VYSGRN

SEQ ID NO: 2922258 - protein, 8 aa, Entamoeba invadens
VYSKNNRD

SEQ ID NO: 2922259 - protein, 9 aa, Entamoeba invadens
VYSPSNNPI

SEQ ID NO: 2922260 - protein, 8 aa, Entamoeba invadens
VYSQRNGN

SEQ ID NO: 2922261 - protein, 7 aa, Entamoeba invadens
VYSTGDS

SEQ ID NO: 2922262 - protein, 6 aa, Entamoeba invadens
VYTDEQ

SEQ ID NO: 2922263 - protein, 7 aa, Entamoeba invadens
VYTNSEL

SEQ ID NO: 2922264 - protein, 7 aa, Entamoeba invadens
VYTPSKT

SEQ ID NO: 2922265 - protein, 5 aa, Entamoeba invadens
VYTRD

SEQ ID NO: 2922266 - protein, 6 aa, Entamoeba invadens
VYTSDN

SEQ ID NO: 2922267 - protein, 12 aa, Entamoeba invadens
VYTSESPTTMEG

SEQ ID NO: 2922268 - protein, 7 aa, Entamoeba invadens
VYTTKSD

SEQ ID NO: 2922269 - protein, 12 aa, Entamoeba invadens
WADAKKKLATCK

SEQ ID NO: 2922270 - protein, 6 aa, Entamoeba invadens
WADTTL

SEQ ID NO: 2922271 - protein, 18 aa, Entamoeba invadens
WAEETTGAKSIGGALRSG

SEQ ID NO: 2922272 - protein, 13 aa, Entamoeba invadens
WAGQAQFKNTPNF

SEQ ID NO: 2922273 - protein, 7 aa, Entamoeba invadens
WAGQKRI

SEQ ID NO: 2922274 - protein, 5 aa, Entamoeba invadens
WAGSN

SEQ ID NO: 2922275 - protein, 9 aa, Entamoeba invadens
WALGQSHGK

SEQ ID NO: 2922276 - protein, 4 aa, Entamoeba invadens
WAPD

SEQ ID NO: 2922277 - protein, 4 aa, Entamoeba invadens
WAPE

SEQ ID NO: 2922278 - protein, 7 aa, Entamoeba invadens
WAPEEDA

SEQ ID NO: 2922279 - protein, 9 aa, Entamoeba invadens
WASQGRKNV

SEQ ID NO: 2922280 - protein, 8 aa, Entamoeba invadens
WASQTEKF

SEQ ID NO: 2922281 - protein, 9 aa, Entamoeba invadens
WASSAPVEA

SEQ ID NO: 2922282 - protein, 9 aa, Entamoeba invadens
WAYGGGYES

SEQ ID NO: 2922283 - protein, 12 aa, Entamoeba invadens
WDDDTNTQRKEL

SEQ ID NO: 2922284 - protein, 10 aa, Entamoeba invadens
WDDSEGNLSP

SEQ ID NO: 2922285 - protein, 11 aa, Entamoeba invadens
WDEAKNQKTED

SEQ ID NO: 2922286 - protein, 9 aa, Entamoeba invadens
WDGNVTTDV

SEQ ID NO: 2922287 - protein, 8 aa, Entamoeba invadens
WDGTDTRS

SEQ ID NO: 2922288 - protein, 8 aa, Entamoeba invadens
WDKQNQRY

SEQ ID NO: 2922289 - protein, 7 aa, Entamoeba invadens
WDNDNGN

SEQ ID NO: 2922290 - protein, 5 aa, Entamoeba invadens
WDPTP

SEQ ID NO: 2922291 - protein, 9 aa, Entamoeba invadens
WDQDKQKRI

SEQ ID NO: 2922292 - protein, 8 aa, Entamoeba invadens
WDRTPQIS

SEQ ID NO: 2922293 - protein, 5 aa, Entamoeba invadens
WDVTK

SEQ ID NO: 2922294 - protein, 9 aa, Entamoeba invadens
WEDAGDCYS

SEQ ID NO: 2922295 - protein, 5 aa, Entamoeba invadens
WEDPY

SEQ ID NO: 2922296 - protein, 10 aa, Entamoeba invadens
WEEAEKDVEC

SEQ ID NO: 2922297 - protein, 12 aa, Entamoeba invadens
WEEDQGEYTRAR

SEQ ID NO: 2922298 - protein, 11 aa, Entamoeba invadens
WEEEQQKRIRM

SEQ ID NO: 2922299 - protein, 12 aa, Entamoeba invadens
WEESNKSQASNG

SEQ ID NO: 2922300 - protein, 8 aa, Entamoeba invadens
WEGKQTDA

SEQ ID NO: 2922301 - protein, 10 aa, Entamoeba invadens
WEKASQKYTS

SEQ ID NO: 2922302 - protein, 9 aa, Entamoeba invadens
WEKQKEGSL

SEQ ID NO: 2922303 - protein, 9 aa, Entamoeba invadens
WEQAKSVYN

SEQ ID NO: 2922304 - protein, 4 aa, Entamoeba invadens
WERG

SEQ ID NO: 2922305 - protein, 9 aa, Entamoeba invadens
WESSQNTLK

SEQ ID NO: 2922306 - protein, 11 aa, Entamoeba invadens
WETEAKKWSPG

SEQ ID NO: 2922307 - protein, 16 aa, Entamoeba invadens
WETKAPASKFSLKLSI

SEQ ID NO: 2922308 - protein, 4 aa, Entamoeba invadens
WGAD

SEQ ID NO: 2922309 - protein, 13 aa, Entamoeba invadens
WGDEGKFDLEVVT

SEQ ID NO: 2922310 - protein, 9 aa, Entamoeba invadens
WGDSIEQHR

SEQ ID NO: 2922311 - protein, 6 aa, Entamoeba invadens
WGEDTD

SEQ ID NO: 2922312 - protein, 6 aa, Entamoeba invadens
WGEEWG

SEQ ID NO: 2922313 - protein, 5 aa, Entamoeba invadens
WGEGV

SEQ ID NO: 2922314 - protein, 5 aa, Entamoeba invadens
WGEKG

SEQ ID NO: 2922315 - protein, 9 aa, Entamoeba invadens
WGGKNTTPT

SEQ ID NO: 2922316 - protein, 10 aa, Entamoeba invadens
WGKESDPSIY

SEQ ID NO: 2922317 - protein, 9 aa, Entamoeba invadens
WGKSCDNDE

SEQ ID NO: 2922318 - protein, 4 aa, Entamoeba invadens
WGKT

SEQ ID NO: 2922319 - protein, 7 aa, Entamoeba invadens
WGLPKGK

SEQ ID NO: 2922320 - protein, 6 aa, Entamoeba invadens
WGNDDV

SEQ ID NO: 2922321 - protein, 9 aa, Entamoeba invadens
WGNDSSETN

SEQ ID NO: 2922322 - protein, 18 aa, Entamoeba invadens
WGNPPEYPAFQSRPPTPF

SEQ ID NO: 2922323 - protein, 4 aa, Entamoeba invadens
WGRD

SEQ ID NO: 2922324 - protein, 12 aa, Entamoeba invadens
WGRPGAFRNKQS

SEQ ID NO: 2922325 - protein, 12 aa, Entamoeba invadens
WGSDSKGVGTTR

SEQ ID NO: 2922326 - protein, 10 aa, Entamoeba invadens
WGSREKNEDV

SEQ ID NO: 2922327 - protein, 7 aa, Entamoeba invadens
WGTSWGD

SEQ ID NO: 2922328 - protein, 11 aa, Entamoeba invadens
WHDGNNKVPYL

SEQ ID NO: 2922329 - protein, 4 aa, Entamoeba invadens
WHTK

SEQ ID NO: 2922330 - protein, 4 aa, Entamoeba invadens
WKDE

SEQ ID NO: 2922331 - protein, 11 aa, Entamoeba invadens
WKDKPTSRSDI

SEQ ID NO: 2922332 - protein, 7 aa, Entamoeba invadens
WKDREAE

SEQ ID NO: 2922333 - protein, 6 aa, Entamoeba invadens
WKDSGK

SEQ ID NO: 2922334 - protein, 12 aa, Entamoeba invadens
WKDSGKDDTPKE

SEQ ID NO: 2922335 - protein, 7 aa, Entamoeba invadens
WKEEEAE

SEQ ID NO: 2922336 - protein, 22 aa, Entamoeba invadens
WKEKYEKKNEELSKALTENTTL

SEQ ID NO: 2922337 - protein, 6 aa, Entamoeba invadens
WKEPKE

SEQ ID NO: 2922338 - protein, 15 aa, Entamoeba invadens
WKEREKAIESEKSSV

SEQ ID NO: 2922339 - protein, 21 aa, Entamoeba invadens
WKEYNTEANGIYPKGGSRHQL

SEQ ID NO: 2922340 - protein, 10 aa, Entamoeba invadens
WKEYTRENNT

SEQ ID NO: 2922341 - protein, 12 aa, Entamoeba invadens
WKGKDAGKCPGY

SEQ ID NO: 2922342 - protein, 5 aa, Entamoeba invadens
WKGRP

SEQ ID NO: 2922343 - protein, 11 aa, Entamoeba invadens
WKKAGSEVKKT

SEQ ID NO: 2922344 - protein, 12 aa, Entamoeba invadens
WKKDNAKGSTAF

SEQ ID NO: 2922345 - protein, 8 aa, Entamoeba invadens
WKKPKELS

SEQ ID NO: 2922346 - protein, 17 aa, Entamoeba invadens
WKPQSHLNDTFIEKLVI

SEQ ID NO: 2922347 - protein, 9 aa, Entamoeba invadens
WKQDPKERI

SEQ ID NO: 2922348 - protein, 12 aa, Entamoeba invadens
WKQKAEEQKAGL

SEQ ID NO: 2922349 - protein, 5 aa, Entamoeba invadens
WKRNG

SEQ ID NO: 2922350 - protein, 12 aa, Entamoeba invadens
WKRRKGKNTTGT

SEQ ID NO: 2922351 - protein, 8 aa, Entamoeba invadens
WKSEGNKE

SEQ ID NO: 2922352 - protein, 7 aa, Entamoeba invadens
WKSSNDI

SEQ ID NO: 2922353 - protein, 10 aa, Entamoeba invadens
WKSTNTLPSP

SEQ ID NO: 2922354 - protein, 8 aa, Entamoeba invadens
WKTDRPEH

SEQ ID NO: 2922355 - protein, 9 aa, Entamoeba invadens
WKTEGGLKT

SEQ ID NO: 2922356 - protein, 4 aa, Entamoeba invadens
WKTP

SEQ ID NO: 2922357 - protein, 7 aa, Entamoeba invadens
WKTSKTP

SEQ ID NO: 2922358 - protein, 15 aa, Entamoeba invadens
WKTSSDSEKAEVEKE

SEQ ID NO: 2922359 - protein, 9 aa, Entamoeba invadens
WKTTNTEQC

SEQ ID NO: 2922360 - protein, 8 aa, Entamoeba invadens
WKTTPKRF

SEQ ID NO: 2922361 - protein, 38 aa, Entamoeba invadens
WKVTSNDGKGNEQEDEDDGWDTWQTRQKKAKTPVLSAD

SEQ ID NO: 2922362 - protein, 19 aa, Entamoeba invadens
WLASKESKSPDTQEKHDAF

SEQ ID NO: 2922363 - protein, 4 aa, Entamoeba invadens
WMDE

SEQ ID NO: 2922364 - protein, 8 aa, Entamoeba invadens
WNAKDTEF

SEQ ID NO: 2922365 - protein, 10 aa, Entamoeba invadens
WNDGYNRDVT

SEQ ID NO: 2922366 - protein, 4 aa, Entamoeba invadens
WNDV

SEQ ID NO: 2922367 - protein, 5 aa, Entamoeba invadens
WNEEQ

SEQ ID NO: 2922368 - protein, 5 aa, Entamoeba invadens
WNEEV

SEQ ID NO: 2922369 - protein, 12 aa, Entamoeba invadens
WNENNSNPQKYE

SEQ ID NO: 2922370 - protein, 13 aa, Entamoeba invadens
WNEQEDDQSVEYE

SEQ ID NO: 2922371 - protein, 5 aa, Entamoeba invadens
WNERS

SEQ ID NO: 2922372 - protein, 11 aa, Entamoeba invadens
WNKDSARASKL

SEQ ID NO: 2922373 - protein, 12 aa, Entamoeba invadens
WNKGNRSRYSHD

SEQ ID NO: 2922374 - protein, 6 aa, Entamoeba invadens
WNKSGS

SEQ ID NO: 2922375 - protein, 6 aa, Entamoeba invadens
WNNSPE

SEQ ID NO: 2922376 - protein, 9 aa, Entamoeba invadens
WNPAKDKQA

SEQ ID NO: 2922377 - protein, 10 aa, Entamoeba invadens
WNPANDEQAM

SEQ ID NO: 2922378 - protein, 33 aa, Entamoeba invadens
WNPNGAEASAPTAAPVQKAPAPKKEAPKANPAG

SEQ ID NO: 2922379 - protein, 14 aa, Entamoeba invadens
WNPTVDSQAKERTL

SEQ ID NO: 2922380 - protein, 5 aa, Entamoeba invadens
WNQQK

SEQ ID NO: 2922381 - protein, 11 aa, Entamoeba invadens
WNSETAGGSFT

SEQ ID NO: 2922382 - protein, 5 aa, Entamoeba invadens
WNSKT

SEQ ID NO: 2922383 - protein, 4 aa, Entamoeba invadens
WNSN

SEQ ID NO: 2922384 - protein, 8 aa, Entamoeba invadens
WNSSNGPF

SEQ ID NO: 2922385 - protein, 5 aa, Entamoeba invadens
WPDPT

SEQ ID NO: 2922386 - protein, 4 aa, Entamoeba invadens
WPKD

SEQ ID NO: 2922387 - protein, 4 aa, Entamoeba invadens
WPLS

SEQ ID NO: 2922388 - protein, 12 aa, Entamoeba invadens
WPNGQKKKATRV

SEQ ID NO: 2922389 - protein, 4 aa, Entamoeba invadens
WPNS

SEQ ID NO: 2922390 - protein, 16 aa, Entamoeba invadens
WPQETRDKLEKKNVTL

SEQ ID NO: 2922391 - protein, 10 aa, Entamoeba invadens
WPREKNETAM

SEQ ID NO: 2922392 - protein, 4 aa, Entamoeba invadens
WPSS

SEQ ID NO: 2922393 - protein, 18 aa, Entamoeba invadens
WPSYPERDLDDDGNYSTK

SEQ ID NO: 2922394 - protein, 4 aa, Entamoeba invadens
WPTF

SEQ ID NO: 2922395 - protein, 5 aa, Entamoeba invadens
WPTWG

SEQ ID NO: 2922396 - protein, 4 aa, Entamoeba invadens
WPVT

SEQ ID NO: 2922397 - protein, 5 aa, Entamoeba invadens
WQDPY

SEQ ID NO: 2922398 - protein, 11 aa, Entamoeba invadens
WQKEGDKLKDI

SEQ ID NO: 2922399 - protein, 5 aa, Entamoeba invadens
WQTPK

SEQ ID NO: 2922400 - protein, 7 aa, Entamoeba invadens
WRDDDPA

SEQ ID NO: 2922401 - protein, 12 aa, Entamoeba invadens
WREDGDESERPD

SEQ ID NO: 2922402 - protein, 10 aa, Entamoeba invadens
WRKQKTPKEL

SEQ ID NO: 2922403 - protein, 4 aa, Entamoeba invadens
WRKT

SEQ ID NO: 2922404 - protein, 12 aa, Entamoeba invadens
WRNNQMSEMTRV

SEQ ID NO: 2922405 - protein, 7 aa, Entamoeba invadens
WRNSRND

SEQ ID NO: 2922406 - protein, 12 aa, Entamoeba invadens
WRQQSEKQKSGL

SEQ ID NO: 2922407 - protein, 4 aa, Entamoeba invadens
WRSR

SEQ ID NO: 2922408 - protein, 14 aa, Entamoeba invadens
WRSSNSISSIDVSN

SEQ ID NO: 2922409 - protein, 18 aa, Entamoeba invadens
WSDVKKSDAIQKDGPHGD

SEQ ID NO: 2922410 - protein, 8 aa, Entamoeba invadens
WSEAEQSV

SEQ ID NO: 2922411 - protein, 10 aa, Entamoeba invadens
WSEEEQQTLD

SEQ ID NO: 2922412 - protein, 39 aa, Entamoeba invadens
WSEGKGVGKYEQGIQAPIKPASTANREGVDSVQTTQRRD

SEQ ID NO: 2922413 - protein, 10 aa, Entamoeba invadens
WSEGQTVGIS

SEQ ID NO: 2922414 - protein, 14 aa, Entamoeba invadens
WSENHSDKRTIEEN

SEQ ID NO: 2922415 - protein, 12 aa, Entamoeba invadens
WSGNSVFAFKSF

SEQ ID NO: 2922416 - protein, 9 aa, Entamoeba invadens
WSGTTDGTV

SEQ ID NO: 2922417 - protein, 6 aa, Entamoeba invadens
WSKKEF

SEQ ID NO: 2922418 - protein, 11 aa, Entamoeba invadens
WSKSSNDRSEA

SEQ ID NO: 2922419 - protein, 7 aa, Entamoeba invadens
WSKTDKT

SEQ ID NO: 2922420 - protein, 18 aa, Entamoeba invadens
WSNGTEKANDNTAYSQSE

SEQ ID NO: 2922421 - protein, 11 aa, Entamoeba invadens
WSNKTDEARPD

SEQ ID NO: 2922422 - protein, 12 aa, Entamoeba invadens
WSNKTDKISTDT

SEQ ID NO: 2922423 - protein, 15 aa, Entamoeba invadens
WSNPDPTGKPTYPAN

SEQ ID NO: 2922424 - protein, 5 aa, Entamoeba invadens
WSNSY

SEQ ID NO: 2922425 - protein, 10 aa, Entamoeba invadens
WSNTPTPYLE

SEQ ID NO: 2922426 - protein, 4 aa, Entamoeba invadens
WSPA

SEQ ID NO: 2922427 - protein, 5 aa, Entamoeba invadens
WSPKG

SEQ ID NO: 2922428 - protein, 5 aa, Entamoeba invadens
WSPKQ

SEQ ID NO: 2922429 - protein, 5 aa, Entamoeba invadens
WSPNE

SEQ ID NO: 2922430 - protein, 17 aa, Entamoeba invadens
WSPPAGLSTPRQAEDGT

SEQ ID NO: 2922431 - protein, 9 aa, Entamoeba invadens
WSQREIGSQ

SEQ ID NO: 2922432 - protein, 9 aa, Entamoeba invadens
WSRRDTAEA

SEQ ID NO: 2922433 - protein, 8 aa, Entamoeba invadens
WSRTESGF

SEQ ID NO: 2922434 - protein, 11 aa, Entamoeba invadens
WSSESEKSEAV

SEQ ID NO: 2922435 - protein, 7 aa, Entamoeba invadens
WSSKSAD

SEQ ID NO: 2922436 - protein, 4 aa, Entamoeba invadens
WSSS

SEQ ID NO: 2922437 - protein, 13 aa, Entamoeba invadens
WSTPNQSFDFQGK

SEQ ID NO: 2922438 - protein, 6 aa, Entamoeba invadens
WSTPST

SEQ ID NO: 2922439 - protein, 6 aa, Entamoeba invadens
WSTREK

SEQ ID NO: 2922440 - protein, 11 aa, Entamoeba invadens
WSVPDGRRPLR

SEQ ID NO: 2922441 - protein, 40 aa, Entamoeba invadens
WSYNTQPDSTQKEEKVVPETVEDKKSPLSSDSQQNKIEND

SEQ ID NO: 2922442 - protein, 7 aa, Entamoeba invadens
WTAENSE

SEQ ID NO: 2922443 - protein, 7 aa, Entamoeba invadens
WTDDTDQ

SEQ ID NO: 2922444 - protein, 14 aa, Entamoeba invadens
WTEAQDKKNSGAPM

SEQ ID NO: 2922445 - protein, 18 aa, Entamoeba invadens
WTETSKGDVQVYDKPSNN

SEQ ID NO: 2922446 - protein, 4 aa, Entamoeba invadens
WTGA

SEQ ID NO: 2922447 - protein, 8 aa, Entamoeba invadens
WTGDAQEG

SEQ ID NO: 2922448 - protein, 4 aa, Entamoeba invadens
WTGK

SEQ ID NO: 2922449 - protein, 5 aa, Entamoeba invadens
WTGTE

SEQ ID NO: 2922450 - protein, 8 aa, Entamoeba invadens
WTKEEDET

SEQ ID NO: 2922451 - protein, 7 aa, Entamoeba invadens
WTKEETE

SEQ ID NO: 2922452 - protein, 4 aa, Entamoeba invadens
WTKK

SEQ ID NO: 2922453 - protein, 8 aa, Entamoeba invadens
WTKKTYDL

SEQ ID NO: 2922454 - protein, 12 aa, Entamoeba invadens
WTKPDKTERSPN

SEQ ID NO: 2922455 - protein, 7 aa, Entamoeba invadens
WTKTTSA

SEQ ID NO: 2922456 - protein, 5 aa, Entamoeba invadens
WTNSK

SEQ ID NO: 2922457 - protein, 15 aa, Entamoeba invadens
WTPKPRKVKSVKPSV

SEQ ID NO: 2922458 - protein, 20 aa, Entamoeba invadens
WTPKTADELEEFGEKADVKN

SEQ ID NO: 2922459 - protein, 9 aa, Entamoeba invadens
WTPPSPSNI

SEQ ID NO: 2922460 - protein, 4 aa, Entamoeba invadens
WTPS

SEQ ID NO: 2922461 - protein, 4 aa, Entamoeba invadens
WTPT

SEQ ID NO: 2922462 - protein, 8 aa, Entamoeba invadens
WTQDPHER

SEQ ID NO: 2922463 - protein, 8 aa, Entamoeba invadens
WTQDPLER

SEQ ID NO: 2922464 - protein, 9 aa, Entamoeba invadens
WTQGVDDEP

SEQ ID NO: 2922465 - protein, 8 aa, Entamoeba invadens
WTQTPDDV

SEQ ID NO: 2922466 - protein, 8 aa, Entamoeba invadens
WTRATTDS

SEQ ID NO: 2922467 - protein, 97 aa, Entamoeba invadens
WTRDCPEKRGRYRSRSRSRSRSRSRRSHRDRRGRSSSSRRDRSRSRSRSDSRRRGRSDRYRDRKDSRSRSRSSSRGRGRDSTKRDTETKKVDTKETA

SEQ ID NO: 2922468 - protein, 5 aa, Entamoeba invadens
WTSRN

SEQ ID NO: 2922469 - protein, 9 aa, Entamoeba invadens
WYSPSKSAL

SEQ ID NO: 2922470 - protein, 10 aa, Entamoeba invadens
YAADKTTFDD

SEQ ID NO: 2922471 - protein, 25 aa, Entamoeba invadens
YADDGMEGLEEDDSSEEENQNGEFV

SEQ ID NO: 2922472 - protein, 8 aa, Entamoeba invadens
YADDMEEA

SEQ ID NO: 2922473 - protein, 11 aa, Entamoeba invadens
YADEDDESEKY

SEQ ID NO: 2922474 - protein, 6 aa, Entamoeba invadens
YADEKY

SEQ ID NO: 2922475 - protein, 9 aa, Entamoeba invadens
YADENSLTS

SEQ ID NO: 2922476 - protein, 10 aa, Entamoeba invadens
YADGDSIEGQ

SEQ ID NO: 2922477 - protein, 10 aa, Entamoeba invadens
YADSKEIDQV

SEQ ID NO: 2922478 - protein, 5 aa, Entamoeba invadens
YAEAA

SEQ ID NO: 2922479 - protein, 30 aa, Entamoeba invadens
YAEEKRAQSQKDSDDVISPTKTPDIPRTKH

SEQ ID NO: 2922480 - protein, 7 aa, Entamoeba invadens
YAEGEAT

SEQ ID NO: 2922481 - protein, 5 aa, Entamoeba invadens
YAEKC

SEQ ID NO: 2922482 - protein, 17 aa, Entamoeba invadens
YAEPRTSLSKMSPYTNK

SEQ ID NO: 2922483 - protein, 4 aa, Entamoeba invadens
YAEY

SEQ ID NO: 2922484 - protein, 7 aa, Entamoeba invadens
YAFKENT

SEQ ID NO: 2922485 - protein, 13 aa, Entamoeba invadens
YAGDGAGILTPTN

SEQ ID NO: 2922486 - protein, 6 aa, Entamoeba invadens
YAGDTP

SEQ ID NO: 2922487 - protein, 11 aa, Entamoeba invadens
YAGKSESANDV

SEQ ID NO: 2922488 - protein, 9 aa, Entamoeba invadens
YAGNTEPSY

SEQ ID NO: 2922489 - protein, 4 aa, Entamoeba invadens
YAHD

SEQ ID NO: 2922490 - protein, 6 aa, Entamoeba invadens
YAIDPS

SEQ ID NO: 2922491 - protein, 9 aa, Entamoeba invadens
YAKEGTLSE

SEQ ID NO: 2922492 - protein, 6 aa, Entamoeba invadens
YAKGTD

SEQ ID NO: 2922493 - protein, 15 aa, Entamoeba invadens
YAKSKAVGAEPTELN

SEQ ID NO: 2922494 - protein, 12 aa, Entamoeba invadens
YANATNNKCQQC

SEQ ID NO: 2922495 - protein, 7 aa, Entamoeba invadens
YANKGKN

SEQ ID NO: 2922496 - protein, 11 aa, Entamoeba invadens
YANSHLKDPNI

SEQ ID NO: 2922497 - protein, 6 aa, Entamoeba invadens
YANSSA

SEQ ID NO: 2922498 - protein, 7 aa, Entamoeba invadens
YANTEYK

SEQ ID NO: 2922499 - protein, 7 aa, Entamoeba invadens
YANTSSQ

SEQ ID NO: 2922500 - protein, 4 aa, Entamoeba invadens
YAPA

SEQ ID NO: 2922501 - protein, 6 aa, Entamoeba invadens
YAPDQL

SEQ ID NO: 2922502 - protein, 17 aa, Entamoeba invadens
YAPEKTERQTHRQPLPS

SEQ ID NO: 2922503 - protein, 7 aa, Entamoeba invadens
YAPINPT

SEQ ID NO: 2922504 - protein, 10 aa, Entamoeba invadens
YAPKDESLKP

SEQ ID NO: 2922505 - protein, 5 aa, Entamoeba invadens
YAPKK

SEQ ID NO: 2922506 - protein, 9 aa, Entamoeba invadens
YAPKYPELY

SEQ ID NO: 2922507 - protein, 9 aa, Entamoeba invadens
YAPNAPKYF

SEQ ID NO: 2922508 - protein, 12 aa, Entamoeba invadens
YAPNSMKDGKID

SEQ ID NO: 2922509 - protein, 20 aa, Entamoeba invadens
YAPQRTKGTKEKATKDQLTR

SEQ ID NO: 2922510 - protein, 13 aa, Entamoeba invadens
YAPQYNPYQNSMQ

SEQ ID NO: 2922511 - protein, 6 aa, Entamoeba invadens
YAPSGI

SEQ ID NO: 2922512 - protein, 11 aa, Entamoeba invadens
YAPSPEEEDQV

SEQ ID NO: 2922513 - protein, 7 aa, Entamoeba invadens
YAPTQKD

SEQ ID NO: 2922514 - protein, 11 aa, Entamoeba invadens
YAPVNKEQYKE

SEQ ID NO: 2922515 - protein, 11 aa, Entamoeba invadens
YAQEDSQEKDY

SEQ ID NO: 2922516 - protein, 6 aa, Entamoeba invadens
YAQESG

SEQ ID NO: 2922517 - protein, 5 aa, Entamoeba invadens
YAQKA

SEQ ID NO: 2922518 - protein, 12 aa, Entamoeba invadens
YAQKNRKRFGNK

SEQ ID NO: 2922519 - protein, 13 aa, Entamoeba invadens
YAQQQQPQQQGSL

SEQ ID NO: 2922520 - protein, 29 aa, Entamoeba invadens
YAQSPEETFSNDCSSSEQSITPPLSGQRC

SEQ ID NO: 2922521 - protein, 16 aa, Entamoeba invadens
YAQTNKDQLPKNHRGL

SEQ ID NO: 2922522 - protein, 4 aa, Entamoeba invadens
YARE

SEQ ID NO: 2922523 - protein, 5 aa, Entamoeba invadens
YARGG

SEQ ID NO: 2922524 - protein, 10 aa, Entamoeba invadens
YARKNEDQAW

SEQ ID NO: 2922525 - protein, 4 aa, Entamoeba invadens
YARP

SEQ ID NO: 2922526 - protein, 7 aa, Entamoeba invadens
YARRTTI

SEQ ID NO: 2922527 - protein, 10 aa, Entamoeba invadens
YASDEDKKYY

SEQ ID NO: 2922528 - protein, 7 aa, Entamoeba invadens
YASDTIG

SEQ ID NO: 2922529 - protein, 4 aa, Entamoeba invadens
YASE

SEQ ID NO: 2922530 - protein, 12 aa, Entamoeba invadens
YASENDEENTTV

SEQ ID NO: 2922531 - protein, 12 aa, Entamoeba invadens
YASESLKKGDDF

SEQ ID NO: 2922532 - protein, 7 aa, Entamoeba invadens
YASGNYP

SEQ ID NO: 2922533 - protein, 4 aa, Entamoeba invadens
YASM

SEQ ID NO: 2922534 - protein, 4 aa, Entamoeba invadens
YASS

SEQ ID NO: 2922535 - protein, 5 aa, Entamoeba invadens
YASTQ

SEQ ID NO: 2922536 - protein, 17 aa, Entamoeba invadens
YATASKGVKRVEQDESY

SEQ ID NO: 2922537 - protein, 15 aa, Entamoeba invadens
YATDGAAFSRTQAKP

SEQ ID NO: 2922538 - protein, 12 aa, Entamoeba invadens
YATESSQQIMKP

SEQ ID NO: 2922539 - protein, 10 aa, Entamoeba invadens
YATGAANNLE

SEQ ID NO: 2922540 - protein, 6 aa, Entamoeba invadens
YATKSL

SEQ ID NO: 2922541 - protein, 12 aa, Entamoeba invadens
YATKTREGSNTF

SEQ ID NO: 2922542 - protein, 7 aa, Entamoeba invadens
YATNGEK

SEQ ID NO: 2922543 - protein, 10 aa, Entamoeba invadens
YATPDDEDTP

SEQ ID NO: 2922544 - protein, 7 aa, Entamoeba invadens
YATQSTH

SEQ ID NO: 2922545 - protein, 13 aa, Entamoeba invadens
YATRSKNVKGLSR

SEQ ID NO: 2922546 - protein, 13 aa, Entamoeba invadens
YATVPSCSQPTVG

SEQ ID NO: 2922547 - protein, 5 aa, Entamoeba invadens
YAVEG

SEQ ID NO: 2922548 - protein, 36 aa, Entamoeba invadens
YAVGKEEKQVCNDNEYPAWETTPKPHVKKPTNDVAC

SEQ ID NO: 2922549 - protein, 24 aa, Entamoeba invadens
YAVKEPKRRRTEHKPRGDHREENL

SEQ ID NO: 2922550 - protein, 13 aa, Entamoeba invadens
YAYETKEAGRIEA

SEQ ID NO: 2922551 - protein, 5 aa, Entamoeba invadens
YAYNN

SEQ ID NO: 2922552 - protein, 6 aa, Entamoeba invadens
YAYNNR

SEQ ID NO: 2922553 - protein, 28 aa, Entamoeba invadens
YAYTSTKPTRMSMSEESESRSYSAPIKT

SEQ ID NO: 2922554 - protein, 8 aa, Entamoeba invadens
YCDRGTSN

SEQ ID NO: 2922555 - protein, 5 aa, Entamoeba invadens
YCGPH

SEQ ID NO: 2922556 - protein, 6 aa, Entamoeba invadens
YCGSQS

SEQ ID NO: 2922557 - protein, 7 aa, Entamoeba invadens
YCNETQQ

SEQ ID NO: 2922558 - protein, 9 aa, Entamoeba invadens
YCPNSQEAG

SEQ ID NO: 2922559 - protein, 5 aa, Entamoeba invadens
YCPTS

SEQ ID NO: 2922560 - protein, 8 aa, Entamoeba invadens
YDADMKPK

SEQ ID NO: 2922561 - protein, 9 aa, Entamoeba invadens
YDAKEKKNV

SEQ ID NO: 2922562 - protein, 10 aa, Entamoeba invadens
YDAKEKTLTE

SEQ ID NO: 2922563 - protein, 8 aa, Entamoeba invadens
YDAPTFKK

SEQ ID NO: 2922564 - protein, 8 aa, Entamoeba invadens
YDAQNEAE

SEQ ID NO: 2922565 - protein, 8 aa, Entamoeba invadens
YDATPTSV

SEQ ID NO: 2922566 - protein, 4 aa, Entamoeba invadens
YDAV

SEQ ID NO: 2922567 - protein, 5 aa, Entamoeba invadens
YDCSG

SEQ ID NO: 2922568 - protein, 12 aa, Entamoeba invadens
YDDDDVKNTYKG

SEQ ID NO: 2922569 - protein, 14 aa, Entamoeba invadens
YDDDTLTIINIIKP

SEQ ID NO: 2922570 - protein, 7 aa, Entamoeba invadens
YDDDVPD

SEQ ID NO: 2922571 - protein, 6 aa, Entamoeba invadens
YDDEEY

SEQ ID NO: 2922572 - protein, 6 aa, Entamoeba invadens
YDDEKR

SEQ ID NO: 2922573 - protein, 7 aa, Entamoeba invadens
YDDEQRI

SEQ ID NO: 2922574 - protein, 15 aa, Entamoeba invadens
YDDGRPTIYRSPEQV

SEQ ID NO: 2922575 - protein, 5 aa, Entamoeba invadens
YDDMA

SEQ ID NO: 2922576 - protein, 7 aa, Entamoeba invadens
YDDNDDG

SEQ ID NO: 2922577 - protein, 6 aa, Entamoeba invadens
YDDPSC

SEQ ID NO: 2922578 - protein, 4 aa, Entamoeba invadens
YDDQ

SEQ ID NO: 2922579 - protein, 5 aa, Entamoeba invadens
YDDRD

SEQ ID NO: 2922580 - protein, 7 aa, Entamoeba invadens
YDDTTQY

SEQ ID NO: 2922581 - protein, 6 aa, Entamoeba invadens
YDDYKS

SEQ ID NO: 2922582 - protein, 9 aa, Entamoeba invadens
YDEDDDRYS

SEQ ID NO: 2922583 - protein, 9 aa, Entamoeba invadens
YDEDDDRYT

SEQ ID NO: 2922584 - protein, 10 aa, Entamoeba invadens
YDEDDYPEFP

SEQ ID NO: 2922585 - protein, 10 aa, Entamoeba invadens
YDEDEKTQRA

SEQ ID NO: 2922586 - protein, 9 aa, Entamoeba invadens
YDEDKESVL

SEQ ID NO: 2922587 - protein, 23 aa, Entamoeba invadens
YDEDSDDSNNENIKTNRNEINTR

SEQ ID NO: 2922588 - protein, 22 aa, Entamoeba invadens
YDEGKAEEAKRKKEKRQRKEHK

SEQ ID NO: 2922589 - protein, 9 aa, Entamoeba invadens
YDEGKESAE

SEQ ID NO: 2922590 - protein, 10 aa, Entamoeba invadens
YDEGPAPSFE

SEQ ID NO: 2922591 - protein, 6 aa, Entamoeba invadens
YDEKGA

SEQ ID NO: 2922592 - protein, 7 aa, Entamoeba invadens
YDEKKKY

SEQ ID NO: 2922593 - protein, 8 aa, Entamoeba invadens
YDEKRNEV

SEQ ID NO: 2922594 - protein, 16 aa, Entamoeba invadens
YDEKSAETLKKIRAEK

SEQ ID NO: 2922595 - protein, 10 aa, Entamoeba invadens
YDENGEKKSV

SEQ ID NO: 2922596 - protein, 8 aa, Entamoeba invadens
YDENGKEI

SEQ ID NO: 2922597 - protein, 13 aa, Entamoeba invadens
YDENGNATVLNPD

SEQ ID NO: 2922598 - protein, 15 aa, Entamoeba invadens
YDENKPETHKGRNLK

SEQ ID NO: 2922599 - protein, 13 aa, Entamoeba invadens
YDENPSTKVPTEI

SEQ ID NO: 2922600 - protein, 8 aa, Entamoeba invadens
YDERREES

SEQ ID NO: 2922601 - protein, 5 aa, Entamoeba invadens
YDERS

SEQ ID NO: 2922602 - protein, 4 aa, Entamoeba invadens
YDES

SEQ ID NO: 2922603 - protein, 41 aa, Entamoeba invadens
YDESDASANLDTYSNSREIKKEEKSISPLSEKKKSKDANER

SEQ ID NO: 2922604 - protein, 10 aa, Entamoeba invadens
YDEYDNGEVE

SEQ ID NO: 2922605 - protein, 4 aa, Entamoeba invadens
YDFE

SEQ ID NO: 2922606 - protein, 4 aa, Entamoeba invadens
YDGA

SEQ ID NO: 2922607 - protein, 6 aa, Entamoeba invadens
YDGDEM

SEQ ID NO: 2922608 - protein, 4 aa, Entamoeba invadens
YDGE

SEQ ID NO: 2922609 - protein, 9 aa, Entamoeba invadens
YDGEPYLQT

SEQ ID NO: 2922610 - protein, 8 aa, Entamoeba invadens
YDGERGQI

SEQ ID NO: 2922611 - protein, 5 aa, Entamoeba invadens
YDGET

SEQ ID NO: 2922612 - protein, 6 aa, Entamoeba invadens
YDGISN

SEQ ID NO: 2922613 - protein, 5 aa, Entamoeba invadens
YDGKI

SEQ ID NO: 2922614 - protein, 9 aa, Entamoeba invadens
YDGKTDAAG

SEQ ID NO: 2922615 - protein, 7 aa, Entamoeba invadens
YDGKTER

SEQ ID NO: 2922616 - protein, 6 aa, Entamoeba invadens
YDGNEQ

SEQ ID NO: 2922617 - protein, 8 aa, Entamoeba invadens
YDGNNEKV

SEQ ID NO: 2922618 - protein, 8 aa, Entamoeba invadens
YDGPNSLS

SEQ ID NO: 2922619 - protein, 6 aa, Entamoeba invadens
YDGPYS

SEQ ID NO: 2922620 - protein, 7 aa, Entamoeba invadens
YDGSPME

SEQ ID NO: 2922621 - protein, 17 aa, Entamoeba invadens
YDGSRGTLVTGSSDKKV

SEQ ID NO: 2922622 - protein, 24 aa, Entamoeba invadens
YDGSRSPSLIGSNQSPQPSTTTNT

SEQ ID NO: 2922623 - protein, 8 aa, Entamoeba invadens
YDGSSLAK

SEQ ID NO: 2922624 - protein, 8 aa, Entamoeba invadens
YDGYTPKM

SEQ ID NO: 2922625 - protein, 13 aa, Entamoeba invadens
YDHLDTKGIETVR

SEQ ID NO: 2922626 - protein, 6 aa, Entamoeba invadens
YDIDTE

SEQ ID NO: 2922627 - protein, 10 aa, Entamoeba invadens
YDIEGREEGV

SEQ ID NO: 2922628 - protein, 14 aa, Entamoeba invadens
YDIPKSKAQSFQHT

SEQ ID NO: 2922629 - protein, 12 aa, Entamoeba invadens
YDITETPQQITK

SEQ ID NO: 2922630 - protein, 25 aa, Entamoeba invadens
YDKAAEAYKTAASQYEMDNRPASAL

SEQ ID NO: 2922631 - protein, 9 aa, Entamoeba invadens
YDKDETGKV

SEQ ID NO: 2922632 - protein, 13 aa, Entamoeba invadens
YDKDGKMKASPLR

SEQ ID NO: 2922633 - protein, 10 aa, Entamoeba invadens
YDKDGSKNTV

SEQ ID NO: 2922634 - protein, 7 aa, Entamoeba invadens
YDKDGVR

SEQ ID NO: 2922635 - protein, 17 aa, Entamoeba invadens
YDKDQLSSEKKKLQDEY

SEQ ID NO: 2922636 - protein, 15 aa, Entamoeba invadens
YDKDTAEKISREAKV

SEQ ID NO: 2922637 - protein, 4 aa, Entamoeba invadens
YDKE

SEQ ID NO: 2922638 - protein, 8 aa, Entamoeba invadens
YDKNHENY

SEQ ID NO: 2922639 - protein, 15 aa, Entamoeba invadens
YDKNSPNPNLGYPKF

SEQ ID NO: 2922640 - protein, 13 aa, Entamoeba invadens
YDKNTINKLTTKA

SEQ ID NO: 2922641 - protein, 11 aa, Entamoeba invadens
YDKPQSEMYGS

SEQ ID NO: 2922642 - protein, 7 aa, Entamoeba invadens
YDKSDDM

SEQ ID NO: 2922643 - protein, 9 aa, Entamoeba invadens
YDKSGEEHY

SEQ ID NO: 2922644 - protein, 26 aa, Entamoeba invadens
YDKSKSANIPKKSFGELEKEYKQSVQ

SEQ ID NO: 2922645 - protein, 8 aa, Entamoeba invadens
YDKSKTLS

SEQ ID NO: 2922646 - protein, 8 aa, Entamoeba invadens
YDKSTNLK

SEQ ID NO: 2922647 - protein, 9 aa, Entamoeba invadens
YDKTDDKNK

SEQ ID NO: 2922648 - protein, 10 aa, Entamoeba invadens
YDKTNKDQNG

SEQ ID NO: 2922649 - protein, 6 aa, Entamoeba invadens
YDKTTI

SEQ ID NO: 2922650 - protein, 8 aa, Entamoeba invadens
YDKYPSMH

SEQ ID NO: 2922651 - protein, 5 aa, Entamoeba invadens
YDLPK

SEQ ID NO: 2922652 - protein, 5 aa, Entamoeba invadens
YDLPS

SEQ ID NO: 2922653 - protein, 5 aa, Entamoeba invadens
YDLSP

SEQ ID NO: 2922654 - protein, 4 aa, Entamoeba invadens
YDNA

SEQ ID NO: 2922655 - protein, 8 aa, Entamoeba invadens
YDNATEDS

SEQ ID NO: 2922656 - protein, 16 aa, Entamoeba invadens
YDNEEEGVVNFSFVSI

SEQ ID NO: 2922657 - protein, 10 aa, Entamoeba invadens
YDNPDEKLPT

SEQ ID NO: 2922658 - protein, 18 aa, Entamoeba invadens
YDNPNSLDNLATEKAKVS

SEQ ID NO: 2922659 - protein, 5 aa, Entamoeba invadens
YDNPS

SEQ ID NO: 2922660 - protein, 6 aa, Entamoeba invadens
YDNTKE

SEQ ID NO: 2922661 - protein, 6 aa, Entamoeba invadens
YDNTSK

SEQ ID NO: 2922662 - protein, 9 aa, Entamoeba invadens
YDPATYGSY

SEQ ID NO: 2922663 - protein, 15 aa, Entamoeba invadens
YDPDCSTCSQTTRKC

SEQ ID NO: 2922664 - protein, 11 aa, Entamoeba invadens
YDPDTNRYDHH

SEQ ID NO: 2922665 - protein, 6 aa, Entamoeba invadens
YDPEDV

SEQ ID NO: 2922666 - protein, 6 aa, Entamoeba invadens
YDPEEP

SEQ ID NO: 2922667 - protein, 5 aa, Entamoeba invadens
YDPEI

SEQ ID NO: 2922668 - protein, 10 aa, Entamoeba invadens
YDPENEKPRE

SEQ ID NO: 2922669 - protein, 11 aa, Entamoeba invadens
YDPESRMRPDQ

SEQ ID NO: 2922670 - protein, 5 aa, Entamoeba invadens
YDPKV

SEQ ID NO: 2922671 - protein, 4 aa, Entamoeba invadens
YDPL

SEQ ID NO: 2922672 - protein, 5 aa, Entamoeba invadens
YDPLP

SEQ ID NO: 2922673 - protein, 7 aa, Entamoeba invadens
YDPNCSE

SEQ ID NO: 2922674 - protein, 9 aa, Entamoeba invadens
YDPNQSERL

SEQ ID NO: 2922675 - protein, 9 aa, Entamoeba invadens
YDPNQVRGY

SEQ ID NO: 2922676 - protein, 7 aa, Entamoeba invadens
YDPNTYL

SEQ ID NO: 2922677 - protein, 10 aa, Entamoeba invadens
YDPNVTPNKK

SEQ ID NO: 2922678 - protein, 7 aa, Entamoeba invadens
YDPQQYA

SEQ ID NO: 2922679 - protein, 21 aa, Entamoeba invadens
YDPSETRNSLIESPDGSSTHT

SEQ ID NO: 2922680 - protein, 7 aa, Entamoeba invadens
YDPSHMD

SEQ ID NO: 2922681 - protein, 9 aa, Entamoeba invadens
YDPSNDNPF

SEQ ID NO: 2922682 - protein, 4 aa, Entamoeba invadens
YDPT

SEQ ID NO: 2922683 - protein, 16 aa, Entamoeba invadens
YDPTDSTPILEGDEPY

SEQ ID NO: 2922684 - protein, 6 aa, Entamoeba invadens
YDPTHA

SEQ ID NO: 2922685 - protein, 4 aa, Entamoeba invadens
YDPY

SEQ ID NO: 2922686 - protein, 8 aa, Entamoeba invadens
YDQDAARD

SEQ ID NO: 2922687 - protein, 5 aa, Entamoeba invadens
YDQIP

SEQ ID NO: 2922688 - protein, 8 aa, Entamoeba invadens
YDQNYKEA

SEQ ID NO: 2922689 - protein, 8 aa, Entamoeba invadens
YDQPSESV

SEQ ID NO: 2922690 - protein, 10 aa, Entamoeba invadens
YDQQQEEEYS

SEQ ID NO: 2922691 - protein, 4 aa, Entamoeba invadens
YDQT

SEQ ID NO: 2922692 - protein, 8 aa, Entamoeba invadens
YDQTKGAL

SEQ ID NO: 2922693 - protein, 8 aa, Entamoeba invadens
YDQTQNVK

SEQ ID NO: 2922694 - protein, 4 aa, Entamoeba invadens
YDRN

SEQ ID NO: 2922695 - protein, 6 aa, Entamoeba invadens
YDRSRR

SEQ ID NO: 2922696 - protein, 9 aa, Entamoeba invadens
YDRSSTSNF

SEQ ID NO: 2922697 - protein, 6 aa, Entamoeba invadens
YDSEKV

SEQ ID NO: 2922698 - protein, 14 aa, Entamoeba invadens
YDSGASGSSAMPSF

SEQ ID NO: 2922699 - protein, 6 aa, Entamoeba invadens
YDSGVE

SEQ ID NO: 2922700 - protein, 4 aa, Entamoeba invadens
YDSK

SEQ ID NO: 2922701 - protein, 6 aa, Entamoeba invadens
YDSKTA

SEQ ID NO: 2922702 - protein, 6 aa, Entamoeba invadens
YDSNGK

SEQ ID NO: 2922703 - protein, 7 aa, Entamoeba invadens
YDSPNNF

SEQ ID NO: 2922704 - protein, 8 aa, Entamoeba invadens
YDSPVRAA

SEQ ID NO: 2922705 - protein, 17 aa, Entamoeba invadens
YDSQYKSVKDKFEPNLS

SEQ ID NO: 2922706 - protein, 6 aa, Entamoeba invadens
YDSRCD

SEQ ID NO: 2922707 - protein, 10 aa, Entamoeba invadens
YDSSDKTLGD

SEQ ID NO: 2922708 - protein, 7 aa, Entamoeba invadens
YDSSKIG

SEQ ID NO: 2922709 - protein, 7 aa, Entamoeba invadens
YDSTGLK

SEQ ID NO: 2922710 - protein, 4 aa, Entamoeba invadens
YDSY

SEQ ID NO: 2922711 - protein, 7 aa, Entamoeba invadens
YDTAKTE

SEQ ID NO: 2922712 - protein, 8 aa, Entamoeba invadens
YDTEDSYV

SEQ ID NO: 2922713 - protein, 8 aa, Entamoeba invadens
YDTEKETV

SEQ ID NO: 2922714 - protein, 8 aa, Entamoeba invadens
YDTEKKYV

SEQ ID NO: 2922715 - protein, 9 aa, Entamoeba invadens
YDTEKSKVV

SEQ ID NO: 2922716 - protein, 11 aa, Entamoeba invadens
YDTHTSAEKLD

SEQ ID NO: 2922717 - protein, 8 aa, Entamoeba invadens
YDTKAHTQ

SEQ ID NO: 2922718 - protein, 9 aa, Entamoeba invadens
YDTKEGRNV

SEQ ID NO: 2922719 - protein, 28 aa, Entamoeba invadens
YDTKGMSKTPRVEGSPKPSFVKTPRSLS

SEQ ID NO: 2922720 - protein, 16 aa, Entamoeba invadens
YDTPKVAPNHSEDAKK

SEQ ID NO: 2922721 - protein, 8 aa, Entamoeba invadens
YDTPYGSS

SEQ ID NO: 2922722 - protein, 5 aa, Entamoeba invadens
YDTTT

SEQ ID NO: 2922723 - protein, 4 aa, Entamoeba invadens
YDTV

SEQ ID NO: 2922724 - protein, 8 aa, Entamoeba invadens
YDTVTGQG

SEQ ID NO: 2922725 - protein, 19 aa, Entamoeba invadens
YDTYDQKATETAFSPSGSV

SEQ ID NO: 2922726 - protein, 7 aa, Entamoeba invadens
YDTYPQS

SEQ ID NO: 2922727 - protein, 4 aa, Entamoeba invadens
YDVA

SEQ ID NO: 2922728 - protein, 4 aa, Entamoeba invadens
YDVD

SEQ ID NO: 2922729 - protein, 36 aa, Entamoeba invadens
YDVGQPDDVCDDASDTSDDGDVEEKEEADNGPEGEY

SEQ ID NO: 2922730 - protein, 4 aa, Entamoeba invadens
YDVP

SEQ ID NO: 2922731 - protein, 9 aa, Entamoeba invadens
YDVTDNPDS

SEQ ID NO: 2922732 - protein, 8 aa, Entamoeba invadens
YEAEPNKE

SEQ ID NO: 2922733 - protein, 6 aa, Entamoeba invadens
YEAEQE

SEQ ID NO: 2922734 - protein, 14 aa, Entamoeba invadens
YEAGTNKTEFPSEG

SEQ ID NO: 2922735 - protein, 10 aa, Entamoeba invadens
YEAKNTTTLT

SEQ ID NO: 2922736 - protein, 16 aa, Entamoeba invadens
YEAQEANELSIKTDDT

SEQ ID NO: 2922737 - protein, 7 aa, Entamoeba invadens
YEAQKDA

SEQ ID NO: 2922738 - protein, 12 aa, Entamoeba invadens
YEARSTQNLNKD

SEQ ID NO: 2922739 - protein, 7 aa, Entamoeba invadens
YEASGYE

SEQ ID NO: 2922740 - protein, 11 aa, Entamoeba invadens
YEATEDDIRQA

SEQ ID NO: 2922741 - protein, 4 aa, Entamoeba invadens
YECQ

SEQ ID NO: 2922742 - protein, 19 aa, Entamoeba invadens
YEDAETLSSTVKPEEKDVK

SEQ ID NO: 2922743 - protein, 8 aa, Entamoeba invadens
YEDDRNTK

SEQ ID NO: 2922744 - protein, 9 aa, Entamoeba invadens
YEDDSKKKQ

SEQ ID NO: 2922745 - protein, 30 aa, Entamoeba invadens
YEDDTTQDTPTSDDDDSDDDSSDDTEDDVG

SEQ ID NO: 2922746 - protein, 6 aa, Entamoeba invadens
YEDELE

SEQ ID NO: 2922747 - protein, 12 aa, Entamoeba invadens
YEDGELQATSIG

SEQ ID NO: 2922748 - protein, 5 aa, Entamoeba invadens
YEDKE

SEQ ID NO: 2922749 - protein, 10 aa, Entamoeba invadens
YEDKQLKQSP

SEQ ID NO: 2922750 - protein, 9 aa, Entamoeba invadens
YEDNEPMEQ

SEQ ID NO: 2922751 - protein, 10 aa, Entamoeba invadens
YEDNTSTVSG

SEQ ID NO: 2922752 - protein, 17 aa, Entamoeba invadens
YEDQEKTVLGDENKSLS

SEQ ID NO: 2922753 - protein, 9 aa, Entamoeba invadens
YEDRFQGRR

SEQ ID NO: 2922754 - protein, 9 aa, Entamoeba invadens
YEDSRYYEG

SEQ ID NO: 2922755 - protein, 4 aa, Entamoeba invadens
YEDT

SEQ ID NO: 2922756 - protein, 8 aa, Entamoeba invadens
YEDTDTDE

SEQ ID NO: 2922757 - protein, 8 aa, Entamoeba invadens
YEDTPLKS

SEQ ID NO: 2922758 - protein, 13 aa, Entamoeba invadens
YEDTRKQEVTTLE

SEQ ID NO: 2922759 - protein, 4 aa, Entamoeba invadens
YEEA

SEQ ID NO: 2922760 - protein, 5 aa, Entamoeba invadens
YEEDQ

SEQ ID NO: 2922761 - protein, 7 aa, Entamoeba invadens
YEEDVKS

SEQ ID NO: 2922762 - protein, 20 aa, Entamoeba invadens
YEEEAEEDVDPNETEEDRIN

SEQ ID NO: 2922763 - protein, 11 aa, Entamoeba invadens
YEEEATEYDGF

SEQ ID NO: 2922764 - protein, 6 aa, Entamoeba invadens
YEEEGN

SEQ ID NO: 2922765 - protein, 5 aa, Entamoeba invadens
YEEEI

SEQ ID NO: 2922766 - protein, 20 aa, Entamoeba invadens
YEEELKKPEDQIEKQYELPD

SEQ ID NO: 2922767 - protein, 17 aa, Entamoeba invadens
YEEEPAEPDENVQDNTQ

SEQ ID NO: 2922768 - protein, 8 aa, Entamoeba invadens
YEEEREKY

SEQ ID NO: 2922769 - protein, 11 aa, Entamoeba invadens
YEEETQYSNTT

SEQ ID NO: 2922770 - protein, 7 aa, Entamoeba invadens
YEEGAKH

SEQ ID NO: 2922771 - protein, 8 aa, Entamoeba invadens
YEEGRELA

SEQ ID NO: 2922772 - protein, 4 aa, Entamoeba invadens
YEEI

SEQ ID NO: 2922773 - protein, 14 aa, Entamoeba invadens
YEEIEEKKKLGEGS

SEQ ID NO: 2922774 - protein, 4 aa, Entamoeba invadens
YEEK

SEQ ID NO: 2922775 - protein, 8 aa, Entamoeba invadens
YEEKSPLP

SEQ ID NO: 2922776 - protein, 9 aa, Entamoeba invadens
YEEKSRPCL

SEQ ID NO: 2922777 - protein, 13 aa, Entamoeba invadens
YEENGASFINSHL

SEQ ID NO: 2922778 - protein, 4 aa, Entamoeba invadens
YEEQ

SEQ ID NO: 2922779 - protein, 7 aa, Entamoeba invadens
YEEQIEK

SEQ ID NO: 2922780 - protein, 10 aa, Entamoeba invadens
YEEQKKAEFT

SEQ ID NO: 2922781 - protein, 10 aa, Entamoeba invadens
YEETGKDNIS

SEQ ID NO: 2922782 - protein, 8 aa, Entamoeba invadens
YEETKNVS

SEQ ID NO: 2922783 - protein, 9 aa, Entamoeba invadens
YEETTRPNV

SEQ ID NO: 2922784 - protein, 20 aa, Entamoeba invadens
YEEVEEDEEEEEDKNDEDYE

SEQ ID NO: 2922785 - protein, 9 aa, Entamoeba invadens
YEFDKPNFK

SEQ ID NO: 2922786 - protein, 9 aa, Entamoeba invadens
YEGDYKDSF

SEQ ID NO: 2922787 - protein, 10 aa, Entamoeba invadens
YEGENREGIY

SEQ ID NO: 2922788 - protein, 4 aa, Entamoeba invadens
YEGG

SEQ ID NO: 2922789 - protein, 17 aa, Entamoeba invadens
YEGGFSGNPGGEAHGGY

SEQ ID NO: 2922790 - protein, 12 aa, Entamoeba invadens
YEGGQDDNEIDN

SEQ ID NO: 2922791 - protein, 5 aa, Entamoeba invadens
YEGMS

SEQ ID NO: 2922792 - protein, 10 aa, Entamoeba invadens
YEGNEEEMKN

SEQ ID NO: 2922793 - protein, 6 aa, Entamoeba invadens
YEGNYK

SEQ ID NO: 2922794 - protein, 4 aa, Entamoeba invadens
YEGQ

SEQ ID NO: 2922795 - protein, 15 aa, Entamoeba invadens
YEGQEARTKRKEFQD

SEQ ID NO: 2922796 - protein, 5 aa, Entamoeba invadens
YEGQG

SEQ ID NO: 2922797 - protein, 16 aa, Entamoeba invadens
YEGQQEGDLSFKEGEQ

SEQ ID NO: 2922798 - protein, 9 aa, Entamoeba invadens
YEGSEVKEM

SEQ ID NO: 2922799 - protein, 14 aa, Entamoeba invadens
YEGSGRKNQVERNK

SEQ ID NO: 2922800 - protein, 5 aa, Entamoeba invadens
YEGSL

SEQ ID NO: 2922801 - protein, 9 aa, Entamoeba invadens
YEGSNAATV

SEQ ID NO: 2922802 - protein, 4 aa, Entamoeba invadens
YEGT

SEQ ID NO: 2922803 - protein, 21 aa, Entamoeba invadens
YEGTKKTSNSTTNSSESVSKK

SEQ ID NO: 2922804 - protein, 15 aa, Entamoeba invadens
YEGTPDEQATNFRDH

SEQ ID NO: 2922805 - protein, 10 aa, Entamoeba invadens
YEGTQTNPKK

SEQ ID NO: 2922806 - protein, 6 aa, Entamoeba invadens
YEGTVT

SEQ ID NO: 2922807 - protein, 4 aa, Entamoeba invadens
YEGV

SEQ ID NO: 2922808 - protein, 10 aa, Entamoeba invadens
YEIEGSASEI

SEQ ID NO: 2922809 - protein, 6 aa, Entamoeba invadens
YEISPT

SEQ ID NO: 2922810 - protein, 7 aa, Entamoeba invadens
YEKDDKF

SEQ ID NO: 2922811 - protein, 7 aa, Entamoeba invadens
YEKDGVQ

SEQ ID NO: 2922812 - protein, 45 aa, Entamoeba invadens
YEKDRKEWQEKEKKLKEEISSLKKNKKTSFFGKKDDSANEAEKAQ

SEQ ID NO: 2922813 - protein, 17 aa, Entamoeba invadens
YEKDSGDNISVIVIDLT

SEQ ID NO: 2922814 - protein, 11 aa, Entamoeba invadens
YEKEAKDNQRE

SEQ ID NO: 2922815 - protein, 12 aa, Entamoeba invadens
YEKEKKKETKEL

SEQ ID NO: 2922816 - protein, 5 aa, Entamoeba invadens
YEKLP

SEQ ID NO: 2922817 - protein, 12 aa, Entamoeba invadens
YEKLPNSSLNTD

SEQ ID NO: 2922818 - protein, 5 aa, Entamoeba invadens
YEKNH

SEQ ID NO: 2922819 - protein, 7 aa, Entamoeba invadens
YEKNPEL

SEQ ID NO: 2922820 - protein, 10 aa, Entamoeba invadens
YEKNPSTPMS

SEQ ID NO: 2922821 - protein, 8 aa, Entamoeba invadens
YEKPEDIS

SEQ ID NO: 2922822 - protein, 13 aa, Entamoeba invadens
YEKPQKKTQPFQN

SEQ ID NO: 2922823 - protein, 14 aa, Entamoeba invadens
YEKSDDGGQVEKKT

SEQ ID NO: 2922824 - protein, 9 aa, Entamoeba invadens
YEKSEEKGL

SEQ ID NO: 2922825 - protein, 9 aa, Entamoeba invadens
YEKSEISDN

SEQ ID NO: 2922826 - protein, 9 aa, Entamoeba invadens
YEKSQKNLQ

SEQ ID NO: 2922827 - protein, 22 aa, Entamoeba invadens
YEKSSEDSEVTKSDVDKTEVQK

SEQ ID NO: 2922828 - protein, 8 aa, Entamoeba invadens
YEKTDNLA

SEQ ID NO: 2922829 - protein, 8 aa, Entamoeba invadens
YEKTNNFE

SEQ ID NO: 2922830 - protein, 14 aa, Entamoeba invadens
YEKVNEVPQPYVDG

SEQ ID NO: 2922831 - protein, 9 aa, Entamoeba invadens
YEKYDEHRE

SEQ ID NO: 2922832 - protein, 4 aa, Entamoeba invadens
YELE

SEQ ID NO: 2922833 - protein, 4 aa, Entamoeba invadens
YELP

SEQ ID NO: 2922834 - protein, 10 aa, Entamoeba invadens
YELPKSKLEN

SEQ ID NO: 2922835 - protein, 7 aa, Entamoeba invadens
YELRQDA

SEQ ID NO: 2922836 - protein, 8 aa, Entamoeba invadens
YEMTQNGK

SEQ ID NO: 2922837 - protein, 11 aa, Entamoeba invadens
YENDTDVTDPL

SEQ ID NO: 2922838 - protein, 4 aa, Entamoeba invadens
YENE

SEQ ID NO: 2922839 - protein, 15 aa, Entamoeba invadens
YENEEELGDKEKQFL

SEQ ID NO: 2922840 - protein, 11 aa, Entamoeba invadens
YENEPRGDGAI

SEQ ID NO: 2922841 - protein, 5 aa, Entamoeba invadens
YENET

SEQ ID NO: 2922842 - protein, 8 aa, Entamoeba invadens
YENGDYSI

SEQ ID NO: 2922843 - protein, 10 aa, Entamoeba invadens
YENNDESLYQ

SEQ ID NO: 2922844 - protein, 29 aa, Entamoeba invadens
YENNINKTQMDVERKKAKMQERADKGGKD

SEQ ID NO: 2922845 - protein, 6 aa, Entamoeba invadens
YENPQE

SEQ ID NO: 2922846 - protein, 9 aa, Entamoeba invadens
YENQNTDAF

SEQ ID NO: 2922847 - protein, 7 aa, Entamoeba invadens
YENQSVN

SEQ ID NO: 2922848 - protein, 9 aa, Entamoeba invadens
YENSDKRPI

SEQ ID NO: 2922849 - protein, 11 aa, Entamoeba invadens
YENSNESDEKL

SEQ ID NO: 2922850 - protein, 6 aa, Entamoeba invadens
YENSRK

SEQ ID NO: 2922851 - protein, 5 aa, Entamoeba invadens
YENSY

SEQ ID NO: 2922852 - protein, 14 aa, Entamoeba invadens
YENTLPKESSTCTL

SEQ ID NO: 2922853 - protein, 9 aa, Entamoeba invadens
YEPETTDPM

SEQ ID NO: 2922854 - protein, 5 aa, Entamoeba invadens
YEPFE

SEQ ID NO: 2922855 - protein, 14 aa, Entamoeba invadens
YEPNGLSKSKNQLS

SEQ ID NO: 2922856 - protein, 9 aa, Entamoeba invadens
YEPNTGDPN

SEQ ID NO: 2922857 - protein, 5 aa, Entamoeba invadens
YEPPQ

SEQ ID NO: 2922858 - protein, 8 aa, Entamoeba invadens
YEPPTDMA

SEQ ID NO: 2922859 - protein, 7 aa, Entamoeba invadens
YEPSEIE

SEQ ID NO: 2922860 - protein, 20 aa, Entamoeba invadens
YEPSGSHKTVESNKGTPKNL

SEQ ID NO: 2922861 - protein, 12 aa, Entamoeba invadens
YEPSSANLKPSI

SEQ ID NO: 2922862 - protein, 13 aa, Entamoeba invadens
YEPTIEDSYNTQI

SEQ ID NO: 2922863 - protein, 7 aa, Entamoeba invadens
YEQEKTV

SEQ ID NO: 2922864 - protein, 13 aa, Entamoeba invadens
YEQELRANPSDSD

SEQ ID NO: 2922865 - protein, 5 aa, Entamoeba invadens
YEQET

SEQ ID NO: 2922866 - protein, 6 aa, Entamoeba invadens
YEQKAN

SEQ ID NO: 2922867 - protein, 8 aa, Entamoeba invadens
YEQKDKEI

SEQ ID NO: 2922868 - protein, 10 aa, Entamoeba invadens
YEQKSPDYEK

SEQ ID NO: 2922869 - protein, 4 aa, Entamoeba invadens
YEQN

SEQ ID NO: 2922870 - protein, 26 aa, Entamoeba invadens
YEQNESKTGSEYSSVSPRKEQEEENS

SEQ ID NO: 2922871 - protein, 5 aa, Entamoeba invadens
YEQNT

SEQ ID NO: 2922872 - protein, 5 aa, Entamoeba invadens
YEQRK

SEQ ID NO: 2922873 - protein, 6 aa, Entamoeba invadens
YEQSGG

SEQ ID NO: 2922874 - protein, 21 aa, Entamoeba invadens
YEQVETEKNKYGSDVQTVKQT

SEQ ID NO: 2922875 - protein, 8 aa, Entamoeba invadens
YERADERL

SEQ ID NO: 2922876 - protein, 10 aa, Entamoeba invadens
YERKDHDNCH

SEQ ID NO: 2922877 - protein, 9 aa, Entamoeba invadens
YERKENVDK

SEQ ID NO: 2922878 - protein, 9 aa, Entamoeba invadens
YERSGNEEN

SEQ ID NO: 2922879 - protein, 12 aa, Entamoeba invadens
YERTAAKKKEKN

SEQ ID NO: 2922880 - protein, 9 aa, Entamoeba invadens
YESDARKWS

SEQ ID NO: 2922881 - protein, 10 aa, Entamoeba invadens
YESDSNKSIV

SEQ ID NO: 2922882 - protein, 7 aa, Entamoeba invadens
YESEEDI

SEQ ID NO: 2922883 - protein, 15 aa, Entamoeba invadens
YESESLDITDAKNYR

SEQ ID NO: 2922884 - protein, 9 aa, Entamoeba invadens
YESGESLSS

SEQ ID NO: 2922885 - protein, 5 aa, Entamoeba invadens
YESGQ

SEQ ID NO: 2922886 - protein, 10 aa, Entamoeba invadens
YESGSAIPSE

SEQ ID NO: 2922887 - protein, 9 aa, Entamoeba invadens
YESKEELKE

SEQ ID NO: 2922888 - protein, 10 aa, Entamoeba invadens
YESNASDDYT

SEQ ID NO: 2922889 - protein, 45 aa, Entamoeba invadens
YESPNFKTSAKAFKPGKNSFSQKALPTSIPSLEESVGNLRASPRV

SEQ ID NO: 2922890 - protein, 12 aa, Entamoeba invadens
YESQPVLDENSN

SEQ ID NO: 2922891 - protein, 5 aa, Entamoeba invadens
YESTE

SEQ ID NO: 2922892 - protein, 8 aa, Entamoeba invadens
YESTTRKH

SEQ ID NO: 2922893 - protein, 8 aa, Entamoeba invadens
YESVLGSG

SEQ ID NO: 2922894 - protein, 12 aa, Entamoeba invadens
YETDLQKSRQSY

SEQ ID NO: 2922895 - protein, 10 aa, Entamoeba invadens
YETEDARQVL

SEQ ID NO: 2922896 - protein, 40 aa, Entamoeba invadens
YETEKDEFSSSDVDKGSDKDDDKCKRKREKCPMDKERRQM

SEQ ID NO: 2922897 - protein, 23 aa, Entamoeba invadens
YETEKDESSSSDVDEGSDKDYDK

SEQ ID NO: 2922898 - protein, 40 aa, Entamoeba invadens
YETEKDESSSSEVDEESDKDYDKCKRKHEKCPMDKERRQM

SEQ ID NO: 2922899 - protein, 40 aa, Entamoeba invadens
YETEKDKSSSSDIEEDNDKDYDKCQRRHEKCPMDKERRQM

SEQ ID NO: 2922900 - protein, 40 aa, Entamoeba invadens
YETEKDQSYSSDVDEGSDKDDDKCKRRHEKCPMDKKRRQM

SEQ ID NO: 2922901 - protein, 10 aa, Entamoeba invadens
YETEKGKRNK

SEQ ID NO: 2922902 - protein, 5 aa, Entamoeba invadens
YETKP

SEQ ID NO: 2922903 - protein, 14 aa, Entamoeba invadens
YETLSASKNGQNIS

SEQ ID NO: 2922904 - protein, 6 aa, Entamoeba invadens
YETPKD

SEQ ID NO: 2922905 - protein, 10 aa, Entamoeba invadens
YETPNKPKYE

SEQ ID NO: 2922906 - protein, 9 aa, Entamoeba invadens
YETPSSASV

SEQ ID NO: 2922907 - protein, 4 aa, Entamoeba invadens
YETQ

SEQ ID NO: 2922908 - protein, 42 aa, Entamoeba invadens
YETQQKIDAKGISNNTHDIQEGGGYCPPSVPLQEQKNYPSLP

SEQ ID NO: 2922909 - protein, 9 aa, Entamoeba invadens
YETSAKENL

SEQ ID NO: 2922910 - protein, 12 aa, Entamoeba invadens
YETSAKTGENVD

SEQ ID NO: 2922911 - protein, 11 aa, Entamoeba invadens
YETSKEDKKAE

SEQ ID NO: 2922912 - protein, 9 aa, Entamoeba invadens
YETSKKGKF

SEQ ID NO: 2922913 - protein, 14 aa, Entamoeba invadens
YETSTALDNLDTEY

SEQ ID NO: 2922914 - protein, 13 aa, Entamoeba invadens
YETTYESVTQTDI

SEQ ID NO: 2922915 - protein, 23 aa, Entamoeba invadens
YEVGEGEESYDVSQDVEKPKKKF

SEQ ID NO: 2922916 - protein, 15 aa, Entamoeba invadens
YEVGPESTSHDTDLN

SEQ ID NO: 2922917 - protein, 9 aa, Entamoeba invadens
YEVSKSGFV

SEQ ID NO: 2922918 - protein, 10 aa, Entamoeba invadens
YEVTQSSNLK

SEQ ID NO: 2922919 - protein, 11 aa, Entamoeba invadens
YEYENSENKTV

SEQ ID NO: 2922920 - protein, 16 aa, Entamoeba invadens
YEYQDDDEGNQPNKVL

SEQ ID NO: 2922921 - protein, 11 aa, Entamoeba invadens
YFEETGPPFSV

SEQ ID NO: 2922922 - protein, 20 aa, Entamoeba invadens
YFGSDNSSLLKTENLTNTEH

SEQ ID NO: 2922923 - protein, 5 aa, Entamoeba invadens
YFKTG

SEQ ID NO: 2922924 - protein, 5 aa, Entamoeba invadens
YFPEK

SEQ ID NO: 2922925 - protein, 5 aa, Entamoeba invadens
YFPES

SEQ ID NO: 2922926 - protein, 5 aa, Entamoeba invadens
YFPKP

SEQ ID NO: 2922927 - protein, 8 aa, Entamoeba invadens
YFSSNTDA

SEQ ID NO: 2922928 - protein, 30 aa, Entamoeba invadens
YFTDDDEEYTSSQSSESDESQTEEINADNY

SEQ ID NO: 2922929 - protein, 6 aa, Entamoeba invadens
YFTEGS

SEQ ID NO: 2922930 - protein, 8 aa, Entamoeba invadens
YFTPNDKD

SEQ ID NO: 2922931 - protein, 6 aa, Entamoeba invadens
YFTPST

SEQ ID NO: 2922932 - protein, 9 aa, Entamoeba invadens
YFTPSTTLS

SEQ ID NO: 2922933 - protein, 4 aa, Entamoeba invadens
YFTS

SEQ ID NO: 2922934 - protein, 4 aa, Entamoeba invadens
YGAE

SEQ ID NO: 2922935 - protein, 7 aa, Entamoeba invadens
YGAKSAT

SEQ ID NO: 2922936 - protein, 7 aa, Entamoeba invadens
YGANPEK

SEQ ID NO: 2922937 - protein, 7 aa, Entamoeba invadens
YGDDPTV

SEQ ID NO: 2922938 - protein, 11 aa, Entamoeba invadens
YGDGKEYTWET

SEQ ID NO: 2922939 - protein, 9 aa, Entamoeba invadens
YGDGSKPPV

SEQ ID NO: 2922940 - protein, 6 aa, Entamoeba invadens
YGDHPS

SEQ ID NO: 2922941 - protein, 21 aa, Entamoeba invadens
YGDRIDTKELVDDNKLSNTIE

SEQ ID NO: 2922942 - protein, 9 aa, Entamoeba invadens
YGDSNNNRI

SEQ ID NO: 2922943 - protein, 4 aa, Entamoeba invadens
YGDT

SEQ ID NO: 2922944 - protein, 5 aa, Entamoeba invadens
YGDTD

SEQ ID NO: 2922945 - protein, 4 aa, Entamoeba invadens
YGED

SEQ ID NO: 2922946 - protein, 7 aa, Entamoeba invadens
YGEDKDI

SEQ ID NO: 2922947 - protein, 9 aa, Entamoeba invadens
YGEDVRERN

SEQ ID NO: 2922948 - protein, 10 aa, Entamoeba invadens
YGEELSGPEY

SEQ ID NO: 2922949 - protein, 15 aa, Entamoeba invadens
YGEESYSATFSNDGS

SEQ ID NO: 2922950 - protein, 6 aa, Entamoeba invadens
YGEGGG

SEQ ID NO: 2922951 - protein, 15 aa, Entamoeba invadens
YGEGSTTSSNNLKYF

SEQ ID NO: 2922952 - protein, 4 aa, Entamoeba invadens
YGEH

SEQ ID NO: 2922953 - protein, 7 aa, Entamoeba invadens
YGEHGGR

SEQ ID NO: 2922954 - protein, 4 aa, Entamoeba invadens
YGEK

SEQ ID NO: 2922955 - protein, 9 aa, Entamoeba invadens
YGEKTRRER

SEQ ID NO: 2922956 - protein, 14 aa, Entamoeba invadens
YGELKKSVKITYVV

SEQ ID NO: 2922957 - protein, 4 aa, Entamoeba invadens
YGEN

SEQ ID NO: 2922958 - protein, 6 aa, Entamoeba invadens
YGENIQ

SEQ ID NO: 2922959 - protein, 6 aa, Entamoeba invadens
YGENTE

SEQ ID NO: 2922960 - protein, 7 aa, Entamoeba invadens
YGENTSK

SEQ ID NO: 2922961 - protein, 4 aa, Entamoeba invadens
YGEP

SEQ ID NO: 2922962 - protein, 4 aa, Entamoeba invadens
YGES

SEQ ID NO: 2922963 - protein, 13 aa, Entamoeba invadens
YGESTPTSNTANQ

SEQ ID NO: 2922964 - protein, 5 aa, Entamoeba invadens
YGETP

SEQ ID NO: 2922965 - protein, 6 aa, Entamoeba invadens
YGETSN

SEQ ID NO: 2922966 - protein, 4 aa, Entamoeba invadens
YGEV

SEQ ID NO: 2922967 - protein, 5 aa, Entamoeba invadens
YGFEN

SEQ ID NO: 2922968 - protein, 10 aa, Entamoeba invadens
YGFPPTKRIS

SEQ ID NO: 2922969 - protein, 4 aa, Entamoeba invadens
YGGF

SEQ ID NO: 2922970 - protein, 9 aa, Entamoeba invadens
YGGGEKEKH

SEQ ID NO: 2922971 - protein, 19 aa, Entamoeba invadens
YGGKLEDTVGIPEDQIREA

SEQ ID NO: 2922972 - protein, 9 aa, Entamoeba invadens
YGGKNPKVT

SEQ ID NO: 2922973 - protein, 9 aa, Entamoeba invadens
YGGNDGRAN

SEQ ID NO: 2922974 - protein, 5 aa, Entamoeba invadens
YGGNM

SEQ ID NO: 2922975 - protein, 6 aa, Entamoeba invadens
YGGNPS

SEQ ID NO: 2922976 - protein, 9 aa, Entamoeba invadens
YGGRKTEAF

SEQ ID NO: 2922977 - protein, 8 aa, Entamoeba invadens
YGGSNTEC

SEQ ID NO: 2922978 - protein, 7 aa, Entamoeba invadens
YGGSNTQ

SEQ ID NO: 2922979 - protein, 5 aa, Entamoeba invadens
YGGTV

SEQ ID NO: 2922980 - protein, 6 aa, Entamoeba invadens
YGGVPA

SEQ ID NO: 2922981 - protein, 8 aa, Entamoeba invadens
YGHKSSEC

SEQ ID NO: 2922982 - protein, 4 aa, Entamoeba invadens
YGIG

SEQ ID NO: 2922983 - protein, 6 aa, Entamoeba invadens
YGINDD

SEQ ID NO: 2922984 - protein, 8 aa, Entamoeba invadens
YGKDLTQD

SEQ ID NO: 2922985 - protein, 9 aa, Entamoeba invadens
YGKDSSQKA

SEQ ID NO: 2922986 - protein, 11 aa, Entamoeba invadens
YGKDSTPSGMH

SEQ ID NO: 2922987 - protein, 7 aa, Entamoeba invadens
YGKDVEN

SEQ ID NO: 2922988 - protein, 5 aa, Entamoeba invadens
YGKEC

SEQ ID NO: 2922989 - protein, 5 aa, Entamoeba invadens
YGKEE

SEQ ID NO: 2922990 - protein, 5 aa, Entamoeba invadens
YGKEK

SEQ ID NO: 2922991 - protein, 9 aa, Entamoeba invadens
YGKGKDYLT

SEQ ID NO: 2922992 - protein, 8 aa, Entamoeba invadens
YGKGKTGS

SEQ ID NO: 2922993 - protein, 7 aa, Entamoeba invadens
YGKIEKK

SEQ ID NO: 2922994 - protein, 12 aa, Entamoeba invadens
YGKKDVKTLNPE

SEQ ID NO: 2922995 - protein, 10 aa, Entamoeba invadens
YGKPKPDDAY

SEQ ID NO: 2922996 - protein, 22 aa, Entamoeba invadens
YGKQSRKGKVMKEKTQRSTSPY

SEQ ID NO: 2922997 - protein, 4 aa, Entamoeba invadens
YGKR

SEQ ID NO: 2922998 - protein, 8 aa, Entamoeba invadens
YGKRPGSR

SEQ ID NO: 2922999 - protein, 15 aa, Entamoeba invadens
YGKRVDTQYSKFEEG

SEQ ID NO: 2923000 - protein, 5 aa, Entamoeba invadens
YGKVS

SEQ ID NO: 2923001 - protein, 10 aa, Entamoeba invadens
YGLEGKREKY

SEQ ID NO: 2923002 - protein, 11 aa, Entamoeba invadens
YGLEGKRENYK

SEQ ID NO: 2923003 - protein, 10 aa, Entamoeba invadens
YGLGDEETRF

SEQ ID NO: 2923004 - protein, 9 aa, Entamoeba invadens
YGLGSKEFT

SEQ ID NO: 2923005 - protein, 10 aa, Entamoeba invadens
YGLGSKEFTP

SEQ ID NO: 2923006 - protein, 15 aa, Entamoeba invadens
YGLNKNDKSVSLETT

SEQ ID NO: 2923007 - protein, 11 aa, Entamoeba invadens
YGLNPRELSPL

SEQ ID NO: 2923008 - protein, 4 aa, Entamoeba invadens
YGLP

SEQ ID NO: 2923009 - protein, 8 aa, Entamoeba invadens
YGLQSPSL

SEQ ID NO: 2923010 - protein, 6 aa, Entamoeba invadens
YGLSED

SEQ ID NO: 2923011 - protein, 6 aa, Entamoeba invadens
YGLSSK

SEQ ID NO: 2923012 - protein, 4 aa, Entamoeba invadens
YGMT

SEQ ID NO: 2923013 - protein, 8 aa, Entamoeba invadens
YGNAESDD

SEQ ID NO: 2923014 - protein, 5 aa, Entamoeba invadens
YGNAT

SEQ ID NO: 2923015 - protein, 16 aa, Entamoeba invadens
YGNEYSEEYEEDEEDD

SEQ ID NO: 2923016 - protein, 11 aa, Entamoeba invadens
YGNGKSSKINA

SEQ ID NO: 2923017 - protein, 7 aa, Entamoeba invadens
YGNNREV

SEQ ID NO: 2923018 - protein, 7 aa, Entamoeba invadens
YGNSALK

SEQ ID NO: 2923019 - protein, 18 aa, Entamoeba invadens
YGPAEVSDQPPKTLLLEQ

SEQ ID NO: 2923020 - protein, 31 aa, Entamoeba invadens
YGPAPVEDTAEKDARFPKLGEKTKRSERPKI

SEQ ID NO: 2923021 - protein, 5 aa, Entamoeba invadens
YGPFK

SEQ ID NO: 2923022 - protein, 9 aa, Entamoeba invadens
YGPGVDGKI

SEQ ID NO: 2923023 - protein, 6 aa, Entamoeba invadens
YGPNKG

SEQ ID NO: 2923024 - protein, 4 aa, Entamoeba invadens
YGPP

SEQ ID NO: 2923025 - protein, 11 aa, Entamoeba invadens
YGPPGSGKTSI

SEQ ID NO: 2923026 - protein, 8 aa, Entamoeba invadens
YGPTKPAF

SEQ ID NO: 2923027 - protein, 4 aa, Entamoeba invadens
YGQE

SEQ ID NO: 2923028 - protein, 15 aa, Entamoeba invadens
YGQEDDEVADNTKSL

SEQ ID NO: 2923029 - protein, 11 aa, Entamoeba invadens
YGQESAKADSI

SEQ ID NO: 2923030 - protein, 7 aa, Entamoeba invadens
YGQPPSR

SEQ ID NO: 2923031 - protein, 5 aa, Entamoeba invadens
YGQQD

SEQ ID NO: 2923032 - protein, 15 aa, Entamoeba invadens
YGQQQYAQQQYTQQS

SEQ ID NO: 2923033 - protein, 13 aa, Entamoeba invadens
YGQSRSDVMTDNT

SEQ ID NO: 2923034 - protein, 11 aa, Entamoeba invadens
YGRAYEDASES

SEQ ID NO: 2923035 - protein, 6 aa, Entamoeba invadens
YGRNQP

SEQ ID NO: 2923036 - protein, 10 aa, Entamoeba invadens
YGRNVSKGSY

SEQ ID NO: 2923037 - protein, 5 aa, Entamoeba invadens
YGRTE

SEQ ID NO: 2923038 - protein, 8 aa, Entamoeba invadens
YGRTKVGG

SEQ ID NO: 2923039 - protein, 9 aa, Entamoeba invadens
YGRTPNAVK

SEQ ID NO: 2923040 - protein, 6 aa, Entamoeba invadens
YGSDGA

SEQ ID NO: 2923041 - protein, 11 aa, Entamoeba invadens
YGSDIPKYTKT

SEQ ID NO: 2923042 - protein, 16 aa, Entamoeba invadens
YGSEAGEITEYCDKLL

SEQ ID NO: 2923043 - protein, 5 aa, Entamoeba invadens
YGSEE

SEQ ID NO: 2923044 - protein, 5 aa, Entamoeba invadens
YGSKI

SEQ ID NO: 2923045 - protein, 4 aa, Entamoeba invadens
YGSN

SEQ ID NO: 2923046 - protein, 10 aa, Entamoeba invadens
YGSNGSIRSA

SEQ ID NO: 2923047 - protein, 4 aa, Entamoeba invadens
YGSP

SEQ ID NO: 2923048 - protein, 13 aa, Entamoeba invadens
YGSQEVFLGSTLH

SEQ ID NO: 2923049 - protein, 10 aa, Entamoeba invadens
YGSQTNSNVS

SEQ ID NO: 2923050 - protein, 4 aa, Entamoeba invadens
YGST

SEQ ID NO: 2923051 - protein, 10 aa, Entamoeba invadens
YGSTGFNSGG

SEQ ID NO: 2923052 - protein, 9 aa, Entamoeba invadens
YGSTHCGHS

SEQ ID NO: 2923053 - protein, 13 aa, Entamoeba invadens
YGSVSGLSSTPPL

SEQ ID NO: 2923054 - protein, 5 aa, Entamoeba invadens
YGTDN

SEQ ID NO: 2923055 - protein, 5 aa, Entamoeba invadens
YGTGG

SEQ ID NO: 2923056 - protein, 5 aa, Entamoeba invadens
YGTGK

SEQ ID NO: 2923057 - protein, 6 aa, Entamoeba invadens
YGTGKT

SEQ ID NO: 2923058 - protein, 6 aa, Entamoeba invadens
YGTKAD

SEQ ID NO: 2923059 - protein, 13 aa, Entamoeba invadens
YGTKFNKDRNDTG

SEQ ID NO: 2923060 - protein, 5 aa, Entamoeba invadens
YGTNC

SEQ ID NO: 2923061 - protein, 5 aa, Entamoeba invadens
YGTND

SEQ ID NO: 2923062 - protein, 4 aa, Entamoeba invadens
YGTP

SEQ ID NO: 2923063 - protein, 14 aa, Entamoeba invadens
YGTQPLKENPSTSG

SEQ ID NO: 2923064 - protein, 4 aa, Entamoeba invadens
YGTR

SEQ ID NO: 2923065 - protein, 6 aa, Entamoeba invadens
YGTRGS

SEQ ID NO: 2923066 - protein, 7 aa, Entamoeba invadens
YGTRYGA

SEQ ID NO: 2923067 - protein, 4 aa, Entamoeba invadens
YGTS

SEQ ID NO: 2923068 - protein, 9 aa, Entamoeba invadens
YGTSHRPNA

SEQ ID NO: 2923069 - protein, 4 aa, Entamoeba invadens
YGTT

SEQ ID NO: 2923070 - protein, 5 aa, Entamoeba invadens
YGVNK

SEQ ID NO: 2923071 - protein, 10 aa, Entamoeba invadens
YGYDNKQRTL

SEQ ID NO: 2923072 - protein, 13 aa, Entamoeba invadens
YGYPRSAENYTVP

SEQ ID NO: 2923073 - protein, 12 aa, Entamoeba invadens
YGYSQDNSDYWG

SEQ ID NO: 2923074 - protein, 6 aa, Entamoeba invadens
YHAPKG

SEQ ID NO: 2923075 - protein, 24 aa, Entamoeba invadens
YHATGSKTNSPRCVKKTSDNELPP

SEQ ID NO: 2923076 - protein, 7 aa, Entamoeba invadens
YHDTTFK

SEQ ID NO: 2923077 - protein, 4 aa, Entamoeba invadens
YHEN

SEQ ID NO: 2923078 - protein, 5 aa, Entamoeba invadens
YHGED

SEQ ID NO: 2923079 - protein, 4 aa, Entamoeba invadens
YHKD

SEQ ID NO: 2923080 - protein, 10 aa, Entamoeba invadens
YHKDETIDSQ

SEQ ID NO: 2923081 - protein, 8 aa, Entamoeba invadens
YHKDPNLN

SEQ ID NO: 2923082 - protein, 62 aa, Entamoeba invadens
YHKSKTHSANLSHNSPNDSSGPSSPYSSNHSSPRPSRERELSPKRYKASKSEEYIPRPRKPF

SEQ ID NO: 2923083 - protein, 11 aa, Entamoeba invadens
YHPDRNPEGRD

SEQ ID NO: 2923084 - protein, 11 aa, Entamoeba invadens
YHPDRNPEGRE

SEQ ID NO: 2923085 - protein, 5 aa, Entamoeba invadens
YHPGV

SEQ ID NO: 2923086 - protein, 4 aa, Entamoeba invadens
YHQG

SEQ ID NO: 2923087 - protein, 4 aa, Entamoeba invadens
YHRK

SEQ ID NO: 2923088 - protein, 32 aa, Entamoeba invadens
YHSDDETIYNNGDLDGYDSKIRSGKKTGETDV

SEQ ID NO: 2923089 - protein, 7 aa, Entamoeba invadens
YHSPTTA

SEQ ID NO: 2923090 - protein, 9 aa, Entamoeba invadens
YHSSETKGK

SEQ ID NO: 2923091 - protein, 9 aa, Entamoeba invadens
YHSSETLRN

SEQ ID NO: 2923092 - protein, 8 aa, Entamoeba invadens
YHSTAQSD

SEQ ID NO: 2923093 - protein, 8 aa, Entamoeba invadens
YHSTNDYP

SEQ ID NO: 2923094 - protein, 14 aa, Entamoeba invadens
YHSTPKKSHDRPHR

SEQ ID NO: 2923095 - protein, 7 aa, Entamoeba invadens
YHTSSNT

SEQ ID NO: 2923096 - protein, 12 aa, Entamoeba invadens
YHTTNNNTVEQC

SEQ ID NO: 2923097 - protein, 15 aa, Entamoeba invadens
YHTTPSYPSPTQNPF

SEQ ID NO: 2923098 - protein, 4 aa, Entamoeba invadens
YHVP

SEQ ID NO: 2923099 - protein, 27 aa, Entamoeba invadens
YIAPTKKGEEEAPKGEKPTEKKAEVKV

SEQ ID NO: 2923100 - protein, 10 aa, Entamoeba invadens
YIATASDDKT

SEQ ID NO: 2923101 - protein, 27 aa, Entamoeba invadens
YIDDGESKHVRKKETKSHLKSRKVPPK

SEQ ID NO: 2923102 - protein, 6 aa, Entamoeba invadens
YIDDPP

SEQ ID NO: 2923103 - protein, 14 aa, Entamoeba invadens
YIDGDDAKSIAANE

SEQ ID NO: 2923104 - protein, 18 aa, Entamoeba invadens
YIEGRDPKQEQINDPSNP

SEQ ID NO: 2923105 - protein, 7 aa, Entamoeba invadens
YIEPENA

SEQ ID NO: 2923106 - protein, 4 aa, Entamoeba invadens
YIGK

SEQ ID NO: 2923107 - protein, 10 aa, Entamoeba invadens
YIGNPTKAKR

SEQ ID NO: 2923108 - protein, 5 aa, Entamoeba invadens
YINGH

SEQ ID NO: 2923109 - protein, 10 aa, Entamoeba invadens
YINPGSKIGV

SEQ ID NO: 2923110 - protein, 4 aa, Entamoeba invadens
YIPK

SEQ ID NO: 2923111 - protein, 21 aa, Entamoeba invadens
YIPPKPKEEIKKSKKKALRKE

SEQ ID NO: 2923112 - protein, 8 aa, Entamoeba invadens
YIPPKTST

SEQ ID NO: 2923113 - protein, 17 aa, Entamoeba invadens
YIPRRKDALQQRSYRSQ

SEQ ID NO: 2923114 - protein, 12 aa, Entamoeba invadens
YIPTDDESVNTT

SEQ ID NO: 2923115 - protein, 43 aa, Entamoeba invadens
YIPTGTPKVVRESPINKSKDKPNPEPVKKASVQNVNNTREKQN

SEQ ID NO: 2923116 - protein, 17 aa, Entamoeba invadens
YIQGGEPEKKPFEVPKE

SEQ ID NO: 2923117 - protein, 6 aa, Entamoeba invadens
YIRGGD

SEQ ID NO: 2923118 - protein, 10 aa, Entamoeba invadens
YISEPPTLTG

SEQ ID NO: 2923119 - protein, 9 aa, Entamoeba invadens
YISKQDDFD

SEQ ID NO: 2923120 - protein, 8 aa, Entamoeba invadens
YISRDGKG

SEQ ID NO: 2923121 - protein, 12 aa, Entamoeba invadens
YISRDGSTHEGV

SEQ ID NO: 2923122 - protein, 4 aa, Entamoeba invadens
YITN

SEQ ID NO: 2923123 - protein, 24 aa, Entamoeba invadens
YITPEGEHIPYNENRSLTGTARYA

SEQ ID NO: 2923124 - protein, 11 aa, Entamoeba invadens
YKADAESGRDA

SEQ ID NO: 2923125 - protein, 7 aa, Entamoeba invadens
YKAEPNK

SEQ ID NO: 2923126 - protein, 23 aa, Entamoeba invadens
YKAKQAKTNPISKNEEFDDISTS

SEQ ID NO: 2923127 - protein, 10 aa, Entamoeba invadens
YKALSDENEN

SEQ ID NO: 2923128 - protein, 22 aa, Entamoeba invadens
YKAQKKREEDARLEAEASKAEA

SEQ ID NO: 2923129 - protein, 27 aa, Entamoeba invadens
YKAQRQERKERREKKHEKYGRTKRNSL

SEQ ID NO: 2923130 - protein, 6 aa, Entamoeba invadens
YKASDE

SEQ ID NO: 2923131 - protein, 18 aa, Entamoeba invadens
YKASLEKRQTMPDPLKNE

SEQ ID NO: 2923132 - protein, 4 aa, Entamoeba invadens
YKAT

SEQ ID NO: 2923133 - protein, 9 aa, Entamoeba invadens
YKATNDKSV

SEQ ID NO: 2923134 - protein, 4 aa, Entamoeba invadens
YKCS

SEQ ID NO: 2923135 - protein, 40 aa, Entamoeba invadens
YKDARAHAEERLKERVEETKRQMMGTTKKEEKKDEEDLDE

SEQ ID NO: 2923136 - protein, 4 aa, Entamoeba invadens
YKDE

SEQ ID NO: 2923137 - protein, 8 aa, Entamoeba invadens
YKDGLAKE

SEQ ID NO: 2923138 - protein, 11 aa, Entamoeba invadens
YKDGNDEAAGR

SEQ ID NO: 2923139 - protein, 5 aa, Entamoeba invadens
YKDGY

SEQ ID NO: 2923140 - protein, 4 aa, Entamoeba invadens
YKDK

SEQ ID NO: 2923141 - protein, 8 aa, Entamoeba invadens
YKDKMSKG

SEQ ID NO: 2923142 - protein, 6 aa, Entamoeba invadens
YKDPQF

SEQ ID NO: 2923143 - protein, 7 aa, Entamoeba invadens
YKDRKTT

SEQ ID NO: 2923144 - protein, 7 aa, Entamoeba invadens
YKDSSYV

SEQ ID NO: 2923145 - protein, 8 aa, Entamoeba invadens
YKDTEEYQ

SEQ ID NO: 2923146 - protein, 7 aa, Entamoeba invadens
YKDTGRV

SEQ ID NO: 2923147 - protein, 5 aa, Entamoeba invadens
YKDTL

SEQ ID NO: 2923148 - protein, 14 aa, Entamoeba invadens
YKEDVSKITDENIR

SEQ ID NO: 2923149 - protein, 23 aa, Entamoeba invadens
YKEGREFGRGKDGEQKQSQRRFE

SEQ ID NO: 2923150 - protein, 13 aa, Entamoeba invadens
YKEKETKEKYPQV

SEQ ID NO: 2923151 - protein, 21 aa, Entamoeba invadens
YKEKSANESRKGNTEKKKQRL

SEQ ID NO: 2923152 - protein, 14 aa, Entamoeba invadens
YKEKTQEKMNENRE

SEQ ID NO: 2923153 - protein, 23 aa, Entamoeba invadens
YKENEKAKAAEYVKKSKEEFGEG

SEQ ID NO: 2923154 - protein, 5 aa, Entamoeba invadens
YKENG

SEQ ID NO: 2923155 - protein, 9 aa, Entamoeba invadens
YKENKDNQM

SEQ ID NO: 2923156 - protein, 10 aa, Entamoeba invadens
YKENKTNTNG

SEQ ID NO: 2923157 - protein, 6 aa, Entamoeba invadens
YKENSA

SEQ ID NO: 2923158 - protein, 10 aa, Entamoeba invadens
YKENSTNTNG

SEQ ID NO: 2923159 - protein, 7 aa, Entamoeba invadens
YKENTGE

SEQ ID NO: 2923160 - protein, 8 aa, Entamoeba invadens
YKEPQGHD

SEQ ID NO: 2923161 - protein, 11 aa, Entamoeba invadens
YKEQSGQGPSW

SEQ ID NO: 2923162 - protein, 12 aa, Entamoeba invadens
YKERKSKESIET

SEQ ID NO: 2923163 - protein, 18 aa, Entamoeba invadens
YKERNLDSIAKTASRALA

SEQ ID NO: 2923164 - protein, 11 aa, Entamoeba invadens
YKESEKVNTES

SEQ ID NO: 2923165 - protein, 4 aa, Entamoeba invadens
YKFN

SEQ ID NO: 2923166 - protein, 7 aa, Entamoeba invadens
YKFNGNE

SEQ ID NO: 2923167 - protein, 9 aa, Entamoeba invadens
YKGARKSGV

SEQ ID NO: 2923168 - protein, 6 aa, Entamoeba invadens
YKGATV

SEQ ID NO: 2923169 - protein, 6 aa, Entamoeba invadens
YKGCQK

SEQ ID NO: 2923170 - protein, 5 aa, Entamoeba invadens
YKGDF

SEQ ID NO: 2923171 - protein, 8 aa, Entamoeba invadens
YKGETKKF

SEQ ID NO: 2923172 - protein, 12 aa, Entamoeba invadens
YKGETKKFTQEE

SEQ ID NO: 2923173 - protein, 15 aa, Entamoeba invadens
YKGGSKDNICVVVIE

SEQ ID NO: 2923174 - protein, 12 aa, Entamoeba invadens
YKGQDENCTGTH

SEQ ID NO: 2923175 - protein, 5 aa, Entamoeba invadens
YKGQS

SEQ ID NO: 2923176 - protein, 12 aa, Entamoeba invadens
YKGSKAEESKFM

SEQ ID NO: 2923177 - protein, 8 aa, Entamoeba invadens
YKGSVPSY

SEQ ID NO: 2923178 - protein, 4 aa, Entamoeba invadens
YKGT

SEQ ID NO: 2923179 - protein, 8 aa, Entamoeba invadens
YKGTPPSN

SEQ ID NO: 2923180 - protein, 8 aa, Entamoeba invadens
YKGTTEQV

SEQ ID NO: 2923181 - protein, 4 aa, Entamoeba invadens
YKHQ

SEQ ID NO: 2923182 - protein, 15 aa, Entamoeba invadens
YKHRDDLKKTQHDAG

SEQ ID NO: 2923183 - protein, 13 aa, Entamoeba invadens
YKHTTKTDKMTEK

SEQ ID NO: 2923184 - protein, 4 aa, Entamoeba invadens
YKIE

SEQ ID NO: 2923185 - protein, 6 aa, Entamoeba invadens
YKIKGD

SEQ ID NO: 2923186 - protein, 30 aa, Entamoeba invadens
YKIKTTSNNPFFESSAKPNAQLKHLFVLQW

SEQ ID NO: 2923187 - protein, 5 aa, Entamoeba invadens
YKIPP

SEQ ID NO: 2923188 - protein, 7 aa, Entamoeba invadens
YKKANEA

SEQ ID NO: 2923189 - protein, 13 aa, Entamoeba invadens
YKKDGKAKVNTEE

SEQ ID NO: 2923190 - protein, 9 aa, Entamoeba invadens
YKKDGKPRV

SEQ ID NO: 2923191 - protein, 11 aa, Entamoeba invadens
YKKDGKSYTEE

SEQ ID NO: 2923192 - protein, 11 aa, Entamoeba invadens
YKKDISGNARA

SEQ ID NO: 2923193 - protein, 9 aa, Entamoeba invadens
YKKDPQGLD

SEQ ID NO: 2923194 - protein, 11 aa, Entamoeba invadens
YKKDSDVQEVS

SEQ ID NO: 2923195 - protein, 8 aa, Entamoeba invadens
YKKDYDSA

SEQ ID NO: 2923196 - protein, 9 aa, Entamoeba invadens
YKKEGIEAK

SEQ ID NO: 2923197 - protein, 11 aa, Entamoeba invadens
YKKEKDVLRSD

SEQ ID NO: 2923198 - protein, 8 aa, Entamoeba invadens
YKKEQTEI

SEQ ID NO: 2923199 - protein, 20 aa, Entamoeba invadens
YKKFAEKKKEEGEEKTFPST

SEQ ID NO: 2923200 - protein, 10 aa, Entamoeba invadens
YKKGCTKDVY

SEQ ID NO: 2923201 - protein, 7 aa, Entamoeba invadens
YKKGEET

SEQ ID NO: 2923202 - protein, 8 aa, Entamoeba invadens
YKKGKTTA

SEQ ID NO: 2923203 - protein, 16 aa, Entamoeba invadens
YKKGRDEIKEQDQKIK

SEQ ID NO: 2923204 - protein, 7 aa, Entamoeba invadens
YKKGRDY

SEQ ID NO: 2923205 - protein, 8 aa, Entamoeba invadens
YKKGRTTH

SEQ ID NO: 2923206 - protein, 5 aa, Entamoeba invadens
YKKIE

SEQ ID NO: 2923207 - protein, 7 aa, Entamoeba invadens
YKKITKE

SEQ ID NO: 2923208 - protein, 9 aa, Entamoeba invadens
YKKKEEDTT

SEQ ID NO: 2923209 - protein, 83 aa, Entamoeba invadens
YKKKGDADKQTQPNMEPLKNKGNVPSPVQTPFQKSLEGSSLQERINTRKNNSCSTHTTPSFTRTSSCGNGPNVVPKKSTTLPN

SEQ ID NO: 2923210 - protein, 7 aa, Entamoeba invadens
YKKPADV

SEQ ID NO: 2923211 - protein, 10 aa, Entamoeba invadens
YKKPGEATLE

SEQ ID NO: 2923212 - protein, 12 aa, Entamoeba invadens
YKKQAKSGTEEF

SEQ ID NO: 2923213 - protein, 27 aa, Entamoeba invadens
YKKQEEAKQAAKAAQQSGETAPQGRTL

SEQ ID NO: 2923214 - protein, 8 aa, Entamoeba invadens
YKKRSAPT

SEQ ID NO: 2923215 - protein, 46 aa, Entamoeba invadens
YKKRTIKRKTLKATNTEDDEMKKLEEEERKLNEQMAREEAESNAEM

SEQ ID NO: 2923216 - protein, 4 aa, Entamoeba invadens
YKKS

SEQ ID NO: 2923217 - protein, 5 aa, Entamoeba invadens
YKKSG

SEQ ID NO: 2923218 - protein, 7 aa, Entamoeba invadens
YKKTSGM

SEQ ID NO: 2923219 - protein, 29 aa, Entamoeba invadens
YKKYETDHRLNTNEKFKQKEFHLDYPLAW

SEQ ID NO: 2923220 - protein, 9 aa, Entamoeba invadens
YKKYSSEFK

SEQ ID NO: 2923221 - protein, 7 aa, Entamoeba invadens
YKLDGDN

SEQ ID NO: 2923222 - protein, 10 aa, Entamoeba invadens
YKLNTTTNKC

SEQ ID NO: 2923223 - protein, 7 aa, Entamoeba invadens
YKLPDGK

SEQ ID NO: 2923224 - protein, 10 aa, Entamoeba invadens
YKLPGDPIEE

SEQ ID NO: 2923225 - protein, 6 aa, Entamoeba invadens
YKLSDD

SEQ ID NO: 2923226 - protein, 12 aa, Entamoeba invadens
YKLSENKKTCYA

SEQ ID NO: 2923227 - protein, 22 aa, Entamoeba invadens
YKLSENKTKCYSTCPNGTYVSG

SEQ ID NO: 2923228 - protein, 17 aa, Entamoeba invadens
YKMKNELPDIDKDEKKR

SEQ ID NO: 2923229 - protein, 6 aa, Entamoeba invadens
YKMPRP

SEQ ID NO: 2923230 - protein, 11 aa, Entamoeba invadens
YKNAEPRKQHT

SEQ ID NO: 2923231 - protein, 12 aa, Entamoeba invadens
YKNDNETKHDHL

SEQ ID NO: 2923232 - protein, 4 aa, Entamoeba invadens
YKNF

SEQ ID NO: 2923233 - protein, 12 aa, Entamoeba invadens
YKNGKKLHEKAK

SEQ ID NO: 2923234 - protein, 12 aa, Entamoeba invadens
YKNGKLSPPQPM

SEQ ID NO: 2923235 - protein, 8 aa, Entamoeba invadens
YKNGTKNI

SEQ ID NO: 2923236 - protein, 11 aa, Entamoeba invadens
YKNKGNTINPN

SEQ ID NO: 2923237 - protein, 7 aa, Entamoeba invadens
YKNKSNC

SEQ ID NO: 2923238 - protein, 11 aa, Entamoeba invadens
YKNNRSEYERR

SEQ ID NO: 2923239 - protein, 5 aa, Entamoeba invadens
YKNNT

SEQ ID NO: 2923240 - protein, 16 aa, Entamoeba invadens
YKNPDEVDVMFESRVN

SEQ ID NO: 2923241 - protein, 11 aa, Entamoeba invadens
YKNPECDNSNS

SEQ ID NO: 2923242 - protein, 9 aa, Entamoeba invadens
YKNPQTKVQ

SEQ ID NO: 2923243 - protein, 4 aa, Entamoeba invadens
YKNT

SEQ ID NO: 2923244 - protein, 12 aa, Entamoeba invadens
YKNTKEDYKNND

SEQ ID NO: 2923245 - protein, 7 aa, Entamoeba invadens
YKNTSKC

SEQ ID NO: 2923246 - protein, 8 aa, Entamoeba invadens
YKNVDNDS

SEQ ID NO: 2923247 - protein, 7 aa, Entamoeba invadens
YKNYRTT

SEQ ID NO: 2923248 - protein, 13 aa, Entamoeba invadens
YKPDRKEFSNGGS

SEQ ID NO: 2923249 - protein, 9 aa, Entamoeba invadens
YKPDTTGVI

SEQ ID NO: 2923250 - protein, 11 aa, Entamoeba invadens
YKPEELQGKKA

SEQ ID NO: 2923251 - protein, 24 aa, Entamoeba invadens
YKPETVVPSNSNENFYNLGAVGLF

SEQ ID NO: 2923252 - protein, 7 aa, Entamoeba invadens
YKPGKTT

SEQ ID NO: 2923253 - protein, 9 aa, Entamoeba invadens
YKPHSKREA

SEQ ID NO: 2923254 - protein, 11 aa, Entamoeba invadens
YKPKSNEKTFD

SEQ ID NO: 2923255 - protein, 6 aa, Entamoeba invadens
YKPLKQ

SEQ ID NO: 2923256 - protein, 7 aa, Entamoeba invadens
YKPNNKR

SEQ ID NO: 2923257 - protein, 6 aa, Entamoeba invadens
YKPQRR

SEQ ID NO: 2923258 - protein, 13 aa, Entamoeba invadens
YKPQTIQPKFEGT

SEQ ID NO: 2923259 - protein, 8 aa, Entamoeba invadens
YKPRENGV

SEQ ID NO: 2923260 - protein, 18 aa, Entamoeba invadens
YKPRESDNYDDSRFRNYT

SEQ ID NO: 2923261 - protein, 11 aa, Entamoeba invadens
YKPRHKKTTKF

SEQ ID NO: 2923262 - protein, 12 aa, Entamoeba invadens
YKPSEAGDHDQA

SEQ ID NO: 2923263 - protein, 8 aa, Entamoeba invadens
YKPSHKEN

SEQ ID NO: 2923264 - protein, 7 aa, Entamoeba invadens
YKPSIGF

SEQ ID NO: 2923265 - protein, 12 aa, Entamoeba invadens
YKPSKKDSDIKR

SEQ ID NO: 2923266 - protein, 16 aa, Entamoeba invadens
YKPSQSKLHTSTSNNM

SEQ ID NO: 2923267 - protein, 8 aa, Entamoeba invadens
YKPTTNTA

SEQ ID NO: 2923268 - protein, 7 aa, Entamoeba invadens
YKQEGKR

SEQ ID NO: 2923269 - protein, 4 aa, Entamoeba invadens
YKQK

SEQ ID NO: 2923270 - protein, 13 aa, Entamoeba invadens
YKQNAVKSGTSDY

SEQ ID NO: 2923271 - protein, 11 aa, Entamoeba invadens
YKQNIKTKDGY

SEQ ID NO: 2923272 - protein, 6 aa, Entamoeba invadens
YKQNPF

SEQ ID NO: 2923273 - protein, 9 aa, Entamoeba invadens
YKQNPNDGN

SEQ ID NO: 2923274 - protein, 9 aa, Entamoeba invadens
YKQRRSKED

SEQ ID NO: 2923275 - protein, 7 aa, Entamoeba invadens
YKQSHPT

SEQ ID NO: 2923276 - protein, 10 aa, Entamoeba invadens
YKQSNTLNSN

SEQ ID NO: 2923277 - protein, 11 aa, Entamoeba invadens
YKQSRGDRGNM

SEQ ID NO: 2923278 - protein, 12 aa, Entamoeba invadens
YKRAANGTANAA

SEQ ID NO: 2923279 - protein, 5 aa, Entamoeba invadens
YKRDD

SEQ ID NO: 2923280 - protein, 11 aa, Entamoeba invadens
YKREEETTPTK

SEQ ID NO: 2923281 - protein, 9 aa, Entamoeba invadens
YKREGGGEK

SEQ ID NO: 2923282 - protein, 8 aa, Entamoeba invadens
YKRERDNL

SEQ ID NO: 2923283 - protein, 14 aa, Entamoeba invadens
YKRETYQINDNDYT

SEQ ID NO: 2923284 - protein, 10 aa, Entamoeba invadens
YKREVHRKTS

SEQ ID NO: 2923285 - protein, 9 aa, Entamoeba invadens
YKRGNAQNV

SEQ ID NO: 2923286 - protein, 9 aa, Entamoeba invadens
YKRKSDNPL

SEQ ID NO: 2923287 - protein, 11 aa, Entamoeba invadens
YKRPTINNNET

SEQ ID NO: 2923288 - protein, 5 aa, Entamoeba invadens
YKRVQ

SEQ ID NO: 2923289 - protein, 7 aa, Entamoeba invadens
YKSAPTD

SEQ ID NO: 2923290 - protein, 7 aa, Entamoeba invadens
YKSATTP

SEQ ID NO: 2923291 - protein, 5 aa, Entamoeba invadens
YKSDP

SEQ ID NO: 2923292 - protein, 9 aa, Entamoeba invadens
YKSDRDADY

SEQ ID NO: 2923293 - protein, 8 aa, Entamoeba invadens
YKSDRKQI

SEQ ID NO: 2923294 - protein, 9 aa, Entamoeba invadens
YKSEEQRES

SEQ ID NO: 2923295 - protein, 22 aa, Entamoeba invadens
YKSEIEAEKRRAEAEAARAKEP

SEQ ID NO: 2923296 - protein, 8 aa, Entamoeba invadens
YKSESDAL

SEQ ID NO: 2923297 - protein, 9 aa, Entamoeba invadens
YKSESLRNS

SEQ ID NO: 2923298 - protein, 18 aa, Entamoeba invadens
YKSETTTIGGKNGNARTE

SEQ ID NO: 2923299 - protein, 12 aa, Entamoeba invadens
YKSFSSNTVVHR

SEQ ID NO: 2923300 - protein, 4 aa, Entamoeba invadens
YKSG

SEQ ID NO: 2923301 - protein, 5 aa, Entamoeba invadens
YKSGY

SEQ ID NO: 2923302 - protein, 4 aa, Entamoeba invadens
YKSI

SEQ ID NO: 2923303 - protein, 11 aa, Entamoeba invadens
YKSKDKEVDKK

SEQ ID NO: 2923304 - protein, 9 aa, Entamoeba invadens
YKSKDSLNN

SEQ ID NO: 2923305 - protein, 10 aa, Entamoeba invadens
YKSKEREADK

SEQ ID NO: 2923306 - protein, 10 aa, Entamoeba invadens
YKSNEKFTDA

SEQ ID NO: 2923307 - protein, 39 aa, Entamoeba invadens
YKSPENTQKQIDEHKEDIEKVKTKQLELTDNERCTSKGT

SEQ ID NO: 2923308 - protein, 10 aa, Entamoeba invadens
YKSPKSEKMT

SEQ ID NO: 2923309 - protein, 9 aa, Entamoeba invadens
YKSPYSIDT

SEQ ID NO: 2923310 - protein, 15 aa, Entamoeba invadens
YKSSEVCENGRPTKC

SEQ ID NO: 2923311 - protein, 10 aa, Entamoeba invadens
YKSSKIDPTA

SEQ ID NO: 2923312 - protein, 8 aa, Entamoeba invadens
YKSSQDQC

SEQ ID NO: 2923313 - protein, 9 aa, Entamoeba invadens
YKSSTHPLP

SEQ ID NO: 2923314 - protein, 22 aa, Entamoeba invadens
YKSTGVSKSTHGNVVWYDMILR

SEQ ID NO: 2923315 - protein, 6 aa, Entamoeba invadens
YKSTMG

SEQ ID NO: 2923316 - protein, 8 aa, Entamoeba invadens
YKSTSNTK

SEQ ID NO: 2923317 - protein, 9 aa, Entamoeba invadens
YKTCPNPNG

SEQ ID NO: 2923318 - protein, 7 aa, Entamoeba invadens
YKTDSNT

SEQ ID NO: 2923319 - protein, 11 aa, Entamoeba invadens
YKTEEYSKEAE

SEQ ID NO: 2923320 - protein, 9 aa, Entamoeba invadens
YKTGETGDY

SEQ ID NO: 2923321 - protein, 4 aa, Entamoeba invadens
YKTI

SEQ ID NO: 2923322 - protein, 7 aa, Entamoeba invadens
YKTKEEK

SEQ ID NO: 2923323 - protein, 5 aa, Entamoeba invadens
YKTKN

SEQ ID NO: 2923324 - protein, 8 aa, Entamoeba invadens
YKTKSGDF

SEQ ID NO: 2923325 - protein, 13 aa, Entamoeba invadens
YKTLNKSTIQQKE

SEQ ID NO: 2923326 - protein, 16 aa, Entamoeba invadens
YKTNDQSNKQQVTCSL

SEQ ID NO: 2923327 - protein, 7 aa, Entamoeba invadens
YKTNEKV

SEQ ID NO: 2923328 - protein, 7 aa, Entamoeba invadens
YKTQEGV

SEQ ID NO: 2923329 - protein, 16 aa, Entamoeba invadens
YKTRNAQGINLNGDSM

SEQ ID NO: 2923330 - protein, 23 aa, Entamoeba invadens
YKTRVSNRNSKPYKPQAHTPPVK

SEQ ID NO: 2923331 - protein, 4 aa, Entamoeba invadens
YKTS

SEQ ID NO: 2923332 - protein, 9 aa, Entamoeba invadens
YKTSENDKV

SEQ ID NO: 2923333 - protein, 10 aa, Entamoeba invadens
YKTSTDASIA

SEQ ID NO: 2923334 - protein, 11 aa, Entamoeba invadens
YKTSVTTGQGI

SEQ ID NO: 2923335 - protein, 6 aa, Entamoeba invadens
YKTTIG

SEQ ID NO: 2923336 - protein, 8 aa, Entamoeba invadens
YKTTNEKY

SEQ ID NO: 2923337 - protein, 4 aa, Entamoeba invadens
YKTV

SEQ ID NO: 2923338 - protein, 4 aa, Entamoeba invadens
YKTY

SEQ ID NO: 2923339 - protein, 11 aa, Entamoeba invadens
YKVGKQNQYNF

SEQ ID NO: 2923340 - protein, 4 aa, Entamoeba invadens
YKYD

SEQ ID NO: 2923341 - protein, 6 aa, Entamoeba invadens
YKYDAE

SEQ ID NO: 2923342 - protein, 5 aa, Entamoeba invadens
YKYIE

SEQ ID NO: 2923343 - protein, 7 aa, Entamoeba invadens
YKYQGEE

SEQ ID NO: 2923344 - protein, 6 aa, Entamoeba invadens
YKYRSE

SEQ ID NO: 2923345 - protein, 9 aa, Entamoeba invadens
YKYSEYDGN

SEQ ID NO: 2923346 - protein, 21 aa, Entamoeba invadens
YLAASEKALRDRLDKTKDVSN

SEQ ID NO: 2923347 - protein, 4 aa, Entamoeba invadens
YLAS

SEQ ID NO: 2923348 - protein, 18 aa, Entamoeba invadens
YLDENDGVLSAKSQQPSL

SEQ ID NO: 2923349 - protein, 4 aa, Entamoeba invadens
YLDG

SEQ ID NO: 2923350 - protein, 13 aa, Entamoeba invadens
YLDPEKQKKFTGI

SEQ ID NO: 2923351 - protein, 4 aa, Entamoeba invadens
YLDQ

SEQ ID NO: 2923352 - protein, 4 aa, Entamoeba invadens
YLED

SEQ ID NO: 2923353 - protein, 15 aa, Entamoeba invadens
YLEEQKKKAEGSGQG

SEQ ID NO: 2923354 - protein, 14 aa, Entamoeba invadens
YLGDSRGPRRYHTT

SEQ ID NO: 2923355 - protein, 6 aa, Entamoeba invadens
YLGGDK

SEQ ID NO: 2923356 - protein, 7 aa, Entamoeba invadens
YLGPARE

SEQ ID NO: 2923357 - protein, 6 aa, Entamoeba invadens
YLGQPN

SEQ ID NO: 2923358 - protein, 6 aa, Entamoeba invadens
YLKNPR

SEQ ID NO: 2923359 - protein, 11 aa, Entamoeba invadens
YLKSTDSALSK

SEQ ID NO: 2923360 - protein, 8 aa, Entamoeba invadens
YLKTEKRL

SEQ ID NO: 2923361 - protein, 12 aa, Entamoeba invadens
YLKTKKDNQDFE

SEQ ID NO: 2923362 - protein, 11 aa, Entamoeba invadens
YLKTKKENQNF

SEQ ID NO: 2923363 - protein, 6 aa, Entamoeba invadens
YLNEGS

SEQ ID NO: 2923364 - protein, 5 aa, Entamoeba invadens
YLPQS

SEQ ID NO: 2923365 - protein, 19 aa, Entamoeba invadens
YLPTSTELSLGSNSTTFQY

SEQ ID NO: 2923366 - protein, 11 aa, Entamoeba invadens
YLQKTNGNVKD

SEQ ID NO: 2923367 - protein, 5 aa, Entamoeba invadens
YLQPN

SEQ ID NO: 2923368 - protein, 8 aa, Entamoeba invadens
YLQTSDEN

SEQ ID NO: 2923369 - protein, 8 aa, Entamoeba invadens
YLSGNEEG

SEQ ID NO: 2923370 - protein, 6 aa, Entamoeba invadens
YLSPSE

SEQ ID NO: 2923371 - protein, 5 aa, Entamoeba invadens
YLSPT

SEQ ID NO: 2923372 - protein, 20 aa, Entamoeba invadens
YLSQTGTTTQNGNKSNAPLL

SEQ ID NO: 2923373 - protein, 18 aa, Entamoeba invadens
YLSSEDKKQLQTWSGQNV

SEQ ID NO: 2923374 - protein, 14 aa, Entamoeba invadens
YLSSRSTAGIDGTV

SEQ ID NO: 2923375 - protein, 9 aa, Entamoeba invadens
YLTDESQIE

SEQ ID NO: 2923376 - protein, 12 aa, Entamoeba invadens
YLTKPGAKSTIK

SEQ ID NO: 2923377 - protein, 5 aa, Entamoeba invadens
YLVDT

SEQ ID NO: 2923378 - protein, 7 aa, Entamoeba invadens
YMNENGQ

SEQ ID NO: 2923379 - protein, 10 aa, Entamoeba invadens
YMPTKPGKYN

SEQ ID NO: 2923380 - protein, 10 aa, Entamoeba invadens
YMRSSDGKQC

SEQ ID NO: 2923381 - protein, 7 aa, Entamoeba invadens
YMSGNSY

SEQ ID NO: 2923382 - protein, 7 aa, Entamoeba invadens
YMSNSSY

SEQ ID NO: 2923383 - protein, 13 aa, Entamoeba invadens
YMSQTDKGIAGNY

SEQ ID NO: 2923384 - protein, 11 aa, Entamoeba invadens
YMSTSDDTELE

SEQ ID NO: 2923385 - protein, 4 aa, Entamoeba invadens
YNAK

SEQ ID NO: 2923386 - protein, 27 aa, Entamoeba invadens
YNAKSEKELSSLPNVNSLTDASNEKYA

SEQ ID NO: 2923387 - protein, 5 aa, Entamoeba invadens
YNAKT

SEQ ID NO: 2923388 - protein, 10 aa, Entamoeba invadens
YNANDNPHIK

SEQ ID NO: 2923389 - protein, 9 aa, Entamoeba invadens
YNANKGLRG

SEQ ID NO: 2923390 - protein, 10 aa, Entamoeba invadens
YNANKGLRSR

SEQ ID NO: 2923391 - protein, 14 aa, Entamoeba invadens
YNANSGKLENVEKN

SEQ ID NO: 2923392 - protein, 12 aa, Entamoeba invadens
YNATDHKKFGSK

SEQ ID NO: 2923393 - protein, 26 aa, Entamoeba invadens
YNATEGRVEYRNSNNEVRYTPPKKNK

SEQ ID NO: 2923394 - protein, 6 aa, Entamoeba invadens
YNATRQ

SEQ ID NO: 2923395 - protein, 12 aa, Entamoeba invadens
YNATSSPSCDFS

SEQ ID NO: 2923396 - protein, 5 aa, Entamoeba invadens
YNCNQ

SEQ ID NO: 2923397 - protein, 22 aa, Entamoeba invadens
YNDAKESAKASNTLKTQLEEQD

SEQ ID NO: 2923398 - protein, 5 aa, Entamoeba invadens
YNDDT

SEQ ID NO: 2923399 - protein, 10 aa, Entamoeba invadens
YNDDYNNTKE

SEQ ID NO: 2923400 - protein, 5 aa, Entamoeba invadens
YNDER

SEQ ID NO: 2923401 - protein, 18 aa, Entamoeba invadens
YNDGKQEIQPGSTPEQTL

SEQ ID NO: 2923402 - protein, 4 aa, Entamoeba invadens
YNDI

SEQ ID NO: 2923403 - protein, 12 aa, Entamoeba invadens
YNDMRESNYIGT

SEQ ID NO: 2923404 - protein, 5 aa, Entamoeba invadens
YNDNT

SEQ ID NO: 2923405 - protein, 5 aa, Entamoeba invadens
YNDPE

SEQ ID NO: 2923406 - protein, 5 aa, Entamoeba invadens
YNDRA

SEQ ID NO: 2923407 - protein, 25 aa, Entamoeba invadens
YNDSDDEDNKEKQQEENKEEPTTPK

SEQ ID NO: 2923408 - protein, 5 aa, Entamoeba invadens
YNEAK

SEQ ID NO: 2923409 - protein, 22 aa, Entamoeba invadens
YNEATWENTEEITENDGSKIEE

SEQ ID NO: 2923410 - protein, 4 aa, Entamoeba invadens
YNED

SEQ ID NO: 2923411 - protein, 8 aa, Entamoeba invadens
YNEDGSAK

SEQ ID NO: 2923412 - protein, 18 aa, Entamoeba invadens
YNEDKNITIKNTPNTKNY

SEQ ID NO: 2923413 - protein, 7 aa, Entamoeba invadens
YNEDTKS

SEQ ID NO: 2923414 - protein, 6 aa, Entamoeba invadens
YNEEDL

SEQ ID NO: 2923415 - protein, 6 aa, Entamoeba invadens
YNEEET

SEQ ID NO: 2923416 - protein, 7 aa, Entamoeba invadens
YNEEGEI

SEQ ID NO: 2923417 - protein, 8 aa, Entamoeba invadens
YNEESTNC

SEQ ID NO: 2923418 - protein, 7 aa, Entamoeba invadens
YNEGNAK

SEQ ID NO: 2923419 - protein, 8 aa, Entamoeba invadens
YNEGQQVD

SEQ ID NO: 2923420 - protein, 4 aa, Entamoeba invadens
YNEI

SEQ ID NO: 2923421 - protein, 4 aa, Entamoeba invadens
YNEK

SEQ ID NO: 2923422 - protein, 12 aa, Entamoeba invadens
YNEKKTPIHQDA

SEQ ID NO: 2923423 - protein, 7 aa, Entamoeba invadens
YNEKTQK

SEQ ID NO: 2923424 - protein, 9 aa, Entamoeba invadens
YNEKTQKPL

SEQ ID NO: 2923425 - protein, 6 aa, Entamoeba invadens
YNEKYT

SEQ ID NO: 2923426 - protein, 14 aa, Entamoeba invadens
YNENENQHIGETKD

SEQ ID NO: 2923427 - protein, 10 aa, Entamoeba invadens
YNENPNKPKL

SEQ ID NO: 2923428 - protein, 18 aa, Entamoeba invadens
YNENQKKKLTLNHNSSTG

SEQ ID NO: 2923429 - protein, 6 aa, Entamoeba invadens
YNERNE

SEQ ID NO: 2923430 - protein, 9 aa, Entamoeba invadens
YNERTTPAT

SEQ ID NO: 2923431 - protein, 18 aa, Entamoeba invadens
YNETKETFKYKPKCNARN

SEQ ID NO: 2923432 - protein, 5 aa, Entamoeba invadens
YNETS

SEQ ID NO: 2923433 - protein, 14 aa, Entamoeba invadens
YNETTNLGSKRNPI

SEQ ID NO: 2923434 - protein, 5 aa, Entamoeba invadens
YNFDP

SEQ ID NO: 2923435 - protein, 6 aa, Entamoeba invadens
YNFEGK

SEQ ID NO: 2923436 - protein, 6 aa, Entamoeba invadens
YNGCNE

SEQ ID NO: 2923437 - protein, 9 aa, Entamoeba invadens
YNGCNKKTG

SEQ ID NO: 2923438 - protein, 7 aa, Entamoeba invadens
YNGDNKR

SEQ ID NO: 2923439 - protein, 6 aa, Entamoeba invadens
YNGEEC

SEQ ID NO: 2923440 - protein, 8 aa, Entamoeba invadens
YNGEPSDQ

SEQ ID NO: 2923441 - protein, 21 aa, Entamoeba invadens
YNGEYTGADAIKEPKETITRD

SEQ ID NO: 2923442 - protein, 5 aa, Entamoeba invadens
YNGFT

SEQ ID NO: 2923443 - protein, 5 aa, Entamoeba invadens
YNGGD

SEQ ID NO: 2923444 - protein, 5 aa, Entamoeba invadens
YNGGP

SEQ ID NO: 2923445 - protein, 9 aa, Entamoeba invadens
YNGGQDAEV

SEQ ID NO: 2923446 - protein, 7 aa, Entamoeba invadens
YNGGSDF

SEQ ID NO: 2923447 - protein, 4 aa, Entamoeba invadens
YNGK

SEQ ID NO: 2923448 - protein, 11 aa, Entamoeba invadens
YNGKAPTDEEV

SEQ ID NO: 2923449 - protein, 8 aa, Entamoeba invadens
YNGKEDDV

SEQ ID NO: 2923450 - protein, 8 aa, Entamoeba invadens
YNGPNGYL

SEQ ID NO: 2923451 - protein, 7 aa, Entamoeba invadens
YNGQTDY

SEQ ID NO: 2923452 - protein, 5 aa, Entamoeba invadens
YNGRD

SEQ ID NO: 2923453 - protein, 10 aa, Entamoeba invadens
YNGTPEYTAP

SEQ ID NO: 2923454 - protein, 8 aa, Entamoeba invadens
YNIDSESL

SEQ ID NO: 2923455 - protein, 10 aa, Entamoeba invadens
YNIPDNKIPA

SEQ ID NO: 2923456 - protein, 5 aa, Entamoeba invadens
YNIPP

SEQ ID NO: 2923457 - protein, 6 aa, Entamoeba invadens
YNITSD

SEQ ID NO: 2923458 - protein, 6 aa, Entamoeba invadens
YNKAND

SEQ ID NO: 2923459 - protein, 7 aa, Entamoeba invadens
YNKEAEL

SEQ ID NO: 2923460 - protein, 9 aa, Entamoeba invadens
YNKEREEDM

SEQ ID NO: 2923461 - protein, 22 aa, Entamoeba invadens
YNKKGVANTFNTTSEITTTQNS

SEQ ID NO: 2923462 - protein, 11 aa, Entamoeba invadens
YNKKSEPQNTI

SEQ ID NO: 2923463 - protein, 6 aa, Entamoeba invadens
YNKNDI

SEQ ID NO: 2923464 - protein, 6 aa, Entamoeba invadens
YNKPAD

SEQ ID NO: 2923465 - protein, 12 aa, Entamoeba invadens
YNKQAKSGTEEF

SEQ ID NO: 2923466 - protein, 15 aa, Entamoeba invadens
YNKRPGNSTTITYPT

SEQ ID NO: 2923467 - protein, 4 aa, Entamoeba invadens
YNKT

SEQ ID NO: 2923468 - protein, 7 aa, Entamoeba invadens
YNKTKAW

SEQ ID NO: 2923469 - protein, 12 aa, Entamoeba invadens
YNKTRDIGKDTP

SEQ ID NO: 2923470 - protein, 5 aa, Entamoeba invadens
YNLND

SEQ ID NO: 2923471 - protein, 7 aa, Entamoeba invadens
YNLNSND

SEQ ID NO: 2923472 - protein, 7 aa, Entamoeba invadens
YNLPQEG

SEQ ID NO: 2923473 - protein, 23 aa, Entamoeba invadens
YNLPQEQHPQQPQQQQIKTERTV

SEQ ID NO: 2923474 - protein, 6 aa, Entamoeba invadens
YNMGKE

SEQ ID NO: 2923475 - protein, 12 aa, Entamoeba invadens
YNNDDIQTTQRG

SEQ ID NO: 2923476 - protein, 5 aa, Entamoeba invadens
YNNDN

SEQ ID NO: 2923477 - protein, 7 aa, Entamoeba invadens
YNNEDGK

SEQ ID NO: 2923478 - protein, 14 aa, Entamoeba invadens
YNNEEGVAGYDPVN

SEQ ID NO: 2923479 - protein, 6 aa, Entamoeba invadens
YNNEEN

SEQ ID NO: 2923480 - protein, 10 aa, Entamoeba invadens
YNNEFRKKSL

SEQ ID NO: 2923481 - protein, 5 aa, Entamoeba invadens
YNNGE

SEQ ID NO: 2923482 - protein, 14 aa, Entamoeba invadens
YNNGKSEVLKTKNE

SEQ ID NO: 2923483 - protein, 4 aa, Entamoeba invadens
YNNK

SEQ ID NO: 2923484 - protein, 7 aa, Entamoeba invadens
YNNKESV

SEQ ID NO: 2923485 - protein, 10 aa, Entamoeba invadens
YNNKKDAQNK

SEQ ID NO: 2923486 - protein, 7 aa, Entamoeba invadens
YNNNERN

SEQ ID NO: 2923487 - protein, 8 aa, Entamoeba invadens
YNNNPGIN

SEQ ID NO: 2923488 - protein, 5 aa, Entamoeba invadens
YNNPD

SEQ ID NO: 2923489 - protein, 6 aa, Entamoeba invadens
YNNPEI

SEQ ID NO: 2923490 - protein, 6 aa, Entamoeba invadens
YNNSQE

SEQ ID NO: 2923491 - protein, 6 aa, Entamoeba invadens
YNNSTQ

SEQ ID NO: 2923492 - protein, 4 aa, Entamoeba invadens
YNNT

SEQ ID NO: 2923493 - protein, 8 aa, Entamoeba invadens
YNNTEGSP

SEQ ID NO: 2923494 - protein, 5 aa, Entamoeba invadens
YNNTR

SEQ ID NO: 2923495 - protein, 27 aa, Entamoeba invadens
YNNYTNSTIQCGQSNLTPITTSDYNVQ

SEQ ID NO: 2923496 - protein, 11 aa, Entamoeba invadens
YNPDPSGKPIY

SEQ ID NO: 2923497 - protein, 10 aa, Entamoeba invadens
YNPEKSKEEL

SEQ ID NO: 2923498 - protein, 9 aa, Entamoeba invadens
YNPKAKTVS

SEQ ID NO: 2923499 - protein, 5 aa, Entamoeba invadens
YNPKL

SEQ ID NO: 2923500 - protein, 15 aa, Entamoeba invadens
YNPKPLTQTETEKER

SEQ ID NO: 2923501 - protein, 13 aa, Entamoeba invadens
YNPLGQNPTGANA

SEQ ID NO: 2923502 - protein, 6 aa, Entamoeba invadens
YNPNGR

SEQ ID NO: 2923503 - protein, 9 aa, Entamoeba invadens
YNPNYDKSP

SEQ ID NO: 2923504 - protein, 10 aa, Entamoeba invadens
YNPPKKQFAN

SEQ ID NO: 2923505 - protein, 9 aa, Entamoeba invadens
YNPQPNTYH

SEQ ID NO: 2923506 - protein, 14 aa, Entamoeba invadens
YNPQTQKEEVKETA

SEQ ID NO: 2923507 - protein, 10 aa, Entamoeba invadens
YNPSDEKFKD

SEQ ID NO: 2923508 - protein, 7 aa, Entamoeba invadens
YNPSDVP

SEQ ID NO: 2923509 - protein, 12 aa, Entamoeba invadens
YNPSERLTPDQA

SEQ ID NO: 2923510 - protein, 7 aa, Entamoeba invadens
YNPSIED

SEQ ID NO: 2923511 - protein, 4 aa, Entamoeba invadens
YNPT

SEQ ID NO: 2923512 - protein, 6 aa, Entamoeba invadens
YNPTDV

SEQ ID NO: 2923513 - protein, 6 aa, Entamoeba invadens
YNQKQS

SEQ ID NO: 2923514 - protein, 20 aa, Entamoeba invadens
YNQKSESDSARNFAEQKNMK

SEQ ID NO: 2923515 - protein, 4 aa, Entamoeba invadens
YNQP

SEQ ID NO: 2923516 - protein, 6 aa, Entamoeba invadens
YNQPIN

SEQ ID NO: 2923517 - protein, 8 aa, Entamoeba invadens
YNQSAKER

SEQ ID NO: 2923518 - protein, 13 aa, Entamoeba invadens
YNRDKSDTPNNFT

SEQ ID NO: 2923519 - protein, 20 aa, Entamoeba invadens
YNRDSGYSGDSRGPRRYHTT

SEQ ID NO: 2923520 - protein, 9 aa, Entamoeba invadens
YNRPVNTDS

SEQ ID NO: 2923521 - protein, 10 aa, Entamoeba invadens
YNRSDNTCTI

SEQ ID NO: 2923522 - protein, 45 aa, Entamoeba invadens
YNRTETNEKKEEKKDEKKGDTTPPTGTKNTETISNAKTENNETKE

SEQ ID NO: 2923523 - protein, 8 aa, Entamoeba invadens
YNRYPKNT

SEQ ID NO: 2923524 - protein, 9 aa, Entamoeba invadens
YNSEQEKEI

SEQ ID NO: 2923525 - protein, 10 aa, Entamoeba invadens
YNSEQEKKVK

SEQ ID NO: 2923526 - protein, 17 aa, Entamoeba invadens
YNSESIPEALKDEEEYF

SEQ ID NO: 2923527 - protein, 5 aa, Entamoeba invadens
YNSGD

SEQ ID NO: 2923528 - protein, 17 aa, Entamoeba invadens
YNSGPSGYCGDEDNGQM

SEQ ID NO: 2923529 - protein, 5 aa, Entamoeba invadens
YNSGY

SEQ ID NO: 2923530 - protein, 5 aa, Entamoeba invadens
YNSIT

SEQ ID NO: 2923531 - protein, 7 aa, Entamoeba invadens
YNSKDDE

SEQ ID NO: 2923532 - protein, 6 aa, Entamoeba invadens
YNSKKD

SEQ ID NO: 2923533 - protein, 7 aa, Entamoeba invadens
YNSNDNI

SEQ ID NO: 2923534 - protein, 6 aa, Entamoeba invadens
YNSNPT

SEQ ID NO: 2923535 - protein, 20 aa, Entamoeba invadens
YNSNQGDAPSFGGAPVPEKW

SEQ ID NO: 2923536 - protein, 9 aa, Entamoeba invadens
YNSNSKSNY

SEQ ID NO: 2923537 - protein, 4 aa, Entamoeba invadens
YNSP

SEQ ID NO: 2923538 - protein, 13 aa, Entamoeba invadens
YNSPIASTPQQLQ

SEQ ID NO: 2923539 - protein, 6 aa, Entamoeba invadens
YNSPLQ

SEQ ID NO: 2923540 - protein, 5 aa, Entamoeba invadens
YNSPT

SEQ ID NO: 2923541 - protein, 7 aa, Entamoeba invadens
YNSPTEM

SEQ ID NO: 2923542 - protein, 7 aa, Entamoeba invadens
YNSSQNV

SEQ ID NO: 2923543 - protein, 5 aa, Entamoeba invadens
YNSTE

SEQ ID NO: 2923544 - protein, 5 aa, Entamoeba invadens
YNSTL

SEQ ID NO: 2923545 - protein, 5 aa, Entamoeba invadens
YNSVT

SEQ ID NO: 2923546 - protein, 8 aa, Entamoeba invadens
YNTFDGEK

SEQ ID NO: 2923547 - protein, 8 aa, Entamoeba invadens
YNTKDTPV

SEQ ID NO: 2923548 - protein, 10 aa, Entamoeba invadens
YNTKEEKDER

SEQ ID NO: 2923549 - protein, 11 aa, Entamoeba invadens
YNTKYGKKSEI

SEQ ID NO: 2923550 - protein, 10 aa, Entamoeba invadens
YNTNESNLTI

SEQ ID NO: 2923551 - protein, 23 aa, Entamoeba invadens
YNTNKKGQTGYLKNEGVKQTGTV

SEQ ID NO: 2923552 - protein, 20 aa, Entamoeba invadens
YNTPVQTSPLRTKSATKTVT

SEQ ID NO: 2923553 - protein, 7 aa, Entamoeba invadens
YNTQPVQ

SEQ ID NO: 2923554 - protein, 7 aa, Entamoeba invadens
YNTSTKE

SEQ ID NO: 2923555 - protein, 4 aa, Entamoeba invadens
YNTT

SEQ ID NO: 2923556 - protein, 5 aa, Entamoeba invadens
YNTTH

SEQ ID NO: 2923557 - protein, 10 aa, Entamoeba invadens
YNTTKSPKGV

SEQ ID NO: 2923558 - protein, 5 aa, Entamoeba invadens
YNTTN

SEQ ID NO: 2923559 - protein, 5 aa, Entamoeba invadens
YNTVK

SEQ ID NO: 2923560 - protein, 4 aa, Entamoeba invadens
YNVE

SEQ ID NO: 2923561 - protein, 5 aa, Entamoeba invadens
YNVET

SEQ ID NO: 2923562 - protein, 11 aa, Entamoeba invadens
YNVKKRTESTL

SEQ ID NO: 2923563 - protein, 12 aa, Entamoeba invadens
YNVRDAKNHQTC

SEQ ID NO: 2923564 - protein, 8 aa, Entamoeba invadens
YNVSPECR

SEQ ID NO: 2923565 - protein, 6 aa, Entamoeba invadens
YNYNNS

SEQ ID NO: 2923566 - protein, 6 aa, Entamoeba invadens
YNYPDN

SEQ ID NO: 2923567 - protein, 5 aa, Entamoeba invadens
YNYQQ

SEQ ID NO: 2923568 - protein, 10 aa, Entamoeba invadens
YPAESMNRDG

SEQ ID NO: 2923569 - protein, 8 aa, Entamoeba invadens
YPDALRPS

SEQ ID NO: 2923570 - protein, 15 aa, Entamoeba invadens
YPDDGKCTKQRASKI

SEQ ID NO: 2923571 - protein, 9 aa, Entamoeba invadens
YPDETTCTG

SEQ ID NO: 2923572 - protein, 8 aa, Entamoeba invadens
YPDKSDNT

SEQ ID NO: 2923573 - protein, 15 aa, Entamoeba invadens
YPDLIPKTSTARSPI

SEQ ID NO: 2923574 - protein, 5 aa, Entamoeba invadens
YPDNF

SEQ ID NO: 2923575 - protein, 15 aa, Entamoeba invadens
YPDPNKLTSGGRQKI

SEQ ID NO: 2923576 - protein, 12 aa, Entamoeba invadens
YPDQYKTLAPSK

SEQ ID NO: 2923577 - protein, 6 aa, Entamoeba invadens
YPDRDE

SEQ ID NO: 2923578 - protein, 5 aa, Entamoeba invadens
YPDTE

SEQ ID NO: 2923579 - protein, 4 aa, Entamoeba invadens
YPDV

SEQ ID NO: 2923580 - protein, 4 aa, Entamoeba invadens
YPDY

SEQ ID NO: 2923581 - protein, 4 aa, Entamoeba invadens
YPED

SEQ ID NO: 2923582 - protein, 13 aa, Entamoeba invadens
YPEDTSSETTNIQ

SEQ ID NO: 2923583 - protein, 5 aa, Entamoeba invadens
YPEEC

SEQ ID NO: 2923584 - protein, 5 aa, Entamoeba invadens
YPEEE

SEQ ID NO: 2923585 - protein, 6 aa, Entamoeba invadens
YPEGKM

SEQ ID NO: 2923586 - protein, 8 aa, Entamoeba invadens
YPEGTKIK

SEQ ID NO: 2923587 - protein, 4 aa, Entamoeba invadens
YPEN

SEQ ID NO: 2923588 - protein, 7 aa, Entamoeba invadens
YPETEKS

SEQ ID NO: 2923589 - protein, 12 aa, Entamoeba invadens
YPFGDDTLNDLP

SEQ ID NO: 2923590 - protein, 8 aa, Entamoeba invadens
YPFNPNNV

SEQ ID NO: 2923591 - protein, 14 aa, Entamoeba invadens
YPFRNGKKIGNPIC

SEQ ID NO: 2923592 - protein, 4 aa, Entamoeba invadens
YPGA

SEQ ID NO: 2923593 - protein, 5 aa, Entamoeba invadens
YPGAS

SEQ ID NO: 2923594 - protein, 7 aa, Entamoeba invadens
YPGKCDH

SEQ ID NO: 2923595 - protein, 7 aa, Entamoeba invadens
YPGKYGN

SEQ ID NO: 2923596 - protein, 5 aa, Entamoeba invadens
YPGLG

SEQ ID NO: 2923597 - protein, 5 aa, Entamoeba invadens
YPGNN

SEQ ID NO: 2923598 - protein, 77 aa, Entamoeba invadens
YPGQQMSPAMTGEYKKDKDHKKDKDHKDKDKKDKKDKKDKKDKEHKDKDHKDKDKKYQQMPPMQGQTYQQAQQIPQN

SEQ ID NO: 2923599 - protein, 8 aa, Entamoeba invadens
YPGSPNDL

SEQ ID NO: 2923600 - protein, 7 aa, Entamoeba invadens
YPGTSGQ

SEQ ID NO: 2923601 - protein, 6 aa, Entamoeba invadens
YPGTTA

SEQ ID NO: 2923602 - protein, 6 aa, Entamoeba invadens
YPHPIK

SEQ ID NO: 2923603 - protein, 9 aa, Entamoeba invadens
YPHTSTPKI

SEQ ID NO: 2923604 - protein, 6 aa, Entamoeba invadens
YPIKPP

SEQ ID NO: 2923605 - protein, 12 aa, Entamoeba invadens
YPIKTTATKRKE

SEQ ID NO: 2923606 - protein, 5 aa, Entamoeba invadens
YPKAD

SEQ ID NO: 2923607 - protein, 5 aa, Entamoeba invadens
YPKAK

SEQ ID NO: 2923608 - protein, 6 aa, Entamoeba invadens
YPKCTT

SEQ ID NO: 2923609 - protein, 8 aa, Entamoeba invadens
YPKEDGEL

SEQ ID NO: 2923610 - protein, 8 aa, Entamoeba invadens
YPKEGKVD

SEQ ID NO: 2923611 - protein, 5 aa, Entamoeba invadens
YPKEK

SEQ ID NO: 2923612 - protein, 12 aa, Entamoeba invadens
YPKELDKSRLED

SEQ ID NO: 2923613 - protein, 7 aa, Entamoeba invadens
YPKESET

SEQ ID NO: 2923614 - protein, 8 aa, Entamoeba invadens
YPKETRNK

SEQ ID NO: 2923615 - protein, 29 aa, Entamoeba invadens
YPKKETAETSPKNPQKRKNPNTGDYDRSK

SEQ ID NO: 2923616 - protein, 8 aa, Entamoeba invadens
YPKLSENY

SEQ ID NO: 2923617 - protein, 4 aa, Entamoeba invadens
YPKS

SEQ ID NO: 2923618 - protein, 5 aa, Entamoeba invadens
YPKSA

SEQ ID NO: 2923619 - protein, 4 aa, Entamoeba invadens
YPKT

SEQ ID NO: 2923620 - protein, 5 aa, Entamoeba invadens
YPKTA

SEQ ID NO: 2923621 - protein, 9 aa, Entamoeba invadens
YPKTRKNEQ

SEQ ID NO: 2923622 - protein, 11 aa, Entamoeba invadens
YPLEKDIQKNN

SEQ ID NO: 2923623 - protein, 6 aa, Entamoeba invadens
YPLNPP

SEQ ID NO: 2923624 - protein, 4 aa, Entamoeba invadens
YPLP

SEQ ID NO: 2923625 - protein, 11 aa, Entamoeba invadens
YPLQKSTTKPK

SEQ ID NO: 2923626 - protein, 4 aa, Entamoeba invadens
YPLT

SEQ ID NO: 2923627 - protein, 6 aa, Entamoeba invadens
YPLTSS

SEQ ID NO: 2923628 - protein, 8 aa, Entamoeba invadens
YPLTTKER

SEQ ID NO: 2923629 - protein, 20 aa, Entamoeba invadens
YPNAKAKETGKIGGDDNEFS

SEQ ID NO: 2923630 - protein, 15 aa, Entamoeba invadens
YPNFAQDDPRSDETY

SEQ ID NO: 2923631 - protein, 10 aa, Entamoeba invadens
YPNGQDAGEV

SEQ ID NO: 2923632 - protein, 10 aa, Entamoeba invadens
YPNGTPSQYD

SEQ ID NO: 2923633 - protein, 11 aa, Entamoeba invadens
YPNKKSFKSLS

SEQ ID NO: 2923634 - protein, 13 aa, Entamoeba invadens
YPNMDDENIPEEA

SEQ ID NO: 2923635 - protein, 4 aa, Entamoeba invadens
YPNN

SEQ ID NO: 2923636 - protein, 15 aa, Entamoeba invadens
YPNNISKRTASDGIN

SEQ ID NO: 2923637 - protein, 5 aa, Entamoeba invadens
YPNNS

SEQ ID NO: 2923638 - protein, 6 aa, Entamoeba invadens
YPNPLP

SEQ ID NO: 2923639 - protein, 8 aa, Entamoeba invadens
YPNPLPKE

SEQ ID NO: 2923640 - protein, 7 aa, Entamoeba invadens
YPNRQEQ

SEQ ID NO: 2923641 - protein, 11 aa, Entamoeba invadens
YPNSEGECNKC

SEQ ID NO: 2923642 - protein, 14 aa, Entamoeba invadens
YPNSEYTDKTHSTD

SEQ ID NO: 2923643 - protein, 14 aa, Entamoeba invadens
YPNSEYTDNTHSTD

SEQ ID NO: 2923644 - protein, 10 aa, Entamoeba invadens
YPNSGKSSVI

SEQ ID NO: 2923645 - protein, 9 aa, Entamoeba invadens
YPNTSPRNI

SEQ ID NO: 2923646 - protein, 4 aa, Entamoeba invadens
YPNV

SEQ ID NO: 2923647 - protein, 13 aa, Entamoeba invadens
YPPDTIDEPTRSS

SEQ ID NO: 2923648 - protein, 5 aa, Entamoeba invadens
YPPEF

SEQ ID NO: 2923649 - protein, 13 aa, Entamoeba invadens
YPPKPPTIPPKPL

SEQ ID NO: 2923650 - protein, 5 aa, Entamoeba invadens
YPPLA

SEQ ID NO: 2923651 - protein, 9 aa, Entamoeba invadens
YPPNNGGKV

SEQ ID NO: 2923652 - protein, 8 aa, Entamoeba invadens
YPPNSQTG

SEQ ID NO: 2923653 - protein, 4 aa, Entamoeba invadens
YPPQ

SEQ ID NO: 2923654 - protein, 16 aa, Entamoeba invadens
YPPSPDITKKVETKED

SEQ ID NO: 2923655 - protein, 20 aa, Entamoeba invadens
YPPTEDMKKQVTTQNQYRSK

SEQ ID NO: 2923656 - protein, 5 aa, Entamoeba invadens
YPPTK

SEQ ID NO: 2923657 - protein, 5 aa, Entamoeba invadens
YPQDN

SEQ ID NO: 2923658 - protein, 7 aa, Entamoeba invadens
YPQDNNI

SEQ ID NO: 2923659 - protein, 4 aa, Entamoeba invadens
YPQP

SEQ ID NO: 2923660 - protein, 31 aa, Entamoeba invadens
YPQPDTNPQSSNQQSEPLAYPQQTTQHIQTP

SEQ ID NO: 2923661 - protein, 5 aa, Entamoeba invadens
YPQPI

SEQ ID NO: 2923662 - protein, 10 aa, Entamoeba invadens
YPQPKKATMT

SEQ ID NO: 2923663 - protein, 7 aa, Entamoeba invadens
YPQPSDT

SEQ ID NO: 2923664 - protein, 91 aa, Entamoeba invadens
YPQQPPMGQYPPMGYPPQQQFPQQPMGQYPPMGYPQQQPPMGQYPPQGYPPQQYPPQQPMGQYPPQGYPMQQPPMGQYPPQGYPPQQFPPQ

SEQ ID NO: 2923665 - protein, 5 aa, Entamoeba invadens
YPQSQ

SEQ ID NO: 2923666 - protein, 15 aa, Entamoeba invadens
YPQSTSCSNPNRALP

SEQ ID NO: 2923667 - protein, 6 aa, Entamoeba invadens
YPQYTK

SEQ ID NO: 2923668 - protein, 4 aa, Entamoeba invadens
YPRQ

SEQ ID NO: 2923669 - protein, 11 aa, Entamoeba invadens
YPRQQEENYVN

SEQ ID NO: 2923670 - protein, 8 aa, Entamoeba invadens
YPRSDGRV

SEQ ID NO: 2923671 - protein, 9 aa, Entamoeba invadens
YPRSEENVN

SEQ ID NO: 2923672 - protein, 9 aa, Entamoeba invadens
YPRTESTKF

SEQ ID NO: 2923673 - protein, 8 aa, Entamoeba invadens
YPRTETNI

SEQ ID NO: 2923674 - protein, 10 aa, Entamoeba invadens
YPRYSQRESF

SEQ ID NO: 2923675 - protein, 6 aa, Entamoeba invadens
YPSATQ

SEQ ID NO: 2923676 - protein, 5 aa, Entamoeba invadens
YPSDF

SEQ ID NO: 2923677 - protein, 6 aa, Entamoeba invadens
YPSDKF

SEQ ID NO: 2923678 - protein, 14 aa, Entamoeba invadens
YPSESNSKNIECST

SEQ ID NO: 2923679 - protein, 15 aa, Entamoeba invadens
YPSFAQTDPRKDDTY

SEQ ID NO: 2923680 - protein, 21 aa, Entamoeba invadens
YPSKDPNFITPTNPPKSQKSQ

SEQ ID NO: 2923681 - protein, 7 aa, Entamoeba invadens
YPSKNQN

SEQ ID NO: 2923682 - protein, 5 aa, Entamoeba invadens
YPSKR

SEQ ID NO: 2923683 - protein, 4 aa, Entamoeba invadens
YPSN

SEQ ID NO: 2923684 - protein, 5 aa, Entamoeba invadens
YPSNA

SEQ ID NO: 2923685 - protein, 5 aa, Entamoeba invadens
YPSPQ

SEQ ID NO: 2923686 - protein, 44 aa, Entamoeba invadens
YPSPTLNSNTIEIEEKNTKDKNVKEKTQKVKIASPEKEKKSIPL

SEQ ID NO: 2923687 - protein, 16 aa, Entamoeba invadens
YPSQPYQSVYSGSPTM

SEQ ID NO: 2923688 - protein, 14 aa, Entamoeba invadens
YPSQTSSSESEHCD

SEQ ID NO: 2923689 - protein, 5 aa, Entamoeba invadens
YPSRE

SEQ ID NO: 2923690 - protein, 7 aa, Entamoeba invadens
YPSRGKH

SEQ ID NO: 2923691 - protein, 4 aa, Entamoeba invadens
YPSS

SEQ ID NO: 2923692 - protein, 15 aa, Entamoeba invadens
YPSSPYSQQNTSEVN

SEQ ID NO: 2923693 - protein, 8 aa, Entamoeba invadens
YPSSQNND

SEQ ID NO: 2923694 - protein, 4 aa, Entamoeba invadens
YPST

SEQ ID NO: 2923695 - protein, 6 aa, Entamoeba invadens
YPSTPH

SEQ ID NO: 2923696 - protein, 18 aa, Entamoeba invadens
YPSTSDLTDSKQRDDLEK

SEQ ID NO: 2923697 - protein, 8 aa, Entamoeba invadens
YPSTTDSH

SEQ ID NO: 2923698 - protein, 6 aa, Entamoeba invadens
YPTAEA

SEQ ID NO: 2923699 - protein, 10 aa, Entamoeba invadens
YPTDKEKGMR

SEQ ID NO: 2923700 - protein, 8 aa, Entamoeba invadens
YPTDNREI

SEQ ID NO: 2923701 - protein, 10 aa, Entamoeba invadens
YPTDSSQPIQ

SEQ ID NO: 2923702 - protein, 4 aa, Entamoeba invadens
YPTE

SEQ ID NO: 2923703 - protein, 4 aa, Entamoeba invadens
YPTG

SEQ ID NO: 2923704 - protein, 5 aa, Entamoeba invadens
YPTGM

SEQ ID NO: 2923705 - protein, 4 aa, Entamoeba invadens
YPTK

SEQ ID NO: 2923706 - protein, 6 aa, Entamoeba invadens
YPTKAD

SEQ ID NO: 2923707 - protein, 6 aa, Entamoeba invadens
YPTKKE

SEQ ID NO: 2923708 - protein, 8 aa, Entamoeba invadens
YPTNSNKD

SEQ ID NO: 2923709 - protein, 11 aa, Entamoeba invadens
YPTPESKITRT

SEQ ID NO: 2923710 - protein, 4 aa, Entamoeba invadens
YPTQ

SEQ ID NO: 2923711 - protein, 5 aa, Entamoeba invadens
YPTQT

SEQ ID NO: 2923712 - protein, 8 aa, Entamoeba invadens
YPTSKEGV

SEQ ID NO: 2923713 - protein, 5 aa, Entamoeba invadens
YPTSL

SEQ ID NO: 2923714 - protein, 7 aa, Entamoeba invadens
YPTSSET

SEQ ID NO: 2923715 - protein, 7 aa, Entamoeba invadens
YPTTEDF

SEQ ID NO: 2923716 - protein, 9 aa, Entamoeba invadens
YPTTKTSHK

SEQ ID NO: 2923717 - protein, 10 aa, Entamoeba invadens
YPTTSGTCDS

SEQ ID NO: 2923718 - protein, 5 aa, Entamoeba invadens
YPTTV

SEQ ID NO: 2923719 - protein, 5 aa, Entamoeba invadens
YPTVT

SEQ ID NO: 2923720 - protein, 6 aa, Entamoeba invadens
YPVKPP

SEQ ID NO: 2923721 - protein, 9 aa, Entamoeba invadens
YPVSKDAKD

SEQ ID NO: 2923722 - protein, 5 aa, Entamoeba invadens
YPVTM

SEQ ID NO: 2923723 - protein, 7 aa, Entamoeba invadens
YPYHGKT

SEQ ID NO: 2923724 - protein, 4 aa, Entamoeba invadens
YPYS

SEQ ID NO: 2923725 - protein, 5 aa, Entamoeba invadens
YQAEQ

SEQ ID NO: 2923726 - protein, 4 aa, Entamoeba invadens
YQAK

SEQ ID NO: 2923727 - protein, 5 aa, Entamoeba invadens
YQAQQ

SEQ ID NO: 2923728 - protein, 5 aa, Entamoeba invadens
YQASQ

SEQ ID NO: 2923729 - protein, 9 aa, Entamoeba invadens
YQDDEGGSL

SEQ ID NO: 2923730 - protein, 7 aa, Entamoeba invadens
YQDDGDG

SEQ ID NO: 2923731 - protein, 11 aa, Entamoeba invadens
YQDGVSALNSQ

SEQ ID NO: 2923732 - protein, 4 aa, Entamoeba invadens
YQDK

SEQ ID NO: 2923733 - protein, 6 aa, Entamoeba invadens
YQDSPD

SEQ ID NO: 2923734 - protein, 8 aa, Entamoeba invadens
YQDTDSVH

SEQ ID NO: 2923735 - protein, 4 aa, Entamoeba invadens
YQDY

SEQ ID NO: 2923736 - protein, 5 aa, Entamoeba invadens
YQDYS

SEQ ID NO: 2923737 - protein, 4 aa, Entamoeba invadens
YQEA

SEQ ID NO: 2923738 - protein, 5 aa, Entamoeba invadens
YQEDF

SEQ ID NO: 2923739 - protein, 5 aa, Entamoeba invadens
YQEEN

SEQ ID NO: 2923740 - protein, 4 aa, Entamoeba invadens
YQEG

SEQ ID NO: 2923741 - protein, 9 aa, Entamoeba invadens
YQEGVRSTI

SEQ ID NO: 2923742 - protein, 5 aa, Entamoeba invadens
YQELP

SEQ ID NO: 2923743 - protein, 7 aa, Entamoeba invadens
YQENEGL

SEQ ID NO: 2923744 - protein, 9 aa, Entamoeba invadens
YQENKNTFT

SEQ ID NO: 2923745 - protein, 72 aa, Entamoeba invadens
YQFPTQQKNTNRYWQGQAKDTSSQPKQLPQKHSQQRTSDAQSDQKQQRSYKPKQDKRTQYSGGQKGQQNFAL

SEQ ID NO: 2923746 - protein, 4 aa, Entamoeba invadens
YQGK

SEQ ID NO: 2923747 - protein, 8 aa, Entamoeba invadens
YQGKSPKI

SEQ ID NO: 2923748 - protein, 4 aa, Entamoeba invadens
YQGS

SEQ ID NO: 2923749 - protein, 6 aa, Entamoeba invadens
YQGTSF

SEQ ID NO: 2923750 - protein, 4 aa, Entamoeba invadens
YQHG

SEQ ID NO: 2923751 - protein, 6 aa, Entamoeba invadens
YQHSEQ

SEQ ID NO: 2923752 - protein, 4 aa, Entamoeba invadens
YQIE

SEQ ID NO: 2923753 - protein, 11 aa, Entamoeba invadens
YQIKKNEKNLN

SEQ ID NO: 2923754 - protein, 12 aa, Entamoeba invadens
YQITPRDKAIRT

SEQ ID NO: 2923755 - protein, 8 aa, Entamoeba invadens
YQKDEEKV

SEQ ID NO: 2923756 - protein, 4 aa, Entamoeba invadens
YQKG

SEQ ID NO: 2923757 - protein, 9 aa, Entamoeba invadens
YQKGDGNFT

SEQ ID NO: 2923758 - protein, 15 aa, Entamoeba invadens
YQKGDGNFTYHNEES

SEQ ID NO: 2923759 - protein, 5 aa, Entamoeba invadens
YQKGR

SEQ ID NO: 2923760 - protein, 14 aa, Entamoeba invadens
YQKGVGNIREQSNN

SEQ ID NO: 2923761 - protein, 4 aa, Entamoeba invadens
YQKK

SEQ ID NO: 2923762 - protein, 13 aa, Entamoeba invadens
YQKKKTSKQECIV

SEQ ID NO: 2923763 - protein, 10 aa, Entamoeba invadens
YQKKKVDKKI

SEQ ID NO: 2923764 - protein, 33 aa, Entamoeba invadens
YQKNTNSDVPIKEKKKKRKERRYISQSEEPETA

SEQ ID NO: 2923765 - protein, 7 aa, Entamoeba invadens
YQKPTNV

SEQ ID NO: 2923766 - protein, 9 aa, Entamoeba invadens
YQKQLESLR

SEQ ID NO: 2923767 - protein, 9 aa, Entamoeba invadens
YQKSEKGVS

SEQ ID NO: 2923768 - protein, 7 aa, Entamoeba invadens
YQKTAQN

SEQ ID NO: 2923769 - protein, 8 aa, Entamoeba invadens
YQKVSPYT

SEQ ID NO: 2923770 - protein, 8 aa, Entamoeba invadens
YQKYTANS

SEQ ID NO: 2923771 - protein, 7 aa, Entamoeba invadens
YQLDTSN

SEQ ID NO: 2923772 - protein, 9 aa, Entamoeba invadens
YQMKEEPSK

SEQ ID NO: 2923773 - protein, 7 aa, Entamoeba invadens
YQMNGEN

SEQ ID NO: 2923774 - protein, 8 aa, Entamoeba invadens
YQNAAESF

SEQ ID NO: 2923775 - protein, 5 aa, Entamoeba invadens
YQNAQ

SEQ ID NO: 2923776 - protein, 5 aa, Entamoeba invadens
YQNEM

SEQ ID NO: 2923777 - protein, 5 aa, Entamoeba invadens
YQNEQ

SEQ ID NO: 2923778 - protein, 10 aa, Entamoeba invadens
YQNGNNAMEI

SEQ ID NO: 2923779 - protein, 4 aa, Entamoeba invadens
YQNL

SEQ ID NO: 2923780 - protein, 17 aa, Entamoeba invadens
YQNQRRQNDVPDESHHT

SEQ ID NO: 2923781 - protein, 31 aa, Entamoeba invadens
YQNRERDGERFEEKSHGRDSYGKSEKRGDTH

SEQ ID NO: 2923782 - protein, 21 aa, Entamoeba invadens
YQPAPTTNTIATVGGQPIPLQ

SEQ ID NO: 2923783 - protein, 9 aa, Entamoeba invadens
YQPKHPQNV

SEQ ID NO: 2923784 - protein, 7 aa, Entamoeba invadens
YQPPTPK

SEQ ID NO: 2923785 - protein, 15 aa, Entamoeba invadens
YQPPVTPAAAKPSTR

SEQ ID NO: 2923786 - protein, 9 aa, Entamoeba invadens
YQPRTSEPR

SEQ ID NO: 2923787 - protein, 5 aa, Entamoeba invadens
YQPTL

SEQ ID NO: 2923788 - protein, 7 aa, Entamoeba invadens
YQPTPVD

SEQ ID NO: 2923789 - protein, 6 aa, Entamoeba invadens
YQPTSA

SEQ ID NO: 2923790 - protein, 6 aa, Entamoeba invadens
YQPTTH

SEQ ID NO: 2923791 - protein, 11 aa, Entamoeba invadens
YQQANTSYIGG

SEQ ID NO: 2923792 - protein, 4 aa, Entamoeba invadens
YQQL

SEQ ID NO: 2923793 - protein, 19 aa, Entamoeba invadens
YQQNAQPQDLTKDYSACRI

SEQ ID NO: 2923794 - protein, 19 aa, Entamoeba invadens
YQQNAQPRDLTNDYSVCRI

SEQ ID NO: 2923795 - protein, 10 aa, Entamoeba invadens
YQQPPLPPPQ

SEQ ID NO: 2923796 - protein, 29 aa, Entamoeba invadens
YQQPPQQQQQGYYSPFAPGAQQPTVHNPP

SEQ ID NO: 2923797 - protein, 41 aa, Entamoeba invadens
YQQPPQYNSPAMYPPQRGGFPSGGYQQPVQPQQIPPPQQQG

SEQ ID NO: 2923798 - protein, 9 aa, Entamoeba invadens
YQQPQQQID

SEQ ID NO: 2923799 - protein, 21 aa, Entamoeba invadens
YQQQPQQRQQHVQPEPPPKNK

SEQ ID NO: 2923800 - protein, 57 aa, Entamoeba invadens
YQQRPTQYQQPYAQYKQPQQPQQQMQQSYNPYVKSTQQGGSQQYPMSPYGTSQQQQF

SEQ ID NO: 2923801 - protein, 4 aa, Entamoeba invadens
YQQT

SEQ ID NO: 2923802 - protein, 14 aa, Entamoeba invadens
YQQTPHTPEEVEKY

SEQ ID NO: 2923803 - protein, 11 aa, Entamoeba invadens
YQRKSQNSQGE

SEQ ID NO: 2923804 - protein, 18 aa, Entamoeba invadens
YQRNEFKTSNYSQPETKG

SEQ ID NO: 2923805 - protein, 33 aa, Entamoeba invadens
YQRRPYNPNYERRYERRNYDNEYERRPYEGHYQ

SEQ ID NO: 2923806 - protein, 36 aa, Entamoeba invadens
YQRSNMKRTMEENSYSPKRRITSMEREHDKKMEADD

SEQ ID NO: 2923807 - protein, 5 aa, Entamoeba invadens
YQSAA

SEQ ID NO: 2923808 - protein, 6 aa, Entamoeba invadens
YQSDTK

SEQ ID NO: 2923809 - protein, 7 aa, Entamoeba invadens
YQSESEE

SEQ ID NO: 2923810 - protein, 4 aa, Entamoeba invadens
YQSF

SEQ ID NO: 2923811 - protein, 7 aa, Entamoeba invadens
YQSGPAR

SEQ ID NO: 2923812 - protein, 6 aa, Entamoeba invadens
YQSNVQ

SEQ ID NO: 2923813 - protein, 11 aa, Entamoeba invadens
YQSNYSKQNAA

SEQ ID NO: 2923814 - protein, 5 aa, Entamoeba invadens
YQSPT

SEQ ID NO: 2923815 - protein, 7 aa, Entamoeba invadens
YQSQQGL

SEQ ID NO: 2923816 - protein, 26 aa, Entamoeba invadens
YQSRLGTKTIGVNSSENEEEQPKDNG

SEQ ID NO: 2923817 - protein, 6 aa, Entamoeba invadens
YQSSQE

SEQ ID NO: 2923818 - protein, 7 aa, Entamoeba invadens
YQTDAEA

SEQ ID NO: 2923819 - protein, 10 aa, Entamoeba invadens
YQTDRQKRMK

SEQ ID NO: 2923820 - protein, 5 aa, Entamoeba invadens
YQTED

SEQ ID NO: 2923821 - protein, 6 aa, Entamoeba invadens
YQTEEN

SEQ ID NO: 2923822 - protein, 4 aa, Entamoeba invadens
YQTF

SEQ ID NO: 2923823 - protein, 7 aa, Entamoeba invadens
YQTGGQK

SEQ ID NO: 2923824 - protein, 7 aa, Entamoeba invadens
YQTNRIT

SEQ ID NO: 2923825 - protein, 6 aa, Entamoeba invadens
YQTPIT

SEQ ID NO: 2923826 - protein, 9 aa, Entamoeba invadens
YQTRKDKKR

SEQ ID NO: 2923827 - protein, 35 aa, Entamoeba invadens
YQTTPGTQTFTQGQQPQQYQQQIPQQANPQIGQQV

SEQ ID NO: 2923828 - protein, 4 aa, Entamoeba invadens
YQTV

SEQ ID NO: 2923829 - protein, 8 aa, Entamoeba invadens
YQTYETNS

SEQ ID NO: 2923830 - protein, 5 aa, Entamoeba invadens
YQVEG

SEQ ID NO: 2923831 - protein, 26 aa, Entamoeba invadens
YQVRSTGPVNPLTQQPVKGRKRGGGI

SEQ ID NO: 2923832 - protein, 4 aa, Entamoeba invadens
YQVS

SEQ ID NO: 2923833 - protein, 13 aa, Entamoeba invadens
YQVSDKKDFNGQV

SEQ ID NO: 2923834 - protein, 9 aa, Entamoeba invadens
YQVTGDTLS

SEQ ID NO: 2923835 - protein, 6 aa, Entamoeba invadens
YQYNEE

SEQ ID NO: 2923836 - protein, 7 aa, Entamoeba invadens
YRANGIR

SEQ ID NO: 2923837 - protein, 8 aa, Entamoeba invadens
YRAPNEPF

SEQ ID NO: 2923838 - protein, 4 aa, Entamoeba invadens
YRAQ

SEQ ID NO: 2923839 - protein, 7 aa, Entamoeba invadens
YRARQEH

SEQ ID NO: 2923840 - protein, 6 aa, Entamoeba invadens
YRDEHD

SEQ ID NO: 2923841 - protein, 8 aa, Entamoeba invadens
YRDETFDQ

SEQ ID NO: 2923842 - protein, 6 aa, Entamoeba invadens
YRDEYL

SEQ ID NO: 2923843 - protein, 5 aa, Entamoeba invadens
YRDIP

SEQ ID NO: 2923844 - protein, 4 aa, Entamoeba invadens
YRDK

SEQ ID NO: 2923845 - protein, 5 aa, Entamoeba invadens
YREKA

SEQ ID NO: 2923846 - protein, 8 aa, Entamoeba invadens
YRENDTTV

SEQ ID NO: 2923847 - protein, 7 aa, Entamoeba invadens
YREQESS

SEQ ID NO: 2923848 - protein, 5 aa, Entamoeba invadens
YRESN

SEQ ID NO: 2923849 - protein, 6 aa, Entamoeba invadens
YRESSV

SEQ ID NO: 2923850 - protein, 4 aa, Entamoeba invadens
YRGA

SEQ ID NO: 2923851 - protein, 5 aa, Entamoeba invadens
YRGAE

SEQ ID NO: 2923852 - protein, 6 aa, Entamoeba invadens
YRGDVP

SEQ ID NO: 2923853 - protein, 4 aa, Entamoeba invadens
YRGG

SEQ ID NO: 2923854 - protein, 15 aa, Entamoeba invadens
YRGGLDVKSGSTGAY

SEQ ID NO: 2923855 - protein, 5 aa, Entamoeba invadens
YRGGS

SEQ ID NO: 2923856 - protein, 10 aa, Entamoeba invadens
YRGKTESKGF

SEQ ID NO: 2923857 - protein, 5 aa, Entamoeba invadens
YRGNT

SEQ ID NO: 2923858 - protein, 5 aa, Entamoeba invadens
YRGSD

SEQ ID NO: 2923859 - protein, 5 aa, Entamoeba invadens
YRGYD

SEQ ID NO: 2923860 - protein, 13 aa, Entamoeba invadens
YRIPDDQKEASKK

SEQ ID NO: 2923861 - protein, 5 aa, Entamoeba invadens
YRITP

SEQ ID NO: 2923862 - protein, 6 aa, Entamoeba invadens
YRITPS

SEQ ID NO: 2923863 - protein, 10 aa, Entamoeba invadens
YRKAENVSKG

SEQ ID NO: 2923864 - protein, 8 aa, Entamoeba invadens
YRKEYTEG

SEQ ID NO: 2923865 - protein, 7 aa, Entamoeba invadens
YRKNTTL

SEQ ID NO: 2923866 - protein, 9 aa, Entamoeba invadens
YRKPDGSGI

SEQ ID NO: 2923867 - protein, 10 aa, Entamoeba invadens
YRKQGKGQQL

SEQ ID NO: 2923868 - protein, 18 aa, Entamoeba invadens
YRKQRDRFKEEANEYKVQ

SEQ ID NO: 2923869 - protein, 12 aa, Entamoeba invadens
YRKRSDKKDIGL

SEQ ID NO: 2923870 - protein, 6 aa, Entamoeba invadens
YRKSPE

SEQ ID NO: 2923871 - protein, 12 aa, Entamoeba invadens
YRNDKKQPLPKD

SEQ ID NO: 2923872 - protein, 10 aa, Entamoeba invadens
YRNGSTEDEL

SEQ ID NO: 2923873 - protein, 11 aa, Entamoeba invadens
YRNKQKQDGLY

SEQ ID NO: 2923874 - protein, 9 aa, Entamoeba invadens
YRPASNGTC

SEQ ID NO: 2923875 - protein, 4 aa, Entamoeba invadens
YRPD

SEQ ID NO: 2923876 - protein, 8 aa, Entamoeba invadens
YRPDRTPL

SEQ ID NO: 2923877 - protein, 4 aa, Entamoeba invadens
YRPF

SEQ ID NO: 2923878 - protein, 41 aa, Entamoeba invadens
YRPKQQHEHQKVGDMNKQNEEKSVQHTGAASPNIPKPSSEQ

SEQ ID NO: 2923879 - protein, 7 aa, Entamoeba invadens
YRPNKPF

SEQ ID NO: 2923880 - protein, 12 aa, Entamoeba invadens
YRPPYQQYQQNQ

SEQ ID NO: 2923881 - protein, 8 aa, Entamoeba invadens
YRPQEAKD

SEQ ID NO: 2923882 - protein, 6 aa, Entamoeba invadens
YRPQTI

SEQ ID NO: 2923883 - protein, 6 aa, Entamoeba invadens
YRPSES

SEQ ID NO: 2923884 - protein, 4 aa, Entamoeba invadens
YRPT

SEQ ID NO: 2923885 - protein, 9 aa, Entamoeba invadens
YRPTKDTVT

SEQ ID NO: 2923886 - protein, 10 aa, Entamoeba invadens
YRPTKEFSGG

SEQ ID NO: 2923887 - protein, 6 aa, Entamoeba invadens
YRPTLG

SEQ ID NO: 2923888 - protein, 25 aa, Entamoeba invadens
YRPTTPSSSVVSPRTYNEKSGKKKL

SEQ ID NO: 2923889 - protein, 14 aa, Entamoeba invadens
YRPVGTSNIDKTEV

SEQ ID NO: 2923890 - protein, 13 aa, Entamoeba invadens
YRPVGTSNIDQTE

SEQ ID NO: 2923891 - protein, 14 aa, Entamoeba invadens
YRPVGTSNIDQTEV

SEQ ID NO: 2923892 - protein, 23 aa, Entamoeba invadens
YRPVGTSNIDQTEVNKRDNQIAD

SEQ ID NO: 2923893 - protein, 10 aa, Entamoeba invadens
YRQGDATSDL

SEQ ID NO: 2923894 - protein, 6 aa, Entamoeba invadens
YRQKVS

SEQ ID NO: 2923895 - protein, 4 aa, Entamoeba invadens
YRQS

SEQ ID NO: 2923896 - protein, 7 aa, Entamoeba invadens
YRQTTPR

SEQ ID NO: 2923897 - protein, 5 aa, Entamoeba invadens
YRQYE

SEQ ID NO: 2923898 - protein, 4 aa, Entamoeba invadens
YRSA

SEQ ID NO: 2923899 - protein, 10 aa, Entamoeba invadens
YRSAKNISVD

SEQ ID NO: 2923900 - protein, 40 aa, Entamoeba invadens
YRSCSYSPKGGSSNSSCDEPQRVGSPKPHSKRKSKKTECP

SEQ ID NO: 2923901 - protein, 5 aa, Entamoeba invadens
YRSDT

SEQ ID NO: 2923902 - protein, 9 aa, Entamoeba invadens
YRSGDTTIP

SEQ ID NO: 2923903 - protein, 7 aa, Entamoeba invadens
YRSGRMN

SEQ ID NO: 2923904 - protein, 5 aa, Entamoeba invadens
YRSKS

SEQ ID NO: 2923905 - protein, 12 aa, Entamoeba invadens
YRSRGTDEEKIS

SEQ ID NO: 2923906 - protein, 12 aa, Entamoeba invadens
YRSRSKKRAQRT

SEQ ID NO: 2923907 - protein, 6 aa, Entamoeba invadens
YRSSAK

SEQ ID NO: 2923908 - protein, 8 aa, Entamoeba invadens
YRSTTTSY

SEQ ID NO: 2923909 - protein, 18 aa, Entamoeba invadens
YRTESKVNEGRNGNVSTE

SEQ ID NO: 2923910 - protein, 16 aa, Entamoeba invadens
YRTPNNNTKLCNPQKE

SEQ ID NO: 2923911 - protein, 12 aa, Entamoeba invadens
YRTPTKKDKESY

SEQ ID NO: 2923912 - protein, 7 aa, Entamoeba invadens
YRTSSNV

SEQ ID NO: 2923913 - protein, 4 aa, Entamoeba invadens
YRTT

SEQ ID NO: 2923914 - protein, 9 aa, Entamoeba invadens
YRTTQNTNL

SEQ ID NO: 2923915 - protein, 7 aa, Entamoeba invadens
YRTTRGM

SEQ ID NO: 2923916 - protein, 5 aa, Entamoeba invadens
YRTTT

SEQ ID NO: 2923917 - protein, 12 aa, Entamoeba invadens
YRYENNKEMSTE

SEQ ID NO: 2923918 - protein, 10 aa, Entamoeba invadens
YSADRSAGEV

SEQ ID NO: 2923919 - protein, 9 aa, Entamoeba invadens
YSAGRGVDE

SEQ ID NO: 2923920 - protein, 20 aa, Entamoeba invadens
YSAKDQKNENGELTAEAIES

SEQ ID NO: 2923921 - protein, 7 aa, Entamoeba invadens
YSANESG

SEQ ID NO: 2923922 - protein, 10 aa, Entamoeba invadens
YSANPETVSR

SEQ ID NO: 2923923 - protein, 17 aa, Entamoeba invadens
YSAPDGSFSKESEEDIR

SEQ ID NO: 2923924 - protein, 17 aa, Entamoeba invadens
YSARRPPPPPPPTYPTR

SEQ ID NO: 2923925 - protein, 6 aa, Entamoeba invadens
YSASHT

SEQ ID NO: 2923926 - protein, 7 aa, Entamoeba invadens
YSASTSA

SEQ ID NO: 2923927 - protein, 11 aa, Entamoeba invadens
YSCEERKAREI

SEQ ID NO: 2923928 - protein, 8 aa, Entamoeba invadens
YSCSSDEK

SEQ ID NO: 2923929 - protein, 11 aa, Entamoeba invadens
YSDDDGMEEGE

SEQ ID NO: 2923930 - protein, 8 aa, Entamoeba invadens
YSDDKNSL

SEQ ID NO: 2923931 - protein, 17 aa, Entamoeba invadens
YSDEDDNQNSDKLEDEN

SEQ ID NO: 2923932 - protein, 6 aa, Entamoeba invadens
YSDEGL

SEQ ID NO: 2923933 - protein, 9 aa, Entamoeba invadens
YSDFEENTI

SEQ ID NO: 2923934 - protein, 14 aa, Entamoeba invadens
YSDGVLSDETITKV

SEQ ID NO: 2923935 - protein, 9 aa, Entamoeba invadens
YSDKEESEF

SEQ ID NO: 2923936 - protein, 13 aa, Entamoeba invadens
YSDKKKEKHKTSN

SEQ ID NO: 2923937 - protein, 10 aa, Entamoeba invadens
YSDKNDLKND

SEQ ID NO: 2923938 - protein, 5 aa, Entamoeba invadens
YSDKT

SEQ ID NO: 2923939 - protein, 5 aa, Entamoeba invadens
YSDPS

SEQ ID NO: 2923940 - protein, 15 aa, Entamoeba invadens
YSDQDFRDLSEEQLR

SEQ ID NO: 2923941 - protein, 5 aa, Entamoeba invadens
YSDRD

SEQ ID NO: 2923942 - protein, 9 aa, Entamoeba invadens
YSDRDFRDL

SEQ ID NO: 2923943 - protein, 4 aa, Entamoeba invadens
YSDS

SEQ ID NO: 2923944 - protein, 10 aa, Entamoeba invadens
YSDSPSPSPF

SEQ ID NO: 2923945 - protein, 7 aa, Entamoeba invadens
YSDTFDE

SEQ ID NO: 2923946 - protein, 13 aa, Entamoeba invadens
YSDTGKREVNKEN

SEQ ID NO: 2923947 - protein, 7 aa, Entamoeba invadens
YSDTKEE

SEQ ID NO: 2923948 - protein, 5 aa, Entamoeba invadens
YSDTQ

SEQ ID NO: 2923949 - protein, 8 aa, Entamoeba invadens
YSDTSKCK

SEQ ID NO: 2923950 - protein, 18 aa, Entamoeba invadens
YSDYATDGRMAKTGDNAV

SEQ ID NO: 2923951 - protein, 7 aa, Entamoeba invadens
YSEAPKV

SEQ ID NO: 2923952 - protein, 6 aa, Entamoeba invadens
YSECNP

SEQ ID NO: 2923953 - protein, 17 aa, Entamoeba invadens
YSEDGRAVTRYSNSDGN

SEQ ID NO: 2923954 - protein, 12 aa, Entamoeba invadens
YSEDKAKDGGNL

SEQ ID NO: 2923955 - protein, 5 aa, Entamoeba invadens
YSEDP

SEQ ID NO: 2923956 - protein, 7 aa, Entamoeba invadens
YSEEGSD

SEQ ID NO: 2923957 - protein, 13 aa, Entamoeba invadens
YSEEYEAEMTKRG

SEQ ID NO: 2923958 - protein, 18 aa, Entamoeba invadens
YSEGVKEIKETSLANETY

SEQ ID NO: 2923959 - protein, 4 aa, Entamoeba invadens
YSEI

SEQ ID NO: 2923960 - protein, 4 aa, Entamoeba invadens
YSEK

SEQ ID NO: 2923961 - protein, 18 aa, Entamoeba invadens
YSEKNPNDCQIKQEGGTY

SEQ ID NO: 2923962 - protein, 9 aa, Entamoeba invadens
YSENDYGTE

SEQ ID NO: 2923963 - protein, 6 aa, Entamoeba invadens
YSENEQ

SEQ ID NO: 2923964 - protein, 30 aa, Entamoeba invadens
YSEPTESEPKSSVKKPDEVEKQKEMKGEGE

SEQ ID NO: 2923965 - protein, 8 aa, Entamoeba invadens
YSEPVTSK

SEQ ID NO: 2923966 - protein, 5 aa, Entamoeba invadens
YSEPW

SEQ ID NO: 2923967 - protein, 7 aa, Entamoeba invadens
YSEREKE

SEQ ID NO: 2923968 - protein, 6 aa, Entamoeba invadens
YSERMS

SEQ ID NO: 2923969 - protein, 9 aa, Entamoeba invadens
YSESGSTSM

SEQ ID NO: 2923970 - protein, 12 aa, Entamoeba invadens
YSETKNQEDPCL

SEQ ID NO: 2923971 - protein, 8 aa, Entamoeba invadens
YSETPEGH

SEQ ID NO: 2923972 - protein, 5 aa, Entamoeba invadens
YSETV

SEQ ID NO: 2923973 - protein, 9 aa, Entamoeba invadens
YSEVRGEPV

SEQ ID NO: 2923974 - protein, 8 aa, Entamoeba invadens
YSFDTDYK

SEQ ID NO: 2923975 - protein, 4 aa, Entamoeba invadens
YSFG

SEQ ID NO: 2923976 - protein, 5 aa, Entamoeba invadens
YSFTK

SEQ ID NO: 2923977 - protein, 4 aa, Entamoeba invadens
YSGC

SEQ ID NO: 2923978 - protein, 9 aa, Entamoeba invadens
YSGDSRGST

SEQ ID NO: 2923979 - protein, 6 aa, Entamoeba invadens
YSGEGV

SEQ ID NO: 2923980 - protein, 5 aa, Entamoeba invadens
YSGEL

SEQ ID NO: 2923981 - protein, 18 aa, Entamoeba invadens
YSGEPQSQPEQQSEVDNV

SEQ ID NO: 2923982 - protein, 9 aa, Entamoeba invadens
YSGETYEHN

SEQ ID NO: 2923983 - protein, 21 aa, Entamoeba invadens
YSGGLDTKCGSDGPTSTYYSN

SEQ ID NO: 2923984 - protein, 12 aa, Entamoeba invadens
YSGKGFGKYRAE

SEQ ID NO: 2923985 - protein, 6 aa, Entamoeba invadens
YSGKSS

SEQ ID NO: 2923986 - protein, 4 aa, Entamoeba invadens
YSGN

SEQ ID NO: 2923987 - protein, 5 aa, Entamoeba invadens
YSGNQ

SEQ ID NO: 2923988 - protein, 8 aa, Entamoeba invadens
YSGPTAGF

SEQ ID NO: 2923989 - protein, 7 aa, Entamoeba invadens
YSGQGIS

SEQ ID NO: 2923990 - protein, 7 aa, Entamoeba invadens
YSGQGVS

SEQ ID NO: 2923991 - protein, 8 aa, Entamoeba invadens
YSGQQPDI

SEQ ID NO: 2923992 - protein, 21 aa, Entamoeba invadens
YSGSPRARKPAMYRGTPPTFT

SEQ ID NO: 2923993 - protein, 11 aa, Entamoeba invadens
YSHESGGISNA

SEQ ID NO: 2923994 - protein, 4 aa, Entamoeba invadens
YSKD

SEQ ID NO: 2923995 - protein, 7 aa, Entamoeba invadens
YSKDGTE

SEQ ID NO: 2923996 - protein, 9 aa, Entamoeba invadens
YSKDPEETV

SEQ ID NO: 2923997 - protein, 8 aa, Entamoeba invadens
YSKDTSAA

SEQ ID NO: 2923998 - protein, 9 aa, Entamoeba invadens
YSKDYQVTQ

SEQ ID NO: 2923999 - protein, 4 aa, Entamoeba invadens
YSKE

SEQ ID NO: 2924000 - protein, 5 aa, Entamoeba invadens
YSKER

SEQ ID NO: 2924001 - protein, 6 aa, Entamoeba invadens
YSKETK

SEQ ID NO: 2924002 - protein, 6 aa, Entamoeba invadens
YSKGNS

SEQ ID NO: 2924003 - protein, 7 aa, Entamoeba invadens
YSKKAHP

SEQ ID NO: 2924004 - protein, 8 aa, Entamoeba invadens
YSKKDYDN

SEQ ID NO: 2924005 - protein, 8 aa, Entamoeba invadens
YSKKEAAR

SEQ ID NO: 2924006 - protein, 18 aa, Entamoeba invadens
YSKNSPTAFTSSRKLARK

SEQ ID NO: 2924007 - protein, 13 aa, Entamoeba invadens
YSKQAVKRKPVKK

SEQ ID NO: 2924008 - protein, 8 aa, Entamoeba invadens
YSKRQQIE

SEQ ID NO: 2924009 - protein, 17 aa, Entamoeba invadens
YSKSNRGASVEISEGGM

SEQ ID NO: 2924010 - protein, 10 aa, Entamoeba invadens
YSKSSPKSYF

SEQ ID NO: 2924011 - protein, 8 aa, Entamoeba invadens
YSKTNETD

SEQ ID NO: 2924012 - protein, 11 aa, Entamoeba invadens
YSKTPNRQLQT

SEQ ID NO: 2924013 - protein, 19 aa, Entamoeba invadens
YSKTPSRFDESALPTKTKI

SEQ ID NO: 2924014 - protein, 7 aa, Entamoeba invadens
YSKTTTA

SEQ ID NO: 2924015 - protein, 4 aa, Entamoeba invadens
YSKY

SEQ ID NO: 2924016 - protein, 10 aa, Entamoeba invadens
YSLDEEKCEM

SEQ ID NO: 2924017 - protein, 11 aa, Entamoeba invadens
YSLETSPKPHS

SEQ ID NO: 2924018 - protein, 7 aa, Entamoeba invadens
YSLNNEG

SEQ ID NO: 2924019 - protein, 4 aa, Entamoeba invadens
YSLP

SEQ ID NO: 2924020 - protein, 10 aa, Entamoeba invadens
YSLPDGTSFT

SEQ ID NO: 2924021 - protein, 7 aa, Entamoeba invadens
YSLPSHT

SEQ ID NO: 2924022 - protein, 7 aa, Entamoeba invadens
YSLSRDQ

SEQ ID NO: 2924023 - protein, 17 aa, Entamoeba invadens
YSMATTEAQKAATLPGD

SEQ ID NO: 2924024 - protein, 5 aa, Entamoeba invadens
YSNEE

SEQ ID NO: 2924025 - protein, 7 aa, Entamoeba invadens
YSNEEMK

SEQ ID NO: 2924026 - protein, 5 aa, Entamoeba invadens
YSNEN

SEQ ID NO: 2924027 - protein, 4 aa, Entamoeba invadens
YSNG

SEQ ID NO: 2924028 - protein, 6 aa, Entamoeba invadens
YSNGPQ

SEQ ID NO: 2924029 - protein, 4 aa, Entamoeba invadens
YSNI

SEQ ID NO: 2924030 - protein, 9 aa, Entamoeba invadens
YSNKTSSLS

SEQ ID NO: 2924031 - protein, 7 aa, Entamoeba invadens
YSNNESL

SEQ ID NO: 2924032 - protein, 11 aa, Entamoeba invadens
YSNNNEKNSAM

SEQ ID NO: 2924033 - protein, 6 aa, Entamoeba invadens
YSNPTP

SEQ ID NO: 2924034 - protein, 9 aa, Entamoeba invadens
YSNRKRFGN

SEQ ID NO: 2924035 - protein, 8 aa, Entamoeba invadens
YSNRNPYF

SEQ ID NO: 2924036 - protein, 7 aa, Entamoeba invadens
YSNSGKC

SEQ ID NO: 2924037 - protein, 7 aa, Entamoeba invadens
YSNSGLN

SEQ ID NO: 2924038 - protein, 5 aa, Entamoeba invadens
YSNSL

SEQ ID NO: 2924039 - protein, 17 aa, Entamoeba invadens
YSNSTKMQKQVKNASAL

SEQ ID NO: 2924040 - protein, 4 aa, Entamoeba invadens
YSNT

SEQ ID NO: 2924041 - protein, 7 aa, Entamoeba invadens
YSNTPLI

SEQ ID NO: 2924042 - protein, 6 aa, Entamoeba invadens
YSNTTE

SEQ ID NO: 2924043 - protein, 7 aa, Entamoeba invadens
YSPANTD

SEQ ID NO: 2924044 - protein, 6 aa, Entamoeba invadens
YSPDGQ

SEQ ID NO: 2924045 - protein, 9 aa, Entamoeba invadens
YSPDTSAPN

SEQ ID NO: 2924046 - protein, 5 aa, Entamoeba invadens
YSPEA

SEQ ID NO: 2924047 - protein, 25 aa, Entamoeba invadens
YSPEEARAHAIEEEKALSEHSSDSQ

SEQ ID NO: 2924048 - protein, 10 aa, Entamoeba invadens
YSPEEQKKQS

SEQ ID NO: 2924049 - protein, 9 aa, Entamoeba invadens
YSPEKGKAY

SEQ ID NO: 2924050 - protein, 6 aa, Entamoeba invadens
YSPHAK

SEQ ID NO: 2924051 - protein, 5 aa, Entamoeba invadens
YSPKD

SEQ ID NO: 2924052 - protein, 16 aa, Entamoeba invadens
YSPKSNRIYTSSTTPY

SEQ ID NO: 2924053 - protein, 6 aa, Entamoeba invadens
YSPKVN

SEQ ID NO: 2924054 - protein, 4 aa, Entamoeba invadens
YSPL

SEQ ID NO: 2924055 - protein, 15 aa, Entamoeba invadens
YSPLGNNGNADRNQV

SEQ ID NO: 2924056 - protein, 15 aa, Entamoeba invadens
YSPLGNNGNAGRNKV

SEQ ID NO: 2924057 - protein, 15 aa, Entamoeba invadens
YSPLGNNGNPARNKV

SEQ ID NO: 2924058 - protein, 6 aa, Entamoeba invadens
YSPNLT

SEQ ID NO: 2924059 - protein, 9 aa, Entamoeba invadens
YSPNMTKEE

SEQ ID NO: 2924060 - protein, 8 aa, Entamoeba invadens
YSPNPTCG

SEQ ID NO: 2924061 - protein, 6 aa, Entamoeba invadens
YSPPEY

SEQ ID NO: 2924062 - protein, 16 aa, Entamoeba invadens
YSPPGSESKRKRDDNV

SEQ ID NO: 2924063 - protein, 6 aa, Entamoeba invadens
YSPPKS

SEQ ID NO: 2924064 - protein, 29 aa, Entamoeba invadens
YSPPMRVSSGEPAPKEEFSPINEKEEETY

SEQ ID NO: 2924065 - protein, 5 aa, Entamoeba invadens
YSPPS

SEQ ID NO: 2924066 - protein, 4 aa, Entamoeba invadens
YSPQ

SEQ ID NO: 2924067 - protein, 13 aa, Entamoeba invadens
YSPQINTKTITDP

SEQ ID NO: 2924068 - protein, 9 aa, Entamoeba invadens
YSPQKGKKY

SEQ ID NO: 2924069 - protein, 9 aa, Entamoeba invadens
YSPQTSDLD

SEQ ID NO: 2924070 - protein, 7 aa, Entamoeba invadens
YSPRALE

SEQ ID NO: 2924071 - protein, 22 aa, Entamoeba invadens
YSPRFRKHEKQRSLDSLDESKI

SEQ ID NO: 2924072 - protein, 28 aa, Entamoeba invadens
YSPRNRSENRFRDRKREMDEDAERYFER

SEQ ID NO: 2924073 - protein, 9 aa, Entamoeba invadens
YSPSGCAPN

SEQ ID NO: 2924074 - protein, 7 aa, Entamoeba invadens
YSPSVED

SEQ ID NO: 2924075 - protein, 7 aa, Entamoeba invadens
YSPTFTK

SEQ ID NO: 2924076 - protein, 6 aa, Entamoeba invadens
YSPVSG

SEQ ID NO: 2924077 - protein, 4 aa, Entamoeba invadens
YSPY

SEQ ID NO: 2924078 - protein, 8 aa, Entamoeba invadens
YSQAERDI

SEQ ID NO: 2924079 - protein, 9 aa, Entamoeba invadens
YSQAGAPKL

SEQ ID NO: 2924080 - protein, 19 aa, Entamoeba invadens
YSQATENESQNTNDSTKEE

SEQ ID NO: 2924081 - protein, 19 aa, Entamoeba invadens
YSQATENESQNTNNSTKEE

SEQ ID NO: 2924082 - protein, 6 aa, Entamoeba invadens
YSQGID

SEQ ID NO: 2924083 - protein, 4 aa, Entamoeba invadens
YSQH

SEQ ID NO: 2924084 - protein, 9 aa, Entamoeba invadens
YSQKEKWDT

SEQ ID NO: 2924085 - protein, 15 aa, Entamoeba invadens
YSQKSGKSKEDIGSH

SEQ ID NO: 2924086 - protein, 8 aa, Entamoeba invadens
YSQKTKKD

SEQ ID NO: 2924087 - protein, 16 aa, Entamoeba invadens
YSQLESEEESIAFESK

SEQ ID NO: 2924088 - protein, 12 aa, Entamoeba invadens
YSQLKATNSVGV

SEQ ID NO: 2924089 - protein, 6 aa, Entamoeba invadens
YSQPDG

SEQ ID NO: 2924090 - protein, 29 aa, Entamoeba invadens
YSQQERKDEKKKHNKEITEKKPKYDNENE

SEQ ID NO: 2924091 - protein, 28 aa, Entamoeba invadens
YSQQERKDEKKKHNKEITEKKPRNENET

SEQ ID NO: 2924092 - protein, 37 aa, Entamoeba invadens
YSQQQSGGSPQTNSSQQNVVHEKKSEDFSKKSNDQQM

SEQ ID NO: 2924093 - protein, 14 aa, Entamoeba invadens
YSQRIDTDTVKRNM

SEQ ID NO: 2924094 - protein, 9 aa, Entamoeba invadens
YSQRKTTLD

SEQ ID NO: 2924095 - protein, 9 aa, Entamoeba invadens
YSQRSESKE

SEQ ID NO: 2924096 - protein, 10 aa, Entamoeba invadens
YSQSGKSQGY

SEQ ID NO: 2924097 - protein, 15 aa, Entamoeba invadens
YSQSKQKKSKKNTDQ

SEQ ID NO: 2924098 - protein, 15 aa, Entamoeba invadens
YSQTDTSKYLKLIYS

SEQ ID NO: 2924099 - protein, 12 aa, Entamoeba invadens
YSQTTTKSEYKS

SEQ ID NO: 2924100 - protein, 7 aa, Entamoeba invadens
YSREDCE

SEQ ID NO: 2924101 - protein, 15 aa, Entamoeba invadens
YSREESQAKLTGSLD

SEQ ID NO: 2924102 - protein, 5 aa, Entamoeba invadens
YSRHK

SEQ ID NO: 2924103 - protein, 8 aa, Entamoeba invadens
YSRKSKIS

SEQ ID NO: 2924104 - protein, 9 aa, Entamoeba invadens
YSRNNTTID

SEQ ID NO: 2924105 - protein, 11 aa, Entamoeba invadens
YSRNSSLPKKS

SEQ ID NO: 2924106 - protein, 11 aa, Entamoeba invadens
YSRPNKAKINK

SEQ ID NO: 2924107 - protein, 4 aa, Entamoeba invadens
YSRQ

SEQ ID NO: 2924108 - protein, 4 aa, Entamoeba invadens
YSRR

SEQ ID NO: 2924109 - protein, 4 aa, Entamoeba invadens
YSRS

SEQ ID NO: 2924110 - protein, 8 aa, Entamoeba invadens
YSSDENMR

SEQ ID NO: 2924111 - protein, 12 aa, Entamoeba invadens
YSSDFQDSDFEE

SEQ ID NO: 2924112 - protein, 7 aa, Entamoeba invadens
YSSEDVA

SEQ ID NO: 2924113 - protein, 12 aa, Entamoeba invadens
YSSELTSDSSCV

SEQ ID NO: 2924114 - protein, 4 aa, Entamoeba invadens
YSSG

SEQ ID NO: 2924115 - protein, 9 aa, Entamoeba invadens
YSSGGKSNC

SEQ ID NO: 2924116 - protein, 9 aa, Entamoeba invadens
YSSGGTSSC

SEQ ID NO: 2924117 - protein, 13 aa, Entamoeba invadens
YSSGKNQSNRTET

SEQ ID NO: 2924118 - protein, 5 aa, Entamoeba invadens
YSSGQ

SEQ ID NO: 2924119 - protein, 10 aa, Entamoeba invadens
YSSGTIKERT

SEQ ID NO: 2924120 - protein, 10 aa, Entamoeba invadens
YSSGVTSDGT

SEQ ID NO: 2924121 - protein, 4 aa, Entamoeba invadens
YSSH

SEQ ID NO: 2924122 - protein, 8 aa, Entamoeba invadens
YSSKDETF

SEQ ID NO: 2924123 - protein, 5 aa, Entamoeba invadens
YSSKE

SEQ ID NO: 2924124 - protein, 6 aa, Entamoeba invadens
YSSKET

SEQ ID NO: 2924125 - protein, 6 aa, Entamoeba invadens
YSSLSD

SEQ ID NO: 2924126 - protein, 8 aa, Entamoeba invadens
YSSNEEYN

SEQ ID NO: 2924127 - protein, 6 aa, Entamoeba invadens
YSSNGR

SEQ ID NO: 2924128 - protein, 9 aa, Entamoeba invadens
YSSNHNNKA

SEQ ID NO: 2924129 - protein, 9 aa, Entamoeba invadens
YSSNKSDVP

SEQ ID NO: 2924130 - protein, 5 aa, Entamoeba invadens
YSSNV

SEQ ID NO: 2924131 - protein, 15 aa, Entamoeba invadens
YSSPQQRVKSTLVFN

SEQ ID NO: 2924132 - protein, 9 aa, Entamoeba invadens
YSSPSEKDM

SEQ ID NO: 2924133 - protein, 10 aa, Entamoeba invadens
YSSPSKHDDE

SEQ ID NO: 2924134 - protein, 10 aa, Entamoeba invadens
YSSPTNAQGL

SEQ ID NO: 2924135 - protein, 13 aa, Entamoeba invadens
YSSQDTHNKLSYK

SEQ ID NO: 2924136 - protein, 13 aa, Entamoeba invadens
YSSQPQLPRKTQL

SEQ ID NO: 2924137 - protein, 9 aa, Entamoeba invadens
YSSQQNSAE

SEQ ID NO: 2924138 - protein, 6 aa, Entamoeba invadens
YSSREN

SEQ ID NO: 2924139 - protein, 12 aa, Entamoeba invadens
YSSRLGDDTDEK

SEQ ID NO: 2924140 - protein, 9 aa, Entamoeba invadens
YSSSEQQEE

SEQ ID NO: 2924141 - protein, 11 aa, Entamoeba invadens
YSSSKKEKRCE

SEQ ID NO: 2924142 - protein, 11 aa, Entamoeba invadens
YSSSKKQEKLE

SEQ ID NO: 2924143 - protein, 14 aa, Entamoeba invadens
YSSSPDDRKQKIDF

SEQ ID NO: 2924144 - protein, 9 aa, Entamoeba invadens
YSSSQVPFT

SEQ ID NO: 2924145 - protein, 6 aa, Entamoeba invadens
YSSTLG

SEQ ID NO: 2924146 - protein, 23 aa, Entamoeba invadens
YSSVESSSECTNCEAGTYSSQGA

SEQ ID NO: 2924147 - protein, 9 aa, Entamoeba invadens
YSSVSDGVV

SEQ ID NO: 2924148 - protein, 7 aa, Entamoeba invadens
YSTDGLS

SEQ ID NO: 2924149 - protein, 7 aa, Entamoeba invadens
YSTEPSI

SEQ ID NO: 2924150 - protein, 10 aa, Entamoeba invadens
YSTESTTMTV

SEQ ID NO: 2924151 - protein, 6 aa, Entamoeba invadens
YSTGPT

SEQ ID NO: 2924152 - protein, 8 aa, Entamoeba invadens
YSTGTGNF

SEQ ID NO: 2924153 - protein, 4 aa, Entamoeba invadens
YSTI

SEQ ID NO: 2924154 - protein, 12 aa, Entamoeba invadens
YSTKKTDSNSRK

SEQ ID NO: 2924155 - protein, 8 aa, Entamoeba invadens
YSTKPEDV

SEQ ID NO: 2924156 - protein, 11 aa, Entamoeba invadens
YSTKSEFNENE

SEQ ID NO: 2924157 - protein, 4 aa, Entamoeba invadens
YSTN

SEQ ID NO: 2924158 - protein, 12 aa, Entamoeba invadens
YSTNKKGYSGTA

SEQ ID NO: 2924159 - protein, 6 aa, Entamoeba invadens
YSTNPH

SEQ ID NO: 2924160 - protein, 9 aa, Entamoeba invadens
YSTPEIQRT

SEQ ID NO: 2924161 - protein, 8 aa, Entamoeba invadens
YSTPPEGC

SEQ ID NO: 2924162 - protein, 10 aa, Entamoeba invadens
YSTQYDGQTE

SEQ ID NO: 2924163 - protein, 5 aa, Entamoeba invadens
YSTRK

SEQ ID NO: 2924164 - protein, 12 aa, Entamoeba invadens
YSTSAQDTPKTV

SEQ ID NO: 2924165 - protein, 8 aa, Entamoeba invadens
YSTSNGDL

SEQ ID NO: 2924166 - protein, 6 aa, Entamoeba invadens
YSTTKT

SEQ ID NO: 2924167 - protein, 4 aa, Entamoeba invadens
YSTV

SEQ ID NO: 2924168 - protein, 4 aa, Entamoeba invadens
YSVD

SEQ ID NO: 2924169 - protein, 18 aa, Entamoeba invadens
YSVENSPITISKRSDGQL

SEQ ID NO: 2924170 - protein, 7 aa, Entamoeba invadens
YSVGNGN

SEQ ID NO: 2924171 - protein, 6 aa, Entamoeba invadens
YSVPDS

SEQ ID NO: 2924172 - protein, 84 aa, Entamoeba invadens
YSVPQDSNPYNYNYPPQPPPPQQNIQGQQHTLPNPPQHQQNSNVTQQQRQKTADNQNYKPAPTPVDQPRREQQQLPQKDIQGNR

SEQ ID NO: 2924173 - protein, 9 aa, Entamoeba invadens
YSYANSNGI

SEQ ID NO: 2924174 - protein, 9 aa, Entamoeba invadens
YSYDPRNET

SEQ ID NO: 2924175 - protein, 6 aa, Entamoeba invadens
YSYGAY

SEQ ID NO: 2924176 - protein, 14 aa, Entamoeba invadens
YSYNDREKYGDVIP

SEQ ID NO: 2924177 - protein, 8 aa, Entamoeba invadens
YSYNSEGK

SEQ ID NO: 2924178 - protein, 5 aa, Entamoeba invadens
YSYSA

SEQ ID NO: 2924179 - protein, 7 aa, Entamoeba invadens
YSYTKNG

SEQ ID NO: 2924180 - protein, 9 aa, Entamoeba invadens
YTAANDEEL

SEQ ID NO: 2924181 - protein, 14 aa, Entamoeba invadens
YTAETDDELSFKQG

SEQ ID NO: 2924182 - protein, 5 aa, Entamoeba invadens
YTAGE

SEQ ID NO: 2924183 - protein, 6 aa, Entamoeba invadens
YTAGTF

SEQ ID NO: 2924184 - protein, 7 aa, Entamoeba invadens
YTAKNGN

SEQ ID NO: 2924185 - protein, 15 aa, Entamoeba invadens
YTANGNGGKSVYAQA

SEQ ID NO: 2924186 - protein, 10 aa, Entamoeba invadens
YTAPTDEALK

SEQ ID NO: 2924187 - protein, 11 aa, Entamoeba invadens
YTAQDQGELSF

SEQ ID NO: 2924188 - protein, 9 aa, Entamoeba invadens
YTAQKVAPY

SEQ ID NO: 2924189 - protein, 5 aa, Entamoeba invadens
YTAQR

SEQ ID NO: 2924190 - protein, 4 aa, Entamoeba invadens
YTAS

SEQ ID NO: 2924191 - protein, 7 aa, Entamoeba invadens
YTASPKL

SEQ ID NO: 2924192 - protein, 9 aa, Entamoeba invadens
YTATATTSF

SEQ ID NO: 2924193 - protein, 4 aa, Entamoeba invadens
YTCT

SEQ ID NO: 2924194 - protein, 4 aa, Entamoeba invadens
YTDE

SEQ ID NO: 2924195 - protein, 6 aa, Entamoeba invadens
YTDEHT

SEQ ID NO: 2924196 - protein, 6 aa, Entamoeba invadens
YTDGEV

SEQ ID NO: 2924197 - protein, 4 aa, Entamoeba invadens
YTDN

SEQ ID NO: 2924198 - protein, 14 aa, Entamoeba invadens
YTDNDRKIYSDTIP

SEQ ID NO: 2924199 - protein, 9 aa, Entamoeba invadens
YTDNGKEKY

SEQ ID NO: 2924200 - protein, 5 aa, Entamoeba invadens
YTDPR

SEQ ID NO: 2924201 - protein, 7 aa, Entamoeba invadens
YTDRDKR

SEQ ID NO: 2924202 - protein, 7 aa, Entamoeba invadens
YTDSDGN

SEQ ID NO: 2924203 - protein, 6 aa, Entamoeba invadens
YTDSPL

SEQ ID NO: 2924204 - protein, 8 aa, Entamoeba invadens
YTDSSVVD

SEQ ID NO: 2924205 - protein, 5 aa, Entamoeba invadens
YTDTK

SEQ ID NO: 2924206 - protein, 9 aa, Entamoeba invadens
YTDTPGQNR

SEQ ID NO: 2924207 - protein, 6 aa, Entamoeba invadens
YTDTPV

SEQ ID NO: 2924208 - protein, 5 aa, Entamoeba invadens
YTDTY

SEQ ID NO: 2924209 - protein, 4 aa, Entamoeba invadens
YTDV

SEQ ID NO: 2924210 - protein, 6 aa, Entamoeba invadens
YTEAKT

SEQ ID NO: 2924211 - protein, 13 aa, Entamoeba invadens
YTEANEVTSSGKD

SEQ ID NO: 2924212 - protein, 18 aa, Entamoeba invadens
YTEATSSAKNSIEGGCTD

SEQ ID NO: 2924213 - protein, 7 aa, Entamoeba invadens
YTEDKPD

SEQ ID NO: 2924214 - protein, 13 aa, Entamoeba invadens
YTEDKSLTGTARY

SEQ ID NO: 2924215 - protein, 9 aa, Entamoeba invadens
YTEDSQDIQ

SEQ ID NO: 2924216 - protein, 13 aa, Entamoeba invadens
YTEEADHGLVIAN

SEQ ID NO: 2924217 - protein, 5 aa, Entamoeba invadens
YTEET

SEQ ID NO: 2924218 - protein, 7 aa, Entamoeba invadens
YTEEYPN

SEQ ID NO: 2924219 - protein, 5 aa, Entamoeba invadens
YTEIR

SEQ ID NO: 2924220 - protein, 6 aa, Entamoeba invadens
YTEKGE

SEQ ID NO: 2924221 - protein, 13 aa, Entamoeba invadens
YTENGNSFKATKT

SEQ ID NO: 2924222 - protein, 10 aa, Entamoeba invadens
YTENKKEKYL

SEQ ID NO: 2924223 - protein, 5 aa, Entamoeba invadens
YTENY

SEQ ID NO: 2924224 - protein, 6 aa, Entamoeba invadens
YTEPSF

SEQ ID NO: 2924225 - protein, 9 aa, Entamoeba invadens
YTERDTFNN

SEQ ID NO: 2924226 - protein, 12 aa, Entamoeba invadens
YTEVTGKTDNIP

SEQ ID NO: 2924227 - protein, 6 aa, Entamoeba invadens
YTFNGK

SEQ ID NO: 2924228 - protein, 18 aa, Entamoeba invadens
YTFTTKQSVHGKKQRITS

SEQ ID NO: 2924229 - protein, 19 aa, Entamoeba invadens
YTFTTKQSVHGKKQRITSV

SEQ ID NO: 2924230 - protein, 4 aa, Entamoeba invadens
YTGD

SEQ ID NO: 2924231 - protein, 10 aa, Entamoeba invadens
YTGDDTDSVM

SEQ ID NO: 2924232 - protein, 5 aa, Entamoeba invadens
YTGES

SEQ ID NO: 2924233 - protein, 9 aa, Entamoeba invadens
YTGGDNSVM

SEQ ID NO: 2924234 - protein, 12 aa, Entamoeba invadens
YTGGQKLKDSCG

SEQ ID NO: 2924235 - protein, 9 aa, Entamoeba invadens
YTGLGDEYD

SEQ ID NO: 2924236 - protein, 5 aa, Entamoeba invadens
YTGRY

SEQ ID NO: 2924237 - protein, 10 aa, Entamoeba invadens
YTGRYEKNAS

SEQ ID NO: 2924238 - protein, 6 aa, Entamoeba invadens
YTGSDS

SEQ ID NO: 2924239 - protein, 5 aa, Entamoeba invadens
YTGSI

SEQ ID NO: 2924240 - protein, 7 aa, Entamoeba invadens
YTGSQTE

SEQ ID NO: 2924241 - protein, 7 aa, Entamoeba invadens
YTGTNSV

SEQ ID NO: 2924242 - protein, 9 aa, Entamoeba invadens
YTGTPEPID

SEQ ID NO: 2924243 - protein, 7 aa, Entamoeba invadens
YTGTTEA

SEQ ID NO: 2924244 - protein, 51 aa, Entamoeba invadens
YTGYGGGSGSTDNTSVVGGKVAEAAAAEDAEQRRNAPAQKVAPKAAPVAGP

SEQ ID NO: 2924245 - protein, 11 aa, Entamoeba invadens
YTHDSSENGNI

SEQ ID NO: 2924246 - protein, 9 aa, Entamoeba invadens
YTHPPSELY

SEQ ID NO: 2924247 - protein, 4 aa, Entamoeba invadens
YTID

SEQ ID NO: 2924248 - protein, 11 aa, Entamoeba invadens
YTINPSNPKQC

SEQ ID NO: 2924249 - protein, 11 aa, Entamoeba invadens
YTKAKESDYYT

SEQ ID NO: 2924250 - protein, 9 aa, Entamoeba invadens
YTKAKSLSH

SEQ ID NO: 2924251 - protein, 8 aa, Entamoeba invadens
YTKATDKM

SEQ ID NO: 2924252 - protein, 7 aa, Entamoeba invadens
YTKDDRI

SEQ ID NO: 2924253 - protein, 8 aa, Entamoeba invadens
YTKEDCKK

SEQ ID NO: 2924254 - protein, 9 aa, Entamoeba invadens
YTKEDRAKF

SEQ ID NO: 2924255 - protein, 9 aa, Entamoeba invadens
YTKEDSSVT

SEQ ID NO: 2924256 - protein, 17 aa, Entamoeba invadens
YTKGESQTDVEVTNATD

SEQ ID NO: 2924257 - protein, 10 aa, Entamoeba invadens
YTKHDRETFG

SEQ ID NO: 2924258 - protein, 17 aa, Entamoeba invadens
YTKHDRKKFGNDIPQNV

SEQ ID NO: 2924259 - protein, 12 aa, Entamoeba invadens
YTKNDREKFGTT

SEQ ID NO: 2924260 - protein, 10 aa, Entamoeba invadens
YTKNDRERFG

SEQ ID NO: 2924261 - protein, 17 aa, Entamoeba invadens
YTKNDRKKFGNDIPQNV

SEQ ID NO: 2924262 - protein, 20 aa, Entamoeba invadens
YTKNDRKKYGNNIPSSVTSI

SEQ ID NO: 2924263 - protein, 11 aa, Entamoeba invadens
YTKNDRKTFGD

SEQ ID NO: 2924264 - protein, 10 aa, Entamoeba invadens
YTKNNRQKFG

SEQ ID NO: 2924265 - protein, 13 aa, Entamoeba invadens
YTKPTKTGGEKIA

SEQ ID NO: 2924266 - protein, 4 aa, Entamoeba invadens
YTKQ

SEQ ID NO: 2924267 - protein, 7 aa, Entamoeba invadens
YTKQGTI

SEQ ID NO: 2924268 - protein, 5 aa, Entamoeba invadens
YTKQN

SEQ ID NO: 2924269 - protein, 7 aa, Entamoeba invadens
YTKRQQI

SEQ ID NO: 2924270 - protein, 6 aa, Entamoeba invadens
YTKSDK

SEQ ID NO: 2924271 - protein, 6 aa, Entamoeba invadens
YTKSSD

SEQ ID NO: 2924272 - protein, 6 aa, Entamoeba invadens
YTKTEL

SEQ ID NO: 2924273 - protein, 5 aa, Entamoeba invadens
YTKTF

SEQ ID NO: 2924274 - protein, 7 aa, Entamoeba invadens
YTKTTRK

SEQ ID NO: 2924275 - protein, 10 aa, Entamoeba invadens
YTLDSTKKYG

SEQ ID NO: 2924276 - protein, 10 aa, Entamoeba invadens
YTLEKDNEDI

SEQ ID NO: 2924277 - protein, 5 aa, Entamoeba invadens
YTLGA

SEQ ID NO: 2924278 - protein, 11 aa, Entamoeba invadens
YTLNTPANETK

SEQ ID NO: 2924279 - protein, 6 aa, Entamoeba invadens
YTLPDG

SEQ ID NO: 2924280 - protein, 10 aa, Entamoeba invadens
YTLSEKMEEK

SEQ ID NO: 2924281 - protein, 26 aa, Entamoeba invadens
YTLSSNGKSCDQCDSTSYYDRTTNRC

SEQ ID NO: 2924282 - protein, 11 aa, Entamoeba invadens
YTLTSNSTNSV

SEQ ID NO: 2924283 - protein, 9 aa, Entamoeba invadens
YTMSDTPDL

SEQ ID NO: 2924284 - protein, 4 aa, Entamoeba invadens
YTNA

SEQ ID NO: 2924285 - protein, 7 aa, Entamoeba invadens
YTNDKSK

SEQ ID NO: 2924286 - protein, 11 aa, Entamoeba invadens
YTNDSITDSNV

SEQ ID NO: 2924287 - protein, 5 aa, Entamoeba invadens
YTNEQ

SEQ ID NO: 2924288 - protein, 34 aa, Entamoeba invadens
YTNGKLDEKYQTAPSDDGPQEKKSSHNESCGRWS

SEQ ID NO: 2924289 - protein, 7 aa, Entamoeba invadens
YTNGKNQ

SEQ ID NO: 2924290 - protein, 5 aa, Entamoeba invadens
YTNKG

SEQ ID NO: 2924291 - protein, 6 aa, Entamoeba invadens
YTNKKL

SEQ ID NO: 2924292 - protein, 8 aa, Entamoeba invadens
YTNKNSIN

SEQ ID NO: 2924293 - protein, 5 aa, Entamoeba invadens
YTNMS

SEQ ID NO: 2924294 - protein, 12 aa, Entamoeba invadens
YTNNDRKLHGNN

SEQ ID NO: 2924295 - protein, 5 aa, Entamoeba invadens
YTNPE

SEQ ID NO: 2924296 - protein, 7 aa, Entamoeba invadens
YTNPEKS

SEQ ID NO: 2924297 - protein, 13 aa, Entamoeba invadens
YTNPFTGKSNSEK

SEQ ID NO: 2924298 - protein, 5 aa, Entamoeba invadens
YTNPL

SEQ ID NO: 2924299 - protein, 9 aa, Entamoeba invadens
YTNPNIKDS

SEQ ID NO: 2924300 - protein, 7 aa, Entamoeba invadens
YTNPPKI

SEQ ID NO: 2924301 - protein, 24 aa, Entamoeba invadens
YTNSDSCENGKATKCDNTSEIDTN

SEQ ID NO: 2924302 - protein, 23 aa, Entamoeba invadens
YTNSNTERSVGYSNQFDGPYEYN

SEQ ID NO: 2924303 - protein, 11 aa, Entamoeba invadens
YTNSTAPFEGD

SEQ ID NO: 2924304 - protein, 7 aa, Entamoeba invadens
YTNSVSN

SEQ ID NO: 2924305 - protein, 10 aa, Entamoeba invadens
YTNTDRRKYG

SEQ ID NO: 2924306 - protein, 10 aa, Entamoeba invadens
YTNTEKAISD

SEQ ID NO: 2924307 - protein, 12 aa, Entamoeba invadens
YTNTTDSMGTVS

SEQ ID NO: 2924308 - protein, 9 aa, Entamoeba invadens
YTPAPTEMS

SEQ ID NO: 2924309 - protein, 6 aa, Entamoeba invadens
YTPDNT

SEQ ID NO: 2924310 - protein, 7 aa, Entamoeba invadens
YTPDPTE

SEQ ID NO: 2924311 - protein, 13 aa, Entamoeba invadens
YTPEHEEKKYKAP

SEQ ID NO: 2924312 - protein, 16 aa, Entamoeba invadens
YTPEIEPGDTQSSPPF

SEQ ID NO: 2924313 - protein, 9 aa, Entamoeba invadens
YTPEKRPTA

SEQ ID NO: 2924314 - protein, 5 aa, Entamoeba invadens
YTPES

SEQ ID NO: 2924315 - protein, 7 aa, Entamoeba invadens
YTPETQP

SEQ ID NO: 2924316 - protein, 13 aa, Entamoeba invadens
YTPKKREGPQPTV

SEQ ID NO: 2924317 - protein, 12 aa, Entamoeba invadens
YTPKKSPKTMNY

SEQ ID NO: 2924318 - protein, 5 aa, Entamoeba invadens
YTPKN

SEQ ID NO: 2924319 - protein, 5 aa, Entamoeba invadens
YTPLP

SEQ ID NO: 2924320 - protein, 9 aa, Entamoeba invadens
YTPLSTSGA

SEQ ID NO: 2924321 - protein, 9 aa, Entamoeba invadens
YTPNSKKSN

SEQ ID NO: 2924322 - protein, 11 aa, Entamoeba invadens
YTPNSPTNMEG

SEQ ID NO: 2924323 - protein, 6 aa, Entamoeba invadens
YTPPEV

SEQ ID NO: 2924324 - protein, 5 aa, Entamoeba invadens
YTPQA

SEQ ID NO: 2924325 - protein, 19 aa, Entamoeba invadens
YTPSKTKKEKLDSPPLDAE

SEQ ID NO: 2924326 - protein, 9 aa, Entamoeba invadens
YTPSRNSLK

SEQ ID NO: 2924327 - protein, 5 aa, Entamoeba invadens
YTPTL

SEQ ID NO: 2924328 - protein, 5 aa, Entamoeba invadens
YTPTP

SEQ ID NO: 2924329 - protein, 10 aa, Entamoeba invadens
YTPTSEETPI

SEQ ID NO: 2924330 - protein, 8 aa, Entamoeba invadens
YTQDPPKC

SEQ ID NO: 2924331 - protein, 5 aa, Entamoeba invadens
YTQEK

SEQ ID NO: 2924332 - protein, 5 aa, Entamoeba invadens
YTQEM

SEQ ID NO: 2924333 - protein, 5 aa, Entamoeba invadens
YTQGD

SEQ ID NO: 2924334 - protein, 7 aa, Entamoeba invadens
YTQGENE

SEQ ID NO: 2924335 - protein, 5 aa, Entamoeba invadens
YTQHT

SEQ ID NO: 2924336 - protein, 8 aa, Entamoeba invadens
YTQHTSSL

SEQ ID NO: 2924337 - protein, 13 aa, Entamoeba invadens
YTQKESDVAEGGI

SEQ ID NO: 2924338 - protein, 7 aa, Entamoeba invadens
YTQKNAD

SEQ ID NO: 2924339 - protein, 7 aa, Entamoeba invadens
YTQKQNE

SEQ ID NO: 2924340 - protein, 10 aa, Entamoeba invadens
YTQKSSASLS

SEQ ID NO: 2924341 - protein, 15 aa, Entamoeba invadens
YTQKTNSSDGTDYVA

SEQ ID NO: 2924342 - protein, 12 aa, Entamoeba invadens
YTQNDREKFGND

SEQ ID NO: 2924343 - protein, 20 aa, Entamoeba invadens
YTQNDREKFGNNIPSNVKSL

SEQ ID NO: 2924344 - protein, 8 aa, Entamoeba invadens
YTQNDRKR

SEQ ID NO: 2924345 - protein, 17 aa, Entamoeba invadens
YTQNYKNKFGNNIPRRV

SEQ ID NO: 2924346 - protein, 8 aa, Entamoeba invadens
YTQPDPPY

SEQ ID NO: 2924347 - protein, 7 aa, Entamoeba invadens
YTQPKEH

SEQ ID NO: 2924348 - protein, 48 aa, Entamoeba invadens
YTQQDSETNDTNQHQLAANSRNNNDNSNQNSNDTENTTTPTATTQQSD

SEQ ID NO: 2924349 - protein, 10 aa, Entamoeba invadens
YTQRTKANTM

SEQ ID NO: 2924350 - protein, 5 aa, Entamoeba invadens
YTQSE

SEQ ID NO: 2924351 - protein, 26 aa, Entamoeba invadens
YTQTEDVEEIKADETDEEKKTRIKQK

SEQ ID NO: 2924352 - protein, 18 aa, Entamoeba invadens
YTQTNDDGIGRNTEETKR

SEQ ID NO: 2924353 - protein, 5 aa, Entamoeba invadens
YTQTQ

SEQ ID NO: 2924354 - protein, 11 aa, Entamoeba invadens
YTQVNKSPVVE

SEQ ID NO: 2924355 - protein, 19 aa, Entamoeba invadens
YTQYNRKKYGNNIPSGVSS

SEQ ID NO: 2924356 - protein, 12 aa, Entamoeba invadens
YTRDNTSHKKSV

SEQ ID NO: 2924357 - protein, 23 aa, Entamoeba invadens
YTRERTKRGCTADKSVTKKNVGR

SEQ ID NO: 2924358 - protein, 9 aa, Entamoeba invadens
YTSAKTGMN

SEQ ID NO: 2924359 - protein, 8 aa, Entamoeba invadens
YTSANGSC

SEQ ID NO: 2924360 - protein, 9 aa, Entamoeba invadens
YTSAPPEEE

SEQ ID NO: 2924361 - protein, 8 aa, Entamoeba invadens
YTSDNSAF

SEQ ID NO: 2924362 - protein, 7 aa, Entamoeba invadens
YTSDYNS

SEQ ID NO: 2924363 - protein, 6 aa, Entamoeba invadens
YTSEGS

SEQ ID NO: 2924364 - protein, 6 aa, Entamoeba invadens
YTSEPY

SEQ ID NO: 2924365 - protein, 4 aa, Entamoeba invadens
YTSK

SEQ ID NO: 2924366 - protein, 8 aa, Entamoeba invadens
YTSKDNRY

SEQ ID NO: 2924367 - protein, 7 aa, Entamoeba invadens
YTSKGND

SEQ ID NO: 2924368 - protein, 6 aa, Entamoeba invadens
YTSKKH

SEQ ID NO: 2924369 - protein, 11 aa, Entamoeba invadens
YTSKNRNRFGN

SEQ ID NO: 2924370 - protein, 4 aa, Entamoeba invadens
YTSN

SEQ ID NO: 2924371 - protein, 8 aa, Entamoeba invadens
YTSPERKE

SEQ ID NO: 2924372 - protein, 6 aa, Entamoeba invadens
YTSPLE

SEQ ID NO: 2924373 - protein, 10 aa, Entamoeba invadens
YTSPSVRPKI

SEQ ID NO: 2924374 - protein, 7 aa, Entamoeba invadens
YTSPYQR

SEQ ID NO: 2924375 - protein, 5 aa, Entamoeba invadens
YTSQT

SEQ ID NO: 2924376 - protein, 4 aa, Entamoeba invadens
YTSR

SEQ ID NO: 2924377 - protein, 14 aa, Entamoeba invadens
YTSRGYSSTQIPKN

SEQ ID NO: 2924378 - protein, 6 aa, Entamoeba invadens
YTSSGN

SEQ ID NO: 2924379 - protein, 12 aa, Entamoeba invadens
YTSSNDEVGSVD

SEQ ID NO: 2924380 - protein, 9 aa, Entamoeba invadens
YTSSSEKIF

SEQ ID NO: 2924381 - protein, 7 aa, Entamoeba invadens
YTSTASY

SEQ ID NO: 2924382 - protein, 16 aa, Entamoeba invadens
YTSTEKGGRQDNEKGL

SEQ ID NO: 2924383 - protein, 8 aa, Entamoeba invadens
YTSTETEF

SEQ ID NO: 2924384 - protein, 4 aa, Entamoeba invadens
YTSV

SEQ ID NO: 2924385 - protein, 4 aa, Entamoeba invadens
YTSY

SEQ ID NO: 2924386 - protein, 6 aa, Entamoeba invadens
YTSYDK

SEQ ID NO: 2924387 - protein, 7 aa, Entamoeba invadens
YTTADPQ

SEQ ID NO: 2924388 - protein, 9 aa, Entamoeba invadens
YTTEEGQRE

SEQ ID NO: 2924389 - protein, 9 aa, Entamoeba invadens
YTTEKSKVA

SEQ ID NO: 2924390 - protein, 6 aa, Entamoeba invadens
YTTESG

SEQ ID NO: 2924391 - protein, 5 aa, Entamoeba invadens
YTTHT

SEQ ID NO: 2924392 - protein, 4 aa, Entamoeba invadens
YTTK

SEQ ID NO: 2924393 - protein, 9 aa, Entamoeba invadens
YTTKDQKKF

SEQ ID NO: 2924394 - protein, 7 aa, Entamoeba invadens
YTTKNDI

SEQ ID NO: 2924395 - protein, 18 aa, Entamoeba invadens
YTTLQTEKETTEKEKECE

SEQ ID NO: 2924396 - protein, 9 aa, Entamoeba invadens
YTTNRKEYN

SEQ ID NO: 2924397 - protein, 12 aa, Entamoeba invadens
YTTNTDTTTTIG

SEQ ID NO: 2924398 - protein, 6 aa, Entamoeba invadens
YTTPDL

SEQ ID NO: 2924399 - protein, 5 aa, Entamoeba invadens
YTTPN

SEQ ID NO: 2924400 - protein, 9 aa, Entamoeba invadens
YTTPPENGL

SEQ ID NO: 2924401 - protein, 8 aa, Entamoeba invadens
YTTPSKDV

SEQ ID NO: 2924402 - protein, 10 aa, Entamoeba invadens
YTTPSRDECF

SEQ ID NO: 2924403 - protein, 11 aa, Entamoeba invadens
YTTQDNPPRGE

SEQ ID NO: 2924404 - protein, 8 aa, Entamoeba invadens
YTTQHSEN

SEQ ID NO: 2924405 - protein, 5 aa, Entamoeba invadens
YTTQQ

SEQ ID NO: 2924406 - protein, 5 aa, Entamoeba invadens
YTTQR

SEQ ID NO: 2924407 - protein, 10 aa, Entamoeba invadens
YTTQREADTY

SEQ ID NO: 2924408 - protein, 9 aa, Entamoeba invadens
YTTRGATFD

SEQ ID NO: 2924409 - protein, 5 aa, Entamoeba invadens
YTTRK

SEQ ID NO: 2924410 - protein, 4 aa, Entamoeba invadens
YTTS

SEQ ID NO: 2924411 - protein, 6 aa, Entamoeba invadens
YTTSDI

SEQ ID NO: 2924412 - protein, 10 aa, Entamoeba invadens
YTTSKNNYKQ

SEQ ID NO: 2924413 - protein, 8 aa, Entamoeba invadens
YTTSPQEI

SEQ ID NO: 2924414 - protein, 4 aa, Entamoeba invadens
YTTT

SEQ ID NO: 2924415 - protein, 20 aa, Entamoeba invadens
YTTTDTKLQKMNKDKRPDVN

SEQ ID NO: 2924416 - protein, 5 aa, Entamoeba invadens
YTTTP

SEQ ID NO: 2924417 - protein, 6 aa, Entamoeba invadens
YTTTSE

SEQ ID NO: 2924418 - protein, 19 aa, Entamoeba invadens
YTTTSQPFTIQNDSETKIK

SEQ ID NO: 2924419 - protein, 6 aa, Entamoeba invadens
YTTVPT

SEQ ID NO: 2924420 - protein, 5 aa, Entamoeba invadens
YTTWN

SEQ ID NO: 2924421 - protein, 16 aa, Entamoeba invadens
YTYNTKETTPESQSNI

SEQ ID NO: 2924422 - protein, 10 aa, Entamoeba invadens
YTYQSTYERK

SEQ ID NO: 2924423 - protein, 6 aa, Entamoeba invadens
YTYSGD

SEQ ID NO: 2924424 - protein, 10 aa, Entamoeba invadens
YVDETSKNQL

SEQ ID NO: 2924425 - protein, 4 aa, Entamoeba invadens
YVDQ

SEQ ID NO: 2924426 - protein, 14 aa, Entamoeba invadens
YVEAQKKCDEMNKR

SEQ ID NO: 2924427 - protein, 8 aa, Entamoeba invadens
YVEDDDAT

SEQ ID NO: 2924428 - protein, 6 aa, Entamoeba invadens
YVEKSS

SEQ ID NO: 2924429 - protein, 9 aa, Entamoeba invadens
YVEREEAEA

SEQ ID NO: 2924430 - protein, 5 aa, Entamoeba invadens
YVGDE

SEQ ID NO: 2924431 - protein, 6 aa, Entamoeba invadens
YVGKSS

SEQ ID NO: 2924432 - protein, 7 aa, Entamoeba invadens
YVGNGLK

SEQ ID NO: 2924433 - protein, 5 aa, Entamoeba invadens
YVGYQ

SEQ ID NO: 2924434 - protein, 8 aa, Entamoeba invadens
YVKEPPTI

SEQ ID NO: 2924435 - protein, 39 aa, Entamoeba invadens
YVPDAVPSKKAAPLKKKQPKAYKSNKGLQLGKKKQSDQI

SEQ ID NO: 2924436 - protein, 11 aa, Entamoeba invadens
YVPDSKNESLH

SEQ ID NO: 2924437 - protein, 22 aa, Entamoeba invadens
YVPEESKHKESKPIDTNKKVTP

SEQ ID NO: 2924438 - protein, 10 aa, Entamoeba invadens
YVPENTQISE

SEQ ID NO: 2924439 - protein, 10 aa, Entamoeba invadens
YVPKSKRKEM

SEQ ID NO: 2924440 - protein, 9 aa, Entamoeba invadens
YVPNDPQNE

SEQ ID NO: 2924441 - protein, 10 aa, Entamoeba invadens
YVPPKTSKVK

SEQ ID NO: 2924442 - protein, 7 aa, Entamoeba invadens
YVPPRHS

SEQ ID NO: 2924443 - protein, 15 aa, Entamoeba invadens
YVPQDTKELSSKDGK

SEQ ID NO: 2924444 - protein, 6 aa, Entamoeba invadens
YVPQNG

SEQ ID NO: 2924445 - protein, 7 aa, Entamoeba invadens
YVPSNTN

SEQ ID NO: 2924446 - protein, 21 aa, Entamoeba invadens
YVPSRSKETEANLKDVAKGAD

SEQ ID NO: 2924447 - protein, 7 aa, Entamoeba invadens
YVPTEDG

SEQ ID NO: 2924448 - protein, 9 aa, Entamoeba invadens
YVPTPEEEL

SEQ ID NO: 2924449 - protein, 34 aa, Entamoeba invadens
YVPTPEKKKPKKSVEKSMETVTSEESASENTYSK

SEQ ID NO: 2924450 - protein, 7 aa, Entamoeba invadens
YVPTPQS

SEQ ID NO: 2924451 - protein, 8 aa, Entamoeba invadens
YVQPPTYI

SEQ ID NO: 2924452 - protein, 16 aa, Entamoeba invadens
YVREEDNVKEKVCYYI

SEQ ID NO: 2924453 - protein, 10 aa, Entamoeba invadens
YVRQPSGPGC

SEQ ID NO: 2924454 - protein, 17 aa, Entamoeba invadens
YVRSQGAKGYEVGEKYL

SEQ ID NO: 2924455 - protein, 7 aa, Entamoeba invadens
YVSGGNF

SEQ ID NO: 2924456 - protein, 5 aa, Entamoeba invadens
YVSSE

SEQ ID NO: 2924457 - protein, 28 aa, Entamoeba invadens
YVSTNDNVDEKSISKEYELPDKTSITIG

SEQ ID NO: 2924458 - protein, 7 aa, Entamoeba invadens
YVTDAGN

SEQ ID NO: 2924459 - protein, 12 aa, Entamoeba invadens
YVTSKTKVEEIT

SEQ ID NO: 2924460 - protein, 4 aa, Entamoeba invadens
YVTT

SEQ ID NO: 2924461 - protein, 5 aa, Entamoeba invadens
YWPEQ

SEQ ID NO: 2924462 - protein, 14 aa, Entamoeba invadens
YYCQSTDSSYNKET

SEQ ID NO: 2924463 - protein, 4 aa, Entamoeba invadens
YYDE

SEQ ID NO: 2924464 - protein, 12 aa, Entamoeba invadens
YYDENGKELIGG

SEQ ID NO: 2924465 - protein, 5 aa, Entamoeba invadens
YYDKT

SEQ ID NO: 2924466 - protein, 12 aa, Entamoeba invadens
YYDKTTKNCVSN

SEQ ID NO: 2924467 - protein, 17 aa, Entamoeba invadens
YYDPRSSTENVVDGRRT

SEQ ID NO: 2924468 - protein, 20 aa, Entamoeba invadens
YYDPSPEAQAARDIKEDKGE

SEQ ID NO: 2924469 - protein, 12 aa, Entamoeba invadens
YYDTKKNDLNAP

SEQ ID NO: 2924470 - protein, 8 aa, Entamoeba invadens
YYEEKSND

SEQ ID NO: 2924471 - protein, 5 aa, Entamoeba invadens
YYENM

SEQ ID NO: 2924472 - protein, 12 aa, Entamoeba invadens
YYENTKGKKIEK

SEQ ID NO: 2924473 - protein, 11 aa, Entamoeba invadens
YYETSKPWDIP

SEQ ID NO: 2924474 - protein, 8 aa, Entamoeba invadens
YYGEDGET

SEQ ID NO: 2924475 - protein, 8 aa, Entamoeba invadens
YYGEGDAK

SEQ ID NO: 2924476 - protein, 6 aa, Entamoeba invadens
YYGGSN

SEQ ID NO: 2924477 - protein, 5 aa, Entamoeba invadens
YYGNE

SEQ ID NO: 2924478 - protein, 6 aa, Entamoeba invadens
YYGNGE

SEQ ID NO: 2924479 - protein, 7 aa, Entamoeba invadens
YYKDDTK

SEQ ID NO: 2924480 - protein, 6 aa, Entamoeba invadens
YYKDEA

SEQ ID NO: 2924481 - protein, 7 aa, Entamoeba invadens
YYKKPAD

SEQ ID NO: 2924482 - protein, 8 aa, Entamoeba invadens
YYKPNDKW

SEQ ID NO: 2924483 - protein, 8 aa, Entamoeba invadens
YYKPSYSV

SEQ ID NO: 2924484 - protein, 7 aa, Entamoeba invadens
YYKQKTD

SEQ ID NO: 2924485 - protein, 5 aa, Entamoeba invadens
YYNDT

SEQ ID NO: 2924486 - protein, 4 aa, Entamoeba invadens
YYNP

SEQ ID NO: 2924487 - protein, 19 aa, Entamoeba invadens
YYNPEEDITKTKKEKKCRI

SEQ ID NO: 2924488 - protein, 13 aa, Entamoeba invadens
YYNPNSKSCQSND

SEQ ID NO: 2924489 - protein, 7 aa, Entamoeba invadens
YYPASNG

SEQ ID NO: 2924490 - protein, 11 aa, Entamoeba invadens
YYPDSKDAENL

SEQ ID NO: 2924491 - protein, 8 aa, Entamoeba invadens
YYPDSNGK

SEQ ID NO: 2924492 - protein, 9 aa, Entamoeba invadens
YYPEPEDKK

SEQ ID NO: 2924493 - protein, 12 aa, Entamoeba invadens
YYPKTSGDYKCQ

SEQ ID NO: 2924494 - protein, 5 aa, Entamoeba invadens
YYPKY

SEQ ID NO: 2924495 - protein, 4 aa, Entamoeba invadens
YYPN

SEQ ID NO: 2924496 - protein, 10 aa, Entamoeba invadens
YYPPDGLKTP

SEQ ID NO: 2924497 - protein, 5 aa, Entamoeba invadens
YYPPE

SEQ ID NO: 2924498 - protein, 5 aa, Entamoeba invadens
YYPSN

SEQ ID NO: 2924499 - protein, 5 aa, Entamoeba invadens
YYQDS

SEQ ID NO: 2924500 - protein, 14 aa, Entamoeba invadens
YYQNMTKKTTKPIV

SEQ ID NO: 2924501 - protein, 23 aa, Entamoeba invadens
YYQQPDKPNVTTPTPKPKPQNSV

SEQ ID NO: 2924502 - protein, 12 aa, Entamoeba invadens
YYQTDAKNIENK

SEQ ID NO: 2924503 - protein, 4 aa, Entamoeba invadens
YYRG

SEQ ID NO: 2924504 - protein, 5 aa, Entamoeba invadens
YYRGS

SEQ ID NO: 2924505 - protein, 6 aa, Entamoeba invadens
YYRGSN

SEQ ID NO: 2924506 - protein, 5 aa, Entamoeba invadens
YYRGT

SEQ ID NO: 2924507 - protein, 4 aa, Entamoeba invadens
YYRN

SEQ ID NO: 2924508 - protein, 4 aa, Entamoeba invadens
YYRS

SEQ ID NO: 2924509 - protein, 7 aa, Entamoeba invadens
YYRSGDG

SEQ ID NO: 2924510 - protein, 8 aa, Entamoeba invadens
YYSDSSKE

SEQ ID NO: 2924511 - protein, 30 aa, Entamoeba invadens
YYSEETTKQVQLSPTQKTQITGPKRSTMRS

SEQ ID NO: 2924512 - protein, 6 aa, Entamoeba invadens
YYSGGG

SEQ ID NO: 2924513 - protein, 4 aa, Entamoeba invadens
YYSN

SEQ ID NO: 2924514 - protein, 8 aa, Entamoeba invadens
YYSNNGTC

SEQ ID NO: 2924515 - protein, 13 aa, Entamoeba invadens
YYSQDDKLRYGDS

SEQ ID NO: 2924516 - protein, 10 aa, Entamoeba invadens
YYSTEDTFEV

SEQ ID NO: 2924517 - protein, 10 aa, Entamoeba invadens
YYSTNDQSIN

SEQ ID NO: 2924518 - protein, 11 aa, Entamoeba invadens
YYTDNKSCKKC

SEQ ID NO: 2924519 - protein, 19 aa, Entamoeba invadens
YYTDSNTLELTKTKTISRH

SEQ ID NO: 2924520 - protein, 20 aa, Entamoeba invadens
YYTKEKTQTEQTKQEGKEVL

SEQ ID NO: 2924521 - protein, 9 aa, Entamoeba invadens
YYTRSHKKT

SEQ ID NO: 2924522 - protein, 6 aa, Entamoeba invadens
YYTTDK

SEQ ID NO: 2924523 - protein, 25 aa, Entamoeba invadens
VRDIKEKLCYVALDFNEEMQKAASS

SEQ ID NO: 2924524 - protein, 18 aa, Entamoeba invadens
DVDIRKDLYGNIVLSGGT

SEQ ID NO: 2924525 - protein, 25 aa, Entamoeba invadens
ERFRCPEALFQPSFLGMEASGIHET

SEQ ID NO: 2924526 - protein, 19 aa, Entamoeba invadens
GSGMCKAGFAGDDAPRAVF

SEQ ID NO: 2924527 - protein, 18 aa, Entamoeba invadens
KGKCKLISYFNEKKKLVL

SEQ ID NO: 2924528 - protein, 17 aa, Entamoeba invadens
LYGNIVLSGGTSMYPGI

SEQ ID NO: 2924529 - protein, 17 aa, Entamoeba invadens
MKILTERGYAFTTTAER

SEQ ID NO: 2924530 - protein, 18 aa, Entamoeba invadens
VVRDMVLPMLCRGNKFTV

SEQ ID NO: 2924531 - protein, 22 aa, Entamoeba invadens
DVRIKRGIVGSGVVKVVPAITP

SEQ ID NO: 2924532 - protein, 17 aa, Entamoeba invadens
FFCTLRLSHYLASCGCQ

SEQ ID NO: 2924533 - protein, 25 aa, Entamoeba invadens
ECNVNCKLFVACMFFTQIVLSKVKI

SEQ ID NO: 2924534 - protein, 23 aa, Entamoeba invadens
HLCSYKGHMWAKVFIKSKPGRYG

SEQ ID NO: 2924535 - protein, 18 aa, Entamoeba invadens
IRALYDMIDIAALNAYKT

SEQ ID NO: 2924536 - protein, 17 aa, Entamoeba invadens
QGFRVVRDMVLPMLCRG

SEQ ID NO: 2924537 - protein, 24 aa, Entamoeba invadens
AKNHIKGAVLKLVQRSETRWLQTV

SEQ ID NO: 2924538 - protein, 18 aa, Entamoeba invadens
DVRNCVCFAIATDTYKKD

SEQ ID NO: 2924539 - protein, 18 aa, Entamoeba invadens
FESQWGLAIESFLDGLTV

SEQ ID NO: 2924540 - protein, 31 aa, Entamoeba invadens
KTDAAGWLSWIMKILELMDADLIKCIGACFD

SEQ ID NO: 2924541 - protein, 19 aa, Entamoeba invadens
FLDLRKRAFKFPTMGKKAR

SEQ ID NO: 2924542 - protein, 18 aa, Entamoeba invadens
FWMCADCETGMTLNLQMY

SEQ ID NO: 2924543 - protein, 24 aa, Entamoeba invadens
KCIGACFDGAYVLIRNGGLSGKLL

SEQ ID NO: 2924544 - protein, 25 aa, Entamoeba invadens
RTSRWNVRILYDLLDIAALNAYKVY

SEQ ID NO: 2924545 - protein, 37 aa, Entamoeba invadens
YKKDGITFVAIFIRVCMKFDFYECPLLLSEYYGESDG

SEQ ID NO: 2924546 - protein, 19 aa, Entamoeba invadens
YMCEKCTKLTRVVLPDNLI

SEQ ID NO: 2924547 - protein, 24 aa, Entamoeba invadens
AEHKRRGSIERAKENIGMFRQAQQ

SEQ ID NO: 2924548 - protein, 24 aa, Entamoeba invadens
CNVNCKLFVACMFFTQIVLSKVKI

SEQ ID NO: 2924549 - protein, 24 aa, Entamoeba invadens
DMSEYKGKFIVLLFYPLDWTFVCP

SEQ ID NO: 2924550 - protein, 21 aa, Entamoeba invadens
ETNLNLPICRNHVGWKEGAVG

SEQ ID NO: 2924551 - protein, 25 aa, Entamoeba invadens
FIKSKPGRYGIKFWMCADCETGMTL

SEQ ID NO: 2924552 - protein, 31 aa, Entamoeba invadens
FIKSKPGRYGIKFWMCADCETGMTLNLQMYC

SEQ ID NO: 2924553 - protein, 25 aa, Entamoeba invadens
FNLQSRLVVRLTLFNITKQTICNLF

SEQ ID NO: 2924554 - protein, 25 aa, Entamoeba invadens
HMTCSCGHQFCWLCMADYTNTHFKS

SEQ ID NO: 2924555 - protein, 17 aa, Entamoeba invadens
IKFWMCADCETGMTLNL

SEQ ID NO: 2924556 - protein, 25 aa, Entamoeba invadens
ISSRNSFRVATDFNVLAKSAFLCEI

SEQ ID NO: 2924557 - protein, 18 aa, Entamoeba invadens
KYGLLKRDYESLVNIAHS

SEQ ID NO: 2924558 - protein, 20 aa, Entamoeba invadens
LNLFKSCANLEELVISKNVT

SEQ ID NO: 2924559 - protein, 26 aa, Entamoeba invadens
LTVYKCNWDPSFVLENEWVLADSGYR

SEQ ID NO: 2924560 - protein, 19 aa, Entamoeba invadens
NQFPCLFNLVKKMNAKSPT

SEQ ID NO: 2924561 - protein, 18 aa, Entamoeba invadens
QLGIKYTKKNGGVYYRII

SEQ ID NO: 2924562 - protein, 20 aa, Entamoeba invadens
RAERAYLCFHCSSYQKGVGS

SEQ ID NO: 2924563 - protein, 23 aa, Entamoeba invadens
RDTKELKKKFMLARSKDKKPEEI

SEQ ID NO: 2924564 - protein, 23 aa, Entamoeba invadens
RNSMPRDMFKFISSHIETYDVGQ

SEQ ID NO: 2924565 - protein, 24 aa, Entamoeba invadens
SISDGCFRGCFALSSVSLCSTVTR

SEQ ID NO: 2924566 - protein, 22 aa, Entamoeba invadens
TGVLKPGMFLTFAPTGVTSECK

SEQ ID NO: 2924567 - protein, 24 aa, Entamoeba invadens
TKICPKCKNPIRKNGGCNHMTCSC

SEQ ID NO: 2924568 - protein, 25 aa, Entamoeba invadens
YRNSMPRDMFKFISSHIETYDVGQP

SEQ ID NO: 2924569 - protein, 24 aa, Entamoeba invadens
YSPECAKCKASAPMMDKLADEHTN

SEQ ID NO: 2924570 - protein, 24 aa, Entamoeba invadens
YSPECAQCKASAPMLEKLSEEHKN

SEQ ID NO: 2924571 - protein, 21 aa, Entamoeba invadens
YTKGVCKLLSYYNEKKKLVLI

SEQ ID NO: 2924572 - protein, 17 aa, Entamoeba invadens
AEKIFPIDNVYIRKVKI

SEQ ID NO: 2924573 - protein, 26 aa, Entamoeba invadens
AEMGKGSFKYAWVLDNLKAERERGIT

SEQ ID NO: 2924574 - protein, 24 aa, Entamoeba invadens
AHIDARLAPTIGIAVDRKRRNLSQ

SEQ ID NO: 2924575 - protein, 23 aa, Entamoeba invadens
AKNHIKGAVLKLVQRSETRWLQT

SEQ ID NO: 2924576 - protein, 21 aa, Entamoeba invadens
AKNSLKDALIAKINLVEFLDF

SEQ ID NO: 2924577 - protein, 24 aa, Entamoeba invadens
AKRTCWPRVRGVAMNPVEHPHGGG

SEQ ID NO: 2924578 - protein, 25 aa, Entamoeba invadens
CAKNHIKGAVLKLVQRSETRWLQTV

SEQ ID NO: 2924579 - protein, 20 aa, Entamoeba invadens
CKAPIGIDLIKFKGACDILF

SEQ ID NO: 2924580 - protein, 17 aa, Entamoeba invadens
CKFFHLEAKIDRRTGKA

SEQ ID NO: 2924581 - protein, 18 aa, Entamoeba invadens
CNSTKLKEYYTFCNSNNI

SEQ ID NO: 2924582 - protein, 31 aa, Entamoeba invadens
DDATSLLRPFPCGEVGEIIFSESLMNEINDE

SEQ ID NO: 2924583 - protein, 25 aa, Entamoeba invadens
DDNYYYCVICEKWLTRGVKNNHKCH

SEQ ID NO: 2924584 - protein, 20 aa, Entamoeba invadens
DFFGKKGMRVFHAKPNLKYC

SEQ ID NO: 2924585 - protein, 23 aa, Entamoeba invadens
DFNLSKHIICLSKLNESETCEFS

SEQ ID NO: 2924586 - protein, 17 aa, Entamoeba invadens
DQFCAKNHIKGAVLKLV

SEQ ID NO: 2924587 - protein, 24 aa, Entamoeba invadens
EAIIEKLILLKAFLVDLVAVIITK

SEQ ID NO: 2924588 - protein, 23 aa, Entamoeba invadens
EDVPQCVIDGSFIKDLVEKKLSK

SEQ ID NO: 2924589 - protein, 17 aa, Entamoeba invadens
EELTELINLTRFSPSAK

SEQ ID NO: 2924590 - protein, 20 aa, Entamoeba invadens
EFKLSHKWRYILFKMNDKMT

SEQ ID NO: 2924591 - protein, 20 aa, Entamoeba invadens
EGMKPILTCDVWEHAYYIDT

SEQ ID NO: 2924592 - protein, 25 aa, Entamoeba invadens
EKEKCVKLSLKYNVLSKYTTFVAID

SEQ ID NO: 2924593 - protein, 17 aa, Entamoeba invadens
EKKRYNAILKRYTLLKA

SEQ ID NO: 2924594 - protein, 20 aa, Entamoeba invadens
ELKMRCETEADDGECGLHFF

SEQ ID NO: 2924595 - protein, 20 aa, Entamoeba invadens
ERYISAFIVDIEITKVNKHL

SEQ ID NO: 2924596 - protein, 23 aa, Entamoeba invadens
ESDGESMCEWIFNALAFDINKEV

SEQ ID NO: 2924597 - protein, 24 aa, Entamoeba invadens
EYPPLGRFAVRDMKQTVAVGVVKA

SEQ ID NO: 2924598 - protein, 25 aa, Entamoeba invadens
FANPLRKSTCFEIFEEYHLKEYELE

SEQ ID NO: 2924599 - protein, 29 aa, Entamoeba invadens
FDAELKLAGQFGLKCKREIQRVHFMLGHM

SEQ ID NO: 2924600 - protein, 20 aa, Entamoeba invadens
FELKSVTKITIWNCTHPTFL

SEQ ID NO: 2924601 - protein, 24 aa, Entamoeba invadens
FEQCLRNSIELSKRFREMCVNFKA

SEQ ID NO: 2924602 - protein, 19 aa, Entamoeba invadens
FESLLGLGYQVIYIDHHRL

SEQ ID NO: 2924603 - protein, 24 aa, Entamoeba invadens
FFPYHYKPEFEIFGQYLAKAQIFS

SEQ ID NO: 2924604 - protein, 17 aa, Entamoeba invadens
FILKKYSIHLLVKLSDA

SEQ ID NO: 2924605 - protein, 23 aa, Entamoeba invadens
FLCDLPHNAVCYFHNLKYDGSFL

SEQ ID NO: 2924606 - protein, 20 aa, Entamoeba invadens
FPGLKNLFCECVEKCTNVIL

SEQ ID NO: 2924607 - protein, 31 aa, Entamoeba invadens
FPSHIKSVGYYSCFSCANLKEVVLPEGITEI

SEQ ID NO: 2924608 - protein, 25 aa, Entamoeba invadens
FSDEHGDVCPLNWKPGKDTMKPTPE

SEQ ID NO: 2924609 - protein, 20 aa, Entamoeba invadens
GAPKNCIQWIEFGGIEASNK

SEQ ID NO: 2924610 - protein, 21 aa, Entamoeba invadens
GAVGKTCLLISYTTNAFPNEY

SEQ ID NO: 2924611 - protein, 18 aa, Entamoeba invadens
GHVKLCAYYITYPYKDLN

SEQ ID NO: 2924612 - protein, 21 aa, Entamoeba invadens
GKDCLMVFHSLKLTTDKLRSI

SEQ ID NO: 2924613 - protein, 21 aa, Entamoeba invadens
GLDVLPEFQHRGLAQQLMRHF

SEQ ID NO: 2924614 - protein, 23 aa, Entamoeba invadens
GRKFVREDMKVFTFITKKSESAF

SEQ ID NO: 2924615 - protein, 18 aa, Entamoeba invadens
GRTVDFKNTVIIMTSNLG

SEQ ID NO: 2924616 - protein, 25 aa, Entamoeba invadens
GSFCGSCPKAGGKYCKKYYLEDILR

SEQ ID NO: 2924617 - protein, 34 aa, Entamoeba invadens
GTPLRCILEGKKYIRDIICGIMFLHEQGIVHMDI

SEQ ID NO: 2924618 - protein, 22 aa, Entamoeba invadens
GVHCPAHRCNLFAQDVGMEAPF

SEQ ID NO: 2924619 - protein, 21 aa, Entamoeba invadens
HCPKTPCLLVGTKLDMREDKD

SEQ ID NO: 2924620 - protein, 25 aa, Entamoeba invadens
HINKRAKISFGCFEGCVGLTSLEIP

SEQ ID NO: 2924621 - protein, 23 aa, Entamoeba invadens
HNFYCSAGANFPAIVGKESIMED

SEQ ID NO: 2924622 - protein, 18 aa, Entamoeba invadens
HYFDCIFGPFKPYVLKGI

SEQ ID NO: 2924623 - protein, 24 aa, Entamoeba invadens
IDLIKFKGACDILFSDSSKDEKVT

SEQ ID NO: 2924624 - protein, 19 aa, Entamoeba invadens
IFGPFKPYVLKGINLIETQ

SEQ ID NO: 2924625 - protein, 18 aa, Entamoeba invadens
IGLSRAGRRTTLIGCIAL

SEQ ID NO: 2924626 - protein, 19 aa, Entamoeba invadens
ILDLLKLVRIKSENVRFIP

SEQ ID NO: 2924627 - protein, 28 aa, Entamoeba invadens
ILVENHFGRLIILFKLMRNKYGLLKRDY

SEQ ID NO: 2924628 - protein, 18 aa, Entamoeba invadens
IPLQDVYKISGIGTVPVG

SEQ ID NO: 2924629 - protein, 19 aa, Entamoeba invadens
IQHRKHIRALFKKEAEDFL

SEQ ID NO: 2924630 - protein, 25 aa, Entamoeba invadens
KDVRIKRGIVGSGVVKVVPAITPNA

SEQ ID NO: 2924631 - protein, 19 aa, Entamoeba invadens
KEVLFPLRKFIGSTQDGAS

SEQ ID NO: 2924632 - protein, 25 aa, Entamoeba invadens
KEWYNVKVPKNFKRRNVGQIVVNKT

SEQ ID NO: 2924633 - protein, 19 aa, Entamoeba invadens
KGCFDMCSSLTKIVLPQNI

SEQ ID NO: 2924634 - protein, 18 aa, Entamoeba invadens
KKEAEDFLKSCPVKKLTL

SEQ ID NO: 2924635 - protein, 24 aa, Entamoeba invadens
KKPLRKFPFYLFKRMADGDYSTPI

SEQ ID NO: 2924636 - protein, 18 aa, Entamoeba invadens
KMVGLAIFYYKRRKEKEV

SEQ ID NO: 2924637 - protein, 19 aa, Entamoeba invadens
KPLRIPLQDVYKISGIGTV

SEQ ID NO: 2924638 - protein, 19 aa, Entamoeba invadens
KQFLEQVIRDSVTYTEHGK

SEQ ID NO: 2924639 - protein, 18 aa, Entamoeba invadens
KREIQRVHFMLGHMRTIA

SEQ ID NO: 2924640 - protein, 27 aa, Entamoeba invadens
KRYNAILKRYTLLKAHGVKVVSFADTE

SEQ ID NO: 2924641 - protein, 22 aa, Entamoeba invadens
KSPTTCPVERSFNKIGQLDRAN

SEQ ID NO: 2924642 - protein, 19 aa, Entamoeba invadens
KTLKSACRAMIGLIAGGGR

SEQ ID NO: 2924643 - protein, 23 aa, Entamoeba invadens
KVHTWFKQPFRAVRRHQVRVTKA

SEQ ID NO: 2924644 - protein, 19 aa, Entamoeba invadens
KYFNFCYNGNYTFTDKNIE

SEQ ID NO: 2924645 - protein, 26 aa, Entamoeba invadens
KYNYKLRLGKGFTLAELRAAHIDARL

SEQ ID NO: 2924646 - protein, 18 aa, Entamoeba invadens
KYSIHLLVKLSDAMILRF

SEQ ID NO: 2924647 - protein, 24 aa, Entamoeba invadens
LANIPHCAFFRCYKLSEISVPNSV

SEQ ID NO: 2924648 - protein, 19 aa, Entamoeba invadens
LAQQLMRHFIKNAKENGRL

SEQ ID NO: 2924649 - protein, 17 aa, Entamoeba invadens
LEGNALLRRLHNLGILP

SEQ ID NO: 2924650 - protein, 22 aa, Entamoeba invadens
LERRLQTIVFRKGFAKSIHHAR

SEQ ID NO: 2924651 - protein, 19 aa, Entamoeba invadens
LESYMARLTVLPMHKSAKA

SEQ ID NO: 2924652 - protein, 21 aa, Entamoeba invadens
LKIHQCTNFSIGLMSKTKEVD

SEQ ID NO: 2924653 - protein, 25 aa, Entamoeba invadens
LKKDFLEKLETVFGLQEEGYYDEAK

SEQ ID NO: 2924654 - protein, 20 aa, Entamoeba invadens
LKSALQLFLRQLPTDSTFDI

SEQ ID NO: 2924655 - protein, 19 aa, Entamoeba invadens
LPNNLRVLQPYTFCQCNSL

SEQ ID NO: 2924656 - protein, 26 aa, Entamoeba invadens
LRQEELRKIVKMQMKDIVARIKKSYP

SEQ ID NO: 2924657 - protein, 19 aa, Entamoeba invadens
LRVLQPYTFCQCNSLIDIN

SEQ ID NO: 2924658 - protein, 17 aa, Entamoeba invadens
LSDLILYIRDHNGFEPY

SEQ ID NO: 2924659 - protein, 20 aa, Entamoeba invadens
LWKFESPKYYFTIIDAPGHR

SEQ ID NO: 2924660 - protein, 20 aa, Entamoeba invadens
MCQECCGITGDGSFEGLGWL

SEQ ID NO: 2924661 - protein, 18 aa, Entamoeba invadens
MCVNFKATTLLGEKIGES

SEQ ID NO: 2924662 - protein, 21 aa, Entamoeba invadens
MLNMYKPILSDGVSLTSSKNK

SEQ ID NO: 2924663 - protein, 22 aa, Entamoeba invadens
NKFSFDEIILLLGAESATYYSE

SEQ ID NO: 2924664 - protein, 27 aa, Entamoeba invadens
NLLQLRPSFEFTKDFKIKSRSQFCRNI

SEQ ID NO: 2924665 - protein, 18 aa, Entamoeba invadens
NPRKVFWTAIYRQLNKKG

SEQ ID NO: 2924666 - protein, 23 aa, Entamoeba invadens
NRSERGRDLFALEVGYKNVLSVR

SEQ ID NO: 2924667 - protein, 24 aa, Entamoeba invadens
PIGQCPEGTVVCNVELKPGDRGHL

SEQ ID NO: 2924668 - protein, 19 aa, Entamoeba invadens
PYNLSICQLYNTLITEPEN

SEQ ID NO: 2924669 - protein, 23 aa, Entamoeba invadens
QQLMRVYGALMWSLGKVMQTPEC

SEQ ID NO: 2924670 - protein, 23 aa, Entamoeba invadens
RFEEFRNYFTFELKTQLPENRLR

SEQ ID NO: 2924671 - protein, 18 aa, Entamoeba invadens
RLNPKCPGMSPKWFAENA

SEQ ID NO: 2924672 - protein, 22 aa, Entamoeba invadens
RNPDYECLKNAYTQFELFSNVV

SEQ ID NO: 2924673 - protein, 23 aa, Entamoeba invadens
SCETFEFNMCPNFTFNFLNTKNT

SEQ ID NO: 2924674 - protein, 23 aa, Entamoeba invadens
SDEHGEVCPLNWKPGKDTMKPSP

SEQ ID NO: 2924675 - protein, 20 aa, Entamoeba invadens
SEFDLNCFTYALKQANVDDE

SEQ ID NO: 2924676 - protein, 24 aa, Entamoeba invadens
SEKCQSCIPGTVLSHGKCVTIFTL

SEQ ID NO: 2924677 - protein, 19 aa, Entamoeba invadens
SFSGFKIPIGKGRKFVRED

SEQ ID NO: 2924678 - protein, 20 aa, Entamoeba invadens
SGLGDEFKGYILKVTGGSDK

SEQ ID NO: 2924679 - protein, 21 aa, Entamoeba invadens
SIASLPTFVFFQNQKVVKKAP

SEQ ID NO: 2924680 - protein, 18 aa, Entamoeba invadens
SIYLASALLVFTMDYNIS

SEQ ID NO: 2924681 - protein, 19 aa, Entamoeba invadens
SKTEYFKAQVIIMNHPGQI

SEQ ID NO: 2924682 - protein, 18 aa, Entamoeba invadens
SSLSKIILFDGLANIPHC

SEQ ID NO: 2924683 - protein, 19 aa, Entamoeba invadens
STKLVFPSHIKSVGYYSCF

SEQ ID NO: 2924684 - protein, 19 aa, Entamoeba invadens
SVRKFSYDKTSSFILERFI

SEQ ID NO: 2924685 - protein, 18 aa, Entamoeba invadens
TIKRCILMSHAAFSRDTL

SEQ ID NO: 2924686 - protein, 20 aa, Entamoeba invadens
TKGVCKLLSYYNEKKKLVLI

SEQ ID NO: 2924687 - protein, 22 aa, Entamoeba invadens
TKRVVEIIQSFKIACVNNNTSA

SEQ ID NO: 2924688 - protein, 18 aa, Entamoeba invadens
TKSVLLFNIENFIFSNTF

SEQ ID NO: 2924689 - protein, 22 aa, Entamoeba invadens
TLKNGCYHEDIGFGSSALKTNP

SEQ ID NO: 2924690 - protein, 23 aa, Entamoeba invadens
TLNCNFLPISFDYLLKPIYIRNY

SEQ ID NO: 2924691 - protein, 23 aa, Entamoeba invadens
TNKFKSVHNFKFFDENFDKFNLI

SEQ ID NO: 2924692 - protein, 17 aa, Entamoeba invadens
VAFPGRRSNLNIDKNEG

SEQ ID NO: 2924693 - protein, 24 aa, Entamoeba invadens
VDLREIITPLALFLGGSGGGHANA

SEQ ID NO: 2924694 - protein, 21 aa, Entamoeba invadens
VEIPDSVTFIGEYCFTSCQKL

SEQ ID NO: 2924695 - protein, 23 aa, Entamoeba invadens
VEYFSLFVRFVFSDGSFVEKRVK

SEQ ID NO: 2924696 - protein, 26 aa, Entamoeba invadens
VIESAVRGCLVRRKYKVNSLLMRKNV

SEQ ID NO: 2924697 - protein, 25 aa, Entamoeba invadens
VKIEYCRDCDFIFGDSKIEQLGIFS

SEQ ID NO: 2924698 - protein, 17 aa, Entamoeba invadens
VNFSDVCYEQFKTLQKL

SEQ ID NO: 2924699 - protein, 25 aa, Entamoeba invadens
VPPKIFFEPHAIRYLKELKELSKIF

SEQ ID NO: 2924700 - protein, 17 aa, Entamoeba invadens
VQCSQGFIMNQAGNCIH

SEQ ID NO: 2924701 - protein, 17 aa, Entamoeba invadens
VRDMVLPMLCRGNKFTV

SEQ ID NO: 2924702 - protein, 17 aa, Entamoeba invadens
VSLDLNLFKSCANLEEL

SEQ ID NO: 2924703 - protein, 17 aa, Entamoeba invadens
VTSLPTFVFFQDQKVAK

SEQ ID NO: 2924704 - protein, 26 aa, Entamoeba invadens
VYLKQCIKSGSLIVTGPFKLSGVPLL

SEQ ID NO: 2924705 - protein, 23 aa, Entamoeba invadens
YCPSINVEGLWALVGAKVQEQYK

SEQ ID NO: 2924706 - protein, 18 aa, Entamoeba invadens
YEDFLRIVPKVQVGEEAP

SEQ ID NO: 2924707 - protein, 17 aa, Entamoeba invadens
YLMKILTERGYAFTTTA

SEQ ID NO: 2924708 - protein, 26 aa, Entamoeba invadens
YNKGEYRWAATVLNHLVFADVNNMKA

SEQ ID NO: 2924709 - protein, 18 aa, Entamoeba invadens
YSKIAVIVKQAYLFTKTF

SEQ ID NO: 2924710 - protein, 18 aa, Entamoeba invadens
AAAKAPGAERIWTPGEKE

SEQ ID NO: 2924711 - protein, 31 aa, Entamoeba invadens
ACAFKNCRQLEVIKIPASVCLVDREAFSDCI

SEQ ID NO: 2924712 - protein, 22 aa, Entamoeba invadens
ADGQPLILLCQINYSEMPKLEN

SEQ ID NO: 2924713 - protein, 18 aa, Entamoeba invadens
ADLVYKTDFVEFTNTSFE

SEQ ID NO: 2924714 - protein, 19 aa, Entamoeba invadens
AEAHPIPCAVFYGNDKDDV

SEQ ID NO: 2924715 - protein, 21 aa, Entamoeba invadens
AESYNGVSIIIAYCPCKEQGV

SEQ ID NO: 2924716 - protein, 26 aa, Entamoeba invadens
AEYNPKRFAGAIMRISSPKSTALIFQ

SEQ ID NO: 2924717 - protein, 17 aa, Entamoeba invadens
AFEKCGIIKLSIPDTVV

SEQ ID NO: 2924718 - protein, 21 aa, Entamoeba invadens
AFLNRIWKYKHGNIIDILGVY

SEQ ID NO: 2924719 - protein, 27 aa, Entamoeba invadens
AFPREMFRYPWEVVNFITGGRRLDKPA

SEQ ID NO: 2924720 - protein, 18 aa, Entamoeba invadens
AFSGCGLTQVSIPTTVTY

SEQ ID NO: 2924721 - protein, 18 aa, Entamoeba invadens
AFSNCKQLKCANLPQTVT

SEQ ID NO: 2924722 - protein, 18 aa, Entamoeba invadens
AGELLPAVIHVASRNIGA

SEQ ID NO: 2924723 - protein, 17 aa, Entamoeba invadens
AGGKCLRFDELAMKAPT

SEQ ID NO: 2924724 - protein, 24 aa, Entamoeba invadens
AGILANKHHLCWTDKRGVHEPNYY

SEQ ID NO: 2924725 - protein, 23 aa, Entamoeba invadens
AGKGRTGLMSAAFLVYMLDALNA

SEQ ID NO: 2924726 - protein, 20 aa, Entamoeba invadens
AGTTQCMFWGLGSDGTVGAN

SEQ ID NO: 2924727 - protein, 19 aa, Entamoeba invadens
AKAKLGLVEMTKHSLVDAY

SEQ ID NO: 2924728 - protein, 23 aa, Entamoeba invadens
AKRLKYEKIDLIVSSPFYRATQT

SEQ ID NO: 2924729 - protein, 18 aa, Entamoeba invadens
AKVGLKVLYKLMDADGDG

SEQ ID NO: 2924730 - protein, 29 aa, Entamoeba invadens
AKYGVNRCIKKGGKIMQMTLKFKGKQLTF

SEQ ID NO: 2924731 - protein, 18 aa, Entamoeba invadens
AKYNLEMFLYRDSLMKGD

SEQ ID NO: 2924732 - protein, 19 aa, Entamoeba invadens
ALDPLNWTGHTGMAVLAPH

SEQ ID NO: 2924733 - protein, 19 aa, Entamoeba invadens
ALGSCAFSRCIKIQTIVIP

SEQ ID NO: 2924734 - protein, 27 aa, Entamoeba invadens
ALKKMRAHRGLRHYWGLRVRGQHTKTT

SEQ ID NO: 2924735 - protein, 22 aa, Entamoeba invadens
ALNQFPKMFGLRNLQKELYPYN

SEQ ID NO: 2924736 - protein, 19 aa, Entamoeba invadens
ALPFSLKYIPPLTFNRCVS

SEQ ID NO: 2924737 - protein, 19 aa, Entamoeba invadens
AMMKVSKNLACNFVVLQPK

SEQ ID NO: 2924738 - protein, 21 aa, Entamoeba invadens
ANKTYAVQCSQGFIMNQAGNC

SEQ ID NO: 2924739 - protein, 21 aa, Entamoeba invadens
ANKYIGGGVLNMGMVQEEILF

SEQ ID NO: 2924740 - protein, 24 aa, Entamoeba invadens
ANLEHLRKSIVPGVICIIVAGKYA

SEQ ID NO: 2924741 - protein, 18 aa, Entamoeba invadens
ANLLPSRHFGAIVYTTSM

SEQ ID NO: 2924742 - protein, 22 aa, Entamoeba invadens
APFDIVTTFIKWLCNSTKLKEY

SEQ ID NO: 2924743 - protein, 27 aa, Entamoeba invadens
APQLCMGNLRLAHYLAQYGSTLLGTVR

SEQ ID NO: 2924744 - protein, 28 aa, Entamoeba invadens
APQLCMGNLRLAHYLAQYGSTLLGTVRK

SEQ ID NO: 2924745 - protein, 19 aa, Entamoeba invadens
AQALCPCNGIVDFDFEKVR

SEQ ID NO: 2924746 - protein, 19 aa, Entamoeba invadens
AQCLCPCGAIKDFDMSEYK

SEQ ID NO: 2924747 - protein, 17 aa, Entamoeba invadens
AQIIFDMYDEMMGGSTP

SEQ ID NO: 2924748 - protein, 17 aa, Entamoeba invadens
AQLTSVFQCPTAVLYTV

SEQ ID NO: 2924749 - protein, 21 aa, Entamoeba invadens
ARQIVLDIFLPQSLYVKDEFS

SEQ ID NO: 2924750 - protein, 30 aa, Entamoeba invadens
ARTPQKSLWVFRMRVLRRLLAKYRAMGKID

SEQ ID NO: 2924751 - protein, 24 aa, Entamoeba invadens
ASPFRLWFLKRFGKDIASKDYIKS

SEQ ID NO: 2924752 - protein, 25 aa, Entamoeba invadens
ASQMRKGDCQIAIIGDEDSVTGFLL

SEQ ID NO: 2924753 - protein, 27 aa, Entamoeba invadens
ASVKMATQLFGKRMVCAMTSGCSSVSS

SEQ ID NO: 2924754 - protein, 22 aa, Entamoeba invadens
ATGVKFPLADKIFENMSSAPVA

SEQ ID NO: 2924755 - protein, 19 aa, Entamoeba invadens
ATWCKDCIYVKPLYRKLVK

SEQ ID NO: 2924756 - protein, 20 aa, Entamoeba invadens
AVAEFKRLHAYFVNDEEKAK

SEQ ID NO: 2924757 - protein, 25 aa, Entamoeba invadens
AVDIYKKLAVSFRSARRRLKSENSI

SEQ ID NO: 2924758 - protein, 23 aa, Entamoeba invadens
AVRRRPYSVVLFDEVEKAHQQVF

SEQ ID NO: 2924759 - protein, 18 aa, Entamoeba invadens
AYCVFYCNQDVRILKQGH

SEQ ID NO: 2924760 - protein, 17 aa, Entamoeba invadens
AYGGVKEVIPWSITSKE

SEQ ID NO: 2924761 - protein, 19 aa, Entamoeba invadens
CAFENCKKLKTLKFAGRIP

SEQ ID NO: 2924762 - protein, 19 aa, Entamoeba invadens
CCCERLKKIVIPVTITKIG

SEQ ID NO: 2924763 - protein, 19 aa, Entamoeba invadens
CCFDGCSSLSNIVISTSVT

SEQ ID NO: 2924764 - protein, 22 aa, Entamoeba invadens
CEKVFRKKCEEIVCSDNVEKVV

SEQ ID NO: 2924765 - protein, 21 aa, Entamoeba invadens
CELNNTFCCCERLKKIVIPVT

SEQ ID NO: 2924766 - protein, 25 aa, Entamoeba invadens
CFCLSKFRLPLGIRHLPESLFALCR

SEQ ID NO: 2924767 - protein, 17 aa, Entamoeba invadens
CFQNCYKLKDIRLPLNI

SEQ ID NO: 2924768 - protein, 20 aa, Entamoeba invadens
CFVPCFSIVNLDTFKSLKTL

SEQ ID NO: 2924769 - protein, 22 aa, Entamoeba invadens
CGENVTFLPPFHCDYGKYIQVG

SEQ ID NO: 2924770 - protein, 34 aa, Entamoeba invadens
CGKVFKGKYNYEKGIAFPCCISLNNCCGYYSPLA

SEQ ID NO: 2924771 - protein, 18 aa, Entamoeba invadens
CGLLKFMFSFNECLDIVG

SEQ ID NO: 2924772 - protein, 19 aa, Entamoeba invadens
CGRRFAFLVCKRAGIDVNR

SEQ ID NO: 2924773 - protein, 25 aa, Entamoeba invadens
CIEIQRPNCEYAWVFEKTKGEKWEA

SEQ ID NO: 2924774 - protein, 18 aa, Entamoeba invadens
CIGACFDGAYVLIRNGGL

SEQ ID NO: 2924775 - protein, 19 aa, Entamoeba invadens
CIVKGKARLGKIIHKKTAA

SEQ ID NO: 2924776 - protein, 23 aa, Entamoeba invadens
CIYIISSVCDFLRDDPKFREQFK

SEQ ID NO: 2924777 - protein, 19 aa, Entamoeba invadens
CKDCELFNGLLPFNITNLK

SEQ ID NO: 2924778 - protein, 19 aa, Entamoeba invadens
CKNLKKFECQPSLTKIGNG

SEQ ID NO: 2924779 - protein, 19 aa, Entamoeba invadens
CKQLKCANLPQTVTSLGRK

SEQ ID NO: 2924780 - protein, 18 aa, Entamoeba invadens
CKSFLEYWGDMFTESQVE

SEQ ID NO: 2924781 - protein, 19 aa, Entamoeba invadens
CKSLSCIDTPLSITSFGNC

SEQ ID NO: 2924782 - protein, 26 aa, Entamoeba invadens
CKVEKRTLGTFGIPYIITHDGRTIRY

SEQ ID NO: 2924783 - protein, 19 aa, Entamoeba invadens
CLLGKGAYGKVFLVEMKST

SEQ ID NO: 2924784 - protein, 20 aa, Entamoeba invadens
CNLFCTRVIIEKCSEMTVTL

SEQ ID NO: 2924785 - protein, 17 aa, Entamoeba invadens
CQKVCDYPSFDKQISRL

SEQ ID NO: 2924786 - protein, 18 aa, Entamoeba invadens
CSNCILNIDCESCETFEF

SEQ ID NO: 2924787 - protein, 20 aa, Entamoeba invadens
CSSLSKIILGNRVECLKDLC

SEQ ID NO: 2924788 - protein, 18 aa, Entamoeba invadens
CSSRRYCGKSPEVDTNII

SEQ ID NO: 2924789 - protein, 18 aa, Entamoeba invadens
CTALGPALLVSTVAAGKQ

SEQ ID NO: 2924790 - protein, 18 aa, Entamoeba invadens
CVDTGVFVTVGKKKTKMI

SEQ ID NO: 2924791 - protein, 19 aa, Entamoeba invadens
CYIDKYLIKLCKLKNIKVP

SEQ ID NO: 2924792 - protein, 23 aa, Entamoeba invadens
DDKRFRVARYPNYEYTDTSHQTE

SEQ ID NO: 2924793 - protein, 24 aa, Entamoeba invadens
DDKRFRVARYPNYEYTDTSHQTER

SEQ ID NO: 2924794 - protein, 23 aa, Entamoeba invadens
DDMSEMKTELEALEQAAKTYKQS

SEQ ID NO: 2924795 - protein, 33 aa, Entamoeba invadens
DEIKLYNSVMLIKACSVVQYVRFMNTLDNVHQV

SEQ ID NO: 2924796 - protein, 25 aa, Entamoeba invadens
DEPFPYCLDCATSIVQRGKIEMYAR

SEQ ID NO: 2924797 - protein, 21 aa, Entamoeba invadens
DESDVKCEFVAKEVNYNGILK

SEQ ID NO: 2924798 - protein, 17 aa, Entamoeba invadens
DESRFIGEVVVTNKKGL

SEQ ID NO: 2924799 - protein, 22 aa, Entamoeba invadens
DFIPNLKIENFIGEFPNFSTSA

SEQ ID NO: 2924800 - protein, 19 aa, Entamoeba invadens
DFMKERYDQFVGIYADCVT

SEQ ID NO: 2924801 - protein, 25 aa, Entamoeba invadens
DFSLFFKKNIDVITNFVQRSYSNYK

SEQ ID NO: 2924802 - protein, 26 aa, Entamoeba invadens
DFYVVLARPGFRVARRKRGQNRIGKD

SEQ ID NO: 2924803 - protein, 21 aa, Entamoeba invadens
DGELRIAELEDQVRKAGEDLN

SEQ ID NO: 2924804 - protein, 21 aa, Entamoeba invadens
DIMKRLVKIKVDEVSTNVMSE

SEQ ID NO: 2924805 - protein, 27 aa, Entamoeba invadens
DIWIKCPRYRWDYESHFTEEIKSIWTM

SEQ ID NO: 2924806 - protein, 19 aa, Entamoeba invadens
DKSFFCGGVSGGVSIVDMR

SEQ ID NO: 2924807 - protein, 19 aa, Entamoeba invadens
DLHPWDVKFCESLEKDMLF

SEQ ID NO: 2924808 - protein, 24 aa, Entamoeba invadens
DLNGVAYQSSWFKPVGGILEESVY

SEQ ID NO: 2924809 - protein, 22 aa, Entamoeba invadens
DLQLIFKQCDYYTLMADSAMYS

SEQ ID NO: 2924810 - protein, 24 aa, Entamoeba invadens
DLSKRKITPFAVITTMTNNVTIKG

SEQ ID NO: 2924811 - protein, 25 aa, Entamoeba invadens
DMLFEMLKAATFMNIDMLVEATAKT

SEQ ID NO: 2924812 - protein, 25 aa, Entamoeba invadens
DMLIMLKRYLDYIIDIVRPRKLVYM

SEQ ID NO: 2924813 - protein, 25 aa, Entamoeba invadens
DMRIKVHECRYGLGGKEMTPSMILS

SEQ ID NO: 2924814 - protein, 25 aa, Entamoeba invadens
DNFFCSLRLAHYLAQYGSTLLGTVR

SEQ ID NO: 2924815 - protein, 20 aa, Entamoeba invadens
DPNMPRIIIFSSAHQQHIAF

SEQ ID NO: 2924816 - protein, 22 aa, Entamoeba invadens
DRPKVFPSLNYFGASVPICKYT

SEQ ID NO: 2924817 - protein, 19 aa, Entamoeba invadens
DVILRELLGACGENVTFLP

SEQ ID NO: 2924818 - protein, 17 aa, Entamoeba invadens
DYDACSLYPSAINRLKL

SEQ ID NO: 2924819 - protein, 17 aa, Entamoeba invadens
DYNFKRKKDHVLTLYDT

SEQ ID NO: 2924820 - protein, 18 aa, Entamoeba invadens
EAAKVVVGNVCINTILVQ

SEQ ID NO: 2924821 - protein, 28 aa, Entamoeba invadens
EAIKEKKPLRLASRLIAVKAMANADRAK

SEQ ID NO: 2924822 - protein, 19 aa, Entamoeba invadens
EAKLSISGFENGIRVFLQF

SEQ ID NO: 2924823 - protein, 19 aa, Entamoeba invadens
EALQKLADITAELEKNKAA

SEQ ID NO: 2924824 - protein, 24 aa, Entamoeba invadens
EAPFDIVTTFIKWLCNSTKLKEYY

SEQ ID NO: 2924825 - protein, 23 aa, Entamoeba invadens
EASEKRLSCEEMRVNVMRREVLM

SEQ ID NO: 2924826 - protein, 23 aa, Entamoeba invadens
EATTFTCFFDLTSCTDFIEPKKL

SEQ ID NO: 2924827 - protein, 19 aa, Entamoeba invadens
ECASWRYNYQTAAYELRNL

SEQ ID NO: 2924828 - protein, 17 aa, Entamoeba invadens
ECFNIVKEIAVFDGAAL

SEQ ID NO: 2924829 - protein, 21 aa, Entamoeba invadens
EDKEVMCSLCELLKEVHPIMS

SEQ ID NO: 2924830 - protein, 17 aa, Entamoeba invadens
EEARGWYSDDIGFDDEH

SEQ ID NO: 2924831 - protein, 23 aa, Entamoeba invadens
EEGKGEISFRMKGKRFGIFGDYT

SEQ ID NO: 2924832 - protein, 17 aa, Entamoeba invadens
EEILLDYNFKRKKDHVL

SEQ ID NO: 2924833 - protein, 27 aa, Entamoeba invadens
EEKYVILVRMCKGRTFKTFPLVTQIKC

SEQ ID NO: 2924834 - protein, 35 aa, Entamoeba invadens
EENKKLVGEKVCLIEVRLILPFSVEKLIEKIPKTT

SEQ ID NO: 2924835 - protein, 24 aa, Entamoeba invadens
EEVKKEIKNLVSIDISMNRIQELP

SEQ ID NO: 2924836 - protein, 25 aa, Entamoeba invadens
EFQSDMKAYCVFYCNQDVKNLKQGH

SEQ ID NO: 2924837 - protein, 21 aa, Entamoeba invadens
EGDEVDRCMVYSIGDYLRVCN

SEQ ID NO: 2924838 - protein, 24 aa, Entamoeba invadens
EIKPEMLGHYLGEFSITYKPVTHG

SEQ ID NO: 2924839 - protein, 20 aa, Entamoeba invadens
EILIWYKVSYTFTQHKKSTN

SEQ ID NO: 2924840 - protein, 21 aa, Entamoeba invadens
EISKAVCRFVANVASNPLAFV

SEQ ID NO: 2924841 - protein, 21 aa, Entamoeba invadens
EKEYIKNMIIEIGKTLGTEMY

SEQ ID NO: 2924842 - protein, 23 aa, Entamoeba invadens
EKLRKWYTSFGFKTLDKSYLQPS

SEQ ID NO: 2924843 - protein, 23 aa, Entamoeba invadens
EKYIKAFYIPALMDKNGNGALIG

SEQ ID NO: 2924844 - protein, 17 aa, Entamoeba invadens
EKYPAFNAIVFNESKKE

SEQ ID NO: 2924845 - protein, 19 aa, Entamoeba invadens
ELIGKLIVVSDESGQLYKQ

SEQ ID NO: 2924846 - protein, 25 aa, Entamoeba invadens
ELKAVCCSHGPVLRTNIKENIERYR

SEQ ID NO: 2924847 - protein, 20 aa, Entamoeba invadens
ELRVKNCLNAIMKKYHRVAI

SEQ ID NO: 2924848 - protein, 17 aa, Entamoeba invadens
ELTCLHCVDGYYPDDGK

SEQ ID NO: 2924849 - protein, 17 aa, Entamoeba invadens
ELTCLHCVDGYYPDEGK

SEQ ID NO: 2924850 - protein, 20 aa, Entamoeba invadens
EMNQELELLLGTLYEKYKEI

SEQ ID NO: 2924851 - protein, 26 aa, Entamoeba invadens
ENCELCNKKKCTKCVSGFSFNKIQQC

SEQ ID NO: 2924852 - protein, 23 aa, Entamoeba invadens
ENIRCFECNKSFDDFFVPNLIGV

SEQ ID NO: 2924853 - protein, 20 aa, Entamoeba invadens
ENITKIVICDGISTLGSKAF

SEQ ID NO: 2924854 - protein, 17 aa, Entamoeba invadens
ENVRFIPIDGLRGDNLT

SEQ ID NO: 2924855 - protein, 27 aa, Entamoeba invadens
EPEIKMLKILCQWFCRKRRLSDYNQHC

SEQ ID NO: 2924856 - protein, 19 aa, Entamoeba invadens
EPIAFRQTSRFFKKKGTIA

SEQ ID NO: 2924857 - protein, 24 aa, Entamoeba invadens
EPPKCPSCGSYFTVNSFKEDGNII

SEQ ID NO: 2924858 - protein, 17 aa, Entamoeba invadens
ERIKTKWVPEIVAHCGV

SEQ ID NO: 2924859 - protein, 24 aa, Entamoeba invadens
ESSNYVACHFARILKKHLLTENNL

SEQ ID NO: 2924860 - protein, 25 aa, Entamoeba invadens
ESVEIKAPQLLFLSGGKFSVDVHGT

SEQ ID NO: 2924861 - protein, 23 aa, Entamoeba invadens
ETHATEIMECLTLQQQMKLLRSE

SEQ ID NO: 2924862 - protein, 25 aa, Entamoeba invadens
ETINSLPYKCFANLIALTEIATPNE

SEQ ID NO: 2924863 - protein, 24 aa, Entamoeba invadens
ETVKRIYTRVGLEFNDETEKKILE

SEQ ID NO: 2924864 - protein, 18 aa, Entamoeba invadens
EVDHSYWYADFEASTQGY

SEQ ID NO: 2924865 - protein, 24 aa, Entamoeba invadens
EVECFRLFFCEEIANNLLLFSNKK

SEQ ID NO: 2924866 - protein, 25 aa, Entamoeba invadens
EVECFRLFFCEEITNNLLLFSNKKI

SEQ ID NO: 2924867 - protein, 23 aa, Entamoeba invadens
EVFKKAYPTLSFDIFSSKNKVEA

SEQ ID NO: 2924868 - protein, 20 aa, Entamoeba invadens
EVGSGCFRECKALAQIIIPE

SEQ ID NO: 2924869 - protein, 21 aa, Entamoeba invadens
EVIRTIFDAMETWKMRTDEEI

SEQ ID NO: 2924870 - protein, 17 aa, Entamoeba invadens
EVKQFDYKGGFEAIKSE

SEQ ID NO: 2924871 - protein, 18 aa, Entamoeba invadens
EVLFPLRKFIGSTQDGAS

SEQ ID NO: 2924872 - protein, 18 aa, Entamoeba invadens
EVNHSYWYADFEASTQGY

SEQ ID NO: 2924873 - protein, 23 aa, Entamoeba invadens
EVVCGPLDVHVVGVVSTSTETTN

SEQ ID NO: 2924874 - protein, 24 aa, Entamoeba invadens
EYKELAKDFEFIWDVMSNLCSKYD

SEQ ID NO: 2924875 - protein, 17 aa, Entamoeba invadens
FAEIPAMFHYNPVSMKG

SEQ ID NO: 2924876 - protein, 27 aa, Entamoeba invadens
FAFAIIILECLTWKNAYNEKQFKYPSK

SEQ ID NO: 2924877 - protein, 25 aa, Entamoeba invadens
FAITMYETFGWREAYPVNTFKFPWK

SEQ ID NO: 2924878 - protein, 17 aa, Entamoeba invadens
FASSMIFYSGKYKAYCI

SEQ ID NO: 2924879 - protein, 17 aa, Entamoeba invadens
FCQNSCATNGDGLYEGL

SEQ ID NO: 2924880 - protein, 26 aa, Entamoeba invadens
FCVDLSLLNCHCDVKLGEAKLMHLML

SEQ ID NO: 2924881 - protein, 18 aa, Entamoeba invadens
FDYKGGFEAIKSEGKGHG

SEQ ID NO: 2924882 - protein, 25 aa, Entamoeba invadens
FECNLFNRNFRVFGNGLLYKVTMEN

SEQ ID NO: 2924883 - protein, 25 aa, Entamoeba invadens
FEMEELRALIFYLMDRPYVMVSSDV

SEQ ID NO: 2924884 - protein, 25 aa, Entamoeba invadens
FENLRFRFLQKLVIKKSVNDKLKIK

SEQ ID NO: 2924885 - protein, 20 aa, Entamoeba invadens
FEPELRRPEAQLKYIIENEP

SEQ ID NO: 2924886 - protein, 20 aa, Entamoeba invadens
FGCKKLEIYPKFIPTKTATF

SEQ ID NO: 2924887 - protein, 17 aa, Entamoeba invadens
FGDCFEVAIQREKFPER

SEQ ID NO: 2924888 - protein, 23 aa, Entamoeba invadens
FGDKEIKSQYLIQNSDYTACHFP

SEQ ID NO: 2924889 - protein, 19 aa, Entamoeba invadens
FGESCFKGTSITNFIFNDN

SEQ ID NO: 2924890 - protein, 24 aa, Entamoeba invadens
FGYCKKEVKTQISFSANLYGLAEE

SEQ ID NO: 2924891 - protein, 18 aa, Entamoeba invadens
FGYVKYRTIEAALKAVEN

SEQ ID NO: 2924892 - protein, 21 aa, Entamoeba invadens
FIPNLKIENFIGEFPNFSTSA

SEQ ID NO: 2924893 - protein, 18 aa, Entamoeba invadens
FISDTPKSKMSFVVGEQA

SEQ ID NO: 2924894 - protein, 25 aa, Entamoeba invadens
FITKYKPKLVCFGHTHNCFGVVKDE

SEQ ID NO: 2924895 - protein, 17 aa, Entamoeba invadens
FKATVIITEKGKVLLTP

SEQ ID NO: 2924896 - protein, 19 aa, Entamoeba invadens
FKDNTEWGTALTYAQAAAK

SEQ ID NO: 2924897 - protein, 20 aa, Entamoeba invadens
FKEIPLMFHFNPIQWNPKMV

SEQ ID NO: 2924898 - protein, 19 aa, Entamoeba invadens
FKESVEIVLNIVLGVYSLV

SEQ ID NO: 2924899 - protein, 20 aa, Entamoeba invadens
FKKEAEDFLKSCPVKKLTLN

SEQ ID NO: 2924900 - protein, 20 aa, Entamoeba invadens
FKLADILPFETAVKLLKEAV

SEQ ID NO: 2924901 - protein, 18 aa, Entamoeba invadens
FKLSHKWRYIIFKMNDKL

SEQ ID NO: 2924902 - protein, 21 aa, Entamoeba invadens
FKMMGNIVVRFSAVQCLRNLI

SEQ ID NO: 2924903 - protein, 23 aa, Entamoeba invadens
FKYDGEMNALFGMDKCTGTTSYL

SEQ ID NO: 2924904 - protein, 24 aa, Entamoeba invadens
FLCDLPHNAVCYFHNLKYDGSFLA

SEQ ID NO: 2924905 - protein, 26 aa, Entamoeba invadens
FLKCPESLVSLLLCEGMEDKDSIRMY

SEQ ID NO: 2924906 - protein, 18 aa, Entamoeba invadens
FLQEFSIGEITLLEDVPL

SEQ ID NO: 2924907 - protein, 21 aa, Entamoeba invadens
FLVCKRAGIDVNRRAGLLKAD

SEQ ID NO: 2924908 - protein, 27 aa, Entamoeba invadens
FMPYLCKKLEVPYCIVKGKARLGKIIH

SEQ ID NO: 2924909 - protein, 18 aa, Entamoeba invadens
FNPAHKLIKVFSGDFDLQ

SEQ ID NO: 2924910 - protein, 27 aa, Entamoeba invadens
FNSSNWCFAHLTALVGVSMMKSAEGEL

SEQ ID NO: 2924911 - protein, 28 aa, Entamoeba invadens
FNSSNWCFAHLTALVGVSMMKSAEGELI

SEQ ID NO: 2924912 - protein, 17 aa, Entamoeba invadens
FNTSVPYFEMKDVDPNK

SEQ ID NO: 2924913 - protein, 17 aa, Entamoeba invadens
FNVFSIIDLEKEYIKNM

SEQ ID NO: 2924914 - protein, 25 aa, Entamoeba invadens
FPKIETLQCYDYMLGNNDKLVHKVK

SEQ ID NO: 2924915 - protein, 17 aa, Entamoeba invadens
FPVTFKVSENFRKNGIG

SEQ ID NO: 2924916 - protein, 29 aa, Entamoeba invadens
FQELLIYYKRFWLEKIDCSNWCQFCEQNR

SEQ ID NO: 2924917 - protein, 17 aa, Entamoeba invadens
FQHRGLAQQLMRHFIKN

SEQ ID NO: 2924918 - protein, 21 aa, Entamoeba invadens
FRDVSIFPIVFFGGKVQATKL

SEQ ID NO: 2924919 - protein, 22 aa, Entamoeba invadens
FRKVQCPIVERLVCCLMQHGRN

SEQ ID NO: 2924920 - protein, 19 aa, Entamoeba invadens
FSAVQCLRNLINADAKFFE

SEQ ID NO: 2924921 - protein, 20 aa, Entamoeba invadens
FSGCCKLSNIIVPFKVESIG

SEQ ID NO: 2924922 - protein, 18 aa, Entamoeba invadens
FSGCLSLTSIHIPSSITK

SEQ ID NO: 2924923 - protein, 21 aa, Entamoeba invadens
FSLGETILITSFCNMGLLQDG

SEQ ID NO: 2924924 - protein, 17 aa, Entamoeba invadens
FSVDVHGTVIEFDMPAF

SEQ ID NO: 2924925 - protein, 24 aa, Entamoeba invadens
FSYDKTSSFILERFIVAYDYLFKD

SEQ ID NO: 2924926 - protein, 17 aa, Entamoeba invadens
FTARSDAKLSYKNHKYC

SEQ ID NO: 2924927 - protein, 24 aa, Entamoeba invadens
FTLRALRLATSMTFLSNSSINIVT

SEQ ID NO: 2924928 - protein, 26 aa, Entamoeba invadens
FTSIIKNICKFFWNVSLIKMIVSNND

SEQ ID NO: 2924929 - protein, 18 aa, Entamoeba invadens
FTVEFPSEPITSGLSGTL

SEQ ID NO: 2924930 - protein, 29 aa, Entamoeba invadens
FVGHKGAVWGVCWSHPRFGVLATCGYDGE

SEQ ID NO: 2924931 - protein, 22 aa, Entamoeba invadens
FVRNTYWVALKFVNGINTCVTV

SEQ ID NO: 2924932 - protein, 24 aa, Entamoeba invadens
FVSGCSLLTSLVCENGTSFDLKNI

SEQ ID NO: 2924933 - protein, 17 aa, Entamoeba invadens
FWTDNWKPFSYYQRIKT

SEQ ID NO: 2924934 - protein, 17 aa, Entamoeba invadens
FYQIIVWFTVDFDTFNT

SEQ ID NO: 2924935 - protein, 20 aa, Entamoeba invadens
FYRVISWCPIELGTVPHNFN

SEQ ID NO: 2924936 - protein, 18 aa, Entamoeba invadens
GACLYARDVASQTVKNHI

SEQ ID NO: 2924937 - protein, 18 aa, Entamoeba invadens
GAKWNFAGDDSFQLDSTK

SEQ ID NO: 2924938 - protein, 18 aa, Entamoeba invadens
GAVGKTCLLICYTTNEFP

SEQ ID NO: 2924939 - protein, 23 aa, Entamoeba invadens
GCESLKLDFSFIIENSSPIELSK

SEQ ID NO: 2924940 - protein, 22 aa, Entamoeba invadens
GDFSLERFIVAFDCLFDEINTI

SEQ ID NO: 2924941 - protein, 23 aa, Entamoeba invadens
GDICFCCCEKLSGITIPSNVTSI

SEQ ID NO: 2924942 - protein, 18 aa, Entamoeba invadens
GDKIPAVKGALFTVISYL

SEQ ID NO: 2924943 - protein, 19 aa, Entamoeba invadens
GDKSSKVYIRREAIVWEDS

SEQ ID NO: 2924944 - protein, 21 aa, Entamoeba invadens
GDTSIGILDIAGFEIFRENSF

SEQ ID NO: 2924945 - protein, 18 aa, Entamoeba invadens
GDYCYRGATNLTTFHIPS

SEQ ID NO: 2924946 - protein, 17 aa, Entamoeba invadens
GEFTVEFPSEPITSGLS

SEQ ID NO: 2924947 - protein, 25 aa, Entamoeba invadens
GEGINEVFFKAAFPKGEFSYPDKRV

SEQ ID NO: 2924948 - protein, 18 aa, Entamoeba invadens
GEKCFKCDHNLKSVTLSE

SEQ ID NO: 2924949 - protein, 18 aa, Entamoeba invadens
GEMVAVEYKGKWYRANVV

SEQ ID NO: 2924950 - protein, 24 aa, Entamoeba invadens
GFDTKWRCEQALGVGEYFVADPSI

SEQ ID NO: 2924951 - protein, 24 aa, Entamoeba invadens
GFDYHTCAVLSCLEQQSPDIANGV

SEQ ID NO: 2924952 - protein, 26 aa, Entamoeba invadens
GFGRIGRLVARVILTRPEFDLVALND

SEQ ID NO: 2924953 - protein, 20 aa, Entamoeba invadens
GGKLEIPEWVDLVKTGVTKE

SEQ ID NO: 2924954 - protein, 17 aa, Entamoeba invadens
GGSGFGNRGGRGGRGGF

SEQ ID NO: 2924955 - protein, 19 aa, Entamoeba invadens
GHGPALFGNERINKFWRTK

SEQ ID NO: 2924956 - protein, 24 aa, Entamoeba invadens
GHMYSPLKVYRKWQKKTPKQIRRY

SEQ ID NO: 2924957 - protein, 21 aa, Entamoeba invadens
GHVTFRNCTECEFLRTNCPKR

SEQ ID NO: 2924958 - protein, 24 aa, Entamoeba invadens
GIATLPVYYVPVAISYVNNTPYAI

SEQ ID NO: 2924959 - protein, 19 aa, Entamoeba invadens
GIQRLKTVYVDRIDAGQLY

SEQ ID NO: 2924960 - protein, 31 aa, Entamoeba invadens
GKCVKNENNVFVWTYKDYKAFDHTEELNYQF

SEQ ID NO: 2924961 - protein, 29 aa, Entamoeba invadens
GKPSSENWLKWIVSVGEEFEFDFKKCSSV

SEQ ID NO: 2924962 - protein, 19 aa, Entamoeba invadens
GKQTLALPKRMPVFPRGAE

SEQ ID NO: 2924963 - protein, 24 aa, Entamoeba invadens
GKTSIIKRLCCNAFDKDMKPTIGG

SEQ ID NO: 2924964 - protein, 17 aa, Entamoeba invadens
GKYPFYDVLNIKHVTSF

SEQ ID NO: 2924965 - protein, 26 aa, Entamoeba invadens
GLGSDKRPTGSFMFLGPSGVGKTELA

SEQ ID NO: 2924966 - protein, 19 aa, Entamoeba invadens
GLTKIEIPSTVKMIRERAF

SEQ ID NO: 2924967 - protein, 21 aa, Entamoeba invadens
GNIKKRLEEIAKELSNNTDKL

SEQ ID NO: 2924968 - protein, 20 aa, Entamoeba invadens
GNMVSCLDFVESVFGNAGNP

SEQ ID NO: 2924969 - protein, 30 aa, Entamoeba invadens
GPSGKDWRAGRCAACNIIPATTGAAKAVGK

SEQ ID NO: 2924970 - protein, 21 aa, Entamoeba invadens
GQAKLIRKIMGAIITKQAINK

SEQ ID NO: 2924971 - protein, 18 aa, Entamoeba invadens
GRSPNAVKNRFFGHLNKF

SEQ ID NO: 2924972 - protein, 17 aa, Entamoeba invadens
GSCLRPMTRQYYSRTQA

SEQ ID NO: 2924973 - protein, 21 aa, Entamoeba invadens
GSDCFMICFAVSEEESFERIK

SEQ ID NO: 2924974 - protein, 20 aa, Entamoeba invadens
GSEHRLRIRGNFEGTLKNDV

SEQ ID NO: 2924975 - protein, 19 aa, Entamoeba invadens
GSFGIVYLGEFRGYKVAIK

SEQ ID NO: 2924976 - protein, 20 aa, Entamoeba invadens
GSGMCKAGFAGDDAPRAVFP

SEQ ID NO: 2924977 - protein, 23 aa, Entamoeba invadens
GTIFTTRLANVFIIGKGTETLVN

SEQ ID NO: 2924978 - protein, 20 aa, Entamoeba invadens
GVKEVIPWSITSKETTMKYC

SEQ ID NO: 2924979 - protein, 21 aa, Entamoeba invadens
GVMLDAFFDMCYDRLKHLELM

SEQ ID NO: 2924980 - protein, 17 aa, Entamoeba invadens
GVRQVCYSIVNRLVQAL

SEQ ID NO: 2924981 - protein, 27 aa, Entamoeba invadens
GVYTREHLELFVLPPRPTYLVKSEEES

SEQ ID NO: 2924982 - protein, 19 aa, Entamoeba invadens
GYGSLWCGLLKFMFSFNEC

SEQ ID NO: 2924983 - protein, 27 aa, Entamoeba invadens
GYLEGREITRLQGFYTKSTPKEGEKDV

SEQ ID NO: 2924984 - protein, 20 aa, Entamoeba invadens
HCPAHRCNLFAQDVGMEAPF

SEQ ID NO: 2924985 - protein, 25 aa, Entamoeba invadens
HFLEDLLYIIGIDCFCQIGDKVGNT

SEQ ID NO: 2924986 - protein, 23 aa, Entamoeba invadens
HIKALEAQKKMALDDKAEAEKTA

SEQ ID NO: 2924987 - protein, 17 aa, Entamoeba invadens
HKQNCFEDVSMKFNKWC

SEQ ID NO: 2924988 - protein, 24 aa, Entamoeba invadens
HLCSYKGHMWAKVFIKSKPGRYGI

SEQ ID NO: 2924989 - protein, 22 aa, Entamoeba invadens
HLMPSNCQKDFLARVKESEKIK

SEQ ID NO: 2924990 - protein, 24 aa, Entamoeba invadens
HLTSYFYREFYRIIVYEEVDYKTA

SEQ ID NO: 2924991 - protein, 26 aa, Entamoeba invadens
HMPEHYKSVVFHTKFALNTLFDYSQC

SEQ ID NO: 2924992 - protein, 18 aa, Entamoeba invadens
HRAPKAIKVIRFIAMKTM

SEQ ID NO: 2924993 - protein, 19 aa, Entamoeba invadens
HSAISWGTGRAVARIPRIS

SEQ ID NO: 2924994 - protein, 18 aa, Entamoeba invadens
HTKTSVVFERTPIYYFEV

SEQ ID NO: 2924995 - protein, 20 aa, Entamoeba invadens
HVISCKKLVLSDKVEELELQ

SEQ ID NO: 2924996 - protein, 17 aa, Entamoeba invadens
HWMLSKLGGTFAPKPSG

SEQ ID NO: 2924997 - protein, 19 aa, Entamoeba invadens
HYRAIEIILGLPYSCAIDM

SEQ ID NO: 2924998 - protein, 26 aa, Entamoeba invadens
IAHDVCPLEMVLFMPYLCKKLEVPYC

SEQ ID NO: 2924999 - protein, 31 aa, Entamoeba invadens
IAKSLVNAGLCKRALVQLSYAIGLSHPLSVY

SEQ ID NO: 2925000 - protein, 24 aa, Entamoeba invadens
IASYKRSGVVGVNIGKIKRMFVSI

SEQ ID NO: 2925001 - protein, 17 aa, Entamoeba invadens
IDFKEIVGTKCLTINRN

SEQ ID NO: 2925002 - protein, 18 aa, Entamoeba invadens
IDIPECLCVIEDEVFYKC

SEQ ID NO: 2925003 - protein, 18 aa, Entamoeba invadens
IDLDKLKDVLSFKNITKV

SEQ ID NO: 2925004 - protein, 20 aa, Entamoeba invadens
IDMSDLFYQPILCVVGNQRD

SEQ ID NO: 2925005 - protein, 23 aa, Entamoeba invadens
IDMSINRILAIPKHMSKLSNLTF

SEQ ID NO: 2925006 - protein, 25 aa, Entamoeba invadens
IEHRIKATYSFTRWCYIYKNVEDIT

SEQ ID NO: 2925007 - protein, 17 aa, Entamoeba invadens
IEIPHWTKFSEKTVPME

SEQ ID NO: 2925008 - protein, 17 aa, Entamoeba invadens
IERIELITSLGIITGKY

SEQ ID NO: 2925009 - protein, 25 aa, Entamoeba invadens
IESIKYPTYYVVAGSFSGVRNYEMK

SEQ ID NO: 2925010 - protein, 23 aa, Entamoeba invadens
IESRARIDGSLYKKLKITQKALG

SEQ ID NO: 2925011 - protein, 18 aa, Entamoeba invadens
IETLHLWSREDENFGNVI

SEQ ID NO: 2925012 - protein, 21 aa, Entamoeba invadens
IFCVMLRLIKGRNCYSMPLLL

SEQ ID NO: 2925013 - protein, 27 aa, Entamoeba invadens
IFEGDLKLILGLLWVLILKYQIAANKM

SEQ ID NO: 2925014 - protein, 21 aa, Entamoeba invadens
IGEKCFNWCSYLSSITIPLGV

SEQ ID NO: 2925015 - protein, 30 aa, Entamoeba invadens
IGKPSSENWLKWIVSVGEEFEFDFKKCSSV

SEQ ID NO: 2925016 - protein, 23 aa, Entamoeba invadens
IGKSCFKNCKQLGTINVELTTEF

SEQ ID NO: 2925017 - protein, 17 aa, Entamoeba invadens
IGLVAIDCLIKGKNVEF

SEQ ID NO: 2925018 - protein, 17 aa, Entamoeba invadens
IGNNAFCCCSSLEIVEI

SEQ ID NO: 2925019 - protein, 23 aa, Entamoeba invadens
IGVSGCALIKSYNPEPTITENNG

SEQ ID NO: 2925020 - protein, 19 aa, Entamoeba invadens
IHFAGHGPALFGNERINKF

SEQ ID NO: 2925021 - protein, 19 aa, Entamoeba invadens
IIIPPSVTLIGDFCFGRCY

SEQ ID NO: 2925022 - protein, 24 aa, Entamoeba invadens
IIKKIGYNEVRFSNFNVQNIVGSC

SEQ ID NO: 2925023 - protein, 25 aa, Entamoeba invadens
IILNPHFCKLIAWYDNEWGYSTRLV

SEQ ID NO: 2925024 - protein, 18 aa, Entamoeba invadens
IIRMIGIPPSALLEKGTK

SEQ ID NO: 2925025 - protein, 23 aa, Entamoeba invadens
IKGDLWLNLSVQGKLHINLDTLK

SEQ ID NO: 2925026 - protein, 22 aa, Entamoeba invadens
IKIPSNCFENCFSLKTIKLPKS

SEQ ID NO: 2925027 - protein, 24 aa, Entamoeba invadens
IKKLDINVCNTFTYKSSKITTVKG

SEQ ID NO: 2925028 - protein, 18 aa, Entamoeba invadens
IKKYLRFDDGAYLREIAR

SEQ ID NO: 2925029 - protein, 21 aa, Entamoeba invadens
IKLPPSVIEIGNFAFSDCSHL

SEQ ID NO: 2925030 - protein, 18 aa, Entamoeba invadens
IKNRKWYCQTSCATNGDG

SEQ ID NO: 2925031 - protein, 22 aa, Entamoeba invadens
ILMDEFFRKPLLSLAEQKVVAA

SEQ ID NO: 2925032 - protein, 19 aa, Entamoeba invadens
ILNCFTIKAGTIKAASTKI

SEQ ID NO: 2925033 - protein, 22 aa, Entamoeba invadens
ILPMVCPDDIVLGGWDISKTNM

SEQ ID NO: 2925034 - protein, 25 aa, Entamoeba invadens
ILVCKKFSCILDRFRYNPIPITSTK

SEQ ID NO: 2925035 - protein, 27 aa, Entamoeba invadens
INFTVDFMFVKGCQKVCDYPSFDKQIS

SEQ ID NO: 2925036 - protein, 23 aa, Entamoeba invadens
INGKYKFNDKFSVNGNAQKTNTN

SEQ ID NO: 2925037 - protein, 24 aa, Entamoeba invadens
INLPKDLIVMISYIGKMELYYDLI

SEQ ID NO: 2925038 - protein, 22 aa, Entamoeba invadens
INNKECRKELIAMDIETRDLYF

SEQ ID NO: 2925039 - protein, 20 aa, Entamoeba invadens
IPDIHRLVVWYPVSLQESKT

SEQ ID NO: 2925040 - protein, 21 aa, Entamoeba invadens
IPLILCATKLDLERNVSSHEE

SEQ ID NO: 2925041 - protein, 22 aa, Entamoeba invadens
IPMRDFGDFLAVHVDPNVIEGL

SEQ ID NO: 2925042 - protein, 27 aa, Entamoeba invadens
IPRYELLIRDMLRDVGKDFPDLEQLKK

SEQ ID NO: 2925043 - protein, 19 aa, Entamoeba invadens
IPTNVTILGKECFAKSPNT

SEQ ID NO: 2925044 - protein, 20 aa, Entamoeba invadens
IQHRKHIRALFKKEAEDFLK

SEQ ID NO: 2925045 - protein, 17 aa, Entamoeba invadens
IQNGPVRGISFKLQEEE

SEQ ID NO: 2925046 - protein, 26 aa, Entamoeba invadens
IQPPMLRIKAFEPLFVIGKEYYAQLD

SEQ ID NO: 2925047 - protein, 18 aa, Entamoeba invadens
IRALFKKEAEDFLKSCPV

SEQ ID NO: 2925048 - protein, 23 aa, Entamoeba invadens
ISIKTRNPIIFSFHPSALKCSIA

SEQ ID NO: 2925049 - protein, 17 aa, Entamoeba invadens
ISIPHNVIFIGKDAFNW

SEQ ID NO: 2925050 - protein, 18 aa, Entamoeba invadens
ITIPLSVTYIGYYCFSSN

SEQ ID NO: 2925051 - protein, 22 aa, Entamoeba invadens
ITNKKRLFAMEVRQRKITDYVI

SEQ ID NO: 2925052 - protein, 24 aa, Entamoeba invadens
ITRELFDYFASFGCVVSFHEKVAI

SEQ ID NO: 2925053 - protein, 21 aa, Entamoeba invadens
IVLCGFCFQNCYKLKDIRLPL

SEQ ID NO: 2925054 - protein, 31 aa, Entamoeba invadens
IVMEKCTPHAIRVCGYTGKQLVLNDEKLSVV

SEQ ID NO: 2925055 - protein, 20 aa, Entamoeba invadens
IVVRYFKCEYEYEINNVVLV

SEQ ID NO: 2925056 - protein, 29 aa, Entamoeba invadens
KADPILPAKNLKAAFSALSLVDDIEDDDA

SEQ ID NO: 2925057 - protein, 17 aa, Entamoeba invadens
KAFPKIETLQCYDYMLG

SEQ ID NO: 2925058 - protein, 19 aa, Entamoeba invadens
KAGCLKVGGLVVIEKSPCK

SEQ ID NO: 2925059 - protein, 17 aa, Entamoeba invadens
KALEAQKKMALDDKAEA

SEQ ID NO: 2925060 - protein, 20 aa, Entamoeba invadens
KANILKCVDTGVFVTVGKKK

SEQ ID NO: 2925061 - protein, 21 aa, Entamoeba invadens
KCAPPTYVKTRFLSLECVFRW

SEQ ID NO: 2925062 - protein, 17 aa, Entamoeba invadens
KCCFSRSKLEEFVVPPN

SEQ ID NO: 2925063 - protein, 20 aa, Entamoeba invadens
KCDYINIFGTFDCQKVLSFC

SEQ ID NO: 2925064 - protein, 18 aa, Entamoeba invadens
KCFYGCSKLNLIEMSNCV

SEQ ID NO: 2925065 - protein, 20 aa, Entamoeba invadens
KCGIIKLSIPDTVVSLDLNL

SEQ ID NO: 2925066 - protein, 25 aa, Entamoeba invadens
KCHFKNCKWLTSFDIPSSVTHIGDD

SEQ ID NO: 2925067 - protein, 18 aa, Entamoeba invadens
KCTKLTRVVLPDNLISIK

SEQ ID NO: 2925068 - protein, 18 aa, Entamoeba invadens
KCVECPNKMLLNGETCVL

SEQ ID NO: 2925069 - protein, 22 aa, Entamoeba invadens
KDDKLKLAFQSVWETQDAGQFA

SEQ ID NO: 2925070 - protein, 23 aa, Entamoeba invadens
KDDVETMLSILFKNAINERRYVQ

SEQ ID NO: 2925071 - protein, 25 aa, Entamoeba invadens
KDNQYELICECWKQNPIERITIETI

SEQ ID NO: 2925072 - protein, 27 aa, Entamoeba invadens
KDPYLDKQFKFAWDIVDFVVSGKRQKR

SEQ ID NO: 2925073 - protein, 18 aa, Entamoeba invadens
KDQFPEWALLPKTSEELM

SEQ ID NO: 2925074 - protein, 23 aa, Entamoeba invadens
KDSPDLEEFIKFYTETNHEEVIE

SEQ ID NO: 2925075 - protein, 21 aa, Entamoeba invadens
KDVTRALLIVLYNSYIAPVTC

SEQ ID NO: 2925076 - protein, 21 aa, Entamoeba invadens
KDYFEVMKTVWGMEGNDKQKM

SEQ ID NO: 2925077 - protein, 24 aa, Entamoeba invadens
KEGLCKKYMKYLMKKYLKKNNLRE

SEQ ID NO: 2925078 - protein, 20 aa, Entamoeba invadens
KEGRGTYRINSECSSEDFDF

SEQ ID NO: 2925079 - protein, 20 aa, Entamoeba invadens
KEIIKYTPFHLTIKTKDGHF

SEQ ID NO: 2925080 - protein, 25 aa, Entamoeba invadens
KEIKKKWRMCHSLKDYKRKEMKKAS

SEQ ID NO: 2925081 - protein, 26 aa, Entamoeba invadens
KERRQMKRMWKWYMMNQMYNRPPPPP

SEQ ID NO: 2925082 - protein, 26 aa, Entamoeba invadens
KETILKYSSCWELLFNTKSDDEIQQL

SEQ ID NO: 2925083 - protein, 17 aa, Entamoeba invadens
KFCRGEDGLPIGDTGKS

SEQ ID NO: 2925084 - protein, 18 aa, Entamoeba invadens
KFILKKYSIHLLVKLGDA

SEQ ID NO: 2925085 - protein, 18 aa, Entamoeba invadens
KFILKKYSIHLLVKLSDA

SEQ ID NO: 2925086 - protein, 21 aa, Entamoeba invadens
KFNKWCLNELITTKDYKKMLI

SEQ ID NO: 2925087 - protein, 23 aa, Entamoeba invadens
KFNYSGVCGDVFKYGPNTKRDLV

SEQ ID NO: 2925088 - protein, 19 aa, Entamoeba invadens
KGRNCYSMPLLLRQYKGEL

SEQ ID NO: 2925089 - protein, 28 aa, Entamoeba invadens
KGVFKKEFFRIIVWFNVDFKTVDRNKNR

SEQ ID NO: 2925090 - protein, 18 aa, Entamoeba invadens
KHFPSIETLNLWSEKDET

SEQ ID NO: 2925091 - protein, 18 aa, Entamoeba invadens
KHSKNMLCVEQQYDDHFI

SEQ ID NO: 2925092 - protein, 18 aa, Entamoeba invadens
KIAVPTPRNVSCQKMEII

SEQ ID NO: 2925093 - protein, 25 aa, Entamoeba invadens
KIELSEGLTSFGFGAFCGAKNLVKV

SEQ ID NO: 2925094 - protein, 25 aa, Entamoeba invadens
KIKLIDFGSACFENSTLYSYIQSRH

SEQ ID NO: 2925095 - protein, 22 aa, Entamoeba invadens
KIKMFREMIHRLKVAHPDIEEL

SEQ ID NO: 2925096 - protein, 21 aa, Entamoeba invadens
KITPSLCKLTKLSVLDVSANP

SEQ ID NO: 2925097 - protein, 25 aa, Entamoeba invadens
KKAKETLKEIACISQGYEDNKIMNK

SEQ ID NO: 2925098 - protein, 22 aa, Entamoeba invadens
KKAKRVIKVIRGYHGISAEEIA

SEQ ID NO: 2925099 - protein, 28 aa, Entamoeba invadens
KKDLAIDMIKFLLGKAENQFTHPPTVRM

SEQ ID NO: 2925100 - protein, 25 aa, Entamoeba invadens
KKIAGVCAVWRIIKDVNFIEHVVIS

SEQ ID NO: 2925101 - protein, 27 aa, Entamoeba invadens
KKILDAIFYKIHDTFPTGAWKYNEAEP

SEQ ID NO: 2925102 - protein, 24 aa, Entamoeba invadens
KKKFFRIIVWFSVDFGTVDRNKSR

SEQ ID NO: 2925103 - protein, 18 aa, Entamoeba invadens
KKLKTLKFAGRIPQIEKC

SEQ ID NO: 2925104 - protein, 23 aa, Entamoeba invadens
KKNNIRLLLNFHIPQGGYLSKCA

SEQ ID NO: 2925105 - protein, 24 aa, Entamoeba invadens
KKPLRKFPFYLFKRMADGDYSTPV

SEQ ID NO: 2925106 - protein, 17 aa, Entamoeba invadens
KKPSIPIRNKMKPTPLV

SEQ ID NO: 2925107 - protein, 27 aa, Entamoeba invadens
KKTRFMLPCGMFKFTVHNTTELEMIMM

SEQ ID NO: 2925108 - protein, 20 aa, Entamoeba invadens
KLKDVLSFKNITKVIVYIIN

SEQ ID NO: 2925109 - protein, 26 aa, Entamoeba invadens
KLSFDAICWKVAFSVDAEQLAVSLET

SEQ ID NO: 2925110 - protein, 22 aa, Entamoeba invadens
KLSKHAYCFVPIITMKTSQGSD

SEQ ID NO: 2925111 - protein, 19 aa, Entamoeba invadens
KLTDKIIRVIKFVEDTPVK

SEQ ID NO: 2925112 - protein, 21 aa, Entamoeba invadens
KMCAVDLKTLLDIQSLERIEI

SEQ ID NO: 2925113 - protein, 24 aa, Entamoeba invadens
KMLKIVEPYITYGYPSLKTVSDLI

SEQ ID NO: 2925114 - protein, 21 aa, Entamoeba invadens
KNITCTNCSNCILNIDCESCE

SEQ ID NO: 2925115 - protein, 20 aa, Entamoeba invadens
KNQFPCLFNLVKKMNAKSPT

SEQ ID NO: 2925116 - protein, 21 aa, Entamoeba invadens
KNQFPCLFNLVKKMNAKSPTT

SEQ ID NO: 2925117 - protein, 20 aa, Entamoeba invadens
KNQLRRYCEYVTQVVKDEDD

SEQ ID NO: 2925118 - protein, 24 aa, Entamoeba invadens
KNTLIRKAIKMEMEAHPELELLLE

SEQ ID NO: 2925119 - protein, 20 aa, Entamoeba invadens
KPEFINRLDDIVVFTPLRQE

SEQ ID NO: 2925120 - protein, 22 aa, Entamoeba invadens
KQGHSKFRDMCLEYLNIDIDKV

SEQ ID NO: 2925121 - protein, 18 aa, Entamoeba invadens
KQGSLFIYLFRLMLATGI

SEQ ID NO: 2925122 - protein, 22 aa, Entamoeba invadens
KQLDFALPMIKNMFPYTFTVTR

SEQ ID NO: 2925123 - protein, 26 aa, Entamoeba invadens
KQLGFCIASLFGVMLGKKEFKKVEKF

SEQ ID NO: 2925124 - protein, 24 aa, Entamoeba invadens
KRILMKRLKVPPAVNIFYNHTLDK

SEQ ID NO: 2925125 - protein, 23 aa, Entamoeba invadens
KRLEDIKMVFIGAGSANATCLRL

SEQ ID NO: 2925126 - protein, 18 aa, Entamoeba invadens
KRTTVGVFHICEGDVPVP

SEQ ID NO: 2925127 - protein, 20 aa, Entamoeba invadens
KRYSAKYVLIKAGMEKKTKA

SEQ ID NO: 2925128 - protein, 18 aa, Entamoeba invadens
KSFLFKIENEKVIFFDIK

SEQ ID NO: 2925129 - protein, 18 aa, Entamoeba invadens
KSFYRVRVFYPITYQDYL

SEQ ID NO: 2925130 - protein, 23 aa, Entamoeba invadens
KSPTTCPVERSFNKIGQLDRANM

SEQ ID NO: 2925131 - protein, 22 aa, Entamoeba invadens
KSTFLGHLFAGLQIIDQRTIDR

SEQ ID NO: 2925132 - protein, 17 aa, Entamoeba invadens
KSVVDAKLEDAEREKAA

SEQ ID NO: 2925133 - protein, 23 aa, Entamoeba invadens
KSYLGGCCFNCCESLVEVELPDF

SEQ ID NO: 2925134 - protein, 24 aa, Entamoeba invadens
KTAIAVALCKQGKGMIRVNGVPLD

SEQ ID NO: 2925135 - protein, 26 aa, Entamoeba invadens
KTIGEKCFYCCVELSAITLGEVLSVG

SEQ ID NO: 2925136 - protein, 27 aa, Entamoeba invadens
KTIKHFPNIETLYIWSRKDETFGNEII

SEQ ID NO: 2925137 - protein, 18 aa, Entamoeba invadens
KTLSMKLLTASIWSPDNR

SEQ ID NO: 2925138 - protein, 20 aa, Entamoeba invadens
KTPITGPVPFKAQNPTEHFS

SEQ ID NO: 2925139 - protein, 25 aa, Entamoeba invadens
KTSILYKLKLGEIVTTIPTIGFNVE

SEQ ID NO: 2925140 - protein, 25 aa, Entamoeba invadens
KTSILYKLRLGENVTTIPTIGFNAE

SEQ ID NO: 2925141 - protein, 27 aa, Entamoeba invadens
KTYTSGCARCGFGFYYNLITQRCETCD

SEQ ID NO: 2925142 - protein, 19 aa, Entamoeba invadens
KVAHVPTFILYHNGVEQQR

SEQ ID NO: 2925143 - protein, 19 aa, Entamoeba invadens
KVGVLAVHLYRPFSAKHFL

SEQ ID NO: 2925144 - protein, 17 aa, Entamoeba invadens
KVISLGIECFIYCGSLV

SEQ ID NO: 2925145 - protein, 24 aa, Entamoeba invadens
KVLDFGRLPWKRIQIENENKGTYV

SEQ ID NO: 2925146 - protein, 19 aa, Entamoeba invadens
KVVGCLAMGVPLYHYTSQV

SEQ ID NO: 2925147 - protein, 28 aa, Entamoeba invadens
KVVLKKEFFRIIVWFNVDFETVDRNKNR

SEQ ID NO: 2925148 - protein, 24 aa, Entamoeba invadens
KYAEYFHKIEAWSVIGDGAAFDIG

SEQ ID NO: 2925149 - protein, 19 aa, Entamoeba invadens
KYCFYGCSSLSNMTIPLSV

SEQ ID NO: 2925150 - protein, 24 aa, Entamoeba invadens
KYDSVWMRGYWLIFSQDQAVKGKI

SEQ ID NO: 2925151 - protein, 20 aa, Entamoeba invadens
KYFDEYKEIVIVRVDNVGSS

SEQ ID NO: 2925152 - protein, 20 aa, Entamoeba invadens
LADDWKVLFFETSAKNKINI

SEQ ID NO: 2925153 - protein, 20 aa, Entamoeba invadens
LANRVFRLPVKAVECTKRVM

SEQ ID NO: 2925154 - protein, 20 aa, Entamoeba invadens
LCKHEFCKKCLCVCHPGKTC

SEQ ID NO: 2925155 - protein, 22 aa, Entamoeba invadens
LCSYKGHMWAKVFIKSKPGRYG

SEQ ID NO: 2925156 - protein, 18 aa, Entamoeba invadens
LCVHRSCVVLMTHGAVFT

SEQ ID NO: 2925157 - protein, 24 aa, Entamoeba invadens
LDAKYQFFGCKKFAVLADVLCGLC

SEQ ID NO: 2925158 - protein, 18 aa, Entamoeba invadens
LDDKWLIDNVDIYITKVP

SEQ ID NO: 2925159 - protein, 39 aa, Entamoeba invadens
LDELSKACELWGCEPEALRKALIQPSFKTGKEVIEKKYN

SEQ ID NO: 2925160 - protein, 17 aa, Entamoeba invadens
LDMEYTQHIPIILVGNK

SEQ ID NO: 2925161 - protein, 21 aa, Entamoeba invadens
LDMFPKDWIAFDNKKWLIERI

SEQ ID NO: 2925162 - protein, 18 aa, Entamoeba invadens
LDNSRFVGEVVITNVKGL

SEQ ID NO: 2925163 - protein, 24 aa, Entamoeba invadens
LEETRAKAFYVKKIEAELKNPDIS

SEQ ID NO: 2925164 - protein, 25 aa, Entamoeba invadens
LENFPTEGLLQFFIGTDELYGTKHS

SEQ ID NO: 2925165 - protein, 18 aa, Entamoeba invadens
LENRKLLLAEEIPTYVDA

SEQ ID NO: 2925166 - protein, 18 aa, Entamoeba invadens
LFAGLQIIDQRTIDRYKR

SEQ ID NO: 2925167 - protein, 24 aa, Entamoeba invadens
LFVNSNWKVFGAFISNQQLESSKS

SEQ ID NO: 2925168 - protein, 18 aa, Entamoeba invadens
LFYQPILCVVGNQRDEED

SEQ ID NO: 2925169 - protein, 27 aa, Entamoeba invadens
LGDIHLKFIIQPFLHWPDTMMTVIEEL

SEQ ID NO: 2925170 - protein, 18 aa, Entamoeba invadens
LHIKNCPVENVLYKNIEI

SEQ ID NO: 2925171 - protein, 24 aa, Entamoeba invadens
LHIQNCPKLTHIEGIKQVATLTIK

SEQ ID NO: 2925172 - protein, 18 aa, Entamoeba invadens
LICKKFTCILDRFQYNPI

SEQ ID NO: 2925173 - protein, 19 aa, Entamoeba invadens
LIPDEHWEPLFAELGKQSI

SEQ ID NO: 2925174 - protein, 26 aa, Entamoeba invadens
LIRKYSNDAFKCFETITLNKESQNDI

SEQ ID NO: 2925175 - protein, 27 aa, Entamoeba invadens
LKAILKISRSHFAQFKNIFVNTLNEYL

SEQ ID NO: 2925176 - protein, 25 aa, Entamoeba invadens
LKEIKIFAFKDCRCLSYLNISKSVK

SEQ ID NO: 2925177 - protein, 20 aa, Entamoeba invadens
LKINPFRYGAVIDTIYDNGV

SEQ ID NO: 2925178 - protein, 24 aa, Entamoeba invadens
LKIPETFSLIGVSSFSHNKYLQEV

SEQ ID NO: 2925179 - protein, 18 aa, Entamoeba invadens
LKISGDVDEIFNKRRVDG

SEQ ID NO: 2925180 - protein, 17 aa, Entamoeba invadens
LKKKLAEEIAKREAAEK

SEQ ID NO: 2925181 - protein, 20 aa, Entamoeba invadens
LKKNNLREWLRVVSDKNEGF

SEQ ID NO: 2925182 - protein, 25 aa, Entamoeba invadens
LKNQYCVACAIHGRIVRVRSHEDRK

SEQ ID NO: 2925183 - protein, 19 aa, Entamoeba invadens
LKRLNAPHHWMLSKLGGTF

SEQ ID NO: 2925184 - protein, 29 aa, Entamoeba invadens
LKTDFALLIKEVMTLIIQFMDWGFSIPNE

SEQ ID NO: 2925185 - protein, 18 aa, Entamoeba invadens
LKTLWLPEIKRLNRDIPI

SEQ ID NO: 2925186 - protein, 20 aa, Entamoeba invadens
LKTWKEMKKAGCVRTLVDMN

SEQ ID NO: 2925187 - protein, 18 aa, Entamoeba invadens
LKVGGLVVIEKSPCKIIS

SEQ ID NO: 2925188 - protein, 20 aa, Entamoeba invadens
LKVNPWFTLTQDIERFYDLF

SEQ ID NO: 2925189 - protein, 19 aa, Entamoeba invadens
LLGACGENVTFLPPFHCDY

SEQ ID NO: 2925190 - protein, 24 aa, Entamoeba invadens
LLGMICCGYSGFVSSASYCGPHYK

SEQ ID NO: 2925191 - protein, 26 aa, Entamoeba invadens
LLLEHIKGNVGFIFTKGDLHALKDKL

SEQ ID NO: 2925192 - protein, 25 aa, Entamoeba invadens
LLVKLSDAMILRFAIPSRKMTKEDL

SEQ ID NO: 2925193 - protein, 26 aa, Entamoeba invadens
LMGRVYPLKLGYIGVVNRSQQDINNG

SEQ ID NO: 2925194 - protein, 27 aa, Entamoeba invadens
LMKKLRMTTPHFIRCILPNTQKRRHYF

SEQ ID NO: 2925195 - protein, 17 aa, Entamoeba invadens
LNAIMKKYHRVAIISHR

SEQ ID NO: 2925196 - protein, 25 aa, Entamoeba invadens
LNFPDNTKFCGIKIFTNCTQLSSLT

SEQ ID NO: 2925197 - protein, 20 aa, Entamoeba invadens
LNIYKPWRATNEQLEMFHSK

SEQ ID NO: 2925198 - protein, 19 aa, Entamoeba invadens
LNLAPGGHMGRFIIWTESA

SEQ ID NO: 2925199 - protein, 30 aa, Entamoeba invadens
LNLNPLKLYINWCTIRNSTLETINVVQNTQ

SEQ ID NO: 2925200 - protein, 17 aa, Entamoeba invadens
LNPDWMYIRAAAIARQV

SEQ ID NO: 2925201 - protein, 37 aa, Entamoeba invadens
LNVVFKKEGNAFVGRHRRDVCEFVYYTGEPKPESQGV

SEQ ID NO: 2925202 - protein, 26 aa, Entamoeba invadens
LPEIKRLNRDIPILLVGLKSDLRESN

SEQ ID NO: 2925203 - protein, 23 aa, Entamoeba invadens
LPFKGAFRLMGKIGETFALPEDR

SEQ ID NO: 2925204 - protein, 29 aa, Entamoeba invadens
LPHGRCVAVLLPHVIRYNGVVPRKLAMWP

SEQ ID NO: 2925205 - protein, 20 aa, Entamoeba invadens
LPLKYATQIDIDWTNSVSSM

SEQ ID NO: 2925206 - protein, 22 aa, Entamoeba invadens
LPNTLPLPQIVVVGSQSSGKSS

SEQ ID NO: 2925207 - protein, 21 aa, Entamoeba invadens
LPPEAFFNVSHDIYYINLTNF

SEQ ID NO: 2925208 - protein, 23 aa, Entamoeba invadens
LPPHLTRIGAKCFVECSDLKEIK

SEQ ID NO: 2925209 - protein, 25 aa, Entamoeba invadens
LPPRELAVKFVEAFGGVEKTLEIGQ

SEQ ID NO: 2925210 - protein, 17 aa, Entamoeba invadens
LPTVKCVVFIKNNKTLF

SEQ ID NO: 2925211 - protein, 21 aa, Entamoeba invadens
LQKIICFGMVYMVFPPDHATN

SEQ ID NO: 2925212 - protein, 26 aa, Entamoeba invadens
LQLYRFGQTVSVCFWTDNWKPFSYYQ

SEQ ID NO: 2925213 - protein, 25 aa, Entamoeba invadens
LRALARAGMKIGRIEDVTPIPTDCT

SEQ ID NO: 2925214 - protein, 24 aa, Entamoeba invadens
LRANLKIETLFAMLQEALGSYREK

SEQ ID NO: 2925215 - protein, 19 aa, Entamoeba invadens
LRDFFPFKREEFPKLYEVV

SEQ ID NO: 2925216 - protein, 21 aa, Entamoeba invadens
LREEREILYRIEMKEMIERAT

SEQ ID NO: 2925217 - protein, 19 aa, Entamoeba invadens
LRILPHLQNTGGFYTAVFV

SEQ ID NO: 2925218 - protein, 26 aa, Entamoeba invadens
LRNSDLIKFLDGWIGFGEKYTFNKID

SEQ ID NO: 2925219 - protein, 17 aa, Entamoeba invadens
LRYLGILLYMGAHHDVI

SEQ ID NO: 2925220 - protein, 20 aa, Entamoeba invadens
LSCTSLQMNCFFKRDYNALN

SEQ ID NO: 2925221 - protein, 17 aa, Entamoeba invadens
LSDLILYIRDHNRFEPY

SEQ ID NO: 2925222 - protein, 24 aa, Entamoeba invadens
LSEHPRVYIPTTIVKADIGCYNFN

SEQ ID NO: 2925223 - protein, 18 aa, Entamoeba invadens
LSGGKFSVDVHGTVIEFD

SEQ ID NO: 2925224 - protein, 26 aa, Entamoeba invadens
LSSLKALHSGSCTALGPALLVSTVAA

SEQ ID NO: 2925225 - protein, 18 aa, Entamoeba invadens
LSSVRLLLIPSYNIEKSD

SEQ ID NO: 2925226 - protein, 17 aa, Entamoeba invadens
LTRIEKKTTFSLLNALK

SEQ ID NO: 2925227 - protein, 18 aa, Entamoeba invadens
LVDWCKKTGISLIQTLPV

SEQ ID NO: 2925228 - protein, 31 aa, Entamoeba invadens
LVLQCLHSLSNIKGRLPTKAFTTLIKETCDK

SEQ ID NO: 2925229 - protein, 25 aa, Entamoeba invadens
LVYGCPAHADVLVPIVTRSEYTIID

SEQ ID NO: 2925230 - protein, 30 aa, Entamoeba invadens
LYCKSHECLFGFGGGHAIGVFKKGSLSRSY

SEQ ID NO: 2925231 - protein, 18 aa, Entamoeba invadens
LYKTVAFNHCRNLKEIVI

SEQ ID NO: 2925232 - protein, 27 aa, Entamoeba invadens
MCQYEPEVFPGLVFRMTQPKVTLLVFS

SEQ ID NO: 2925233 - protein, 25 aa, Entamoeba invadens
MEGFQAGRLLACISSRPGQTGRVDG

SEQ ID NO: 2925234 - protein, 25 aa, Entamoeba invadens
MFINKEFLFNVVFAAADAFRKQNLQ

SEQ ID NO: 2925235 - protein, 19 aa, Entamoeba invadens
MHNILSFGTQCFYKNTSLQ

SEQ ID NO: 2925236 - protein, 20 aa, Entamoeba invadens
MIQEEMHFSFKMQRNDYDYK

SEQ ID NO: 2925237 - protein, 20 aa, Entamoeba invadens
MKAYCVFYCNQDVRILKQGH

SEQ ID NO: 2925238 - protein, 18 aa, Entamoeba invadens
MKEMKKFQKMFVRIVDRK

SEQ ID NO: 2925239 - protein, 19 aa, Entamoeba invadens
MKKYLKKNNLREWLRVVSD

SEQ ID NO: 2925240 - protein, 20 aa, Entamoeba invadens
MKLLTASIWSPDNREVFNDQ

SEQ ID NO: 2925241 - protein, 24 aa, Entamoeba invadens
MKRNLETFLSFSGHQISVFSDMID

SEQ ID NO: 2925242 - protein, 17 aa, Entamoeba invadens
MLDKFRCDYIVHFYGAV

SEQ ID NO: 2925243 - protein, 25 aa, Entamoeba invadens
MMFYLPEFKAIFVADNFASCMHNLG

SEQ ID NO: 2925244 - protein, 18 aa, Entamoeba invadens
MPPNMFKIAGELLPAVIH

SEQ ID NO: 2925245 - protein, 19 aa, Entamoeba invadens
MQSDECGKQIAMLMADKDS

SEQ ID NO: 2925246 - protein, 23 aa, Entamoeba invadens
MSSNLLSLGNYCFSGCSNLSVIE

SEQ ID NO: 2925247 - protein, 20 aa, Entamoeba invadens
MTSGMPFYIYNLIEELDEEG

SEQ ID NO: 2925248 - protein, 17 aa, Entamoeba invadens
MWSFGCVAAELFLGIPL

SEQ ID NO: 2925249 - protein, 29 aa, Entamoeba invadens
MWSLGCIAAEFFIGIPLFPGSSEYNQIYK

SEQ ID NO: 2925250 - protein, 18 aa, Entamoeba invadens
NADLKYEAMTFLKILEIS

SEQ ID NO: 2925251 - protein, 19 aa, Entamoeba invadens
NCVSFFPGSEVLKFVCGSS

SEQ ID NO: 2925252 - protein, 18 aa, Entamoeba invadens
NDFVVYWMKEMKKFQKMF

SEQ ID NO: 2925253 - protein, 20 aa, Entamoeba invadens
NDKYPTFPFAISMLENEAKA

SEQ ID NO: 2925254 - protein, 23 aa, Entamoeba invadens
NEAFEMTARVALGMEDGKEKDKD

SEQ ID NO: 2925255 - protein, 25 aa, Entamoeba invadens
NEIYKGEITLFVDLHVENCKADLSH

SEQ ID NO: 2925256 - protein, 25 aa, Entamoeba invadens
NEKVHLVAAHHGWIFGGDPFFDFVG

SEQ ID NO: 2925257 - protein, 22 aa, Entamoeba invadens
NELKVSDMVPGFYCPTGQSQFN

SEQ ID NO: 2925258 - protein, 28 aa, Entamoeba invadens
NERRYVQLYVKFFVKVRNAMLVVDTKKD

SEQ ID NO: 2925259 - protein, 20 aa, Entamoeba invadens
NEYRIFVSLVKDLEVLEFDT

SEQ ID NO: 2925260 - protein, 17 aa, Entamoeba invadens
NFGFIPNIFNLITSTVA

SEQ ID NO: 2925261 - protein, 18 aa, Entamoeba invadens
NFGFIPNIFNLITSTVAI

SEQ ID NO: 2925262 - protein, 17 aa, Entamoeba invadens
NFITREINSFQNIKQNI

SEQ ID NO: 2925263 - protein, 19 aa, Entamoeba invadens
NFMNYKINFFFPSEKQSKT

SEQ ID NO: 2925264 - protein, 18 aa, Entamoeba invadens
NFVAILYFVDYIITKIKV

SEQ ID NO: 2925265 - protein, 24 aa, Entamoeba invadens
NGCFKNCKNLRGITIPYNVRSLGD

SEQ ID NO: 2925266 - protein, 24 aa, Entamoeba invadens
NGFISTDIFLAWFRDVVLTYIIKK

SEQ ID NO: 2925267 - protein, 24 aa, Entamoeba invadens
NGPEWVWPYGYYVMAMLMYNPDNL

SEQ ID NO: 2925268 - protein, 24 aa, Entamoeba invadens
NIKKCKLSTYSATRWNYMANSSSA

SEQ ID NO: 2925269 - protein, 24 aa, Entamoeba invadens
NKENEWKKNFIVLNNQQLEDSRNK

SEQ ID NO: 2925270 - protein, 23 aa, Entamoeba invadens
NKERCCRGLYGSLNHNIKSQYQL

SEQ ID NO: 2925271 - protein, 17 aa, Entamoeba invadens
NKIAGYITHLMKRIQNG

SEQ ID NO: 2925272 - protein, 20 aa, Entamoeba invadens
NKKGLDFGCFKNDRESDIDV

SEQ ID NO: 2925273 - protein, 24 aa, Entamoeba invadens
NKKIKVICPHITFSSGDLQNNYSY

SEQ ID NO: 2925274 - protein, 26 aa, Entamoeba invadens
NKNFDMRPGMIIKNLKLRRPIFQKTA

SEQ ID NO: 2925275 - protein, 33 aa, Entamoeba invadens
NKPKRKSSLHVLKKMLLTFMISSTFIDLNYSES

SEQ ID NO: 2925276 - protein, 17 aa, Entamoeba invadens
NKQEWRIVISENKMHFF

SEQ ID NO: 2925277 - protein, 23 aa, Entamoeba invadens
NKTEIFEFFISVACECLEISEYN

SEQ ID NO: 2925278 - protein, 23 aa, Entamoeba invadens
NKYGKDCAYDFLCDLPHNAVCYF

SEQ ID NO: 2925279 - protein, 19 aa, Entamoeba invadens
NLGTFIIELRRNYKTPKSQ

SEQ ID NO: 2925280 - protein, 21 aa, Entamoeba invadens
NLKQGHSIFRDMCLEYLNIDV

SEQ ID NO: 2925281 - protein, 17 aa, Entamoeba invadens
NLLVFSLDINDKVNAKL

SEQ ID NO: 2925282 - protein, 20 aa, Entamoeba invadens
NLQIKCARANNSFNTITRSK

SEQ ID NO: 2925283 - protein, 17 aa, Entamoeba invadens
NMFPYTFTVTRQYKYMY

SEQ ID NO: 2925284 - protein, 19 aa, Entamoeba invadens
NMTRRAAKFMNDYKKEGDE

SEQ ID NO: 2925285 - protein, 18 aa, Entamoeba invadens
NNETFPLLVISEVKHLFI

SEQ ID NO: 2925286 - protein, 47 aa, Entamoeba invadens
NNGELPKEIPFSVPSVFRKEFSALKRKGEISWDDLVKLLVGPTKGHG

SEQ ID NO: 2925287 - protein, 17 aa, Entamoeba invadens
NNITQIGNFCFACATQL

SEQ ID NO: 2925288 - protein, 26 aa, Entamoeba invadens
NNLVFKRVDIPSVNTYVFKGVKYEIN

SEQ ID NO: 2925289 - protein, 37 aa, Entamoeba invadens
NPDDRILLLYLFFKYDKLRIIRDLCLPFVKTNEQIER

SEQ ID NO: 2925290 - protein, 24 aa, Entamoeba invadens
NPPKLCVGMKYLVRVLPQLNTVFF

SEQ ID NO: 2925291 - protein, 18 aa, Entamoeba invadens
NQGFRVVRDMVLPMLCRG

SEQ ID NO: 2925292 - protein, 21 aa, Entamoeba invadens
NRKRFSECIDVLFDYYLHSKY

SEQ ID NO: 2925293 - protein, 22 aa, Entamoeba invadens
NRKRFSECIDVLFDYYLHSKYC

SEQ ID NO: 2925294 - protein, 20 aa, Entamoeba invadens
NRTSPFAFIGNRFEFRAVGS

SEQ ID NO: 2925295 - protein, 19 aa, Entamoeba invadens
NTICDCISEVNLKHQHKLD

SEQ ID NO: 2925296 - protein, 24 aa, Entamoeba invadens
NTTKTFKACFGRIFHIQQEAHMNE

SEQ ID NO: 2925297 - protein, 22 aa, Entamoeba invadens
NVHMYREFGGRINGFKHNQKQM

SEQ ID NO: 2925298 - protein, 18 aa, Entamoeba invadens
NVPFLKIVNPALMALYAE

SEQ ID NO: 2925299 - protein, 25 aa, Entamoeba invadens
NYIKGVFRTANWSVFGLSERTNNRS

SEQ ID NO: 2925300 - protein, 23 aa, Entamoeba invadens
NYVYRGNMWTAYAPDRYGRTFYY

SEQ ID NO: 2925301 - protein, 20 aa, Entamoeba invadens
PAQIGWGKLGVDYVVESTGV

SEQ ID NO: 2925302 - protein, 24 aa, Entamoeba invadens
PAYHTLMKLKLPKSLAEKNAAKRK

SEQ ID NO: 2925303 - protein, 19 aa, Entamoeba invadens
PCIVLDIVRILGRNAPEKK

SEQ ID NO: 2925304 - protein, 17 aa, Entamoeba invadens
PDISVALNLSLRQLDPT

SEQ ID NO: 2925305 - protein, 20 aa, Entamoeba invadens
PDMRGLCIGKKVIDQLKQLF

SEQ ID NO: 2925306 - protein, 21 aa, Entamoeba invadens
PELVASFVSLLFVYTKEQDSF

SEQ ID NO: 2925307 - protein, 18 aa, Entamoeba invadens
PESLEIIEDMAFANNNLL

SEQ ID NO: 2925308 - protein, 17 aa, Entamoeba invadens
PGGHMGRFIIWTESAFK

SEQ ID NO: 2925309 - protein, 19 aa, Entamoeba invadens
PIGDVKGKHVIIYDDMTRT

SEQ ID NO: 2925310 - protein, 19 aa, Entamoeba invadens
PKCCFSRSKLEEFVVPPNV

SEQ ID NO: 2925311 - protein, 18 aa, Entamoeba invadens
PKSARYGVYHLQYNQGSG

SEQ ID NO: 2925312 - protein, 20 aa, Entamoeba invadens
PKTAFYSGFMLSELSYKCKA

SEQ ID NO: 2925313 - protein, 17 aa, Entamoeba invadens
PKTYLKNQYCVACAIHG

SEQ ID NO: 2925314 - protein, 20 aa, Entamoeba invadens
PLSAFPKMFGLSNIQKEIYP

SEQ ID NO: 2925315 - protein, 19 aa, Entamoeba invadens
PMLSRGELRCIGATTLEEY

SEQ ID NO: 2925316 - protein, 20 aa, Entamoeba invadens
PNDIPSFFVNKALVTEPVPW

SEQ ID NO: 2925317 - protein, 23 aa, Entamoeba invadens
PNFSTSAFGRVEMKNCNFVAPFE

SEQ ID NO: 2925318 - protein, 19 aa, Entamoeba invadens
PNMPFDFVFNEKIDFTIYK

SEQ ID NO: 2925319 - protein, 25 aa, Entamoeba invadens
PNPIKMLRPAVHCMGQKYNYKLRLG

SEQ ID NO: 2925320 - protein, 19 aa, Entamoeba invadens
PPKSARYGVYHLQYNQGSG

SEQ ID NO: 2925321 - protein, 30 aa, Entamoeba invadens
PSGGPHGMKECLPLILIMRNRLHYALNARE

SEQ ID NO: 2925322 - protein, 25 aa, Entamoeba invadens
PSLFEKRCVNNLVMKNIDNIPYQMA

SEQ ID NO: 2925323 - protein, 23 aa, Entamoeba invadens
PSSEVFRSRVFAPNFVVAKSKFW

SEQ ID NO: 2925324 - protein, 18 aa, Entamoeba invadens
PSSKVICEFLNIMMKHQY

SEQ ID NO: 2925325 - protein, 23 aa, Entamoeba invadens
PTESKFISAFIVDIDITKVNKKL

SEQ ID NO: 2925326 - protein, 19 aa, Entamoeba invadens
PTHITELYHSCFYNNTTLT

SEQ ID NO: 2925327 - protein, 23 aa, Entamoeba invadens
PTHITELYHSCFYNNTTLTSVTL

SEQ ID NO: 2925328 - protein, 25 aa, Entamoeba invadens
PTSCFQNCVCLAVVTFSRQLEKIGN

SEQ ID NO: 2925329 - protein, 18 aa, Entamoeba invadens
PTVTSLGEYCFSRCTNLS

SEQ ID NO: 2925330 - protein, 24 aa, Entamoeba invadens
PVLPKMTVCALRFTKTAEQAITKA

SEQ ID NO: 2925331 - protein, 19 aa, Entamoeba invadens
PVPHSEYFLYECTNQSIYF

SEQ ID NO: 2925332 - protein, 20 aa, Entamoeba invadens
PYSCAIDMWSFGCVAAELFL

SEQ ID NO: 2925333 - protein, 25 aa, Entamoeba invadens
QCSPCNPRIPMVVDMEKILKEAYYP

SEQ ID NO: 2925334 - protein, 17 aa, Entamoeba invadens
QDGESYYRINIPERTSL

SEQ ID NO: 2925335 - protein, 22 aa, Entamoeba invadens
QEIFKRLKIEVLNRMNNKEINN

SEQ ID NO: 2925336 - protein, 17 aa, Entamoeba invadens
QFLIPVVEWIYSQDVDA

SEQ ID NO: 2925337 - protein, 19 aa, Entamoeba invadens
QGLLLMPPNMFKIAGELLP

SEQ ID NO: 2925338 - protein, 20 aa, Entamoeba invadens
QIDNCIKYVNGMCVECSSKY

SEQ ID NO: 2925339 - protein, 17 aa, Entamoeba invadens
QIEFNIIRGYYWTGCKS

SEQ ID NO: 2925340 - protein, 20 aa, Entamoeba invadens
QIGNFCFACATQLENVILPS

SEQ ID NO: 2925341 - protein, 18 aa, Entamoeba invadens
QIVLDVFLPQSLYVKDEF

SEQ ID NO: 2925342 - protein, 18 aa, Entamoeba invadens
QKDVELFNGIIPSNFYKL

SEQ ID NO: 2925343 - protein, 18 aa, Entamoeba invadens
QKLIVAIRIRGINNVSPK

SEQ ID NO: 2925344 - protein, 17 aa, Entamoeba invadens
QLFCGHWLLEVDGDAAH

SEQ ID NO: 2925345 - protein, 20 aa, Entamoeba invadens
QMKRMWKWQMMNQMYNRPPP

SEQ ID NO: 2925346 - protein, 23 aa, Entamoeba invadens
QNLDFSKPLWKFHIFTNVAGKWK

SEQ ID NO: 2925347 - protein, 19 aa, Entamoeba invadens
QNLQDLFVDLSMFTANSND

SEQ ID NO: 2925348 - protein, 28 aa, Entamoeba invadens
QRFNVDVWRKFCWVFGYLPVAALIDSSI

SEQ ID NO: 2925349 - protein, 21 aa, Entamoeba invadens
QRKLFKTVFLYFQPCKSYAIY

SEQ ID NO: 2925350 - protein, 21 aa, Entamoeba invadens
QTSRFFKKKGTIAIKENTPPS

SEQ ID NO: 2925351 - protein, 19 aa, Entamoeba invadens
QTVFFKLADILPFETAVKL

SEQ ID NO: 2925352 - protein, 19 aa, Entamoeba invadens
QVIKKGCFDMCSSLTKIVL

SEQ ID NO: 2925353 - protein, 24 aa, Entamoeba invadens
QVLRKRLIGKTVKFEVVKEMDNGI

SEQ ID NO: 2925354 - protein, 25 aa, Entamoeba invadens
QVSPEDCMGCNSCASSCKSKAITML

SEQ ID NO: 2925355 - protein, 21 aa, Entamoeba invadens
QYFRNGHGFLIVYSVTDRNSF

SEQ ID NO: 2925356 - protein, 22 aa, Entamoeba invadens
RAALKHFGKVCAKKHAAKEYKG

SEQ ID NO: 2925357 - protein, 18 aa, Entamoeba invadens
RDIFEPPRYMTINQCIDQ

SEQ ID NO: 2925358 - protein, 18 aa, Entamoeba invadens
REALYSSIFKFIIKAFPK

SEQ ID NO: 2925359 - protein, 19 aa, Entamoeba invadens
REFIQGAIYGGRCMTRDNK

SEQ ID NO: 2925360 - protein, 20 aa, Entamoeba invadens
REFIQGAIYGGRCMTRDNKK

SEQ ID NO: 2925361 - protein, 39 aa, Entamoeba invadens
REKLWRTCQFVIKMEKILYSLGVAFEFFDLKYSDLPKVL

SEQ ID NO: 2925362 - protein, 20 aa, Entamoeba invadens
RFNGPAFVIFYCVCVDHKFD

SEQ ID NO: 2925363 - protein, 20 aa, Entamoeba invadens
RGDLPLFFYMNPFFGDQNTP

SEQ ID NO: 2925364 - protein, 20 aa, Entamoeba invadens
RHYRAPEIVLGLPYSCAIDM

SEQ ID NO: 2925365 - protein, 17 aa, Entamoeba invadens
RIDKITPSLCKLTKLSV

SEQ ID NO: 2925366 - protein, 20 aa, Entamoeba invadens
RIFYCREYAFRIREFLGEQV

SEQ ID NO: 2925367 - protein, 20 aa, Entamoeba invadens
RIINCTTDGASVCSGLDGGL

SEQ ID NO: 2925368 - protein, 17 aa, Entamoeba invadens
RISNNMFAHCLNIKNVI

SEQ ID NO: 2925369 - protein, 17 aa, Entamoeba invadens
RISSPKSTALIFQTGKI

SEQ ID NO: 2925370 - protein, 20 aa, Entamoeba invadens
RIVISENKMHFFGIKGSWTA

SEQ ID NO: 2925371 - protein, 28 aa, Entamoeba invadens
RIVSVGGYVTKGRVNGVLAITRSIGDVR

SEQ ID NO: 2925372 - protein, 19 aa, Entamoeba invadens
RKEEVAPHVYAIAEGALTQ

SEQ ID NO: 2925373 - protein, 24 aa, Entamoeba invadens
RKLVKESKNSVCIDVDVDKAPQLK

SEQ ID NO: 2925374 - protein, 18 aa, Entamoeba invadens
RKLVYMAVDGVAPRAKMN

SEQ ID NO: 2925375 - protein, 21 aa, Entamoeba invadens
RKPEFMIALNSCFLPEYEKVK

SEQ ID NO: 2925376 - protein, 25 aa, Entamoeba invadens
RLEECRKKGIISWLRPDAKTQVTLE

SEQ ID NO: 2925377 - protein, 17 aa, Entamoeba invadens
RLIGRRFSDPAIQEDMK

SEQ ID NO: 2925378 - protein, 20 aa, Entamoeba invadens
RLLVQNGYWNLFRYDPSKKG

SEQ ID NO: 2925379 - protein, 27 aa, Entamoeba invadens
RMGPFSEKGFKEFGVGVIGIIRALPKT

SEQ ID NO: 2925380 - protein, 19 aa, Entamoeba invadens
RMHRTLKIGLSRAGRRTTL

SEQ ID NO: 2925381 - protein, 22 aa, Entamoeba invadens
RMLRKYFSTTFVASSLINEICE

SEQ ID NO: 2925382 - protein, 20 aa, Entamoeba invadens
RMTCYDCKHLKEVVMDNTVE

SEQ ID NO: 2925383 - protein, 20 aa, Entamoeba invadens
RNCFDGCKALKSVIVENKKC

SEQ ID NO: 2925384 - protein, 19 aa, Entamoeba invadens
RNECLKCNINYYLKLGKCY

SEQ ID NO: 2925385 - protein, 25 aa, Entamoeba invadens
RNFLLSAHEGGEFTVEFPSEPITSG

SEQ ID NO: 2925386 - protein, 19 aa, Entamoeba invadens
RPLSYPQTDVFLICFSVVS

SEQ ID NO: 2925387 - protein, 21 aa, Entamoeba invadens
RPYKATLVFKSKSAKLCVYNL

SEQ ID NO: 2925388 - protein, 25 aa, Entamoeba invadens
RQKLEEWTGLKFQKVLFDSEVDNFS

SEQ ID NO: 2925389 - protein, 20 aa, Entamoeba invadens
RQSMKVVVTHPVFFDQKQRD

SEQ ID NO: 2925390 - protein, 17 aa, Entamoeba invadens
RRLPNQCFYNCVHLSKI

SEQ ID NO: 2925391 - protein, 29 aa, Entamoeba invadens
RRNELPEMCDLLACVGCVCDYMDETDYIT

SEQ ID NO: 2925392 - protein, 18 aa, Entamoeba invadens
RRQVAGLLALSLLGFYTL

SEQ ID NO: 2925393 - protein, 22 aa, Entamoeba invadens
RRTRKLFRRPYRCHGLQNTTTF

SEQ ID NO: 2925394 - protein, 19 aa, Entamoeba invadens
RSCFEGCSSLVTVKLPQNI

SEQ ID NO: 2925395 - protein, 24 aa, Entamoeba invadens
RSDRYKGFIYVGASKTGKTFFFDR

SEQ ID NO: 2925396 - protein, 18 aa, Entamoeba invadens
RSDVWSFGILIYRLLVGR

SEQ ID NO: 2925397 - protein, 18 aa, Entamoeba invadens
RSETRWLQTVLILDNMFE

SEQ ID NO: 2925398 - protein, 19 aa, Entamoeba invadens
RSVHRSALEYIIFTNCVLT

SEQ ID NO: 2925399 - protein, 24 aa, Entamoeba invadens
RTTQLRMLPSHMLRHDERPMTSQI

SEQ ID NO: 2925400 - protein, 25 aa, Entamoeba invadens
RVFKVFRTSEEIHFIDYFEKIPQRV

SEQ ID NO: 2925401 - protein, 17 aa, Entamoeba invadens
RVIRKVETHPGWTTQDR

SEQ ID NO: 2925402 - protein, 24 aa, Entamoeba invadens
RVNKRIPHWDINMCQQCSTCSIVC

SEQ ID NO: 2925403 - protein, 19 aa, Entamoeba invadens
RYINARFLPDKAIDLVDEA

SEQ ID NO: 2925404 - protein, 17 aa, Entamoeba invadens
SALLLFVNSNWKVFGAF

SEQ ID NO: 2925405 - protein, 24 aa, Entamoeba invadens
SASTLRLGDFCFNKCSNLSQIKLP

SEQ ID NO: 2925406 - protein, 21 aa, Entamoeba invadens
SCAGYCVATYILGIGDRHSDN

SEQ ID NO: 2925407 - protein, 23 aa, Entamoeba invadens
SCVNAISGIISFAGYQLDRPKVF

SEQ ID NO: 2925408 - protein, 22 aa, Entamoeba invadens
SDGESMCEWIFNALAFDINKEV

SEQ ID NO: 2925409 - protein, 20 aa, Entamoeba invadens
SDRVYRVTIVPGDFDTINKE

SEQ ID NO: 2925410 - protein, 30 aa, Entamoeba invadens
SEATVLYNLRLRYMKDIIHTYSGLFCVVIN

SEQ ID NO: 2925411 - protein, 20 aa, Entamoeba invadens
SEETVELVLSPPELQKLEKV

SEQ ID NO: 2925412 - protein, 20 aa, Entamoeba invadens
SEIKIPVKFASEMSTALDPD

SEQ ID NO: 2925413 - protein, 25 aa, Entamoeba invadens
SENLRELPAFCFSDCKKLREVVIPQ

SEQ ID NO: 2925414 - protein, 24 aa, Entamoeba invadens
SEPPKCPSCASYFTLNSFTEDGNI

SEQ ID NO: 2925415 - protein, 24 aa, Entamoeba invadens
SEYCPTCRQRIVFNKNLLQNDVKL

SEQ ID NO: 2925416 - protein, 19 aa, Entamoeba invadens
SFYGCVSLTSILCNTNVIL

SEQ ID NO: 2925417 - protein, 21 aa, Entamoeba invadens
SGKKLLAMRVVEEAFDIIHLL

SEQ ID NO: 2925418 - protein, 23 aa, Entamoeba invadens
SHLTKLSAAFTYVYNLRDLVIPS

SEQ ID NO: 2925419 - protein, 18 aa, Entamoeba invadens
SHYTLICVCWSKNKNERL

SEQ ID NO: 2925420 - protein, 17 aa, Entamoeba invadens
SICNNCFSWCKNLSSIT

SEQ ID NO: 2925421 - protein, 18 aa, Entamoeba invadens
SIGDKCFYKSTFLNEVTL

SEQ ID NO: 2925422 - protein, 19 aa, Entamoeba invadens
SINKIFLKARHETKEIYLK

SEQ ID NO: 2925423 - protein, 21 aa, Entamoeba invadens
SIPDIIPLLLTRIEKKTTFSL

SEQ ID NO: 2925424 - protein, 24 aa, Entamoeba invadens
SIRKFAFYYCINFSQIVLPISLVD

SEQ ID NO: 2925425 - protein, 19 aa, Entamoeba invadens
SKGFPIKKSSLINTSECVT

SEQ ID NO: 2925426 - protein, 21 aa, Entamoeba invadens
SKHPLTDYVFIVIEMDLDDIK

SEQ ID NO: 2925427 - protein, 18 aa, Entamoeba invadens
SKLPLMLYYIDVRMKAYF

SEQ ID NO: 2925428 - protein, 25 aa, Entamoeba invadens
SKLTEICNFAFFKCYSLNKIVLPTH

SEQ ID NO: 2925429 - protein, 19 aa, Entamoeba invadens
SKQQFMCFVVRSENKRTFG

SEQ ID NO: 2925430 - protein, 19 aa, Entamoeba invadens
SKVHFSMNQFNIMKTEDLI

SEQ ID NO: 2925431 - protein, 17 aa, Entamoeba invadens
SKYALFFDEVVINNTEL

SEQ ID NO: 2925432 - protein, 18 aa, Entamoeba invadens
SLCEIELPPTLQKIRNFM

SEQ ID NO: 2925433 - protein, 17 aa, Entamoeba invadens
SLGKVMQTPECLRVYVS

SEQ ID NO: 2925434 - protein, 17 aa, Entamoeba invadens
SLIKIPYDFSMFETLTK

SEQ ID NO: 2925435 - protein, 19 aa, Entamoeba invadens
SLLQIPKFVKSISLKNGFT

SEQ ID NO: 2925436 - protein, 19 aa, Entamoeba invadens
SMDTPCFYMAMGNNQFPNA

SEQ ID NO: 2925437 - protein, 17 aa, Entamoeba invadens
SNCILNIDCESCETFEF

SEQ ID NO: 2925438 - protein, 23 aa, Entamoeba invadens
SNFEKSLIITPFASYSTHLPHSQ

SEQ ID NO: 2925439 - protein, 21 aa, Entamoeba invadens
SNGNLKGIRPHDAVEKSGNLT

SEQ ID NO: 2925440 - protein, 19 aa, Entamoeba invadens
SNISIPHNVIFIGKDAFNW

SEQ ID NO: 2925441 - protein, 19 aa, Entamoeba invadens
SNVAFPLPRLNIIEIKKHS

SEQ ID NO: 2925442 - protein, 17 aa, Entamoeba invadens
SPINREIYEYGKCSNGV

SEQ ID NO: 2925443 - protein, 19 aa, Entamoeba invadens
SQPRKARKAFYNANKNQRR

SEQ ID NO: 2925444 - protein, 23 aa, Entamoeba invadens
SQTRLCILPDLIETTKCFGVYID

SEQ ID NO: 2925445 - protein, 18 aa, Entamoeba invadens
SQVEFMGKVSLNYFTEKA

SEQ ID NO: 2925446 - protein, 18 aa, Entamoeba invadens
SQVKLEIMTKPDLSTDCG

SEQ ID NO: 2925447 - protein, 23 aa, Entamoeba invadens
SRLKLYANHSLCDGRTIANLYQV

SEQ ID NO: 2925448 - protein, 18 aa, Entamoeba invadens
SRRWTLRGILPQYTLCHK

SEQ ID NO: 2925449 - protein, 20 aa, Entamoeba invadens
SSGKWALRKVRSQKKRECIH

SEQ ID NO: 2925450 - protein, 18 aa, Entamoeba invadens
SSSFEYVSALKIIQFPKG

SEQ ID NO: 2925451 - protein, 18 aa, Entamoeba invadens
STEFPSLFEKRCVNNLVM

SEQ ID NO: 2925452 - protein, 21 aa, Entamoeba invadens
STENFPMFFASTLTRLTNFHC

SEQ ID NO: 2925453 - protein, 18 aa, Entamoeba invadens
STEWFPKRVRKLRIFEEE

SEQ ID NO: 2925454 - protein, 17 aa, Entamoeba invadens
STKEKMVGLAIFYYKRR

SEQ ID NO: 2925455 - protein, 17 aa, Entamoeba invadens
STLTRISNDRVTDKTTV

SEQ ID NO: 2925456 - protein, 25 aa, Entamoeba invadens
STMCECLRNIVKINGVDSFSAAISP

SEQ ID NO: 2925457 - protein, 30 aa, Entamoeba invadens
STVLKQLRCNGVLEGIRITRLGYPNRIIYN

SEQ ID NO: 2925458 - protein, 19 aa, Entamoeba invadens
SVLEVIKSAMIHQIKAMLN

SEQ ID NO: 2925459 - protein, 23 aa, Entamoeba invadens
SVRRLGNFCFYGCRELREIKIGN

SEQ ID NO: 2925460 - protein, 25 aa, Entamoeba invadens
SVRTAELMTGVLLYHERVDIKPTTL

SEQ ID NO: 2925461 - protein, 22 aa, Entamoeba invadens
SVVHCLVCIFPTSVSVERFFSK

SEQ ID NO: 2925462 - protein, 17 aa, Entamoeba invadens
SVVSTCYSIVYREEKYL

SEQ ID NO: 2925463 - protein, 28 aa, Entamoeba invadens
SYDRKIFGIAIPECVNSLGESCYTNTKK

SEQ ID NO: 2925464 - protein, 20 aa, Entamoeba invadens
SYIHFSVCLFNDIYTLVNEL

SEQ ID NO: 2925465 - protein, 18 aa, Entamoeba invadens
SYKDANIFLDKAVKNTSA

SEQ ID NO: 2925466 - protein, 19 aa, Entamoeba invadens
TAGGVHLIGLFDGHGGAES

SEQ ID NO: 2925467 - protein, 17 aa, Entamoeba invadens
TALGPALLVSTVAAGKQ

SEQ ID NO: 2925468 - protein, 17 aa, Entamoeba invadens
TCLLLTYTTNAFPETYV

SEQ ID NO: 2925469 - protein, 17 aa, Entamoeba invadens
TDNWKPFSYYQRIKTNR

SEQ ID NO: 2925470 - protein, 24 aa, Entamoeba invadens
TDVLSCRSTGFCYLTSNTPQESYD

SEQ ID NO: 2925471 - protein, 22 aa, Entamoeba invadens
TEDQLFAVSFAVALQNKEIAFI

SEQ ID NO: 2925472 - protein, 26 aa, Entamoeba invadens
TEEFRFGKTKIFFKVGVLAEIEEIRE

SEQ ID NO: 2925473 - protein, 17 aa, Entamoeba invadens
TEGFKISPILDAFEVNC

SEQ ID NO: 2925474 - protein, 27 aa, Entamoeba invadens
TEHVVLKMCKRCFVMSKKPEIVTQIKC

SEQ ID NO: 2925475 - protein, 18 aa, Entamoeba invadens
TEIGDQCFYGCKYLESVV

SEQ ID NO: 2925476 - protein, 20 aa, Entamoeba invadens
TEPVPWALVSVGSLGCMVDI

SEQ ID NO: 2925477 - protein, 23 aa, Entamoeba invadens
TESAFKRLNYIFGTQKAMAQGKK

SEQ ID NO: 2925478 - protein, 20 aa, Entamoeba invadens
TETYCLPLGFVTDDQKVIGS

SEQ ID NO: 2925479 - protein, 25 aa, Entamoeba invadens
TFNDFPKLGTFVLRDNGKIAAYGGV

SEQ ID NO: 2925480 - protein, 17 aa, Entamoeba invadens
TGCAKCFDGHYLSGTEC

SEQ ID NO: 2925481 - protein, 26 aa, Entamoeba invadens
TGFGCECFGRGCGIESIVVTPNICVS

SEQ ID NO: 2925482 - protein, 24 aa, Entamoeba invadens
TGVSRVKFPYGYPILENFNITSHT

SEQ ID NO: 2925483 - protein, 23 aa, Entamoeba invadens
THISKFAFKNCISLTSFNSESVL

SEQ ID NO: 2925484 - protein, 18 aa, Entamoeba invadens
THLMKRIQNGPVRGISFK

SEQ ID NO: 2925485 - protein, 27 aa, Entamoeba invadens
TIEASLPFLHFFDGFKTGYALQKVSTL

SEQ ID NO: 2925486 - protein, 17 aa, Entamoeba invadens
TIEETFNVFSIIDLEKE

SEQ ID NO: 2925487 - protein, 17 aa, Entamoeba invadens
TIPLGVTSFSDWCFSGC

SEQ ID NO: 2925488 - protein, 19 aa, Entamoeba invadens
TITSSSLFPSFARIVDADR

SEQ ID NO: 2925489 - protein, 19 aa, Entamoeba invadens
TKGVCKLVSFYNEKKKLVL

SEQ ID NO: 2925490 - protein, 18 aa, Entamoeba invadens
TKHAMRWGVPVLTHQWLF

SEQ ID NO: 2925491 - protein, 26 aa, Entamoeba invadens
TKIMCGEVWCSSAFVEEERNSGFLVF

SEQ ID NO: 2925492 - protein, 20 aa, Entamoeba invadens
TKKIYEYFGMEYTPEFEQNI

SEQ ID NO: 2925493 - protein, 18 aa, Entamoeba invadens
TKLSEFSFYGCVSLTSIL

SEQ ID NO: 2925494 - protein, 24 aa, Entamoeba invadens
TKNLKRIWGGAFWNCSSLNEVVVC

SEQ ID NO: 2925495 - protein, 23 aa, Entamoeba invadens
TKPAIRRLARRGGVKRINGLVYE

SEQ ID NO: 2925496 - protein, 21 aa, Entamoeba invadens
TKPIVFCCANPVPEIYPYEAK

SEQ ID NO: 2925497 - protein, 18 aa, Entamoeba invadens
TKTPIKVNRSFMNDFDSL

SEQ ID NO: 2925498 - protein, 18 aa, Entamoeba invadens
TKTPITVNHHFMNDFDSL

SEQ ID NO: 2925499 - protein, 22 aa, Entamoeba invadens
TMQCSQTLWGADIKHPNTKNDV

SEQ ID NO: 2925500 - protein, 22 aa, Entamoeba invadens
TNKRVVDEFAVISTKKMRNKIA

SEQ ID NO: 2925501 - protein, 18 aa, Entamoeba invadens
TNLTEIWMGKNLNKIELF

SEQ ID NO: 2925502 - protein, 18 aa, Entamoeba invadens
TNLTHVALPFSLKYIPPL

SEQ ID NO: 2925503 - protein, 23 aa, Entamoeba invadens
TNMEKMREGIYRELNKLQTQNQQ

SEQ ID NO: 2925504 - protein, 25 aa, Entamoeba invadens
TNSKYYYVHSCLSYLAMKKKYSFIV

SEQ ID NO: 2925505 - protein, 27 aa, Entamoeba invadens
TNVDLGTACGRYFGVSVLSIVDAGDSD

SEQ ID NO: 2925506 - protein, 27 aa, Entamoeba invadens
TNVMSECYGKLLAFDLEKYIKAFYIPA

SEQ ID NO: 2925507 - protein, 24 aa, Entamoeba invadens
TPHLILCCCLNIGIDPPLNGLVKP

SEQ ID NO: 2925508 - protein, 19 aa, Entamoeba invadens
TPLLELTGLVVLKVKDNKI

SEQ ID NO: 2925509 - protein, 18 aa, Entamoeba invadens
TRGIPLIIIFSKVDLPYN

SEQ ID NO: 2925510 - protein, 24 aa, Entamoeba invadens
TRLGVAECMGMPIGTTALAQLVLS

SEQ ID NO: 2925511 - protein, 19 aa, Entamoeba invadens
TRNVLKQFLEQVIRDSVTY

SEQ ID NO: 2925512 - protein, 22 aa, Entamoeba invadens
TSIICAECKEVGVKEPLTKEKL

SEQ ID NO: 2925513 - protein, 22 aa, Entamoeba invadens
TSILRYLGILLYMGAHHDVINP

SEQ ID NO: 2925514 - protein, 31 aa, Entamoeba invadens
TSKYPAIVYRKLRATRRCSICETNKPIYQVV

SEQ ID NO: 2925515 - protein, 29 aa, Entamoeba invadens
TSLLPATTWPWYKLISAIKLFTFPPGVNR

SEQ ID NO: 2925516 - protein, 18 aa, Entamoeba invadens
TSLTKLDVPFSYMKHVYT

SEQ ID NO: 2925517 - protein, 23 aa, Entamoeba invadens
TSVGQQCFYCCKNLTKINTNNSI

SEQ ID NO: 2925518 - protein, 18 aa, Entamoeba invadens
TTHNFVFPTSITKIGKHS

SEQ ID NO: 2925519 - protein, 19 aa, Entamoeba invadens
TTLNGCFDPLMSALHAYEE

SEQ ID NO: 2925520 - protein, 24 aa, Entamoeba invadens
TVAHPKLFVLIDFLRKIENKTKKE

SEQ ID NO: 2925521 - protein, 32 aa, Entamoeba invadens
TVDEISNLIKLWFRELPKPILNVLSSDQIFYS

SEQ ID NO: 2925522 - protein, 18 aa, Entamoeba invadens
TVIPAVQGVKGFEHEKKT

SEQ ID NO: 2925523 - protein, 25 aa, Entamoeba invadens
VACFMKEILEESGLSSQVYLYTKKD

SEQ ID NO: 2925524 - protein, 25 aa, Entamoeba invadens
VAHCGVPNPRIVIVGTKSDIRDNAK

SEQ ID NO: 2925525 - protein, 19 aa, Entamoeba invadens
VAKTLKLNTLVLADSFDFF

SEQ ID NO: 2925526 - protein, 23 aa, Entamoeba invadens
VALPRSGSTFTHAVLSQDPNANC

SEQ ID NO: 2925527 - protein, 20 aa, Entamoeba invadens
VARNLNMFVSTYFKVERMLL

SEQ ID NO: 2925528 - protein, 17 aa, Entamoeba invadens
VASICNNCFSWCKNLSS

SEQ ID NO: 2925529 - protein, 23 aa, Entamoeba invadens
VDIYKKLAVSFRSARRRLKSENS

SEQ ID NO: 2925530 - protein, 23 aa, Entamoeba invadens
VDRSGAYCARWIAKSLVNAGLCK

SEQ ID NO: 2925531 - protein, 18 aa, Entamoeba invadens
VDSVFCHKAWTEAPKEHG

SEQ ID NO: 2925532 - protein, 27 aa, Entamoeba invadens
VEKFHKYIKWGVCVDAYSCYMDDFLNM

SEQ ID NO: 2925533 - protein, 17 aa, Entamoeba invadens
VELLSTMCECLRNIVKI

SEQ ID NO: 2925534 - protein, 19 aa, Entamoeba invadens
VELTRRQVAGLLALSLLGF

SEQ ID NO: 2925535 - protein, 24 aa, Entamoeba invadens
VESLRPNLYEGWGKKQGGAVKTWK

SEQ ID NO: 2925536 - protein, 19 aa, Entamoeba invadens
VGKKFKYPLDFGSVTSLTR

SEQ ID NO: 2925537 - protein, 18 aa, Entamoeba invadens
VGKTCLLLTYTTNAFPET

SEQ ID NO: 2925538 - protein, 26 aa, Entamoeba invadens
VGQPLCPASFLLRCDTLKEYTGNYEK

SEQ ID NO: 2925539 - protein, 25 aa, Entamoeba invadens
VGRCPREIENINEWAKMNMLTPVSG

SEQ ID NO: 2925540 - protein, 23 aa, Entamoeba invadens
VGRQKCYWGQLGTISDIKSIATK

SEQ ID NO: 2925541 - protein, 23 aa, Entamoeba invadens
VHPDASVVLLRYFNPIGAHKSGL

SEQ ID NO: 2925542 - protein, 17 aa, Entamoeba invadens
VIFDLAILSLKYIQSPI

SEQ ID NO: 2925543 - protein, 18 aa, Entamoeba invadens
VISPDMRGLCIGKKVIDQ

SEQ ID NO: 2925544 - protein, 19 aa, Entamoeba invadens
VKAKIPWLQAEGENVVEFW

SEQ ID NO: 2925545 - protein, 21 aa, Entamoeba invadens
VKEIIKYTPFHLTIKTKDGHF

SEQ ID NO: 2925546 - protein, 18 aa, Entamoeba invadens
VKEVLKMRTGNHSFDEAD

SEQ ID NO: 2925547 - protein, 21 aa, Entamoeba invadens
VKHAQEMLIKLGYNCGPDGAD

SEQ ID NO: 2925548 - protein, 18 aa, Entamoeba invadens
VKKLPDRIFEKCKKLFQI

SEQ ID NO: 2925549 - protein, 24 aa, Entamoeba invadens
VKMEDGCFMNCLNLKSVNFKNKNI

SEQ ID NO: 2925550 - protein, 17 aa, Entamoeba invadens
VLFFETSAKNKINITEA

SEQ ID NO: 2925551 - protein, 26 aa, Entamoeba invadens
VLFGRPNPWEGPVFITRKEEKMNEKK

SEQ ID NO: 2925552 - protein, 18 aa, Entamoeba invadens
VLNQNGFHGFPYNFNRSV

SEQ ID NO: 2925553 - protein, 26 aa, Entamoeba invadens
VMQTPECLRVYVSSFWEQPFKDTMFT

SEQ ID NO: 2925554 - protein, 18 aa, Entamoeba invadens
VNHIGRSCFEGCSSLVTV

SEQ ID NO: 2925555 - protein, 26 aa, Entamoeba invadens
VNKKCFECLQSLFINPLINLEIETFV

SEQ ID NO: 2925556 - protein, 24 aa, Entamoeba invadens
VNKQCLEAIKMLHINSYIDVSSYV

SEQ ID NO: 2925557 - protein, 20 aa, Entamoeba invadens
VPKLHWVGVMDYDLRVFDII

SEQ ID NO: 2925558 - protein, 27 aa, Entamoeba invadens
VQYSYGGLVLPKFCVDLSLLNCHCDVK

SEQ ID NO: 2925559 - protein, 28 aa, Entamoeba invadens
VRIYNYCFFRCYNLSSLVIPSSVTVIDN

SEQ ID NO: 2925560 - protein, 17 aa, Entamoeba invadens
VRLLLIPSYNIEKSDFE

SEQ ID NO: 2925561 - protein, 18 aa, Entamoeba invadens
VRNVELFINKDCAKNITC

SEQ ID NO: 2925562 - protein, 26 aa, Entamoeba invadens
VSDRMMYKLGYVDRVMDVLKRRQNDV

SEQ ID NO: 2925563 - protein, 18 aa, Entamoeba invadens
VSQFKATVIITEKGKVLL

SEQ ID NO: 2925564 - protein, 17 aa, Entamoeba invadens
VTAWEILNGGRVPFENV

SEQ ID NO: 2925565 - protein, 20 aa, Entamoeba invadens
VTFGRQIPKCEIDIFDKCKM

SEQ ID NO: 2925566 - protein, 23 aa, Entamoeba invadens
VTGPFKLSGVPLLQINQRYVIAT

SEQ ID NO: 2925567 - protein, 23 aa, Entamoeba invadens
VTKEFFQIVIWFNVNYRTVVKNR

SEQ ID NO: 2925568 - protein, 28 aa, Entamoeba invadens
VTKGYRYKMRVVYAHFPVNLVIADDKKS

SEQ ID NO: 2925569 - protein, 17 aa, Entamoeba invadens
VTSIGEKCFNWCSYLSS

SEQ ID NO: 2925570 - protein, 19 aa, Entamoeba invadens
VVCVAGVSLHGLWTNKKQK

SEQ ID NO: 2925571 - protein, 18 aa, Entamoeba invadens
VVDCKGHVLGRVASTVAK

SEQ ID NO: 2925572 - protein, 18 aa, Entamoeba invadens
VVEGIPLEKIRSLNTGII

SEQ ID NO: 2925573 - protein, 27 aa, Entamoeba invadens
VVEQYALRMKACRILHNVPSSQGGIGG

SEQ ID NO: 2925574 - protein, 18 aa, Entamoeba invadens
VVHHCPKTPCLLVGTKLD

SEQ ID NO: 2925575 - protein, 24 aa, Entamoeba invadens
VVHHCPKTPCLLVGTKLDMREDKD

SEQ ID NO: 2925576 - protein, 27 aa, Entamoeba invadens
VVSHGAWIKCAILGLLKLEPKAYHNIK

SEQ ID NO: 2925577 - protein, 21 aa, Entamoeba invadens
VYFMKGSLPWQGIKGKKGDKN

SEQ ID NO: 2925578 - protein, 18 aa, Entamoeba invadens
VYMPNVIGSIGLRCLCGD

SEQ ID NO: 2925579 - protein, 24 aa, Entamoeba invadens
WADKEWKKGKLVTRYKCNPLGGAS

SEQ ID NO: 2925580 - protein, 17 aa, Entamoeba invadens
WDLCAPLKNACKEVLKT

SEQ ID NO: 2925581 - protein, 19 aa, Entamoeba invadens
WDVKFCESLEKDMLFEMLK

SEQ ID NO: 2925582 - protein, 18 aa, Entamoeba invadens
WGTGRAVARIPRISGSGS

SEQ ID NO: 2925583 - protein, 20 aa, Entamoeba invadens
WLQAEGENVVEFWKYWMDST

SEQ ID NO: 2925584 - protein, 17 aa, Entamoeba invadens
WLSKLLGKKDMRILMVG

SEQ ID NO: 2925585 - protein, 19 aa, Entamoeba invadens
WMYIRAAAIARQVYLNQGL

SEQ ID NO: 2925586 - protein, 19 aa, Entamoeba invadens
WRKVHCPQHGCSQVIEISD

SEQ ID NO: 2925587 - protein, 25 aa, Entamoeba invadens
WSPSKCSLKEKVIFSATKVLVKQVF

SEQ ID NO: 2925588 - protein, 24 aa, Entamoeba invadens
WTPAACSIKEKMVYSATKATIKQA

SEQ ID NO: 2925589 - protein, 23 aa, Entamoeba invadens
YAEGELKGIMGITHDLVVSSDFI

SEQ ID NO: 2925590 - protein, 23 aa, Entamoeba invadens
YAEGELKGIMGITHDLVVSSDII

SEQ ID NO: 2925591 - protein, 23 aa, Entamoeba invadens
YAEGELKGIMGITQDLVVSSDII

SEQ ID NO: 2925592 - protein, 25 aa, Entamoeba invadens
YCAELVKGKMAPECNTNARLLVEYF

SEQ ID NO: 2925593 - protein, 23 aa, Entamoeba invadens
YCFHGCSKLSGFSFPDHLKSIGD

SEQ ID NO: 2925594 - protein, 27 aa, Entamoeba invadens
YDFKESRMKVALCLSVETLSTLLFSKD

SEQ ID NO: 2925595 - protein, 20 aa, Entamoeba invadens
YEKDTPLNYCIITMGDKEAA

SEQ ID NO: 2925596 - protein, 17 aa, Entamoeba invadens
YEYGKCSNGVIFADAIF

SEQ ID NO: 2925597 - protein, 21 aa, Entamoeba invadens
YGKDCAYDFLCDLPHNAVCYF

SEQ ID NO: 2925598 - protein, 17 aa, Entamoeba invadens
YISEETVELVLSPPELQ

SEQ ID NO: 2925599 - protein, 18 aa, Entamoeba invadens
YKAIRGMLPKHNFRGKSA

SEQ ID NO: 2925600 - protein, 17 aa, Entamoeba invadens
YKDISSMGFNTVRMYLH

SEQ ID NO: 2925601 - protein, 23 aa, Entamoeba invadens
YKERKGGVVSVMVSFTGELLESG

SEQ ID NO: 2925602 - protein, 18 aa, Entamoeba invadens
YKIPVWFLNRQKDIKDGK

SEQ ID NO: 2925603 - protein, 17 aa, Entamoeba invadens
YKVANWLFDNCKELTAV

SEQ ID NO: 2925604 - protein, 17 aa, Entamoeba invadens
YMYCPGGTKDVEQMDNI

SEQ ID NO: 2925605 - protein, 17 aa, Entamoeba invadens
YNFNRSVAKQLLHSLNV

SEQ ID NO: 2925606 - protein, 22 aa, Entamoeba invadens
YNKPCKFALQMEDFSSFRTFGF

SEQ ID NO: 2925607 - protein, 17 aa, Entamoeba invadens
YNLECLEQLELASIGGY

SEQ ID NO: 2925608 - protein, 18 aa, Entamoeba invadens
YNPIPVKSTKLFPYMETQ

SEQ ID NO: 2925609 - protein, 21 aa, Entamoeba invadens
YNPSGRFVIGGPMGDAGLTGR

SEQ ID NO: 2925610 - protein, 17 aa, Entamoeba invadens
YPAFNAIVFNESKKELG

SEQ ID NO: 2925611 - protein, 19 aa, Entamoeba invadens
YPNTTCFVPCFSIVNLDTF

SEQ ID NO: 2925612 - protein, 26 aa, Entamoeba invadens
YQEIWLRGYWLIFAHDQIVRGKVDNS

SEQ ID NO: 2925613 - protein, 23 aa, Entamoeba invadens
YQKKLHLRTEWQSLLQDVLLLTA

SEQ ID NO: 2925614 - protein, 19 aa, Entamoeba invadens
YQSIFGLDVLPEFQHRGLA

SEQ ID NO: 2925615 - protein, 18 aa, Entamoeba invadens
YRKTLTVDNRICVLDILD

SEQ ID NO: 2925616 - protein, 24 aa, Entamoeba invadens
YRNSMPRDNFKFISSHIETYDVGQ

SEQ ID NO: 2925617 - protein, 21 aa, Entamoeba invadens
YTKKNGGVYYRIITRKIEVAK

SEQ ID NO: 2925618 - protein, 22 aa, Entamoeba invadens
YTKKNGGVYYRIITRKIEVAKE

SEQ ID NO: 2925619 - protein, 18 aa, Entamoeba invadens
YTSTIFLDVLDTFRPICN

SEQ ID NO: 2925620 - protein, 22 aa, Entamoeba invadens
IIWRCIFKRIFLLRESLYRCIN

SEQ ID NO: 2925621 - protein, 20 aa, Entamoeba invadens
AAALLRCFYTLYVNSDVNDN

SEQ ID NO: 2925622 - protein, 18 aa, Entamoeba invadens
AAANKCKTMFKRFSSGVF

SEQ ID NO: 2925623 - protein, 19 aa, Entamoeba invadens
AAAPCFEKAANIFRSLQKW

SEQ ID NO: 2925624 - protein, 20 aa, Entamoeba invadens
AAAPFLIRRVNSYVQVYGML

SEQ ID NO: 2925625 - protein, 27 aa, Entamoeba invadens
AAASAGMGLMWWMQRELTEKKKYMPTR

SEQ ID NO: 2925626 - protein, 25 aa, Entamoeba invadens
AAAVFGYKCCLCVGLHSDKTITNQK

SEQ ID NO: 2925627 - protein, 18 aa, Entamoeba invadens
AACFNYFLSCIVGERSGE

SEQ ID NO: 2925628 - protein, 18 aa, Entamoeba invadens
AACIARSQSILKYVMSVA

SEQ ID NO: 2925629 - protein, 28 aa, Entamoeba invadens
AACNRAAKENRWVAAYVLKETDLNQLVF

SEQ ID NO: 2925630 - protein, 24 aa, Entamoeba invadens
AACSEDALCFGSLVLVNKDDKSFS

SEQ ID NO: 2925631 - protein, 20 aa, Entamoeba invadens
AACTELSEICTFDVYAKETN

SEQ ID NO: 2925632 - protein, 25 aa, Entamoeba invadens
AADDAKAKAFAALNRKVSEESDDEV

SEQ ID NO: 2925633 - protein, 20 aa, Entamoeba invadens
AADILGARAFVDARQIVDGD

SEQ ID NO: 2925634 - protein, 42 aa, Entamoeba invadens
AADLFKGKMQIIIKSRCGHCIKRVEPFCCCPLEVERFSKVAL

SEQ ID NO: 2925635 - protein, 20 aa, Entamoeba invadens
AADNRYGLRYQFASSNFHKV

SEQ ID NO: 2925636 - protein, 17 aa, Entamoeba invadens
AAEFCCFKLYNEVIRCK

SEQ ID NO: 2925637 - protein, 17 aa, Entamoeba invadens
AAEFVMRRVPGCHISHI

SEQ ID NO: 2925638 - protein, 18 aa, Entamoeba invadens
AAENILKIQSYRNKYMFV

SEQ ID NO: 2925639 - protein, 23 aa, Entamoeba invadens
AAESFERAYMCASPNFQEVILMY

SEQ ID NO: 2925640 - protein, 17 aa, Entamoeba invadens
AAEYELVSAGYILRHMK

SEQ ID NO: 2925641 - protein, 17 aa, Entamoeba invadens
AAFDVFIAECLLSNNER

SEQ ID NO: 2925642 - protein, 27 aa, Entamoeba invadens
AAFGGCTFGFSRGCSMIDIHETEFVQK

SEQ ID NO: 2925643 - protein, 18 aa, Entamoeba invadens
AAFIRVIDVMVGREKALL

SEQ ID NO: 2925644 - protein, 23 aa, Entamoeba invadens
AAFKEISEFFILFEKSCSTYVGV

SEQ ID NO: 2925645 - protein, 25 aa, Entamoeba invadens
AAFKRRNRIPLNWDLNHALREKVRM

SEQ ID NO: 2925646 - protein, 20 aa, Entamoeba invadens
AAFLNEFRKTPMFKNFTNDS

SEQ ID NO: 2925647 - protein, 25 aa, Entamoeba invadens
AAFNMKLFPRIMIYFNQEDNEMRCS

SEQ ID NO: 2925648 - protein, 19 aa, Entamoeba invadens
AAFQIRFAGVKGVVSVDCL

SEQ ID NO: 2925649 - protein, 20 aa, Entamoeba invadens
AAFRKAGMTYGRLEPWSVGE

SEQ ID NO: 2925650 - protein, 23 aa, Entamoeba invadens
AAFYDFLGKVLVWDPFLRMRPSQ

SEQ ID NO: 2925651 - protein, 19 aa, Entamoeba invadens
AAGDYGGRVVLFKKSRNDE

SEQ ID NO: 2925652 - protein, 19 aa, Entamoeba invadens
AAGFVLKPLDGVIGIFKGL

SEQ ID NO: 2925653 - protein, 17 aa, Entamoeba invadens
AAGGCTRPKKDLGAIAM

SEQ ID NO: 2925654 - protein, 19 aa, Entamoeba invadens
AAGGLSFDLSSGVANIKNY

SEQ ID NO: 2925655 - protein, 25 aa, Entamoeba invadens
AAIEMKKEIPIFVKYMKENVSQVEI

SEQ ID NO: 2925656 - protein, 19 aa, Entamoeba invadens
AAIHRLKNTFSHLTDKTKS

SEQ ID NO: 2925657 - protein, 21 aa, Entamoeba invadens
AAISEMFFGVVLYLVEQEKMP

SEQ ID NO: 2925658 - protein, 20 aa, Entamoeba invadens
AAITILRIDDMIKLNPEPQP

SEQ ID NO: 2925659 - protein, 29 aa, Entamoeba invadens
AAKAPEIDLSIFLRKCIGSSFYNKHLIDL

SEQ ID NO: 2925660 - protein, 23 aa, Entamoeba invadens
AAKDAWLGIAVGQKIYDQGLTTK

SEQ ID NO: 2925661 - protein, 19 aa, Entamoeba invadens
AAKEFLSDFFTGYDEANPN

SEQ ID NO: 2925662 - protein, 22 aa, Entamoeba invadens
AAKLRVGVQYLKLEWKEAKDLD

SEQ ID NO: 2925663 - protein, 23 aa, Entamoeba invadens
AAKSGVECFSIWMENPLIKFLVE

SEQ ID NO: 2925664 - protein, 20 aa, Entamoeba invadens
AALCFRVISDRVFIVKCSNL

SEQ ID NO: 2925665 - protein, 17 aa, Entamoeba invadens
AALGRACGVSRDVIAVA

SEQ ID NO: 2925666 - protein, 18 aa, Entamoeba invadens
AALHYEYTNGLLEIHMEN

SEQ ID NO: 2925667 - protein, 25 aa, Entamoeba invadens
AALIDRADPLFAISSLLGTLFKYYH

SEQ ID NO: 2925668 - protein, 18 aa, Entamoeba invadens
AALIKEAFLSRSMLENPN

SEQ ID NO: 2925669 - protein, 21 aa, Entamoeba invadens
AALKALNLFHPSSYEGGVDMK

SEQ ID NO: 2925670 - protein, 19 aa, Entamoeba invadens
AALLATFLFHQEVKKDRDT

SEQ ID NO: 2925671 - protein, 18 aa, Entamoeba invadens
AALLIKTNWAKWMDEVWV

SEQ ID NO: 2925672 - protein, 17 aa, Entamoeba invadens
AALQNCVVDKFMRESVS

SEQ ID NO: 2925673 - protein, 19 aa, Entamoeba invadens
AALTFKFVGILLKDEKTLD

SEQ ID NO: 2925674 - protein, 20 aa, Entamoeba invadens
AALVDAFKLTAAVDEEKSQR

SEQ ID NO: 2925675 - protein, 21 aa, Entamoeba invadens
AALVSRFDLLFVLLDNQNEDF

SEQ ID NO: 2925676 - protein, 23 aa, Entamoeba invadens
AAMAYPREFVYVLVQYKSEGKYY

SEQ ID NO: 2925677 - protein, 17 aa, Entamoeba invadens
AAMSMPGMMDTILNLGL

SEQ ID NO: 2925678 - protein, 18 aa, Entamoeba invadens
AAMTSILLGDAVRTINLV

SEQ ID NO: 2925679 - protein, 26 aa, Entamoeba invadens
AANNGFKGMLLVSAKTGYNLDETMNN

SEQ ID NO: 2925680 - protein, 25 aa, Entamoeba invadens
AAPDRLEKVLPVFVDTFVKLVPNAT

SEQ ID NO: 2925681 - protein, 23 aa, Entamoeba invadens
AAPEEANAFFVLQHASLEGSEST

SEQ ID NO: 2925682 - protein, 27 aa, Entamoeba invadens
AAPQPPLVICRETLDMFIERTKANTES

SEQ ID NO: 2925683 - protein, 25 aa, Entamoeba invadens
AAQFQRLSLRKCTIDSLTVPPTLTS

SEQ ID NO: 2925684 - protein, 18 aa, Entamoeba invadens
AAQHVAIMKVFDVFESDI

SEQ ID NO: 2925685 - protein, 18 aa, Entamoeba invadens
AAQLPQPLLVPLQNEADP

SEQ ID NO: 2925686 - protein, 18 aa, Entamoeba invadens
AAQSALHGLCKCVEDNIS

SEQ ID NO: 2925687 - protein, 22 aa, Entamoeba invadens
AAQSVALLSMFVVDAKQNKDDT

SEQ ID NO: 2925688 - protein, 17 aa, Entamoeba invadens
AAQYAGIDVVKLIPEPT

SEQ ID NO: 2925689 - protein, 18 aa, Entamoeba invadens
AAQYTMGISFKKMTSSAP

SEQ ID NO: 2925690 - protein, 30 aa, Entamoeba invadens
AARKQILAVVFKFGDLYFSEIVSEINRVCD

SEQ ID NO: 2925691 - protein, 22 aa, Entamoeba invadens
AARRLAEKYKKLEIPNLGFGTD

SEQ ID NO: 2925692 - protein, 21 aa, Entamoeba invadens
AASGMYPPLIKMFELDQLSEK

SEQ ID NO: 2925693 - protein, 18 aa, Entamoeba invadens
AASKECWTETAGKTNRKL

SEQ ID NO: 2925694 - protein, 18 aa, Entamoeba invadens
AASLFPMVTGNAHAVVKS

SEQ ID NO: 2925695 - protein, 18 aa, Entamoeba invadens
AASRIVSVFNSFIESALK

SEQ ID NO: 2925696 - protein, 23 aa, Entamoeba invadens
AATFPKKPKKAFVTVKDTQMFVF

SEQ ID NO: 2925697 - protein, 17 aa, Entamoeba invadens
AATKFQNAVDHLDLTLD

SEQ ID NO: 2925698 - protein, 17 aa, Entamoeba invadens
AAVEWRTNKEEYKKKVR

SEQ ID NO: 2925699 - protein, 26 aa, Entamoeba invadens
AAVKKDVGGEWALEGGALVLADEGVC

SEQ ID NO: 2925700 - protein, 17 aa, Entamoeba invadens
AAVKVAKGKRPNFDEGF

SEQ ID NO: 2925701 - protein, 26 aa, Entamoeba invadens
AAVMKDVIKLLGFDLLIKKVVPISQD

SEQ ID NO: 2925702 - protein, 20 aa, Entamoeba invadens
AAYEKMLFREALHKGFYELI

SEQ ID NO: 2925703 - protein, 18 aa, Entamoeba invadens
AAYGFKVNIVMPSTMSVE

SEQ ID NO: 2925704 - protein, 21 aa, Entamoeba invadens
AAYLEKWWNVVNWKFVEQNLV

SEQ ID NO: 2925705 - protein, 23 aa, Entamoeba invadens
AAYNEFVEGLGWTLDIRTHSGFL

SEQ ID NO: 2925706 - protein, 17 aa, Entamoeba invadens
AAYRMMPKIEVTAVGKM

SEQ ID NO: 2925707 - protein, 27 aa, Entamoeba invadens
AAYSKEKFKFEWSIADFVSHGNRLEKD

SEQ ID NO: 2925708 - protein, 17 aa, Entamoeba invadens
ACAQLLNMSSRGVGDIE

SEQ ID NO: 2925709 - protein, 18 aa, Entamoeba invadens
ACATRLETVMLPLSITEL

SEQ ID NO: 2925710 - protein, 20 aa, Entamoeba invadens
ACAYTKSVLVESGYTELHES

SEQ ID NO: 2925711 - protein, 19 aa, Entamoeba invadens
ACCVDDRFTSYIKADFLVH

SEQ ID NO: 2925712 - protein, 18 aa, Entamoeba invadens
ACDGVFDFLSNETVCEIV

SEQ ID NO: 2925713 - protein, 20 aa, Entamoeba invadens
ACEFEIFNKLLCSFICLNLT

SEQ ID NO: 2925714 - protein, 25 aa, Entamoeba invadens
ACEFSLCLTPLCTCKINTTIQIISK

SEQ ID NO: 2925715 - protein, 28 aa, Entamoeba invadens
ACEYEILKKRPIFIGISFEKFIKKEISV

SEQ ID NO: 2925716 - protein, 18 aa, Entamoeba invadens
ACFANCVKPEHPLENVPD

SEQ ID NO: 2925717 - protein, 19 aa, Entamoeba invadens
ACFFNCKLLSKFDIPEGVK

SEQ ID NO: 2925718 - protein, 17 aa, Entamoeba invadens
ACFYGCVQLTKLQLPTT

SEQ ID NO: 2925719 - protein, 18 aa, Entamoeba invadens
ACGCGDGKIRFYLLDLMQ

SEQ ID NO: 2925720 - protein, 18 aa, Entamoeba invadens
ACGDCVTGPMSIVNAVGD

SEQ ID NO: 2925721 - protein, 17 aa, Entamoeba invadens
ACGLKEDAAEFIWASDL

SEQ ID NO: 2925722 - protein, 29 aa, Entamoeba invadens
ACHEKLRKYLIDLLNTWTGSFPQEIVNGI

SEQ ID NO: 2925723 - protein, 21 aa, Entamoeba invadens
ACHIPCCIKKLQSLINKSNGE

SEQ ID NO: 2925724 - protein, 20 aa, Entamoeba invadens
ACIGESYAFGPGVDGNISID

SEQ ID NO: 2925725 - protein, 23 aa, Entamoeba invadens
ACINYCKRTILIKSTKVDIVQAI

SEQ ID NO: 2925726 - protein, 20 aa, Entamoeba invadens
ACIPKCIHFGKRGTKRTISR

SEQ ID NO: 2925727 - protein, 20 aa, Entamoeba invadens
ACKANLFLSNVFVETLSGVT

SEQ ID NO: 2925728 - protein, 24 aa, Entamoeba invadens
ACKKLFGHFIFFVYDKMEEEEKER

SEQ ID NO: 2925729 - protein, 19 aa, Entamoeba invadens
ACLDQSGLVDKGMFSFTIS

SEQ ID NO: 2925730 - protein, 22 aa, Entamoeba invadens
ACLEALEPFEVIKNAPKNVRLI

SEQ ID NO: 2925731 - protein, 27 aa, Entamoeba invadens
ACLKIYKFILPFLFKHNNLEYLVRMRI

SEQ ID NO: 2925732 - protein, 27 aa, Entamoeba invadens
ACLKSVGDYCFRKCISLKSITFNSSDI

SEQ ID NO: 2925733 - protein, 17 aa, Entamoeba invadens
ACLNETFLNEYVANYRR

SEQ ID NO: 2925734 - protein, 25 aa, Entamoeba invadens
ACLNIIKGLCCNEVNMGVIRDNGVL

SEQ ID NO: 2925735 - protein, 21 aa, Entamoeba invadens
ACMKIKRSAVVIGNSTQSVLQ

SEQ ID NO: 2925736 - protein, 26 aa, Entamoeba invadens
ACNISGMTVHSFFGIGIGSGTVEELL

SEQ ID NO: 2925737 - protein, 22 aa, Entamoeba invadens
ACPCSICKKAVLYTSTPQKIKT

SEQ ID NO: 2925738 - protein, 20 aa, Entamoeba invadens
ACQFTFKYVYPDLGMNPTLV

SEQ ID NO: 2925739 - protein, 18 aa, Entamoeba invadens
ACRAILDLMMKKNVFENF

SEQ ID NO: 2925740 - protein, 17 aa, Entamoeba invadens
ACSCAYRNNNHFKLFVR

SEQ ID NO: 2925741 - protein, 28 aa, Entamoeba invadens
ACSLYPSAIHRLKLATGKPILIPKNLLN

SEQ ID NO: 2925742 - protein, 22 aa, Entamoeba invadens
ACTALTKIIPCLQNNTQGDVLV

SEQ ID NO: 2925743 - protein, 22 aa, Entamoeba invadens
ACTIKNKWTLNRPKQRMSARLV

SEQ ID NO: 2925744 - protein, 19 aa, Entamoeba invadens
ACTNKKCGHACFLAQHADR

SEQ ID NO: 2925745 - protein, 18 aa, Entamoeba invadens
ACTNKKCGHACFLAQHSD

SEQ ID NO: 2925746 - protein, 19 aa, Entamoeba invadens
ACVKEGVEIGTIFEQIITE

SEQ ID NO: 2925747 - protein, 18 aa, Entamoeba invadens
ACVLNKHSLFIILFDKKG

SEQ ID NO: 2925748 - protein, 18 aa, Entamoeba invadens
ACVWDLRTDCVNPVIQYD

SEQ ID NO: 2925749 - protein, 18 aa, Entamoeba invadens
ACVYCEYTFCRECLEPWH

SEQ ID NO: 2925750 - protein, 18 aa, Entamoeba invadens
ADAAAALATTLPGLIFFN

SEQ ID NO: 2925751 - protein, 17 aa, Entamoeba invadens
ADAARKAAESKLLETNE

SEQ ID NO: 2925752 - protein, 25 aa, Entamoeba invadens
ADAESGRDAMRWLDRALLRTCNKFG

SEQ ID NO: 2925753 - protein, 17 aa, Entamoeba invadens
ADAGAMIEFVQRIQHTF

SEQ ID NO: 2925754 - protein, 17 aa, Entamoeba invadens
ADAKLDLRDYLIMPVQR

SEQ ID NO: 2925755 - protein, 23 aa, Entamoeba invadens
ADAKVALLTLCGEFPNSIENPRE

SEQ ID NO: 2925756 - protein, 24 aa, Entamoeba invadens
ADALNCTAEGPGLNEAETKTPAPF

SEQ ID NO: 2925757 - protein, 25 aa, Entamoeba invadens
ADAPPHGFGCCGDGFPDGCPCGKDF

SEQ ID NO: 2925758 - protein, 21 aa, Entamoeba invadens
ADATLRSSAAVGYFPPYDGGY

SEQ ID NO: 2925759 - protein, 21 aa, Entamoeba invadens
ADAVGAFLLQIVTTGIIKETN

SEQ ID NO: 2925760 - protein, 28 aa, Entamoeba invadens
ADDAVLVFDCGSSFIKIGAAGEEQPRKV

SEQ ID NO: 2925761 - protein, 17 aa, Entamoeba invadens
ADDELKGILQKEEEKYQ

SEQ ID NO: 2925762 - protein, 20 aa, Entamoeba invadens
ADDFINMILVCKKFSCILDR

SEQ ID NO: 2925763 - protein, 23 aa, Entamoeba invadens
ADDMLKKNFSFHSVKFNFSSQLK

SEQ ID NO: 2925764 - protein, 25 aa, Entamoeba invadens
ADEELRKELPYSYSQILSQLRKTEK

SEQ ID NO: 2925765 - protein, 27 aa, Entamoeba invadens
ADEELWAVFRECHRIWAKTKEVALAWV

SEQ ID NO: 2925766 - protein, 17 aa, Entamoeba invadens
ADEGVCLIDEFDKMSDE

SEQ ID NO: 2925767 - protein, 29 aa, Entamoeba invadens
ADEIGCSFEKGCFENCRNVTIIKNNGQTM

SEQ ID NO: 2925768 - protein, 48 aa, Entamoeba invadens
ADEIKNKRISAKVSLKKRVKNVLQRMLDCVKNVKVIWPNDDDETKPKE

SEQ ID NO: 2925769 - protein, 24 aa, Entamoeba invadens
ADEIVLDDVLLWICTNVPQHLIPR

SEQ ID NO: 2925770 - protein, 29 aa, Entamoeba invadens
ADEKSSFYKVCFVSAAFVDQGKVFRKMTR

SEQ ID NO: 2925771 - protein, 17 aa, Entamoeba invadens
ADELEYFNAYSKEARNK

SEQ ID NO: 2925772 - protein, 22 aa, Entamoeba invadens
ADELKGAPLLIFANKHDLPQAM

SEQ ID NO: 2925773 - protein, 23 aa, Entamoeba invadens
ADELPINPFVKFVVGKNSYETTL

SEQ ID NO: 2925774 - protein, 18 aa, Entamoeba invadens
ADEMWKFDCLLDSAMQCG

SEQ ID NO: 2925775 - protein, 24 aa, Entamoeba invadens
ADEQWRFPNSFVQMVPLRNWIFYT

SEQ ID NO: 2925776 - protein, 18 aa, Entamoeba invadens
ADESGVENFCFVVEAKNR

SEQ ID NO: 2925777 - protein, 18 aa, Entamoeba invadens
ADESRLVDLVKMMDKGQA

SEQ ID NO: 2925778 - protein, 23 aa, Entamoeba invadens
ADETKTLISYVCVGKNFTLKKGE

SEQ ID NO: 2925779 - protein, 25 aa, Entamoeba invadens
ADEVILKMRIKLILDTAKGIQYLHA

SEQ ID NO: 2925780 - protein, 17 aa, Entamoeba invadens
ADFEKAFYEVKDAIDEM

SEQ ID NO: 2925781 - protein, 20 aa, Entamoeba invadens
ADFKKGIQGNMFYFGDNKFL

SEQ ID NO: 2925782 - protein, 23 aa, Entamoeba invadens
ADFPFDLKDAVLISLVDNFSALA

SEQ ID NO: 2925783 - protein, 23 aa, Entamoeba invadens
ADFPVFGGYDYKYLQPALMSYMY

SEQ ID NO: 2925784 - protein, 23 aa, Entamoeba invadens
ADFYKWISCAKFEVLYDSERPIP

SEQ ID NO: 2925785 - protein, 26 aa, Entamoeba invadens
ADGDGRNALNFVEKVYLYYTKFNIDQ

SEQ ID NO: 2925786 - protein, 20 aa, Entamoeba invadens
ADGLCPLDTVRVCYTIFNTM

SEQ ID NO: 2925787 - protein, 18 aa, Entamoeba invadens
ADGLRKGIVLNILNSNPF

SEQ ID NO: 2925788 - protein, 24 aa, Entamoeba invadens
ADGNFKVADGLFYNVETLQKITKP

SEQ ID NO: 2925789 - protein, 21 aa, Entamoeba invadens
ADGQPLILLCQINYSEMPKLA

SEQ ID NO: 2925790 - protein, 20 aa, Entamoeba invadens
ADGTFWPIPITMSVSEEDAR

SEQ ID NO: 2925791 - protein, 21 aa, Entamoeba invadens
ADGYLYILIREFGYSVKLKQT

SEQ ID NO: 2925792 - protein, 26 aa, Entamoeba invadens
ADIAYNYAYVAWVYFDRIINTSALGK

SEQ ID NO: 2925793 - protein, 24 aa, Entamoeba invadens
ADICLRSAAAPSYYKPYQNYVDGG

SEQ ID NO: 2925794 - protein, 27 aa, Entamoeba invadens
ADIFSFGVTMFEIFGWKEAYPKDIFKY

SEQ ID NO: 2925795 - protein, 18 aa, Entamoeba invadens
ADIIKWIYETAPEMMNVK

SEQ ID NO: 2925796 - protein, 24 aa, Entamoeba invadens
ADIKAICTEAGLLALRERRMKVTQ

SEQ ID NO: 2925797 - protein, 26 aa, Entamoeba invadens
ADIKALCAKYNPISYDIPRYVVDTPI

SEQ ID NO: 2925798 - protein, 17 aa, Entamoeba invadens
ADIKTQHFLTKRIKQSQ

SEQ ID NO: 2925799 - protein, 18 aa, Entamoeba invadens
ADILSSLFSALPKLNYLH

SEQ ID NO: 2925800 - protein, 17 aa, Entamoeba invadens
ADINVFIEDHWKLLSKL

SEQ ID NO: 2925801 - protein, 21 aa, Entamoeba invadens
ADINYPTGFYLYQNKEKISFT

SEQ ID NO: 2925802 - protein, 24 aa, Entamoeba invadens
ADIRDCGLASMVVEEMINGYEEIF

SEQ ID NO: 2925803 - protein, 18 aa, Entamoeba invadens
ADITKLDCAVPLINDSFH

SEQ ID NO: 2925804 - protein, 22 aa, Entamoeba invadens
ADIVPIKSCFYLYSTLSRLIVL

SEQ ID NO: 2925805 - protein, 26 aa, Entamoeba invadens
ADIWALGCTILELITGNPPYWDLNPT

SEQ ID NO: 2925806 - protein, 20 aa, Entamoeba invadens
ADIWSIGVILVRMLTGKYPF

SEQ ID NO: 2925807 - protein, 24 aa, Entamoeba invadens
ADKCKACGLPLPAKGIAKTKIGSF

SEQ ID NO: 2925808 - protein, 25 aa, Entamoeba invadens
ADKLGSCKLVHEMSFGTTKEKMIKV

SEQ ID NO: 2925809 - protein, 51 aa, Entamoeba invadens
ADKLKSIGVGPELFVFRWLTLLCCMEFPLSETLRYWDFFFLDLDNFPLVKA

SEQ ID NO: 2925810 - protein, 20 aa, Entamoeba invadens
ADKLVDFGFVKKVGKMIFLT

SEQ ID NO: 2925811 - protein, 18 aa, Entamoeba invadens
ADKMFNNDFEYFQMDGMT

SEQ ID NO: 2925812 - protein, 18 aa, Entamoeba invadens
ADKMFNNDFEYFQMNGVT

SEQ ID NO: 2925813 - protein, 17 aa, Entamoeba invadens
ADKMFSNDFEYFQMNGV

SEQ ID NO: 2925814 - protein, 18 aa, Entamoeba invadens
ADKQMWFNLDKIITEMML

SEQ ID NO: 2925815 - protein, 19 aa, Entamoeba invadens
ADKSLAYFNNAVQRFKDLY

SEQ ID NO: 2925816 - protein, 24 aa, Entamoeba invadens
ADKTDFPVAVWDTTVCKLENWMLD

SEQ ID NO: 2925817 - protein, 17 aa, Entamoeba invadens
ADKTKAFAIYKELADSE

SEQ ID NO: 2925818 - protein, 20 aa, Entamoeba invadens
ADKTVKIWGLQFGECKRTMK

SEQ ID NO: 2925819 - protein, 18 aa, Entamoeba invadens
ADLARISELPTFFDEKQK

SEQ ID NO: 2925820 - protein, 22 aa, Entamoeba invadens
ADLDIAKKVLFYKENMASMQPQ

SEQ ID NO: 2925821 - protein, 17 aa, Entamoeba invadens
ADLDLSKFPALYDLDIS

SEQ ID NO: 2925822 - protein, 22 aa, Entamoeba invadens
ADLEAITAMTLLSYIASNKPKM

SEQ ID NO: 2925823 - protein, 26 aa, Entamoeba invadens
ADLEDLCKIGEVWLIDNGFCSRCAEK

SEQ ID NO: 2925824 - protein, 18 aa, Entamoeba invadens
ADLFRVNDLLVVYCGLNV

SEQ ID NO: 2925825 - protein, 18 aa, Entamoeba invadens
ADLIYRTFISSCKEPAKL

SEQ ID NO: 2925826 - protein, 21 aa, Entamoeba invadens
ADLLAKLGFTHFAAAEAFVRY

SEQ ID NO: 2925827 - protein, 18 aa, Entamoeba invadens
ADLLKARKELESQLRQTS

SEQ ID NO: 2925828 - protein, 25 aa, Entamoeba invadens
ADLLKLRTFCVEMKKRTAVEKPQPK

SEQ ID NO: 2925829 - protein, 17 aa, Entamoeba invadens
ADLLRVSYQNFLNAFTA

SEQ ID NO: 2925830 - protein, 17 aa, Entamoeba invadens
ADLLRVSYQNFLNAFTM

SEQ ID NO: 2925831 - protein, 22 aa, Entamoeba invadens
ADLRKKCLEGMVAVDTPGYAIG

SEQ ID NO: 2925832 - protein, 24 aa, Entamoeba invadens
ADLRSLTCLTKFYLYGGTVSVKLP

SEQ ID NO: 2925833 - protein, 20 aa, Entamoeba invadens
ADLSDWRSFLIFQQECTRNW

SEQ ID NO: 2925834 - protein, 17 aa, Entamoeba invadens
ADLSEQVHIQWKSVSTF

SEQ ID NO: 2925835 - protein, 20 aa, Entamoeba invadens
ADLSIFMLQKLFAFVNGEID

SEQ ID NO: 2925836 - protein, 20 aa, Entamoeba invadens
ADLVGWKSCLEECIDVMISC

SEQ ID NO: 2925837 - protein, 17 aa, Entamoeba invadens
ADLVIKSSIEYYNNLHN

SEQ ID NO: 2925838 - protein, 20 aa, Entamoeba invadens
ADLYCAFCTYGELCKAQNGV

SEQ ID NO: 2925839 - protein, 21 aa, Entamoeba invadens
ADLYNSINWNDFIVVEVVDFE

SEQ ID NO: 2925840 - protein, 17 aa, Entamoeba invadens
ADMKKAATIMVSQNKYA

SEQ ID NO: 2925841 - protein, 25 aa, Entamoeba invadens
ADMKPKLPFRVIRFSLLHVFSSDLL

SEQ ID NO: 2925842 - protein, 18 aa, Entamoeba invadens
ADMSKLLTLPSCGDGGII

SEQ ID NO: 2925843 - protein, 18 aa, Entamoeba invadens
ADMSKLLTLPSCGNGGII

SEQ ID NO: 2925844 - protein, 17 aa, Entamoeba invadens
ADMVLKEEKVCFEEPET

SEQ ID NO: 2925845 - protein, 28 aa, Entamoeba invadens
ADNFPREEIPTLLGLIASLYKENCKLKK

SEQ ID NO: 2925846 - protein, 25 aa, Entamoeba invadens
ADNIPKLQEWTPFKTYERIYDSKTD

SEQ ID NO: 2925847 - protein, 20 aa, Entamoeba invadens
ADNLAVCWTPVLFDLLDLLP

SEQ ID NO: 2925848 - protein, 21 aa, Entamoeba invadens
ADNQPGVLIQVFEGEASMTSH

SEQ ID NO: 2925849 - protein, 18 aa, Entamoeba invadens
ADNYRKVIFHFPSTDKQS

SEQ ID NO: 2925850 - protein, 22 aa, Entamoeba invadens
ADPCIKDGKGVCPITAAMRHGY

SEQ ID NO: 2925851 - protein, 30 aa, Entamoeba invadens
ADPEKRPTFEQCLKLTVFGRKRECERNEKS

SEQ ID NO: 2925852 - protein, 17 aa, Entamoeba invadens
ADPVLKKSGKVAGMNEG

SEQ ID NO: 2925853 - protein, 17 aa, Entamoeba invadens
ADPVLKKYGKVAGMNEG

SEQ ID NO: 2925854 - protein, 21 aa, Entamoeba invadens
ADQFRPLGIQVFHIQENSTMF

SEQ ID NO: 2925855 - protein, 20 aa, Entamoeba invadens
ADQKGSVFIWDIKYGEPAKK

SEQ ID NO: 2925856 - protein, 18 aa, Entamoeba invadens
ADQKLEFMQRTNGDLKKE

SEQ ID NO: 2925857 - protein, 25 aa, Entamoeba invadens
ADRCFNEEMYLAAKILYASLNNYIK

SEQ ID NO: 2925858 - protein, 20 aa, Entamoeba invadens
ADRHLVSFSKQRKAGYVMKE

SEQ ID NO: 2925859 - protein, 17 aa, Entamoeba invadens
ADRILDMGFKKELTSIL

SEQ ID NO: 2925860 - protein, 20 aa, Entamoeba invadens
ADRKAAEGLMSRFKTSPENK

SEQ ID NO: 2925861 - protein, 19 aa, Entamoeba invadens
ADRVFTMLMGDEVEPRRDF

SEQ ID NO: 2925862 - protein, 27 aa, Entamoeba invadens
ADRVMVFDNGMLKEMETPYNLIQDEKS

SEQ ID NO: 2925863 - protein, 23 aa, Entamoeba invadens
ADSEIPEALYMQGECYMNGDGVR

SEQ ID NO: 2925864 - protein, 24 aa, Entamoeba invadens
ADSERLLVLTLWKQNIAVFTNPSP

SEQ ID NO: 2925865 - protein, 18 aa, Entamoeba invadens
ADSPLELDSRKSFGSTEE

SEQ ID NO: 2925866 - protein, 27 aa, Entamoeba invadens
ADSRACVLSPFPDDRLKIVDETYRLLG

SEQ ID NO: 2925867 - protein, 26 aa, Entamoeba invadens
ADTEKELTRRISIVSSDKEKMYQGER

SEQ ID NO: 2925868 - protein, 25 aa, Entamoeba invadens
ADTFPRYTEMFNIITVMKSPLYNEL

SEQ ID NO: 2925869 - protein, 26 aa, Entamoeba invadens
ADTFSVNYYLSFVFEDEEGLKYNALV

SEQ ID NO: 2925870 - protein, 19 aa, Entamoeba invadens
ADTIGRGAFGEVLKGMNAD

SEQ ID NO: 2925871 - protein, 28 aa, Entamoeba invadens
ADTLCLSVRCLLCETNVCVTLYTSNLNC

SEQ ID NO: 2925872 - protein, 18 aa, Entamoeba invadens
ADTWCTSCAEGYYLYQVS

SEQ ID NO: 2925873 - protein, 17 aa, Entamoeba invadens
ADVCINWSGGLHHAKKS

SEQ ID NO: 2925874 - protein, 24 aa, Entamoeba invadens
ADVCLRSAAAPSYYKPYQNYVDGG

SEQ ID NO: 2925875 - protein, 20 aa, Entamoeba invadens
ADVFLKKFLNLFYEVTDSFL

SEQ ID NO: 2925876 - protein, 23 aa, Entamoeba invadens
ADVGKTSLLLRYITQAYQEGVRS

SEQ ID NO: 2925877 - protein, 23 aa, Entamoeba invadens
ADVIKYKYLSFIRKPILEQNFGN

SEQ ID NO: 2925878 - protein, 17 aa, Entamoeba invadens
ADVIPLSGSSFLIDENE

SEQ ID NO: 2925879 - protein, 19 aa, Entamoeba invadens
ADVKEVLKEVLNMEEITAE

SEQ ID NO: 2925880 - protein, 19 aa, Entamoeba invadens
ADVKEVLKEVLTMEKITAE

SEQ ID NO: 2925881 - protein, 21 aa, Entamoeba invadens
ADVMTGLCIHKTIDRLLKIKN

SEQ ID NO: 2925882 - protein, 34 aa, Entamoeba invadens
ADVRYWPEDTFSVFFDRSRLQSVINSFLRVKEID

SEQ ID NO: 2925883 - protein, 26 aa, Entamoeba invadens
ADVTKFGDKVVCGMTKMFGFVLGNAR

SEQ ID NO: 2925884 - protein, 18 aa, Entamoeba invadens
ADVVAFGMKEWAEEHGAV

SEQ ID NO: 2925885 - protein, 18 aa, Entamoeba invadens
ADVVARAGIAVTIATIGE

SEQ ID NO: 2925886 - protein, 18 aa, Entamoeba invadens
ADVVIVDVMVLVYITETL

SEQ ID NO: 2925887 - protein, 23 aa, Entamoeba invadens
ADVWSLGCCLYWMATGHSIYPKD

SEQ ID NO: 2925888 - protein, 28 aa, Entamoeba invadens
ADVYSFAITMLWCITWTDPFPQTVYHYA

SEQ ID NO: 2925889 - protein, 25 aa, Entamoeba invadens
ADWIKKSGKGLGVILNKVDLVDTVI

SEQ ID NO: 2925890 - protein, 26 aa, Entamoeba invadens
ADYCYCPTCVDLFKKRSGIDIKLVED

SEQ ID NO: 2925891 - protein, 23 aa, Entamoeba invadens
ADYIIYTTLAWRNVKYGNCSGFV

SEQ ID NO: 2925892 - protein, 17 aa, Entamoeba invadens
ADYMRKADDVWKKLYDF

SEQ ID NO: 2925893 - protein, 33 aa, Entamoeba invadens
ADYQLYLPYLYILCYYLKIDVPKIKQHTDTAKT

SEQ ID NO: 2925894 - protein, 25 aa, Entamoeba invadens
ADYRIPQLLLGWDCLDFLDQSLKEK

SEQ ID NO: 2925895 - protein, 24 aa, Entamoeba invadens
ADYVCGYCSLLKSVKMDTTVQGIG

SEQ ID NO: 2925896 - protein, 21 aa, Entamoeba invadens
AEAAAKVFLPFTPSFITLFCE

SEQ ID NO: 2925897 - protein, 22 aa, Entamoeba invadens
AEAAGIMMFRCDAISKEALNTY

SEQ ID NO: 2925898 - protein, 18 aa, Entamoeba invadens
AEAAWASFYSYVQPGVSM

SEQ ID NO: 2925899 - protein, 26 aa, Entamoeba invadens
AEAHAKLHLKSVINFEDIKMALKVSL

SEQ ID NO: 2925900 - protein, 31 aa, Entamoeba invadens
AEAIEVLTTLIFLRFLFVPFLATPSLLKCFQ

SEQ ID NO: 2925901 - protein, 24 aa, Entamoeba invadens
AEAIRLKMLSERLATVRSAIQSDL

SEQ ID NO: 2925902 - protein, 20 aa, Entamoeba invadens
AEAIVSIFMESWNKNASELI

SEQ ID NO: 2925903 - protein, 23 aa, Entamoeba invadens
AEAKGLGLTKCVGVFFTHGHFDH

SEQ ID NO: 2925904 - protein, 20 aa, Entamoeba invadens
AEALCSLSNVISKLKKGSNT

SEQ ID NO: 2925905 - protein, 26 aa, Entamoeba invadens
AEALVPYETLQFVFFYFDVVYLRLPR

SEQ ID NO: 2925906 - protein, 23 aa, Entamoeba invadens
AEAPCNKCNTTGFRVTNMCEGCT

SEQ ID NO: 2925907 - protein, 22 aa, Entamoeba invadens
AEAPSEFVFYIPEFKAFCQAEE

SEQ ID NO: 2925908 - protein, 27 aa, Entamoeba invadens
AEATKEQRLKMSLKLDLVTKILQEGLG

SEQ ID NO: 2925909 - protein, 17 aa, Entamoeba invadens
AEAYLGTYFSALGTEAA

SEQ ID NO: 2925910 - protein, 26 aa, Entamoeba invadens
AECCFRNCFDLESLILPTKVMEIGEA

SEQ ID NO: 2925911 - protein, 19 aa, Entamoeba invadens
AECDLPKLLLPLNSLKELH

SEQ ID NO: 2925912 - protein, 22 aa, Entamoeba invadens
AECFLYCSALTSFALPKHVTRI

SEQ ID NO: 2925913 - protein, 17 aa, Entamoeba invadens
AECLRLTSITLHSMLQE

SEQ ID NO: 2925914 - protein, 19 aa, Entamoeba invadens
AECNPFLLFCKDHRDNVRE

SEQ ID NO: 2925915 - protein, 21 aa, Entamoeba invadens
AECNSELIVLAASHNTQLRFH

SEQ ID NO: 2925916 - protein, 17 aa, Entamoeba invadens
AECQSLRVLELPEDLTE

SEQ ID NO: 2925917 - protein, 22 aa, Entamoeba invadens
AECTKCKSGFGFFNGSCVQCNL

SEQ ID NO: 2925918 - protein, 28 aa, Entamoeba invadens
AEDAVSLGWSCRQLHGIIFGTEGELYWE

SEQ ID NO: 2925919 - protein, 26 aa, Entamoeba invadens
AEDLELKTVLSFFAFQLPVVGQIFSK

SEQ ID NO: 2925920 - protein, 17 aa, Entamoeba invadens
AEDLLNLHLRYFTPTEI

SEQ ID NO: 2925921 - protein, 20 aa, Entamoeba invadens
AEDLVKCLTHFMPPHQRVLT

SEQ ID NO: 2925922 - protein, 19 aa, Entamoeba invadens
AEEAALCVYIDGRKINTDV

SEQ ID NO: 2925923 - protein, 18 aa, Entamoeba invadens
AEEAIKMKLHDTTADETI

SEQ ID NO: 2925924 - protein, 20 aa, Entamoeba invadens
AEEIKLLRFLENDYIVRYIA

SEQ ID NO: 2925925 - protein, 22 aa, Entamoeba invadens
AEEKRIGTLIIVKNLDFLSIGY

SEQ ID NO: 2925926 - protein, 25 aa, Entamoeba invadens
AEEKVEFWRGEYRFVEKLFDDTGDD

SEQ ID NO: 2925927 - protein, 17 aa, Entamoeba invadens
AEENARNLLAQKTAEFD

SEQ ID NO: 2925928 - protein, 24 aa, Entamoeba invadens
AEEQEKRPAAAVVAAKFDDWVKEV

SEQ ID NO: 2925929 - protein, 24 aa, Entamoeba invadens
AEEQYKRAVAELKQVTAQLNTAMT

SEQ ID NO: 2925930 - protein, 17 aa, Entamoeba invadens
AEFAELFDYRIVVKRGN

SEQ ID NO: 2925931 - protein, 21 aa, Entamoeba invadens
AEFESRMALLTQEKERILSKQ

SEQ ID NO: 2925932 - protein, 26 aa, Entamoeba invadens
AEFIPKHLMSLLGKYKKANLNEKLVD

SEQ ID NO: 2925933 - protein, 17 aa, Entamoeba invadens
AEFLIEMAEMIDRRYNL

SEQ ID NO: 2925934 - protein, 23 aa, Entamoeba invadens
AEFLNVTESFVWGEKEVSHLHQS

SEQ ID NO: 2925935 - protein, 20 aa, Entamoeba invadens
AEFPMAPSLARVIISAEGFG

SEQ ID NO: 2925936 - protein, 21 aa, Entamoeba invadens
AEFRRFRDGRMMCVVTHQTES

SEQ ID NO: 2925937 - protein, 26 aa, Entamoeba invadens
AEFVEELTELFFLISQHAETNKMSVT

SEQ ID NO: 2925938 - protein, 23 aa, Entamoeba invadens
AEFVSDYLTFVLICDDLYQRDFP

SEQ ID NO: 2925939 - protein, 17 aa, Entamoeba invadens
AEFYKPGTQYNVRVASR

SEQ ID NO: 2925940 - protein, 24 aa, Entamoeba invadens
AEGEIKRNSWLVCVNTLSNSDELN

SEQ ID NO: 2925941 - protein, 18 aa, Entamoeba invadens
AEGIFRISGKLEDINLIK

SEQ ID NO: 2925942 - protein, 22 aa, Entamoeba invadens
AEGKKFYELYPLIAQTMQSLLA

SEQ ID NO: 2925943 - protein, 18 aa, Entamoeba invadens
AEGKTIFENGVCRLDPAF

SEQ ID NO: 2925944 - protein, 21 aa, Entamoeba invadens
AEGLFKIADGFKVYEAQAVIS

SEQ ID NO: 2925945 - protein, 21 aa, Entamoeba invadens
AEGLLKAGFVFGSKLAEADVA

SEQ ID NO: 2925946 - protein, 17 aa, Entamoeba invadens
AEGMIKSVLSVIAVAIC

SEQ ID NO: 2925947 - protein, 25 aa, Entamoeba invadens
AEGNFKRSEATIVALQTDLSDARHD

SEQ ID NO: 2925948 - protein, 26 aa, Entamoeba invadens
AEGTALIKCVYVESGNTFEATKEFTV

SEQ ID NO: 2925949 - protein, 17 aa, Entamoeba invadens
AEGTGNVVFSVKYEAIV

SEQ ID NO: 2925950 - protein, 21 aa, Entamoeba invadens
AEGVVMFLDVTSGMVVRPLLL

SEQ ID NO: 2925951 - protein, 21 aa, Entamoeba invadens
AEHKDEILAKEAKRAELKAQR

SEQ ID NO: 2925952 - protein, 17 aa, Entamoeba invadens
AEIEGRVTEALRKRDES

SEQ ID NO: 2925953 - protein, 21 aa, Entamoeba invadens
AEIESLLKYGAYGVFKDDEES

SEQ ID NO: 2925954 - protein, 24 aa, Entamoeba invadens
AEIFHKWITFCHIIFTDSSSCKKA

SEQ ID NO: 2925955 - protein, 20 aa, Entamoeba invadens
AEIGVLFGVCDSAIHTHLKQ

SEQ ID NO: 2925956 - protein, 20 aa, Entamoeba invadens
AEIIKGLLINTEIATMRSSE

SEQ ID NO: 2925957 - protein, 24 aa, Entamoeba invadens
AEIIYRLVSFCAGAVEEEVCSKDT

SEQ ID NO: 2925958 - protein, 24 aa, Entamoeba invadens
AEILKFCVERDVILKLDNAVFSPY

SEQ ID NO: 2925959 - protein, 32 aa, Entamoeba invadens
AEIQDISNLIGRLCAECIVGELTLAKQIIEDA

SEQ ID NO: 2925960 - protein, 18 aa, Entamoeba invadens
AEISAFCKMHKVGVQAIM

SEQ ID NO: 2925961 - protein, 18 aa, Entamoeba invadens
AEIVLKLYTSLSYIQTDD

SEQ ID NO: 2925962 - protein, 18 aa, Entamoeba invadens
AEKAFEILDEDYQKKLHL

SEQ ID NO: 2925963 - protein, 18 aa, Entamoeba invadens
AEKAYGFVRFVSHDNATK

SEQ ID NO: 2925964 - protein, 19 aa, Entamoeba invadens
AEKCIKLMNGRWFDQRQLT

SEQ ID NO: 2925965 - protein, 26 aa, Entamoeba invadens
AEKCSGLSCRCVKQILGQIHKLTQNS

SEQ ID NO: 2925966 - protein, 26 aa, Entamoeba invadens
AEKEYRKVLVTTPWYFDCHIRISYHY

SEQ ID NO: 2925967 - protein, 22 aa, Entamoeba invadens
AEKFCRKCVVATNIAETSITID

SEQ ID NO: 2925968 - protein, 22 aa, Entamoeba invadens
AEKFIPDYFQYYVHYPLSLTNY

SEQ ID NO: 2925969 - protein, 24 aa, Entamoeba invadens
AEKFKRLQMIFGISQTKFYNKHFS

SEQ ID NO: 2925970 - protein, 22 aa, Entamoeba invadens
AEKFRIALKQAQDIDKEIERKY

SEQ ID NO: 2925971 - protein, 22 aa, Entamoeba invadens
AEKKARLGAMKKDFIKQQAEKV

SEQ ID NO: 2925972 - protein, 17 aa, Entamoeba invadens
AEKKFGKKVSVRNCLAW

SEQ ID NO: 2925973 - protein, 18 aa, Entamoeba invadens
AEKKIAKCIAIKFDPNEY

SEQ ID NO: 2925974 - protein, 20 aa, Entamoeba invadens
AEKLSPCVIFIDEVDALLGK

SEQ ID NO: 2925975 - protein, 19 aa, Entamoeba invadens
AEKPKEGAEMVVRPKEKKE

SEQ ID NO: 2925976 - protein, 29 aa, Entamoeba invadens
AEKRSPSSYVKILLRNAVCQSEKTALESY

SEQ ID NO: 2925977 - protein, 22 aa, Entamoeba invadens
AEKVWDVCNKFAEFDQENKAEG

SEQ ID NO: 2925978 - protein, 21 aa, Entamoeba invadens
AELAQKMVLNLNMKQVVANHA

SEQ ID NO: 2925979 - protein, 17 aa, Entamoeba invadens
AELARLVEEESACDKEL

SEQ ID NO: 2925980 - protein, 26 aa, Entamoeba invadens
AELDEECQMCHKMSKLRMMLTKIPFF

SEQ ID NO: 2925981 - protein, 20 aa, Entamoeba invadens
AELEIPEFQNLVPKVLNVIS

SEQ ID NO: 2925982 - protein, 21 aa, Entamoeba invadens
AELFVGIPIFPGNSEYNMIYK

SEQ ID NO: 2925983 - protein, 17 aa, Entamoeba invadens
AELGKDGLYSWIAKIHG

SEQ ID NO: 2925984 - protein, 19 aa, Entamoeba invadens
AELHAMRAIFMIPNAPPPK

SEQ ID NO: 2925985 - protein, 26 aa, Entamoeba invadens
AELIQKFFIKNLRKVVVLCTPSQTLM

SEQ ID NO: 2925986 - protein, 22 aa, Entamoeba invadens
AELKARLAKRKVLSETITTKIE

SEQ ID NO: 2925987 - protein, 20 aa, Entamoeba invadens
AELKELFLVMMNKGQVLMSQ

SEQ ID NO: 2925988 - protein, 18 aa, Entamoeba invadens
AELLAAYDDPLASQYVQP

SEQ ID NO: 2925989 - protein, 19 aa, Entamoeba invadens
AELLKLLAQIEHVNIAQTI

SEQ ID NO: 2925990 - protein, 18 aa, Entamoeba invadens
AELLRFYSTKSGEDMTSF

SEQ ID NO: 2925991 - protein, 27 aa, Entamoeba invadens
AELNKLKNCKFIAGDVLKVLDSLKEQK

SEQ ID NO: 2925992 - protein, 17 aa, Entamoeba invadens
AELQPYFRVKDYTVEDL

SEQ ID NO: 2925993 - protein, 22 aa, Entamoeba invadens
AELTLRVGDTFDVTDWSDDEFW

SEQ ID NO: 2925994 - protein, 17 aa, Entamoeba invadens
AEMKNKDDVWAFKLKRE

SEQ ID NO: 2925995 - protein, 17 aa, Entamoeba invadens
AEMLPQDYLQRLISLSQ

SEQ ID NO: 2925996 - protein, 24 aa, Entamoeba invadens
AEMRSGGTMIVFRDYFKNVFGIHL

SEQ ID NO: 2925997 - protein, 24 aa, Entamoeba invadens
AEMSLPEVRKLREINRKLMTQPEG

SEQ ID NO: 2925998 - protein, 25 aa, Entamoeba invadens
AEMYCYTCQSVICGVCRASLHSSHT

SEQ ID NO: 2925999 - protein, 32 aa, Entamoeba invadens
AENALREGGKWFKELQRLYVAGGRNKEYILPL

SEQ ID NO: 2926000 - protein, 17 aa, Entamoeba invadens
AENDRKGLVKKFEHDWK

SEQ ID NO: 2926001 - protein, 25 aa, Entamoeba invadens
AENELKGCLLDKITWIDASSQISTI

SEQ ID NO: 2926002 - protein, 25 aa, Entamoeba invadens
AENFFVINLCGQFHLRNMKGVSKKY

SEQ ID NO: 2926003 - protein, 28 aa, Entamoeba invadens
AENHDVSLLAFCYKNKMMHDNTQTLESL

SEQ ID NO: 2926004 - protein, 24 aa, Entamoeba invadens
AENIRCFECNKSFDDFFVPNLIGV

SEQ ID NO: 2926005 - protein, 26 aa, Entamoeba invadens
AENITLCSIKDFIPISFKETKNVFLF

SEQ ID NO: 2926006 - protein, 26 aa, Entamoeba invadens
AENITLCTIKDFIPISFIETKKVYLF

SEQ ID NO: 2926007 - protein, 23 aa, Entamoeba invadens
AENKFEFNNFVFLDSQPYQVDTT

SEQ ID NO: 2926008 - protein, 17 aa, Entamoeba invadens
AENSRLSDQLSQHKDVK

SEQ ID NO: 2926009 - protein, 33 aa, Entamoeba invadens
AENVDGLNALHIFKNFFEGIEYGKLKKRDTAIF

SEQ ID NO: 2926010 - protein, 20 aa, Entamoeba invadens
AEPDGSFCINFFITSINQVF

SEQ ID NO: 2926011 - protein, 18 aa, Entamoeba invadens
AEPEPQFTRTTTTTKEED

SEQ ID NO: 2926012 - protein, 18 aa, Entamoeba invadens
AEPKVVLENCAFVVCNDG

SEQ ID NO: 2926013 - protein, 17 aa, Entamoeba invadens
AEPMAVPGIDNLSVMEI

SEQ ID NO: 2926014 - protein, 22 aa, Entamoeba invadens
AEPNKDIFVIFINRLSVLISEV

SEQ ID NO: 2926015 - protein, 17 aa, Entamoeba invadens
AEPSVISFSGLKEPNPD

SEQ ID NO: 2926016 - protein, 19 aa, Entamoeba invadens
AEQAFKFSREEFPKTITFI

SEQ ID NO: 2926017 - protein, 25 aa, Entamoeba invadens
AEQALSHPWFKGVSQITVTDGIVPV

SEQ ID NO: 2926018 - protein, 24 aa, Entamoeba invadens
AEQATHEYLEFVGNLGVLETVKEN

SEQ ID NO: 2926019 - protein, 24 aa, Entamoeba invadens
AEQCALGIQWVHNRFDIIHKDIKP

SEQ ID NO: 2926020 - protein, 19 aa, Entamoeba invadens
AEQRRSLTFLAQDDESLAM

SEQ ID NO: 2926021 - protein, 24 aa, Entamoeba invadens
AEQSRRATPIIFKSKPESNVRSPQ

SEQ ID NO: 2926022 - protein, 43 aa, Entamoeba invadens
AERACYKCDVSYVWFKAVKEIGDFCFAESVFREKRIEIPEPMT

SEQ ID NO: 2926023 - protein, 43 aa, Entamoeba invadens
AERACYKCDVSYVWFKAVKEIGDFCFAESVFREKRIEIPEQMT

SEQ ID NO: 2926024 - protein, 21 aa, Entamoeba invadens
AERERKMWILNDVETKINKYR

SEQ ID NO: 2926025 - protein, 17 aa, Entamoeba invadens
AERKAEREKAKQDREAK

SEQ ID NO: 2926026 - protein, 22 aa, Entamoeba invadens
AERLTTQIIHFICYYIIEELIS

SEQ ID NO: 2926027 - protein, 26 aa, Entamoeba invadens
AERVEIAEAIFVRWKTRKLMKERDIE

SEQ ID NO: 2926028 - protein, 22 aa, Entamoeba invadens
AERYIDCSTLAPVAKAPVKCEK

SEQ ID NO: 2926029 - protein, 23 aa, Entamoeba invadens
AESCVTCAFGYYYDRTSNDCIYV

SEQ ID NO: 2926030 - protein, 18 aa, Entamoeba invadens
AESFAEGLVKVTPSQTEI

SEQ ID NO: 2926031 - protein, 18 aa, Entamoeba invadens
AESFSRIKTRIDVQRNVS

SEQ ID NO: 2926032 - protein, 29 aa, Entamoeba invadens
AESHPAICKICQKVFGVIRESFWRNTRSK

SEQ ID NO: 2926033 - protein, 19 aa, Entamoeba invadens
AESIFGIRNENDFFLFDQE

SEQ ID NO: 2926034 - protein, 28 aa, Entamoeba invadens
AESIKAKLKIAIINKGWEYSDTFDEKVT

SEQ ID NO: 2926035 - protein, 20 aa, Entamoeba invadens
AESINRTGGVAMLLGIVNRC

SEQ ID NO: 2926036 - protein, 27 aa, Entamoeba invadens
AESKLARLRLEKIGFVFQTYNLLATMS

SEQ ID NO: 2926037 - protein, 21 aa, Entamoeba invadens
AESKLSLKGGVVLTKETPFVV

SEQ ID NO: 2926038 - protein, 29 aa, Entamoeba invadens
AESKSVCKPKLKLVFLTPERIQLDSFLEA

SEQ ID NO: 2926039 - protein, 20 aa, Entamoeba invadens
AESLFLEMLHKTEVYSQRNG

SEQ ID NO: 2926040 - protein, 20 aa, Entamoeba invadens
AESLGTLFFETSAKLGINVK

SEQ ID NO: 2926041 - protein, 19 aa, Entamoeba invadens
AESLITFNNSPLITPSNTL

SEQ ID NO: 2926042 - protein, 19 aa, Entamoeba invadens
AESLKREKEQVMASKNNAL

SEQ ID NO: 2926043 - protein, 32 aa, Entamoeba invadens
AESLRVYAKYILKCPYFLDVFPVFSQSQKLTD

SEQ ID NO: 2926044 - protein, 31 aa, Entamoeba invadens
AESPFGQYAPIFFQFLDCVHIMMNTFSNFFE

SEQ ID NO: 2926045 - protein, 18 aa, Entamoeba invadens
AESQAILPYDQYLHRFAA

SEQ ID NO: 2926046 - protein, 24 aa, Entamoeba invadens
AESRYPITCPLVLLDDVIPTFNLQ

SEQ ID NO: 2926047 - protein, 21 aa, Entamoeba invadens
AESVWVLGKELCKFIDGKKRQ

SEQ ID NO: 2926048 - protein, 17 aa, Entamoeba invadens
AESYGGIPGTEIGVEVA

SEQ ID NO: 2926049 - protein, 20 aa, Entamoeba invadens
AETIMPSMNSYSMMFNQANF

SEQ ID NO: 2926050 - protein, 21 aa, Entamoeba invadens
AETKAAEFAKDYQLSKENEAK

SEQ ID NO: 2926051 - protein, 26 aa, Entamoeba invadens
AETKMLAVCFGHFFAETVLFIGGDSA

SEQ ID NO: 2926052 - protein, 24 aa, Entamoeba invadens
AETLCNRMELSIRVQQCLCKKPQS

SEQ ID NO: 2926053 - protein, 25 aa, Entamoeba invadens
AETLKKLWKVPRHFVDTFLSEMQSV

SEQ ID NO: 2926054 - protein, 20 aa, Entamoeba invadens
AETNCLTFSKSIKRTLATFS

SEQ ID NO: 2926055 - protein, 17 aa, Entamoeba invadens
AETNFYNSHIINQLLQN

SEQ ID NO: 2926056 - protein, 20 aa, Entamoeba invadens
AETNINIVLANSVVCNVSCD

SEQ ID NO: 2926057 - protein, 30 aa, Entamoeba invadens
AETNRALEVLRLTSEFLATIEQTESVVKKD

SEQ ID NO: 2926058 - protein, 24 aa, Entamoeba invadens
AETQAFTNLCFWREEVARKEDVTV

SEQ ID NO: 2926059 - protein, 17 aa, Entamoeba invadens
AETQLIKGKYEKDIAEI

SEQ ID NO: 2926060 - protein, 21 aa, Entamoeba invadens
AETQSTVTFFAFVTKIMKINA

SEQ ID NO: 2926061 - protein, 20 aa, Entamoeba invadens
AETRLKHVMRDYGVLKHQYE

SEQ ID NO: 2926062 - protein, 25 aa, Entamoeba invadens
AETRYPITCPLVLLDDVIPTFNLQS

SEQ ID NO: 2926063 - protein, 26 aa, Entamoeba invadens
AETSFPEYKKATGKVCKVVITEESPQ

SEQ ID NO: 2926064 - protein, 27 aa, Entamoeba invadens
AETSLFKLEAFMIDAICEGRDTVDKMR

SEQ ID NO: 2926065 - protein, 17 aa, Entamoeba invadens
AETVTLFLSRSGINLNI

SEQ ID NO: 2926066 - protein, 17 aa, Entamoeba invadens
AETYEVLYHRWVPHNSK

SEQ ID NO: 2926067 - protein, 23 aa, Entamoeba invadens
AETYFPRVLNLYLTHLIEPQNEF

SEQ ID NO: 2926068 - protein, 25 aa, Entamoeba invadens
AETYSQCFDIFKVVVEQFIIKEEET

SEQ ID NO: 2926069 - protein, 18 aa, Entamoeba invadens
AEVAKWYGQYIVMGDSAV

SEQ ID NO: 2926070 - protein, 18 aa, Entamoeba invadens
AEVALSLGYKNKLMDQTM

SEQ ID NO: 2926071 - protein, 32 aa, Entamoeba invadens
AEVILVLKANYEWHYPQYVCEYICEELVRLGL

SEQ ID NO: 2926072 - protein, 30 aa, Entamoeba invadens
AEVISFYNFWYGFKTWREMAPEEMYDIDEA

SEQ ID NO: 2926073 - protein, 17 aa, Entamoeba invadens
AEVLKIIGSDNIEAPNA

SEQ ID NO: 2926074 - protein, 23 aa, Entamoeba invadens
AEVLRDFPSLSIKLIPQTCQSLR

SEQ ID NO: 2926075 - protein, 20 aa, Entamoeba invadens
AEVSILERFNHAAGVINMID

SEQ ID NO: 2926076 - protein, 23 aa, Entamoeba invadens
AEVSTFFCMSMLLSNIRDWFDPS

SEQ ID NO: 2926077 - protein, 20 aa, Entamoeba invadens
AEVWNSLLFDQIQRLNHNAK

SEQ ID NO: 2926078 - protein, 22 aa, Entamoeba invadens
AEVYAIGLFLYYLLAGTLPRCC

SEQ ID NO: 2926079 - protein, 20 aa, Entamoeba invadens
AEVYGMVLSFVLIENGREIS

SEQ ID NO: 2926080 - protein, 17 aa, Entamoeba invadens
AEWCHYYTFPVFNKYNG

SEQ ID NO: 2926081 - protein, 21 aa, Entamoeba invadens
AEWMSYPLNFAHYGGAAPARS

SEQ ID NO: 2926082 - protein, 17 aa, Entamoeba invadens
AEWNEWILFPIQYKDLS

SEQ ID NO: 2926083 - protein, 24 aa, Entamoeba invadens
AEWSPKEYSGFRFLSLANELVIFG

SEQ ID NO: 2926084 - protein, 20 aa, Entamoeba invadens
AEYFYRHKFSVFLVDLPGHG

SEQ ID NO: 2926085 - protein, 24 aa, Entamoeba invadens
AEYKGELCIFPVVDRLMAADFLSS

SEQ ID NO: 2926086 - protein, 26 aa, Entamoeba invadens
AEYLAPEVLVGFGYSAQVDWWTFGIL

SEQ ID NO: 2926087 - protein, 25 aa, Entamoeba invadens
AEYNPKRFGALIIRITNPKTTALVF

SEQ ID NO: 2926088 - protein, 20 aa, Entamoeba invadens
AEYWPEKKQWIFHDKEQEKK

SEQ ID NO: 2926089 - protein, 24 aa, Entamoeba invadens
AFAECNWKTVIVHESVTDFGIGIF

SEQ ID NO: 2926090 - protein, 19 aa, Entamoeba invadens
AFAGCAFDKVFFPKSVKEI

SEQ ID NO: 2926091 - protein, 23 aa, Entamoeba invadens
AFANCLKLKSVIFPESVLEGRDV

SEQ ID NO: 2926092 - protein, 24 aa, Entamoeba invadens
AFANCLKLKSVIFPESVLEGRDVF

SEQ ID NO: 2926093 - protein, 19 aa, Entamoeba invadens
AFAQDGSSFTCVSDKHKHK

SEQ ID NO: 2926094 - protein, 23 aa, Entamoeba invadens
AFASESFASLKTQEATLLSEIEK

SEQ ID NO: 2926095 - protein, 21 aa, Entamoeba invadens
AFCLKGVGLQQPVLFRSYSTL

SEQ ID NO: 2926096 - protein, 24 aa, Entamoeba invadens
AFCQYRLGHADAFILADGVQYIFS

SEQ ID NO: 2926097 - protein, 18 aa, Entamoeba invadens
AFCREHIEKLITISTPIK

SEQ ID NO: 2926098 - protein, 20 aa, Entamoeba invadens
AFCSPDLNGCFANDSNCAVC

SEQ ID NO: 2926099 - protein, 28 aa, Entamoeba invadens
AFDAEGYFRISLCQHPDVFKDCIPVFKN

SEQ ID NO: 2926100 - protein, 25 aa, Entamoeba invadens
AFDETKPRLSIYIEGFCKVFKTLLS

SEQ ID NO: 2926101 - protein, 25 aa, Entamoeba invadens
AFDLRCVTCSPSFARKCVNCVAGSY

SEQ ID NO: 2926102 - protein, 18 aa, Entamoeba invadens
AFDVDGWISKLHGVIGDE

SEQ ID NO: 2926103 - protein, 25 aa, Entamoeba invadens
AFDYSIKVWDIRSVTPLCTIPLKGK

SEQ ID NO: 2926104 - protein, 21 aa, Entamoeba invadens
AFEAYLPVYKIEIVSVADRKA

SEQ ID NO: 2926105 - protein, 28 aa, Entamoeba invadens
AFECNTGYRQTRIEKIDAIYLLELFFGK

SEQ ID NO: 2926106 - protein, 18 aa, Entamoeba invadens
AFEEIYQPTIGVEFSSKF

SEQ ID NO: 2926107 - protein, 17 aa, Entamoeba invadens
AFEGCVKLQKVVSPIIV

SEQ ID NO: 2926108 - protein, 24 aa, Entamoeba invadens
AFEGRLLLCEKIVFPLTKTIRTYV

SEQ ID NO: 2926109 - protein, 23 aa, Entamoeba invadens
AFEIKTLFYRTFYVMNKVMMEKQ

SEQ ID NO: 2926110 - protein, 36 aa, Entamoeba invadens
AFEKCTSLRKFVIPRGLLYMCARVFCDCSNLEELYF

SEQ ID NO: 2926111 - protein, 26 aa, Entamoeba invadens
AFEKGEYRWAATILNHIVFANKTNQK

SEQ ID NO: 2926112 - protein, 18 aa, Entamoeba invadens
AFEMCGLFDNIGLLINSR

SEQ ID NO: 2926113 - protein, 18 aa, Entamoeba invadens
AFEMWKEALEEASKEFYN

SEQ ID NO: 2926114 - protein, 17 aa, Entamoeba invadens
AFENCNFLSQFIVNNVV

SEQ ID NO: 2926115 - protein, 26 aa, Entamoeba invadens
AFENRGELCLYFLLELLDCVNCETFN

SEQ ID NO: 2926116 - protein, 18 aa, Entamoeba invadens
AFEQRKLIDMTWKQHKHF

SEQ ID NO: 2926117 - protein, 17 aa, Entamoeba invadens
AFERCALETATLNGNAI

SEQ ID NO: 2926118 - protein, 21 aa, Entamoeba invadens
AFESCERLKKVVFECYSNENP

SEQ ID NO: 2926119 - protein, 17 aa, Entamoeba invadens
AFESCGLTKIEIPSTVK

SEQ ID NO: 2926120 - protein, 25 aa, Entamoeba invadens
AFESGEYQWAITLLNHVVFKNPRNF

SEQ ID NO: 2926121 - protein, 19 aa, Entamoeba invadens
AFEYCVKSPYTTSSDEEKP

SEQ ID NO: 2926122 - protein, 25 aa, Entamoeba invadens
AFFAFPDERLFMFVAAALMVENRDN

SEQ ID NO: 2926123 - protein, 27 aa, Entamoeba invadens
AFFDIPQTCGFVFDFQIRKHKPQTNLF

SEQ ID NO: 2926124 - protein, 24 aa, Entamoeba invadens
AFFFARDICHFVNLWDGRYQKCIL

SEQ ID NO: 2926125 - protein, 18 aa, Entamoeba invadens
AFFKMLCFGEHLLNEDKI

SEQ ID NO: 2926126 - protein, 19 aa, Entamoeba invadens
AFFNCVSCSQTLRQCQTCS

SEQ ID NO: 2926127 - protein, 18 aa, Entamoeba invadens
AFFNKGIINEGSIPNTLT

SEQ ID NO: 2926128 - protein, 24 aa, Entamoeba invadens
AFGDGSNRIALCTTEKGNYDLYFG

SEQ ID NO: 2926129 - protein, 17 aa, Entamoeba invadens
AFGICWNPRNDLKNTCV

SEQ ID NO: 2926130 - protein, 18 aa, Entamoeba invadens
AFGKAAVHRLRLTKRFLN

SEQ ID NO: 2926131 - protein, 27 aa, Entamoeba invadens
AFGKKLKLLDGFFLAMLHFVRNDIIEN

SEQ ID NO: 2926132 - protein, 18 aa, Entamoeba invadens
AFGNCIWSFLVRDNNLEV

SEQ ID NO: 2926133 - protein, 18 aa, Entamoeba invadens
AFHAMLPFGETSKLLADV

SEQ ID NO: 2926134 - protein, 18 aa, Entamoeba invadens
AFHIPYKSVDIVISTKDI

SEQ ID NO: 2926135 - protein, 24 aa, Entamoeba invadens
AFILIPGSHLFYFSSSEKRVISAT

SEQ ID NO: 2926136 - protein, 23 aa, Entamoeba invadens
AFKKMTSLLLWTAKGFVSGTKSL

SEQ ID NO: 2926137 - protein, 24 aa, Entamoeba invadens
AFKNCFKIKELVFNRSCVIERGAF

SEQ ID NO: 2926138 - protein, 30 aa, Entamoeba invadens
AFKNWKQGRCVVFKAPLLKIPNECFTNSEN

SEQ ID NO: 2926139 - protein, 19 aa, Entamoeba invadens
AFLDTAVPILLKYFKLVFE

SEQ ID NO: 2926140 - protein, 18 aa, Entamoeba invadens
AFLIYLRALGQLFTMSIF

SEQ ID NO: 2926141 - protein, 23 aa, Entamoeba invadens
AFLKKGLEIYNLYKTNCKNGTYK

SEQ ID NO: 2926142 - protein, 23 aa, Entamoeba invadens
AFLKSPRTISTLKLNVTGAKSPR

SEQ ID NO: 2926143 - protein, 23 aa, Entamoeba invadens
AFLPEFVVSIITDYVGMCLNLEA

SEQ ID NO: 2926144 - protein, 23 aa, Entamoeba invadens
AFLRELLDLLKILSDNQQETKMT

SEQ ID NO: 2926145 - protein, 17 aa, Entamoeba invadens
AFLRPETAQGIFTMFKR

SEQ ID NO: 2926146 - protein, 24 aa, Entamoeba invadens
AFLSCGFESLTIPSSIYSIEFGAF

SEQ ID NO: 2926147 - protein, 22 aa, Entamoeba invadens
AFLSSRFNYDFRGITDVGHSYI

SEQ ID NO: 2926148 - protein, 17 aa, Entamoeba invadens
AFLVSSIAKLQCITPTV

SEQ ID NO: 2926149 - protein, 23 aa, Entamoeba invadens
AFMATCKRFYLIVKNEDEIWHGI

SEQ ID NO: 2926150 - protein, 18 aa, Entamoeba invadens
AFMKAWRDAVEQNRKMKE

SEQ ID NO: 2926151 - protein, 19 aa, Entamoeba invadens
AFMYPEKYGICTAETLTLK

SEQ ID NO: 2926152 - protein, 19 aa, Entamoeba invadens
AFNAILFVGVFAELEIPEF

SEQ ID NO: 2926153 - protein, 25 aa, Entamoeba invadens
AFNGCVKLLSVNFYAPLTKLLDSLA

SEQ ID NO: 2926154 - protein, 20 aa, Entamoeba invadens
AFNMYREMYYEGGVHSVYVW

SEQ ID NO: 2926155 - protein, 20 aa, Entamoeba invadens
AFNQCPLTSIVISKNMTSLS

SEQ ID NO: 2926156 - protein, 23 aa, Entamoeba invadens
AFNRPFMDYSMCAIAVGAIMVVP

SEQ ID NO: 2926157 - protein, 28 aa, Entamoeba invadens
AFNTMKAAELFSAFGRILHIWVDTKKQI

SEQ ID NO: 2926158 - protein, 17 aa, Entamoeba invadens
AFNYRGIVRNVFADYAN

SEQ ID NO: 2926159 - protein, 17 aa, Entamoeba invadens
AFPKSTYIFPWTFADDV

SEQ ID NO: 2926160 - protein, 26 aa, Entamoeba invadens
AFPTAFHIAGLWKIDRLVAEMKLCYN

SEQ ID NO: 2926161 - protein, 26 aa, Entamoeba invadens
AFPTAFHIAGLWKIDRLVAEMKTVYD

SEQ ID NO: 2926162 - protein, 23 aa, Entamoeba invadens
AFPTWRNNLQISLQIRVKTQVRI

SEQ ID NO: 2926163 - protein, 24 aa, Entamoeba invadens
AFQICGLNSFTFPESVKVIGSCLF

SEQ ID NO: 2926164 - protein, 18 aa, Entamoeba invadens
AFQPHFMDFLNGYFDLLK

SEQ ID NO: 2926165 - protein, 24 aa, Entamoeba invadens
AFQRGDCIAVFNFNPNKSFTDYGV

SEQ ID NO: 2926166 - protein, 18 aa, Entamoeba invadens
AFRDCSKLLYIVLSSSLL

SEQ ID NO: 2926167 - protein, 17 aa, Entamoeba invadens
AFRIREFLGEQVCVVPV

SEQ ID NO: 2926168 - protein, 22 aa, Entamoeba invadens
AFRLPYGRCVAVLLKSETTAEG

SEQ ID NO: 2926169 - protein, 28 aa, Entamoeba invadens
AFRNCTSLRRFLIPQGLLYMDSLVFYNC

SEQ ID NO: 2926170 - protein, 25 aa, Entamoeba invadens
AFRNCTSLRRFVIPQGLLYIDSLVF

SEQ ID NO: 2926171 - protein, 25 aa, Entamoeba invadens
AFRNCTSLRRFVIPQGLLYMDSLVF

SEQ ID NO: 2926172 - protein, 23 aa, Entamoeba invadens
AFSCCPHLKCVKNMNRSTVVRRD

SEQ ID NO: 2926173 - protein, 24 aa, Entamoeba invadens
AFSGCLKLSTFIVGQEHLSQISFP

SEQ ID NO: 2926174 - protein, 17 aa, Entamoeba invadens
AFSGCVSLSKFALPQNV

SEQ ID NO: 2926175 - protein, 20 aa, Entamoeba invadens
AFSGNIEKRVQYLYNKYPQL

SEQ ID NO: 2926176 - protein, 20 aa, Entamoeba invadens
AFSLIRLKRIGVHMRIVNYQ

SEQ ID NO: 2926177 - protein, 20 aa, Entamoeba invadens
AFSNCNKLCQFQVPQKVRFV

SEQ ID NO: 2926178 - protein, 24 aa, Entamoeba invadens
AFSSCGLTAFTIPDHVIYIGDRCF

SEQ ID NO: 2926179 - protein, 32 aa, Entamoeba invadens
AFTALTEWAFAPSCVFIKALIPEVTAQLLNGI

SEQ ID NO: 2926180 - protein, 18 aa, Entamoeba invadens
AFTNCLCLSKVILSSNIC

SEQ ID NO: 2926181 - protein, 22 aa, Entamoeba invadens
AFTSTQEGFLWAMKNTTNPEKV

SEQ ID NO: 2926182 - protein, 19 aa, Entamoeba invadens
AFVKELHYITSFVVDCTNQ

SEQ ID NO: 2926183 - protein, 17 aa, Entamoeba invadens
AFVKPPLDADHRVVNDT

SEQ ID NO: 2926184 - protein, 19 aa, Entamoeba invadens
AFVPVPYLPFTFETLNLLR

SEQ ID NO: 2926185 - protein, 19 aa, Entamoeba invadens
AFVQLCLEQLTLMRVINQN

SEQ ID NO: 2926186 - protein, 24 aa, Entamoeba invadens
AFVQSRFERWGIVPGDPLDKEIKP

SEQ ID NO: 2926187 - protein, 20 aa, Entamoeba invadens
AFVQYLLCKDSALLNVANYA

SEQ ID NO: 2926188 - protein, 22 aa, Entamoeba invadens
AFYECLGNIYLDVGPECKIEKD

SEQ ID NO: 2926189 - protein, 23 aa, Entamoeba invadens
AFYECLGNIYLDVGPECKIEKDS

SEQ ID NO: 2926190 - protein, 18 aa, Entamoeba invadens
AFYECSAKTGDKCEEALK

SEQ ID NO: 2926191 - protein, 17 aa, Entamoeba invadens
AFYGCRSLQYFVVPLTV

SEQ ID NO: 2926192 - protein, 17 aa, Entamoeba invadens
AFYKCKELIKIKVFSID

SEQ ID NO: 2926193 - protein, 23 aa, Entamoeba invadens
AFYKHSSEFLSIFENVLSTIVKP

SEQ ID NO: 2926194 - protein, 23 aa, Entamoeba invadens
AFYLKCGVLEYTVRNYNEGFDLC

SEQ ID NO: 2926195 - protein, 24 aa, Entamoeba invadens
AFYQIRCIPTFYFFSNGIKMSQFS

SEQ ID NO: 2926196 - protein, 19 aa, Entamoeba invadens
AFYSARANFIRSMSAYSIV

SEQ ID NO: 2926197 - protein, 24 aa, Entamoeba invadens
AGAHGKDTWGIFRVHQFEKVEQFC

SEQ ID NO: 2926198 - protein, 19 aa, Entamoeba invadens
AGAILLSEVCETKFLPEFF

SEQ ID NO: 2926199 - protein, 20 aa, Entamoeba invadens
AGAKVYSRLSTFNLFVDKQR

SEQ ID NO: 2926200 - protein, 19 aa, Entamoeba invadens
AGALKWVPHIIDIHQLSRR

SEQ ID NO: 2926201 - protein, 17 aa, Entamoeba invadens
AGAMVLADRGIVCVDEF

SEQ ID NO: 2926202 - protein, 24 aa, Entamoeba invadens
AGAPKLAPFYIEDMHAFVVKKDDT

SEQ ID NO: 2926203 - protein, 21 aa, Entamoeba invadens
AGATGAFIAKLKAKYETELEE

SEQ ID NO: 2926204 - protein, 19 aa, Entamoeba invadens
AGAYEQLQMNAKRAGVPFF

SEQ ID NO: 2926205 - protein, 19 aa, Entamoeba invadens
AGAYFACDRFEFNKHIEGE

SEQ ID NO: 2926206 - protein, 22 aa, Entamoeba invadens
AGCANLKALVIKNVNSFDDNVR

SEQ ID NO: 2926207 - protein, 26 aa, Entamoeba invadens
AGCICAELILGIPLFPGNSEYNELYK

SEQ ID NO: 2926208 - protein, 24 aa, Entamoeba invadens
AGCTGSIGFFEFVALYNWVKLCFA

SEQ ID NO: 2926209 - protein, 26 aa, Entamoeba invadens
AGDAFVGSFARCWAKGIDFVNSAKMS

SEQ ID NO: 2926210 - protein, 24 aa, Entamoeba invadens
AGDHGCGKTCLLTLYSSSEFPTDY

SEQ ID NO: 2926211 - protein, 19 aa, Entamoeba invadens
AGDHGCGKTSLLTVYSSSE

SEQ ID NO: 2926212 - protein, 23 aa, Entamoeba invadens
AGDLKMAVCFFEKYTEHGNEKYL

SEQ ID NO: 2926213 - protein, 23 aa, Entamoeba invadens
AGDLPRLLKHLRITKELENGEYD

SEQ ID NO: 2926214 - protein, 25 aa, Entamoeba invadens
AGDLPRLLKHMTLFEVQDDKYFCIF

SEQ ID NO: 2926215 - protein, 24 aa, Entamoeba invadens
AGDLPRLLNHLSIVREVSEGNYDT

SEQ ID NO: 2926216 - protein, 22 aa, Entamoeba invadens
AGDRMHCAAGFLTADSITHGVT

SEQ ID NO: 2926217 - protein, 19 aa, Entamoeba invadens
AGDVLKYLLSVQLDKSQKE

SEQ ID NO: 2926218 - protein, 19 aa, Entamoeba invadens
AGEAFRLVGHEPQECKEWL

SEQ ID NO: 2926219 - protein, 24 aa, Entamoeba invadens
AGEKCKAERIMAFNLQFNPSPRME

SEQ ID NO: 2926220 - protein, 29 aa, Entamoeba invadens
AGELFGGEVMYRFAMSQVMDTWKKEYASL

SEQ ID NO: 2926221 - protein, 17 aa, Entamoeba invadens
AGESAFVEKMECEEENK

SEQ ID NO: 2926222 - protein, 25 aa, Entamoeba invadens
AGFAKWAEGSLMFSDDIDSQELLLT

SEQ ID NO: 2926223 - protein, 22 aa, Entamoeba invadens
AGGAICRPSYDLGESAKAVQYA

SEQ ID NO: 2926224 - protein, 19 aa, Entamoeba invadens
AGGDGSVGWCLNECRKKNL

SEQ ID NO: 2926225 - protein, 17 aa, Entamoeba invadens
AGGFEIEMSKKLSEYGD

SEQ ID NO: 2926226 - protein, 23 aa, Entamoeba invadens
AGGGLPALRGSGLLCFDVQENDC

SEQ ID NO: 2926227 - protein, 19 aa, Entamoeba invadens
AGGKGGFGALLKDSSQRVA

SEQ ID NO: 2926228 - protein, 21 aa, Entamoeba invadens
AGGYDYLLSMKIWTLTYERAK

SEQ ID NO: 2926229 - protein, 19 aa, Entamoeba invadens
AGHGLEIFHSLEHTKLPKV

SEQ ID NO: 2926230 - protein, 18 aa, Entamoeba invadens
AGHYICFTNTPSGWIECN

SEQ ID NO: 2926231 - protein, 25 aa, Entamoeba invadens
AGIEIKELLISQVVEPLKLYLDQWG

SEQ ID NO: 2926232 - protein, 22 aa, Entamoeba invadens
AGIFCGLVALGIFHFGGGFDVD

SEQ ID NO: 2926233 - protein, 18 aa, Entamoeba invadens
AGINCLRLMNEHTATALA

SEQ ID NO: 2926234 - protein, 18 aa, Entamoeba invadens
AGINIPGFITEIKKENYT

SEQ ID NO: 2926235 - protein, 18 aa, Entamoeba invadens
AGITFCFDNEALYKITSN

SEQ ID NO: 2926236 - protein, 30 aa, Entamoeba invadens
AGIVVWPCVAEILPQFVFNDRNPIICGVKI

SEQ ID NO: 2926237 - protein, 27 aa, Entamoeba invadens
AGKCQKCSVSGCKRCSDGETCDMCNEI

SEQ ID NO: 2926238 - protein, 28 aa, Entamoeba invadens
AGKDIGLVVFCVYNFVGPMEELLFEYDC

SEQ ID NO: 2926239 - protein, 23 aa, Entamoeba invadens
AGKKIANLWSQWFDIPEGAISKD

SEQ ID NO: 2926240 - protein, 26 aa, Entamoeba invadens
AGKKIEVPEGCMLNLLHFAYEGNEPT

SEQ ID NO: 2926241 - protein, 20 aa, Entamoeba invadens
AGKKILKLQCGMGHHNTVGF

SEQ ID NO: 2926242 - protein, 24 aa, Entamoeba invadens
AGKNVRLRYYLRVTVNKKYSSGMN

SEQ ID NO: 2926243 - protein, 21 aa, Entamoeba invadens
AGKNYLPPVFAIEPVEIDLDT

SEQ ID NO: 2926244 - protein, 20 aa, Entamoeba invadens
AGKPKAYAYIELDSVESRER

SEQ ID NO: 2926245 - protein, 25 aa, Entamoeba invadens
AGKPLSFIVGRRIKRGRDWKWSDQD

SEQ ID NO: 2926246 - protein, 22 aa, Entamoeba invadens
AGKPRQSAIFHFGRNPLMESTV

SEQ ID NO: 2926247 - protein, 17 aa, Entamoeba invadens
AGKTCLLMRFTRNEFDA

SEQ ID NO: 2926248 - protein, 25 aa, Entamoeba invadens
AGKVFPYNEFHVFESLFTLLENYLS

SEQ ID NO: 2926249 - protein, 25 aa, Entamoeba invadens
AGLDIKATGFGRCVGFRYEKGGMYV

SEQ ID NO: 2926250 - protein, 19 aa, Entamoeba invadens
AGLERYILKIANRIPQCQL

SEQ ID NO: 2926251 - protein, 25 aa, Entamoeba invadens
AGLFKPQMAVPFLKALREVTDLPIF

SEQ ID NO: 2926252 - protein, 18 aa, Entamoeba invadens
AGLGRLPASFSKFENLED

SEQ ID NO: 2926253 - protein, 19 aa, Entamoeba invadens
AGLICQMNTIFSLLQQYPG

SEQ ID NO: 2926254 - protein, 17 aa, Entamoeba invadens
AGLKMLMEAEEEAKKVI

SEQ ID NO: 2926255 - protein, 21 aa, Entamoeba invadens
AGLKNAPLIFGAMKIVLEDVA

SEQ ID NO: 2926256 - protein, 20 aa, Entamoeba invadens
AGLMGMLISVVIAKAYSNSS

SEQ ID NO: 2926257 - protein, 23 aa, Entamoeba invadens
AGLQSRIKILAAENEKLRKDSSG

SEQ ID NO: 2926258 - protein, 24 aa, Entamoeba invadens
AGLREVIAQIKLCDVQAMSTYSSY

SEQ ID NO: 2926259 - protein, 20 aa, Entamoeba invadens
AGLVGRRDFVHFRKIYDNVE

SEQ ID NO: 2926260 - protein, 17 aa, Entamoeba invadens
AGMFKQDIAGPVIELLL

SEQ ID NO: 2926261 - protein, 24 aa, Entamoeba invadens
AGMLADGLFDFLIELFMITTDDNT

SEQ ID NO: 2926262 - protein, 19 aa, Entamoeba invadens
AGNPINFGRPFKLNCAEAL

SEQ ID NO: 2926263 - protein, 19 aa, Entamoeba invadens
AGPGLKPQDAVVFEDNPNP

SEQ ID NO: 2926264 - protein, 27 aa, Entamoeba invadens
AGPHPSSEHLLCLKVNVGEENVRSVVA

SEQ ID NO: 2926265 - protein, 32 aa, Entamoeba invadens
AGQFPLPRLTVGAFCKCLQAIWCQMSGKELEV

SEQ ID NO: 2926266 - protein, 43 aa, Entamoeba invadens
AGQKIDWSRTESGFGDFCSYIFKAAQLKNDFGLVAKLSDANKD

SEQ ID NO: 2926267 - protein, 28 aa, Entamoeba invadens
AGQQQRTKFILKNCNPTWNETFEFHNVV

SEQ ID NO: 2926268 - protein, 25 aa, Entamoeba invadens
AGQRPELNMTWNYNFDKMTYFNEYV

SEQ ID NO: 2926269 - protein, 17 aa, Entamoeba invadens
AGRGGVIRLDIKRLRSV

SEQ ID NO: 2926270 - protein, 23 aa, Entamoeba invadens
AGRRPRYVDPFTQQVHHTAPPVV

SEQ ID NO: 2926271 - protein, 24 aa, Entamoeba invadens
AGRSWVFQTCIAYGYYQVVSEKSS

SEQ ID NO: 2926272 - protein, 23 aa, Entamoeba invadens
AGSCVTCAFGYYYDTTSNDCIYV

SEQ ID NO: 2926273 - protein, 25 aa, Entamoeba invadens
AGSELRFDVLLDLIRRLFVEEKNRM

SEQ ID NO: 2926274 - protein, 18 aa, Entamoeba invadens
AGSKRLAIYDARPPLNAQ

SEQ ID NO: 2926275 - protein, 24 aa, Entamoeba invadens
AGSPIPCKYKETFVTTSDYQTTLL

SEQ ID NO: 2926276 - protein, 18 aa, Entamoeba invadens
AGSQKFGAVWTGDTDSTW

SEQ ID NO: 2926277 - protein, 19 aa, Entamoeba invadens
AGSQVPFTSINFGTDVSDE

SEQ ID NO: 2926278 - protein, 30 aa, Entamoeba invadens
AGTMTVKITVVRGTKLPKKDLLSSDPYVIV

SEQ ID NO: 2926279 - protein, 26 aa, Entamoeba invadens
AGTYMRTLCVHLGYLSGTGAHMEELR

SEQ ID NO: 2926280 - protein, 17 aa, Entamoeba invadens
AGVACTHIIIMVYTILR

SEQ ID NO: 2926281 - protein, 18 aa, Entamoeba invadens
AGVALDMTDYLDGCEFHV

SEQ ID NO: 2926282 - protein, 19 aa, Entamoeba invadens
AGVCAKCRLPKPIYKEFKK

SEQ ID NO: 2926283 - protein, 19 aa, Entamoeba invadens
AGVIIKYPDLFLVNKEVLL

SEQ ID NO: 2926284 - protein, 18 aa, Entamoeba invadens
AGVITRASFEQTLEQFRR

SEQ ID NO: 2926285 - protein, 19 aa, Entamoeba invadens
AGVLTFRAASSLATSQNTV

SEQ ID NO: 2926286 - protein, 19 aa, Entamoeba invadens
AGVRAEIVSVWSFGVILYR

SEQ ID NO: 2926287 - protein, 18 aa, Entamoeba invadens
AGVSFCFDNEALNTIAKN

SEQ ID NO: 2926288 - protein, 17 aa, Entamoeba invadens
AGWGCAIRSVQMLLVNS

SEQ ID NO: 2926289 - protein, 22 aa, Entamoeba invadens
AHAFAALLRMIRPYSSDVKNFI

SEQ ID NO: 2926290 - protein, 32 aa, Entamoeba invadens
AHALIDFPPAVKMSQFFTSFVMGIGDYYEPNS

SEQ ID NO: 2926291 - protein, 25 aa, Entamoeba invadens
AHANCKVCAVDKCYQCKDDKYLKED

SEQ ID NO: 2926292 - protein, 17 aa, Entamoeba invadens
AHCVSQWGHDFRESYQK

SEQ ID NO: 2926293 - protein, 32 aa, Entamoeba invadens
AHDVTLFMVLKFLGFKVDKWVPLASYIILEIF

SEQ ID NO: 2926294 - protein, 25 aa, Entamoeba invadens
AHEDPEFRKIAAYLYSSYDDYKSAM

SEQ ID NO: 2926295 - protein, 23 aa, Entamoeba invadens
AHEKSDLFESFRIKKVVEKIKKN

SEQ ID NO: 2926296 - protein, 21 aa, Entamoeba invadens
AHEPVSCGVHFTRENNVDMYF

SEQ ID NO: 2926297 - protein, 30 aa, Entamoeba invadens
AHERFIKKEAEVMAVSPWSVVFKNWNNVLP

SEQ ID NO: 2926298 - protein, 26 aa, Entamoeba invadens
AHEVARDRLSQILIYLFSGNVKDASE

SEQ ID NO: 2926299 - protein, 17 aa, Entamoeba invadens
AHFPNLKFCEIDVTENY

SEQ ID NO: 2926300 - protein, 18 aa, Entamoeba invadens
AHFQRSFTHAFSASPLVR

SEQ ID NO: 2926301 - protein, 18 aa, Entamoeba invadens
AHFSSRMQCKACNKDLMV

SEQ ID NO: 2926302 - protein, 21 aa, Entamoeba invadens
AHGRIPYLQVHNPCVPTIALG

SEQ ID NO: 2926303 - protein, 22 aa, Entamoeba invadens
AHHFIGIIPYNGILLMLDGLSE

SEQ ID NO: 2926304 - protein, 18 aa, Entamoeba invadens
AHHLRLKDIHNILLNCQY

SEQ ID NO: 2926305 - protein, 18 aa, Entamoeba invadens
AHHLRYLHDQNITGLVFV

SEQ ID NO: 2926306 - protein, 22 aa, Entamoeba invadens
AHIGEIQASVWPQETRDKLEKK

SEQ ID NO: 2926307 - protein, 18 aa, Entamoeba invadens
AHINKEMMEEWMVNMAKY

SEQ ID NO: 2926308 - protein, 22 aa, Entamoeba invadens
AHIRTLLLTFFYRQMPDLVERG

SEQ ID NO: 2926309 - protein, 35 aa, Entamoeba invadens
AHKFFRVKIRIMPKCALCGFNWFNAYYTPGVSRIS

SEQ ID NO: 2926310 - protein, 20 aa, Entamoeba invadens
AHKFYRRKIQIMPKCTLCGF

SEQ ID NO: 2926311 - protein, 26 aa, Entamoeba invadens
AHKSLEPFGGLIAWLRKYSNDDFVAV

SEQ ID NO: 2926312 - protein, 18 aa, Entamoeba invadens
AHLPKVPVVSIWIHDIIS

SEQ ID NO: 2926313 - protein, 27 aa, Entamoeba invadens
AHLSLFKGLMKLAFKITMYKDINMMDA

SEQ ID NO: 2926314 - protein, 20 aa, Entamoeba invadens
AHLTTLRCVVVYSQNVKKPY

SEQ ID NO: 2926315 - protein, 21 aa, Entamoeba invadens
AHLYPPQRRLHLHKRYDVEYP

SEQ ID NO: 2926316 - protein, 24 aa, Entamoeba invadens
AHMILARQNFRTDLKDAIEHIKNA

SEQ ID NO: 2926317 - protein, 20 aa, Entamoeba invadens
AHMTPDLLLTVSREGSVGKT

SEQ ID NO: 2926318 - protein, 19 aa, Entamoeba invadens
AHNCPNIPYIFVGTKVNTR

SEQ ID NO: 2926319 - protein, 22 aa, Entamoeba invadens
AHPFVVDSFNFISMNNLQTKFP

SEQ ID NO: 2926320 - protein, 24 aa, Entamoeba invadens
AHPPYPRFSLFFTQTGTITDDILM

SEQ ID NO: 2926321 - protein, 25 aa, Entamoeba invadens
AHQIKRIYFTGGFVSRNTVVWEGIT

SEQ ID NO: 2926322 - protein, 23 aa, Entamoeba invadens
AHQLGYGGVWLGVYPEEDRMMNI

SEQ ID NO: 2926323 - protein, 24 aa, Entamoeba invadens
AHQTRLLMYNIMCYVLQLCYVSNV

SEQ ID NO: 2926324 - protein, 19 aa, Entamoeba invadens
AHRKYLFLEDEKLELERNL

SEQ ID NO: 2926325 - protein, 21 aa, Entamoeba invadens
AHSDMIAYMKKIFVKKTNLYP

SEQ ID NO: 2926326 - protein, 18 aa, Entamoeba invadens
AHSIPSLVHLFRAKTDEF

SEQ ID NO: 2926327 - protein, 19 aa, Entamoeba invadens
AHSVPRKMMFSELEKSVKV

SEQ ID NO: 2926328 - protein, 18 aa, Entamoeba invadens
AHTLILLFSLLPTEDLMV

SEQ ID NO: 2926329 - protein, 21 aa, Entamoeba invadens
AHTPNKMWAKLLLDEDYMKAL

SEQ ID NO: 2926330 - protein, 25 aa, Entamoeba invadens
AHTQCCLFKGIRQCLKQLENDHILY

SEQ ID NO: 2926331 - protein, 18 aa, Entamoeba invadens
AHVRKARKTLYFVELRDG

SEQ ID NO: 2926332 - protein, 17 aa, Entamoeba invadens
AHVTSISVLRTYRRLGV

SEQ ID NO: 2926333 - protein, 20 aa, Entamoeba invadens
AHYICVDHTIGAIVISCRGT

SEQ ID NO: 2926334 - protein, 25 aa, Entamoeba invadens
AHYLQELYMRMSVTNFLEIPPDITA

SEQ ID NO: 2926335 - protein, 27 aa, Entamoeba invadens
AHYVCAWCGLCVDPKCIDKVPNVCFRG

SEQ ID NO: 2926336 - protein, 28 aa, Entamoeba invadens
AIAEASQAFAWICVDKTPAPFVNDAIPS

SEQ ID NO: 2926337 - protein, 23 aa, Entamoeba invadens
AIALRTGEVVLFDLKKNKKIFSL

SEQ ID NO: 2926338 - protein, 26 aa, Entamoeba invadens
AIAPFSIPVARNFFKQLLSGVKYCHD

SEQ ID NO: 2926339 - protein, 25 aa, Entamoeba invadens
AICHAEFTGGSSIEFSGKRYCINCY

SEQ ID NO: 2926340 - protein, 18 aa, Entamoeba invadens
AICRRGCVIIDKNQIIRF

SEQ ID NO: 2926341 - protein, 20 aa, Entamoeba invadens
AICTPRAVKVLVGKHNEIFS

SEQ ID NO: 2926342 - protein, 18 aa, Entamoeba invadens
AIDCLIKGKNVEFDMMVN

SEQ ID NO: 2926343 - protein, 18 aa, Entamoeba invadens
AIDKKIAEDFKYVKEDEK

SEQ ID NO: 2926344 - protein, 22 aa, Entamoeba invadens
AIDLIPIFFALKSNMWFTDVSV

SEQ ID NO: 2926345 - protein, 23 aa, Entamoeba invadens
AIDMGDELFLLFQNKIGCYDFDT

SEQ ID NO: 2926346 - protein, 32 aa, Entamoeba invadens
AIDNRYCPIFSMWCMCHRLNLCVEECIKDNGV

SEQ ID NO: 2926347 - protein, 32 aa, Entamoeba invadens
AIDNRYCPIFSMWCMCHRLNLCVEECITDNGV

SEQ ID NO: 2926348 - protein, 21 aa, Entamoeba invadens
AIDSYPFFEYVMRVYAYAIGV

SEQ ID NO: 2926349 - protein, 20 aa, Entamoeba invadens
AIDTMMAWADSQNVVLRKGS

SEQ ID NO: 2926350 - protein, 32 aa, Entamoeba invadens
AIDVQTVFNLARWIYIHGIEVEGLFRVNGDQG

SEQ ID NO: 2926351 - protein, 26 aa, Entamoeba invadens
AIDYYDLYRSFSLYFFKDKTLDKFNK

SEQ ID NO: 2926352 - protein, 19 aa, Entamoeba invadens
AIESAKLVERFPAQFQNNL

SEQ ID NO: 2926353 - protein, 22 aa, Entamoeba invadens
AIETVCKAALFVPDSDERQIQL

SEQ ID NO: 2926354 - protein, 24 aa, Entamoeba invadens
AIFDVKRLIGRPVSDVIKDTTKIF

SEQ ID NO: 2926355 - protein, 17 aa, Entamoeba invadens
AIFFDWDSEYQKCKDKL

SEQ ID NO: 2926356 - protein, 18 aa, Entamoeba invadens
AIFGFSFKAPIRGIFKEV

SEQ ID NO: 2926357 - protein, 23 aa, Entamoeba invadens
AIFGLPSVRKVTIWNCTHISYLN

SEQ ID NO: 2926358 - protein, 18 aa, Entamoeba invadens
AIFKSVMLSDYFEMQKLL

SEQ ID NO: 2926359 - protein, 21 aa, Entamoeba invadens
AIFLHPYAKEMLLKKTVLELL

SEQ ID NO: 2926360 - protein, 17 aa, Entamoeba invadens
AIFPPKPTRGFNSVEAK

SEQ ID NO: 2926361 - protein, 21 aa, Entamoeba invadens
AIFQLKALCLVFPNRKDLWFF

SEQ ID NO: 2926362 - protein, 18 aa, Entamoeba invadens
AIFQSVKKPFAIIGEEEK

SEQ ID NO: 2926363 - protein, 22 aa, Entamoeba invadens
AIGAGLKVIACIGETEAERVGN

SEQ ID NO: 2926364 - protein, 18 aa, Entamoeba invadens
AIGFKLLSICLTQSSVVY

SEQ ID NO: 2926365 - protein, 18 aa, Entamoeba invadens
AIGKEKCAAMNSVESERK

SEQ ID NO: 2926366 - protein, 23 aa, Entamoeba invadens
AIGLKRGGEKDIMIKTFKEKFLD

SEQ ID NO: 2926367 - protein, 17 aa, Entamoeba invadens
AIGSCCFSGCINLEDLI

SEQ ID NO: 2926368 - protein, 18 aa, Entamoeba invadens
AIHFKELAKNAANANKEG

SEQ ID NO: 2926369 - protein, 19 aa, Entamoeba invadens
AIHHIELIEAIQHKQLLET

SEQ ID NO: 2926370 - protein, 18 aa, Entamoeba invadens
AIHMNLIGGHGLKKMDIR

SEQ ID NO: 2926371 - protein, 19 aa, Entamoeba invadens
AIHTTGYWRSKEHVFVKHT

SEQ ID NO: 2926372 - protein, 26 aa, Entamoeba invadens
AIIKKIFKFFPRLEVLQVDPETAKTI

SEQ ID NO: 2926373 - protein, 20 aa, Entamoeba invadens
AIIPHCLIGRDVIGAAKTGS

SEQ ID NO: 2926374 - protein, 18 aa, Entamoeba invadens
AIIPIDFVADSIVLILEK

SEQ ID NO: 2926375 - protein, 23 aa, Entamoeba invadens
AIIPIKPPLPMLNKRDVKCREEY

SEQ ID NO: 2926376 - protein, 18 aa, Entamoeba invadens
AIITVCWDPVPQNRPEMK

SEQ ID NO: 2926377 - protein, 25 aa, Entamoeba invadens
AIKAHGVTCFVSRQLIYPLPEQFFS

SEQ ID NO: 2926378 - protein, 17 aa, Entamoeba invadens
AIKDLTTNFAINYMYQD

SEQ ID NO: 2926379 - protein, 25 aa, Entamoeba invadens
AIKELNFPAGSKFIAEPGRYLASDA

SEQ ID NO: 2926380 - protein, 20 aa, Entamoeba invadens
AIKMDARGAVLLLDSTAETA

SEQ ID NO: 2926381 - protein, 20 aa, Entamoeba invadens
AIKNTGCLKNLILLFEESPL

SEQ ID NO: 2926382 - protein, 19 aa, Entamoeba invadens
AIKPIKRKAALDFDIKSLA

SEQ ID NO: 2926383 - protein, 19 aa, Entamoeba invadens
AIKQEFHFLGFYVVDNLFN

SEQ ID NO: 2926384 - protein, 29 aa, Entamoeba invadens
AIKTVWDVKRIREMWLLIFKFLDHPLQVG

SEQ ID NO: 2926385 - protein, 23 aa, Entamoeba invadens
AIKVLRSKFSYFRQGMLEVAMLS

SEQ ID NO: 2926386 - protein, 18 aa, Entamoeba invadens
AILCLSNYCFSNCFDITE

SEQ ID NO: 2926387 - protein, 17 aa, Entamoeba invadens
AILMDWDMDYSKCKKSM

SEQ ID NO: 2926388 - protein, 20 aa, Entamoeba invadens
AILRRFSRRILVDLPTKEDR

SEQ ID NO: 2926389 - protein, 19 aa, Entamoeba invadens
AILSLLYQLMYKFRLGNCS

SEQ ID NO: 2926390 - protein, 25 aa, Entamoeba invadens
AILSTRIGIQFGCALPDPEMWFTTA

SEQ ID NO: 2926391 - protein, 17 aa, Entamoeba invadens
AIMEMSKLLPKERGEEI

SEQ ID NO: 2926392 - protein, 17 aa, Entamoeba invadens
AINALKVNPFFTNEVSV

SEQ ID NO: 2926393 - protein, 23 aa, Entamoeba invadens
AINEEFDSWFLLLNSKGEMEKTI

SEQ ID NO: 2926394 - protein, 26 aa, Entamoeba invadens
AINGWNMDICVSIVKNIFGEDKTNFV

SEQ ID NO: 2926395 - protein, 24 aa, Entamoeba invadens
AINSFTGSVKSMWDIIKDTISEIR

SEQ ID NO: 2926396 - protein, 23 aa, Entamoeba invadens
AINTKGFNAHAFVRKLPYMAEWS

SEQ ID NO: 2926397 - protein, 21 aa, Entamoeba invadens
AINVCVNAFDVLYLDGVDLMR

SEQ ID NO: 2926398 - protein, 25 aa, Entamoeba invadens
AIPCSVKSITPRLPHHVYSIDEMKE

SEQ ID NO: 2926399 - protein, 17 aa, Entamoeba invadens
AIPEMFHYNPICLRSHF

SEQ ID NO: 2926400 - protein, 18 aa, Entamoeba invadens
AIPLKIIFIGESGVGKTA

SEQ ID NO: 2926401 - protein, 17 aa, Entamoeba invadens
AIPRIYGRWKSMGLVNN

SEQ ID NO: 2926402 - protein, 30 aa, Entamoeba invadens
AIPSAFVPVQCLPSFFSVENNVSNTFGRTT

SEQ ID NO: 2926403 - protein, 25 aa, Entamoeba invadens
AIPSETMLSFLFQFINSCTKELMNV

SEQ ID NO: 2926404 - protein, 23 aa, Entamoeba invadens
AIQSELIALFTIFHSDKDMKGRI

SEQ ID NO: 2926405 - protein, 25 aa, Entamoeba invadens
AIQSRCAKFRFGPLSPEALKKIMKH

SEQ ID NO: 2926406 - protein, 17 aa, Entamoeba invadens
AIRDCALAADGRDNVTC

SEQ ID NO: 2926407 - protein, 25 aa, Entamoeba invadens
AIRNLCILRDQIVPFTCVDDSLRKV

SEQ ID NO: 2926408 - protein, 22 aa, Entamoeba invadens
AIRRRFEKRIYIGLPEAPARSK

SEQ ID NO: 2926409 - protein, 19 aa, Entamoeba invadens
AISDLSLRFGEGSGKKKMM

SEQ ID NO: 2926410 - protein, 18 aa, Entamoeba invadens
AISDVLPWICDNQTKITS

SEQ ID NO: 2926411 - protein, 22 aa, Entamoeba invadens
AISHWIGTTILMFYDVDMRAKI

SEQ ID NO: 2926412 - protein, 35 aa, Entamoeba invadens
AISLRWPNLTKLIIRKCGVPSIPPFIFTKENFPHL

SEQ ID NO: 2926413 - protein, 24 aa, Entamoeba invadens
AISNAESFIFIGFFNGKVKRYNIK

SEQ ID NO: 2926414 - protein, 19 aa, Entamoeba invadens
AISSVVFEVVEFFIKSYQL

SEQ ID NO: 2926415 - protein, 22 aa, Entamoeba invadens
AITGSIAVRVGEGFKNRMYFVY

SEQ ID NO: 2926416 - protein, 21 aa, Entamoeba invadens
AITLRVANSYQRFSMNLKRSE

SEQ ID NO: 2926417 - protein, 21 aa, Entamoeba invadens
AITMVECFLWSNAYPKTIYMY

SEQ ID NO: 2926418 - protein, 22 aa, Entamoeba invadens
AITMYECFGWSYAFSKEKFKFP

SEQ ID NO: 2926419 - protein, 39 aa, Entamoeba invadens
AITMYEVFGWSNTYPIETFKFPWKIAEFVMSGKRLQRKE

SEQ ID NO: 2926420 - protein, 18 aa, Entamoeba invadens
AITNNDWQNYESNLNFVR

SEQ ID NO: 2926421 - protein, 19 aa, Entamoeba invadens
AITNRLCKGNVHQEDGREC

SEQ ID NO: 2926422 - protein, 21 aa, Entamoeba invadens
AITSMCFSNSVSKEREDDIVL

SEQ ID NO: 2926423 - protein, 23 aa, Entamoeba invadens
AITTACGMLDHIVVEKTEDAQKI

SEQ ID NO: 2926424 - protein, 21 aa, Entamoeba invadens
AIVKNCGGFTFIYQWLLLLFK

SEQ ID NO: 2926425 - protein, 24 aa, Entamoeba invadens
AIVPRRKPRRQFPHMKAGQVPSES

SEQ ID NO: 2926426 - protein, 17 aa, Entamoeba invadens
AIVRRLEGKIAVSEEDV

SEQ ID NO: 2926427 - protein, 18 aa, Entamoeba invadens
AIVTIEFLNTLCPSGLPP

SEQ ID NO: 2926428 - protein, 22 aa, Entamoeba invadens
AIWASCFFNCKALCDVTLPHKA

SEQ ID NO: 2926429 - protein, 22 aa, Entamoeba invadens
AIYFNGEWNEPFHILPNKMEFE

SEQ ID NO: 2926430 - protein, 24 aa, Entamoeba invadens
AIYKLLENIPMPWEDIKEVEVMYH

SEQ ID NO: 2926431 - protein, 17 aa, Entamoeba invadens
AIYLEYLGFFEGDKIKG

SEQ ID NO: 2926432 - protein, 22 aa, Entamoeba invadens
AIYLHAFKDGFIIVSVSNNTTD

SEQ ID NO: 2926433 - protein, 17 aa, Entamoeba invadens
AKAAAIVDELIQTEKSY

SEQ ID NO: 2926434 - protein, 18 aa, Entamoeba invadens
AKAAMIWIIGEYNKLITN

SEQ ID NO: 2926435 - protein, 19 aa, Entamoeba invadens
AKAAMIWIIGEYSDRITNV

SEQ ID NO: 2926436 - protein, 18 aa, Entamoeba invadens
AKAARFKKNASKYKEALA

SEQ ID NO: 2926437 - protein, 25 aa, Entamoeba invadens
AKADKLSGVITRRGQEVAEADEELE

SEQ ID NO: 2926438 - protein, 23 aa, Entamoeba invadens
AKAEIVIPLSTCFVSEALQGTVL

SEQ ID NO: 2926439 - protein, 20 aa, Entamoeba invadens
AKAFAQRKLIEQKRNEQIAI

SEQ ID NO: 2926440 - protein, 20 aa, Entamoeba invadens
AKAFAVPLISSMRYSVVENT

SEQ ID NO: 2926441 - protein, 22 aa, Entamoeba invadens
AKAKMQYQLVCPIMISSQPPEN

SEQ ID NO: 2926442 - protein, 20 aa, Entamoeba invadens
AKALPALGFNCSKRSIDTLL

SEQ ID NO: 2926443 - protein, 19 aa, Entamoeba invadens
AKANDEWKKAMKKVESTKK

SEQ ID NO: 2926444 - protein, 21 aa, Entamoeba invadens
AKAQKEFVKKFIFGRLKAMTE

SEQ ID NO: 2926445 - protein, 17 aa, Entamoeba invadens
AKCEILAQKCMSLMSIK

SEQ ID NO: 2926446 - protein, 20 aa, Entamoeba invadens
AKCFRGCKSIKEVVIQGNRF

SEQ ID NO: 2926447 - protein, 20 aa, Entamoeba invadens
AKCFYQCSSLGFVNLPNVGS

SEQ ID NO: 2926448 - protein, 20 aa, Entamoeba invadens
AKCKTCKKVFEEGDDKYEDA

SEQ ID NO: 2926449 - protein, 20 aa, Entamoeba invadens
AKCRLPKPIYKEFKKPKTIE

SEQ ID NO: 2926450 - protein, 21 aa, Entamoeba invadens
AKCYHVLKIAQVVLKVIQNVC

SEQ ID NO: 2926451 - protein, 18 aa, Entamoeba invadens
AKDKLLNKREFKYILDAI

SEQ ID NO: 2926452 - protein, 26 aa, Entamoeba invadens
AKDKYEWLKLELIEDATKLIQDCEVV

SEQ ID NO: 2926453 - protein, 19 aa, Entamoeba invadens
AKDTIKFSELILYIRDHNG

SEQ ID NO: 2926454 - protein, 19 aa, Entamoeba invadens
AKEAANRWTDAIFNVQSYA

SEQ ID NO: 2926455 - protein, 26 aa, Entamoeba invadens
AKEANELVCSLFLLAQVFLDKNIVNQ

SEQ ID NO: 2926456 - protein, 19 aa, Entamoeba invadens
AKEAVKIYFVLTENGVFDG

SEQ ID NO: 2926457 - protein, 22 aa, Entamoeba invadens
AKEFSVHTCIEMKRYGFDEQIR

SEQ ID NO: 2926458 - protein, 17 aa, Entamoeba invadens
AKEFVVSHFHEFPKVYL

SEQ ID NO: 2926459 - protein, 20 aa, Entamoeba invadens
AKEGDWWWGKCNGREGTFPK

SEQ ID NO: 2926460 - protein, 24 aa, Entamoeba invadens
AKEIKATCYMECSALTRSGLNQVF

SEQ ID NO: 2926461 - protein, 19 aa, Entamoeba invadens
AKEILKYVVQFLQYDPNRF

SEQ ID NO: 2926462 - protein, 24 aa, Entamoeba invadens
AKEIRPVVWYYFATEGITFDEVIT

SEQ ID NO: 2926463 - protein, 33 aa, Entamoeba invadens
AKEKEAKRLKAKTTKLKRRRNIADLEQQVQDFE

SEQ ID NO: 2926464 - protein, 18 aa, Entamoeba invadens
AKEMKFPHITVFGDTHLY

SEQ ID NO: 2926465 - protein, 25 aa, Entamoeba invadens
AKENSTWTVGDFGLNIGNTGKRGTL

SEQ ID NO: 2926466 - protein, 23 aa, Entamoeba invadens
AKENYDWLKLELIEDTDKLCKNC

SEQ ID NO: 2926467 - protein, 21 aa, Entamoeba invadens
AKEPKKAGPICILDAKNNQTF

SEQ ID NO: 2926468 - protein, 23 aa, Entamoeba invadens
AKEPNLRLKVKMMLDTSKGILYL

SEQ ID NO: 2926469 - protein, 26 aa, Entamoeba invadens
AKERALKIHLWVVDWDENGFVNNMNR

SEQ ID NO: 2926470 - protein, 17 aa, Entamoeba invadens
AKETWKTEMKKYEEKKD

SEQ ID NO: 2926471 - protein, 20 aa, Entamoeba invadens
AKEYIMRFYGGIQHVPAWMI

SEQ ID NO: 2926472 - protein, 18 aa, Entamoeba invadens
AKEYLRKYFTSIPNDEVV

SEQ ID NO: 2926473 - protein, 18 aa, Entamoeba invadens
AKFCELKEIVIWKSITEI

SEQ ID NO: 2926474 - protein, 18 aa, Entamoeba invadens
AKFDVLIYDIGGNSLTSK

SEQ ID NO: 2926475 - protein, 23 aa, Entamoeba invadens
AKFEECTKMNAILMNDTEKEVER

SEQ ID NO: 2926476 - protein, 18 aa, Entamoeba invadens
AKFFPGFIPLLKAFKARG

SEQ ID NO: 2926477 - protein, 19 aa, Entamoeba invadens
AKFGDARVGMVGFPSVGKS

SEQ ID NO: 2926478 - protein, 22 aa, Entamoeba invadens
AKFLKWDEDYTWNFPMALVTGI

SEQ ID NO: 2926479 - protein, 21 aa, Entamoeba invadens
AKFNIKIKSLEVFNNTTQFPM

SEQ ID NO: 2926480 - protein, 17 aa, Entamoeba invadens
AKFNKLCSQSKKVDKAL

SEQ ID NO: 2926481 - protein, 17 aa, Entamoeba invadens
AKGACLYARDMASQTVK

SEQ ID NO: 2926482 - protein, 22 aa, Entamoeba invadens
AKGEFIIRLPLSEIDGNFEDTG

SEQ ID NO: 2926483 - protein, 19 aa, Entamoeba invadens
AKGGLFLDKILYLRNDKMT

SEQ ID NO: 2926484 - protein, 17 aa, Entamoeba invadens
AKGILHVLLDLGFSKKL

SEQ ID NO: 2926485 - protein, 23 aa, Entamoeba invadens
AKGIPIKASLILNTSERLTASKS

SEQ ID NO: 2926486 - protein, 26 aa, Entamoeba invadens
AKGKLRFGKTRNFKVGDLVTIINSDE

SEQ ID NO: 2926487 - protein, 21 aa, Entamoeba invadens
AKGKTLILIICDGHVTETEPT

SEQ ID NO: 2926488 - protein, 18 aa, Entamoeba invadens
AKGNLIASIIQRNKGKKI

SEQ ID NO: 2926489 - protein, 21 aa, Entamoeba invadens
AKGPFSRMLVLDDRFLAILVH

SEQ ID NO: 2926490 - protein, 18 aa, Entamoeba invadens
AKGPRDLIEIGRVVERAL

SEQ ID NO: 2926491 - protein, 19 aa, Entamoeba invadens
AKGRISFKNTIKSESVTPR

SEQ ID NO: 2926492 - protein, 23 aa, Entamoeba invadens
AKGSAEFWVEYLLLCRNSGDYKR

SEQ ID NO: 2926493 - protein, 25 aa, Entamoeba invadens
AKGVFGDKEHFVFRVKDGKATKYMK

SEQ ID NO: 2926494 - protein, 19 aa, Entamoeba invadens
AKHKIVFTHHCPTKTLETP

SEQ ID NO: 2926495 - protein, 30 aa, Entamoeba invadens
AKHLEFARMLDVFVVLSLVNKKSKSKRYLK

SEQ ID NO: 2926496 - protein, 19 aa, Entamoeba invadens
AKHNIALILLEGSNNTLEV

SEQ ID NO: 2926497 - protein, 17 aa, Entamoeba invadens
AKHPEYIMHSAMKTWTF

SEQ ID NO: 2926498 - protein, 23 aa, Entamoeba invadens
AKHTFYCKMCLEISMNEPSCKKR

SEQ ID NO: 2926499 - protein, 19 aa, Entamoeba invadens
AKHTIKMILINEMKHHETG

SEQ ID NO: 2926500 - protein, 19 aa, Entamoeba invadens
AKHTIVLSSHFDTVPIGDK

SEQ ID NO: 2926501 - protein, 19 aa, Entamoeba invadens
AKHVGGFKGKLKVSEQTKK

SEQ ID NO: 2926502 - protein, 17 aa, Entamoeba invadens
AKHVPPITINTKSISDR

SEQ ID NO: 2926503 - protein, 19 aa, Entamoeba invadens
AKHYKRVVFTLSLHKTLEQ

SEQ ID NO: 2926504 - protein, 17 aa, Entamoeba invadens
AKIADLDVIGLISEPTA

SEQ ID NO: 2926505 - protein, 19 aa, Entamoeba invadens
AKIAMSHLKLVEFAGKVFP

SEQ ID NO: 2926506 - protein, 17 aa, Entamoeba invadens
AKIAQLYYHYYLRTSET

SEQ ID NO: 2926507 - protein, 18 aa, Entamoeba invadens
AKICLEKPVVLFDNNIKE

SEQ ID NO: 2926508 - protein, 22 aa, Entamoeba invadens
AKIDKFLLKSAFKGLTKSKKER

SEQ ID NO: 2926509 - protein, 19 aa, Entamoeba invadens
AKIDSHFFIDHGVGVVIGE

SEQ ID NO: 2926510 - protein, 24 aa, Entamoeba invadens
AKIEELKKEYGFIVEDIDSKTIGP

SEQ ID NO: 2926511 - protein, 17 aa, Entamoeba invadens
AKIETYSGLTYFGESAF

SEQ ID NO: 2926512 - protein, 18 aa, Entamoeba invadens
AKIIDGKVCMNVALVENG

SEQ ID NO: 2926513 - protein, 19 aa, Entamoeba invadens
AKIKFDIYDAYTIHREQID

SEQ ID NO: 2926514 - protein, 19 aa, Entamoeba invadens
AKIKSLFSKYNPISYDIPR

SEQ ID NO: 2926515 - protein, 19 aa, Entamoeba invadens
AKILELLGMLGHGDKANSS

SEQ ID NO: 2926516 - protein, 23 aa, Entamoeba invadens
AKILTHMILYIWLYYNNNVESEW

SEQ ID NO: 2926517 - protein, 25 aa, Entamoeba invadens
AKILWKMTHFDPRCQASVSIKVYLI

SEQ ID NO: 2926518 - protein, 22 aa, Entamoeba invadens
AKIMGYLLCCGADLRDVLKYFG

SEQ ID NO: 2926519 - protein, 19 aa, Entamoeba invadens
AKIPFKWTAPEALASKKFD

SEQ ID NO: 2926520 - protein, 20 aa, Entamoeba invadens
AKIPFNEKLFLTRSKVSDIL

SEQ ID NO: 2926521 - protein, 22 aa, Entamoeba invadens
AKIPTICSLGIQWEIVPMDDTS

SEQ ID NO: 2926522 - protein, 20 aa, Entamoeba invadens
AKIQAELELTKTVEELNAKY

SEQ ID NO: 2926523 - protein, 21 aa, Entamoeba invadens
AKISLYGRFCIERNLAKDAIE

SEQ ID NO: 2926524 - protein, 26 aa, Entamoeba invadens
AKITRGYCLPSKYVIHTVGPIVEEQL

SEQ ID NO: 2926525 - protein, 17 aa, Entamoeba invadens
AKIVLNALVKRKLIVGP

SEQ ID NO: 2926526 - protein, 25 aa, Entamoeba invadens
AKKEVYRLGSISQHVVMVPDLEQCL

SEQ ID NO: 2926527 - protein, 22 aa, Entamoeba invadens
AKKFESGVIKARIEGNRVVLNI

SEQ ID NO: 2926528 - protein, 17 aa, Entamoeba invadens
AKKIVEWAKAISEETNA

SEQ ID NO: 2926529 - protein, 35 aa, Entamoeba invadens
AKKKAERLVDCDMSFLSQMRRIGCDVHNVVGTLKT

SEQ ID NO: 2926530 - protein, 18 aa, Entamoeba invadens
AKKKFRMISIDGGGSKCI

SEQ ID NO: 2926531 - protein, 22 aa, Entamoeba invadens
AKKKIMFEGGMMKNGVVTKSEM

SEQ ID NO: 2926532 - protein, 17 aa, Entamoeba invadens
AKKKMVLDHLVIQTMEK

SEQ ID NO: 2926533 - protein, 18 aa, Entamoeba invadens
AKKMIPYQTGFCCHYDRF

SEQ ID NO: 2926534 - protein, 24 aa, Entamoeba invadens
AKKNIKFYVIDAIKIGQEVKLGRR

SEQ ID NO: 2926535 - protein, 23 aa, Entamoeba invadens
AKKNTNGIWSWMGYSAEVNSQLS

SEQ ID NO: 2926536 - protein, 22 aa, Entamoeba invadens
AKKPSRRLSMRLKKKTQEEQKS

SEQ ID NO: 2926537 - protein, 25 aa, Entamoeba invadens
AKKQDKRVILFKRIHVEDITLSDAL

SEQ ID NO: 2926538 - protein, 24 aa, Entamoeba invadens
AKKREVSTLLDFSGPVVRVVLQDK

SEQ ID NO: 2926539 - protein, 22 aa, Entamoeba invadens
AKKRVKRLYAGIFGNQTEDNPI

SEQ ID NO: 2926540 - protein, 29 aa, Entamoeba invadens
AKKSLFKIKWFLPHLFSRNRSKTEMKKAK

SEQ ID NO: 2926541 - protein, 19 aa, Entamoeba invadens
AKKTLLFSMMHPTHEILNF

SEQ ID NO: 2926542 - protein, 25 aa, Entamoeba invadens
AKKVTLCGLKSFSFNNNLFDNCEEL

SEQ ID NO: 2926543 - protein, 20 aa, Entamoeba invadens
AKKYGMGMVVVRNSTHFGIA

SEQ ID NO: 2926544 - protein, 20 aa, Entamoeba invadens
AKKYIECSALTQFNLKELFM

SEQ ID NO: 2926545 - protein, 20 aa, Entamoeba invadens
AKKYKSQIIIDWTDTTEPEK

SEQ ID NO: 2926546 - protein, 19 aa, Entamoeba invadens
AKKYLVAPNEITWVTKVET

SEQ ID NO: 2926547 - protein, 27 aa, Entamoeba invadens
AKLALRSYCIKMCWVVSRYDTYQNNYY

SEQ ID NO: 2926548 - protein, 17 aa, Entamoeba invadens
AKLCCALNVFPENTTLK

SEQ ID NO: 2926549 - protein, 17 aa, Entamoeba invadens
AKLCPSTLQYWVRQCDH

SEQ ID NO: 2926550 - protein, 21 aa, Entamoeba invadens
AKLDLPFEVMSGGVSDKKINK

SEQ ID NO: 2926551 - protein, 23 aa, Entamoeba invadens
AKLEKFMFGVCAYSDDSANARLN

SEQ ID NO: 2926552 - protein, 25 aa, Entamoeba invadens
AKLICKIGLKYAPKYIHLLVLLIRS

SEQ ID NO: 2926553 - protein, 27 aa, Entamoeba invadens
AKLIDSRLFVLISCEKYAEILMKTTSV

SEQ ID NO: 2926554 - protein, 19 aa, Entamoeba invadens
AKLKAKYETEFEGIETEKK

SEQ ID NO: 2926555 - protein, 18 aa, Entamoeba invadens
AKLKAKYETELEGIETEK

SEQ ID NO: 2926556 - protein, 20 aa, Entamoeba invadens
AKLKEGKSFSRHSPPPLRDY

SEQ ID NO: 2926557 - protein, 20 aa, Entamoeba invadens
AKLKKFVLEVGCMEDANTMF

SEQ ID NO: 2926558 - protein, 18 aa, Entamoeba invadens
AKLKTTEIGGKQVGVVFL

SEQ ID NO: 2926559 - protein, 20 aa, Entamoeba invadens
AKLKTVKAILGEATLTGFAN

SEQ ID NO: 2926560 - protein, 19 aa, Entamoeba invadens
AKLKVLLIGVIAQLKKEVG

SEQ ID NO: 2926561 - protein, 20 aa, Entamoeba invadens
AKLLKRVVNQMVNKLPQSFK

SEQ ID NO: 2926562 - protein, 21 aa, Entamoeba invadens
AKLLKSVAFVNCIDFELESED

SEQ ID NO: 2926563 - protein, 17 aa, Entamoeba invadens
AKLMFSQLMREMTQHLF

SEQ ID NO: 2926564 - protein, 19 aa, Entamoeba invadens
AKLNWDVRSVLLIFGELNF

SEQ ID NO: 2926565 - protein, 25 aa, Entamoeba invadens
AKLQCEQKTVFPFISRNWCDNLFED

SEQ ID NO: 2926566 - protein, 26 aa, Entamoeba invadens
AKLRKRIELIKKRRAALLKRKEHERM

SEQ ID NO: 2926567 - protein, 18 aa, Entamoeba invadens
AKLSAFKYELENLMKEKE

SEQ ID NO: 2926568 - protein, 18 aa, Entamoeba invadens
AKLSQQGQQVFLRKVELN

SEQ ID NO: 2926569 - protein, 18 aa, Entamoeba invadens
AKLTHALSLAGRIVQDPK

SEQ ID NO: 2926570 - protein, 17 aa, Entamoeba invadens
AKLTKRIEDGLNDSDML

SEQ ID NO: 2926571 - protein, 18 aa, Entamoeba invadens
AKLVRIQYLIARNTYDET

SEQ ID NO: 2926572 - protein, 20 aa, Entamoeba invadens
AKLYCEGKGTVYVLATQYAD

SEQ ID NO: 2926573 - protein, 23 aa, Entamoeba invadens
AKLYRCFWPPSILALEKVDVFDC

SEQ ID NO: 2926574 - protein, 18 aa, Entamoeba invadens
AKMGSLAYTPLFLSILKL

SEQ ID NO: 2926575 - protein, 18 aa, Entamoeba invadens
AKMGYPVIMKILSPDIMH

SEQ ID NO: 2926576 - protein, 17 aa, Entamoeba invadens
AKMKMALYYKKELNSCD

SEQ ID NO: 2926577 - protein, 22 aa, Entamoeba invadens
AKMLKMCKADWYYPNYSREESQ

SEQ ID NO: 2926578 - protein, 20 aa, Entamoeba invadens
AKMMFGERFHRVDPVLPGQI

SEQ ID NO: 2926579 - protein, 23 aa, Entamoeba invadens
AKMMPFPTFEGSKKFAKQLLEGM

SEQ ID NO: 2926580 - protein, 18 aa, Entamoeba invadens
AKMMTSFEQILCFFNTKM

SEQ ID NO: 2926581 - protein, 23 aa, Entamoeba invadens
AKMPELIETMILYINPDEEETLI

SEQ ID NO: 2926582 - protein, 20 aa, Entamoeba invadens
AKMRKGRALIPQFDYEVYTP

SEQ ID NO: 2926583 - protein, 19 aa, Entamoeba invadens
AKMVLKEVLCLELIGKSNK

SEQ ID NO: 2926584 - protein, 28 aa, Entamoeba invadens
AKMVRVSGKMYMKWRVIDKSPDALNSGD

SEQ ID NO: 2926585 - protein, 22 aa, Entamoeba invadens
AKNEAVNFFHLIGRIIHTEPIK

SEQ ID NO: 2926586 - protein, 20 aa, Entamoeba invadens
AKNFYKFYIGYFKDEQDAVK

SEQ ID NO: 2926587 - protein, 31 aa, Entamoeba invadens
AKNGFYTLLFLRFLFIPFLQYPPVLKFFQSA

SEQ ID NO: 2926588 - protein, 22 aa, Entamoeba invadens
AKNHIKGAVFKLVQRSETRWLQ

SEQ ID NO: 2926589 - protein, 20 aa, Entamoeba invadens
AKNHIKGAVLKLVQQSETRW

SEQ ID NO: 2926590 - protein, 20 aa, Entamoeba invadens
AKNKPCVVVRGLGRGATSTL

SEQ ID NO: 2926591 - protein, 25 aa, Entamoeba invadens
AKNLKRVCLENCTDVDIISKYGITE

SEQ ID NO: 2926592 - protein, 24 aa, Entamoeba invadens
AKNLKTSNLREGYQQLVDGCRLCG

SEQ ID NO: 2926593 - protein, 19 aa, Entamoeba invadens
AKNLLDVNILYLVFDLSSK

SEQ ID NO: 2926594 - protein, 20 aa, Entamoeba invadens
AKNLLKYGIVNKILKLLSLS

SEQ ID NO: 2926595 - protein, 24 aa, Entamoeba invadens
AKNPSEKFSVVFSGEQIEWDGTDT

SEQ ID NO: 2926596 - protein, 18 aa, Entamoeba invadens
AKNRLEVDVDYYIEKHIN

SEQ ID NO: 2926597 - protein, 20 aa, Entamoeba invadens
AKNSLKDALIAKINLVEFLD

SEQ ID NO: 2926598 - protein, 18 aa, Entamoeba invadens
AKNWRPIKYLVINEPKLT

SEQ ID NO: 2926599 - protein, 19 aa, Entamoeba invadens
AKNYEPIMSVFGLTNPFME

SEQ ID NO: 2926600 - protein, 21 aa, Entamoeba invadens
AKNYQEWRFVLCESEIHLFGV

SEQ ID NO: 2926601 - protein, 25 aa, Entamoeba invadens
AKNYTEICVAEFPVPDFLQDEKTIQ

SEQ ID NO: 2926602 - protein, 25 aa, Entamoeba invadens
AKPATRLRCAGFTKEERESASQLLE

SEQ ID NO: 2926603 - protein, 23 aa, Entamoeba invadens
AKPLPGAFRILKYLKSHNIPIAL

SEQ ID NO: 2926604 - protein, 19 aa, Entamoeba invadens
AKPRVLHMTEAFVDLDSWT

SEQ ID NO: 2926605 - protein, 28 aa, Entamoeba invadens
AKPSTFFCKSLDVLDPFEPVVFDEKGLI

SEQ ID NO: 2926606 - protein, 20 aa, Entamoeba invadens
AKPTCKGCSSGYYQIGSTCS

SEQ ID NO: 2926607 - protein, 17 aa, Entamoeba invadens
AKQITVFTSELFRKIKL

SEQ ID NO: 2926608 - protein, 19 aa, Entamoeba invadens
AKQLMYLAFDRKTILPSDC

SEQ ID NO: 2926609 - protein, 18 aa, Entamoeba invadens
AKRFGNKCFYDCEDLEEV

SEQ ID NO: 2926610 - protein, 17 aa, Entamoeba invadens
AKRIKVLMCTWNVNQCV

SEQ ID NO: 2926611 - protein, 20 aa, Entamoeba invadens
AKRLRDLAVEVVTKHKGVFP

SEQ ID NO: 2926612 - protein, 26 aa, Entamoeba invadens
AKRRQIAFARARRIRMKRNQKRLLKA

SEQ ID NO: 2926613 - protein, 18 aa, Entamoeba invadens
AKRSFPIGEGNRWYDIPL

SEQ ID NO: 2926614 - protein, 22 aa, Entamoeba invadens
AKSELKNAVSYIESKKQDCIEL

SEQ ID NO: 2926615 - protein, 25 aa, Entamoeba invadens
AKSEVRLFAWEVCLGTDYSNLYFPS

SEQ ID NO: 2926616 - protein, 21 aa, Entamoeba invadens
AKSFQCLNCSEGRSTQYIVCQ

SEQ ID NO: 2926617 - protein, 26 aa, Entamoeba invadens
AKSIGAYRYIECSALSQVNLENVFNE

SEQ ID NO: 2926618 - protein, 18 aa, Entamoeba invadens
AKSIKKVILVGGSSQIPK

SEQ ID NO: 2926619 - protein, 17 aa, Entamoeba invadens
AKSKKSCIIFFDEIDAV

SEQ ID NO: 2926620 - protein, 24 aa, Entamoeba invadens
AKSKLKGYHYVVGMIDSVYDVPEC

SEQ ID NO: 2926621 - protein, 19 aa, Entamoeba invadens
AKSLINWFKVRGIGNLIKE

SEQ ID NO: 2926622 - protein, 24 aa, Entamoeba invadens
AKSNSSCICSLCFSEGNHVGHDYY

SEQ ID NO: 2926623 - protein, 17 aa, Entamoeba invadens
AKSPLVLKNATEMEKKG

SEQ ID NO: 2926624 - protein, 21 aa, Entamoeba invadens
AKSPTTCLVERSFNKIGQLER

SEQ ID NO: 2926625 - protein, 21 aa, Entamoeba invadens
AKSQLLRYVMNIAPLSVSTNG

SEQ ID NO: 2926626 - protein, 22 aa, Entamoeba invadens
AKSQRLGQVIQRGFVAREKMHN

SEQ ID NO: 2926627 - protein, 22 aa, Entamoeba invadens
AKSRESMKLMMLCRRATENNLK

SEQ ID NO: 2926628 - protein, 24 aa, Entamoeba invadens
AKSRKTPPVCFMVPHTPSPENGAN

SEQ ID NO: 2926629 - protein, 20 aa, Entamoeba invadens
AKSRYTLSSNRINIFLEKVT

SEQ ID NO: 2926630 - protein, 29 aa, Entamoeba invadens
AKSSDYIKEFLFKIGLVVTDGYGTSETGS

SEQ ID NO: 2926631 - protein, 17 aa, Entamoeba invadens
AKTAGLCLSIFSRLLTN

SEQ ID NO: 2926632 - protein, 18 aa, Entamoeba invadens
AKTATLYGLKSAQIQTLF

SEQ ID NO: 2926633 - protein, 34 aa, Entamoeba invadens
AKTEDKCTICGESFVDGLDCYKCSKCEKHVHGSC

SEQ ID NO: 2926634 - protein, 26 aa, Entamoeba invadens
AKTFPVPQWLPLLFAIELSKPELFDI

SEQ ID NO: 2926635 - protein, 18 aa, Entamoeba invadens
AKTGEGIENVFTEIVNSI

SEQ ID NO: 2926636 - protein, 20 aa, Entamoeba invadens
AKTGELVKFDSALNLEGEEL

SEQ ID NO: 2926637 - protein, 21 aa, Entamoeba invadens
AKTIDKWAFRNYTFESLIIPN

SEQ ID NO: 2926638 - protein, 21 aa, Entamoeba invadens
AKTIFPFVDVIEKFIAKPSEE

SEQ ID NO: 2926639 - protein, 24 aa, Entamoeba invadens
AKTKALCIQLQIVETLPMEDLLET

SEQ ID NO: 2926640 - protein, 17 aa, Entamoeba invadens
AKTLHISGYEIVENVFD

SEQ ID NO: 2926641 - protein, 17 aa, Entamoeba invadens
AKTPVFSQFAPSVQSQD

SEQ ID NO: 2926642 - protein, 17 aa, Entamoeba invadens
AKTQCLFKTVIKTPTLV

SEQ ID NO: 2926643 - protein, 20 aa, Entamoeba invadens
AKTTIKLSDLILYIRDHNGF

SEQ ID NO: 2926644 - protein, 34 aa, Entamoeba invadens
AKTTNWFEAGVDFNSIDWSKCGPKIEIDPAQAGL

SEQ ID NO: 2926645 - protein, 21 aa, Entamoeba invadens
AKTYIRIALPFFNKTVSVNMS

SEQ ID NO: 2926646 - protein, 21 aa, Entamoeba invadens
AKVFALFDVFFFKIPTQFWFE

SEQ ID NO: 2926647 - protein, 19 aa, Entamoeba invadens
AKVGNKWYNFNDSITSEEK

SEQ ID NO: 2926648 - protein, 22 aa, Entamoeba invadens
AKVKAKIPWLQAEGENVVEFWK

SEQ ID NO: 2926649 - protein, 17 aa, Entamoeba invadens
AKVKCLHNSIPINRKVY

SEQ ID NO: 2926650 - protein, 20 aa, Entamoeba invadens
AKVKVLLSLLDNWRKEKHKA

SEQ ID NO: 2926651 - protein, 24 aa, Entamoeba invadens
AKVLGCCDYVKPHFACVDPVHSFT

SEQ ID NO: 2926652 - protein, 19 aa, Entamoeba invadens
AKVLGVYEICPKICGLQRN

SEQ ID NO: 2926653 - protein, 19 aa, Entamoeba invadens
AKVLKVFPDKAKWEKDRKR

SEQ ID NO: 2926654 - protein, 24 aa, Entamoeba invadens
AKVMFKSNLLFVFVNTTNEIFGCY

SEQ ID NO: 2926655 - protein, 35 aa, Entamoeba invadens
AKVMSVLRFEVAKARCAICEMVPSNYEILRTELID

SEQ ID NO: 2926656 - protein, 41 aa, Entamoeba invadens
AKVQAINLEEFISVLKGGVDLFSDVEMELLGKKMLETKTDE

SEQ ID NO: 2926657 - protein, 22 aa, Entamoeba invadens
AKVRSGQLWSYYIDQIIEKFGD

SEQ ID NO: 2926658 - protein, 17 aa, Entamoeba invadens
AKVVESLILRVFGKNTF

SEQ ID NO: 2926659 - protein, 26 aa, Entamoeba invadens
AKVVLKKCKNCFVLSKQRENVEQTEC

SEQ ID NO: 2926660 - protein, 21 aa, Entamoeba invadens
AKVVLLKKEMNDFIGDNSDVK

SEQ ID NO: 2926661 - protein, 18 aa, Entamoeba invadens
AKWLLDKLLLLGIPLNKL

SEQ ID NO: 2926662 - protein, 22 aa, Entamoeba invadens
AKWVCPIEDSMFVLAKGKSVLR

SEQ ID NO: 2926663 - protein, 19 aa, Entamoeba invadens
AKYAMWMGAGMLDKQNAGT

SEQ ID NO: 2926664 - protein, 25 aa, Entamoeba invadens
AKYDSVWMRGYWLIFSQDQAVKGKI

SEQ ID NO: 2926665 - protein, 25 aa, Entamoeba invadens
AKYDSVWMRGYWLIFSQDQAVKGNI

SEQ ID NO: 2926666 - protein, 24 aa, Entamoeba invadens
AKYEEIAKLNADEMKEHKEKIITL

SEQ ID NO: 2926667 - protein, 25 aa, Entamoeba invadens
AKYFEAISGLPLIKICLNNNPIQDV

SEQ ID NO: 2926668 - protein, 27 aa, Entamoeba invadens
AKYGVNRCIKKSGKIMQMTLKFQGKQL

SEQ ID NO: 2926669 - protein, 26 aa, Entamoeba invadens
AKYILKLTLAILEWIPSVQNVHFGRS

SEQ ID NO: 2926670 - protein, 20 aa, Entamoeba invadens
AKYIYQVLIGLEYIHSQGIV

SEQ ID NO: 2926671 - protein, 20 aa, Entamoeba invadens
AKYKAMICTNDFLKLLDRVS

SEQ ID NO: 2926672 - protein, 23 aa, Entamoeba invadens
AKYKEAIKSMSEEIVKYRATTSA

SEQ ID NO: 2926673 - protein, 19 aa, Entamoeba invadens
AKYNLEMFLYRDSLMKGDH

SEQ ID NO: 2926674 - protein, 22 aa, Entamoeba invadens
AKYNPVLKRILNIMSNMPGGIP

SEQ ID NO: 2926675 - protein, 27 aa, Entamoeba invadens
AKYSALIFVGPVWCWDLCAPLKNACKE

SEQ ID NO: 2926676 - protein, 22 aa, Entamoeba invadens
AKYSDCYDFAKTLFEFPEECVY

SEQ ID NO: 2926677 - protein, 20 aa, Entamoeba invadens
AKYTDDGFRIYSLEELGLDK

SEQ ID NO: 2926678 - protein, 17 aa, Entamoeba invadens
AKYTLQFEGIHFDYSKN

SEQ ID NO: 2926679 - protein, 24 aa, Entamoeba invadens
AKYVYQILDGLSFIHEQGIVHRDI

SEQ ID NO: 2926680 - protein, 19 aa, Entamoeba invadens
ALAASGLRSIRYAKELPQE

SEQ ID NO: 2926681 - protein, 24 aa, Entamoeba invadens
ALADIAVDLKGFFVPYVPKCFQIV

SEQ ID NO: 2926682 - protein, 18 aa, Entamoeba invadens
ALAGECYERAYLTVARSQ

SEQ ID NO: 2926683 - protein, 19 aa, Entamoeba invadens
ALAGECYERAYSTVARAHM

SEQ ID NO: 2926684 - protein, 19 aa, Entamoeba invadens
ALANECKANFIAVKGPQLL

SEQ ID NO: 2926685 - protein, 21 aa, Entamoeba invadens
ALANHLDWYTTLYATDTPAID

SEQ ID NO: 2926686 - protein, 18 aa, Entamoeba invadens
ALANHYFKLHVYTQIPNL

SEQ ID NO: 2926687 - protein, 26 aa, Entamoeba invadens
ALANKICVIGGCSLEGIECRVEKELK

SEQ ID NO: 2926688 - protein, 25 aa, Entamoeba invadens
ALAQDCKAAEKLAKEPNEKKIKDLR

SEQ ID NO: 2926689 - protein, 18 aa, Entamoeba invadens
ALATVAIKTLNALVCSIK

SEQ ID NO: 2926690 - protein, 18 aa, Entamoeba invadens
ALCMCERLVSHPKFMYAK

SEQ ID NO: 2926691 - protein, 27 aa, Entamoeba invadens
ALCNSRQLFNASFPFQCLRENSCEPTN

SEQ ID NO: 2926692 - protein, 20 aa, Entamoeba invadens
ALCSVDCSLLLYINQLTNSQ

SEQ ID NO: 2926693 - protein, 25 aa, Entamoeba invadens
ALDAFPVYRLQKLFLQLDENDIENL

SEQ ID NO: 2926694 - protein, 17 aa, Entamoeba invadens
ALDALFKKRIMSQYEGI

SEQ ID NO: 2926695 - protein, 19 aa, Entamoeba invadens
ALDALKGFYPELLYDETLK

SEQ ID NO: 2926696 - protein, 23 aa, Entamoeba invadens
ALDDVCWLFNVRGSDVPYIPVAY

SEQ ID NO: 2926697 - protein, 24 aa, Entamoeba invadens
ALDEFKHTIFGILFASNYKLATKI

SEQ ID NO: 2926698 - protein, 25 aa, Entamoeba invadens
ALDFIPKMQFCLLSKTVPSFLVCQR

SEQ ID NO: 2926699 - protein, 26 aa, Entamoeba invadens
ALDFLNCKPELFQLELFTNLQHLRNI

SEQ ID NO: 2926700 - protein, 25 aa, Entamoeba invadens
ALDFVPKMRFCLENAESMGFKPCAD

SEQ ID NO: 2926701 - protein, 26 aa, Entamoeba invadens
ALDITRTGIQFGAFKKFILTGKKRGL

SEQ ID NO: 2926702 - protein, 25 aa, Entamoeba invadens
ALDMYKPVVWEFNRLNITYTVMSKR

SEQ ID NO: 2926703 - protein, 18 aa, Entamoeba invadens
ALDYELINIFSRRLLEHI

SEQ ID NO: 2926704 - protein, 17 aa, Entamoeba invadens
ALEAKGLVTKEDGYKQF

SEQ ID NO: 2926705 - protein, 21 aa, Entamoeba invadens
ALEEKLNIIGLLRDTEVKIGE

SEQ ID NO: 2926706 - protein, 19 aa, Entamoeba invadens
ALEEVGVFIQVFAALEENI

SEQ ID NO: 2926707 - protein, 28 aa, Entamoeba invadens
ALEFWCERENRLGKYVTMLQNEYISQSS

SEQ ID NO: 2926708 - protein, 22 aa, Entamoeba invadens
ALEIIKIVFELHRNYPNVSEIN

SEQ ID NO: 2926709 - protein, 25 aa, Entamoeba invadens
ALEIKELRKAFGGLCETIPIEIETL

SEQ ID NO: 2926710 - protein, 21 aa, Entamoeba invadens
ALEINKVWTFLDKSHDFPMKN

SEQ ID NO: 2926711 - protein, 63 aa, Entamoeba invadens
ALEKLELLGRWNARGALICVTEYGAIFRKGGVGLVVKWTCEMKEAVMYRVNVGKEFEDFRFVN

SEQ ID NO: 2926712 - protein, 18 aa, Entamoeba invadens
ALEKVGVCNCSNIIISLN

SEQ ID NO: 2926713 - protein, 21 aa, Entamoeba invadens
ALELEIRRGDLLLGPHTLQMQ

SEQ ID NO: 2926714 - protein, 17 aa, Entamoeba invadens
ALELFIHQHLPKFYESH

SEQ ID NO: 2926715 - protein, 28 aa, Entamoeba invadens
ALELLPFYPKLYESIFMRIIREDADENC

SEQ ID NO: 2926716 - protein, 25 aa, Entamoeba invadens
ALELSRYRHLRGLREYIIGVIQDAD

SEQ ID NO: 2926717 - protein, 17 aa, Entamoeba invadens
ALEMFQNKYHCISDPEV

SEQ ID NO: 2926718 - protein, 18 aa, Entamoeba invadens
ALEMGAVERLIVWENLKS

SEQ ID NO: 2926719 - protein, 24 aa, Entamoeba invadens
ALEMLKYKVECRFVNDVLQGNKTS

SEQ ID NO: 2926720 - protein, 25 aa, Entamoeba invadens
ALENFPRSGLLQFFLFPNRTLGLFN

SEQ ID NO: 2926721 - protein, 23 aa, Entamoeba invadens
ALENLKVNFLFESIAKGVVKSTI

SEQ ID NO: 2926722 - protein, 18 aa, Entamoeba invadens
ALENVMLTYIEKINKENS

SEQ ID NO: 2926723 - protein, 17 aa, Entamoeba invadens
ALERLFHSFKFILDQLE

SEQ ID NO: 2926724 - protein, 17 aa, Entamoeba invadens
ALERRYNTEIFNDQTEE

SEQ ID NO: 2926725 - protein, 18 aa, Entamoeba invadens
ALERYKAVVPTITLSGPT

SEQ ID NO: 2926726 - protein, 17 aa, Entamoeba invadens
ALESLKLPDCFVGDIDE

SEQ ID NO: 2926727 - protein, 17 aa, Entamoeba invadens
ALFAACRKLFDTVINSF

SEQ ID NO: 2926728 - protein, 19 aa, Entamoeba invadens
ALFACKILNQLPVEVINSR

SEQ ID NO: 2926729 - protein, 17 aa, Entamoeba invadens
ALFDLPKLSTFECDNCV

SEQ ID NO: 2926730 - protein, 18 aa, Entamoeba invadens
ALFESGPYKEYLKEHPEV

SEQ ID NO: 2926731 - protein, 24 aa, Entamoeba invadens
ALFILDEYLQWGFTEKLATNTVRS

SEQ ID NO: 2926732 - protein, 17 aa, Entamoeba invadens
ALFKNVRYKNGTKNIDF

SEQ ID NO: 2926733 - protein, 17 aa, Entamoeba invadens
ALFLKKHYLDLTIRDLP

SEQ ID NO: 2926734 - protein, 18 aa, Entamoeba invadens
ALFRKYISQYSCDGIQIF

SEQ ID NO: 2926735 - protein, 18 aa, Entamoeba invadens
ALFSLPFLNCVSLSERSG

SEQ ID NO: 2926736 - protein, 24 aa, Entamoeba invadens
ALFTECRIVKSVGNTVVFTVKLFE

SEQ ID NO: 2926737 - protein, 18 aa, Entamoeba invadens
ALFTFNHQYVYDIEDKLI

SEQ ID NO: 2926738 - protein, 17 aa, Entamoeba invadens
ALFTLPNLEVLFKVLSF

SEQ ID NO: 2926739 - protein, 26 aa, Entamoeba invadens
ALFVDVFPCDFIVFSVYFSDGGETNK

SEQ ID NO: 2926740 - protein, 18 aa, Entamoeba invadens
ALFVLKMYLEDHGISSEI

SEQ ID NO: 2926741 - protein, 21 aa, Entamoeba invadens
ALGCMMYEFVVGYPPFNASTP

SEQ ID NO: 2926742 - protein, 22 aa, Entamoeba invadens
ALGEFSLIRFSKIKTQQPEVKV

SEQ ID NO: 2926743 - protein, 19 aa, Entamoeba invadens
ALGKNCFYQCISMKSIELP

SEQ ID NO: 2926744 - protein, 17 aa, Entamoeba invadens
ALGNAFSLIRLKRIGVH

SEQ ID NO: 2926745 - protein, 18 aa, Entamoeba invadens
ALGNGASFVDIEFGTTRM

SEQ ID NO: 2926746 - protein, 18 aa, Entamoeba invadens
ALGRFFCTHGGISPYVTR

SEQ ID NO: 2926747 - protein, 20 aa, Entamoeba invadens
ALGTELKQLLLLVLSASKAS

SEQ ID NO: 2926748 - protein, 18 aa, Entamoeba invadens
ALGYFLHKAPWPLSNRDF

SEQ ID NO: 2926749 - protein, 27 aa, Entamoeba invadens
ALHDTLTLTFRWNIPIYTSKKTGTLFI

SEQ ID NO: 2926750 - protein, 31 aa, Entamoeba invadens
ALHFLGDILLELGFQFSVKWSPGKHNTEKAE

SEQ ID NO: 2926751 - protein, 18 aa, Entamoeba invadens
ALHLKNFIHRDIKSPNVL

SEQ ID NO: 2926752 - protein, 19 aa, Entamoeba invadens
ALHNCCFCCCNKLTGITIP

SEQ ID NO: 2926753 - protein, 17 aa, Entamoeba invadens
ALHYACMSNLTDVLKEM

SEQ ID NO: 2926754 - protein, 20 aa, Entamoeba invadens
ALIEDITCFGALQCYEELVL

SEQ ID NO: 2926755 - protein, 17 aa, Entamoeba invadens
ALIEFLVKVAARSENNK

SEQ ID NO: 2926756 - protein, 25 aa, Entamoeba invadens
ALIEKRTSGQFVMNSMTSVLLRLLE

SEQ ID NO: 2926757 - protein, 17 aa, Entamoeba invadens
ALILRFVIPSRKMTKKD

SEQ ID NO: 2926758 - protein, 34 aa, Entamoeba invadens
ALILYRYTYIDLFAKLKMMFVAKLEGDMKSQDIL

SEQ ID NO: 2926759 - protein, 22 aa, Entamoeba invadens
ALINMKYDLCIQKPTKCATSSL

SEQ ID NO: 2926760 - protein, 27 aa, Entamoeba invadens
ALIPNIPEWIPGHILLTGHTDGTIDVW

SEQ ID NO: 2926761 - protein, 24 aa, Entamoeba invadens
ALKCFRSAVTLNPKSVTGWCYIAK

SEQ ID NO: 2926762 - protein, 25 aa, Entamoeba invadens
ALKDKRFYRTSLFMNLQKKRYESAI

SEQ ID NO: 2926763 - protein, 19 aa, Entamoeba invadens
ALKEALKYINANTVEDIMK

SEQ ID NO: 2926764 - protein, 17 aa, Entamoeba invadens
ALKEQNTRLDAAKKDMK

SEQ ID NO: 2926765 - protein, 17 aa, Entamoeba invadens
ALKICYPDNIKMLRGNH

SEQ ID NO: 2926766 - protein, 19 aa, Entamoeba invadens
ALKKEFLKNYELMNEFVVC

SEQ ID NO: 2926767 - protein, 18 aa, Entamoeba invadens
ALKKFWRKMRQWKTYGRM

SEQ ID NO: 2926768 - protein, 17 aa, Entamoeba invadens
ALKKGRYGEHINKMASV

SEQ ID NO: 2926769 - protein, 18 aa, Entamoeba invadens
ALKLRLSEKEELFKKLET

SEQ ID NO: 2926770 - protein, 20 aa, Entamoeba invadens
ALKMKLEAAKSIKELKNIVK

SEQ ID NO: 2926771 - protein, 26 aa, Entamoeba invadens
ALKMPSLLCCLSQLVAVVSSNCDNMY

SEQ ID NO: 2926772 - protein, 23 aa, Entamoeba invadens
ALKPYVLCKECKQLYNENENQHI

SEQ ID NO: 2926773 - protein, 17 aa, Entamoeba invadens
ALKRVPNKKALKETATE

SEQ ID NO: 2926774 - protein, 29 aa, Entamoeba invadens
ALKVIPLELKALFCGLPLCCVTSDSVHVF

SEQ ID NO: 2926775 - protein, 25 aa, Entamoeba invadens
ALLAALRLGYTEFIEGMKMKEQQDE

SEQ ID NO: 2926776 - protein, 24 aa, Entamoeba invadens
ALLAMLDPFSWQGLFIPIVPPQLS

SEQ ID NO: 2926777 - protein, 27 aa, Entamoeba invadens
ALLARHCTITIGRPHRLSHLTKQFIKI

SEQ ID NO: 2926778 - protein, 28 aa, Entamoeba invadens
ALLEGRSRFARLGLFVHITASFMNPGIN

SEQ ID NO: 2926779 - protein, 17 aa, Entamoeba invadens
ALLFVIYYLWMNDLKQF

SEQ ID NO: 2926780 - protein, 18 aa, Entamoeba invadens
ALLIFSGVVSPQFMTKTT

SEQ ID NO: 2926781 - protein, 17 aa, Entamoeba invadens
ALLLGGTPSALSKPKVI

SEQ ID NO: 2926782 - protein, 33 aa, Entamoeba invadens
ALLMKTPDPSKCLMAGPGLKTGEVLVPQVFTVT

SEQ ID NO: 2926783 - protein, 24 aa, Entamoeba invadens
ALLPGDGPIAIVFVPIRELAEQIN

SEQ ID NO: 2926784 - protein, 24 aa, Entamoeba invadens
ALLRSAQPLPGFVTSVTGKNTSGD

SEQ ID NO: 2926785 - protein, 21 aa, Entamoeba invadens
ALLSLKYNITFEKPSKLPTKS

SEQ ID NO: 2926786 - protein, 25 aa, Entamoeba invadens
ALLTLPFALVIKVCKFLNKIDIFAL

SEQ ID NO: 2926787 - protein, 18 aa, Entamoeba invadens
ALLVFLSIDHTCLDIPEF

SEQ ID NO: 2926788 - protein, 24 aa, Entamoeba invadens
ALLYCIKYGLTLVVPLNPPELSIE

SEQ ID NO: 2926789 - protein, 21 aa, Entamoeba invadens
ALLYLLLKRGWTVKIVKQKTA

SEQ ID NO: 2926790 - protein, 26 aa, Entamoeba invadens
ALLYLVLKEGYKLIFPKTKKENSYHK

SEQ ID NO: 2926791 - protein, 32 aa, Entamoeba invadens
ALLYRHPELFYLKKRLKRCMMSLSAKHHQFFQ

SEQ ID NO: 2926792 - protein, 17 aa, Entamoeba invadens
ALMALGKICCEKLDLKI

SEQ ID NO: 2926793 - protein, 18 aa, Entamoeba invadens
ALMILPTIVSMYLRAINV

SEQ ID NO: 2926794 - protein, 21 aa, Entamoeba invadens
ALMLAKLIVQYSMALGTELKQ

SEQ ID NO: 2926795 - protein, 17 aa, Entamoeba invadens
ALMSRFDLFFVVLDEPD

SEQ ID NO: 2926796 - protein, 26 aa, Entamoeba invadens
ALNAKICGRTNILLIVITNKNYVFGS

SEQ ID NO: 2926797 - protein, 17 aa, Entamoeba invadens
ALNCFAKAFTTFQFYVF

SEQ ID NO: 2926798 - protein, 24 aa, Entamoeba invadens
ALNKIDRCYQWKATDNGPFRDSFE

SEQ ID NO: 2926799 - protein, 26 aa, Entamoeba invadens
ALNKKVFKDQAIWMLNAVWPAYKDTL

SEQ ID NO: 2926800 - protein, 20 aa, Entamoeba invadens
ALNMKGKVVVGGGRNGNLFI

SEQ ID NO: 2926801 - protein, 17 aa, Entamoeba invadens
ALNNIKVDFLFESIAKG

SEQ ID NO: 2926802 - protein, 18 aa, Entamoeba invadens
ALPEFDWILGNTTHLEEK

SEQ ID NO: 2926803 - protein, 22 aa, Entamoeba invadens
ALPEMNKIASLILSFDAGEFKY

SEQ ID NO: 2926804 - protein, 28 aa, Entamoeba invadens
ALPLDKFQIALDMHVGRIPSSSLVQIVA

SEQ ID NO: 2926805 - protein, 26 aa, Entamoeba invadens
ALPNLRRLEIKAGRVALNENLPIRQI

SEQ ID NO: 2926806 - protein, 24 aa, Entamoeba invadens
ALPPDFSLKFTFRRFDGNEKESVE

SEQ ID NO: 2926807 - protein, 26 aa, Entamoeba invadens
ALPPSIRGTWWFPLLSSIGIDQYQRI

SEQ ID NO: 2926808 - protein, 22 aa, Entamoeba invadens
ALQSFCLGDIFQNCVMKTQNWK

SEQ ID NO: 2926809 - protein, 23 aa, Entamoeba invadens
ALQTEVMACISLMKAKNANDPLI

SEQ ID NO: 2926810 - protein, 23 aa, Entamoeba invadens
ALREIKNTMEIVATKSEDLKTQQ

SEQ ID NO: 2926811 - protein, 18 aa, Entamoeba invadens
ALRIYNRNVHVFTNNYLI

SEQ ID NO: 2926812 - protein, 22 aa, Entamoeba invadens
ALRKQIWEQLNLIRVYTKVPGE

SEQ ID NO: 2926813 - protein, 22 aa, Entamoeba invadens
ALRVGCDISHVFCHEEAATAIK

SEQ ID NO: 2926814 - protein, 18 aa, Entamoeba invadens
ALSDSLKKPWEWKEEFSS

SEQ ID NO: 2926815 - protein, 26 aa, Entamoeba invadens
ALSEFNFPLNLKTIGKFCFSNCSSLS

SEQ ID NO: 2926816 - protein, 21 aa, Entamoeba invadens
ALSELKLIKALMNDMIPPSQE

SEQ ID NO: 2926817 - protein, 22 aa, Entamoeba invadens
ALSKHVPLPFDILDPPASQELV

SEQ ID NO: 2926818 - protein, 24 aa, Entamoeba invadens
ALSKTRFYIVTDFPEQFKKSDLLC

SEQ ID NO: 2926819 - protein, 18 aa, Entamoeba invadens
ALSLKHIFIKDNDIRLAF

SEQ ID NO: 2926820 - protein, 30 aa, Entamoeba invadens
ALSPFLRMVHFKEVTCDLVRSKTDIKDFPQ

SEQ ID NO: 2926821 - protein, 20 aa, Entamoeba invadens
ALSPGSCTALGPALLVSTVA

SEQ ID NO: 2926822 - protein, 23 aa, Entamoeba invadens
ALSQLKLLLFPGDSKTMNEATTL

SEQ ID NO: 2926823 - protein, 36 aa, Entamoeba invadens
ALTCFPETLLFDRKDKDLAIILACDGVWDVMSNEEV

SEQ ID NO: 2926824 - protein, 25 aa, Entamoeba invadens
ALTFVKSKRPIICPNSGFERQLLCL

SEQ ID NO: 2926825 - protein, 18 aa, Entamoeba invadens
ALTGFKVNLPFLDGSEVS

SEQ ID NO: 2926826 - protein, 19 aa, Entamoeba invadens
ALTKNGLNSEEFVKNVNGY

SEQ ID NO: 2926827 - protein, 18 aa, Entamoeba invadens
ALTLFDCGTQVFTSKVSL

SEQ ID NO: 2926828 - protein, 26 aa, Entamoeba invadens
ALTLIEKCAYFPMKDVNFGVLFSRHV

SEQ ID NO: 2926829 - protein, 19 aa, Entamoeba invadens
ALTNLCVKSGQYFFDTILT

SEQ ID NO: 2926830 - protein, 25 aa, Entamoeba invadens
ALTPIAGACVVEWINSTNLSLEVFQ

SEQ ID NO: 2926831 - protein, 27 aa, Entamoeba invadens
ALTPRNHLFDGWSFLTKIQIVKKLAEG

SEQ ID NO: 2926832 - protein, 19 aa, Entamoeba invadens
ALTTFPGYQYYAIVDDEDY

SEQ ID NO: 2926833 - protein, 20 aa, Entamoeba invadens
ALTTFVFPPKLMKIGDSCFS

SEQ ID NO: 2926834 - protein, 17 aa, Entamoeba invadens
ALVARLDLDQELQNEKE

SEQ ID NO: 2926835 - protein, 19 aa, Entamoeba invadens
ALVAVKSVLSWLLDNPQTS

SEQ ID NO: 2926836 - protein, 23 aa, Entamoeba invadens
ALVDINFGALIFSVSTCSNRRIG

SEQ ID NO: 2926837 - protein, 19 aa, Entamoeba invadens
ALVECLITFASMRENLFMG

SEQ ID NO: 2926838 - protein, 17 aa, Entamoeba invadens
ALVEGNGLGRFLCTHGG

SEQ ID NO: 2926839 - protein, 19 aa, Entamoeba invadens
ALVEIFQTSGFVFTNQNNE

SEQ ID NO: 2926840 - protein, 25 aa, Entamoeba invadens
ALVKILNYCYIEFRAPYIHLIPQNI

SEQ ID NO: 2926841 - protein, 18 aa, Entamoeba invadens
ALVLTKLGLISVVLFSNG

SEQ ID NO: 2926842 - protein, 24 aa, Entamoeba invadens
ALVNSIVCNFKFPLVSTSSSIVKW

SEQ ID NO: 2926843 - protein, 18 aa, Entamoeba invadens
ALVPESKESFSILKTLST

SEQ ID NO: 2926844 - protein, 17 aa, Entamoeba invadens
ALVPLVIEIPQRESIKD

SEQ ID NO: 2926845 - protein, 18 aa, Entamoeba invadens
ALVSMSFLNEDDKPIKAV

SEQ ID NO: 2926846 - protein, 27 aa, Entamoeba invadens
ALVTRKIGKFFLCHGGISPKMAKIEDI

SEQ ID NO: 2926847 - protein, 22 aa, Entamoeba invadens
ALYELLEKCTNGLNIFSKYAWE

SEQ ID NO: 2926848 - protein, 17 aa, Entamoeba invadens
ALYLAKKNKCHTLWNPA

SEQ ID NO: 2926849 - protein, 19 aa, Entamoeba invadens
ALYLCDGFCSEKFNEDTIT

SEQ ID NO: 2926850 - protein, 18 aa, Entamoeba invadens
ALYQHFEEVHVANLEPQL

SEQ ID NO: 2926851 - protein, 18 aa, Entamoeba invadens
ALYVKGFDLRTEINQIFV

SEQ ID NO: 2926852 - protein, 21 aa, Entamoeba invadens
ALYYKQFFLGIKYSMGAPDDT

SEQ ID NO: 2926853 - protein, 18 aa, Entamoeba invadens
AMAEKQCDLIQKEEVRNG

SEQ ID NO: 2926854 - protein, 22 aa, Entamoeba invadens
AMDDLGFYKKPYLKKFNHKHEI

SEQ ID NO: 2926855 - protein, 27 aa, Entamoeba invadens
AMDFFRKSLKLEILESTDLLQTVKTDM

SEQ ID NO: 2926856 - protein, 30 aa, Entamoeba invadens
AMDIRVKLQPIVTCVNALPLHTDLNRLTEQ

SEQ ID NO: 2926857 - protein, 22 aa, Entamoeba invadens
AMDLCMKEGFDSDAMQIAKKSK

SEQ ID NO: 2926858 - protein, 20 aa, Entamoeba invadens
AMEKYPRYSQRESFDQLRHW

SEQ ID NO: 2926859 - protein, 19 aa, Entamoeba invadens
AMESCKLYHNVLAAADLFK

SEQ ID NO: 2926860 - protein, 19 aa, Entamoeba invadens
AMETWKMRTDEEIFLAFVG

SEQ ID NO: 2926861 - protein, 24 aa, Entamoeba invadens
AMETWKMRTDEEIFLAFVGGMMEG

SEQ ID NO: 2926862 - protein, 19 aa, Entamoeba invadens
AMEVVKIILDKGEVLSGKM

SEQ ID NO: 2926863 - protein, 25 aa, Entamoeba invadens
AMFEKDFIERATVLILYKLLFVNFE

SEQ ID NO: 2926864 - protein, 20 aa, Entamoeba invadens
AMFVKCVLLIQNRHSLDAEK

SEQ ID NO: 2926865 - protein, 25 aa, Entamoeba invadens
AMGEDCIRGKFGITGGVNCCHASDA

SEQ ID NO: 2926866 - protein, 19 aa, Entamoeba invadens
AMGGIKEIGNFCFKNHSDQ

SEQ ID NO: 2926867 - protein, 28 aa, Entamoeba invadens
AMGPLGVGAQMYGVPIGQQIPQGVPVGV

SEQ ID NO: 2926868 - protein, 19 aa, Entamoeba invadens
AMGRRSCYQFGNYLEKSEK

SEQ ID NO: 2926869 - protein, 17 aa, Entamoeba invadens
AMGSSVFSRLVGMKYPV

SEQ ID NO: 2926870 - protein, 24 aa, Entamoeba invadens
AMILENFSALLLENSDKIPTHLKI

SEQ ID NO: 2926871 - protein, 17 aa, Entamoeba invadens
AMKEYIKKMLVIYELGY

SEQ ID NO: 2926872 - protein, 21 aa, Entamoeba invadens
AMKGNNGVNIIKGKNTIVIGY

SEQ ID NO: 2926873 - protein, 19 aa, Entamoeba invadens
AMKLSPYDRGVAIGKSDII

SEQ ID NO: 2926874 - protein, 20 aa, Entamoeba invadens
AMKMVREFYAEASVKNLCQK

SEQ ID NO: 2926875 - protein, 18 aa, Entamoeba invadens
AMKNLFELIRKCNKYLSP

SEQ ID NO: 2926876 - protein, 20 aa, Entamoeba invadens
AMKYIECSALTNYNIDLVFE

SEQ ID NO: 2926877 - protein, 18 aa, Entamoeba invadens
AMLACFPMQDVLSLKAKY

SEQ ID NO: 2926878 - protein, 22 aa, Entamoeba invadens
AMLKSKICRLVSIVKLNDIIQS

SEQ ID NO: 2926879 - protein, 22 aa, Entamoeba invadens
AMLRLAEHPYLFWKYVLEVCLH

SEQ ID NO: 2926880 - protein, 17 aa, Entamoeba invadens
AMLRRKAFMHQYTEEGM

SEQ ID NO: 2926881 - protein, 23 aa, Entamoeba invadens
AMLSEAFSKIVLHTQAMKQVLVE

SEQ ID NO: 2926882 - protein, 18 aa, Entamoeba invadens
AMLSKGQVYPFRYLLQSF

SEQ ID NO: 2926883 - protein, 23 aa, Entamoeba invadens
AMLTHLYRDWSIEGSHERSLCYG

SEQ ID NO: 2926884 - protein, 25 aa, Entamoeba invadens
AMLWKVDPLTSMGVYTCDGAVSDCT

SEQ ID NO: 2926885 - protein, 23 aa, Entamoeba invadens
AMMSKDRYGLIIIDSATALYRTD

SEQ ID NO: 2926886 - protein, 17 aa, Entamoeba invadens
AMNKILLIDDERSVVLL

SEQ ID NO: 2926887 - protein, 24 aa, Entamoeba invadens
AMNKVEAAFWYKAIAPLTHPYGVF

SEQ ID NO: 2926888 - protein, 17 aa, Entamoeba invadens
AMNPLKYLNRMQSKVYN

SEQ ID NO: 2926889 - protein, 37 aa, Entamoeba invadens
AMNSSFKGLCEIIEKLFLWDKVRVEGGAYGAWVTAQA

SEQ ID NO: 2926890 - protein, 19 aa, Entamoeba invadens
AMNYWKYWLESLPSKHSNP

SEQ ID NO: 2926891 - protein, 26 aa, Entamoeba invadens
AMPVVKDLMKLFCEKYKKQAKSEHWQ

SEQ ID NO: 2926892 - protein, 27 aa, Entamoeba invadens
AMPVVKELMKQICEKDGKSYTEEFQIS

SEQ ID NO: 2926893 - protein, 25 aa, Entamoeba invadens
AMRDYMKASSFSLVSAKYTAGEFSH

SEQ ID NO: 2926894 - protein, 26 aa, Entamoeba invadens
AMREWFTNEMKLEWTPIAYNNPDVKL

SEQ ID NO: 2926895 - protein, 23 aa, Entamoeba invadens
AMRFWVNYFDLCSIERIRPFYNN

SEQ ID NO: 2926896 - protein, 24 aa, Entamoeba invadens
AMRNEFYTRFGITQENERVGKYGK

SEQ ID NO: 2926897 - protein, 18 aa, Entamoeba invadens
AMSFKFNKNGIVFKIQPK

SEQ ID NO: 2926898 - protein, 23 aa, Entamoeba invadens
AMSGDVWYGPSITVMCKSDVLDE

SEQ ID NO: 2926899 - protein, 19 aa, Entamoeba invadens
AMSGWKPNTVRGMSVFFGE

SEQ ID NO: 2926900 - protein, 24 aa, Entamoeba invadens
AMSPLKAPPLISAEKKLPPSDQKG

SEQ ID NO: 2926901 - protein, 17 aa, Entamoeba invadens
AMSQISIPTCLKTIEKF

SEQ ID NO: 2926902 - protein, 18 aa, Entamoeba invadens
AMSRNMFKFITANIETYD

SEQ ID NO: 2926903 - protein, 19 aa, Entamoeba invadens
AMTDIQWSALFRGDEAYGR

SEQ ID NO: 2926904 - protein, 18 aa, Entamoeba invadens
AMVTFGPINRIIRMNSNS

SEQ ID NO: 2926905 - protein, 23 aa, Entamoeba invadens
AMYKKTFCGYALEKAFDQFQTNE

SEQ ID NO: 2926906 - protein, 17 aa, Entamoeba invadens
AMYSGVEYFSLFVRFVF

SEQ ID NO: 2926907 - protein, 18 aa, Entamoeba invadens
ANACCFDQGNSYIFITGG

SEQ ID NO: 2926908 - protein, 27 aa, Entamoeba invadens
ANAILGCSMCICRAAASFKKLPLYKYL

SEQ ID NO: 2926909 - protein, 17 aa, Entamoeba invadens
ANAIQLFEHICPGSHTM

SEQ ID NO: 2926910 - protein, 17 aa, Entamoeba invadens
ANALKWVTDVIIHAQSL

SEQ ID NO: 2926911 - protein, 17 aa, Entamoeba invadens
ANAMAKRIYEGLNPQSA

SEQ ID NO: 2926912 - protein, 18 aa, Entamoeba invadens
ANANAIIFFYSVNKKETF

SEQ ID NO: 2926913 - protein, 22 aa, Entamoeba invadens
ANANTDLPFCFGKQDKEIAQLF

SEQ ID NO: 2926914 - protein, 27 aa, Entamoeba invadens
ANASEILKCYLELFREVRKMDQDVFRM

SEQ ID NO: 2926915 - protein, 20 aa, Entamoeba invadens
ANATCLRLIVSTCADPKKIV

SEQ ID NO: 2926916 - protein, 21 aa, Entamoeba invadens
ANCSAPESLAVMFTSFKYLRF

SEQ ID NO: 2926917 - protein, 21 aa, Entamoeba invadens
ANCVFKCPETLCGLTVINSKS

SEQ ID NO: 2926918 - protein, 18 aa, Entamoeba invadens
ANDALMNEIHIVYKKKRR

SEQ ID NO: 2926919 - protein, 24 aa, Entamoeba invadens
ANDCVVCGFVKPIISEKEENYVLG

SEQ ID NO: 2926920 - protein, 22 aa, Entamoeba invadens
ANDVVPLFRVMGSFEQHVEPCD

SEQ ID NO: 2926921 - protein, 18 aa, Entamoeba invadens
ANDYGIAFLKEWLSAPSF

SEQ ID NO: 2926922 - protein, 18 aa, Entamoeba invadens
ANEAKFFIYKVRQNIKNC

SEQ ID NO: 2926923 - protein, 34 aa, Entamoeba invadens
ANEELYRFPVNIRERARFIPLRITQAERKLLRLL

SEQ ID NO: 2926924 - protein, 25 aa, Entamoeba invadens
ANEESRISGNFSRDYVDNGEKLCST

SEQ ID NO: 2926925 - protein, 28 aa, Entamoeba invadens
ANEFPKSELYKTDFVFDEQKFANLIYSM

SEQ ID NO: 2926926 - protein, 30 aa, Entamoeba invadens
ANEGIWRAMWRVVVYLDEHWSFDHTPDVDR

SEQ ID NO: 2926927 - protein, 18 aa, Entamoeba invadens
ANEGRTVAVFDLGGGTFD

SEQ ID NO: 2926928 - protein, 18 aa, Entamoeba invadens
ANELIVWQPPDTVTTNIE

SEQ ID NO: 2926929 - protein, 26 aa, Entamoeba invadens
ANELKKRASNQFNWATLYMRPDTAIT

SEQ ID NO: 2926930 - protein, 26 aa, Entamoeba invadens
ANELKRVCVELLKMIPNIFKKASEVV

SEQ ID NO: 2926931 - protein, 17 aa, Entamoeba invadens
ANENDIFYECCVGGKSV

SEQ ID NO: 2926932 - protein, 25 aa, Entamoeba invadens
ANERYIFGFRVSRNYQAEQQAILLA

SEQ ID NO: 2926933 - protein, 19 aa, Entamoeba invadens
ANESWNWIQVSTVLTSVLQ

SEQ ID NO: 2926934 - protein, 18 aa, Entamoeba invadens
ANFAFANRGMITYQIREA

SEQ ID NO: 2926935 - protein, 20 aa, Entamoeba invadens
ANFIRLIAGFETCQKLMGEL

SEQ ID NO: 2926936 - protein, 25 aa, Entamoeba invadens
ANFRSKKRLPICMYEDNLTHTSLFR

SEQ ID NO: 2926937 - protein, 17 aa, Entamoeba invadens
ANFSEKVTQFFTKIFVV

SEQ ID NO: 2926938 - protein, 17 aa, Entamoeba invadens
ANFSLLPAFLKERESSI

SEQ ID NO: 2926939 - protein, 23 aa, Entamoeba invadens
ANFYCANFIPPTLKNSGRDLTGV

SEQ ID NO: 2926940 - protein, 21 aa, Entamoeba invadens
ANGKYSKTNGVAFKEVNVKGS

SEQ ID NO: 2926941 - protein, 25 aa, Entamoeba invadens
ANGLIYMIIKLGFNIKIKRTKKTVH

SEQ ID NO: 2926942 - protein, 17 aa, Entamoeba invadens
ANGSVLDEAYCIECIPS

SEQ ID NO: 2926943 - protein, 18 aa, Entamoeba invadens
ANGVMCSVVEFTRDDRRT

SEQ ID NO: 2926944 - protein, 26 aa, Entamoeba invadens
ANHLELPMWVCTQSRIFVETSSDLFD

SEQ ID NO: 2926945 - protein, 24 aa, Entamoeba invadens
ANHLESFNSYVILPVQRIPRYQLL

SEQ ID NO: 2926946 - protein, 24 aa, Entamoeba invadens
ANHSRPNVLYNFYSVRGRLVDLML

SEQ ID NO: 2926947 - protein, 18 aa, Entamoeba invadens
ANIAEFFVSVIDYVIVNA

SEQ ID NO: 2926948 - protein, 17 aa, Entamoeba invadens
ANIFQKAVIDWKYDSCF

SEQ ID NO: 2926949 - protein, 23 aa, Entamoeba invadens
ANIKSADVKYVFESIDANGNGKV

SEQ ID NO: 2926950 - protein, 32 aa, Entamoeba invadens
ANIYGEGIGTVFTKLSYFLKMYSNYINRTDEI

SEQ ID NO: 2926951 - protein, 20 aa, Entamoeba invadens
ANKAEYAFYVGTLQGKRLFD

SEQ ID NO: 2926952 - protein, 23 aa, Entamoeba invadens
ANKEVSYCYSLYSNYRINSLANE

SEQ ID NO: 2926953 - protein, 23 aa, Entamoeba invadens
ANKEYPSIFIVNAPPHVYSHFQS

SEQ ID NO: 2926954 - protein, 26 aa, Entamoeba invadens
ANKGLRGRIPFFDVVDVGQSYFMDHS

SEQ ID NO: 2926955 - protein, 28 aa, Entamoeba invadens
ANKGLRSRIPFSDVVDVGQSYFMDHSDN

SEQ ID NO: 2926956 - protein, 31 aa, Entamoeba invadens
ANKKRVVRVICDYDGVRECFGDTELIQILAK

SEQ ID NO: 2926957 - protein, 22 aa, Entamoeba invadens
ANKPEKNWVCLTYEAPKSKNLV

SEQ ID NO: 2926958 - protein, 21 aa, Entamoeba invadens
ANKPLFLGIGNCWSKALYFEK

SEQ ID NO: 2926959 - protein, 17 aa, Entamoeba invadens
ANKQGRVFWVSKPTEAC

SEQ ID NO: 2926960 - protein, 24 aa, Entamoeba invadens
ANKRIERRISLFDLARVTHLDICK

SEQ ID NO: 2926961 - protein, 17 aa, Entamoeba invadens
ANKVLVIHLKRFGNASG

SEQ ID NO: 2926962 - protein, 25 aa, Entamoeba invadens
ANKYVDCPQIFIPWYQMIADQQNSR

SEQ ID NO: 2926963 - protein, 30 aa, Entamoeba invadens
ANLAYVQFLMKMFRLMGRSEALVMLEYHIM

SEQ ID NO: 2926964 - protein, 23 aa, Entamoeba invadens
ANLEHLRKSIVPGVVCIIVAGKY

SEQ ID NO: 2926965 - protein, 22 aa, Entamoeba invadens
ANLFCAKRGLDFSVVDAPNEIK

SEQ ID NO: 2926966 - protein, 25 aa, Entamoeba invadens
ANLFLRKTHEVYKKTCTAVFMKIVV

SEQ ID NO: 2926967 - protein, 18 aa, Entamoeba invadens
ANLILRKYFNVLSSNLFA

SEQ ID NO: 2926968 - protein, 18 aa, Entamoeba invadens
ANLLDTVFTLFVKLSDLD

SEQ ID NO: 2926969 - protein, 20 aa, Entamoeba invadens
ANLPHLASTISFVSTFAETT

SEQ ID NO: 2926970 - protein, 26 aa, Entamoeba invadens
ANMFSMWKNNLIEIADQFKQTSTSLL

SEQ ID NO: 2926971 - protein, 21 aa, Entamoeba invadens
ANMKRARHFVDWQSGEIDENV

SEQ ID NO: 2926972 - protein, 19 aa, Entamoeba invadens
ANMRELVGFEAKKPGGMQL

SEQ ID NO: 2926973 - protein, 30 aa, Entamoeba invadens
ANNAIKYKPGWARGYSRKAFALVKLEKYDE

SEQ ID NO: 2926974 - protein, 24 aa, Entamoeba invadens
ANNIYKLVLYFANALEKENTEDDT

SEQ ID NO: 2926975 - protein, 19 aa, Entamoeba invadens
ANNPLFFLVSFITRCVSGS

SEQ ID NO: 2926976 - protein, 23 aa, Entamoeba invadens
ANNWRNYQCYIGMVKNDFTKELV

SEQ ID NO: 2926977 - protein, 26 aa, Entamoeba invadens
ANNYAIHFRFLMRYAEEPCNSLKHNH

SEQ ID NO: 2926978 - protein, 17 aa, Entamoeba invadens
ANPILAQIMKLVKKEDF

SEQ ID NO: 2926979 - protein, 19 aa, Entamoeba invadens
ANPQFALQLGNTFLTYIDR

SEQ ID NO: 2926980 - protein, 19 aa, Entamoeba invadens
ANPRMTIIRSFDINKAGTF

SEQ ID NO: 2926981 - protein, 17 aa, Entamoeba invadens
ANQFGIQRLISLRIKEG

SEQ ID NO: 2926982 - protein, 21 aa, Entamoeba invadens
ANQIEVAFEFSVENEGNCSTE

SEQ ID NO: 2926983 - protein, 20 aa, Entamoeba invadens
ANQKHRINCSEYKYITDVKV

SEQ ID NO: 2926984 - protein, 23 aa, Entamoeba invadens
ANQKKGFCLGDLIIEPMQRTPRY

SEQ ID NO: 2926985 - protein, 18 aa, Entamoeba invadens
ANQYFPDPQLPAVFDDDI

SEQ ID NO: 2926986 - protein, 19 aa, Entamoeba invadens
ANRITPFFVQLNKTQKFKL

SEQ ID NO: 2926987 - protein, 21 aa, Entamoeba invadens
ANRRRTVQCLAQLSKYANDTQ

SEQ ID NO: 2926988 - protein, 20 aa, Entamoeba invadens
ANSEFLEFFKSFGNIESFKL

SEQ ID NO: 2926989 - protein, 19 aa, Entamoeba invadens
ANSIGRGAFGEVLKGMNAD

SEQ ID NO: 2926990 - protein, 18 aa, Entamoeba invadens
ANSKWLYHISKILKGTVI

SEQ ID NO: 2926991 - protein, 23 aa, Entamoeba invadens
ANSQSVWKLPKSVTEYLLTTTNI

SEQ ID NO: 2926992 - protein, 20 aa, Entamoeba invadens
ANSVFGYDVVDKFYSYQTTF

SEQ ID NO: 2926993 - protein, 25 aa, Entamoeba invadens
ANSYKELLEYLLSFPQMKPLINVKN

SEQ ID NO: 2926994 - protein, 21 aa, Entamoeba invadens
ANTALKFARENGVRLVSVEAG

SEQ ID NO: 2926995 - protein, 24 aa, Entamoeba invadens
ANTEYKTSWLFNALNACQTVPEGW

SEQ ID NO: 2926996 - protein, 18 aa, Entamoeba invadens
ANTFKANYIYWKIDTERN

SEQ ID NO: 2926997 - protein, 21 aa, Entamoeba invadens
ANTFLLKRMRNNPSYYNVNGR

SEQ ID NO: 2926998 - protein, 18 aa, Entamoeba invadens
ANTKRGLAELSVDISVLR

SEQ ID NO: 2926999 - protein, 28 aa, Entamoeba invadens
ANTSEVKRWCSLFDDWRVYEFPQSEDPH

SEQ ID NO: 2927000 - protein, 18 aa, Entamoeba invadens
ANTVRYYPHYQITEDTTC

SEQ ID NO: 2927001 - protein, 33 aa, Entamoeba invadens
ANVANFFIAFCPLLKMYMDYVAKFNLKVKAKID

SEQ ID NO: 2927002 - protein, 17 aa, Entamoeba invadens
ANVASEVEFRIKLYFDE

SEQ ID NO: 2927003 - protein, 17 aa, Entamoeba invadens
ANVGEFFQTVWGKMNGK

SEQ ID NO: 2927004 - protein, 24 aa, Entamoeba invadens
ANVKYIKYCELNKMAALTTQLDSV

SEQ ID NO: 2927005 - protein, 20 aa, Entamoeba invadens
ANVLPRFFKHSNFSSFVRQL

SEQ ID NO: 2927006 - protein, 19 aa, Entamoeba invadens
ANVNLKLAIGKFICEAPFV

SEQ ID NO: 2927007 - protein, 19 aa, Entamoeba invadens
ANVPPFPKGFADITQTPTK

SEQ ID NO: 2927008 - protein, 23 aa, Entamoeba invadens
ANVRAAGVSALFNFANNNENIED

SEQ ID NO: 2927009 - protein, 20 aa, Entamoeba invadens
ANVVFSLLCFYVDCEKTGSH

SEQ ID NO: 2927010 - protein, 18 aa, Entamoeba invadens
ANVVSLLNVHAFQMVEYT

SEQ ID NO: 2927011 - protein, 25 aa, Entamoeba invadens
ANYDVKRAIAFIKKKYVPVKKTAVI

SEQ ID NO: 2927012 - protein, 17 aa, Entamoeba invadens
ANYGIAMECGTPLRCIL

SEQ ID NO: 2927013 - protein, 21 aa, Entamoeba invadens
ANYIFKHSLTINNIIMNNKNY

SEQ ID NO: 2927014 - protein, 29 aa, Entamoeba invadens
ANYPQFEFLRLKIGSEFNLKQCEVQLDID

SEQ ID NO: 2927015 - protein, 31 aa, Entamoeba invadens
ANYPRLPWHDLHCMIEGPAVFDVDRNFVERW

SEQ ID NO: 2927016 - protein, 17 aa, Entamoeba invadens
ANYSGGLILKSSMNEDL

SEQ ID NO: 2927017 - protein, 17 aa, Entamoeba invadens
ANYSGSVCTTCQQNYHI

SEQ ID NO: 2927018 - protein, 21 aa, Entamoeba invadens
ANYVYHGALILKALYESEEDI

SEQ ID NO: 2927019 - protein, 21 aa, Entamoeba invadens
APASAIFRVHFPFYDPTTNDR

SEQ ID NO: 2927020 - protein, 19 aa, Entamoeba invadens
APASGSMCDLMWSDPDNDV

SEQ ID NO: 2927021 - protein, 18 aa, Entamoeba invadens
APCMQKFNKEFPAYRKLE

SEQ ID NO: 2927022 - protein, 17 aa, Entamoeba invadens
APCVTKWYVELFHSCRI

SEQ ID NO: 2927023 - protein, 17 aa, Entamoeba invadens
APDACNVVIKNFEGLSV

SEQ ID NO: 2927024 - protein, 19 aa, Entamoeba invadens
APDSGKTAMIRRLLDDEFS

SEQ ID NO: 2927025 - protein, 28 aa, Entamoeba invadens
APEAIYIFPRMFKLEVCQLYDKLCSIGF

SEQ ID NO: 2927026 - protein, 26 aa, Entamoeba invadens
APEIFKKMLPNMMKRLNVIDHNDETR

SEQ ID NO: 2927027 - protein, 26 aa, Entamoeba invadens
APEILCDIKEGMEIVKNHREVDENGI

SEQ ID NO: 2927028 - protein, 26 aa, Entamoeba invadens
APEKFTLKILEEIRFAPSASNKQEWR

SEQ ID NO: 2927029 - protein, 19 aa, Entamoeba invadens
APEKVAAFIHEIFFQINNI

SEQ ID NO: 2927030 - protein, 20 aa, Entamoeba invadens
APELRKLAIENVKKFWENVA

SEQ ID NO: 2927031 - protein, 20 aa, Entamoeba invadens
APEMSLGFCVGKDGATNITQ

SEQ ID NO: 2927032 - protein, 20 aa, Entamoeba invadens
APEYCPNCDAVIEFELEKHK

SEQ ID NO: 2927033 - protein, 21 aa, Entamoeba invadens
APFDIVTTFIKWLCNSTKLKE

SEQ ID NO: 2927034 - protein, 19 aa, Entamoeba invadens
APFDLIFKTLMKVMTQNYE

SEQ ID NO: 2927035 - protein, 19 aa, Entamoeba invadens
APFHRPSLEALRRHPFIQE

SEQ ID NO: 2927036 - protein, 26 aa, Entamoeba invadens
APFPKIPVLHLWLADLARISELPTFF

SEQ ID NO: 2927037 - protein, 25 aa, Entamoeba invadens
APFSSEKNVECIFVASSDISSEYME

SEQ ID NO: 2927038 - protein, 21 aa, Entamoeba invadens
APFTPFTAFLTENWKKQKYFK

SEQ ID NO: 2927039 - protein, 17 aa, Entamoeba invadens
APFVISYNFKGAYKHNR

SEQ ID NO: 2927040 - protein, 19 aa, Entamoeba invadens
APFVKLRKVEKQKPVETPQ

SEQ ID NO: 2927041 - protein, 19 aa, Entamoeba invadens
APFVSFRVVKDFNENNTKE

SEQ ID NO: 2927042 - protein, 18 aa, Entamoeba invadens
APHMAPGMAPGMCQPPMA

SEQ ID NO: 2927043 - protein, 19 aa, Entamoeba invadens
APIAPEWKATLKSTSGFQD

SEQ ID NO: 2927044 - protein, 23 aa, Entamoeba invadens
APIDRLCRTIRDLYVKYYILNDD

SEQ ID NO: 2927045 - protein, 18 aa, Entamoeba invadens
APIGIDLIKFKGACDILF

SEQ ID NO: 2927046 - protein, 17 aa, Entamoeba invadens
APIKSAPMISTKASDEV

SEQ ID NO: 2927047 - protein, 17 aa, Entamoeba invadens
APIQCIIQGLTYHQVMD

SEQ ID NO: 2927048 - protein, 18 aa, Entamoeba invadens
APIRLKNLTLAFEPKAHI

SEQ ID NO: 2927049 - protein, 31 aa, Entamoeba invadens
APIRMKVMGFVRSWVKWRFIDFEDVDMRSNL

SEQ ID NO: 2927050 - protein, 18 aa, Entamoeba invadens
APITFPCVVKVSCTNAGF

SEQ ID NO: 2927051 - protein, 28 aa, Entamoeba invadens
APITMGYYIYYVNVVPVYFVPQQQDIQE

SEQ ID NO: 2927052 - protein, 26 aa, Entamoeba invadens
APIVKCLHAALPHAFLDCHLMIEDPK

SEQ ID NO: 2927053 - protein, 22 aa, Entamoeba invadens
APIVPVCAQLNFNMDVVCEYIC

SEQ ID NO: 2927054 - protein, 25 aa, Entamoeba invadens
APKDMKDCVEWAYGKYQNYFVNSIH

SEQ ID NO: 2927055 - protein, 26 aa, Entamoeba invadens
APKDMKDCVKWAFGKYQNYFVDSIQK

SEQ ID NO: 2927056 - protein, 22 aa, Entamoeba invadens
APKLKELELVFPTISDLTMLNS

SEQ ID NO: 2927057 - protein, 21 aa, Entamoeba invadens
APKRPCDPQKIAALKQEIDSQ

SEQ ID NO: 2927058 - protein, 22 aa, Entamoeba invadens
APKRRRKVYDADDVGGYVPTTK

SEQ ID NO: 2927059 - protein, 20 aa, Entamoeba invadens
APKSEQWVVAPTHRIQQLEN

SEQ ID NO: 2927060 - protein, 25 aa, Entamoeba invadens
APLFKAKCFCPKGTLTEFNLEDFKG

SEQ ID NO: 2927061 - protein, 17 aa, Entamoeba invadens
APLKEKKDVVVVAMNEE

SEQ ID NO: 2927062 - protein, 22 aa, Entamoeba invadens
APLKPIHRFNFSEAITEQTAPA

SEQ ID NO: 2927063 - protein, 17 aa, Entamoeba invadens
APLKTACKEIIKTIIKS

SEQ ID NO: 2927064 - protein, 27 aa, Entamoeba invadens
APLLPNEFLKLLSLVFFVIKKDTKNSF

SEQ ID NO: 2927065 - protein, 18 aa, Entamoeba invadens
APLSRKLERTKVYLTPED

SEQ ID NO: 2927066 - protein, 18 aa, Entamoeba invadens
APMGCPPMGAPVYPPMGA

SEQ ID NO: 2927067 - protein, 26 aa, Entamoeba invadens
APMKSGLKCLTMLDLSYNRLESAKYF

SEQ ID NO: 2927068 - protein, 23 aa, Entamoeba invadens
APMKYDIADVMPYLDRQTKAKVI

SEQ ID NO: 2927069 - protein, 18 aa, Entamoeba invadens
APMPYVVGVKSNFLEKVF

SEQ ID NO: 2927070 - protein, 23 aa, Entamoeba invadens
APMYCYSYTPAYYVPYNQQQYFN

SEQ ID NO: 2927071 - protein, 20 aa, Entamoeba invadens
APNKLKACISLLEKQSVEEF

SEQ ID NO: 2927072 - protein, 18 aa, Entamoeba invadens
APNLMFFGFVVDQRTQFA

SEQ ID NO: 2927073 - protein, 17 aa, Entamoeba invadens
APNTAWISVYKQIEGVK

SEQ ID NO: 2927074 - protein, 20 aa, Entamoeba invadens
APNYCGRCGNIASIMKVNEK

SEQ ID NO: 2927075 - protein, 23 aa, Entamoeba invadens
APNYCYKCNNLAAIMELSDTGEY

SEQ ID NO: 2927076 - protein, 19 aa, Entamoeba invadens
APPEFIFDCTLGEIFVIRT

SEQ ID NO: 2927077 - protein, 17 aa, Entamoeba invadens
APPGGLMPPGMLPPPGL

SEQ ID NO: 2927078 - protein, 23 aa, Entamoeba invadens
APPGGLMPPGMLPPPGLAPPGGM

SEQ ID NO: 2927079 - protein, 18 aa, Entamoeba invadens
APPGGLMPPGMMPPPGLA

SEQ ID NO: 2927080 - protein, 21 aa, Entamoeba invadens
APPSFNFSGGFQTEEKKEEVP

SEQ ID NO: 2927081 - protein, 19 aa, Entamoeba invadens
APQAFNFSGAFQTEEKKED

SEQ ID NO: 2927082 - protein, 23 aa, Entamoeba invadens
APQGKCYCLFEYQNPEYKDKVLA

SEQ ID NO: 2927083 - protein, 27 aa, Entamoeba invadens
APQGSPLMAGTSFVFDQSDFKREENEI

SEQ ID NO: 2927084 - protein, 24 aa, Entamoeba invadens
APQIFRLSFMGKEPIFCVYTQSQN

SEQ ID NO: 2927085 - protein, 28 aa, Entamoeba invadens
APQLCMGNLRLAHYLAQYGSTMLGTVRK

SEQ ID NO: 2927086 - protein, 17 aa, Entamoeba invadens
APQPWEHLVGLKEDEDL

SEQ ID NO: 2927087 - protein, 18 aa, Entamoeba invadens
APQSLKIITVDNCDNFEK

SEQ ID NO: 2927088 - protein, 25 aa, Entamoeba invadens
APQTPGELAWYFVKVINYNQGILLN

SEQ ID NO: 2927089 - protein, 23 aa, Entamoeba invadens
APQVKYFAFDFHKECANSKYENV

SEQ ID NO: 2927090 - protein, 25 aa, Entamoeba invadens
APREYVCDLSRFKALEKVGVCNCSN

SEQ ID NO: 2927091 - protein, 19 aa, Entamoeba invadens
APRKTEFNLIPTAKQPLKE

SEQ ID NO: 2927092 - protein, 19 aa, Entamoeba invadens
APRVAPFRYCQSLSQFDMP

SEQ ID NO: 2927093 - protein, 24 aa, Entamoeba invadens
APSGTWCKVFKVTAPFMESTPPSV

SEQ ID NO: 2927094 - protein, 21 aa, Entamoeba invadens
APSKARFSILDLYKTPEKEVI

SEQ ID NO: 2927095 - protein, 18 aa, Entamoeba invadens
APSPLNRKSPEERMRRML

SEQ ID NO: 2927096 - protein, 20 aa, Entamoeba invadens
APSRKVASKADRRKQSIQIQ

SEQ ID NO: 2927097 - protein, 17 aa, Entamoeba invadens
APTELGKIASYYYLTNE

SEQ ID NO: 2927098 - protein, 26 aa, Entamoeba invadens
APTGCGKTLTALLCMLREVKMRIHDL

SEQ ID NO: 2927099 - protein, 23 aa, Entamoeba invadens
APVDFVDFVDLCFEYDAKNRPSC

SEQ ID NO: 2927100 - protein, 23 aa, Entamoeba invadens
APVIDYSYPIHRIFNCKKENVIY

SEQ ID NO: 2927101 - protein, 23 aa, Entamoeba invadens
APVIDYSYPIHRLFNCKKENVIY

SEQ ID NO: 2927102 - protein, 25 aa, Entamoeba invadens
APVKKFKISNCYELTSVTFLNQKVT

SEQ ID NO: 2927103 - protein, 24 aa, Entamoeba invadens
APVPEKWPQVVKVATIHGGYGKTV

SEQ ID NO: 2927104 - protein, 18 aa, Entamoeba invadens
APVPHNLYQVFVETAPSS

SEQ ID NO: 2927105 - protein, 18 aa, Entamoeba invadens
APVQGMLFGIQLQPLPPP

SEQ ID NO: 2927106 - protein, 18 aa, Entamoeba invadens
AQAFVKKVIENFKDCTFY

SEQ ID NO: 2927107 - protein, 25 aa, Entamoeba invadens
AQAKQRSVCLSDFYQSQKAFNIVFT

SEQ ID NO: 2927108 - protein, 17 aa, Entamoeba invadens
AQALCPCNGIVDMDFES

SEQ ID NO: 2927109 - protein, 21 aa, Entamoeba invadens
AQAYFRRFFAKNEMNALKKKS

SEQ ID NO: 2927110 - protein, 23 aa, Entamoeba invadens
AQCGITMKQLNTWFSNYRSRSKK

SEQ ID NO: 2927111 - protein, 20 aa, Entamoeba invadens
AQCLCPCGAIKDFDMSEYKG

SEQ ID NO: 2927112 - protein, 24 aa, Entamoeba invadens
AQCPHCKHEFCKKCLCVCHPGKTC

SEQ ID NO: 2927113 - protein, 25 aa, Entamoeba invadens
AQCPHCKHEFCKKCLCVCHPGKTCE

SEQ ID NO: 2927114 - protein, 17 aa, Entamoeba invadens
AQCVFVKKVKYWKIHSV

SEQ ID NO: 2927115 - protein, 22 aa, Entamoeba invadens
AQDARFATNLQRVAHRAELDAV

SEQ ID NO: 2927116 - protein, 23 aa, Entamoeba invadens
AQDFLKDIEFLSGLNHNNIVLYM

SEQ ID NO: 2927117 - protein, 17 aa, Entamoeba invadens
AQDLSTSFEKLFWNEEK

SEQ ID NO: 2927118 - protein, 32 aa, Entamoeba invadens
AQEKLILEQLCLKYCIFITLFVDNTATLEKTI

SEQ ID NO: 2927119 - protein, 25 aa, Entamoeba invadens
AQENFSITLIEIFFKELFLSQENFK

SEQ ID NO: 2927120 - protein, 36 aa, Entamoeba invadens
AQEVTRLFIPILVYRYLCSPTPYIMAATLEIYNSVI

SEQ ID NO: 2927121 - protein, 24 aa, Entamoeba invadens
AQFFPGMAGMGGFEQRSRGPRKGQ

SEQ ID NO: 2927122 - protein, 34 aa, Entamoeba invadens
AQFLLFLDVRMSLHVYRILRPFRLLEIDSIPNTY

SEQ ID NO: 2927123 - protein, 17 aa, Entamoeba invadens
AQFLLSVYQDAEKEFMK

SEQ ID NO: 2927124 - protein, 25 aa, Entamoeba invadens
AQFPRIFGFDPMHLMLKQKSNDISE

SEQ ID NO: 2927125 - protein, 18 aa, Entamoeba invadens
AQFTFSEIVPKAIQCIRK

SEQ ID NO: 2927126 - protein, 17 aa, Entamoeba invadens
AQFVFYAHCDKKENKNY

SEQ ID NO: 2927127 - protein, 20 aa, Entamoeba invadens
AQFYIGTALSVQKAMMQGME

SEQ ID NO: 2927128 - protein, 19 aa, Entamoeba invadens
AQGIIICYDVTSPKSLTSV

SEQ ID NO: 2927129 - protein, 18 aa, Entamoeba invadens
AQGINCRSVIYKMGKELS

SEQ ID NO: 2927130 - protein, 17 aa, Entamoeba invadens
AQGKLKGSGRKLQVKMD

SEQ ID NO: 2927131 - protein, 30 aa, Entamoeba invadens
AQGLTCAYCGVFYHSDCFNDSTGFVKSVCS

SEQ ID NO: 2927132 - protein, 18 aa, Entamoeba invadens
AQGYGMPTAHDFDLLEEQ

SEQ ID NO: 2927133 - protein, 24 aa, Entamoeba invadens
AQHITWPSAVFVISSLAKSWREKD

SEQ ID NO: 2927134 - protein, 25 aa, Entamoeba invadens
AQHLSGIRSDGFWVLGNERFSLFAC

SEQ ID NO: 2927135 - protein, 22 aa, Entamoeba invadens
AQIFAWSGRSVGKMVYDYDKTP

SEQ ID NO: 2927136 - protein, 18 aa, Entamoeba invadens
AQIGWGKLGVDYVVESTG

SEQ ID NO: 2927137 - protein, 20 aa, Entamoeba invadens
AQIIEYRPLTALPTQIDPIL

SEQ ID NO: 2927138 - protein, 20 aa, Entamoeba invadens
AQIIISPNCELFSTNEETKN

SEQ ID NO: 2927139 - protein, 17 aa, Entamoeba invadens
AQIKGYLFQFLVGINYL

SEQ ID NO: 2927140 - protein, 17 aa, Entamoeba invadens
AQIPFSYLTLFTVIKCT

SEQ ID NO: 2927141 - protein, 25 aa, Entamoeba invadens
AQIVKDLKTIFGIKDEIKCFLRKEV

SEQ ID NO: 2927142 - protein, 18 aa, Entamoeba invadens
AQIYNFIAGWLAETFELD

SEQ ID NO: 2927143 - protein, 18 aa, Entamoeba invadens
AQIYNFIARWLAETFELG

SEQ ID NO: 2927144 - protein, 27 aa, Entamoeba invadens
AQKEDMAPCVLQINILKLTSVKYVKHP

SEQ ID NO: 2927145 - protein, 20 aa, Entamoeba invadens
AQKEYCFMKALYTKGMSVPV

SEQ ID NO: 2927146 - protein, 18 aa, Entamoeba invadens
AQKFFLKKNQVLIEPTED

SEQ ID NO: 2927147 - protein, 26 aa, Entamoeba invadens
AQKFPSPRLGLIEVVKGDPNKQNVNT

SEQ ID NO: 2927148 - protein, 18 aa, Entamoeba invadens
AQKIPVVYFRSQTPTKAE

SEQ ID NO: 2927149 - protein, 25 aa, Entamoeba invadens
AQKKEFKGGMSIIDLRDKNNVLTLL

SEQ ID NO: 2927150 - protein, 23 aa, Entamoeba invadens
AQKVFLCPLYDYHIKTHHLFPPF

SEQ ID NO: 2927151 - protein, 27 aa, Entamoeba invadens
AQLECAISAVFRSWMGRRAVDYRREFK

SEQ ID NO: 2927152 - protein, 19 aa, Entamoeba invadens
AQLELGRFVQPYNPTFQHT

SEQ ID NO: 2927153 - protein, 21 aa, Entamoeba invadens
AQLFLTILIEIVRNYEYIETN

SEQ ID NO: 2927154 - protein, 20 aa, Entamoeba invadens
AQLLKHFGVKMAQFEIHIVA

SEQ ID NO: 2927155 - protein, 21 aa, Entamoeba invadens
AQLLLFVCTEIKLLHINNNTM

SEQ ID NO: 2927156 - protein, 25 aa, Entamoeba invadens
AQLLNKFLVIFSHTEILMSILIAIR

SEQ ID NO: 2927157 - protein, 18 aa, Entamoeba invadens
AQLPEEFECLRFELESVY

SEQ ID NO: 2927158 - protein, 31 aa, Entamoeba invadens
AQLSAKAKSAGICPVCGNAHIDISSVEKKEK

SEQ ID NO: 2927159 - protein, 23 aa, Entamoeba invadens
AQLSPALLCKDVSKSQLRFSQDP

SEQ ID NO: 2927160 - protein, 21 aa, Entamoeba invadens
AQLWSRAEMAFLELKAKHHVA

SEQ ID NO: 2927161 - protein, 22 aa, Entamoeba invadens
AQLYLLFEFVELYRSSKRIVIN

SEQ ID NO: 2927162 - protein, 27 aa, Entamoeba invadens
AQLYLLFEFVELYRSSKRIVINGTSIT

SEQ ID NO: 2927163 - protein, 26 aa, Entamoeba invadens
AQMETFKWPECFTEEMKENGFLKLKV

SEQ ID NO: 2927164 - protein, 17 aa, Entamoeba invadens
AQMFMEFSQKEKILNGK

SEQ ID NO: 2927165 - protein, 23 aa, Entamoeba invadens
AQMIKHKFKVIVPLEKCPPQGVG

SEQ ID NO: 2927166 - protein, 26 aa, Entamoeba invadens
AQMKELYKANVEFIRSLKEDIPDEAR

SEQ ID NO: 2927167 - protein, 17 aa, Entamoeba invadens
AQMKGKRPSTALGSSAS

SEQ ID NO: 2927168 - protein, 23 aa, Entamoeba invadens
AQMNFFVCQRVDVNYHINSLMSS

SEQ ID NO: 2927169 - protein, 21 aa, Entamoeba invadens
AQMSLKEACTLVLSKKKNVSP

SEQ ID NO: 2927170 - protein, 23 aa, Entamoeba invadens
AQNRMSWVSNIIPGFGGVYSCCS

SEQ ID NO: 2927171 - protein, 21 aa, Entamoeba invadens
AQNRWKHISIFGNSYGAYLAL

SEQ ID NO: 2927172 - protein, 23 aa, Entamoeba invadens
AQNYPNLFLFYSPVMRNNFMKEI

SEQ ID NO: 2927173 - protein, 22 aa, Entamoeba invadens
AQPGEFHFKFSTTSDIWSYGVT

SEQ ID NO: 2927174 - protein, 25 aa, Entamoeba invadens
AQPKPFRAVPCQPKPLKIDQQDVQP

SEQ ID NO: 2927175 - protein, 22 aa, Entamoeba invadens
AQPKYNFPLNIDKMSVNEATNA

SEQ ID NO: 2927176 - protein, 19 aa, Entamoeba invadens
AQPNAFGATGAFTQQPTSS

SEQ ID NO: 2927177 - protein, 18 aa, Entamoeba invadens
AQQDGFTFGRVEEYRDGS

SEQ ID NO: 2927178 - protein, 31 aa, Entamoeba invadens
AQQGFLLGILMCYDFTIKIRRLYKKGHKTHQ

SEQ ID NO: 2927179 - protein, 20 aa, Entamoeba invadens
AQQIYAFDFYLLRKMTISDF

SEQ ID NO: 2927180 - protein, 27 aa, Entamoeba invadens
AQQKIETRSGLKFEKVIFDGEKDDFSP

SEQ ID NO: 2927181 - protein, 17 aa, Entamoeba invadens
AQQKIGFYLPNPRKEPV

SEQ ID NO: 2927182 - protein, 32 aa, Entamoeba invadens
AQQLELLVRCVFKIPEAFVSELDFLKNNNKTI

SEQ ID NO: 2927183 - protein, 18 aa, Entamoeba invadens
AQQLLCFDDENAFPQESK

SEQ ID NO: 2927184 - protein, 31 aa, Entamoeba invadens
AQQSFLIAILIRNGFYIKIKRLYKRGKTTAQ

SEQ ID NO: 2927185 - protein, 17 aa, Entamoeba invadens
AQRGWSDGEFDVICATI

SEQ ID NO: 2927186 - protein, 18 aa, Entamoeba invadens
AQRLGCLFTEVTSVSGDT

SEQ ID NO: 2927187 - protein, 26 aa, Entamoeba invadens
AQRLKWSEFFIHPFIQRCRDYKIDEI

SEQ ID NO: 2927188 - protein, 18 aa, Entamoeba invadens
AQRVALILCLGKPADVYL

SEQ ID NO: 2927189 - protein, 19 aa, Entamoeba invadens
AQSCIAALIANFPKDMITT

SEQ ID NO: 2927190 - protein, 19 aa, Entamoeba invadens
AQSLFSFVINDKFKVHSDE

SEQ ID NO: 2927191 - protein, 19 aa, Entamoeba invadens
AQSMFKLDVERYIRNLDLN

SEQ ID NO: 2927192 - protein, 18 aa, Entamoeba invadens
AQSSFFFNIVPEFMTKED

SEQ ID NO: 2927193 - protein, 28 aa, Entamoeba invadens
AQSSMGMSLRFISVGGISVSMSNNTEAG

SEQ ID NO: 2927194 - protein, 22 aa, Entamoeba invadens
AQSYLRLLSFYLPMDSVGFAPN

SEQ ID NO: 2927195 - protein, 20 aa, Entamoeba invadens
AQSYLRLLSYYVTLDSADVS

SEQ ID NO: 2927196 - protein, 23 aa, Entamoeba invadens
AQTNWRFSAGKGLLCSLNNLGVS

SEQ ID NO: 2927197 - protein, 24 aa, Entamoeba invadens
AQTPEIKEGVLFCSDVQPHHATST

SEQ ID NO: 2927198 - protein, 17 aa, Entamoeba invadens
AQTPKYTVSTPMQMAPP

SEQ ID NO: 2927199 - protein, 17 aa, Entamoeba invadens
AQVGYNFKSQTEKYEGK

SEQ ID NO: 2927200 - protein, 19 aa, Entamoeba invadens
AQVILRFIVQSGHSTLPKS

SEQ ID NO: 2927201 - protein, 18 aa, Entamoeba invadens
AQVMKGVSLFISVGLNSS

SEQ ID NO: 2927202 - protein, 23 aa, Entamoeba invadens
AQVVKHRWFPKLVKTRNPIVISV

SEQ ID NO: 2927203 - protein, 18 aa, Entamoeba invadens
AQVVLRFIVQCGHSALPK

SEQ ID NO: 2927204 - protein, 18 aa, Entamoeba invadens
AQYEKLHKFMVLMNEAGE

SEQ ID NO: 2927205 - protein, 28 aa, Entamoeba invadens
AQYFQRRGNIDLAINILRRGRNAVDCPL

SEQ ID NO: 2927206 - protein, 19 aa, Entamoeba invadens
AQYFSSEIIVISRLLLLTL

SEQ ID NO: 2927207 - protein, 23 aa, Entamoeba invadens
AQYKSYKNMAAWLRTLYENGMEF

SEQ ID NO: 2927208 - protein, 23 aa, Entamoeba invadens
AQYTRLVGWKSLTRTELVQLLRE

SEQ ID NO: 2927209 - protein, 17 aa, Entamoeba invadens
ARAIAQFQKRSTDLLNL

SEQ ID NO: 2927210 - protein, 19 aa, Entamoeba invadens
ARAKNCGFIEFKNVEDAKR

SEQ ID NO: 2927211 - protein, 21 aa, Entamoeba invadens
ARASFQIYVYSMWEIYMSAFF

SEQ ID NO: 2927212 - protein, 24 aa, Entamoeba invadens
ARDGCGRTPLHIAVVCDDAVMVKR

SEQ ID NO: 2927213 - protein, 18 aa, Entamoeba invadens
ARDIQIPEAFNFIEENIA

SEQ ID NO: 2927214 - protein, 18 aa, Entamoeba invadens
ARDMSDCKIQVESLKTQI

SEQ ID NO: 2927215 - protein, 18 aa, Entamoeba invadens
ARDWWATLYDFSKYQYSS

SEQ ID NO: 2927216 - protein, 17 aa, Entamoeba invadens
AREALTEEVSILEQKRT

SEQ ID NO: 2927217 - protein, 25 aa, Entamoeba invadens
AREEMADLIKIWPGIGPIQVIGLLD

SEQ ID NO: 2927218 - protein, 23 aa, Entamoeba invadens
AREFLKKPIEIICGGRSHVSDTI

SEQ ID NO: 2927219 - protein, 19 aa, Entamoeba invadens
AREGADLLIEKKFIKEFPQ

SEQ ID NO: 2927220 - protein, 25 aa, Entamoeba invadens
AREIKEQFGYVSLNFNQEVLNQLQV

SEQ ID NO: 2927221 - protein, 29 aa, Entamoeba invadens
ARELFLLLREVFFVFTPPKIFGASLDDIL

SEQ ID NO: 2927222 - protein, 24 aa, Entamoeba invadens
ARESWIGKELFEVMTSEFGVSNEK

SEQ ID NO: 2927223 - protein, 27 aa, Entamoeba invadens
AREYETWKANTIYLYSFLTTYETPFPA

SEQ ID NO: 2927224 - protein, 20 aa, Entamoeba invadens
ARFEAVLEIPSLIQKVQIPN

SEQ ID NO: 2927225 - protein, 17 aa, Entamoeba invadens
ARFGTVFSDDGMVALKV

SEQ ID NO: 2927226 - protein, 24 aa, Entamoeba invadens
ARFPSQLKQAIIKGVRPCWSEDRY

SEQ ID NO: 2927227 - protein, 21 aa, Entamoeba invadens
ARFSGCTEYVIAVSLERCSVF

SEQ ID NO: 2927228 - protein, 18 aa, Entamoeba invadens
ARGDGGRMAKDMSDRFEG

SEQ ID NO: 2927229 - protein, 25 aa, Entamoeba invadens
ARGEIALRGRKALKINTTQKSQQNE

SEQ ID NO: 2927230 - protein, 20 aa, Entamoeba invadens
ARGIKACFYHAELTPEERQK

SEQ ID NO: 2927231 - protein, 22 aa, Entamoeba invadens
ARGKGVPGYEIVKNIFVETTPF

SEQ ID NO: 2927232 - protein, 22 aa, Entamoeba invadens
ARGNTPFLYAIGAGHFEIAQFF

SEQ ID NO: 2927233 - protein, 28 aa, Entamoeba invadens
ARGPYRYHYEAGMPYNLLENIEKNGVDR

SEQ ID NO: 2927234 - protein, 24 aa, Entamoeba invadens
ARGTGCTVCGVCSKEAVVANTMNV

SEQ ID NO: 2927235 - protein, 23 aa, Entamoeba invadens
ARHAKDADCTVFIQNVNKKLDYK

SEQ ID NO: 2927236 - protein, 20 aa, Entamoeba invadens
ARIEDCIVEFIWNYNSVSIV

SEQ ID NO: 2927237 - protein, 18 aa, Entamoeba invadens
ARIEGAEVIKMMQAAQCE

SEQ ID NO: 2927238 - protein, 17 aa, Entamoeba invadens
ARIKYTITKVEQKSDFV

SEQ ID NO: 2927239 - protein, 18 aa, Entamoeba invadens
ARINKCINVINAEVIGLE

SEQ ID NO: 2927240 - protein, 19 aa, Entamoeba invadens
ARINREVLLMRTVKSNYII

SEQ ID NO: 2927241 - protein, 20 aa, Entamoeba invadens
ARIQTVYLVLSLVVSNYYEV

SEQ ID NO: 2927242 - protein, 18 aa, Entamoeba invadens
ARIRKLMKIATDKKHVKT

SEQ ID NO: 2927243 - protein, 19 aa, Entamoeba invadens
ARITLKRPKKVSMRTSTIP

SEQ ID NO: 2927244 - protein, 22 aa, Entamoeba invadens
ARKEFLRRMTAIGAQIEYDDVA

SEQ ID NO: 2927245 - protein, 17 aa, Entamoeba invadens
ARKEIPLYLDLNDTGLL

SEQ ID NO: 2927246 - protein, 18 aa, Entamoeba invadens
ARKEYDLDMQKIQREFVK

SEQ ID NO: 2927247 - protein, 18 aa, Entamoeba invadens
ARKKLPAFEKKNENVKKN

SEQ ID NO: 2927248 - protein, 28 aa, Entamoeba invadens
ARKLESIEIPKLVQAIGYNTFKTCEALS

SEQ ID NO: 2927249 - protein, 21 aa, Entamoeba invadens
ARKLFVYAFECNTGYRQTRIE

SEQ ID NO: 2927250 - protein, 23 aa, Entamoeba invadens
ARKMAQKRIKGQLERRAKVVREI

SEQ ID NO: 2927251 - protein, 25 aa, Entamoeba invadens
ARKNICPNMSLAKIIAILENLSVEV

SEQ ID NO: 2927252 - protein, 29 aa, Entamoeba invadens
ARKNPNNFYCCVFCANILEEEGRVEEAIT

SEQ ID NO: 2927253 - protein, 20 aa, Entamoeba invadens
ARKSVKMVRFSSAQVDGKDY

SEQ ID NO: 2927254 - protein, 28 aa, Entamoeba invadens
ARKVPYGNGCLVCKVGYYKKGADCVLCD

SEQ ID NO: 2927255 - protein, 17 aa, Entamoeba invadens
ARLANTLGKKEKRKERQ

SEQ ID NO: 2927256 - protein, 20 aa, Entamoeba invadens
ARLDVAPGCVTNEFQFKEKM

SEQ ID NO: 2927257 - protein, 21 aa, Entamoeba invadens
ARLDVCPHLTDDLLINILKDV

SEQ ID NO: 2927258 - protein, 17 aa, Entamoeba invadens
ARLFAEQRFDFLDSSVL

SEQ ID NO: 2927259 - protein, 17 aa, Entamoeba invadens
ARLFCFACNSFIMNYKF

SEQ ID NO: 2927260 - protein, 20 aa, Entamoeba invadens
ARLGKRTVTLGLKMEFKDGE

SEQ ID NO: 2927261 - protein, 21 aa, Entamoeba invadens
ARLHQFRRAMLFSYDEKTGLI

SEQ ID NO: 2927262 - protein, 20 aa, Entamoeba invadens
ARLKLNMKGVHFHVGSDSQN

SEQ ID NO: 2927263 - protein, 17 aa, Entamoeba invadens
ARLLFEMIQSLKKEGQE

SEQ ID NO: 2927264 - protein, 17 aa, Entamoeba invadens
ARLLFEMIQTLKKEGEQ

SEQ ID NO: 2927265 - protein, 23 aa, Entamoeba invadens
ARLPISENVVCLGRKVLTVNQVF

SEQ ID NO: 2927266 - protein, 21 aa, Entamoeba invadens
ARLQEKACYVMNQLFEEDSTV

SEQ ID NO: 2927267 - protein, 19 aa, Entamoeba invadens
ARLQKDFAEYEAIPGCIFE

SEQ ID NO: 2927268 - protein, 26 aa, Entamoeba invadens
ARLSAEQIRALKRCTLVSHATLSRDS

SEQ ID NO: 2927269 - protein, 20 aa, Entamoeba invadens
ARLSSRRKARREAREKQENA

SEQ ID NO: 2927270 - protein, 21 aa, Entamoeba invadens
ARLVVDGTFTSPVFMKPLDLG

SEQ ID NO: 2927271 - protein, 24 aa, Entamoeba invadens
ARLYDLFKSIPFHLFSTTTPETPK

SEQ ID NO: 2927272 - protein, 26 aa, Entamoeba invadens
ARMKVPLRRMIDACYKITYDQRYYCE

SEQ ID NO: 2927273 - protein, 20 aa, Entamoeba invadens
ARMMLFESVLMTFKGKLSYQ

SEQ ID NO: 2927274 - protein, 21 aa, Entamoeba invadens
ARNKIRLLAVDSHDTMIVAVL

SEQ ID NO: 2927275 - protein, 18 aa, Entamoeba invadens
ARNNWRKALLDSMNHCGS

SEQ ID NO: 2927276 - protein, 23 aa, Entamoeba invadens
ARPDEAISWGKIKVGAPYVKILS

SEQ ID NO: 2927277 - protein, 22 aa, Entamoeba invadens
ARPEIIKSFFEQAGIVLTRKEH

SEQ ID NO: 2927278 - protein, 20 aa, Entamoeba invadens
ARPEPKWVHLSRYLSKTSNN

SEQ ID NO: 2927279 - protein, 17 aa, Entamoeba invadens
ARPLNALETKEKIIPQL

SEQ ID NO: 2927280 - protein, 25 aa, Entamoeba invadens
ARQLFKNDLRGVETYIHQILKNQQK

SEQ ID NO: 2927281 - protein, 27 aa, Entamoeba invadens
ARQLFPRSTRFVVPFNFALLTDAELSK

SEQ ID NO: 2927282 - protein, 17 aa, Entamoeba invadens
ARQMTVIDFGVYKNTKP

SEQ ID NO: 2927283 - protein, 31 aa, Entamoeba invadens
ARRAEHERILLMKKKFTDLGALQTWLNTIGK

SEQ ID NO: 2927284 - protein, 25 aa, Entamoeba invadens
ARRLVKYQKIHLMTSKNFAMILGPL

SEQ ID NO: 2927285 - protein, 18 aa, Entamoeba invadens
ARSAFKLIDVERDFHIFS

SEQ ID NO: 2927286 - protein, 24 aa, Entamoeba invadens
ARSAMKNKNFKLARENLENLKKML

SEQ ID NO: 2927287 - protein, 18 aa, Entamoeba invadens
ARSATPCIIFIDEIDTVV

SEQ ID NO: 2927288 - protein, 24 aa, Entamoeba invadens
ARSEFAIRYYKYWAEYAQKDCPKD

SEQ ID NO: 2927289 - protein, 22 aa, Entamoeba invadens
ARSGDLELVLLLMKYGANKSVE

SEQ ID NO: 2927290 - protein, 18 aa, Entamoeba invadens
ARSGFGFLEDINSSLNEY

SEQ ID NO: 2927291 - protein, 22 aa, Entamoeba invadens
ARSKERCVKSIKAHGSDVNVIN

SEQ ID NO: 2927292 - protein, 22 aa, Entamoeba invadens
ARSKGVPGYEVVRNIYVEMTPF

SEQ ID NO: 2927293 - protein, 19 aa, Entamoeba invadens
ARSNRLVFTKDFFENIAKI

SEQ ID NO: 2927294 - protein, 21 aa, Entamoeba invadens
ARSSCVTGMSGICVTTANETT

SEQ ID NO: 2927295 - protein, 21 aa, Entamoeba invadens
ARSYEQWAWTSPDLCGIPKIA

SEQ ID NO: 2927296 - protein, 20 aa, Entamoeba invadens
ARTAIGIAKVLMKWSDGRKK

SEQ ID NO: 2927297 - protein, 19 aa, Entamoeba invadens
ARTNNGLIYLIKSFGYDFV

SEQ ID NO: 2927298 - protein, 18 aa, Entamoeba invadens
ARTSCLAFIEAMNKRIDQ

SEQ ID NO: 2927299 - protein, 21 aa, Entamoeba invadens
ARTSGALGFEKFETIFIQPVQ

SEQ ID NO: 2927300 - protein, 25 aa, Entamoeba invadens
ARTTLRARVANTIQRMLDCVKNVKI

SEQ ID NO: 2927301 - protein, 18 aa, Entamoeba invadens
ARTVGRKEKWKIKHIMNL

SEQ ID NO: 2927302 - protein, 20 aa, Entamoeba invadens
ARTYLSTDIFRRILEDYFGY

SEQ ID NO: 2927303 - protein, 18 aa, Entamoeba invadens
ARTYSLPDGTSFTIEEER

SEQ ID NO: 2927304 - protein, 18 aa, Entamoeba invadens
ARVEKRRLAIIKMLNSSV

SEQ ID NO: 2927305 - protein, 22 aa, Entamoeba invadens
ARVFCADSKVYAMCFLGKSLVL

SEQ ID NO: 2927306 - protein, 23 aa, Entamoeba invadens
ARVFLARAYCLLGLNKEADKVLQ

SEQ ID NO: 2927307 - protein, 24 aa, Entamoeba invadens
ARVIDFGSACFSTYTLYTYIQSRH

SEQ ID NO: 2927308 - protein, 26 aa, Entamoeba invadens
ARVKGISFHPTRNWVLTSLHNGKVQL

SEQ ID NO: 2927309 - protein, 18 aa, Entamoeba invadens
ARVLEPYSSVELSHVAEL

SEQ ID NO: 2927310 - protein, 20 aa, Entamoeba invadens
ARVMRMCKHPNLVDYFDYFE

SEQ ID NO: 2927311 - protein, 22 aa, Entamoeba invadens
ARYKKCYKTELTALKCNFCGEH

SEQ ID NO: 2927312 - protein, 29 aa, Entamoeba invadens
ARYPLPECEKLPYGWGIGSDRGEIYFINW

SEQ ID NO: 2927313 - protein, 27 aa, Entamoeba invadens
ASAAGFFGCQGRNIFKQNPLTIENLDE

SEQ ID NO: 2927314 - protein, 17 aa, Entamoeba invadens
ASAEKRTAEEINSLCAI

SEQ ID NO: 2927315 - protein, 26 aa, Entamoeba invadens
ASAFENCLRLVLKIQEKDVILKENCF

SEQ ID NO: 2927316 - protein, 18 aa, Entamoeba invadens
ASAQTALGFDFCTKTYEP

SEQ ID NO: 2927317 - protein, 17 aa, Entamoeba invadens
ASARPDEAISWGKIKVG

SEQ ID NO: 2927318 - protein, 19 aa, Entamoeba invadens
ASCCSSCQKLLEVTLPTSL

SEQ ID NO: 2927319 - protein, 23 aa, Entamoeba invadens
ASCDMKFAISLRDLITLSPKNTK

SEQ ID NO: 2927320 - protein, 19 aa, Entamoeba invadens
ASCGKGIMCSCEDRVVRYF

SEQ ID NO: 2927321 - protein, 18 aa, Entamoeba invadens
ASCVEYRYTTSLGSIEKV

SEQ ID NO: 2927322 - protein, 24 aa, Entamoeba invadens
ASDLPKRTPKALVENLKGVRGFVI

SEQ ID NO: 2927323 - protein, 25 aa, Entamoeba invadens
ASEEYIKRVFHFFVNTLKRMQQENN

SEQ ID NO: 2927324 - protein, 22 aa, Entamoeba invadens
ASEGGKGRCWVLDPIDGTLGFL

SEQ ID NO: 2927325 - protein, 39 aa, Entamoeba invadens
ASEKRFLVCRAFPFILEFCYGFPCVIPYVENSIYDAVAI

SEQ ID NO: 2927326 - protein, 31 aa, Entamoeba invadens
ASEKRKLDSIKMSFSSFMASTEKYISKLEKT

SEQ ID NO: 2927327 - protein, 20 aa, Entamoeba invadens
ASELRRILTTMGDKLTDSEV

SEQ ID NO: 2927328 - protein, 18 aa, Entamoeba invadens
ASFGYSVPPPIQINTTAI

SEQ ID NO: 2927329 - protein, 17 aa, Entamoeba invadens
ASFKHCLTSFHKFWKKA

SEQ ID NO: 2927330 - protein, 17 aa, Entamoeba invadens
ASFKRSGIISIFKDKIS

SEQ ID NO: 2927331 - protein, 18 aa, Entamoeba invadens
ASFYERAGMVECIGSPKR

SEQ ID NO: 2927332 - protein, 24 aa, Entamoeba invadens
ASGDKSMMRWSYIKLVDLVPSPNQ

SEQ ID NO: 2927333 - protein, 17 aa, Entamoeba invadens
ASGELFKKTEEKLSHIV

SEQ ID NO: 2927334 - protein, 22 aa, Entamoeba invadens
ASGHFLLVSIFEVTANGVTSDA

SEQ ID NO: 2927335 - protein, 23 aa, Entamoeba invadens
ASGIKFKAVSTVTVINIRYLSTL

SEQ ID NO: 2927336 - protein, 24 aa, Entamoeba invadens
ASGIWQQLSSSLIKSHASKKPPGK

SEQ ID NO: 2927337 - protein, 18 aa, Entamoeba invadens
ASGKRLSVREGISPEAYR

SEQ ID NO: 2927338 - protein, 24 aa, Entamoeba invadens
ASGNMKCVNFLLKHTKTVLSQNSM

SEQ ID NO: 2927339 - protein, 18 aa, Entamoeba invadens
ASHFFEVFLDSVPTDLAD

SEQ ID NO: 2927340 - protein, 21 aa, Entamoeba invadens
ASHFFRKSVSYELEYAFLNEF

SEQ ID NO: 2927341 - protein, 24 aa, Entamoeba invadens
ASHRRAIVIFLSWTLQIPYNKAMS

SEQ ID NO: 2927342 - protein, 20 aa, Entamoeba invadens
ASHTLKSWYVVAKGEEKYIF

SEQ ID NO: 2927343 - protein, 29 aa, Entamoeba invadens
ASIICRSERSSICKPRISTVPVTQKDFEI

SEQ ID NO: 2927344 - protein, 17 aa, Entamoeba invadens
ASIIKHKILRKVFDIFF

SEQ ID NO: 2927345 - protein, 18 aa, Entamoeba invadens
ASIKNGYVINGIFSGDVE

SEQ ID NO: 2927346 - protein, 17 aa, Entamoeba invadens
ASIKVVLSSNEKIGKDS

SEQ ID NO: 2927347 - protein, 19 aa, Entamoeba invadens
ASIPAMLKSKICRLVSIVK

SEQ ID NO: 2927348 - protein, 28 aa, Entamoeba invadens
ASIRRIGWIGFYVCIRKTPAEFIDDKIA

SEQ ID NO: 2927349 - protein, 29 aa, Entamoeba invadens
ASITKKLTICFKELLLILRYTPRVEGDTG

SEQ ID NO: 2927350 - protein, 18 aa, Entamoeba invadens
ASKDCVKPFPPFLRPTRT

SEQ ID NO: 2927351 - protein, 23 aa, Entamoeba invadens
ASKFFPKITRIVLYSSENRASPN

SEQ ID NO: 2927352 - protein, 19 aa, Entamoeba invadens
ASKFSDLLIQNVDMKKSID

SEQ ID NO: 2927353 - protein, 19 aa, Entamoeba invadens
ASKGILCGVMRGVCGGVNG

SEQ ID NO: 2927354 - protein, 23 aa, Entamoeba invadens
ASKKDLRKIWTLADSGRNGSLNA

SEQ ID NO: 2927355 - protein, 17 aa, Entamoeba invadens
ASKKELYDTDWVDESVQ

SEQ ID NO: 2927356 - protein, 27 aa, Entamoeba invadens
ASKKLKYPLEFYAFVRQDVLDFIHSTF

SEQ ID NO: 2927357 - protein, 23 aa, Entamoeba invadens
ASKMSLKNCEFVNVFKQWIRESY

SEQ ID NO: 2927358 - protein, 29 aa, Entamoeba invadens
ASKTPFIFLVDAFRYNVEYVKTQKRVYYE

SEQ ID NO: 2927359 - protein, 25 aa, Entamoeba invadens
ASKVFWVCRECGFIFEGTQAPKNCP

SEQ ID NO: 2927360 - protein, 20 aa, Entamoeba invadens
ASKWKEIAVLKDVEQSKTVK

SEQ ID NO: 2927361 - protein, 18 aa, Entamoeba invadens
ASLARGGIIIMEGIHCLD

SEQ ID NO: 2927362 - protein, 18 aa, Entamoeba invadens
ASLARVIQEEVEWSENHS

SEQ ID NO: 2927363 - protein, 17 aa, Entamoeba invadens
ASLDFLEILFSDLLFGD

SEQ ID NO: 2927364 - protein, 23 aa, Entamoeba invadens
ASLDKAHTARRCIIFSDLAELHM

SEQ ID NO: 2927365 - protein, 20 aa, Entamoeba invadens
ASLILAIAFDCHVAIPVDTH

SEQ ID NO: 2927366 - protein, 19 aa, Entamoeba invadens
ASLKMWKTKDVLIDKYKIN

SEQ ID NO: 2927367 - protein, 19 aa, Entamoeba invadens
ASLLIPFVTVFNTIKQQKM

SEQ ID NO: 2927368 - protein, 19 aa, Entamoeba invadens
ASLLLPLFLQYVQNNISSE

SEQ ID NO: 2927369 - protein, 22 aa, Entamoeba invadens
ASLLRVGFKGDFDIVFDTVRKR

SEQ ID NO: 2927370 - protein, 19 aa, Entamoeba invadens
ASLRRVVLFDLQKGATLKK

SEQ ID NO: 2927371 - protein, 17 aa, Entamoeba invadens
ASLSLILFNEEKTTYYS

SEQ ID NO: 2927372 - protein, 25 aa, Entamoeba invadens
ASLVPEFFYNLYLFPHLEFIGFIKC

SEQ ID NO: 2927373 - protein, 26 aa, Entamoeba invadens
ASLWPIPQFFKYDGKKCVGQPLCPAS

SEQ ID NO: 2927374 - protein, 18 aa, Entamoeba invadens
ASMCMKDKFNKMANEFKK

SEQ ID NO: 2927375 - protein, 24 aa, Entamoeba invadens
ASMRLRRRISLSVMMQNDLKKTLE

SEQ ID NO: 2927376 - protein, 22 aa, Entamoeba invadens
ASNEFLYPWNVVDFVTKGKRLP

SEQ ID NO: 2927377 - protein, 21 aa, Entamoeba invadens
ASNIYRSFVVEFWVEELKSEE

SEQ ID NO: 2927378 - protein, 17 aa, Entamoeba invadens
ASNPLFIRCKKVELLRC

SEQ ID NO: 2927379 - protein, 25 aa, Entamoeba invadens
ASNSDAYIRFGIFERAMSVIQKYKT

SEQ ID NO: 2927380 - protein, 22 aa, Entamoeba invadens
ASPDFFEKFGITIMDKKATLNV

SEQ ID NO: 2927381 - protein, 22 aa, Entamoeba invadens
ASPDGCICCVMTKVLMNVASFL

SEQ ID NO: 2927382 - protein, 19 aa, Entamoeba invadens
ASPRLLAAYQNRTSFTKSS

SEQ ID NO: 2927383 - protein, 19 aa, Entamoeba invadens
ASPSQQLFPPIPQQQQEQQ

SEQ ID NO: 2927384 - protein, 19 aa, Entamoeba invadens
ASPSYPAVKPTGAVSEKVF

SEQ ID NO: 2927385 - protein, 18 aa, Entamoeba invadens
ASQFLIDQNVSFQFFFHS

SEQ ID NO: 2927386 - protein, 19 aa, Entamoeba invadens
ASQQEQRPAITIAGESVTH

SEQ ID NO: 2927387 - protein, 26 aa, Entamoeba invadens
ASQWGNGRPGWHIECSCMASNVFGDT

SEQ ID NO: 2927388 - protein, 29 aa, Entamoeba invadens
ASRAFWVWPANNWCLLQFGFCGDDISIAK

SEQ ID NO: 2927389 - protein, 39 aa, Entamoeba invadens
ASRDCEKCVEISPSFAKGFGRLAVARVKLGKLNEAKEAI

SEQ ID NO: 2927390 - protein, 26 aa, Entamoeba invadens
ASRLIKRSMDALSFSVLLEVAAENSI

SEQ ID NO: 2927391 - protein, 18 aa, Entamoeba invadens
ASRLKYIHEYRLTDNSIM

SEQ ID NO: 2927392 - protein, 21 aa, Entamoeba invadens
ASRRIAIGVINGFDNINKSVP

SEQ ID NO: 2927393 - protein, 21 aa, Entamoeba invadens
ASRRVKTEFLIQMNGVGNSME

SEQ ID NO: 2927394 - protein, 23 aa, Entamoeba invadens
ASRYHKAPELLFEYTYYDYGIDV

SEQ ID NO: 2927395 - protein, 17 aa, Entamoeba invadens
ASSGMFAVSDWLLGVKR

SEQ ID NO: 2927396 - protein, 24 aa, Entamoeba invadens
ASSIKEKLLRLDIATIKTNAVFAE

SEQ ID NO: 2927397 - protein, 25 aa, Entamoeba invadens
ASSKPRFQIDLSIGIFNSKVNKGTK

SEQ ID NO: 2927398 - protein, 21 aa, Entamoeba invadens
ASSLIKEFPVNYNKCYEISTV

SEQ ID NO: 2927399 - protein, 18 aa, Entamoeba invadens
ASSLSIKRNLYLEDGTKT

SEQ ID NO: 2927400 - protein, 17 aa, Entamoeba invadens
ASSMAFEKLCVADVQRH

SEQ ID NO: 2927401 - protein, 30 aa, Entamoeba invadens
ASSSRKVPIGGFGMPCMLIAEELNKRKSGR

SEQ ID NO: 2927402 - protein, 25 aa, Entamoeba invadens
ASSSWKEKYRITSFTSSIQRRNNSR

SEQ ID NO: 2927403 - protein, 19 aa, Entamoeba invadens
ASSTFCLCVGHFQHKFIRY

SEQ ID NO: 2927404 - protein, 25 aa, Entamoeba invadens
ASSVGECFKALIVVGDITTINELLF

SEQ ID NO: 2927405 - protein, 23 aa, Entamoeba invadens
ASSWKEILEVLYVASLDENIDLV

SEQ ID NO: 2927406 - protein, 24 aa, Entamoeba invadens
ASTPELLQFHSFFFSSENSLVTLI

SEQ ID NO: 2927407 - protein, 21 aa, Entamoeba invadens
ASTRDGRRLAMTIGNDVRFFE

SEQ ID NO: 2927408 - protein, 17 aa, Entamoeba invadens
ASTTSVSSATGFKNGTM

SEQ ID NO: 2927409 - protein, 24 aa, Entamoeba invadens
ASTYPELFILKCFKETRDNTIREK

SEQ ID NO: 2927410 - protein, 19 aa, Entamoeba invadens
ASVAYLLEYWRKVPNVFSE

SEQ ID NO: 2927411 - protein, 27 aa, Entamoeba invadens
ASVCVNPSWVSLCHELLNNSGVMVCTV

SEQ ID NO: 2927412 - protein, 25 aa, Entamoeba invadens
ASVFPKAKLSNFALCESIDGTSPQD

SEQ ID NO: 2927413 - protein, 26 aa, Entamoeba invadens
ASVFPKVKIANFALCDAIQTKTALVP

SEQ ID NO: 2927414 - protein, 18 aa, Entamoeba invadens
ASVFRFFLLNNTFNKAFI

SEQ ID NO: 2927415 - protein, 19 aa, Entamoeba invadens
ASVISICIEYSRYQTIFSL

SEQ ID NO: 2927416 - protein, 17 aa, Entamoeba invadens
ASVKCKIPPRSGQEEYL

SEQ ID NO: 2927417 - protein, 17 aa, Entamoeba invadens
ASVMKWAKQLPIEKYSQ

SEQ ID NO: 2927418 - protein, 18 aa, Entamoeba invadens
ASVMNFKSLTALLQMIET

SEQ ID NO: 2927419 - protein, 27 aa, Entamoeba invadens
ASVMSGITCSLRFPGQLNQDLRKLYVN

SEQ ID NO: 2927420 - protein, 31 aa, Entamoeba invadens
ASVRKKKSSFKRGRTPLRERPLPPLPLTDRK

SEQ ID NO: 2927421 - protein, 24 aa, Entamoeba invadens
ASVSRKIRFDFVIETPRIDIRDVT

SEQ ID NO: 2927422 - protein, 19 aa, Entamoeba invadens
ASVTKFGVLCFKGCSSLTS

SEQ ID NO: 2927423 - protein, 18 aa, Entamoeba invadens
ASVVLAYLMKHNTWNFKT

SEQ ID NO: 2927424 - protein, 23 aa, Entamoeba invadens
ASWKERCFEAEKCIDMDEIKTLK

SEQ ID NO: 2927425 - protein, 27 aa, Entamoeba invadens
ATAEDEKRFEAEFKPMVTVVEPEIEQP

SEQ ID NO: 2927426 - protein, 24 aa, Entamoeba invadens
ATAFVEWCYCGTSLALIRATPFTS

SEQ ID NO: 2927427 - protein, 23 aa, Entamoeba invadens
ATAHPECKIGVLVKGSVGEADYM

SEQ ID NO: 2927428 - protein, 26 aa, Entamoeba invadens
ATAMCVLHPSKFIIDRLVEELKVPKY

SEQ ID NO: 2927429 - protein, 35 aa, Entamoeba invadens
ATASYVARCFFLKVGKTFIKRYFTKFFTNFFNEKL

SEQ ID NO: 2927430 - protein, 18 aa, Entamoeba invadens
ATCDFFGYCIDFNNTFNR

SEQ ID NO: 2927431 - protein, 18 aa, Entamoeba invadens
ATCSPDFSRKCVTCDSGY

SEQ ID NO: 2927432 - protein, 17 aa, Entamoeba invadens
ATCVLKGILSWLIHNVW

SEQ ID NO: 2927433 - protein, 20 aa, Entamoeba invadens
ATDCGGRIGPFVDKNFPDLR

SEQ ID NO: 2927434 - protein, 17 aa, Entamoeba invadens
ATEAPCNEGVFLNNLLY

SEQ ID NO: 2927435 - protein, 19 aa, Entamoeba invadens
ATEDWLSMRCEILSQILTR

SEQ ID NO: 2927436 - protein, 26 aa, Entamoeba invadens
ATEEHEIFWLFKLVMDVISPYYLHDE

SEQ ID NO: 2927437 - protein, 18 aa, Entamoeba invadens
ATERCFESQWGLAIESFL

SEQ ID NO: 2927438 - protein, 19 aa, Entamoeba invadens
ATESLSFINSFYMVIASSP

SEQ ID NO: 2927439 - protein, 23 aa, Entamoeba invadens
ATESVRLLAWERCFVNNYKELYI

SEQ ID NO: 2927440 - protein, 18 aa, Entamoeba invadens
ATETLSFSCDDFLFENFV

SEQ ID NO: 2927441 - protein, 25 aa, Entamoeba invadens
ATFCDGYLAKFCHLKSIEVKSSVTE

SEQ ID NO: 2927442 - protein, 17 aa, Entamoeba invadens
ATFDVICFQEVFKELNW

SEQ ID NO: 2927443 - protein, 29 aa, Entamoeba invadens
ATFLDYSSLWKWVSCLDFGAENGPNEEKK

SEQ ID NO: 2927444 - protein, 26 aa, Entamoeba invadens
ATFNFFKINVWFEVDYKMYKTSENDK

SEQ ID NO: 2927445 - protein, 24 aa, Entamoeba invadens
ATFQRICSYLSYTDLKNLSCSSKQ

SEQ ID NO: 2927446 - protein, 17 aa, Entamoeba invadens
ATFVVLFNLFDKGPKGG

SEQ ID NO: 2927447 - protein, 19 aa, Entamoeba invadens
ATGCGNPFCTNKLCKSNPS

SEQ ID NO: 2927448 - protein, 29 aa, Entamoeba invadens
ATGESKFPFVLRIRSAYGMNQFSMVMNCL

SEQ ID NO: 2927449 - protein, 25 aa, Entamoeba invadens
ATGKRSLQHFEIIKEISFVSKTVNW

SEQ ID NO: 2927450 - protein, 18 aa, Entamoeba invadens
ATGKTCIVHRYITNEFTN

SEQ ID NO: 2927451 - protein, 29 aa, Entamoeba invadens
ATGNCKVKEIIFEQFLKFKDVAILLQDSF

SEQ ID NO: 2927452 - protein, 30 aa, Entamoeba invadens
ATGNCPKIDFPESVTFLSICQRSAADLSQL

SEQ ID NO: 2927453 - protein, 25 aa, Entamoeba invadens
ATGRPLKTALWFTDSLDILPITILT

SEQ ID NO: 2927454 - protein, 22 aa, Entamoeba invadens
ATGSEMNNGFVLSRKADNMKLA

SEQ ID NO: 2927455 - protein, 27 aa, Entamoeba invadens
ATHNFSVGKLCFFAPEVLQDVRLGKIH

SEQ ID NO: 2927456 - protein, 19 aa, Entamoeba invadens
ATHTKMVFDEGLPVNEKVI

SEQ ID NO: 2927457 - protein, 26 aa, Entamoeba invadens
ATIKKSCKGPNDFFYAFVEYGKEEEA

SEQ ID NO: 2927458 - protein, 18 aa, Entamoeba invadens
ATIKPELRGDFSSLLEIM

SEQ ID NO: 2927459 - protein, 25 aa, Entamoeba invadens
ATIPNALEFAKWIAKIHDQVCHVVY

SEQ ID NO: 2927460 - protein, 24 aa, Entamoeba invadens
ATKCDIKGKFIRLFTQKGIIKLNI

SEQ ID NO: 2927461 - protein, 19 aa, Entamoeba invadens
ATKGVNWEAVKTSLEQKID

SEQ ID NO: 2927462 - protein, 19 aa, Entamoeba invadens
ATKKCLRIEIDLYTLPEDL

SEQ ID NO: 2927463 - protein, 22 aa, Entamoeba invadens
ATKRLILTCLIKMAKELPDIRP

SEQ ID NO: 2927464 - protein, 19 aa, Entamoeba invadens
ATKRLKMNPFYSKKEPSTK

SEQ ID NO: 2927465 - protein, 26 aa, Entamoeba invadens
ATKSKEGFFPKVFAVYKLETQKRGRP

SEQ ID NO: 2927466 - protein, 24 aa, Entamoeba invadens
ATKSNFWKWLRKDWIEAHGGLQAV

SEQ ID NO: 2927467 - protein, 21 aa, Entamoeba invadens
ATKVFIAVCDVEYSRFEEWEI

SEQ ID NO: 2927468 - protein, 18 aa, Entamoeba invadens
ATKYPEWKKTHHPEERYW

SEQ ID NO: 2927469 - protein, 22 aa, Entamoeba invadens
ATLAEKILQFANIENAQKELQD

SEQ ID NO: 2927470 - protein, 20 aa, Entamoeba invadens
ATLETKWSIFSKEQNMSKAQ

SEQ ID NO: 2927471 - protein, 26 aa, Entamoeba invadens
ATLFLLYAHALIDYTFYHSSYNYFLS

SEQ ID NO: 2927472 - protein, 20 aa, Entamoeba invadens
ATLIEEAECLAIQTLKDVFE

SEQ ID NO: 2927473 - protein, 17 aa, Entamoeba invadens
ATLIKSIILFDSEKSQK

SEQ ID NO: 2927474 - protein, 23 aa, Entamoeba invadens
ATLNSALCVINFASQLIERHNKP

SEQ ID NO: 2927475 - protein, 19 aa, Entamoeba invadens
ATLQCGRCTIKDGKCVSSN

SEQ ID NO: 2927476 - protein, 24 aa, Entamoeba invadens
ATLREMKGIISVSCALRKKIVLPA

SEQ ID NO: 2927477 - protein, 25 aa, Entamoeba invadens
ATLTPEVLEIASLLMKNPLRILTKR

SEQ ID NO: 2927478 - protein, 33 aa, Entamoeba invadens
ATMVCIRWMMGAMFLIKACKPLIEKNTADNKEI

SEQ ID NO: 2927479 - protein, 23 aa, Entamoeba invadens
ATNEIFPTFKFIGDRAKTEVEHL

SEQ ID NO: 2927480 - protein, 29 aa, Entamoeba invadens
ATNGIPFAKSEAVWKIVNEVMDCIGELGP

SEQ ID NO: 2927481 - protein, 33 aa, Entamoeba invadens
ATNMRDNISFFKRNLCVCFGRVALVNPNLVAPH

SEQ ID NO: 2927482 - protein, 26 aa, Entamoeba invadens
ATNNNNCKFVWLSLLRNSFYTHCKSI

SEQ ID NO: 2927483 - protein, 31 aa, Entamoeba invadens
ATNRPDCIDPAMLRPGRLDRLISVELPNENA

SEQ ID NO: 2927484 - protein, 27 aa, Entamoeba invadens
ATNSLYCYLCACIDVLIKKLDWNFLIG

SEQ ID NO: 2927485 - protein, 18 aa, Entamoeba invadens
ATNYACSVMRKDTTLLFE

SEQ ID NO: 2927486 - protein, 21 aa, Entamoeba invadens
ATPHYCFVALLVLANKKKVKL

SEQ ID NO: 2927487 - protein, 25 aa, Entamoeba invadens
ATPTGESARGWWIMMQEDGKKMRGD

SEQ ID NO: 2927488 - protein, 22 aa, Entamoeba invadens
ATPTQKCLRLFGTHRDGLIRPF

SEQ ID NO: 2927489 - protein, 24 aa, Entamoeba invadens
ATQKEISEVFGFSAIPADKLVGVL

SEQ ID NO: 2927490 - protein, 17 aa, Entamoeba invadens
ATQRWIKESELKKASSS

SEQ ID NO: 2927491 - protein, 29 aa, Entamoeba invadens
ATQTLEICRKVKHVVFMSGTPAVNRPLEL

SEQ ID NO: 2927492 - protein, 19 aa, Entamoeba invadens
ATRKKLLKRGIRRAEIKSY

SEQ ID NO: 2927493 - protein, 23 aa, Entamoeba invadens
ATRRLKFDGFRTVVQSEAVVENG

SEQ ID NO: 2927494 - protein, 25 aa, Entamoeba invadens
ATRVAKSFLGKVGRKYLLDTYKKFV

SEQ ID NO: 2927495 - protein, 26 aa, Entamoeba invadens
ATRVQIPLQLAWAISIHKSQGMTLER

SEQ ID NO: 2927496 - protein, 17 aa, Entamoeba invadens
ATSAGCIVVAVASDLKS

SEQ ID NO: 2927497 - protein, 17 aa, Entamoeba invadens
ATSFAVLLVYEMYPSNL

SEQ ID NO: 2927498 - protein, 20 aa, Entamoeba invadens
ATSKASRRCDINSLIEMTND

SEQ ID NO: 2927499 - protein, 23 aa, Entamoeba invadens
ATSKLKRCFLLIKRSDWTYQTCY

SEQ ID NO: 2927500 - protein, 17 aa, Entamoeba invadens
ATSLRSCCVALFKRKEF

SEQ ID NO: 2927501 - protein, 25 aa, Entamoeba invadens
ATSRLKLYANHSLCDGRTIANLYQV

SEQ ID NO: 2927502 - protein, 24 aa, Entamoeba invadens
ATSRWASSHISNFVSILYFTLRAL

SEQ ID NO: 2927503 - protein, 21 aa, Entamoeba invadens
ATSSLPLFKIVHIKNDEFLFE

SEQ ID NO: 2927504 - protein, 18 aa, Entamoeba invadens
ATSVCARGIDVKGLELVI

SEQ ID NO: 2927505 - protein, 18 aa, Entamoeba invadens
ATTFPVLLEEQIVDTNNV

SEQ ID NO: 2927506 - protein, 24 aa, Entamoeba invadens
ATTLCGTPGYIAPEIVERMENTSY

SEQ ID NO: 2927507 - protein, 19 aa, Entamoeba invadens
ATTLCLWILKSLKQLNPDQ

SEQ ID NO: 2927508 - protein, 19 aa, Entamoeba invadens
ATTLMARYAVFKAESEDSR

SEQ ID NO: 2927509 - protein, 18 aa, Entamoeba invadens
ATTLPGLIFFNHGQFDGL

SEQ ID NO: 2927510 - protein, 19 aa, Entamoeba invadens
ATTPTRAWVIFSHGNAEDI

SEQ ID NO: 2927511 - protein, 23 aa, Entamoeba invadens
ATTRIETMLADACVCIHSQDERY

SEQ ID NO: 2927512 - protein, 27 aa, Entamoeba invadens
ATTYLDAPSFRFSKLSKIFGDLLSNVD

SEQ ID NO: 2927513 - protein, 18 aa, Entamoeba invadens
ATVCIECEGGFSVSSNGT

SEQ ID NO: 2927514 - protein, 25 aa, Entamoeba invadens
ATVCSARTILECLDLGMYPSWDADN

SEQ ID NO: 2927515 - protein, 19 aa, Entamoeba invadens
ATVKTPGKDRWTLPGKVSD

SEQ ID NO: 2927516 - protein, 18 aa, Entamoeba invadens
ATVLGFNEVELFLFNEGI

SEQ ID NO: 2927517 - protein, 24 aa, Entamoeba invadens
ATVLSRFDMIFMIRDVPNKENDSR

SEQ ID NO: 2927518 - protein, 24 aa, Entamoeba invadens
ATVPKGATLIPVLNYLNFLNVVDL

SEQ ID NO: 2927519 - protein, 18 aa, Entamoeba invadens
ATVRVVVIQMEYCSGSNL

SEQ ID NO: 2927520 - protein, 19 aa, Entamoeba invadens
ATVSLNLSDYVILGNETRQ

SEQ ID NO: 2927521 - protein, 17 aa, Entamoeba invadens
ATVVFVPLRMMRKIRPI

SEQ ID NO: 2927522 - protein, 24 aa, Entamoeba invadens
ATYILRHIFNLYSYSECNNCSVKI

SEQ ID NO: 2927523 - protein, 22 aa, Entamoeba invadens
ATYMRMLQCIQRVGEAAESRVY

SEQ ID NO: 2927524 - protein, 20 aa, Entamoeba invadens
ATYRLAVLILTSMKQIDVAL

SEQ ID NO: 2927525 - protein, 24 aa, Entamoeba invadens
ATYTIHFKPPFPIEKYAVSCPPSS

SEQ ID NO: 2927526 - protein, 19 aa, Entamoeba invadens
AVAATKSPIVFIGTGEKVN

SEQ ID NO: 2927527 - protein, 23 aa, Entamoeba invadens
AVAKLPWKLLRHPVNHGLIKNFE

SEQ ID NO: 2927528 - protein, 20 aa, Entamoeba invadens
AVALSTKFLYIGTSIGEMLV

SEQ ID NO: 2927529 - protein, 27 aa, Entamoeba invadens
AVAQRMTCMMLRYGLEKKNWPKGVFQQ

SEQ ID NO: 2927530 - protein, 23 aa, Entamoeba invadens
AVASCALGGMVYGMDELIQPWRY

SEQ ID NO: 2927531 - protein, 20 aa, Entamoeba invadens
AVAVKFSLLLGIKAIGLLLF

SEQ ID NO: 2927532 - protein, 19 aa, Entamoeba invadens
AVCESVAHPVAYYRNNLNG

SEQ ID NO: 2927533 - protein, 20 aa, Entamoeba invadens
AVCMCEPREILLLPCRHVAM

SEQ ID NO: 2927534 - protein, 21 aa, Entamoeba invadens
AVDEFEYLGTVFLVSYLYTEG

SEQ ID NO: 2927535 - protein, 25 aa, Entamoeba invadens
AVDGKIDKNDFVFLMETIKYADEDD

SEQ ID NO: 2927536 - protein, 18 aa, Entamoeba invadens
AVDHCNRKVLSFEIEPVT

SEQ ID NO: 2927537 - protein, 23 aa, Entamoeba invadens
AVECLKEVSVFWTLDKASDEKWK

SEQ ID NO: 2927538 - protein, 18 aa, Entamoeba invadens
AVECNRCLDGYGFVSSTT

SEQ ID NO: 2927539 - protein, 17 aa, Entamoeba invadens
AVEECFRLNCNERPIIK

SEQ ID NO: 2927540 - protein, 18 aa, Entamoeba invadens
AVEGKSNVAIVVMNNDEV

SEQ ID NO: 2927541 - protein, 25 aa, Entamoeba invadens
AVEKEFPVKQIVAGKVQITQQQLVM

SEQ ID NO: 2927542 - protein, 26 aa, Entamoeba invadens
AVENCVKRATLASFIVRSENDKRKLR

SEQ ID NO: 2927543 - protein, 19 aa, Entamoeba invadens
AVEPLEYTYGLSHYVSQCF

SEQ ID NO: 2927544 - protein, 25 aa, Entamoeba invadens
AVEVCKRFNSKITMSADNTAVGLGE

SEQ ID NO: 2927545 - protein, 21 aa, Entamoeba invadens
AVEVLNSYFLILNIEIVTTRV

SEQ ID NO: 2927546 - protein, 24 aa, Entamoeba invadens
AVEYKGKWYRANVVVVAPKANILK

SEQ ID NO: 2927547 - protein, 24 aa, Entamoeba invadens
AVEYLGVVLLPFIERPKLLKYLRP

SEQ ID NO: 2927548 - protein, 21 aa, Entamoeba invadens
AVFFKGVGVLFARVSSEIILP

SEQ ID NO: 2927549 - protein, 28 aa, Entamoeba invadens
AVFGGCNFGHIRGCSMIDIHETEFVQKD

SEQ ID NO: 2927550 - protein, 17 aa, Entamoeba invadens
AVFKGCTDLRYITLPNT

SEQ ID NO: 2927551 - protein, 17 aa, Entamoeba invadens
AVFKKNSKWSLIKPVPQ

SEQ ID NO: 2927552 - protein, 17 aa, Entamoeba invadens
AVFLGVFRGKLSEGIDF

SEQ ID NO: 2927553 - protein, 36 aa, Entamoeba invadens
AVFPKNLRCNGLFDKKRLYNFYGLYNSAYVPGIVKI

SEQ ID NO: 2927554 - protein, 22 aa, Entamoeba invadens
AVFPPELLKTFSNAQNRNKNIG

SEQ ID NO: 2927555 - protein, 23 aa, Entamoeba invadens
AVGKRLPLQCAGAILLSEVCETK

SEQ ID NO: 2927556 - protein, 19 aa, Entamoeba invadens
AVGKSCLLLQFQDKRFQPI

SEQ ID NO: 2927557 - protein, 18 aa, Entamoeba invadens
AVGNRLTFNYVFNKKYDK

SEQ ID NO: 2927558 - protein, 26 aa, Entamoeba invadens
AVHELCVKAAIIAGGIFDGVGVETEM

SEQ ID NO: 2927559 - protein, 17 aa, Entamoeba invadens
AVHICPVARIVVMLEKP

SEQ ID NO: 2927560 - protein, 24 aa, Entamoeba invadens
AVHKPKFDTSRCCYLSKWIGVKED

SEQ ID NO: 2927561 - protein, 20 aa, Entamoeba invadens
AVHYVEKMLDVFGLENKKVS

SEQ ID NO: 2927562 - protein, 17 aa, Entamoeba invadens
AVIFPETFDNTILSKII

SEQ ID NO: 2927563 - protein, 27 aa, Entamoeba invadens
AVIPFFKSRRGLLKTYGKDVENIVDKV

SEQ ID NO: 2927564 - protein, 29 aa, Entamoeba invadens
AVISLRYRVPFKQVYFFDTFNCFVSSESK

SEQ ID NO: 2927565 - protein, 21 aa, Entamoeba invadens
AVIWGNLAVCYWNLGNEPLAF

SEQ ID NO: 2927566 - protein, 18 aa, Entamoeba invadens
AVKALLSFSEFREKYFDV

SEQ ID NO: 2927567 - protein, 24 aa, Entamoeba invadens
AVKCQMGGATHCVRAVSDKVCYVG

SEQ ID NO: 2927568 - protein, 24 aa, Entamoeba invadens
AVKDRISVVEGMVLDQGYLSRYFT

SEQ ID NO: 2927569 - protein, 19 aa, Entamoeba invadens
AVKEGKCDQSVLDQLTAQP

SEQ ID NO: 2927570 - protein, 20 aa, Entamoeba invadens
AVKEKTLGRVLRVMSDAMAY

SEQ ID NO: 2927571 - protein, 18 aa, Entamoeba invadens
AVKELLVKVDKEITVDPI

SEQ ID NO: 2927572 - protein, 20 aa, Entamoeba invadens
AVKEMMMYKIYVNIKNTPPA

SEQ ID NO: 2927573 - protein, 25 aa, Entamoeba invadens
AVKFKGAYDNLKLVRPIGDPKDVPT

SEQ ID NO: 2927574 - protein, 28 aa, Entamoeba invadens
AVKKSSWRFPIPLFRSIQYLIENDAQHM

SEQ ID NO: 2927575 - protein, 24 aa, Entamoeba invadens
AVKSLKINPWFSSPYSIMKFHTHF

SEQ ID NO: 2927576 - protein, 24 aa, Entamoeba invadens
AVKTKMPIFLPRFKRYEISQKELG

SEQ ID NO: 2927577 - protein, 17 aa, Entamoeba invadens
AVKYIECSALTQQNLKL

SEQ ID NO: 2927578 - protein, 19 aa, Entamoeba invadens
AVLCEILRAVLKKKVVTQG

SEQ ID NO: 2927579 - protein, 18 aa, Entamoeba invadens
AVLDMKWDRQRKEEIYGL

SEQ ID NO: 2927580 - protein, 30 aa, Entamoeba invadens
AVLETYRGKMEWFIGIKFEQIFPDMEDKKK

SEQ ID NO: 2927581 - protein, 18 aa, Entamoeba invadens
AVLFHIFSAQSIPKSILL

SEQ ID NO: 2927582 - protein, 25 aa, Entamoeba invadens
AVLFSVCGGAFWIGKKNAAVRGECN

SEQ ID NO: 2927583 - protein, 23 aa, Entamoeba invadens
AVLKELIKYTVFHLDIVYKDHHA

SEQ ID NO: 2927584 - protein, 23 aa, Entamoeba invadens
AVLKELWMKLFDIFTSHNTLPNN

SEQ ID NO: 2927585 - protein, 27 aa, Entamoeba invadens
AVLKKEFYRIIVWFNVDFETVDRNKSR

SEQ ID NO: 2927586 - protein, 24 aa, Entamoeba invadens
AVLKRCLSTISIKKYEIVIYEMED

SEQ ID NO: 2927587 - protein, 17 aa, Entamoeba invadens
AVLMRFENMRMEKAVEE

SEQ ID NO: 2927588 - protein, 18 aa, Entamoeba invadens
AVLMRVWSTSDFGSMILM

SEQ ID NO: 2927589 - protein, 23 aa, Entamoeba invadens
AVLPDFCFFKCTTLQSVTFPSHI

SEQ ID NO: 2927590 - protein, 23 aa, Entamoeba invadens
AVLPDFCFFKCTTLQSVTFPSRI

SEQ ID NO: 2927591 - protein, 21 aa, Entamoeba invadens
AVLPKSCFEGCYSLQSVTFPS

SEQ ID NO: 2927592 - protein, 17 aa, Entamoeba invadens
AVLPLFGYEKGNVLRKG

SEQ ID NO: 2927593 - protein, 21 aa, Entamoeba invadens
AVMKIEVGIKVIELSLKKKED

SEQ ID NO: 2927594 - protein, 17 aa, Entamoeba invadens
AVMPVKNILLLYKRENL

SEQ ID NO: 2927595 - protein, 19 aa, Entamoeba invadens
AVMRRCLVESEINDNGERM

SEQ ID NO: 2927596 - protein, 20 aa, Entamoeba invadens
AVNALFSILFEKRLYPQMKM

SEQ ID NO: 2927597 - protein, 17 aa, Entamoeba invadens
AVNDWSVGSSVFNDKIC

SEQ ID NO: 2927598 - protein, 23 aa, Entamoeba invadens
AVNGKISGWIRIRSKTQSLAINL

SEQ ID NO: 2927599 - protein, 25 aa, Entamoeba invadens
AVNQFGKNNWRSVEEVVMTRTRKQC

SEQ ID NO: 2927600 - protein, 24 aa, Entamoeba invadens
AVNTLKWSVGRLIDMVDLNISSRD

SEQ ID NO: 2927601 - protein, 23 aa, Entamoeba invadens
AVPILLKYFKLVFEDNVAETVRC

SEQ ID NO: 2927602 - protein, 20 aa, Entamoeba invadens
AVPKRVKRKKVTEFEEVKNF

SEQ ID NO: 2927603 - protein, 17 aa, Entamoeba invadens
AVPPRRQRSIAMHGSHH

SEQ ID NO: 2927604 - protein, 24 aa, Entamoeba invadens
AVPVLFRPAKREIATRDLLAQNAQ

SEQ ID NO: 2927605 - protein, 25 aa, Entamoeba invadens
AVQEGNWRFVEWLLEHGADATKRDL

SEQ ID NO: 2927606 - protein, 27 aa, Entamoeba invadens
AVQHCLLYPGLPCFGYITEKRVVPVSH

SEQ ID NO: 2927607 - protein, 22 aa, Entamoeba invadens
AVQKDSDCKFMIGNDRASLLKI

SEQ ID NO: 2927608 - protein, 24 aa, Entamoeba invadens
AVQRFKIPAVKSFDGCLKNNAKLL

SEQ ID NO: 2927609 - protein, 25 aa, Entamoeba invadens
AVQYPELYKKFGIYTPAGILLYGPP

SEQ ID NO: 2927610 - protein, 17 aa, Entamoeba invadens
AVREFCASIIMKQSDEV

SEQ ID NO: 2927611 - protein, 23 aa, Entamoeba invadens
AVRVKIGEELLNWNQKGMENSQK

SEQ ID NO: 2927612 - protein, 25 aa, Entamoeba invadens
AVSAETAKKWWVFAKESILAEVRKK

SEQ ID NO: 2927613 - protein, 19 aa, Entamoeba invadens
AVSFLKLTNYLTLKHVIFH

SEQ ID NO: 2927614 - protein, 18 aa, Entamoeba invadens
AVSNYGGCPHYIQMEESF

SEQ ID NO: 2927615 - protein, 18 aa, Entamoeba invadens
AVSTRLRKVSSNDIPLIE

SEQ ID NO: 2927616 - protein, 26 aa, Entamoeba invadens
AVSVQDKWKWISVLRAVSINSAREKL

SEQ ID NO: 2927617 - protein, 19 aa, Entamoeba invadens
AVSVSNVFSSSPLHKTKYI

SEQ ID NO: 2927618 - protein, 20 aa, Entamoeba invadens
AVSVYCFHFFIPKLESQEHQ

SEQ ID NO: 2927619 - protein, 17 aa, Entamoeba invadens
AVSYEFYLQMKAFGYTF

SEQ ID NO: 2927620 - protein, 17 aa, Entamoeba invadens
AVTHMRGLVSLRKALGP

SEQ ID NO: 2927621 - protein, 18 aa, Entamoeba invadens
AVTHYKFGVLYRKAGQTT

SEQ ID NO: 2927622 - protein, 25 aa, Entamoeba invadens
AVTKFQCQIAIDWSVLIDSDYALLT

SEQ ID NO: 2927623 - protein, 19 aa, Entamoeba invadens
AVTLDLIKYIFAIGSDSLG

SEQ ID NO: 2927624 - protein, 24 aa, Entamoeba invadens
AVTYKQRVKMCVDVATGMSYLASL

SEQ ID NO: 2927625 - protein, 25 aa, Entamoeba invadens
AVVEISSKFQIHFIDFTGLGISIFG

SEQ ID NO: 2927626 - protein, 19 aa, Entamoeba invadens
AVVGSRSSIDKVLMVGGSC

SEQ ID NO: 2927627 - protein, 28 aa, Entamoeba invadens
AVVPIEDFGELTLRFERNRSVNDEYYQI

SEQ ID NO: 2927628 - protein, 19 aa, Entamoeba invadens
AVVQDIMLGNAMGKKRRQG

SEQ ID NO: 2927629 - protein, 28 aa, Entamoeba invadens
AVVSRCALSIVLAGIKFGIPVVTTKGMF

SEQ ID NO: 2927630 - protein, 17 aa, Entamoeba invadens
AVVSRWLVSFLSTDLPL

SEQ ID NO: 2927631 - protein, 22 aa, Entamoeba invadens
AVVTCLEHGFTLTLPLMPLTIT

SEQ ID NO: 2927632 - protein, 24 aa, Entamoeba invadens
AVVTKMFYRIVVWVNVDYTTSKNN

SEQ ID NO: 2927633 - protein, 25 aa, Entamoeba invadens
AVVYFFKGICGVAIKELEAPIPRIN

SEQ ID NO: 2927634 - protein, 24 aa, Entamoeba invadens
AVWPAYKDTLAEEMWGFTNTFIEF

SEQ ID NO: 2927635 - protein, 22 aa, Entamoeba invadens
AVWRNCYLTAAFELRLKSGNEE

SEQ ID NO: 2927636 - protein, 20 aa, Entamoeba invadens
AVWRNIYLTGAFELEHPIQK

SEQ ID NO: 2927637 - protein, 17 aa, Entamoeba invadens
AVYDNYREFLAITRRLE

SEQ ID NO: 2927638 - protein, 25 aa, Entamoeba invadens
AVYEIAKTCDLLMVILDATNEDEQT

SEQ ID NO: 2927639 - protein, 22 aa, Entamoeba invadens
AVYELYVKIVLNPFYELQSPIE

SEQ ID NO: 2927640 - protein, 25 aa, Entamoeba invadens
AVYIRNCLMTSKMLETMTPDFFDKF

SEQ ID NO: 2927641 - protein, 24 aa, Entamoeba invadens
AVYKKGKDGSRCFPNSYTESKNAF

SEQ ID NO: 2927642 - protein, 23 aa, Entamoeba invadens
AVYPIICRLLVLPGASSLFFREG

SEQ ID NO: 2927643 - protein, 27 aa, Entamoeba invadens
AWCYPLHCSSADFLALFLNRFQLAMSI

SEQ ID NO: 2927644 - protein, 24 aa, Entamoeba invadens
AWELKTTDFKIIFTETKKGIYDAF

SEQ ID NO: 2927645 - protein, 25 aa, Entamoeba invadens
AWESAKCVQCNMCSLYCPHAAIRPF

SEQ ID NO: 2927646 - protein, 24 aa, Entamoeba invadens
AWETWPPHVITFFKKMSSEWDAEK

SEQ ID NO: 2927647 - protein, 17 aa, Entamoeba invadens
AWFIDKYLAKFCELKEI

SEQ ID NO: 2927648 - protein, 19 aa, Entamoeba invadens
AWGEKGQLLKLTRSGCYYR

SEQ ID NO: 2927649 - protein, 25 aa, Entamoeba invadens
AWGYGIRYQYGMFKQQIAQGYQIET

SEQ ID NO: 2927650 - protein, 19 aa, Entamoeba invadens
AWHPARVGWTVARAGQMGF

SEQ ID NO: 2927651 - protein, 21 aa, Entamoeba invadens
AWLTDPNAFLFKVIEGPNPKT

SEQ ID NO: 2927652 - protein, 24 aa, Entamoeba invadens
AWMPERRILEHISLDREWNKLDII

SEQ ID NO: 2927653 - protein, 19 aa, Entamoeba invadens
AWPLGEIDSELSFSLEVIQ

SEQ ID NO: 2927654 - protein, 17 aa, Entamoeba invadens
AWSGMGVYVNDVGNTID

SEQ ID NO: 2927655 - protein, 18 aa, Entamoeba invadens
AWSKKSGKKTVKEEGKQD

SEQ ID NO: 2927656 - protein, 18 aa, Entamoeba invadens
AWVKNKNVFTCFEVDPDD

SEQ ID NO: 2927657 - protein, 21 aa, Entamoeba invadens
AWWNGYCERYSKLFEMSVEKY

SEQ ID NO: 2927658 - protein, 32 aa, Entamoeba invadens
AWYAAEIVESLNLKCWVKFGPRHNQLLPIDKI

SEQ ID NO: 2927659 - protein, 22 aa, Entamoeba invadens
AWYGAACLGALGSTVELYATKD

SEQ ID NO: 2927660 - protein, 18 aa, Entamoeba invadens
AYADFLRDLRHVTIVPEK

SEQ ID NO: 2927661 - protein, 23 aa, Entamoeba invadens
AYADLCVSLSLFISANFTQLLLN

SEQ ID NO: 2927662 - protein, 29 aa, Entamoeba invadens
AYAPLIIPKEIWRLCDFVRPHLAEPNLLS

SEQ ID NO: 2927663 - protein, 21 aa, Entamoeba invadens
AYAREQFKYPWAIAEFVISGK

SEQ ID NO: 2927664 - protein, 18 aa, Entamoeba invadens
AYCVLKNLMHLIEFTLKG

SEQ ID NO: 2927665 - protein, 27 aa, Entamoeba invadens
AYDGFFSFMCAAKSYAKTKAEPIFSNI

SEQ ID NO: 2927666 - protein, 18 aa, Entamoeba invadens
AYDKGWRVRMEFKKYQVD

SEQ ID NO: 2927667 - protein, 25 aa, Entamoeba invadens
AYDSYRRFVSLFGRIALGVEDAVYD

SEQ ID NO: 2927668 - protein, 19 aa, Entamoeba invadens
AYDYLKFSNELCVDRKRLD

SEQ ID NO: 2927669 - protein, 26 aa, Entamoeba invadens
AYEELKRTIEISAIFFDWDSEYQKCK

SEQ ID NO: 2927670 - protein, 23 aa, Entamoeba invadens
AYEEMHPGIVIQRFQSYLIMPIQ

SEQ ID NO: 2927671 - protein, 17 aa, Entamoeba invadens
AYEFVPPTRSSRYKPER

SEQ ID NO: 2927672 - protein, 19 aa, Entamoeba invadens
AYELLPLEKKRILFLKRWL

SEQ ID NO: 2927673 - protein, 18 aa, Entamoeba invadens
AYEMPLSVLMPGNVKEES

SEQ ID NO: 2927674 - protein, 21 aa, Entamoeba invadens
AYERGEIPWQEYMKDREGYIL

SEQ ID NO: 2927675 - protein, 24 aa, Entamoeba invadens
AYESCNACACFSAIVNESLARDLA

SEQ ID NO: 2927676 - protein, 25 aa, Entamoeba invadens
AYEVGKFCGVGNFAMVRQVRNIQEN

SEQ ID NO: 2927677 - protein, 18 aa, Entamoeba invadens
AYEYPGCYDKYIKSSDGF

SEQ ID NO: 2927678 - protein, 19 aa, Entamoeba invadens
AYFAYNICSSLDAPDLFNQ

SEQ ID NO: 2927679 - protein, 18 aa, Entamoeba invadens
AYFKQALEFTTLVSNEVP

SEQ ID NO: 2927680 - protein, 23 aa, Entamoeba invadens
AYFNNKIPFIYIAKYITDFPNVK

SEQ ID NO: 2927681 - protein, 18 aa, Entamoeba invadens
AYFPKFIYISNVLDTADE

SEQ ID NO: 2927682 - protein, 19 aa, Entamoeba invadens
AYGQLEMAKVVFKTDPSVI

SEQ ID NO: 2927683 - protein, 19 aa, Entamoeba invadens
AYGRLKMAQSLFMEDPSVL

SEQ ID NO: 2927684 - protein, 19 aa, Entamoeba invadens
AYGTFGMRNFGYFPICASG

SEQ ID NO: 2927685 - protein, 17 aa, Entamoeba invadens
AYGVSFSSIQPHGTTTT

SEQ ID NO: 2927686 - protein, 22 aa, Entamoeba invadens
AYHPLCFEGVTGLEKEVTYSPM

SEQ ID NO: 2927687 - protein, 21 aa, Entamoeba invadens
AYHSGVCAYGREFTFSDGGVF

SEQ ID NO: 2927688 - protein, 18 aa, Entamoeba invadens
AYHTLMKLKLPQYPIKTT

SEQ ID NO: 2927689 - protein, 19 aa, Entamoeba invadens
AYICDSCALFDINCLTCDS

SEQ ID NO: 2927690 - protein, 41 aa, Entamoeba invadens
AYICSRAEIFPNMVLHYNFTPTLFCCAYFIALDPSINALVL

SEQ ID NO: 2927691 - protein, 19 aa, Entamoeba invadens
AYIDFTYFTFIAVRFTMAG

SEQ ID NO: 2927692 - protein, 26 aa, Entamoeba invadens
AYIGSRLSFCSTFLKTNLFFNKTEIS

SEQ ID NO: 2927693 - protein, 18 aa, Entamoeba invadens
AYISFDKGVACDDLSKQS

SEQ ID NO: 2927694 - protein, 26 aa, Entamoeba invadens
AYKLLNMSYQILLEMQTTGPKSVAEL

SEQ ID NO: 2927695 - protein, 18 aa, Entamoeba invadens
AYKMFTSFVYPRRVFDVR

SEQ ID NO: 2927696 - protein, 17 aa, Entamoeba invadens
AYKRTTINLVTDFKNLV

SEQ ID NO: 2927697 - protein, 19 aa, Entamoeba invadens
AYLKKVLKPFAKKILSPII

SEQ ID NO: 2927698 - protein, 25 aa, Entamoeba invadens
AYLMFKNMWTYRQALTFVKSKRPII

SEQ ID NO: 2927699 - protein, 18 aa, Entamoeba invadens
AYLQPINGTVTWNQFGIA

SEQ ID NO: 2927700 - protein, 20 aa, Entamoeba invadens
AYLREWKGARPFNTSMQENI

SEQ ID NO: 2927701 - protein, 24 aa, Entamoeba invadens
AYLYYRRGLKFSWDYISQGESAEF

SEQ ID NO: 2927702 - protein, 26 aa, Entamoeba invadens
AYMQCWKQLESFGAFDHLKTIYKDAI

SEQ ID NO: 2927703 - protein, 26 aa, Entamoeba invadens
AYNELKETIDIAAILMDWDMDYSKCK

SEQ ID NO: 2927704 - protein, 27 aa, Entamoeba invadens
AYNFLKDLLLKMGFKITQNEAINLAYK

SEQ ID NO: 2927705 - protein, 19 aa, Entamoeba invadens
AYNYLSLKNLLGLFNGMRL

SEQ ID NO: 2927706 - protein, 27 aa, Entamoeba invadens
AYPKTEFKYPWKIADFVNGGNRLQKLD

SEQ ID NO: 2927707 - protein, 17 aa, Entamoeba invadens
AYPKTIYMYPWTIADDV

SEQ ID NO: 2927708 - protein, 26 aa, Entamoeba invadens
AYPQSLPCYFQAPTLAMPNRLETPFV

SEQ ID NO: 2927709 - protein, 23 aa, Entamoeba invadens
AYQFLKNLPLYSGEPQSQPEQQS

SEQ ID NO: 2927710 - protein, 34 aa, Entamoeba invadens
AYQIGRAIGKDCCQAKCGCLLAPALNIHRHPLGG

SEQ ID NO: 2927711 - protein, 21 aa, Entamoeba invadens
AYRAHPDYHILYFQQKPPDPR

SEQ ID NO: 2927712 - protein, 17 aa, Entamoeba invadens
AYRKEREMREMIEESQA

SEQ ID NO: 2927713 - protein, 20 aa, Entamoeba invadens
AYSDAIEVLSVLVKTKKMSV

SEQ ID NO: 2927714 - protein, 24 aa, Entamoeba invadens
AYSEPWEVQSFFAICNNCIHKSPS

SEQ ID NO: 2927715 - protein, 18 aa, Entamoeba invadens
AYSKTVLPLVEYIQTCLK

SEQ ID NO: 2927716 - protein, 19 aa, Entamoeba invadens
AYSQFILDKIITIFVNIES

SEQ ID NO: 2927717 - protein, 26 aa, Entamoeba invadens
AYTGDEFKFPWSIANFVASGKRLSVR

SEQ ID NO: 2927718 - protein, 18 aa, Entamoeba invadens
AYTLEVVTLWYRAPEILL

SEQ ID NO: 2927719 - protein, 18 aa, Entamoeba invadens
AYTLFSLLMNNVRDFYDP

SEQ ID NO: 2927720 - protein, 18 aa, Entamoeba invadens
AYTLWALKNIVDFYKNDE

SEQ ID NO: 2927721 - protein, 28 aa, Entamoeba invadens
AYVVKTNMELLCMKIAMSVNSESMTPSE

SEQ ID NO: 2927722 - protein, 21 aa, Entamoeba invadens
AYWTIKRDKIAGALNPIEFSG

SEQ ID NO: 2927723 - protein, 21 aa, Entamoeba invadens
AYWTIKREKIAGALNPIESSG

SEQ ID NO: 2927724 - protein, 19 aa, Entamoeba invadens
AYYSDVACVSIQYEEVFPI

SEQ ID NO: 2927725 - protein, 20 aa, Entamoeba invadens
CAAGNLACCKKVVELGVVDF

SEQ ID NO: 2927726 - protein, 19 aa, Entamoeba invadens
CAAVVDLVIQFAVEYSQIL

SEQ ID NO: 2927727 - protein, 30 aa, Entamoeba invadens
CACIAECRDALTMLRGCYGNMFDKFKHIYD

SEQ ID NO: 2927728 - protein, 22 aa, Entamoeba invadens
CACKINYPKRFMLLRGNHESRI

SEQ ID NO: 2927729 - protein, 18 aa, Entamoeba invadens
CACVKSIRIVSTPITDLK

SEQ ID NO: 2927730 - protein, 22 aa, Entamoeba invadens
CADCCPESYIILIASLIANMIC

SEQ ID NO: 2927731 - protein, 22 aa, Entamoeba invadens
CADELSSFLLYDGIYHPIKNNY

SEQ ID NO: 2927732 - protein, 19 aa, Entamoeba invadens
CADITLFAMNSWETGKASM

SEQ ID NO: 2927733 - protein, 17 aa, Entamoeba invadens
CADKAFVFCKQKQRSLC

SEQ ID NO: 2927734 - protein, 22 aa, Entamoeba invadens
CADNYYKLSGFCMKCGSPNVCT

SEQ ID NO: 2927735 - protein, 22 aa, Entamoeba invadens
CAECVKKIIQMYFDKKIQEDSV

SEQ ID NO: 2927736 - protein, 17 aa, Entamoeba invadens
CAEQCYPEEVYIDQFER

SEQ ID NO: 2927737 - protein, 19 aa, Entamoeba invadens
CAFDKVFFPKSVKEIKQGV

SEQ ID NO: 2927738 - protein, 21 aa, Entamoeba invadens
CAFKILTENVLYTFTPEELKA

SEQ ID NO: 2927739 - protein, 25 aa, Entamoeba invadens
CAFKNGLWTTEFVRKIFPKVVRLSL

SEQ ID NO: 2927740 - protein, 18 aa, Entamoeba invadens
CAFRIGKDTMNWSTMITL

SEQ ID NO: 2927741 - protein, 17 aa, Entamoeba invadens
CAFYNCDFQKVVFGEKI

SEQ ID NO: 2927742 - protein, 18 aa, Entamoeba invadens
CAGCARHEDIWCSQDDLC

SEQ ID NO: 2927743 - protein, 19 aa, Entamoeba invadens
CAGKITFPYFKGTLSIQGN

SEQ ID NO: 2927744 - protein, 19 aa, Entamoeba invadens
CAGVPLVVTEPVVSFRETV

SEQ ID NO: 2927745 - protein, 20 aa, Entamoeba invadens
CAHCWPRRHFDNKIERFGID

SEQ ID NO: 2927746 - protein, 18 aa, Entamoeba invadens
CAHGIKGITTSLEEVKTR

SEQ ID NO: 2927747 - protein, 22 aa, Entamoeba invadens
CAHPDYRPALADYFERALKHSY

SEQ ID NO: 2927748 - protein, 21 aa, Entamoeba invadens
CAHQKWLARQFQLIGVIYEKH

SEQ ID NO: 2927749 - protein, 18 aa, Entamoeba invadens
CAIACAELQPYFRVKDYT

SEQ ID NO: 2927750 - protein, 19 aa, Entamoeba invadens
CAIALYWILFQQNYRISEE

SEQ ID NO: 2927751 - protein, 25 aa, Entamoeba invadens
CAIEELKISGLLSLKALSLPTSLTK

SEQ ID NO: 2927752 - protein, 18 aa, Entamoeba invadens
CAILELLKVHSRVLYIDI

SEQ ID NO: 2927753 - protein, 19 aa, Entamoeba invadens
CAIMLKLAACNNYIQQQIS

SEQ ID NO: 2927754 - protein, 33 aa, Entamoeba invadens
CAISKLEIMSELDLDTLFSRHIKVVPLLHGLTE

SEQ ID NO: 2927755 - protein, 17 aa, Entamoeba invadens
CAIWSPGNTQFTKIEVE

SEQ ID NO: 2927756 - protein, 29 aa, Entamoeba invadens
CAKDGVHLCTVKAGGIRFCTTVLCNSEAT

SEQ ID NO: 2927757 - protein, 22 aa, Entamoeba invadens
CAKEPRVSSVLFNNFTPECGDI

SEQ ID NO: 2927758 - protein, 19 aa, Entamoeba invadens
CAKLILGQLTLPFVNCKVE

SEQ ID NO: 2927759 - protein, 25 aa, Entamoeba invadens
CAKNHIKGAVLKLVQRSETRWLQTL

SEQ ID NO: 2927760 - protein, 22 aa, Entamoeba invadens
CALQKVMYVNIVLEYNKVLCQT

SEQ ID NO: 2927761 - protein, 18 aa, Entamoeba invadens
CALVELGAMLPIDSIDTA

SEQ ID NO: 2927762 - protein, 19 aa, Entamoeba invadens
CAMGLNVVMGYNYLKGRVE

SEQ ID NO: 2927763 - protein, 17 aa, Entamoeba invadens
CAMIDDFPVLSLSQPYL

SEQ ID NO: 2927764 - protein, 19 aa, Entamoeba invadens
CANCTGSGYTECTSCVTPG

SEQ ID NO: 2927765 - protein, 20 aa, Entamoeba invadens
CANLEMCRFLGTVSDIGDNC

SEQ ID NO: 2927766 - protein, 20 aa, Entamoeba invadens
CANQGAVFLGVFRGKLSEGI

SEQ ID NO: 2927767 - protein, 19 aa, Entamoeba invadens
CANYSGSVCTTCQQNYHTA

SEQ ID NO: 2927768 - protein, 20 aa, Entamoeba invadens
CAQCGFSNHHVEMVPPVVLS

SEQ ID NO: 2927769 - protein, 19 aa, Entamoeba invadens
CAQWFEFMEISPISKFADL

SEQ ID NO: 2927770 - protein, 17 aa, Entamoeba invadens
CASCYYSFQNYVQDVVE

SEQ ID NO: 2927771 - protein, 19 aa, Entamoeba invadens
CASEFPYLALDTSIIPLTS

SEQ ID NO: 2927772 - protein, 17 aa, Entamoeba invadens
CASEVDGLLLVKFDETF

SEQ ID NO: 2927773 - protein, 28 aa, Entamoeba invadens
CASNCTLCGYNLCFICNNNFILNNETLC

SEQ ID NO: 2927774 - protein, 20 aa, Entamoeba invadens
CATGGGLLVDKILKRFLNFE

SEQ ID NO: 2927775 - protein, 19 aa, Entamoeba invadens
CATVAFGMGIDKADVRFVI

SEQ ID NO: 2927776 - protein, 19 aa, Entamoeba invadens
CATYPPSFVIPKPVADDTI

SEQ ID NO: 2927777 - protein, 17 aa, Entamoeba invadens
CAVCRHFKTIEDLCTLS

SEQ ID NO: 2927778 - protein, 19 aa, Entamoeba invadens
CAVLFAVTLPSALSHLESA

SEQ ID NO: 2927779 - protein, 19 aa, Entamoeba invadens
CAVQNPFCSSVLLRTLIML

SEQ ID NO: 2927780 - protein, 19 aa, Entamoeba invadens
CAYLFERVKAVLVRSTLMT

SEQ ID NO: 2927781 - protein, 22 aa, Entamoeba invadens
CCASGVRRKNCVEAHNPGCAFS

SEQ ID NO: 2927782 - protein, 27 aa, Entamoeba invadens
CCCGKQYFCTLCLLNHPDFDITTFSLK

SEQ ID NO: 2927783 - protein, 21 aa, Entamoeba invadens
CCCGTGFRIPAFPKLLPCMHL

SEQ ID NO: 2927784 - protein, 26 aa, Entamoeba invadens
CCCQDGKCCCDFKCKCGAEGKCEYCC

SEQ ID NO: 2927785 - protein, 23 aa, Entamoeba invadens
CCDAPLCDKCTRILPREYQQTVV

SEQ ID NO: 2927786 - protein, 17 aa, Entamoeba invadens
CCDFVFFVIQIVKEARG

SEQ ID NO: 2927787 - protein, 19 aa, Entamoeba invadens
CCDVLCCWNLSIFTEAAQL

SEQ ID NO: 2927788 - protein, 26 aa, Entamoeba invadens
CCENCYKLSSVIFPPHLESINECAFC

SEQ ID NO: 2927789 - protein, 18 aa, Entamoeba invadens
CCEPIFWMYANYLKESFI

SEQ ID NO: 2927790 - protein, 21 aa, Entamoeba invadens
CCFDNCTLYTYIQSRFYRAPE

SEQ ID NO: 2927791 - protein, 18 aa, Entamoeba invadens
CCFFKCSSLSNVMIPSGV

SEQ ID NO: 2927792 - protein, 18 aa, Entamoeba invadens
CCFFKCTSLSNVTIPSSV

SEQ ID NO: 2927793 - protein, 19 aa, Entamoeba invadens
CCFGKNCKLTNPLHRKRYF

SEQ ID NO: 2927794 - protein, 19 aa, Entamoeba invadens
CCFMLCIRLKAIDLKNVCV

SEQ ID NO: 2927795 - protein, 17 aa, Entamoeba invadens
CCFNECYNLSNVTIPCS

SEQ ID NO: 2927796 - protein, 17 aa, Entamoeba invadens
CCFREGTLDLFTSGNDR

SEQ ID NO: 2927797 - protein, 21 aa, Entamoeba invadens
CCFRGCSKLSNIIIPSIVTSI

SEQ ID NO: 2927798 - protein, 19 aa, Entamoeba invadens
CCFSGCISLSSVTMPSNVT

SEQ ID NO: 2927799 - protein, 20 aa, Entamoeba invadens
CCFSGCLSLSNIEISTSVTS

SEQ ID NO: 2927800 - protein, 21 aa, Entamoeba invadens
CCFSICGSLSKVVFPSDLKKI

SEQ ID NO: 2927801 - protein, 18 aa, Entamoeba invadens
CCFYGCSSLSSLKIPSTI

SEQ ID NO: 2927802 - protein, 25 aa, Entamoeba invadens
CCGADLRDVLKYFGMFDDCGEVLGE

SEQ ID NO: 2927803 - protein, 30 aa, Entamoeba invadens
CCGEVVGSIWYKAIKEIGDFCFENADFYHD

SEQ ID NO: 2927804 - protein, 18 aa, Entamoeba invadens
CCGNAIRLSLLVDSESKV

SEQ ID NO: 2927805 - protein, 21 aa, Entamoeba invadens
CCGSERGKVYVWSWDDWEEPK

SEQ ID NO: 2927806 - protein, 17 aa, Entamoeba invadens
CCHHGKIKPHDMKPPEL

SEQ ID NO: 2927807 - protein, 18 aa, Entamoeba invadens
CCHLRVVKLPKSVTKIGS

SEQ ID NO: 2927808 - protein, 17 aa, Entamoeba invadens
CCHTDCSDKAALDATLR

SEQ ID NO: 2927809 - protein, 18 aa, Entamoeba invadens
CCKCRECTRVCPVDALTV

SEQ ID NO: 2927810 - protein, 21 aa, Entamoeba invadens
CCKNHSINVCDVCQGKVDIGD

SEQ ID NO: 2927811 - protein, 18 aa, Entamoeba invadens
CCLSGLTLPSTLREMGES

SEQ ID NO: 2927812 - protein, 17 aa, Entamoeba invadens
CCLVSKTMLCLHGGISP

SEQ ID NO: 2927813 - protein, 19 aa, Entamoeba invadens
CCNGRKGFCLTPSDMNGVI

SEQ ID NO: 2927814 - protein, 26 aa, Entamoeba invadens
CCPCNSLLCCKCCELNLFYYPCCVVG

SEQ ID NO: 2927815 - protein, 18 aa, Entamoeba invadens
CCPIYDKFLYDIIKHPFN

SEQ ID NO: 2927816 - protein, 17 aa, Entamoeba invadens
CCPPPQFGYDQMGCGFS

SEQ ID NO: 2927817 - protein, 24 aa, Entamoeba invadens
CCQDGKCCCDFKCKCGAEGKCECG

SEQ ID NO: 2927818 - protein, 17 aa, Entamoeba invadens
CCQHVFTPCIPKEADGH

SEQ ID NO: 2927819 - protein, 17 aa, Entamoeba invadens
CCSDSFIQPDFQQQYLR

SEQ ID NO: 2927820 - protein, 21 aa, Entamoeba invadens
CCSDSRAPPEFIFDCTLGEIF

SEQ ID NO: 2927821 - protein, 17 aa, Entamoeba invadens
CCSNCHKELKIFETIEC

SEQ ID NO: 2927822 - protein, 17 aa, Entamoeba invadens
CCTQPRRVAAISVSTRV

SEQ ID NO: 2927823 - protein, 37 aa, Entamoeba invadens
CCVATHFRVPVYVCTGTFKISPIFPTNDTDFALIQSP

SEQ ID NO: 2927824 - protein, 26 aa, Entamoeba invadens
CCVGKMYFCTLCLLNHPDFDREKLTL

SEQ ID NO: 2927825 - protein, 18 aa, Entamoeba invadens
CCYATALANLGQYLYTNL

SEQ ID NO: 2927826 - protein, 18 aa, Entamoeba invadens
CCYYNCINLSTVVIQSNV

SEQ ID NO: 2927827 - protein, 24 aa, Entamoeba invadens
CDADLRALTCLTKFTLNGGSVSVK

SEQ ID NO: 2927828 - protein, 20 aa, Entamoeba invadens
CDAFQLPIKYDILLKENDYI

SEQ ID NO: 2927829 - protein, 25 aa, Entamoeba invadens
CDANPFPMFLCPEVDDKQEKVDTSK

SEQ ID NO: 2927830 - protein, 17 aa, Entamoeba invadens
CDCLQGFQITHSLGGGT

SEQ ID NO: 2927831 - protein, 17 aa, Entamoeba invadens
CDCSFHLQCACPPIAQE

SEQ ID NO: 2927832 - protein, 27 aa, Entamoeba invadens
CDDALCFKMARFEFKAQEFIINSLCDR

SEQ ID NO: 2927833 - protein, 20 aa, Entamoeba invadens
CDDINCAVCDRFYCKECVLG

SEQ ID NO: 2927834 - protein, 20 aa, Entamoeba invadens
CDDKHPTAMGFVDFENEEDA

SEQ ID NO: 2927835 - protein, 20 aa, Entamoeba invadens
CDDLEKIVLCEDVQKVHIQA

SEQ ID NO: 2927836 - protein, 19 aa, Entamoeba invadens
CDDLLYYFVHIYKKVQGFY

SEQ ID NO: 2927837 - protein, 23 aa, Entamoeba invadens
CDEASLLLNVFMFNERVLPTSQV

SEQ ID NO: 2927838 - protein, 19 aa, Entamoeba invadens
CDELDPWYEFRAVVYKDNL

SEQ ID NO: 2927839 - protein, 18 aa, Entamoeba invadens
CDELDVYAFEKCKSLTSA

SEQ ID NO: 2927840 - protein, 27 aa, Entamoeba invadens
CDELYYRVRSECLGPISSQKEYDPRHP

SEQ ID NO: 2927841 - protein, 22 aa, Entamoeba invadens
CDETLKALTFLHSNHCVHRDIK

SEQ ID NO: 2927842 - protein, 24 aa, Entamoeba invadens
CDEWARDAFYFGMRDTIVSEDIET

SEQ ID NO: 2927843 - protein, 20 aa, Entamoeba invadens
CDFAEFLLETTVEYLVRNND

SEQ ID NO: 2927844 - protein, 20 aa, Entamoeba invadens
CDFEILKTRPFFAGTNFDKF

SEQ ID NO: 2927845 - protein, 19 aa, Entamoeba invadens
CDFFSCFWCDVTCCHCFLN

SEQ ID NO: 2927846 - protein, 30 aa, Entamoeba invadens
CDFKKAMARYPRLEFVRLYVDEKIVFPKEV

SEQ ID NO: 2927847 - protein, 26 aa, Entamoeba invadens
CDGAFLAYSVGYDWVKGVEGTLPPQQ

SEQ ID NO: 2927848 - protein, 25 aa, Entamoeba invadens
CDGKRRVKYFGGMKLVTPGEVGKDW

SEQ ID NO: 2927849 - protein, 26 aa, Entamoeba invadens
CDGLREVNDPIPLFVAKMLRKKGVRV

SEQ ID NO: 2927850 - protein, 24 aa, Entamoeba invadens
CDGMGEIDVGWGLKKFEFDFDDIP

SEQ ID NO: 2927851 - protein, 25 aa, Entamoeba invadens
CDGMGEIEVNWGLRKFEFDFENIPE

SEQ ID NO: 2927852 - protein, 19 aa, Entamoeba invadens
CDGNFVIRLGVGKRDVIAC

SEQ ID NO: 2927853 - protein, 18 aa, Entamoeba invadens
CDGYSYSAPMNVVIYDKP

SEQ ID NO: 2927854 - protein, 19 aa, Entamoeba invadens
CDIDIPFNYINIFSDDDTL

SEQ ID NO: 2927855 - protein, 20 aa, Entamoeba invadens
CDIDLRRRLFENILCVGGNT

SEQ ID NO: 2927856 - protein, 18 aa, Entamoeba invadens
CDIGDNFFGPSLVSVTLP

SEQ ID NO: 2927857 - protein, 17 aa, Entamoeba invadens
CDIGYYFLFAKCYHVLK

SEQ ID NO: 2927858 - protein, 18 aa, Entamoeba invadens
CDIPVCYDDQQCIAPVTL

SEQ ID NO: 2927859 - protein, 18 aa, Entamoeba invadens
CDISMPVLAPRSLLSAQK

SEQ ID NO: 2927860 - protein, 29 aa, Entamoeba invadens
CDKEELRGIIPRSLKYLFERLNNQNEGGV

SEQ ID NO: 2927861 - protein, 17 aa, Entamoeba invadens
CDKELLYELRFYLMTQS

SEQ ID NO: 2927862 - protein, 21 aa, Entamoeba invadens
CDKERYVEFCDLKTIHKNFQS

SEQ ID NO: 2927863 - protein, 17 aa, Entamoeba invadens
CDKGIGVLPRLDEFIKE

SEQ ID NO: 2927864 - protein, 17 aa, Entamoeba invadens
CDKLQWEEGIIIEAVNK

SEQ ID NO: 2927865 - protein, 18 aa, Entamoeba invadens
CDKSIKLWDGFKGTCLHT

SEQ ID NO: 2927866 - protein, 17 aa, Entamoeba invadens
CDLCEAAKSFEKIENDV

SEQ ID NO: 2927867 - protein, 21 aa, Entamoeba invadens
CDLDNGIPIMMIWMHDIVNIN

SEQ ID NO: 2927868 - protein, 20 aa, Entamoeba invadens
CDLISLNVNCCPTLNELAMS

SEQ ID NO: 2927869 - protein, 25 aa, Entamoeba invadens
CDLKIRNRISFSYPIFTQDQIHEFQ

SEQ ID NO: 2927870 - protein, 25 aa, Entamoeba invadens
CDLKRLDLSHVISFGSQYNMTRLTA

SEQ ID NO: 2927871 - protein, 25 aa, Entamoeba invadens
CDLKRLDLSHVISFGTQHFMTCLTA

SEQ ID NO: 2927872 - protein, 26 aa, Entamoeba invadens
CDLKRLDLSHVISFGTQRFMTCLTAI

SEQ ID NO: 2927873 - protein, 20 aa, Entamoeba invadens
CDLLKSVVLSSELKSIPSSC

SEQ ID NO: 2927874 - protein, 20 aa, Entamoeba invadens
CDLSEIKNGVLVVFQEKKKK

SEQ ID NO: 2927875 - protein, 17 aa, Entamoeba invadens
CDLSWNRIKSFNPRISW

SEQ ID NO: 2927876 - protein, 24 aa, Entamoeba invadens
CDMKRLDLSHVMFFGSQYDMTFLT

SEQ ID NO: 2927877 - protein, 23 aa, Entamoeba invadens
CDMPLSASFVRKNDTITMVNNTD

SEQ ID NO: 2927878 - protein, 26 aa, Entamoeba invadens
CDNFFCSLRFAHYLAQYGSTLLGTVR

SEQ ID NO: 2927879 - protein, 27 aa, Entamoeba invadens
CDNFFCSLRLAHYLAQCGSTLLGTVRK

SEQ ID NO: 2927880 - protein, 27 aa, Entamoeba invadens
CDNFFCSLRLAHYLAQCGSTLLVIVRK

SEQ ID NO: 2927881 - protein, 26 aa, Entamoeba invadens
CDNFFCSLRLAHYLAQYGSTLLGTVR

SEQ ID NO: 2927882 - protein, 27 aa, Entamoeba invadens
CDNFFCSLRLAHYLAQYGSTLLGTVRK

SEQ ID NO: 2927883 - protein, 19 aa, Entamoeba invadens
CDNPKFLMTVIHPTPMFIV

SEQ ID NO: 2927884 - protein, 17 aa, Entamoeba invadens
CDPLELICPLEITDKES

SEQ ID NO: 2927885 - protein, 19 aa, Entamoeba invadens
CDPTFFLKFLKDIHANGLS

SEQ ID NO: 2927886 - protein, 17 aa, Entamoeba invadens
CDQLVDFIMQNRVNKYI

SEQ ID NO: 2927887 - protein, 26 aa, Entamoeba invadens
CDRKYSYLFWEGRINQYFEGTDIEVG

SEQ ID NO: 2927888 - protein, 18 aa, Entamoeba invadens
CDRLKFVQFDNAVLGVIA

SEQ ID NO: 2927889 - protein, 23 aa, Entamoeba invadens
CDSIELFGRLTLEPTMKIDDITM

SEQ ID NO: 2927890 - protein, 20 aa, Entamoeba invadens
CDSMEGFFFCHSICGGTGSG

SEQ ID NO: 2927891 - protein, 22 aa, Entamoeba invadens
CDSNCLTCVITPTYCLSCPPGF

SEQ ID NO: 2927892 - protein, 30 aa, Entamoeba invadens
CDSPKPFGGIQVILCGDFFQLPPVSSDGLK

SEQ ID NO: 2927893 - protein, 17 aa, Entamoeba invadens
CDSQYYLSSSFTCEPLG

SEQ ID NO: 2927894 - protein, 20 aa, Entamoeba invadens
CDSVGMTVFVCFDMPDNKLQ

SEQ ID NO: 2927895 - protein, 18 aa, Entamoeba invadens
CDSVKEMVPLIVQCRTAL

SEQ ID NO: 2927896 - protein, 25 aa, Entamoeba invadens
CDTCLRASDCFTCNSTNFKDFSGNC

SEQ ID NO: 2927897 - protein, 24 aa, Entamoeba invadens
CDTFKRINFVPVSIFVVCDTTLWN

SEQ ID NO: 2927898 - protein, 25 aa, Entamoeba invadens
CDTFPEFWKFFIASAALHTSTHYKM

SEQ ID NO: 2927899 - protein, 20 aa, Entamoeba invadens
CDTHDLLQCDCEGSGTANKS

SEQ ID NO: 2927900 - protein, 29 aa, Entamoeba invadens
CDTIAVGKARCNVCISPYVLNGAKCELCQ

SEQ ID NO: 2927901 - protein, 25 aa, Entamoeba invadens
CDTKKECGDICIKIGEHLSAQMIHG

SEQ ID NO: 2927902 - protein, 19 aa, Entamoeba invadens
CDTTLLLAVCEVLKSKGKI

SEQ ID NO: 2927903 - protein, 17 aa, Entamoeba invadens
CDTTRKLNIKGILCEPV

SEQ ID NO: 2927904 - protein, 18 aa, Entamoeba invadens
CDTTWKLINEGILCETVD

SEQ ID NO: 2927905 - protein, 25 aa, Entamoeba invadens
CDVLERFGYTFKLIRLIFDDLVDIH

SEQ ID NO: 2927906 - protein, 25 aa, Entamoeba invadens
CDVLNPCFRQRILSSVLNYNHMTNS

SEQ ID NO: 2927907 - protein, 19 aa, Entamoeba invadens
CDVSFMLDDELKVVSRFAF

SEQ ID NO: 2927908 - protein, 24 aa, Entamoeba invadens
CDVSQRFNIALIIQNILKVPKTES

SEQ ID NO: 2927909 - protein, 26 aa, Entamoeba invadens
CDVSVKWSIPDGFSFGYKELENETCV

SEQ ID NO: 2927910 - protein, 17 aa, Entamoeba invadens
CDVWMFEIPQLKSGKDC

SEQ ID NO: 2927911 - protein, 21 aa, Entamoeba invadens
CDWKTWFGKDMVKCVRVDDVL

SEQ ID NO: 2927912 - protein, 19 aa, Entamoeba invadens
CDYLLKGGFFNSFISDVVK

SEQ ID NO: 2927913 - protein, 20 aa, Entamoeba invadens
CDYMRQCKLYDTSAPYLLED

SEQ ID NO: 2927914 - protein, 17 aa, Entamoeba invadens
CDYTFKVLIIGESGVGK

SEQ ID NO: 2927915 - protein, 20 aa, Entamoeba invadens
CEAPHKIKLLNLLQTLFETA

SEQ ID NO: 2927916 - protein, 31 aa, Entamoeba invadens
CEAYSKDAFKFPWKIAEFVTARKRLEKRKNI

SEQ ID NO: 2927917 - protein, 22 aa, Entamoeba invadens
CECKVPFWVSRLLEKDGVKCSK

SEQ ID NO: 2927918 - protein, 26 aa, Entamoeba invadens
CECSIPPDIYTAVFFGWQNSLNMTVM

SEQ ID NO: 2927919 - protein, 21 aa, Entamoeba invadens
CEDFKTLISHFKKCIFQVIKP

SEQ ID NO: 2927920 - protein, 18 aa, Entamoeba invadens
CEEERLSLCVVPLLETVI

SEQ ID NO: 2927921 - protein, 17 aa, Entamoeba invadens
CEEHVRYSQDHFNSNDA

SEQ ID NO: 2927922 - protein, 18 aa, Entamoeba invadens
CEELKSIKIPDGVKQVED

SEQ ID NO: 2927923 - protein, 18 aa, Entamoeba invadens
CEEMSVKFLGRIPLDPVI

SEQ ID NO: 2927924 - protein, 25 aa, Entamoeba invadens
CEERRIKIVIFRNDVIAKLIEREKH

SEQ ID NO: 2927925 - protein, 26 aa, Entamoeba invadens
CEESFVLGGHYFFDFFSIRLEYESVK

SEQ ID NO: 2927926 - protein, 19 aa, Entamoeba invadens
CEFCVRAYRMYIIKDDKTP

SEQ ID NO: 2927927 - protein, 20 aa, Entamoeba invadens
CEFEIFIKLLCLCKIDEHFV

SEQ ID NO: 2927928 - protein, 17 aa, Entamoeba invadens
CEFESLRCYIEMGYTDF

SEQ ID NO: 2927929 - protein, 18 aa, Entamoeba invadens
CEFVCLKTLEMKDVSFKD

SEQ ID NO: 2927930 - protein, 17 aa, Entamoeba invadens
CEGECKAQTAFIELRDL

SEQ ID NO: 2927931 - protein, 18 aa, Entamoeba invadens
CEGFHNGVGLSFQIAHPS

SEQ ID NO: 2927932 - protein, 24 aa, Entamoeba invadens
CEGLKSVTFPPFISSVGLFAFEEC

SEQ ID NO: 2927933 - protein, 17 aa, Entamoeba invadens
CEGMANKFIEFVIPVVV

SEQ ID NO: 2927934 - protein, 23 aa, Entamoeba invadens
CEGPNKLRGVVWTHGNIISQCCA

SEQ ID NO: 2927935 - protein, 22 aa, Entamoeba invadens
CEGRVIIHIGDVFYISKTFSKA

SEQ ID NO: 2927936 - protein, 21 aa, Entamoeba invadens
CEGSMMGIIWVEKACVKCALE

SEQ ID NO: 2927937 - protein, 17 aa, Entamoeba invadens
CEHDVRFVYSLCAVCYL

SEQ ID NO: 2927938 - protein, 17 aa, Entamoeba invadens
CEICGEPLVGSYTICDG

SEQ ID NO: 2927939 - protein, 25 aa, Entamoeba invadens
CEIDSQWSFPLSGLSKNRFDDEVSK

SEQ ID NO: 2927940 - protein, 18 aa, Entamoeba invadens
CEIKEDFQTNILDFLYAQ

SEQ ID NO: 2927941 - protein, 27 aa, Entamoeba invadens
CEILEVAFCKHLDFIFHKEHLKNIKIE

SEQ ID NO: 2927942 - protein, 26 aa, Entamoeba invadens
CEIPLLKFNQIRGFDKMSEIVVLPER

SEQ ID NO: 2927943 - protein, 21 aa, Entamoeba invadens
CEIQPRLATLELKIEGKKDQE

SEQ ID NO: 2927944 - protein, 19 aa, Entamoeba invadens
CEKCGEVIIGRIARVDGKV

SEQ ID NO: 2927945 - protein, 20 aa, Entamoeba invadens
CEKCVYVVHFVFVVRLLMIL

SEQ ID NO: 2927946 - protein, 18 aa, Entamoeba invadens
CEKFAEYVIFKIGKKKTL

SEQ ID NO: 2927947 - protein, 19 aa, Entamoeba invadens
CEKGSELLKMTKGKTDVTV

SEQ ID NO: 2927948 - protein, 23 aa, Entamoeba invadens
CEKGYKNLVEFLIQKGANVNCCD

SEQ ID NO: 2927949 - protein, 29 aa, Entamoeba invadens
CEKKGVLKREFFQIIVWFNVDFETVDRNK

SEQ ID NO: 2927950 - protein, 18 aa, Entamoeba invadens
CEKLEKIIFNYNIYLYDH

SEQ ID NO: 2927951 - protein, 19 aa, Entamoeba invadens
CEKLKELVFNEACEIEEGV

SEQ ID NO: 2927952 - protein, 18 aa, Entamoeba invadens
CEKLSQIRIGSGVKYIES

SEQ ID NO: 2927953 - protein, 35 aa, Entamoeba invadens
CEKPRFLLRRVLMGLFMRPHMLNFLTPEEIRDLIS

SEQ ID NO: 2927954 - protein, 20 aa, Entamoeba invadens
CEKQIILNYCKFQRRKVDGK

SEQ ID NO: 2927955 - protein, 25 aa, Entamoeba invadens
CEKSAWTRYIEFWVLYARFEEKHNN

SEQ ID NO: 2927956 - protein, 22 aa, Entamoeba invadens
CEKTERRIVCLVRSQSKLVKVF

SEQ ID NO: 2927957 - protein, 17 aa, Entamoeba invadens
CEKYLIDFCELKQIKVN

SEQ ID NO: 2927958 - protein, 23 aa, Entamoeba invadens
CELAHLNTLFVYKGNKIAFSEKF

SEQ ID NO: 2927959 - protein, 30 aa, Entamoeba invadens
CELEVEPQLFLLRWVRILFCQVFNTTDLYY

SEQ ID NO: 2927960 - protein, 17 aa, Entamoeba invadens
CELKEDFIEQFFFPNVH

SEQ ID NO: 2927961 - protein, 25 aa, Entamoeba invadens
CELKSECFNGCMMLSFISLKGQKRI

SEQ ID NO: 2927962 - protein, 17 aa, Entamoeba invadens
CELLKEYKVPATVKSIG

SEQ ID NO: 2927963 - protein, 20 aa, Entamoeba invadens
CELNNTFCCCESLKEFVIPE

SEQ ID NO: 2927964 - protein, 17 aa, Entamoeba invadens
CELVVKIGMRVNAKEVD

SEQ ID NO: 2927965 - protein, 18 aa, Entamoeba invadens
CELYLKNQRIHTIPENIT

SEQ ID NO: 2927966 - protein, 32 aa, Entamoeba invadens
CELYYPIAYKKLHRRYCLKYLEKVGIKEKVEE

SEQ ID NO: 2927967 - protein, 19 aa, Entamoeba invadens
CEMKFCCCQNIEIEVYKEM

SEQ ID NO: 2927968 - protein, 17 aa, Entamoeba invadens
CEMLRKIVLPTNLLFLG

SEQ ID NO: 2927969 - protein, 20 aa, Entamoeba invadens
CEMYCQIITGMFVFLEQQQT

SEQ ID NO: 2927970 - protein, 35 aa, Entamoeba invadens
CENELLVYRLTRIKCLLFPWAVRPQNNIFFTSVIQ

SEQ ID NO: 2927971 - protein, 31 aa, Entamoeba invadens
CENKGVLKREFFRIIVWFNVDFETVDRNKSR

SEQ ID NO: 2927972 - protein, 32 aa, Entamoeba invadens
CENKGVLKREFFRIIVWFSVNFEIVNRNKNRN

SEQ ID NO: 2927973 - protein, 19 aa, Entamoeba invadens
CENLIAVTFGRQIPKCEID

SEQ ID NO: 2927974 - protein, 19 aa, Entamoeba invadens
CENLNKFTLPKSVKTLKLE

SEQ ID NO: 2927975 - protein, 20 aa, Entamoeba invadens
CENLRKLKMSQRVTSIGNAC

SEQ ID NO: 2927976 - protein, 18 aa, Entamoeba invadens
CENNEYFLMHQKMNIEKV

SEQ ID NO: 2927977 - protein, 23 aa, Entamoeba invadens
CENVNICGAFPVIESIQNINNIN

SEQ ID NO: 2927978 - protein, 24 aa, Entamoeba invadens
CEPLRPKEVVGINFNIQKQVSFEL

SEQ ID NO: 2927979 - protein, 31 aa, Entamoeba invadens
CEQCYKEECAVKCAGCGKAIVGASLLALGQK

SEQ ID NO: 2927980 - protein, 27 aa, Entamoeba invadens
CEQGPCWADSVAEGFNYIKGMVYTTPG

SEQ ID NO: 2927981 - protein, 25 aa, Entamoeba invadens
CEQLKRLGSSLDWSREVFTMDETRS

SEQ ID NO: 2927982 - protein, 17 aa, Entamoeba invadens
CERIVKMYDHFMFCDHL

SEQ ID NO: 2927983 - protein, 17 aa, Entamoeba invadens
CERLERIEMSTSVTSLG

SEQ ID NO: 2927984 - protein, 19 aa, Entamoeba invadens
CERVVCKTLDYSFVRPLSI

SEQ ID NO: 2927985 - protein, 18 aa, Entamoeba invadens
CERWLKKAGVDFTQLEFI

SEQ ID NO: 2927986 - protein, 24 aa, Entamoeba invadens
CERYLVNFCQLKSIEVKNNIKALS

SEQ ID NO: 2927987 - protein, 17 aa, Entamoeba invadens
CESCANYYSTVEISEKC

SEQ ID NO: 2927988 - protein, 28 aa, Entamoeba invadens
CESCLNLTMCLSCVDGYFLSDYTCKSND

SEQ ID NO: 2927989 - protein, 24 aa, Entamoeba invadens
CESEKCILCNMGFVINSVGICEIQ

SEQ ID NO: 2927990 - protein, 24 aa, Entamoeba invadens
CESILFDFFKLMLSEFEFICEDMI

SEQ ID NO: 2927991 - protein, 30 aa, Entamoeba invadens
CESNINTILAMKVFSSVFYGVRGKIDTLRR

SEQ ID NO: 2927992 - protein, 29 aa, Entamoeba invadens
CESSSHPALCLRTALKLSTKAFQKKNVDV

SEQ ID NO: 2927993 - protein, 22 aa, Entamoeba invadens
CETFEFDMCPDFSFNFLNTKNK

SEQ ID NO: 2927994 - protein, 22 aa, Entamoeba invadens
CETFEFDMCPDFTFNFLNTKNK

SEQ ID NO: 2927995 - protein, 22 aa, Entamoeba invadens
CETFEFNSCLNFTFNFLNTKNN

SEQ ID NO: 2927996 - protein, 23 aa, Entamoeba invadens
CETIKGIGPVTAFEMIKEYKTIE

SEQ ID NO: 2927997 - protein, 18 aa, Entamoeba invadens
CETLKLLCKEGVVHFLFE

SEQ ID NO: 2927998 - protein, 32 aa, Entamoeba invadens
CEYCQSFVTPLCCYECLLSLKCLENATCPLCG

SEQ ID NO: 2927999 - protein, 27 aa, Entamoeba invadens
CEYICEELVRLGLLVPEKGNFLHNQLP

SEQ ID NO: 2928000 - protein, 26 aa, Entamoeba invadens
CEYNMLYKFINMIGMPPRSLLDRGTK

SEQ ID NO: 2928001 - protein, 19 aa, Entamoeba invadens
CEYVPTVMECCTMNVTYKD

SEQ ID NO: 2928002 - protein, 26 aa, Entamoeba invadens
CFALFEYGKSITLGWENPTIPTEPTL

SEQ ID NO: 2928003 - protein, 19 aa, Entamoeba invadens
CFCGCKSLKTIELPTSLSV

SEQ ID NO: 2928004 - protein, 18 aa, Entamoeba invadens
CFCKCSNLSHIIIPPSVT

SEQ ID NO: 2928005 - protein, 19 aa, Entamoeba invadens
CFCRCCFLKNVVILSSVTS

SEQ ID NO: 2928006 - protein, 24 aa, Entamoeba invadens
CFCRCCSLCSVTIPSSVNSFGDYC

SEQ ID NO: 2928007 - protein, 19 aa, Entamoeba invadens
CFCRCNSLSAITLGTNIIK

SEQ ID NO: 2928008 - protein, 31 aa, Entamoeba invadens
CFDDGLVSIGGFKLRYSVECVDEFNMALGKF

SEQ ID NO: 2928009 - protein, 19 aa, Entamoeba invadens
CFDEIKSHISAEQMETMEM

SEQ ID NO: 2928010 - protein, 18 aa, Entamoeba invadens
CFDGCSMQSVQILNCKYR

SEQ ID NO: 2928011 - protein, 18 aa, Entamoeba invadens
CFDGCTNLSTLALKGNIE

SEQ ID NO: 2928012 - protein, 23 aa, Entamoeba invadens
CFDGCYRLSFIELPLELSSIAEC

SEQ ID NO: 2928013 - protein, 25 aa, Entamoeba invadens
CFDHIAEGLVGFFQVRNIITVMNEM

SEQ ID NO: 2928014 - protein, 18 aa, Entamoeba invadens
CFDKERIAFLKFKQSDDV

SEQ ID NO: 2928015 - protein, 20 aa, Entamoeba invadens
CFDTLLMVHINPLFPQPEPE

SEQ ID NO: 2928016 - protein, 39 aa, Entamoeba invadens
CFDVKKIKSGLLILEMFWRNEMYILKFAPFCRFLSSLRE

SEQ ID NO: 2928017 - protein, 18 aa, Entamoeba invadens
CFECCSFQVHIKNKTKKF

SEQ ID NO: 2928018 - protein, 24 aa, Entamoeba invadens
CFECCSNLSAIHFKGYFPKTNSDF

SEQ ID NO: 2928019 - protein, 23 aa, Entamoeba invadens
CFEECKSLRQLLVPNAINEIKKK

SEQ ID NO: 2928020 - protein, 25 aa, Entamoeba invadens
CFEEVCKKCSMAIATVFINPFKLTQ

SEQ ID NO: 2928021 - protein, 18 aa, Entamoeba invadens
CFEGCGSLTRIHIPNDVS

SEQ ID NO: 2928022 - protein, 17 aa, Entamoeba invadens
CFEGCSTLTSLQITTNL

SEQ ID NO: 2928023 - protein, 19 aa, Entamoeba invadens
CFEGCTSLATVTGFEAVTS

SEQ ID NO: 2928024 - protein, 17 aa, Entamoeba invadens
CFEGCVYLSSVSIPQHI

SEQ ID NO: 2928025 - protein, 20 aa, Entamoeba invadens
CFEHCVCLSSVIIPSSVTSI

SEQ ID NO: 2928026 - protein, 17 aa, Entamoeba invadens
CFENCKALGEILYKGKP

SEQ ID NO: 2928027 - protein, 17 aa, Entamoeba invadens
CFENCRQLTNIEIPNSV

SEQ ID NO: 2928028 - protein, 19 aa, Entamoeba invadens
CFENEKCITSLKFSKKCVS

SEQ ID NO: 2928029 - protein, 17 aa, Entamoeba invadens
CFEQCISLAKLDVPINY

SEQ ID NO: 2928030 - protein, 24 aa, Entamoeba invadens
CFEQVASICKFVIPSTISRIGNSC

SEQ ID NO: 2928031 - protein, 20 aa, Entamoeba invadens
CFESQWGLAIESFLDGLTVQ

SEQ ID NO: 2928032 - protein, 17 aa, Entamoeba invadens
CFFACKMMITLEVPEKL

SEQ ID NO: 2928033 - protein, 19 aa, Entamoeba invadens
CFFECGKISSILIPSSVLS

SEQ ID NO: 2928034 - protein, 21 aa, Entamoeba invadens
CFFEKYRLLQYIGKGSFGSVF

SEQ ID NO: 2928035 - protein, 17 aa, Entamoeba invadens
CFFGCKNLEEIVGLKNV

SEQ ID NO: 2928036 - protein, 24 aa, Entamoeba invadens
CFFNCKRLSKFVIPNNVEVVSPEL

SEQ ID NO: 2928037 - protein, 18 aa, Entamoeba invadens
CFFNCRRLSGVTIPTSVI

SEQ ID NO: 2928038 - protein, 18 aa, Entamoeba invadens
CFFTSEFITSVVIPNTVK

SEQ ID NO: 2928039 - protein, 19 aa, Entamoeba invadens
CFGCVYKASLKGVTVAVKV

SEQ ID NO: 2928040 - protein, 25 aa, Entamoeba invadens
CFGFLSLLHPLSWQGVFLPLVPQNH

SEQ ID NO: 2928041 - protein, 18 aa, Entamoeba invadens
CFGNEEMKSFSFQIYELE

SEQ ID NO: 2928042 - protein, 19 aa, Entamoeba invadens
CFGNSPYYMYKFGEDKDSN

SEQ ID NO: 2928043 - protein, 18 aa, Entamoeba invadens
CFGSHGWSGEGVKNLAVR

SEQ ID NO: 2928044 - protein, 19 aa, Entamoeba invadens
CFGYCSKLCLITIPTSVTS

SEQ ID NO: 2928045 - protein, 17 aa, Entamoeba invadens
CFHECFLIGDLLMRGFI

SEQ ID NO: 2928046 - protein, 22 aa, Entamoeba invadens
CFHGCSKLSGFSFPGHLKSIGD

SEQ ID NO: 2928047 - protein, 19 aa, Entamoeba invadens
CFHQCASLRSVIIPPSVTF

SEQ ID NO: 2928048 - protein, 18 aa, Entamoeba invadens
CFHSFGWDEDGLAAYCRV

SEQ ID NO: 2928049 - protein, 17 aa, Entamoeba invadens
CFIECSRLSCVTIPSSV

SEQ ID NO: 2928050 - protein, 19 aa, Entamoeba invadens
CFINVLIFFSQKMSIKEEK

SEQ ID NO: 2928051 - protein, 17 aa, Entamoeba invadens
CFISCEYLTHVQLPNSI

SEQ ID NO: 2928052 - protein, 26 aa, Entamoeba invadens
CFKDCSSLISLCCSSSLILPKSTLKG

SEQ ID NO: 2928053 - protein, 20 aa, Entamoeba invadens
CFKIWEFYERFFRKVEKEMI

SEQ ID NO: 2928054 - protein, 17 aa, Entamoeba invadens
CFKNCGKLKKFVGKIKK

SEQ ID NO: 2928055 - protein, 25 aa, Entamoeba invadens
CFKNCTSLVTLCCPSNLKLPKSTLN

SEQ ID NO: 2928056 - protein, 25 aa, Entamoeba invadens
CFLADHWLCPGLDKNDWDVKKKVGF

SEQ ID NO: 2928057 - protein, 27 aa, Entamoeba invadens
CFLHLPKYRIIPGWSETLTNYVNDGDT

SEQ ID NO: 2928058 - protein, 23 aa, Entamoeba invadens
CFLNCTKLKIPSGVQNIYGLFGK

SEQ ID NO: 2928059 - protein, 21 aa, Entamoeba invadens
CFLSKSLLCLESNVVAITSPV

SEQ ID NO: 2928060 - protein, 18 aa, Entamoeba invadens
CFLVYDITNVDSFKNIVN

SEQ ID NO: 2928061 - protein, 20 aa, Entamoeba invadens
CFMNCFNLKFISKVKHLKSC

SEQ ID NO: 2928062 - protein, 17 aa, Entamoeba invadens
CFMNCFNLKTIPKIQFL

SEQ ID NO: 2928063 - protein, 17 aa, Entamoeba invadens
CFMTCKSLRSVVVPEGV

SEQ ID NO: 2928064 - protein, 18 aa, Entamoeba invadens
CFNARTTFQTEIQRQLFS

SEQ ID NO: 2928065 - protein, 18 aa, Entamoeba invadens
CFNQCISLSIVVFNKNLR

SEQ ID NO: 2928066 - protein, 20 aa, Entamoeba invadens
CFPPPPPFGRFGGWERRRRH

SEQ ID NO: 2928067 - protein, 20 aa, Entamoeba invadens
CFPTSLYQANKFCKMLNECG

SEQ ID NO: 2928068 - protein, 25 aa, Entamoeba invadens
CFQDCCSLCLINFNFNELNKLKATC

SEQ ID NO: 2928069 - protein, 18 aa, Entamoeba invadens
CFQIKAWPCSATEPRQIF

SEQ ID NO: 2928070 - protein, 29 aa, Entamoeba invadens
CFQLFMPYVKAMDSRNFFLGVYDNLLKDE

SEQ ID NO: 2928071 - protein, 19 aa, Entamoeba invadens
CFRGRLGKFVVPPRLVEPS

SEQ ID NO: 2928072 - protein, 19 aa, Entamoeba invadens
CFRNYKLVTMLKMPISLKI

SEQ ID NO: 2928073 - protein, 17 aa, Entamoeba invadens
CFSALKTQLLPKETRVL

SEQ ID NO: 2928074 - protein, 17 aa, Entamoeba invadens
CFSCCDTLSAVTLPSLI

SEQ ID NO: 2928075 - protein, 19 aa, Entamoeba invadens
CFSECSMLTSILFSTNLSF

SEQ ID NO: 2928076 - protein, 19 aa, Entamoeba invadens
CFSGAQFLQSVTFSNTLEK

SEQ ID NO: 2928077 - protein, 20 aa, Entamoeba invadens
CFSGCFKLKRVMFETKVLDK

SEQ ID NO: 2928078 - protein, 20 aa, Entamoeba invadens
CFSGCQWLRVINFPESVRNI

SEQ ID NO: 2928079 - protein, 21 aa, Entamoeba invadens
CFSGCYRLRSVTIPSSVKSIG

SEQ ID NO: 2928080 - protein, 19 aa, Entamoeba invadens
CFSLTEFEFAYGTKSIKSI

SEQ ID NO: 2928081 - protein, 19 aa, Entamoeba invadens
CFSLTEFEFAYGTKSIKVF

SEQ ID NO: 2928082 - protein, 26 aa, Entamoeba invadens
CFSNCCKLKCICLPQQISNLASCVFI

SEQ ID NO: 2928083 - protein, 18 aa, Entamoeba invadens
CFSQCNFSIFDFQKSTKI

SEQ ID NO: 2928084 - protein, 19 aa, Entamoeba invadens
CFSQIKISQLVPFDGCGHV

SEQ ID NO: 2928085 - protein, 19 aa, Entamoeba invadens
CFSSCKKLSKIVFPPTVNF

SEQ ID NO: 2928086 - protein, 20 aa, Entamoeba invadens
CFSYSGSLSSIIIPLRVTSI

SEQ ID NO: 2928087 - protein, 24 aa, Entamoeba invadens
CFTATKRSACMLANNTAMCQVFGK

SEQ ID NO: 2928088 - protein, 17 aa, Entamoeba invadens
CFTFICRSLGYYARLVL

SEQ ID NO: 2928089 - protein, 19 aa, Entamoeba invadens
CFTNCIKLAEIEIGRDVKL

SEQ ID NO: 2928090 - protein, 18 aa, Entamoeba invadens
CFTSCERLSNIVIPSSVK

SEQ ID NO: 2928091 - protein, 19 aa, Entamoeba invadens
CFTSLKYEVVHQWKQGVVC

SEQ ID NO: 2928092 - protein, 30 aa, Entamoeba invadens
CFTTTCPYFNCLFALLSQLSEIGYRNKLEY

SEQ ID NO: 2928093 - protein, 17 aa, Entamoeba invadens
CFVDCKSLRSVTIPSSV

SEQ ID NO: 2928094 - protein, 24 aa, Entamoeba invadens
CFVLKRLVPEKVIKVAREDSAKGI

SEQ ID NO: 2928095 - protein, 17 aa, Entamoeba invadens
CFVQIRKLLPCIEAEEE

SEQ ID NO: 2928096 - protein, 18 aa, Entamoeba invadens
CFVTKLLSERLCYNYRSG

SEQ ID NO: 2928097 - protein, 19 aa, Entamoeba invadens
CFWEYVLENRAKFVNEKFN

SEQ ID NO: 2928098 - protein, 17 aa, Entamoeba invadens
CFYGCHRLSSVTIPLSV

SEQ ID NO: 2928099 - protein, 17 aa, Entamoeba invadens
CFYGCSKLSSLIIPSSV

SEQ ID NO: 2928100 - protein, 18 aa, Entamoeba invadens
CFYGCSNLMLFRIPINIA

SEQ ID NO: 2928101 - protein, 20 aa, Entamoeba invadens
CFYKCCVLESIEIPLTVTSL

SEQ ID NO: 2928102 - protein, 17 aa, Entamoeba invadens
CFYNCSTLSKIEIDKEA

SEQ ID NO: 2928103 - protein, 22 aa, Entamoeba invadens
CFYPNELSEYAVLYQKYLELGV

SEQ ID NO: 2928104 - protein, 18 aa, Entamoeba invadens
CFYQCMSINKLIFPLKLK

SEQ ID NO: 2928105 - protein, 19 aa, Entamoeba invadens
CFYRCKKLSTINLPLHILS

SEQ ID NO: 2928106 - protein, 20 aa, Entamoeba invadens
CGATSFMPLVAYDFVAPSEV

SEQ ID NO: 2928107 - protein, 18 aa, Entamoeba invadens
CGAVKQFLLDFTDVDPPE

SEQ ID NO: 2928108 - protein, 20 aa, Entamoeba invadens
CGCCYAAAIANHAQILYANM

SEQ ID NO: 2928109 - protein, 20 aa, Entamoeba invadens
CGCDLRRDFYNTIVLCGGSS

SEQ ID NO: 2928110 - protein, 17 aa, Entamoeba invadens
CGCSNLKSITLSFHVTS

SEQ ID NO: 2928111 - protein, 19 aa, Entamoeba invadens
CGCVSVLIPQQNVLNHSIY

SEQ ID NO: 2928112 - protein, 21 aa, Entamoeba invadens
CGDLTPTLLRMFQGIPEIKSV

SEQ ID NO: 2928113 - protein, 21 aa, Entamoeba invadens
CGDRICKKCMIDGLNMAVNTG

SEQ ID NO: 2928114 - protein, 18 aa, Entamoeba invadens
CGDVKEVFVMIGNYSNFV

SEQ ID NO: 2928115 - protein, 18 aa, Entamoeba invadens
CGDYKKLENGGCEVTNNV

SEQ ID NO: 2928116 - protein, 17 aa, Entamoeba invadens
CGEMPVINLEFYSSYLL

SEQ ID NO: 2928117 - protein, 23 aa, Entamoeba invadens
CGENVTFIPPFYCDYGKYIEIGD

SEQ ID NO: 2928118 - protein, 21 aa, Entamoeba invadens
CGETHYSLYARMCSDYTTTSE

SEQ ID NO: 2928119 - protein, 21 aa, Entamoeba invadens
CGETICENCLAKGTCPYCDKQ

SEQ ID NO: 2928120 - protein, 27 aa, Entamoeba invadens
CGFFFESTFPFKTRFTIQQERVNSIYY

SEQ ID NO: 2928121 - protein, 21 aa, Entamoeba invadens
CGFKTPLRKFQSFKVFFNWAK

SEQ ID NO: 2928122 - protein, 18 aa, Entamoeba invadens
CGFMKGLLTPPGAMDLLG

SEQ ID NO: 2928123 - protein, 25 aa, Entamoeba invadens
CGFRGTPRYAAPNVHLGNAPTQGDD

SEQ ID NO: 2928124 - protein, 20 aa, Entamoeba invadens
CGFTIPAHNNIVMATKFKSD

SEQ ID NO: 2928125 - protein, 21 aa, Entamoeba invadens
CGGDLVVLLVRYAWSTDDVIR

SEQ ID NO: 2928126 - protein, 17 aa, Entamoeba invadens
CGGFWGADFWVYALNEN

SEQ ID NO: 2928127 - protein, 20 aa, Entamoeba invadens
CGGHNIECCRCGDTNIFDLL

SEQ ID NO: 2928128 - protein, 24 aa, Entamoeba invadens
CGGKGKFSDLIFYNKIEELGDAIL

SEQ ID NO: 2928129 - protein, 20 aa, Entamoeba invadens
CGGKTWKGLSVVHLGDRDVP

SEQ ID NO: 2928130 - protein, 26 aa, Entamoeba invadens
CGGLATFKGYPVMAICMKKGHNPNEM

SEQ ID NO: 2928131 - protein, 20 aa, Entamoeba invadens
CGGLCPGLNNVIRGLVMNLQ

SEQ ID NO: 2928132 - protein, 20 aa, Entamoeba invadens
CGGSIYPGHGMMFVRNDGCC

SEQ ID NO: 2928133 - protein, 25 aa, Entamoeba invadens
CGHIFCRECMIHLFSNNESVHCPYC

SEQ ID NO: 2928134 - protein, 26 aa, Entamoeba invadens
CGHRFCKSCVRDSIKYQMKQTWEKVH

SEQ ID NO: 2928135 - protein, 27 aa, Entamoeba invadens
CGHYICCDCCIGTKKCPLCDKPTTGVF

SEQ ID NO: 2928136 - protein, 21 aa, Entamoeba invadens
CGIDAVPICIDSKVVEKTDAD

SEQ ID NO: 2928137 - protein, 24 aa, Entamoeba invadens
CGIESLKIPDSVSFLGESAFQNCT

SEQ ID NO: 2928138 - protein, 17 aa, Entamoeba invadens
CGILLDATYFTTHVDKI

SEQ ID NO: 2928139 - protein, 20 aa, Entamoeba invadens
CGINICMTGDNLLLMTDGVY

SEQ ID NO: 2928140 - protein, 18 aa, Entamoeba invadens
CGIPSSGLGNLFMLMDLH

SEQ ID NO: 2928141 - protein, 20 aa, Entamoeba invadens
CGIPVTWIVPHEFMIEKSET

SEQ ID NO: 2928142 - protein, 20 aa, Entamoeba invadens
CGIQTKFKENCVVCVKTTKS

SEQ ID NO: 2928143 - protein, 18 aa, Entamoeba invadens
CGIRQTIMASFDSRFDYF

SEQ ID NO: 2928144 - protein, 19 aa, Entamoeba invadens
CGITNLGNYAFSFCYKLSE

SEQ ID NO: 2928145 - protein, 18 aa, Entamoeba invadens
CGITRTTLQMTIDQLNEK

SEQ ID NO: 2928146 - protein, 20 aa, Entamoeba invadens
CGIVMPMILGEYGLNVDKDD

SEQ ID NO: 2928147 - protein, 25 aa, Entamoeba invadens
CGKEDRLGKESSLFNTEEVKAVVFL

SEQ ID NO: 2928148 - protein, 19 aa, Entamoeba invadens
CGKKNCAYILFYQKKEPNY

SEQ ID NO: 2928149 - protein, 18 aa, Entamoeba invadens
CGKNIDLTSLEEWVKEYW

SEQ ID NO: 2928150 - protein, 18 aa, Entamoeba invadens
CGKRVYFNERLTFAGRDY

SEQ ID NO: 2928151 - protein, 19 aa, Entamoeba invadens
CGKSAYPIERTNAGGKDYH

SEQ ID NO: 2928152 - protein, 19 aa, Entamoeba invadens
CGKSAYPIERTTAGGKDYH

SEQ ID NO: 2928153 - protein, 20 aa, Entamoeba invadens
CGKSTLMRVIATRQVAIPDN

SEQ ID NO: 2928154 - protein, 17 aa, Entamoeba invadens
CGKVVGYTQDWKIILES

SEQ ID NO: 2928155 - protein, 18 aa, Entamoeba invadens
CGLGCTKNTIDVEMKNVV

SEQ ID NO: 2928156 - protein, 18 aa, Entamoeba invadens
CGLLIPPTILVTAKVVTN

SEQ ID NO: 2928157 - protein, 18 aa, Entamoeba invadens
CGLLKFMFLFDEKESGWM

SEQ ID NO: 2928158 - protein, 22 aa, Entamoeba invadens
CGLNTLPFLFDLVFCSTFGGSY

SEQ ID NO: 2928159 - protein, 18 aa, Entamoeba invadens
CGLSMYYTPNSVVWEIVN

SEQ ID NO: 2928160 - protein, 20 aa, Entamoeba invadens
CGLTCVNLPPGLVSIGDNCF

SEQ ID NO: 2928161 - protein, 19 aa, Entamoeba invadens
CGLVKMLSLMAQITVALPL

SEQ ID NO: 2928162 - protein, 17 aa, Entamoeba invadens
CGLVKNFSLLTEVTTDS

SEQ ID NO: 2928163 - protein, 17 aa, Entamoeba invadens
CGLVVIDSFGGILKDAF

SEQ ID NO: 2928164 - protein, 18 aa, Entamoeba invadens
CGLWEMASPNFISMCSEN

SEQ ID NO: 2928165 - protein, 19 aa, Entamoeba invadens
CGLYEDFSFSTEDNVNSME

SEQ ID NO: 2928166 - protein, 17 aa, Entamoeba invadens
CGMCARDCIAQCLKVEN

SEQ ID NO: 2928167 - protein, 18 aa, Entamoeba invadens
CGMCARDCIAQCLKVENH

SEQ ID NO: 2928168 - protein, 20 aa, Entamoeba invadens
CGMCARDCITQCLKVENHKI

SEQ ID NO: 2928169 - protein, 23 aa, Entamoeba invadens
CGMENCGATCYINSAIQQLHANK

SEQ ID NO: 2928170 - protein, 18 aa, Entamoeba invadens
CGMKRVIGGQLISYDKHM

SEQ ID NO: 2928171 - protein, 19 aa, Entamoeba invadens
CGMSRTSFDQVTMLEGLQE

SEQ ID NO: 2928172 - protein, 18 aa, Entamoeba invadens
CGNFRAALEAAKELGLPH

SEQ ID NO: 2928173 - protein, 19 aa, Entamoeba invadens
CGNSLIFVECSKLRSVERE

SEQ ID NO: 2928174 - protein, 25 aa, Entamoeba invadens
CGNTEAWKSSGFCKRHGVPFNGDLE

SEQ ID NO: 2928175 - protein, 18 aa, Entamoeba invadens
CGPSIPQMFGQVGVNCTA

SEQ ID NO: 2928176 - protein, 19 aa, Entamoeba invadens
CGPTSMAMVIATLVDGSVT

SEQ ID NO: 2928177 - protein, 24 aa, Entamoeba invadens
CGQVPDKVILYYAYEKEGDSYKED

SEQ ID NO: 2928178 - protein, 22 aa, Entamoeba invadens
CGRKSEVLSLAEWSKFIPNVTN

SEQ ID NO: 2928179 - protein, 22 aa, Entamoeba invadens
CGSCGPRGFYGTTLEHLSIEAE

SEQ ID NO: 2928180 - protein, 26 aa, Entamoeba invadens
CGSEAEYIWKTCGLVAELDVENGVAG

SEQ ID NO: 2928181 - protein, 17 aa, Entamoeba invadens
CGSKEHIARDCPKRLAE

SEQ ID NO: 2928182 - protein, 19 aa, Entamoeba invadens
CGSLSKLVIQPGITTLPKC

SEQ ID NO: 2928183 - protein, 24 aa, Entamoeba invadens
CGSYRNNLKMSYQRKLKEKKINDQ

SEQ ID NO: 2928184 - protein, 29 aa, Entamoeba invadens
CGTEGSKSAFCWFLRNLFVIDDVGMYQLL

SEQ ID NO: 2928185 - protein, 17 aa, Entamoeba invadens
CGTIKYYVEDLVQPVIF

SEQ ID NO: 2928186 - protein, 27 aa, Entamoeba invadens
CGTMPFKDSHPMFWEIVIVFQDKAYVI

SEQ ID NO: 2928187 - protein, 30 aa, Entamoeba invadens
CGTNESLLLRYAYFSRRYVVTITDENVEES

SEQ ID NO: 2928188 - protein, 21 aa, Entamoeba invadens
CGTPEYLAPEVVVGKNYSEPV

SEQ ID NO: 2928189 - protein, 24 aa, Entamoeba invadens
CGVCDKYFLTRAIYLKHCTQTPHK

SEQ ID NO: 2928190 - protein, 18 aa, Entamoeba invadens
CGVDCIGVIYGKGHDTIK

SEQ ID NO: 2928191 - protein, 18 aa, Entamoeba invadens
CGVFGGDVILKFLLQSVV

SEQ ID NO: 2928192 - protein, 18 aa, Entamoeba invadens
CGVGKTLLLNNFTDNPSD

SEQ ID NO: 2928193 - protein, 19 aa, Entamoeba invadens
CGVKGGWTTSGGEFVITED

SEQ ID NO: 2928194 - protein, 25 aa, Entamoeba invadens
CGVNELPLHIILSWYEQKAVCILLT

SEQ ID NO: 2928195 - protein, 26 aa, Entamoeba invadens
CGVNELPLHIYLSWYEQKAVCILLTV

SEQ ID NO: 2928196 - protein, 19 aa, Entamoeba invadens
CGVNLEIGDIYTSDPYVVF

SEQ ID NO: 2928197 - protein, 18 aa, Entamoeba invadens
CGVPDDFNSRFSCLSRTY

SEQ ID NO: 2928198 - protein, 29 aa, Entamoeba invadens
CGVPQEKAEIVGCVIKYGGASKRPIEIFP

SEQ ID NO: 2928199 - protein, 19 aa, Entamoeba invadens
CGVPTLCFEYCGFYSSSEY

SEQ ID NO: 2928200 - protein, 17 aa, Entamoeba invadens
CGVSKQLAYCALKKYAY

SEQ ID NO: 2928201 - protein, 36 aa, Entamoeba invadens
CGVTCLLRYIGGIKVVWLRHEFDFIGGSLGCAEGEK

SEQ ID NO: 2928202 - protein, 19 aa, Entamoeba invadens
CGVYITWNYHNIVFFTLNG

SEQ ID NO: 2928203 - protein, 18 aa, Entamoeba invadens
CHALPPLFVELVKIYIGR

SEQ ID NO: 2928204 - protein, 18 aa, Entamoeba invadens
CHCVKIIYIYTIFFNVLN

SEQ ID NO: 2928205 - protein, 18 aa, Entamoeba invadens
CHEELRFMIDPHNLPSIL

SEQ ID NO: 2928206 - protein, 20 aa, Entamoeba invadens
CHIRGQMQRKVWISVGDVVL

SEQ ID NO: 2928207 - protein, 20 aa, Entamoeba invadens
CHKPYVSHSFYFVDDITNFM

SEQ ID NO: 2928208 - protein, 22 aa, Entamoeba invadens
CHLRLKAFGLDFNNVDLTNNDL

SEQ ID NO: 2928209 - protein, 17 aa, Entamoeba invadens
CHLRLLNCGYHFDNIEF

SEQ ID NO: 2928210 - protein, 20 aa, Entamoeba invadens
CHMETLLIRLFERLVVPLSQ

SEQ ID NO: 2928211 - protein, 19 aa, Entamoeba invadens
CHNENYVLGITWFGKTIYR

SEQ ID NO: 2928212 - protein, 27 aa, Entamoeba invadens
CHNNSCVICSVGYLLQKGVCQEMSVYN

SEQ ID NO: 2928213 - protein, 19 aa, Entamoeba invadens
CHQIVRMKISDSIGFTSFM

SEQ ID NO: 2928214 - protein, 19 aa, Entamoeba invadens
CHQKLLKIDNFRYIKKLSL

SEQ ID NO: 2928215 - protein, 19 aa, Entamoeba invadens
CHRFYRWTTTNDVEMPEKN

SEQ ID NO: 2928216 - protein, 18 aa, Entamoeba invadens
CHSNCLTCSSNAESTCLS

SEQ ID NO: 2928217 - protein, 27 aa, Entamoeba invadens
CHTAFTMLRINPFYSLKTLNEEMKMFS

SEQ ID NO: 2928218 - protein, 19 aa, Entamoeba invadens
CIACADFDANCRVCASSGE

SEQ ID NO: 2928219 - protein, 31 aa, Entamoeba invadens
CIADCTFCYESLCVRGVYGLVHKGIYQTAST

SEQ ID NO: 2928220 - protein, 27 aa, Entamoeba invadens
CIAEDFATRCLYWFNFGYSEVGDIGAL

SEQ ID NO: 2928221 - protein, 24 aa, Entamoeba invadens
CIAEVRWANHIGVFGLVVPLPSNI

SEQ ID NO: 2928222 - protein, 26 aa, Entamoeba invadens
CIATKRLCGYLGLFPPSAREERAKQL

SEQ ID NO: 2928223 - protein, 18 aa, Entamoeba invadens
CICKHWSLIYSNHEKLVI

SEQ ID NO: 2928224 - protein, 21 aa, Entamoeba invadens
CICLPSKVFHVENLKNEKVEF

SEQ ID NO: 2928225 - protein, 26 aa, Entamoeba invadens
CIDFLIERVAFIGFFKRCRPVTACQD

SEQ ID NO: 2928226 - protein, 19 aa, Entamoeba invadens
CIDLLAPLFTFVGYQLDLP

SEQ ID NO: 2928227 - protein, 25 aa, Entamoeba invadens
CIDQAYLLVKIPKLITAQGVVFLHE

SEQ ID NO: 2928228 - protein, 26 aa, Entamoeba invadens
CIECPIEKRVFCLRTGKCIKCETNYL

SEQ ID NO: 2928229 - protein, 17 aa, Entamoeba invadens
CIEDLKCDLKKHALYKG

SEQ ID NO: 2928230 - protein, 17 aa, Entamoeba invadens
CIEGAAFSRCTTIPQIE

SEQ ID NO: 2928231 - protein, 18 aa, Entamoeba invadens
CIELYKILLKKPFSCYHN

SEQ ID NO: 2928232 - protein, 25 aa, Entamoeba invadens
CIENGCFYCAFYLKEINIPDTGTKI

SEQ ID NO: 2928233 - protein, 25 aa, Entamoeba invadens
CIENGCFYCAFYLKEINIPDTVTKI

SEQ ID NO: 2928234 - protein, 22 aa, Entamoeba invadens
CIETFKLPQSVYSASLRSCELW

SEQ ID NO: 2928235 - protein, 17 aa, Entamoeba invadens
CIGDFCFKGCSSLTNIA

SEQ ID NO: 2928236 - protein, 27 aa, Entamoeba invadens
CIGHTLRLIDHFLFYNHICIVTEMLGI

SEQ ID NO: 2928237 - protein, 24 aa, Entamoeba invadens
CIGLLNDFCSFTFKQPAKKSTVSP

SEQ ID NO: 2928238 - protein, 20 aa, Entamoeba invadens
CIGTYCFNYFTALKRIEMPK

SEQ ID NO: 2928239 - protein, 19 aa, Entamoeba invadens
CIGYFQMVCRKAFEWNSVK

SEQ ID NO: 2928240 - protein, 18 aa, Entamoeba invadens
CIHFGKRGTKRTISRSIS

SEQ ID NO: 2928241 - protein, 17 aa, Entamoeba invadens
CIICDKFSDLKKCPLCV

SEQ ID NO: 2928242 - protein, 20 aa, Entamoeba invadens
CIIEMAKISGLVLVPDTLRN

SEQ ID NO: 2928243 - protein, 17 aa, Entamoeba invadens
CIIGRFMTSSFCTNYEA

SEQ ID NO: 2928244 - protein, 24 aa, Entamoeba invadens
CIKAKRIELFVTRGKTLKFTKCET

SEQ ID NO: 2928245 - protein, 23 aa, Entamoeba invadens
CIKRKCFEGCFWLPNISIPENVE

SEQ ID NO: 2928246 - protein, 23 aa, Entamoeba invadens
CIKSFMKEVLMKIGAPEENAEMT

SEQ ID NO: 2928247 - protein, 20 aa, Entamoeba invadens
CIKVWDMRQQKCVAVHDEHN

SEQ ID NO: 2928248 - protein, 17 aa, Entamoeba invadens
CILADEMGLGKTVQVVA

SEQ ID NO: 2928249 - protein, 20 aa, Entamoeba invadens
CILCSKHVIQLGEFELDDDH

SEQ ID NO: 2928250 - protein, 24 aa, Entamoeba invadens
CILCSTCCECLQLKEVVMDDNVEM

SEQ ID NO: 2928251 - protein, 17 aa, Entamoeba invadens
CILPDLIETTKCFGVYI

SEQ ID NO: 2928252 - protein, 20 aa, Entamoeba invadens
CINIPQKLFLLKAENEDNKL

SEQ ID NO: 2928253 - protein, 18 aa, Entamoeba invadens
CIPSVNYHYALFSELKFL

SEQ ID NO: 2928254 - protein, 20 aa, Entamoeba invadens
CIPTRVRTVSKMAFEGCERL

SEQ ID NO: 2928255 - protein, 18 aa, Entamoeba invadens
CIQNCPNLTAVTFTEIPK

SEQ ID NO: 2928256 - protein, 19 aa, Entamoeba invadens
CIQQYVLKLKVEKKMDFDM

SEQ ID NO: 2928257 - protein, 21 aa, Entamoeba invadens
CIQTLFKLSLGLIRKKNINSL

SEQ ID NO: 2928258 - protein, 27 aa, Entamoeba invadens
CIRLKAIDLKNVCVLGQNCFADCDSLS

SEQ ID NO: 2928259 - protein, 19 aa, Entamoeba invadens
CIRNLRPIEQMGYTNTTDS

SEQ ID NO: 2928260 - protein, 22 aa, Entamoeba invadens
CISAFTCIRKQGSLFIYLFRLM

SEQ ID NO: 2928261 - protein, 25 aa, Entamoeba invadens
CISAKRFCSHLSLFAQPIRQEKARL

SEQ ID NO: 2928262 - protein, 18 aa, Entamoeba invadens
CISKFATPSPLVFPCPSL

SEQ ID NO: 2928263 - protein, 17 aa, Entamoeba invadens
CISPSFNSMSPRVKQIV

SEQ ID NO: 2928264 - protein, 22 aa, Entamoeba invadens
CISQMKAIKIVFPFSKLFHCVR

SEQ ID NO: 2928265 - protein, 18 aa, Entamoeba invadens
CISVPHIAGQILRSLVEE

SEQ ID NO: 2928266 - protein, 23 aa, Entamoeba invadens
CITAREVLEYIDLITKEGKALGI

SEQ ID NO: 2928267 - protein, 25 aa, Entamoeba invadens
CITNLCVIFCISFKNKHKVPSELNC

SEQ ID NO: 2928268 - protein, 28 aa, Entamoeba invadens
CITVVREMGRLGVQAFLVLCNAQNILTG

SEQ ID NO: 2928269 - protein, 24 aa, Entamoeba invadens
CIVEIKPECVFKLKKRCKKKKRNT

SEQ ID NO: 2928270 - protein, 19 aa, Entamoeba invadens
CIVFELLSLNLYDVLNQNG

SEQ ID NO: 2928271 - protein, 17 aa, Entamoeba invadens
CIVMEYFNGGNLFNALH

SEQ ID NO: 2928272 - protein, 18 aa, Entamoeba invadens
CIVSRSGKVLMEMETGLR

SEQ ID NO: 2928273 - protein, 32 aa, Entamoeba invadens
CIVVYDITRLTTFKNIEKWVAMIKNKLYDVPI

SEQ ID NO: 2928274 - protein, 20 aa, Entamoeba invadens
CIYAILSTFCELIIDEESAL

SEQ ID NO: 2928275 - protein, 24 aa, Entamoeba invadens
CIYAVRKRSYFFVGTFNLMLQRDD

SEQ ID NO: 2928276 - protein, 28 aa, Entamoeba invadens
CIYDLSEAIKRMRALDERTSKMIADKLA

SEQ ID NO: 2928277 - protein, 18 aa, Entamoeba invadens
CKAACWMKTLDDRKNLIV

SEQ ID NO: 2928278 - protein, 19 aa, Entamoeba invadens
CKAFYKKFGNTLLLACFKD

SEQ ID NO: 2928279 - protein, 18 aa, Entamoeba invadens
CKAGDGLVDLSLISDLHK

SEQ ID NO: 2928280 - protein, 19 aa, Entamoeba invadens
CKAIQWLHNQMNLIHRNVK

SEQ ID NO: 2928281 - protein, 21 aa, Entamoeba invadens
CKAKRFGNKCFYDCEDLEEVF

SEQ ID NO: 2928282 - protein, 18 aa, Entamoeba invadens
CKALDTLLFESAKEIKLL

SEQ ID NO: 2928283 - protein, 17 aa, Entamoeba invadens
CKANFIAVKGPQLLNKY

SEQ ID NO: 2928284 - protein, 23 aa, Entamoeba invadens
CKASDVFSFGLIVIEFLDGKASY

SEQ ID NO: 2928285 - protein, 24 aa, Entamoeba invadens
CKASGCGLSGCQECEEGYYLLEGR

SEQ ID NO: 2928286 - protein, 18 aa, Entamoeba invadens
CKCFTCSKNNSVSYVHHL

SEQ ID NO: 2928287 - protein, 20 aa, Entamoeba invadens
CKCGQRFCFQCGREMHKPVS

SEQ ID NO: 2928288 - protein, 17 aa, Entamoeba invadens
CKCGYVYCSKKCQDLDV

SEQ ID NO: 2928289 - protein, 21 aa, Entamoeba invadens
CKCKPREMRYPLNTHYSPLFM

SEQ ID NO: 2928290 - protein, 17 aa, Entamoeba invadens
CKCRAELERSVGVSEDK

SEQ ID NO: 2928291 - protein, 28 aa, Entamoeba invadens
CKCVPNIPLPIMFCKSVVMNGIANATVM

SEQ ID NO: 2928292 - protein, 18 aa, Entamoeba invadens
CKDCELFNGLLPFDITNL

SEQ ID NO: 2928293 - protein, 19 aa, Entamoeba invadens
CKDEEIMNVPILFYLNKID

SEQ ID NO: 2928294 - protein, 20 aa, Entamoeba invadens
CKDEPFLVVFVKFLTILFMR

SEQ ID NO: 2928295 - protein, 21 aa, Entamoeba invadens
CKDKSLIRPQRVVVTTKVPSR

SEQ ID NO: 2928296 - protein, 20 aa, Entamoeba invadens
CKDKYYKRETDCIACDESCG

SEQ ID NO: 2928297 - protein, 29 aa, Entamoeba invadens
CKDQYYRVGMDCLKCLLNCSTCNTKNKCL

SEQ ID NO: 2928298 - protein, 18 aa, Entamoeba invadens
CKDSVLLNERKVIRTPEK

SEQ ID NO: 2928299 - protein, 19 aa, Entamoeba invadens
CKDYERKDYNGALLKCEKI

SEQ ID NO: 2928300 - protein, 20 aa, Entamoeba invadens
CKDYICGMSKYFHVNMSTQV

SEQ ID NO: 2928301 - protein, 22 aa, Entamoeba invadens
CKEDLRNVKIFEVKQFGGLNNK

SEQ ID NO: 2928302 - protein, 23 aa, Entamoeba invadens
CKEICDFAFYRCLSLSKIDIPKS

SEQ ID NO: 2928303 - protein, 25 aa, Entamoeba invadens
CKEICDFEFYRCLSLSKIDIPKSVT

SEQ ID NO: 2928304 - protein, 20 aa, Entamoeba invadens
CKEIERVTGRMFYLHENELE

SEQ ID NO: 2928305 - protein, 19 aa, Entamoeba invadens
CKEIGASAFENCLRLVLKI

SEQ ID NO: 2928306 - protein, 22 aa, Entamoeba invadens
CKEKGVCPMCRELANKVKELMI

SEQ ID NO: 2928307 - protein, 19 aa, Entamoeba invadens
CKEKNDFFITRLILDGFAR

SEQ ID NO: 2928308 - protein, 21 aa, Entamoeba invadens
CKEKWCFLCNCLLGDGMCVCT

SEQ ID NO: 2928309 - protein, 18 aa, Entamoeba invadens
CKELHNVEIPFGVSAIYP

SEQ ID NO: 2928310 - protein, 19 aa, Entamoeba invadens
CKELIKIKVFSIDIIENNY

SEQ ID NO: 2928311 - protein, 20 aa, Entamoeba invadens
CKELKKFSFLENKYIKTINT

SEQ ID NO: 2928312 - protein, 20 aa, Entamoeba invadens
CKFDKMFFAKNLKVMGTGVF

SEQ ID NO: 2928313 - protein, 18 aa, Entamoeba invadens
CKFFHLEAKIDRRTGKAE

SEQ ID NO: 2928314 - protein, 20 aa, Entamoeba invadens
CKFLPIYKMVERVYSDSVKR

SEQ ID NO: 2928315 - protein, 18 aa, Entamoeba invadens
CKGDEGLKSNATKITDFF

SEQ ID NO: 2928316 - protein, 27 aa, Entamoeba invadens
CKGLKRVKLPFALKSSGMNIFWESPAV

SEQ ID NO: 2928317 - protein, 23 aa, Entamoeba invadens
CKGQKGIILIDFKKVDFFDIRNE

SEQ ID NO: 2928318 - protein, 17 aa, Entamoeba invadens
CKHCNRDKINPIKYFKL

SEQ ID NO: 2928319 - protein, 19 aa, Entamoeba invadens
CKHDIKPIPPFITTDEYCG

SEQ ID NO: 2928320 - protein, 18 aa, Entamoeba invadens
CKHLVFLKNVTTINNFEP

SEQ ID NO: 2928321 - protein, 21 aa, Entamoeba invadens
CKHPNLVEYKDFFGWDYSMVS

SEQ ID NO: 2928322 - protein, 28 aa, Entamoeba invadens
CKIADACLRSSAAVGYFPPYNGFADGGI

SEQ ID NO: 2928323 - protein, 17 aa, Entamoeba invadens
CKIEIIKIRSLLKKARK

SEQ ID NO: 2928324 - protein, 22 aa, Entamoeba invadens
CKIGNNCFRECVALISIELPES

SEQ ID NO: 2928325 - protein, 30 aa, Entamoeba invadens
CKIGPFQLGMPLYRILKMLAKPSATTLADV

SEQ ID NO: 2928326 - protein, 29 aa, Entamoeba invadens
CKIHKSDVFELPLLYKLYTTEIVKTQTSE

SEQ ID NO: 2928327 - protein, 18 aa, Entamoeba invadens
CKIMFKNNLVFLIEDDKQ

SEQ ID NO: 2928328 - protein, 19 aa, Entamoeba invadens
CKIPPRSGQEEYLIGEYYR

SEQ ID NO: 2928329 - protein, 17 aa, Entamoeba invadens
CKKCGKEYAMKSCENYW

SEQ ID NO: 2928330 - protein, 20 aa, Entamoeba invadens
CKKENIFVFGGEYRPVPLQQ

SEQ ID NO: 2928331 - protein, 19 aa, Entamoeba invadens
CKKFGGTMEKFHFNPIPLN

SEQ ID NO: 2928332 - protein, 18 aa, Entamoeba invadens
CKKFIATIAKFHFNPIPL

SEQ ID NO: 2928333 - protein, 19 aa, Entamoeba invadens
CKKFKSMMEKFKYNPIPLT

SEQ ID NO: 2928334 - protein, 21 aa, Entamoeba invadens
CKKGVSKICVVEGGFEELHAA

SEQ ID NO: 2928335 - protein, 19 aa, Entamoeba invadens
CKKHVANIMTYVDGAIGSD

SEQ ID NO: 2928336 - protein, 27 aa, Entamoeba invadens
CKKISSVYFFRCPKLNSFTFPKSLKLL

SEQ ID NO: 2928337 - protein, 18 aa, Entamoeba invadens
CKKLEEMRKMESFLKLKN

SEQ ID NO: 2928338 - protein, 18 aa, Entamoeba invadens
CKKLLQKGIPTWINRMAW

SEQ ID NO: 2928339 - protein, 20 aa, Entamoeba invadens
CKKLNGVVLTCDSIWANFHH

SEQ ID NO: 2928340 - protein, 41 aa, Entamoeba invadens
CKKLTWTPNHIWKGAVTLLRPRTLRWSYSVVEGSSIIRTEH

SEQ ID NO: 2928341 - protein, 20 aa, Entamoeba invadens
CKKTVKQKDSIQCIKCKLVM

SEQ ID NO: 2928342 - protein, 18 aa, Entamoeba invadens
CKLARIRDFKEEKMNLET

SEQ ID NO: 2928343 - protein, 21 aa, Entamoeba invadens
CKLEFIIGLIDQICRGSEKKI

SEQ ID NO: 2928344 - protein, 32 aa, Entamoeba invadens
CKLKEIVFPKSLSFLGANAFKNSKELTRVVFE

SEQ ID NO: 2928345 - protein, 17 aa, Entamoeba invadens
CKLLKPILIAKKKTVSC

SEQ ID NO: 2928346 - protein, 26 aa, Entamoeba invadens
CKLNKKWKLRFATINGSTLYYYKTEL

SEQ ID NO: 2928347 - protein, 18 aa, Entamoeba invadens
CKLSDYWNIREITGIASD

SEQ ID NO: 2928348 - protein, 20 aa, Entamoeba invadens
CKLSTYSATRWNYMANSSSA

SEQ ID NO: 2928349 - protein, 19 aa, Entamoeba invadens
CKLTKIDLPKSLQCIGEGA

SEQ ID NO: 2928350 - protein, 23 aa, Entamoeba invadens
CKLYAFREIHDFVTKALRLEAPS

SEQ ID NO: 2928351 - protein, 24 aa, Entamoeba invadens
CKLYKKPWYSYFVRVVDEDLNVSV

SEQ ID NO: 2928352 - protein, 27 aa, Entamoeba invadens
CKMKETFKREMKVLEDKLLQWTKQSDT

SEQ ID NO: 2928353 - protein, 17 aa, Entamoeba invadens
CKMKTMKIADNVISIKN

SEQ ID NO: 2928354 - protein, 19 aa, Entamoeba invadens
CKMPYTLNGENCFDCSDFK

SEQ ID NO: 2928355 - protein, 18 aa, Entamoeba invadens
CKMQEVIQHNRYIPWITL

SEQ ID NO: 2928356 - protein, 19 aa, Entamoeba invadens
CKMTMYLLEKSRIVSQAKE

SEQ ID NO: 2928357 - protein, 17 aa, Entamoeba invadens
CKNCGTASVGNARCNEC

SEQ ID NO: 2928358 - protein, 19 aa, Entamoeba invadens
CKNDIVLRNTLLQRSFLRA

SEQ ID NO: 2928359 - protein, 17 aa, Entamoeba invadens
CKNIKKLLLPKCLNTRF

SEQ ID NO: 2928360 - protein, 18 aa, Entamoeba invadens
CKNIKKLLLPKCLNTRFD

SEQ ID NO: 2928361 - protein, 18 aa, Entamoeba invadens
CKNLFLFILKKSMIDTSV

SEQ ID NO: 2928362 - protein, 32 aa, Entamoeba invadens
CKNLKMSVELPLCKKRIIFMSQNCDLNFENSP

SEQ ID NO: 2928363 - protein, 21 aa, Entamoeba invadens
CKNLLFFRAPINLIKIGDGCF

SEQ ID NO: 2928364 - protein, 30 aa, Entamoeba invadens
CKNLNFKNTCFEVAYFVFCCNSNLSLQQDV

SEQ ID NO: 2928365 - protein, 23 aa, Entamoeba invadens
CKNMKICPGAKVLYLSAASGTTV

SEQ ID NO: 2928366 - protein, 20 aa, Entamoeba invadens
CKNNSILMKRVNSIKYRDET

SEQ ID NO: 2928367 - protein, 24 aa, Entamoeba invadens
CKNPFLRCELGELFVVSIIQHEEV

SEQ ID NO: 2928368 - protein, 17 aa, Entamoeba invadens
CKNQVFKKHDLLRKRRE

SEQ ID NO: 2928369 - protein, 27 aa, Entamoeba invadens
CKNVCTRHTMLPCLYCNDHVFCSEKCR

SEQ ID NO: 2928370 - protein, 18 aa, Entamoeba invadens
CKNVLKNLLIIAVVLFSI

SEQ ID NO: 2928371 - protein, 19 aa, Entamoeba invadens
CKNWLSYGDRYIGGDYLKS

SEQ ID NO: 2928372 - protein, 19 aa, Entamoeba invadens
CKPNAFNGLNQMQFESMLN

SEQ ID NO: 2928373 - protein, 19 aa, Entamoeba invadens
CKQCIRKLLEKDPAKRLTD

SEQ ID NO: 2928374 - protein, 21 aa, Entamoeba invadens
CKQLEEIVCKSVGKKLKFSSC

SEQ ID NO: 2928375 - protein, 17 aa, Entamoeba invadens
CKQLKRAALGRMSSIVK

SEQ ID NO: 2928376 - protein, 19 aa, Entamoeba invadens
CKQNVRSLLGWEKVNGTLR

SEQ ID NO: 2928377 - protein, 20 aa, Entamoeba invadens
CKQSNERQSIKMFNDVQIIR

SEQ ID NO: 2928378 - protein, 20 aa, Entamoeba invadens
CKRCSDYYCKTCEISTEETC

SEQ ID NO: 2928379 - protein, 28 aa, Entamoeba invadens
CKRNQGLLKNAFCVIAQFANENLNKTIG

SEQ ID NO: 2928380 - protein, 17 aa, Entamoeba invadens
CKSETGSFISSRKASEV

SEQ ID NO: 2928381 - protein, 18 aa, Entamoeba invadens
CKSGFYLNNGRCFPCSEG

SEQ ID NO: 2928382 - protein, 26 aa, Entamoeba invadens
CKSHQKTFFPVFQFTLFPRVMSYLKQ

SEQ ID NO: 2928383 - protein, 17 aa, Entamoeba invadens
CKSKNNLMYFIADVLPD

SEQ ID NO: 2928384 - protein, 19 aa, Entamoeba invadens
CKSLEDFKAKKLYFQLTSE

SEQ ID NO: 2928385 - protein, 17 aa, Entamoeba invadens
CKSLRSVTIPSSVTLID

SEQ ID NO: 2928386 - protein, 19 aa, Entamoeba invadens
CKSLSALTLGTNIIKTAKN

SEQ ID NO: 2928387 - protein, 20 aa, Entamoeba invadens
CKSQCEVFEYAEKFKKTETS

SEQ ID NO: 2928388 - protein, 19 aa, Entamoeba invadens
CKTAVEIIESIFMVTRYSK

SEQ ID NO: 2928389 - protein, 27 aa, Entamoeba invadens
CKTDPTLYRNYFGISLIDLLNEENRMN

SEQ ID NO: 2928390 - protein, 22 aa, Entamoeba invadens
CKTEKGYYLGLRIENDKASILL

SEQ ID NO: 2928391 - protein, 35 aa, Entamoeba invadens
CKTIEEMMYCFGPIMTRFFLDEAIPYEKRYEIFAA

SEQ ID NO: 2928392 - protein, 19 aa, Entamoeba invadens
CKTKVPNKQANCLEIAMKL

SEQ ID NO: 2928393 - protein, 20 aa, Entamoeba invadens
CKTLKRIIGKIKGVQVVVKN

SEQ ID NO: 2928394 - protein, 19 aa, Entamoeba invadens
CKTLKTLILPKSFQVDYEN

SEQ ID NO: 2928395 - protein, 18 aa, Entamoeba invadens
CKTPVVSLFQENQWNSIV

SEQ ID NO: 2928396 - protein, 20 aa, Entamoeba invadens
CKTSMFYKTILADFVKQLNL

SEQ ID NO: 2928397 - protein, 30 aa, Entamoeba invadens
CKVGEGLFGPKLRSVTIPTTLTSIGKNIFT

SEQ ID NO: 2928398 - protein, 22 aa, Entamoeba invadens
CKVKPVHIKLCGVNATVGPVTV

SEQ ID NO: 2928399 - protein, 19 aa, Entamoeba invadens
CKVKQDLRAKRNVLMSELR

SEQ ID NO: 2928400 - protein, 24 aa, Entamoeba invadens
CKVTLKKDIKAVCKKCGKEYAMKS

SEQ ID NO: 2928401 - protein, 21 aa, Entamoeba invadens
CKYAPEFPGDYKIDIDIKNDT

SEQ ID NO: 2928402 - protein, 18 aa, Entamoeba invadens
CKYFSELLTFDVEELSPA

SEQ ID NO: 2928403 - protein, 19 aa, Entamoeba invadens
CKYSLISQSMCIKCLDTFK

SEQ ID NO: 2928404 - protein, 28 aa, Entamoeba invadens
CLAGRGRTGTIITCFLQYIKKCNSPQAA

SEQ ID NO: 2928405 - protein, 23 aa, Entamoeba invadens
CLAPEILRTLDIWEAFTQHLHLP

SEQ ID NO: 2928406 - protein, 20 aa, Entamoeba invadens
CLDCDNYLCFTCEDKYGLSE

SEQ ID NO: 2928407 - protein, 20 aa, Entamoeba invadens
CLDEYGHVISQLFKQGQRSS

SEQ ID NO: 2928408 - protein, 27 aa, Entamoeba invadens
CLDFCARPDVFLSFKYQSPSQNLEIEI

SEQ ID NO: 2928409 - protein, 27 aa, Entamoeba invadens
CLDNCKHLTQLVLRNCVAKDAFPTLKL

SEQ ID NO: 2928410 - protein, 19 aa, Entamoeba invadens
CLDNLPKEHLDTVAKFIEE

SEQ ID NO: 2928411 - protein, 21 aa, Entamoeba invadens
CLDSNCIDCSYNSKKCLRCQQ

SEQ ID NO: 2928412 - protein, 24 aa, Entamoeba invadens
CLDTDVLIHFIIRRSNRFFDDNVL

SEQ ID NO: 2928413 - protein, 19 aa, Entamoeba invadens
CLDVLKSNWSAVFDVSFIL

SEQ ID NO: 2928414 - protein, 20 aa, Entamoeba invadens
CLDYLNISSFVLKELKISVK

SEQ ID NO: 2928415 - protein, 23 aa, Entamoeba invadens
CLEAKDFTTCFERVNVYNKKIEE

SEQ ID NO: 2928416 - protein, 21 aa, Entamoeba invadens
CLEALNGLHINPFIKDFDVQH

SEQ ID NO: 2928417 - protein, 23 aa, Entamoeba invadens
CLEKLGFGGFCVYMGDSENDIPG

SEQ ID NO: 2928418 - protein, 19 aa, Entamoeba invadens
CLEQLELASIGGYIKSYKQ

SEQ ID NO: 2928419 - protein, 19 aa, Entamoeba invadens
CLESLHFKRFRYFFQAALK

SEQ ID NO: 2928420 - protein, 18 aa, Entamoeba invadens
CLETDFFDDIDIYSLGSV

SEQ ID NO: 2928421 - protein, 26 aa, Entamoeba invadens
CLETECLTCKTGFYLNNEKLCSPCSD

SEQ ID NO: 2928422 - protein, 18 aa, Entamoeba invadens
CLEVKVPFTVILDDPSGN

SEQ ID NO: 2928423 - protein, 18 aa, Entamoeba invadens
CLFQFINVMLQRYRNYVG

SEQ ID NO: 2928424 - protein, 26 aa, Entamoeba invadens
CLGCKKPMCVPVCPAHINIPQFISHL

SEQ ID NO: 2928425 - protein, 18 aa, Entamoeba invadens
CLGDFKVGDFYMKANEVE

SEQ ID NO: 2928426 - protein, 19 aa, Entamoeba invadens
CLHALLCAKMEEFKGKMVE

SEQ ID NO: 2928427 - protein, 18 aa, Entamoeba invadens
CLIAVWFSQHRKASSVRE

SEQ ID NO: 2928428 - protein, 22 aa, Entamoeba invadens
CLIPEKAIYTFEKWEKKLKEIT

SEQ ID NO: 2928429 - protein, 22 aa, Entamoeba invadens
CLKDLGDCLSMVYMFASQGLTT

SEQ ID NO: 2928430 - protein, 21 aa, Entamoeba invadens
CLKEDKGKDVFFFSDPTKKVL

SEQ ID NO: 2928431 - protein, 18 aa, Entamoeba invadens
CLKKLRYLKTHPDIEAKL

SEQ ID NO: 2928432 - protein, 21 aa, Entamoeba invadens
CLKVLPKEPRVWIYSAVIEEV

SEQ ID NO: 2928433 - protein, 19 aa, Entamoeba invadens
CLKYKNFNSAISILNGLEH

SEQ ID NO: 2928434 - protein, 18 aa, Entamoeba invadens
CLLDDPFVVDELMKNNVN

SEQ ID NO: 2928435 - protein, 22 aa, Entamoeba invadens
CLLGFLKISGFLEVTKWTNNIW

SEQ ID NO: 2928436 - protein, 27 aa, Entamoeba invadens
CLLGRSRSACIIAAYIMQTYKVKYTDV

SEQ ID NO: 2928437 - protein, 21 aa, Entamoeba invadens
CLLHTMPLNEFFNTANWSDDI

SEQ ID NO: 2928438 - protein, 19 aa, Entamoeba invadens
CLLLHGGIDQVDRQNTINE

SEQ ID NO: 2928439 - protein, 25 aa, Entamoeba invadens
CLLLKHLKCEIKWFNILPTNKVKTL

SEQ ID NO: 2928440 - protein, 17 aa, Entamoeba invadens
CLLLRDVFRINPAKVDW

SEQ ID NO: 2928441 - protein, 20 aa, Entamoeba invadens
CLLQSYPSMFEFKKELLSFI

SEQ ID NO: 2928442 - protein, 18 aa, Entamoeba invadens
CLLTHAFHSIIPEPSDFW

SEQ ID NO: 2928443 - protein, 34 aa, Entamoeba invadens
CLMDETRLVSVFTRIIIHRVFPYIWTPSICLLEN

SEQ ID NO: 2928444 - protein, 20 aa, Entamoeba invadens
CLNCFIGDIWFLTSNSKIEL

SEQ ID NO: 2928445 - protein, 26 aa, Entamoeba invadens
CLNEDATKRVLDWFWKEENQQIVEGL

SEQ ID NO: 2928446 - protein, 17 aa, Entamoeba invadens
CLNINFKTPEHLTTLKV

SEQ ID NO: 2928447 - protein, 19 aa, Entamoeba invadens
CLNTIHGCKVVIGENGYNF

SEQ ID NO: 2928448 - protein, 19 aa, Entamoeba invadens
CLNTRFKIIQHVANSEEEL

SEQ ID NO: 2928449 - protein, 21 aa, Entamoeba invadens
CLPAACLDTLRTMYGITPTLV

SEQ ID NO: 2928450 - protein, 19 aa, Entamoeba invadens
CLPNVKFSIVLNVSNACNI

SEQ ID NO: 2928451 - protein, 19 aa, Entamoeba invadens
CLPYLPKESQLVMKLAGYV

SEQ ID NO: 2928452 - protein, 19 aa, Entamoeba invadens
CLQFNTKIADWIKKSGKGL

SEQ ID NO: 2928453 - protein, 24 aa, Entamoeba invadens
CLQSCQITPIFVFDGAELPSKKMT

SEQ ID NO: 2928454 - protein, 21 aa, Entamoeba invadens
CLRCDGLYYFSELKCVVTTNC

SEQ ID NO: 2928455 - protein, 21 aa, Entamoeba invadens
CLSCSTFKGCKFCDNTIPNKC

SEQ ID NO: 2928456 - protein, 19 aa, Entamoeba invadens
CLSEITIPGSVTYIGSSCF

SEQ ID NO: 2928457 - protein, 34 aa, Entamoeba invadens
CLSLMGIDFPHFIREGFRILKTGGLMFIAEVKGR

SEQ ID NO: 2928458 - protein, 20 aa, Entamoeba invadens
CLSLTKISIGKRVERIGESC

SEQ ID NO: 2928459 - protein, 25 aa, Entamoeba invadens
CLSPATRSEFIFALDNLKNNRKVPG

SEQ ID NO: 2928460 - protein, 21 aa, Entamoeba invadens
CLSSLNMLNWKGHKLTVQYAR

SEQ ID NO: 2928461 - protein, 18 aa, Entamoeba invadens
CLSVIKCITKIFDDKHCE

SEQ ID NO: 2928462 - protein, 19 aa, Entamoeba invadens
CLSWKEAYPKKDFKYPWKI

SEQ ID NO: 2928463 - protein, 17 aa, Entamoeba invadens
CLSYKPEKLKVFKEGKQ

SEQ ID NO: 2928464 - protein, 26 aa, Entamoeba invadens
CLSYLAMKKKYSFIVLKNKRTNFKMA

SEQ ID NO: 2928465 - protein, 25 aa, Entamoeba invadens
CLSYLAMKKKYSFIVLNNKRTNFKM

SEQ ID NO: 2928466 - protein, 18 aa, Entamoeba invadens
CLTSDYRVFSLIPGTEEV

SEQ ID NO: 2928467 - protein, 24 aa, Entamoeba invadens
CLTSSGLCASAFMHLFEPFDTPVF

SEQ ID NO: 2928468 - protein, 19 aa, Entamoeba invadens
CLTVFSCSGGMKNRAGLLV

SEQ ID NO: 2928469 - protein, 18 aa, Entamoeba invadens
CLVERSWRSSNSISSIDV

SEQ ID NO: 2928470 - protein, 18 aa, Entamoeba invadens
CLVKAIRSTRAFEAEVIK

SEQ ID NO: 2928471 - protein, 22 aa, Entamoeba invadens
CLWYLMEYLNIVVLNSKVNKMT

SEQ ID NO: 2928472 - protein, 20 aa, Entamoeba invadens
CLYCNDHVFCSEKCRKKFGN

SEQ ID NO: 2928473 - protein, 18 aa, Entamoeba invadens
CLYFEELDLLIAGDTLFR

SEQ ID NO: 2928474 - protein, 19 aa, Entamoeba invadens
CLYNNPIICKHLIENRLLE

SEQ ID NO: 2928475 - protein, 25 aa, Entamoeba invadens
CLYPSKTGVIIAFDLAYNIYSAYGN

SEQ ID NO: 2928476 - protein, 17 aa, Entamoeba invadens
CMEGFDTKWRCEQALGV

SEQ ID NO: 2928477 - protein, 18 aa, Entamoeba invadens
CMEGFDTKWRCEQALGVG

SEQ ID NO: 2928478 - protein, 23 aa, Entamoeba invadens
CMEIVVLYKVRFVELTMPKTVKI

SEQ ID NO: 2928479 - protein, 17 aa, Entamoeba invadens
CMEKCIMCASKEKCDKC

SEQ ID NO: 2928480 - protein, 27 aa, Entamoeba invadens
CMEYKLKLPRLSKIFLTSDDYSTWGGF

SEQ ID NO: 2928481 - protein, 37 aa, Entamoeba invadens
CMFQYDCYGISYSHFFALPMYAEWAEKFLTTDWKSLM

SEQ ID NO: 2928482 - protein, 25 aa, Entamoeba invadens
CMIHPRVTHELVLFIEVAIHIDKTF

SEQ ID NO: 2928483 - protein, 21 aa, Entamoeba invadens
CMIILNEMLEFFIENKCGAVF

SEQ ID NO: 2928484 - protein, 17 aa, Entamoeba invadens
CMIRKVEKIEVIPLPEL

SEQ ID NO: 2928485 - protein, 28 aa, Entamoeba invadens
CMKNNASWCDLKKGINLNTINVLKDNEY

SEQ ID NO: 2928486 - protein, 18 aa, Entamoeba invadens
CMLDKFRSKIIVHFYGAV

SEQ ID NO: 2928487 - protein, 26 aa, Entamoeba invadens
CMLGGMKEIRFETITFSKASKDQQKD

SEQ ID NO: 2928488 - protein, 21 aa, Entamoeba invadens
CMLHPPIQKWTFTYNQLIHGI

SEQ ID NO: 2928489 - protein, 24 aa, Entamoeba invadens
CMMAGCKHKIHFELVKKTAPELAD

SEQ ID NO: 2928490 - protein, 18 aa, Entamoeba invadens
CMQIASSVTSYGRTMIEL

SEQ ID NO: 2928491 - protein, 24 aa, Entamoeba invadens
CMRSGCPSCLCLDVIRSVLDDFAY

SEQ ID NO: 2928492 - protein, 19 aa, Entamoeba invadens
CMSEMKFATDHIVPVLSPI

SEQ ID NO: 2928493 - protein, 23 aa, Entamoeba invadens
CMSSVYSCKTCFDLIQNTVEKLK

SEQ ID NO: 2928494 - protein, 17 aa, Entamoeba invadens
CMYERRLLSICPYLINA

SEQ ID NO: 2928495 - protein, 23 aa, Entamoeba invadens
CNASDAHFCLCLANAAVHIGMAG

SEQ ID NO: 2928496 - protein, 18 aa, Entamoeba invadens
CNCFSQWIVCTPTTLEVR

SEQ ID NO: 2928497 - protein, 37 aa, Entamoeba invadens
CNDAIQMLRINPPLFFFRLPFIFNFFPNLSTLRGNLI

SEQ ID NO: 2928498 - protein, 17 aa, Entamoeba invadens
CNEETNVFNLRYRTGEN

SEQ ID NO: 2928499 - protein, 20 aa, Entamoeba invadens
CNEFCGLSKFVPMSLGSVVT

SEQ ID NO: 2928500 - protein, 17 aa, Entamoeba invadens
CNEFEYGSWNCVDEFVF

SEQ ID NO: 2928501 - protein, 18 aa, Entamoeba invadens
CNESLKLENIKSFEYVYS

SEQ ID NO: 2928502 - protein, 18 aa, Entamoeba invadens
CNEVARVKSGVFVGETLF

SEQ ID NO: 2928503 - protein, 18 aa, Entamoeba invadens
CNFSAFYIPSNVVVVEEK

SEQ ID NO: 2928504 - protein, 17 aa, Entamoeba invadens
CNFTKQFSLDPNVKKMY

SEQ ID NO: 2928505 - protein, 18 aa, Entamoeba invadens
CNGGCGPTSMAMVIATLV

SEQ ID NO: 2928506 - protein, 25 aa, Entamoeba invadens
CNGIGDSVLPLFAISNIRKPKKDMK

SEQ ID NO: 2928507 - protein, 17 aa, Entamoeba invadens
CNGTFFVPVTSIKKVKI

SEQ ID NO: 2928508 - protein, 18 aa, Entamoeba invadens
CNHALGFYKYEIATENGK

SEQ ID NO: 2928509 - protein, 17 aa, Entamoeba invadens
CNHCNRDKINPIKYFKL

SEQ ID NO: 2928510 - protein, 19 aa, Entamoeba invadens
CNILSLLFWGIVSNDSTCL

SEQ ID NO: 2928511 - protein, 25 aa, Entamoeba invadens
CNIPFKCKYLSPILKNYNVCPISVF

SEQ ID NO: 2928512 - protein, 21 aa, Entamoeba invadens
CNIPKCIKMFYNFEEKDVDDT

SEQ ID NO: 2928513 - protein, 19 aa, Entamoeba invadens
CNITKIGFMAFLRCELLKK

SEQ ID NO: 2928514 - protein, 32 aa, Entamoeba invadens
CNITNIKTLKFVKVMQRKVCDYVMNGEMVKAH

SEQ ID NO: 2928515 - protein, 24 aa, Entamoeba invadens
CNKEHCDVFELCGGRCLYANGSKW

SEQ ID NO: 2928516 - protein, 24 aa, Entamoeba invadens
CNKEIGIDEDLIWLKTQLHARGLK

SEQ ID NO: 2928517 - protein, 19 aa, Entamoeba invadens
CNKLSLPMHFDQRAVEITR

SEQ ID NO: 2928518 - protein, 19 aa, Entamoeba invadens
CNKPKFVIGDQCFNGTQVV

SEQ ID NO: 2928519 - protein, 19 aa, Entamoeba invadens
CNKTCDNCYNPAQTEIVDL

SEQ ID NO: 2928520 - protein, 23 aa, Entamoeba invadens
CNKTCLRESFEAMVCGDELSGEN

SEQ ID NO: 2928521 - protein, 20 aa, Entamoeba invadens
CNKVIKVNRGIRGRSVSDIV

SEQ ID NO: 2928522 - protein, 22 aa, Entamoeba invadens
CNKYGNKCVEEFLNELNDNSVI

SEQ ID NO: 2928523 - protein, 20 aa, Entamoeba invadens
CNKYGNKCVEEFLNELNNNS

SEQ ID NO: 2928524 - protein, 18 aa, Entamoeba invadens
CNLDLKKNDFSVIEEQRN

SEQ ID NO: 2928525 - protein, 25 aa, Entamoeba invadens
CNLDNLKTLFIYQGNRLTFSKKLNS

SEQ ID NO: 2928526 - protein, 18 aa, Entamoeba invadens
CNLLKICVPKTVESLGEN

SEQ ID NO: 2928527 - protein, 20 aa, Entamoeba invadens
CNLPKLKIQILKICYCSSLK

SEQ ID NO: 2928528 - protein, 22 aa, Entamoeba invadens
CNLPNSCFECCKNLQEIAVPSR

SEQ ID NO: 2928529 - protein, 17 aa, Entamoeba invadens
CNLSRITIPLSVTSLGE

SEQ ID NO: 2928530 - protein, 17 aa, Entamoeba invadens
CNMKIESFSSLNVNLIF

SEQ ID NO: 2928531 - protein, 24 aa, Entamoeba invadens
CNNGRLMGAPDFVFTGLKNFTPKK

SEQ ID NO: 2928532 - protein, 18 aa, Entamoeba invadens
CNNIPMFVTEYIKMDLYK

SEQ ID NO: 2928533 - protein, 27 aa, Entamoeba invadens
CNNLKKHVWRCDGTCRDKPPFYGYVKR

SEQ ID NO: 2928534 - protein, 18 aa, Entamoeba invadens
CNNLPNPSLYVVDNNETH

SEQ ID NO: 2928535 - protein, 28 aa, Entamoeba invadens
CNNTFTARYRMGYFKRIKKVLEKSKQVV

SEQ ID NO: 2928536 - protein, 17 aa, Entamoeba invadens
CNPDHLIAVPRVLQRVK

SEQ ID NO: 2928537 - protein, 20 aa, Entamoeba invadens
CNPHMRIACKSGKLICNSML

SEQ ID NO: 2928538 - protein, 25 aa, Entamoeba invadens
CNQIPELPEKFSLLTNLEMLELSCN

SEQ ID NO: 2928539 - protein, 25 aa, Entamoeba invadens
CNQIPELPEKFSLLTNLETLELSCN

SEQ ID NO: 2928540 - protein, 18 aa, Entamoeba invadens
CNQLKLPLSAPQFEENSC

SEQ ID NO: 2928541 - protein, 25 aa, Entamoeba invadens
CNQMCFPPPPFGRFGGWERRRRHHP

SEQ ID NO: 2928542 - protein, 20 aa, Entamoeba invadens
CNQVCIGLGISKNVHDVQTP

SEQ ID NO: 2928543 - protein, 24 aa, Entamoeba invadens
CNSNVRYNKLIFNSMELVKMNNGS

SEQ ID NO: 2928544 - protein, 22 aa, Entamoeba invadens
CNTCGQTGCTLCRNTYYVEGKK

SEQ ID NO: 2928545 - protein, 17 aa, Entamoeba invadens
CNTDLREGKALKRIQTM

SEQ ID NO: 2928546 - protein, 25 aa, Entamoeba invadens
CNTILMDVPVCFVLNKSDLSTEESR

SEQ ID NO: 2928547 - protein, 26 aa, Entamoeba invadens
CNTPEKWNLSQLFLLTEFRMKHCCSK

SEQ ID NO: 2928548 - protein, 17 aa, Entamoeba invadens
CNTRYGFCTGCLSNYVF

SEQ ID NO: 2928549 - protein, 19 aa, Entamoeba invadens
CNTSLEFKKGKTSIVCVQM

SEQ ID NO: 2928550 - protein, 21 aa, Entamoeba invadens
CNVCNFANSCFYLYENLSEII

SEQ ID NO: 2928551 - protein, 23 aa, Entamoeba invadens
CNVCVNGVLTMCYGVDGVPAYVD

SEQ ID NO: 2928552 - protein, 17 aa, Entamoeba invadens
CNVLFSIYLSGVLKMGK

SEQ ID NO: 2928553 - protein, 23 aa, Entamoeba invadens
CNVNCKLFVACMFFTQIVLSKVK

SEQ ID NO: 2928554 - protein, 20 aa, Entamoeba invadens
CNVTELFKAITERLCALQPT

SEQ ID NO: 2928555 - protein, 17 aa, Entamoeba invadens
CNYCAIKGNFDLEIISF

SEQ ID NO: 2928556 - protein, 19 aa, Entamoeba invadens
CPAHRCNLFAQDVGMEAPF

SEQ ID NO: 2928557 - protein, 22 aa, Entamoeba invadens
CPALSFKQIFDIIAKFEPPVNI

SEQ ID NO: 2928558 - protein, 25 aa, Entamoeba invadens
CPAPHKCPVCNAIISPPFTICDIKI

SEQ ID NO: 2928559 - protein, 18 aa, Entamoeba invadens
CPCLVCTRTDDLKRLKSC

SEQ ID NO: 2928560 - protein, 19 aa, Entamoeba invadens
CPCPLCTSPTNIIIKKNTM

SEQ ID NO: 2928561 - protein, 17 aa, Entamoeba invadens
CPDTVLCAMCNKEVCYT

SEQ ID NO: 2928562 - protein, 25 aa, Entamoeba invadens
CPEHQIKRLVLIYLESIQKTENGQL

SEQ ID NO: 2928563 - protein, 20 aa, Entamoeba invadens
CPEMRVFKQVYEFVVNENNY

SEQ ID NO: 2928564 - protein, 28 aa, Entamoeba invadens
CPEPHLVKLLAELGCGFDCASIDEIKEV

SEQ ID NO: 2928565 - protein, 18 aa, Entamoeba invadens
CPETLCGLTVINSKSEEC

SEQ ID NO: 2928566 - protein, 21 aa, Entamoeba invadens
CPFSARLKFETHVGAILQIDS

SEQ ID NO: 2928567 - protein, 20 aa, Entamoeba invadens
CPGGIGFDINCGVRLLRTNL

SEQ ID NO: 2928568 - protein, 20 aa, Entamoeba invadens
CPGSLGPLRTFKRVFATPIQ

SEQ ID NO: 2928569 - protein, 40 aa, Entamoeba invadens
CPHEELLRHSLPVIFRIFIFGSLPPNFGITLYNTASRMSG

SEQ ID NO: 2928570 - protein, 18 aa, Entamoeba invadens
CPHGQYVIMDYNKGALVF

SEQ ID NO: 2928571 - protein, 18 aa, Entamoeba invadens
CPHYIKVLGTKRVLAAGD

SEQ ID NO: 2928572 - protein, 17 aa, Entamoeba invadens
CPICMSVPHPSHAIEHS

SEQ ID NO: 2928573 - protein, 17 aa, Entamoeba invadens
CPIKEYNLLDEAQKNAM

SEQ ID NO: 2928574 - protein, 29 aa, Entamoeba invadens
CPISQKCTMKWRKGLFPWNRGKEFVTGAV

SEQ ID NO: 2928575 - protein, 20 aa, Entamoeba invadens
CPISTFTLKITSMIDSKIVS

SEQ ID NO: 2928576 - protein, 25 aa, Entamoeba invadens
CPKDNCGEIVRMCAAAYLALGQNRL

SEQ ID NO: 2928577 - protein, 17 aa, Entamoeba invadens
CPLCGMPGDYFRIKVDI

SEQ ID NO: 2928578 - protein, 17 aa, Entamoeba invadens
CPLCGMPGDYFRVKVDI

SEQ ID NO: 2928579 - protein, 25 aa, Entamoeba invadens
CPLELKAACGAILYASPYFPDHTEM

SEQ ID NO: 2928580 - protein, 27 aa, Entamoeba invadens
CPLFVSIPVCRTTCFSLIICDENTKYT

SEQ ID NO: 2928581 - protein, 20 aa, Entamoeba invadens
CPLPHQYNSIFPPNRDNFKT

SEQ ID NO: 2928582 - protein, 18 aa, Entamoeba invadens
CPLVLIFNPNAFKNFVYD

SEQ ID NO: 2928583 - protein, 22 aa, Entamoeba invadens
CPLYPIDGGVAIISRYPIVKSH

SEQ ID NO: 2928584 - protein, 17 aa, Entamoeba invadens
CPMDPGGYFVVKGVERV

SEQ ID NO: 2928585 - protein, 22 aa, Entamoeba invadens
CPNDKIHGVFSLYDITMDRKLI

SEQ ID NO: 2928586 - protein, 18 aa, Entamoeba invadens
CPNLVKFNVIEKVNQFTG

SEQ ID NO: 2928587 - protein, 17 aa, Entamoeba invadens
CPNNCMSCINATVCIEC

SEQ ID NO: 2928588 - protein, 19 aa, Entamoeba invadens
CPNYKKCYPKRFLQKKFDK

SEQ ID NO: 2928589 - protein, 23 aa, Entamoeba invadens
CPPLCSECQESGKNKCDVIQTLS

SEQ ID NO: 2928590 - protein, 20 aa, Entamoeba invadens
CPQKCSWSLLDDHIEFTNIS

SEQ ID NO: 2928591 - protein, 17 aa, Entamoeba invadens
CPQYCGLLMNNMNLSQM

SEQ ID NO: 2928592 - protein, 19 aa, Entamoeba invadens
CPSCPLSPIQCSSSSIISL

SEQ ID NO: 2928593 - protein, 19 aa, Entamoeba invadens
CPSPSFSPLEHVKKNQGVV

SEQ ID NO: 2928594 - protein, 17 aa, Entamoeba invadens
CPSTPSGVPPENKEENK

SEQ ID NO: 2928595 - protein, 17 aa, Entamoeba invadens
CPSYCEIYIQKTKALLV

SEQ ID NO: 2928596 - protein, 24 aa, Entamoeba invadens
CPTCVPKKFGFPMSKRLLHDRIIK

SEQ ID NO: 2928597 - protein, 17 aa, Entamoeba invadens
CPTDILDLLDSVEEMMK

SEQ ID NO: 2928598 - protein, 21 aa, Entamoeba invadens
CPTEKMLARDSYFGTFIRQRI

SEQ ID NO: 2928599 - protein, 17 aa, Entamoeba invadens
CPTKFGIKKLGEVLKIS

SEQ ID NO: 2928600 - protein, 17 aa, Entamoeba invadens
CPTPFTWKLTQSKQSLV

SEQ ID NO: 2928601 - protein, 23 aa, Entamoeba invadens
CPTSFRLLTRPKLVIQYTPSMHK

SEQ ID NO: 2928602 - protein, 18 aa, Entamoeba invadens
CPTSYGWSVEGFLISISE

SEQ ID NO: 2928603 - protein, 18 aa, Entamoeba invadens
CPTTRHLIELMKQPHASD

SEQ ID NO: 2928604 - protein, 18 aa, Entamoeba invadens
CPVARIVVMLEKPNVISF

SEQ ID NO: 2928605 - protein, 21 aa, Entamoeba invadens
CPVEGNKLIALMTEKQNCYIY

SEQ ID NO: 2928606 - protein, 20 aa, Entamoeba invadens
CPVKKLTLNSVFALMSQEKK

SEQ ID NO: 2928607 - protein, 18 aa, Entamoeba invadens
CPVKKLTLNTVFALMTQE

SEQ ID NO: 2928608 - protein, 19 aa, Entamoeba invadens
CPVLDFIINELFKKNRETS

SEQ ID NO: 2928609 - protein, 17 aa, Entamoeba invadens
CPVYCLVDFDPCGLDIF

SEQ ID NO: 2928610 - protein, 20 aa, Entamoeba invadens
CPYCNTSMLVTEFYRFYQYD

SEQ ID NO: 2928611 - protein, 17 aa, Entamoeba invadens
CQCACGAAPGEKKEKVK

SEQ ID NO: 2928612 - protein, 34 aa, Entamoeba invadens
CQCSCYKPELYGDLKVKACSMLKDSVNVDKLSGK

SEQ ID NO: 2928613 - protein, 19 aa, Entamoeba invadens
CQDLFKISRQLTGFASKIS

SEQ ID NO: 2928614 - protein, 20 aa, Entamoeba invadens
CQEHNDACCGSCCHDHDDAQ

SEQ ID NO: 2928615 - protein, 22 aa, Entamoeba invadens
CQELKTKLSEYFKYKDTINTVD

SEQ ID NO: 2928616 - protein, 26 aa, Entamoeba invadens
CQFESIEIPPTISIFGDEVFSTCEKV

SEQ ID NO: 2928617 - protein, 25 aa, Entamoeba invadens
CQFKLIRYIFPLALLNMIVSCSLET

SEQ ID NO: 2928618 - protein, 19 aa, Entamoeba invadens
CQFMSSVYFLEFPQRTNLP

SEQ ID NO: 2928619 - protein, 30 aa, Entamoeba invadens
CQFQVPQKVRFVGSFAFKNCEQLDELNFNE

SEQ ID NO: 2928620 - protein, 24 aa, Entamoeba invadens
CQHSFCSLCIRRLISNNMSCPICK

SEQ ID NO: 2928621 - protein, 17 aa, Entamoeba invadens
CQICSLKTFNFNNSKCE

SEQ ID NO: 2928622 - protein, 20 aa, Entamoeba invadens
CQIVVPKIEIEYIKKELNIH

SEQ ID NO: 2928623 - protein, 34 aa, Entamoeba invadens
CQKRYLERRKEVWIAPLFFEFPGYEQVMFKERFC

SEQ ID NO: 2928624 - protein, 26 aa, Entamoeba invadens
CQKSGFKGKTYLGIREIYEKDGKYQL

SEQ ID NO: 2928625 - protein, 17 aa, Entamoeba invadens
CQLHHIVYSLIKTRQSE

SEQ ID NO: 2928626 - protein, 17 aa, Entamoeba invadens
CQLQHMMNVKKVTKSTT

SEQ ID NO: 2928627 - protein, 19 aa, Entamoeba invadens
CQLTRIHGLFELIPGKLYQ

SEQ ID NO: 2928628 - protein, 26 aa, Entamoeba invadens
CQLYDKLCSIGFEMNYFVTWFADLFI

SEQ ID NO: 2928629 - protein, 17 aa, Entamoeba invadens
CQLYHFAKSLNLLDDDS

SEQ ID NO: 2928630 - protein, 22 aa, Entamoeba invadens
CQMRYVYYFDCYLRSFENFIKI

SEQ ID NO: 2928631 - protein, 29 aa, Entamoeba invadens
CQNILFGKECVFLSLKKVVLESVFSVTFD

SEQ ID NO: 2928632 - protein, 30 aa, Entamoeba invadens
CQNITKFGLRCFIHNRILRKITLSPNLHEI

SEQ ID NO: 2928633 - protein, 35 aa, Entamoeba invadens
CQQLEFPKLPSLLTELGSFAFLNCKKLTVVDISSF

SEQ ID NO: 2928634 - protein, 25 aa, Entamoeba invadens
CQRCDGRGSIYVMIRQGMFAMQSEK

SEQ ID NO: 2928635 - protein, 25 aa, Entamoeba invadens
CQRFDFKAKSLFTATAMSLRDRMIE

SEQ ID NO: 2928636 - protein, 18 aa, Entamoeba invadens
CQSCRTFDSLCATSNGMC

SEQ ID NO: 2928637 - protein, 23 aa, Entamoeba invadens
CQSDILKLRKADLLVQTASEEDF

SEQ ID NO: 2928638 - protein, 25 aa, Entamoeba invadens
CQSIYSGYRTQFWNANYNSGYIEDL

SEQ ID NO: 2928639 - protein, 17 aa, Entamoeba invadens
CQSLCVINSNDLQITRN

SEQ ID NO: 2928640 - protein, 26 aa, Entamoeba invadens
CQSLREYLRAFDIIGLILQSASNITR

SEQ ID NO: 2928641 - protein, 18 aa, Entamoeba invadens
CQSLRKIYLGGFAVDTYP

SEQ ID NO: 2928642 - protein, 24 aa, Entamoeba invadens
CQSLYRRVLTMGLSRRFVEGDTFK

SEQ ID NO: 2928643 - protein, 21 aa, Entamoeba invadens
CQSNYICLHHWRENRREYLEH

SEQ ID NO: 2928644 - protein, 18 aa, Entamoeba invadens
CQSSCKLSGGKNECSIYG

SEQ ID NO: 2928645 - protein, 18 aa, Entamoeba invadens
CQTNALCVMDYFRANNRL

SEQ ID NO: 2928646 - protein, 26 aa, Entamoeba invadens
CQWMSCYKCHSFFCWVCMQVTNDHQH

SEQ ID NO: 2928647 - protein, 26 aa, Entamoeba invadens
CQWNMPLSRFTAMVKFGPLSHTLQCV

SEQ ID NO: 2928648 - protein, 27 aa, Entamoeba invadens
CQYEPEVFPVLVFRTTQPKVTLLVFST

SEQ ID NO: 2928649 - protein, 18 aa, Entamoeba invadens
CQYHHICAAVADEEIFLG

SEQ ID NO: 2928650 - protein, 27 aa, Entamoeba invadens
CRADFYKWISCAKFEVLYDSERPIPIT

SEQ ID NO: 2928651 - protein, 17 aa, Entamoeba invadens
CRAECQYYLGFYDANPA

SEQ ID NO: 2928652 - protein, 17 aa, Entamoeba invadens
CRAETAGLYLTYDKTVG

SEQ ID NO: 2928653 - protein, 18 aa, Entamoeba invadens
CRALPSRITIDFHGITKN

SEQ ID NO: 2928654 - protein, 17 aa, Entamoeba invadens
CRALREITIPQSVTRME

SEQ ID NO: 2928655 - protein, 20 aa, Entamoeba invadens
CRAQVTAIIKTCEALEANLK

SEQ ID NO: 2928656 - protein, 40 aa, Entamoeba invadens
CRCCSKKFKSGGVFCHKCCAVFICDKCRGNPEVFSLITNT

SEQ ID NO: 2928657 - protein, 27 aa, Entamoeba invadens
CRDKIVTNCSSFIRPSITILTHGMSMV

SEQ ID NO: 2928658 - protein, 20 aa, Entamoeba invadens
CRDNIKQIYQDQSFDLTKTF

SEQ ID NO: 2928659 - protein, 17 aa, Entamoeba invadens
CREKHYTVREFKRETTS

SEQ ID NO: 2928660 - protein, 18 aa, Entamoeba invadens
CREQIRRMKKKELEATRE

SEQ ID NO: 2928661 - protein, 18 aa, Entamoeba invadens
CRERYCYHLDPKINKRMW

SEQ ID NO: 2928662 - protein, 21 aa, Entamoeba invadens
CREVKYFPFDFHKECANSKYE

SEQ ID NO: 2928663 - protein, 19 aa, Entamoeba invadens
CRFCLQRRDFESGKRFSNI

SEQ ID NO: 2928664 - protein, 27 aa, Entamoeba invadens
CRFGIIKRRALRLDVGYFTWVSQAMTK

SEQ ID NO: 2928665 - protein, 25 aa, Entamoeba invadens
CRFGVHIKKALNFVVPNGMKSEGYD

SEQ ID NO: 2928666 - protein, 17 aa, Entamoeba invadens
CRGLMGVTLPTTLEFLV

SEQ ID NO: 2928667 - protein, 20 aa, Entamoeba invadens
CRGLVEYFDVISLMDVNATV

SEQ ID NO: 2928668 - protein, 20 aa, Entamoeba invadens
CRGSEKKIAVLGPYSKTLSY

SEQ ID NO: 2928669 - protein, 21 aa, Entamoeba invadens
CRIEEACFEKCYSLTSLNLKD

SEQ ID NO: 2928670 - protein, 22 aa, Entamoeba invadens
CRIGACRVLFVGAHFTAGDGPE

SEQ ID NO: 2928671 - protein, 20 aa, Entamoeba invadens
CRIGVCRVLFVGTHFYANMG

SEQ ID NO: 2928672 - protein, 17 aa, Entamoeba invadens
CRINYVLVKKACNEETY

SEQ ID NO: 2928673 - protein, 20 aa, Entamoeba invadens
CRKDFYEVVIGFGVPSSPTL

SEQ ID NO: 2928674 - protein, 20 aa, Entamoeba invadens
CRKFKTFATEDWLSMRCEIL

SEQ ID NO: 2928675 - protein, 19 aa, Entamoeba invadens
CRKGVIYLTSFDSFHSGRY

SEQ ID NO: 2928676 - protein, 19 aa, Entamoeba invadens
CRKGVIYLTSFDSFNSGRF

SEQ ID NO: 2928677 - protein, 19 aa, Entamoeba invadens
CRKICEKPLRIVVEKVSSI

SEQ ID NO: 2928678 - protein, 22 aa, Entamoeba invadens
CRKLEAIESLTFVTEIGENCFC

SEQ ID NO: 2928679 - protein, 18 aa, Entamoeba invadens
CRKLKSVTLPSEICIIQN

SEQ ID NO: 2928680 - protein, 20 aa, Entamoeba invadens
CRKMAKLVKNVFLWCEVEGN

SEQ ID NO: 2928681 - protein, 17 aa, Entamoeba invadens
CRKRRLSDYNQHCQIEH

SEQ ID NO: 2928682 - protein, 25 aa, Entamoeba invadens
CRKVPKPRYFYLFNDIMMYGIESLG

SEQ ID NO: 2928683 - protein, 26 aa, Entamoeba invadens
CRLHPTRFFDPFKFKLFPRVMTYLNQ

SEQ ID NO: 2928684 - protein, 17 aa, Entamoeba invadens
CRLKFSEMFDLYNMSDF

SEQ ID NO: 2928685 - protein, 17 aa, Entamoeba invadens
CRLLHAVKKVLLLAYEN

SEQ ID NO: 2928686 - protein, 17 aa, Entamoeba invadens
CRLLQKIYIVVATLDDF

SEQ ID NO: 2928687 - protein, 19 aa, Entamoeba invadens
CRLLVCSDLAESIELDKEW

SEQ ID NO: 2928688 - protein, 25 aa, Entamoeba invadens
CRLNVEPFDSFNLLEKLVKYQKFAF

SEQ ID NO: 2928689 - protein, 24 aa, Entamoeba invadens
CRLRGHLNVIRAAVVYDDIVITAG

SEQ ID NO: 2928690 - protein, 26 aa, Entamoeba invadens
CRMQDKRALYALSIHLYKEENKLNES

SEQ ID NO: 2928691 - protein, 24 aa, Entamoeba invadens
CRNASCALFDFFGAMPHKHPSNTK

SEQ ID NO: 2928692 - protein, 19 aa, Entamoeba invadens
CRNFGNFIMFVFAASEGAE

SEQ ID NO: 2928693 - protein, 20 aa, Entamoeba invadens
CRNKEACFVNYLSYNLLQFG

SEQ ID NO: 2928694 - protein, 24 aa, Entamoeba invadens
CRNMTYKRLLCMHEHINNLGSNNF

SEQ ID NO: 2928695 - protein, 19 aa, Entamoeba invadens
CRNQCQCASCKRRELKKLG

SEQ ID NO: 2928696 - protein, 19 aa, Entamoeba invadens
CRPDRAFSKNDLHKVQVTK

SEQ ID NO: 2928697 - protein, 19 aa, Entamoeba invadens
CRPIICPNSSFVKQLKEYE

SEQ ID NO: 2928698 - protein, 26 aa, Entamoeba invadens
CRPSRKTFVAQPFLPIVKIIFSQTDV

SEQ ID NO: 2928699 - protein, 19 aa, Entamoeba invadens
CRQCGCEIWEDTLVLLSPT

SEQ ID NO: 2928700 - protein, 19 aa, Entamoeba invadens
CRQKRDIVYLCPKNEKHRF

SEQ ID NO: 2928701 - protein, 29 aa, Entamoeba invadens
CRRTEAFLLRLALHKTFPSTRMAVIAEFG

SEQ ID NO: 2928702 - protein, 23 aa, Entamoeba invadens
CRRVIDMKCPVWKKYLKEGEKYV

SEQ ID NO: 2928703 - protein, 18 aa, Entamoeba invadens
CRSDPRITKPFELIAMGK

SEQ ID NO: 2928704 - protein, 17 aa, Entamoeba invadens
CRSERLCKYNQLMRIEE

SEQ ID NO: 2928705 - protein, 25 aa, Entamoeba invadens
CRSNPRKMVTMWAEKEMRNLKRLGD

SEQ ID NO: 2928706 - protein, 18 aa, Entamoeba invadens
CRSSCKKSEKREKEQRVE

SEQ ID NO: 2928707 - protein, 20 aa, Entamoeba invadens
CRSVIYKMGKELSISGQVEL

SEQ ID NO: 2928708 - protein, 20 aa, Entamoeba invadens
CRTDVLKTWTCFDEIEKKPN

SEQ ID NO: 2928709 - protein, 17 aa, Entamoeba invadens
CRTFLYSHINHHTSSHC

SEQ ID NO: 2928710 - protein, 18 aa, Entamoeba invadens
CRTKMAFDRSKGVSEKTS

SEQ ID NO: 2928711 - protein, 19 aa, Entamoeba invadens
CRTYATLSFVCVFDDNENE

SEQ ID NO: 2928712 - protein, 23 aa, Entamoeba invadens
CRVKNLRSSMDFENVLSDEFLTY

SEQ ID NO: 2928713 - protein, 19 aa, Entamoeba invadens
CRVLDHMDLLYSYYRIAEI

SEQ ID NO: 2928714 - protein, 17 aa, Entamoeba invadens
CRVNRRLLKIQIPQKGC

SEQ ID NO: 2928715 - protein, 20 aa, Entamoeba invadens
CRVVQRLIEKAAFLPIAGKL

SEQ ID NO: 2928716 - protein, 29 aa, Entamoeba invadens
CRYAAISSFALRIDKYFPTIGKGGQFDAV

SEQ ID NO: 2928717 - protein, 26 aa, Entamoeba invadens
CSAGLGRSGTFIGVLRVVEEHVEKLL

SEQ ID NO: 2928718 - protein, 24 aa, Entamoeba invadens
CSAGPVGDDLFHWVATITGPDDSP

SEQ ID NO: 2928719 - protein, 18 aa, Entamoeba invadens
CSAIVLWLDCDREGENIC

SEQ ID NO: 2928720 - protein, 19 aa, Entamoeba invadens
CSAKFNVGINFLFEKLKKI

SEQ ID NO: 2928721 - protein, 25 aa, Entamoeba invadens
CSAKLADFGLAWVIGNHKINCKCEG

SEQ ID NO: 2928722 - protein, 25 aa, Entamoeba invadens
CSALSCVKMSCKVKCVEDYCFEDCA

SEQ ID NO: 2928723 - protein, 20 aa, Entamoeba invadens
CSALTRKGLVEVFETAVEMV

SEQ ID NO: 2928724 - protein, 20 aa, Entamoeba invadens
CSASSAVACCLALGHSVDKL

SEQ ID NO: 2928725 - protein, 21 aa, Entamoeba invadens
CSCCLCQKSRLFQLANPKIKT

SEQ ID NO: 2928726 - protein, 21 aa, Entamoeba invadens
CSCCYECFYVVTNSITTTQSM

SEQ ID NO: 2928727 - protein, 17 aa, Entamoeba invadens
CSCISALTIPGNFPKID

SEQ ID NO: 2928728 - protein, 17 aa, Entamoeba invadens
CSCRKCKVTIIKNTDGC

SEQ ID NO: 2928729 - protein, 30 aa, Entamoeba invadens
CSDAVFRSGHLDCWSSLVMPKDEYNENVTG

SEQ ID NO: 2928730 - protein, 21 aa, Entamoeba invadens
CSDEIPILMYLTILKSIIEKA

SEQ ID NO: 2928731 - protein, 22 aa, Entamoeba invadens
CSDHCLYCETFEFCLSCKNTHI

SEQ ID NO: 2928732 - protein, 17 aa, Entamoeba invadens
CSDMAFCQSEYNSFLHE

SEQ ID NO: 2928733 - protein, 17 aa, Entamoeba invadens
CSDMLGILLTRHGSHFK

SEQ ID NO: 2928734 - protein, 17 aa, Entamoeba invadens
CSDYLFKILLIGDSGVG

SEQ ID NO: 2928735 - protein, 18 aa, Entamoeba invadens
CSECAKHMKKCPICGKTD

SEQ ID NO: 2928736 - protein, 26 aa, Entamoeba invadens
CSECGCKDPQWISVNLGILFCIKCSG

SEQ ID NO: 2928737 - protein, 29 aa, Entamoeba invadens
CSEDRSVYSLECCKNWMGKMSVVYSLDSP

SEQ ID NO: 2928738 - protein, 17 aa, Entamoeba invadens
CSEGVSILSDFVDKERV

SEQ ID NO: 2928739 - protein, 18 aa, Entamoeba invadens
CSELFIWASELFDDQSIF

SEQ ID NO: 2928740 - protein, 20 aa, Entamoeba invadens
CSELGVVVNNFFFSRDYCDV

SEQ ID NO: 2928741 - protein, 18 aa, Entamoeba invadens
CSELSPIVDEAFKTIKED

SEQ ID NO: 2928742 - protein, 20 aa, Entamoeba invadens
CSEMKCPYNYQYQHNALYWK

SEQ ID NO: 2928743 - protein, 26 aa, Entamoeba invadens
CSEPNCTRQGFSFCLTCSKIYCESHT

SEQ ID NO: 2928744 - protein, 18 aa, Entamoeba invadens
CSESICFSSFSESQYRTK

SEQ ID NO: 2928745 - protein, 23 aa, Entamoeba invadens
CSESRCCCTIFNIDRIPCIHMIK

SEQ ID NO: 2928746 - protein, 23 aa, Entamoeba invadens
CSETLCDNCDLIIQNIEKTLLLE

SEQ ID NO: 2928747 - protein, 19 aa, Entamoeba invadens
CSETSPTSAPVVWSSEEQT

SEQ ID NO: 2928748 - protein, 25 aa, Entamoeba invadens
CSFGSHTWPTWGNKNIVEYYEKQRD

SEQ ID NO: 2928749 - protein, 23 aa, Entamoeba invadens
CSFKRRYAHPYSEIKQVNVVSAL

SEQ ID NO: 2928750 - protein, 24 aa, Entamoeba invadens
CSFKSDVYSLSFVIWEIFTQKRPF

SEQ ID NO: 2928751 - protein, 20 aa, Entamoeba invadens
CSFQTQFRVWCYPFDSGPVI

SEQ ID NO: 2928752 - protein, 20 aa, Entamoeba invadens
CSFREYPYNQSVRWAIENAK

SEQ ID NO: 2928753 - protein, 19 aa, Entamoeba invadens
CSFTLFKPKKESVVGICSA

SEQ ID NO: 2928754 - protein, 17 aa, Entamoeba invadens
CSGALAARLECFNELEK

SEQ ID NO: 2928755 - protein, 19 aa, Entamoeba invadens
CSGIHREFGHRVKSISMAT

SEQ ID NO: 2928756 - protein, 22 aa, Entamoeba invadens
CSGMFRKRVAMHLNTDTLIECV

SEQ ID NO: 2928757 - protein, 18 aa, Entamoeba invadens
CSHDPILVRGLYDKEMYI

SEQ ID NO: 2928758 - protein, 18 aa, Entamoeba invadens
CSHEFIDPVTLSCGHTFC

SEQ ID NO: 2928759 - protein, 22 aa, Entamoeba invadens
CSIALGGAIHGEKVYKKKEEDT

SEQ ID NO: 2928760 - protein, 20 aa, Entamoeba invadens
CSIDMSLLFYTKNRLCNYTK

SEQ ID NO: 2928761 - protein, 30 aa, Entamoeba invadens
CSIEEARESLGMFAPCAFSIYRRFKREKHL

SEQ ID NO: 2928762 - protein, 19 aa, Entamoeba invadens
CSIEGFCGDSDPAYHTTKR

SEQ ID NO: 2928763 - protein, 22 aa, Entamoeba invadens
CSIESLLEYDSLLTHLSRALHD

SEQ ID NO: 2928764 - protein, 25 aa, Entamoeba invadens
CSIRDVFRQPLLFKIINEEKAGRKE

SEQ ID NO: 2928765 - protein, 19 aa, Entamoeba invadens
CSISDCPFRNVAMSAEDRQ

SEQ ID NO: 2928766 - protein, 24 aa, Entamoeba invadens
CSITETPTGWKFFGNLMDSGKISL

SEQ ID NO: 2928767 - protein, 24 aa, Entamoeba invadens
CSKAIRLSTVSSFNRTLLGVMNNL

SEQ ID NO: 2928768 - protein, 21 aa, Entamoeba invadens
CSKCSVNNCFVCAQDGSCDTC

SEQ ID NO: 2928769 - protein, 19 aa, Entamoeba invadens
CSKEIVGILPNFGVVGNTE

SEQ ID NO: 2928770 - protein, 17 aa, Entamoeba invadens
CSKENRPKVFSVLQKLE

SEQ ID NO: 2928771 - protein, 29 aa, Entamoeba invadens
CSKKAIVLCAPYKLCYYNFFLEFYYNLGT

SEQ ID NO: 2928772 - protein, 25 aa, Entamoeba invadens
CSKKFAGVVGCPICNGECTCAHCKR

SEQ ID NO: 2928773 - protein, 34 aa, Entamoeba invadens
CSKLPSVMFSRNLKFLGGEGFCECTTLSKVVLPE

SEQ ID NO: 2928774 - protein, 18 aa, Entamoeba invadens
CSKNTIILNETFKFLNVV

SEQ ID NO: 2928775 - protein, 39 aa, Entamoeba invadens
CSKYKKMFVRYLWEIFTTELFEYIWPPLIERNEQNIVFV

SEQ ID NO: 2928776 - protein, 19 aa, Entamoeba invadens
CSLALEMLTMFFETDTFSS

SEQ ID NO: 2928777 - protein, 17 aa, Entamoeba invadens
CSLCNNGDNCISCNSTN

SEQ ID NO: 2928778 - protein, 18 aa, Entamoeba invadens
CSLDGKRVAVSAVSGSVS

SEQ ID NO: 2928779 - protein, 31 aa, Entamoeba invadens
CSLFLVMEFCPGGDLACLLREIEILPESTVK

SEQ ID NO: 2928780 - protein, 19 aa, Entamoeba invadens
CSLITTFLVSFLPKTLPTQ

SEQ ID NO: 2928781 - protein, 17 aa, Entamoeba invadens
CSLKALDGYVMEWDTES

SEQ ID NO: 2928782 - protein, 20 aa, Entamoeba invadens
CSLLTSIELCGNFSTIEGYK

SEQ ID NO: 2928783 - protein, 17 aa, Entamoeba invadens
CSLSEIYIPEGIKFLPK

SEQ ID NO: 2928784 - protein, 20 aa, Entamoeba invadens
CSLSNVFKFPRKLMNLKVDT

SEQ ID NO: 2928785 - protein, 17 aa, Entamoeba invadens
CSLYLSAIHRLKLATGK

SEQ ID NO: 2928786 - protein, 22 aa, Entamoeba invadens
CSLYPSAINRLKLATGSPIVIP

SEQ ID NO: 2928787 - protein, 23 aa, Entamoeba invadens
CSLYPSAINRLKLATGSPIVIPK

SEQ ID NO: 2928788 - protein, 19 aa, Entamoeba invadens
CSNDCPIGYFADNQKCLKC

SEQ ID NO: 2928789 - protein, 19 aa, Entamoeba invadens
CSNEFKKKRSFYDFRGEFE

SEQ ID NO: 2928790 - protein, 33 aa, Entamoeba invadens
CSNEIPSGCLPRSLDVILRGDLVEFVRPGQTCT

SEQ ID NO: 2928791 - protein, 25 aa, Entamoeba invadens
CSNEKFRVIFCVINGGKIQDFLAKT

SEQ ID NO: 2928792 - protein, 19 aa, Entamoeba invadens
CSNGGFPVITAFTATGKAL

SEQ ID NO: 2928793 - protein, 19 aa, Entamoeba invadens
CSNGVSYWGSNSVAYYSNI

SEQ ID NO: 2928794 - protein, 17 aa, Entamoeba invadens
CSNINFKTPEHLTTLNV

SEQ ID NO: 2928795 - protein, 27 aa, Entamoeba invadens
CSNLSTIKLPIGLTRLGTSCFSGARKL

SEQ ID NO: 2928796 - protein, 30 aa, Entamoeba invadens
CSNVCGMLQPIRSRCILVRVPYPNKKSFKS

SEQ ID NO: 2928797 - protein, 18 aa, Entamoeba invadens
CSNYSKYMAIVLGDEVRS

SEQ ID NO: 2928798 - protein, 22 aa, Entamoeba invadens
CSPCNPKIPMVKDMEKILKESF

SEQ ID NO: 2928799 - protein, 19 aa, Entamoeba invadens
CSPCNPKVPMVVDMEKILK

SEQ ID NO: 2928800 - protein, 20 aa, Entamoeba invadens
CSPESIDVVCFHKLPLDKKM

SEQ ID NO: 2928801 - protein, 18 aa, Entamoeba invadens
CSPKDYTHHYVLNFQSQK

SEQ ID NO: 2928802 - protein, 20 aa, Entamoeba invadens
CSPPISGIVNRMYYHGLLVD

SEQ ID NO: 2928803 - protein, 30 aa, Entamoeba invadens
CSPSITLYFCPACEKCLEKGTPSNSTPSAA

SEQ ID NO: 2928804 - protein, 28 aa, Entamoeba invadens
CSQNISARYRLSFFKNIKKAVKRSKQVT

SEQ ID NO: 2928805 - protein, 18 aa, Entamoeba invadens
CSQNPFKKTEVIRNVRDG

SEQ ID NO: 2928806 - protein, 23 aa, Entamoeba invadens
CSQTCPCYFDCTKFFQTISQYAP

SEQ ID NO: 2928807 - protein, 19 aa, Entamoeba invadens
CSREVRYNKKLVHLTIPKL

SEQ ID NO: 2928808 - protein, 28 aa, Entamoeba invadens
CSRKEWEMLRLLASRVIMQMVSSRPSWT

SEQ ID NO: 2928809 - protein, 24 aa, Entamoeba invadens
CSRVREYIDFVFKRIDELTWSEFE

SEQ ID NO: 2928810 - protein, 24 aa, Entamoeba invadens
CSRYVQCFGSYGWSCEGVTNLEMR

SEQ ID NO: 2928811 - protein, 20 aa, Entamoeba invadens
CSSAYFPILYPPRGDEELRL

SEQ ID NO: 2928812 - protein, 25 aa, Entamoeba invadens
CSSCVKGYKYINGMCEIGEDLCMLY

SEQ ID NO: 2928813 - protein, 19 aa, Entamoeba invadens
CSSDEKLKCLKQIRKRSCV

SEQ ID NO: 2928814 - protein, 24 aa, Entamoeba invadens
CSSGYSLVRRSGCPVTCLHAPTQD

SEQ ID NO: 2928815 - protein, 28 aa, Entamoeba invadens
CSSKEIINDIPVSYGFFIRMKTLGNYDF

SEQ ID NO: 2928816 - protein, 19 aa, Entamoeba invadens
CSSLHDIKIPTNVVAIKEN

SEQ ID NO: 2928817 - protein, 21 aa, Entamoeba invadens
CSSLRCLSRLMTPQIAPSIER

SEQ ID NO: 2928818 - protein, 17 aa, Entamoeba invadens
CSSLRGFQVGGHHTAVF

SEQ ID NO: 2928819 - protein, 18 aa, Entamoeba invadens
CSSLRRIVLPKRANRIGF

SEQ ID NO: 2928820 - protein, 24 aa, Entamoeba invadens
CSSLSSYTWRLLKPAPLPHPLPGN

SEQ ID NO: 2928821 - protein, 18 aa, Entamoeba invadens
CSSLTRLIIHNTTHHISC

SEQ ID NO: 2928822 - protein, 18 aa, Entamoeba invadens
CSSPRPLVSPRMSPYSKK

SEQ ID NO: 2928823 - protein, 28 aa, Entamoeba invadens
CSSRITNVLVCIDITPSVLSEAISQHVE

SEQ ID NO: 2928824 - protein, 19 aa, Entamoeba invadens
CSSSFEYVSALKIIQFPKG

SEQ ID NO: 2928825 - protein, 17 aa, Entamoeba invadens
CSSSFQAPQHILKYTNA

SEQ ID NO: 2928826 - protein, 19 aa, Entamoeba invadens
CSSSGKSKDVFYLYNPVVE

SEQ ID NO: 2928827 - protein, 17 aa, Entamoeba invadens
CSSSLHFPLSSLFGVQA

SEQ ID NO: 2928828 - protein, 19 aa, Entamoeba invadens
CSSTCKITQSGIVKIGVSI

SEQ ID NO: 2928829 - protein, 18 aa, Entamoeba invadens
CSSVCPVGAIIFNGVSPS

SEQ ID NO: 2928830 - protein, 33 aa, Entamoeba invadens
CSSVPRTETIFRMLKSLEFKVAVLHSVLPQHVR

SEQ ID NO: 2928831 - protein, 19 aa, Entamoeba invadens
CSTDEKIGVLYAKSGQTSE

SEQ ID NO: 2928832 - protein, 19 aa, Entamoeba invadens
CSTKGIPIVTNKWIEDSIN

SEQ ID NO: 2928833 - protein, 20 aa, Entamoeba invadens
CSTTVLIRGTFKEVKTDNMS

SEQ ID NO: 2928834 - protein, 19 aa, Entamoeba invadens
CSVDCTLLYDNAEKSEVHF

SEQ ID NO: 2928835 - protein, 18 aa, Entamoeba invadens
CSVERSFSQLSRVSKPGM

SEQ ID NO: 2928836 - protein, 25 aa, Entamoeba invadens
CSVGHIIWYLSVFLGNCSRINSIVD

SEQ ID NO: 2928837 - protein, 18 aa, Entamoeba invadens
CSVKFPQNTKLPIENVEI

SEQ ID NO: 2928838 - protein, 17 aa, Entamoeba invadens
CSVKQNYGIYESFAKLR

SEQ ID NO: 2928839 - protein, 17 aa, Entamoeba invadens
CSVLCFGTSFNSMQKLT

SEQ ID NO: 2928840 - protein, 19 aa, Entamoeba invadens
CSWDNKGILYLLYIGNSES

SEQ ID NO: 2928841 - protein, 21 aa, Entamoeba invadens
CSWDTDLKCLVLTSKKVAFAE

SEQ ID NO: 2928842 - protein, 24 aa, Entamoeba invadens
CSWMSLNSGDAFLFDPGKGAKTIY

SEQ ID NO: 2928843 - protein, 18 aa, Entamoeba invadens
CSYFPLPEVGKVKIKIKH

SEQ ID NO: 2928844 - protein, 21 aa, Entamoeba invadens
CSYKGHMCAKVFIKSKPGRYG

SEQ ID NO: 2928845 - protein, 20 aa, Entamoeba invadens
CSYKGHMWAKVFIKSKPGRY

SEQ ID NO: 2928846 - protein, 17 aa, Entamoeba invadens
CTACEIGYVLTNINTCK

SEQ ID NO: 2928847 - protein, 20 aa, Entamoeba invadens
CTACKLAYNHPEVVAKWMPE

SEQ ID NO: 2928848 - protein, 26 aa, Entamoeba invadens
CTAILDWAANQHVGFSYFVSIGSSID

SEQ ID NO: 2928849 - protein, 23 aa, Entamoeba invadens
CTCGCEFCYNCGKRIHGYAHFNE

SEQ ID NO: 2928850 - protein, 17 aa, Entamoeba invadens
CTCGGYSLQIWIHPGVY

SEQ ID NO: 2928851 - protein, 21 aa, Entamoeba invadens
CTCSLCQSQDTFLMDDPKVKT

SEQ ID NO: 2928852 - protein, 23 aa, Entamoeba invadens
CTDCKEKADLVCVTCNKGFCGSC

SEQ ID NO: 2928853 - protein, 20 aa, Entamoeba invadens
CTDDMILWGLFSLANALHFL

SEQ ID NO: 2928854 - protein, 21 aa, Entamoeba invadens
CTDLFQFFMMTVFKHLNGEGY

SEQ ID NO: 2928855 - protein, 17 aa, Entamoeba invadens
CTDLRYITLPNTIQELK

SEQ ID NO: 2928856 - protein, 19 aa, Entamoeba invadens
CTDYRPSDYSKLSYVNYFL

SEQ ID NO: 2928857 - protein, 24 aa, Entamoeba invadens
CTEFECLGCQTVFYLNDNKLCNSC

SEQ ID NO: 2928858 - protein, 21 aa, Entamoeba invadens
CTELRIGGMPLQSVSYPSGIT

SEQ ID NO: 2928859 - protein, 21 aa, Entamoeba invadens
CTENGFFFNSHLSKVSKNAQR

SEQ ID NO: 2928860 - protein, 19 aa, Entamoeba invadens
CTEYCIMVDNLCQFLPQER

SEQ ID NO: 2928861 - protein, 18 aa, Entamoeba invadens
CTEYCLYNIRSLHPKIEK

SEQ ID NO: 2928862 - protein, 18 aa, Entamoeba invadens
CTFLKKVVLSLFIHTLKS

SEQ ID NO: 2928863 - protein, 18 aa, Entamoeba invadens
CTFMKCYNLKEIILPENL

SEQ ID NO: 2928864 - protein, 18 aa, Entamoeba invadens
CTFMKCYNLKKMIFPTTL

SEQ ID NO: 2928865 - protein, 17 aa, Entamoeba invadens
CTFMKCYNLREIILPKT

SEQ ID NO: 2928866 - protein, 18 aa, Entamoeba invadens
CTGAHIMQSYGLTESCGG

SEQ ID NO: 2928867 - protein, 19 aa, Entamoeba invadens
CTGETILRVYNIIFQCVVL

SEQ ID NO: 2928868 - protein, 17 aa, Entamoeba invadens
CTGGFKSHNAMAMAIGV

SEQ ID NO: 2928869 - protein, 20 aa, Entamoeba invadens
CTGHSLGGAVAQVLTILLRA

SEQ ID NO: 2928870 - protein, 17 aa, Entamoeba invadens
CTGNFKYSIFLVKEFRY

SEQ ID NO: 2928871 - protein, 24 aa, Entamoeba invadens
CTGPQRTASQFPYYTKVKQENIKF

SEQ ID NO: 2928872 - protein, 17 aa, Entamoeba invadens
CTHINTKISIYVDASIY

SEQ ID NO: 2928873 - protein, 18 aa, Entamoeba invadens
CTICITQTVFEKWVAFFC

SEQ ID NO: 2928874 - protein, 20 aa, Entamoeba invadens
CTIDELGPRFVLKLRTIQKG

SEQ ID NO: 2928875 - protein, 19 aa, Entamoeba invadens
CTIDEVLTWAEEVRTMYDM

SEQ ID NO: 2928876 - protein, 24 aa, Entamoeba invadens
CTIECGYCRAGFTCSESGSCLVDD

SEQ ID NO: 2928877 - protein, 25 aa, Entamoeba invadens
CTIEIRGKCPIIGKKNMKYIIPNNV

SEQ ID NO: 2928878 - protein, 31 aa, Entamoeba invadens
CTIEQPTLCVLPDFIGDVLFIVNEITNLLPK

SEQ ID NO: 2928879 - protein, 23 aa, Entamoeba invadens
CTIPVGGLPAIFKNLVSHFENMQ

SEQ ID NO: 2928880 - protein, 19 aa, Entamoeba invadens
CTIWSVKYPTLCMTIEDGQ

SEQ ID NO: 2928881 - protein, 22 aa, Entamoeba invadens
CTKKGCSMKFFLKTDLIEHVKT

SEQ ID NO: 2928882 - protein, 17 aa, Entamoeba invadens
CTLCKSTYYISDNNKCS

SEQ ID NO: 2928883 - protein, 19 aa, Entamoeba invadens
CTLDARKRLMWGYYANHQG

SEQ ID NO: 2928884 - protein, 21 aa, Entamoeba invadens
CTLKKVLSCQPHYFLKNNRCV

SEQ ID NO: 2928885 - protein, 18 aa, Entamoeba invadens
CTLLEMYLGHQIFNGKNE

SEQ ID NO: 2928886 - protein, 20 aa, Entamoeba invadens
CTLRQNCFNSNKFLVKVTLK

SEQ ID NO: 2928887 - protein, 18 aa, Entamoeba invadens
CTNCISGYYLYHKECEKC

SEQ ID NO: 2928888 - protein, 17 aa, Entamoeba invadens
CTNCLNVTYNSISPSVV

SEQ ID NO: 2928889 - protein, 42 aa, Entamoeba invadens
CTNGLNIFSKYAWELKKTKGAMVDLCHLIESLNLQCEDDNKK

SEQ ID NO: 2928890 - protein, 21 aa, Entamoeba invadens
CTNLKSIVFEDGRHFDIEMET

SEQ ID NO: 2928891 - protein, 20 aa, Entamoeba invadens
CTNLKSVVFEDGRIFDLNKE

SEQ ID NO: 2928892 - protein, 21 aa, Entamoeba invadens
CTPEVLAMIKRCEFLQNVVDQ

SEQ ID NO: 2928893 - protein, 20 aa, Entamoeba invadens
CTPGRLVYHINNTKGVSQSL

SEQ ID NO: 2928894 - protein, 26 aa, Entamoeba invadens
CTPIEKIMYMFCSFKILEQLIHYHFR

SEQ ID NO: 2928895 - protein, 17 aa, Entamoeba invadens
CTPYDFVKSFNIDYVVH

SEQ ID NO: 2928896 - protein, 25 aa, Entamoeba invadens
CTQKTLENFALWLFDPLSPCAGDII

SEQ ID NO: 2928897 - protein, 19 aa, Entamoeba invadens
CTQLAYILTCIVVNNHHEE

SEQ ID NO: 2928898 - protein, 18 aa, Entamoeba invadens
CTQLLIAKIEKIEQDNTL

SEQ ID NO: 2928899 - protein, 26 aa, Entamoeba invadens
CTQMPIRGCSFLTGQIDVRTTFIQSV

SEQ ID NO: 2928900 - protein, 27 aa, Entamoeba invadens
CTQPIFRAELQTVEFMKRFQAQCDYKE

SEQ ID NO: 2928901 - protein, 19 aa, Entamoeba invadens
CTQTICGVDGSVIFNIQKF

SEQ ID NO: 2928902 - protein, 19 aa, Entamoeba invadens
CTQTRFYEMSALKRDGVFY

SEQ ID NO: 2928903 - protein, 24 aa, Entamoeba invadens
CTRDEIIRFGALNMMIDSGKCSDD

SEQ ID NO: 2928904 - protein, 19 aa, Entamoeba invadens
CTRGNPFTSPKVYPSVLLI

SEQ ID NO: 2928905 - protein, 18 aa, Entamoeba invadens
CTSCGQLIVGPSAKCTKC

SEQ ID NO: 2928906 - protein, 25 aa, Entamoeba invadens
CTSDCRAVVFSPVSVECYIFQENHL

SEQ ID NO: 2928907 - protein, 19 aa, Entamoeba invadens
CTSFLKQVLEYGVCVQSIQ

SEQ ID NO: 2928908 - protein, 20 aa, Entamoeba invadens
CTSLKSATLVDGCTKIADLQ

SEQ ID NO: 2928909 - protein, 22 aa, Entamoeba invadens
CTSLRSVILFSSLYSIGDNCFE

SEQ ID NO: 2928910 - protein, 17 aa, Entamoeba invadens
CTSLSCVDIPSCVSVIG

SEQ ID NO: 2928911 - protein, 18 aa, Entamoeba invadens
CTSLSYIKPSHMITTIPP

SEQ ID NO: 2928912 - protein, 24 aa, Entamoeba invadens
CTSPDLFRDFIWGHRLFATTQEVL

SEQ ID NO: 2928913 - protein, 18 aa, Entamoeba invadens
CTSSFLVKTIFLKITKIV

SEQ ID NO: 2928914 - protein, 18 aa, Entamoeba invadens
CTTCGASVCSGLDGGLSL

SEQ ID NO: 2928915 - protein, 17 aa, Entamoeba invadens
CTTCKSGYTLKNSTYCE

SEQ ID NO: 2928916 - protein, 25 aa, Entamoeba invadens
CTTFGEGAFKNCLELILCADEIGCS

SEQ ID NO: 2928917 - protein, 25 aa, Entamoeba invadens
CTTTAPRMPLLFVWENDMDALSNAS

SEQ ID NO: 2928918 - protein, 19 aa, Entamoeba invadens
CTTTGEGLDAMFNAILPDA

SEQ ID NO: 2928919 - protein, 18 aa, Entamoeba invadens
CTVDYLFNSAYFPPFNQP

SEQ ID NO: 2928920 - protein, 17 aa, Entamoeba invadens
CTVKLHDLTTIFKLKKG

SEQ ID NO: 2928921 - protein, 25 aa, Entamoeba invadens
CTVLIEMVNSLGLLKTGIGSEDITS

SEQ ID NO: 2928922 - protein, 24 aa, Entamoeba invadens
CTVRPSRGEAFEFFSQFGEVTEVR

SEQ ID NO: 2928923 - protein, 29 aa, Entamoeba invadens
CTVSLFNHWLPRFGIQVDFVDTSDVENVK

SEQ ID NO: 2928924 - protein, 17 aa, Entamoeba invadens
CTVSPCYLRCVEGQNMC

SEQ ID NO: 2928925 - protein, 21 aa, Entamoeba invadens
CTVTQCLKVGVVCAGDETTVL

SEQ ID NO: 2928926 - protein, 20 aa, Entamoeba invadens
CTWCGEGFYLDSFHGKYNNT

SEQ ID NO: 2928927 - protein, 21 aa, Entamoeba invadens
CVADVWSLGVLFYALLFGTMP

SEQ ID NO: 2928928 - protein, 20 aa, Entamoeba invadens
CVAKTIEAYVVFSSNSTLVV

SEQ ID NO: 2928929 - protein, 19 aa, Entamoeba invadens
CVAKYYWNIFNEFFFDSKM

SEQ ID NO: 2928930 - protein, 18 aa, Entamoeba invadens
CVALEWLYQSIMTKSMLD

SEQ ID NO: 2928931 - protein, 21 aa, Entamoeba invadens
CVCEKRNVMIIVITYNKYVFG

SEQ ID NO: 2928932 - protein, 25 aa, Entamoeba invadens
CVCSPRKSIHLIQKIDILNSVKIEN

SEQ ID NO: 2928933 - protein, 26 aa, Entamoeba invadens
CVCSPRKSIHLIQKIDILNSVKIENY

SEQ ID NO: 2928934 - protein, 19 aa, Entamoeba invadens
CVDEFVFEIVMRVMETKET

SEQ ID NO: 2928935 - protein, 19 aa, Entamoeba invadens
CVDESFIGMMLSKLSVKSP

SEQ ID NO: 2928936 - protein, 27 aa, Entamoeba invadens
CVDGVCGNAKYLSRFKHFNVDFTQMAE

SEQ ID NO: 2928937 - protein, 18 aa, Entamoeba invadens
CVDKCPIHTSCAVLEILL

SEQ ID NO: 2928938 - protein, 20 aa, Entamoeba invadens
CVDLKRLGVIDEIIDEVPNE

SEQ ID NO: 2928939 - protein, 22 aa, Entamoeba invadens
CVDPICKLPNPSKFLQNEDTHE

SEQ ID NO: 2928940 - protein, 17 aa, Entamoeba invadens
CVECNGFSKVLEQFVVS

SEQ ID NO: 2928941 - protein, 32 aa, Entamoeba invadens
CVECPNEILLQEIFKGTGLSPRGFVEFIKRYC

SEQ ID NO: 2928942 - protein, 19 aa, Entamoeba invadens
CVECYPPYFWDSIGKTCKL

SEQ ID NO: 2928943 - protein, 17 aa, Entamoeba invadens
CVEDLIENKTALSWKGV

SEQ ID NO: 2928944 - protein, 18 aa, Entamoeba invadens
CVEKSTFHKGLKEIRLSG

SEQ ID NO: 2928945 - protein, 18 aa, Entamoeba invadens
CVEKVLYHTAYKTKEQLL

SEQ ID NO: 2928946 - protein, 19 aa, Entamoeba invadens
CVEQYWLLHFEARSEFAIR

SEQ ID NO: 2928947 - protein, 18 aa, Entamoeba invadens
CVERRVPLGSIKDIICSD

SEQ ID NO: 2928948 - protein, 18 aa, Entamoeba invadens
CVESLCISPTSLFYQAKM

SEQ ID NO: 2928949 - protein, 17 aa, Entamoeba invadens
CVETCFQLIPKFNKSQK

SEQ ID NO: 2928950 - protein, 19 aa, Entamoeba invadens
CVFLGCSNLSVIELPKNLR

SEQ ID NO: 2928951 - protein, 18 aa, Entamoeba invadens
CVFNGCTNLTRVTLPSSL

SEQ ID NO: 2928952 - protein, 17 aa, Entamoeba invadens
CVGCYHNDFIKDFPLNA

SEQ ID NO: 2928953 - protein, 22 aa, Entamoeba invadens
CVGCYIKTPIIDFGEWKPDMES

SEQ ID NO: 2928954 - protein, 17 aa, Entamoeba invadens
CVGDVSGVITILSVKTS

SEQ ID NO: 2928955 - protein, 20 aa, Entamoeba invadens
CVGIWQNDRVEIIANDQGNR

SEQ ID NO: 2928956 - protein, 25 aa, Entamoeba invadens
CVGKKGLLSFKWRKCKLQPIETSNE

SEQ ID NO: 2928957 - protein, 17 aa, Entamoeba invadens
CVGKLSINVAALINQLK

SEQ ID NO: 2928958 - protein, 26 aa, Entamoeba invadens
CVGQPLCPASFLLRCDTLNEYTGNYG

SEQ ID NO: 2928959 - protein, 36 aa, Entamoeba invadens
CVHCRAGRGRTGLVCSCVVMALGLYSNATEALEFFA

SEQ ID NO: 2928960 - protein, 23 aa, Entamoeba invadens
CVHQSVQFLVRMMELLTTGFMKS

SEQ ID NO: 2928961 - protein, 18 aa, Entamoeba invadens
CVHVDPKILGEMNSSFEI

SEQ ID NO: 2928962 - protein, 19 aa, Entamoeba invadens
CVIERLWDILTPTGVAYIV

SEQ ID NO: 2928963 - protein, 17 aa, Entamoeba invadens
CVIFELLTGDFLFSPKQ

SEQ ID NO: 2928964 - protein, 26 aa, Entamoeba invadens
CVIKQHYKELVLVLSQAIRFDLFTPE

SEQ ID NO: 2928965 - protein, 17 aa, Entamoeba invadens
CVIKRSAINNVGNKNVR

SEQ ID NO: 2928966 - protein, 17 aa, Entamoeba invadens
CVILDIFNKKSLTEQLS

SEQ ID NO: 2928967 - protein, 17 aa, Entamoeba invadens
CVILRYELNGNFYSVPL

SEQ ID NO: 2928968 - protein, 20 aa, Entamoeba invadens
CVIMYCVLFLNKVVYNYKPS

SEQ ID NO: 2928969 - protein, 17 aa, Entamoeba invadens
CVIPKPAKSYKTSQKSP

SEQ ID NO: 2928970 - protein, 24 aa, Entamoeba invadens
CVITGRGAAPLGFQKIFKSNEYKL

SEQ ID NO: 2928971 - protein, 22 aa, Entamoeba invadens
CVIVGKKYGKVWKRLKDNTLSD

SEQ ID NO: 2928972 - protein, 17 aa, Entamoeba invadens
CVIYEGIAMTITQTMQR

SEQ ID NO: 2928973 - protein, 17 aa, Entamoeba invadens
CVKEEFWRQSGCTPPRQ

SEQ ID NO: 2928974 - protein, 22 aa, Entamoeba invadens
CVKFLSHRTGAIVLVMRNDLDN

SEQ ID NO: 2928975 - protein, 32 aa, Entamoeba invadens
CVKKKIGELAEFVWRVPYVKIDSFGFDGNNIV

SEQ ID NO: 2928976 - protein, 18 aa, Entamoeba invadens
CVKLAKFNTYDNCSFENL

SEQ ID NO: 2928977 - protein, 21 aa, Entamoeba invadens
CVKMAPVWRRFEKLELRENMR

SEQ ID NO: 2928978 - protein, 18 aa, Entamoeba invadens
CVKNSWSGNSVFAFKSFL

SEQ ID NO: 2928979 - protein, 21 aa, Entamoeba invadens
CVKPFPPFLRPTRTHPILPVL

SEQ ID NO: 2928980 - protein, 19 aa, Entamoeba invadens
CVKVTWVPCSLSLEEVSRW

SEQ ID NO: 2928981 - protein, 25 aa, Entamoeba invadens
CVLANKHFVCHSVDYLINNHFSCYN

SEQ ID NO: 2928982 - protein, 21 aa, Entamoeba invadens
CVLEKNHTFLFGFGGGHDICV

SEQ ID NO: 2928983 - protein, 27 aa, Entamoeba invadens
CVLGLLTLFYPFYWPGIFIPYVPDILF

SEQ ID NO: 2928984 - protein, 22 aa, Entamoeba invadens
CVLIKGICRLKCLLSLSLDVII

SEQ ID NO: 2928985 - protein, 17 aa, Entamoeba invadens
CVLLSGKCKTEIERNTL

SEQ ID NO: 2928986 - protein, 17 aa, Entamoeba invadens
CVLPFLYFHSNHFFILQ

SEQ ID NO: 2928987 - protein, 25 aa, Entamoeba invadens
CVLTLPDTLKFIGKHIFSHNIKLTK

SEQ ID NO: 2928988 - protein, 21 aa, Entamoeba invadens
CVLVKKSKYWKVHNAEVSNVY

SEQ ID NO: 2928989 - protein, 19 aa, Entamoeba invadens
CVMVSRWFGGILLGPDRFK

SEQ ID NO: 2928990 - protein, 20 aa, Entamoeba invadens
CVNAISGIISFAGYQLDRPK

SEQ ID NO: 2928991 - protein, 24 aa, Entamoeba invadens
CVNCKKMTSSIYFYVVIASLEYEE

SEQ ID NO: 2928992 - protein, 19 aa, Entamoeba invadens
CVNGGIQMEFFGGEKEGNP

SEQ ID NO: 2928993 - protein, 19 aa, Entamoeba invadens
CVNKASAVVGGNNFDEKIV

SEQ ID NO: 2928994 - protein, 18 aa, Entamoeba invadens
CVNLHKIKIPQKVKRIGM

SEQ ID NO: 2928995 - protein, 21 aa, Entamoeba invadens
CVPSLLRVFFQAVSVRYKSES

SEQ ID NO: 2928996 - protein, 21 aa, Entamoeba invadens
CVQCNLCSLYCPHAAIRPFLL

SEQ ID NO: 2928997 - protein, 26 aa, Entamoeba invadens
CVQQLNEVRKLWAIIHNTKTVDKTKG

SEQ ID NO: 2928998 - protein, 25 aa, Entamoeba invadens
CVQQLSEVTKVWSIISKNTNTKDKQ

SEQ ID NO: 2928999 - protein, 21 aa, Entamoeba invadens
CVRTDVPKEYGLFEHQGDKQY

SEQ ID NO: 2929000 - protein, 28 aa, Entamoeba invadens
CVRVKPSPLFCLGSRFSIVENDKEDFIQ

SEQ ID NO: 2929001 - protein, 24 aa, Entamoeba invadens
CVSESKRLLPSIIYGYKEESILNV

SEQ ID NO: 2929002 - protein, 22 aa, Entamoeba invadens
CVSKRCKKILVGTHVDVTHTLT

SEQ ID NO: 2929003 - protein, 23 aa, Entamoeba invadens
CVSLAGGTILCYLAKTIDDDLIP

SEQ ID NO: 2929004 - protein, 20 aa, Entamoeba invadens
CVSLNAFECSNLNHIEFVGQ

SEQ ID NO: 2929005 - protein, 19 aa, Entamoeba invadens
CVSVDPKVLGNMFETVKVV

SEQ ID NO: 2929006 - protein, 18 aa, Entamoeba invadens
CVTTWQLTPPYSLTDALN

SEQ ID NO: 2929007 - protein, 22 aa, Entamoeba invadens
CVVCANDWVVLKRDDFAKVVEV

SEQ ID NO: 2929008 - protein, 19 aa, Entamoeba invadens
CVVDLLKIIEPQSLNLTED

SEQ ID NO: 2929009 - protein, 18 aa, Entamoeba invadens
CVVEELIHQPLLQTDILS

SEQ ID NO: 2929010 - protein, 25 aa, Entamoeba invadens
CVVFTDWKMHIDIDLTQSIPHATEQ

SEQ ID NO: 2929011 - protein, 17 aa, Entamoeba invadens
CVVKQKYVVQNLMVHRM

SEQ ID NO: 2929012 - protein, 20 aa, Entamoeba invadens
CVVSGPGVDGGEELDDCNDA

SEQ ID NO: 2929013 - protein, 22 aa, Entamoeba invadens
CVVSPPCPSFCYIQSQTNYIPL

SEQ ID NO: 2929014 - protein, 26 aa, Entamoeba invadens
CVVVKSLDRLRVCREEFLSVFNELKL

SEQ ID NO: 2929015 - protein, 19 aa, Entamoeba invadens
CVYFIKRFGTCNDIKKLEN

SEQ ID NO: 2929016 - protein, 22 aa, Entamoeba invadens
CVYYYLKTMVKYSLVANRTITQ

SEQ ID NO: 2929017 - protein, 18 aa, Entamoeba invadens
CWAATSANIIDWYQNSIN

SEQ ID NO: 2929018 - protein, 18 aa, Entamoeba invadens
CWDPEIRLTPGQALKHPF

SEQ ID NO: 2929019 - protein, 17 aa, Entamoeba invadens
CWDSPAYVSWDFKFIEW

SEQ ID NO: 2929020 - protein, 20 aa, Entamoeba invadens
CWGHRVNAYFGRSSEKEKEE

SEQ ID NO: 2929021 - protein, 19 aa, Entamoeba invadens
CWIFDNRVYIGMEYCSQGT

SEQ ID NO: 2929022 - protein, 18 aa, Entamoeba invadens
CWIGISPPLLKSVAAFMA

SEQ ID NO: 2929023 - protein, 17 aa, Entamoeba invadens
CWKKRKSKVTRLLYEEE

SEQ ID NO: 2929024 - protein, 17 aa, Entamoeba invadens
CWKLFNKCVCEISPENF

SEQ ID NO: 2929025 - protein, 19 aa, Entamoeba invadens
CWMTSRLYFGCLVAQSNLS

SEQ ID NO: 2929026 - protein, 21 aa, Entamoeba invadens
CWNGHIPALFVNKATKTMMPS

SEQ ID NO: 2929027 - protein, 18 aa, Entamoeba invadens
CWQDKRFVELQMEKMQVT

SEQ ID NO: 2929028 - protein, 17 aa, Entamoeba invadens
CWQFTEFEILNGVKEVE

SEQ ID NO: 2929029 - protein, 17 aa, Entamoeba invadens
CWRCICVHQSVQFLVRM

SEQ ID NO: 2929030 - protein, 20 aa, Entamoeba invadens
CWSEDRYPYNEFILLTEASW

SEQ ID NO: 2929031 - protein, 22 aa, Entamoeba invadens
CWSPHCSTHLCSASSDQKALLW

SEQ ID NO: 2929032 - protein, 18 aa, Entamoeba invadens
CWSSLVLETDEFCETQES

SEQ ID NO: 2929033 - protein, 18 aa, Entamoeba invadens
CWSYKCDVNSGYCIKDQR

SEQ ID NO: 2929034 - protein, 22 aa, Entamoeba invadens
CWWKEGVVYQIYCRSFKDTTGN

SEQ ID NO: 2929035 - protein, 17 aa, Entamoeba invadens
CWYCTHGYINNCENGGW

SEQ ID NO: 2929036 - protein, 20 aa, Entamoeba invadens
CYASCVSQAWSVATLLDATK

SEQ ID NO: 2929037 - protein, 24 aa, Entamoeba invadens
CYCDMKRLLQVVSTCIKIENRMSN

SEQ ID NO: 2929038 - protein, 17 aa, Entamoeba invadens
CYCHSVEGVLECAQCGK

SEQ ID NO: 2929039 - protein, 21 aa, Entamoeba invadens
CYCSFDRFELFLDHLKVVHKM

SEQ ID NO: 2929040 - protein, 20 aa, Entamoeba invadens
CYDERAVNKIAFPKEMPMQL

SEQ ID NO: 2929041 - protein, 19 aa, Entamoeba invadens
CYDISYVLQCIEISNSKCS

SEQ ID NO: 2929042 - protein, 24 aa, Entamoeba invadens
CYDSVEMLHIYSCKSIHSTKTKPS

SEQ ID NO: 2929043 - protein, 18 aa, Entamoeba invadens
CYDYDRFGKNDSLGKTHY

SEQ ID NO: 2929044 - protein, 18 aa, Entamoeba invadens
CYEECPPKDFVVFSSCGH

SEQ ID NO: 2929045 - protein, 18 aa, Entamoeba invadens
CYEEGRLVGERCGHMFCV

SEQ ID NO: 2929046 - protein, 17 aa, Entamoeba invadens
CYEGGKTADGRCAACQV

SEQ ID NO: 2929047 - protein, 17 aa, Entamoeba invadens
CYFPKLHALAAADNMLQ

SEQ ID NO: 2929048 - protein, 20 aa, Entamoeba invadens
CYGASFGIKCPVLKDKSFIN

SEQ ID NO: 2929049 - protein, 22 aa, Entamoeba invadens
CYGASFGIKCPVLNNKSFINFD

SEQ ID NO: 2929050 - protein, 20 aa, Entamoeba invadens
CYGGYKWLTKIDIPTRVTSI

SEQ ID NO: 2929051 - protein, 25 aa, Entamoeba invadens
CYGVFSRFGALYKYGFITKCVGLYR

SEQ ID NO: 2929052 - protein, 20 aa, Entamoeba invadens
CYHQCKVLEGTAMFLDIGGV

SEQ ID NO: 2929053 - protein, 19 aa, Entamoeba invadens
CYIGKGCFKDCSQLNEVVL

SEQ ID NO: 2929054 - protein, 17 aa, Entamoeba invadens
CYISPGVLTMEDKAQIF

SEQ ID NO: 2929055 - protein, 29 aa, Entamoeba invadens
CYIVQDGKEPFVFTNYFHGWRIAAKQVVS

SEQ ID NO: 2929056 - protein, 21 aa, Entamoeba invadens
CYKHLCLTLGTPQQFISNKAR

SEQ ID NO: 2929057 - protein, 19 aa, Entamoeba invadens
CYKIASALINSQRFNFFKI

SEQ ID NO: 2929058 - protein, 19 aa, Entamoeba invadens
CYKVWRSTLTLEILINKEC

SEQ ID NO: 2929059 - protein, 26 aa, Entamoeba invadens
CYKYEDGYFYWVYKNYVVFKTLNKQK

SEQ ID NO: 2929060 - protein, 19 aa, Entamoeba invadens
CYLPDLIPILNRMRDTITR

SEQ ID NO: 2929061 - protein, 21 aa, Entamoeba invadens
CYLSRLVLEKSITPFPFNLKL

SEQ ID NO: 2929062 - protein, 27 aa, Entamoeba invadens
CYLTSMKDYCFCRLPSLKELDLSNVVK

SEQ ID NO: 2929063 - protein, 25 aa, Entamoeba invadens
CYLVKRKPEELFPVLFDALQRKSQE

SEQ ID NO: 2929064 - protein, 18 aa, Entamoeba invadens
CYLYCTPYLKNLFVDCND

SEQ ID NO: 2929065 - protein, 21 aa, Entamoeba invadens
CYNFRFNCFDEFVEFGKNTKN

SEQ ID NO: 2929066 - protein, 33 aa, Entamoeba invadens
CYNIITEIYIIFDFLRHILIYKAITKRNANANA

SEQ ID NO: 2929067 - protein, 19 aa, Entamoeba invadens
CYNLMNYLFLYPFALLKLS

SEQ ID NO: 2929068 - protein, 17 aa, Entamoeba invadens
CYNLSSVKIPSSVSSIG

SEQ ID NO: 2929069 - protein, 19 aa, Entamoeba invadens
CYNMIFYSKHEFLLSNSPP

SEQ ID NO: 2929070 - protein, 22 aa, Entamoeba invadens
CYNNIKIGQDFVLLDQQCIVHI

SEQ ID NO: 2929071 - protein, 22 aa, Entamoeba invadens
CYNTKIIRLRFCEVSLHNDKLS

SEQ ID NO: 2929072 - protein, 27 aa, Entamoeba invadens
CYNYHKFKKNYVVEWARSQIHRASQAD

SEQ ID NO: 2929073 - protein, 17 aa, Entamoeba invadens
CYPKMVMLTPSYWFPNA

SEQ ID NO: 2929074 - protein, 26 aa, Entamoeba invadens
CYQCKDGYYRIGLNCYECLLNCSTCN

SEQ ID NO: 2929075 - protein, 18 aa, Entamoeba invadens
CYRGVPIATNKPSLSERE

SEQ ID NO: 2929076 - protein, 17 aa, Entamoeba invadens
CYSGKSSLIKRYILNEF

SEQ ID NO: 2929077 - protein, 19 aa, Entamoeba invadens
CYSLPLPQRSFFYDETIGI

SEQ ID NO: 2929078 - protein, 19 aa, Entamoeba invadens
CYSLTSVVMTGRIESIKNS

SEQ ID NO: 2929079 - protein, 20 aa, Entamoeba invadens
CYSQAAACYVREKIPLPAAR

SEQ ID NO: 2929080 - protein, 24 aa, Entamoeba invadens
CYTACNFGDFMSWTGQAQFKNTPY

SEQ ID NO: 2929081 - protein, 23 aa, Entamoeba invadens
CYTASLDFAKWVLEKYPNAYFGF

SEQ ID NO: 2929082 - protein, 27 aa, Entamoeba invadens
CYTCEVDCCAVCVRNCHDGHDTVYIGR

SEQ ID NO: 2929083 - protein, 17 aa, Entamoeba invadens
CYTDLLKERIVMKKSKE

SEQ ID NO: 2929084 - protein, 25 aa, Entamoeba invadens
CYTEKGCLYRQGLIDLIIPLFTLLR

SEQ ID NO: 2929085 - protein, 19 aa, Entamoeba invadens
CYTKPGAKDTIKFSELILY

SEQ ID NO: 2929086 - protein, 21 aa, Entamoeba invadens
CYTSHGLCFLKVYSSSKSYTF

SEQ ID NO: 2929087 - protein, 18 aa, Entamoeba invadens
CYVDTITPSVQWAINSDS

SEQ ID NO: 2929088 - protein, 17 aa, Entamoeba invadens
CYVKCLQIGLTHYYNHL

SEQ ID NO: 2929089 - protein, 21 aa, Entamoeba invadens
CYVREKIPLPAARQYENAYDQ

SEQ ID NO: 2929090 - protein, 18 aa, Entamoeba invadens
CYYWFRRRGTAFEICKDG

SEQ ID NO: 2929091 - protein, 17 aa, Entamoeba invadens
DAAEMFLEIIDSISEET

SEQ ID NO: 2929092 - protein, 20 aa, Entamoeba invadens
DAAIRKKIFAEIDKQINEQM

SEQ ID NO: 2929093 - protein, 25 aa, Entamoeba invadens
DAAKKNMKSDGFGRQSGGREDCRGP

SEQ ID NO: 2929094 - protein, 19 aa, Entamoeba invadens
DAALLDWVNSLSDVKVTNF

SEQ ID NO: 2929095 - protein, 21 aa, Entamoeba invadens
DACADALEFGLLDECPQCHCK

SEQ ID NO: 2929096 - protein, 17 aa, Entamoeba invadens
DACQKYGGFYLGAIGGA

SEQ ID NO: 2929097 - protein, 20 aa, Entamoeba invadens
DADAPVWPSSLLQNLLTITK

SEQ ID NO: 2929098 - protein, 18 aa, Entamoeba invadens
DADLLLKIAQRSSASLGN

SEQ ID NO: 2929099 - protein, 17 aa, Entamoeba invadens
DADLYIEMKEWRKLYKI

SEQ ID NO: 2929100 - protein, 17 aa, Entamoeba invadens
DADNLKAIQIVTDKSRL

SEQ ID NO: 2929101 - protein, 26 aa, Entamoeba invadens
DADPKQCWADGPGVEGGCKTCDLAKF

SEQ ID NO: 2929102 - protein, 20 aa, Entamoeba invadens
DAEKGNECLVLPKETIYELL

SEQ ID NO: 2929103 - protein, 18 aa, Entamoeba invadens
DAELGEFIVLYLSFMSAG

SEQ ID NO: 2929104 - protein, 18 aa, Entamoeba invadens
DAELKMNGIELIKVSSKS

SEQ ID NO: 2929105 - protein, 26 aa, Entamoeba invadens
DAELKRLNLEKERRLNALSYHNVPSN

SEQ ID NO: 2929106 - protein, 25 aa, Entamoeba invadens
DAELWDLRMMKLRKRNEMLSGTYSQ

SEQ ID NO: 2929107 - protein, 28 aa, Entamoeba invadens
DAEMCIKIKPDFIKGYNRKAFSHYCMKE

SEQ ID NO: 2929108 - protein, 24 aa, Entamoeba invadens
DAEPIEILLHIPILCEDKNVPYVF

SEQ ID NO: 2929109 - protein, 24 aa, Entamoeba invadens
DAESALIWFEMSPFSALSVSNVTS

SEQ ID NO: 2929110 - protein, 18 aa, Entamoeba invadens
DAEYSYYLGAKKEDCLIG

SEQ ID NO: 2929111 - protein, 19 aa, Entamoeba invadens
DAFICIPHFAAPEHFLLVA

SEQ ID NO: 2929112 - protein, 18 aa, Entamoeba invadens
DAFKCIGNVYAYKHTQLV

SEQ ID NO: 2929113 - protein, 24 aa, Entamoeba invadens
DAFKEFYELQSLYIPSSVTYIDNA

SEQ ID NO: 2929114 - protein, 24 aa, Entamoeba invadens
DAFQRFYVVVKKFLDFYSSLVDVE

SEQ ID NO: 2929115 - protein, 20 aa, Entamoeba invadens
DAFSCCPHLTRAKNMNRSTV

SEQ ID NO: 2929116 - protein, 18 aa, Entamoeba invadens
DAFSQFLFFLKSLGVSLA

SEQ ID NO: 2929117 - protein, 18 aa, Entamoeba invadens
DAFTFPVTIVQNGLTALF

SEQ ID NO: 2929118 - protein, 26 aa, Entamoeba invadens
DAFVGKTCFFKRFSVGQFEENTSSSI

SEQ ID NO: 2929119 - protein, 18 aa, Entamoeba invadens
DAFYAWTVINSLLKILST

SEQ ID NO: 2929120 - protein, 17 aa, Entamoeba invadens
DAGDCYSQAAACYVREK

SEQ ID NO: 2929121 - protein, 20 aa, Entamoeba invadens
DAGEIKKGRFMFKMPDDSNL

SEQ ID NO: 2929122 - protein, 24 aa, Entamoeba invadens
DAGKGDFVLNVTMYQNGFVVNDGP

SEQ ID NO: 2929123 - protein, 18 aa, Entamoeba invadens
DAGLTCRVGDFGFAKNFS

SEQ ID NO: 2929124 - protein, 18 aa, Entamoeba invadens
DAGRIAGLNVKRIINEPT

SEQ ID NO: 2929125 - protein, 24 aa, Entamoeba invadens
DAHLSILQFILIRSKIQHPFSISA

SEQ ID NO: 2929126 - protein, 25 aa, Entamoeba invadens
DAIAEFKRLGCYFVNDEEKAKLEKF

SEQ ID NO: 2929127 - protein, 18 aa, Entamoeba invadens
DAICERLDSINLKKKIER

SEQ ID NO: 2929128 - protein, 20 aa, Entamoeba invadens
DAICVQFLLEKGANLEEVDI

SEQ ID NO: 2929129 - protein, 20 aa, Entamoeba invadens
DAIDLCIDQAYLLVKIPKLI

SEQ ID NO: 2929130 - protein, 29 aa, Entamoeba invadens
DAIECCKRFNLKTSKRVAAVRLAKSQEGC

SEQ ID NO: 2929131 - protein, 27 aa, Entamoeba invadens
DAIEHIKNAAFCFSEASNAVVGNERVV

SEQ ID NO: 2929132 - protein, 19 aa, Entamoeba invadens
DAIESCFKTQGDIENVKRK

SEQ ID NO: 2929133 - protein, 18 aa, Entamoeba invadens
DAIFKGELLRGFCDGRLF

SEQ ID NO: 2929134 - protein, 23 aa, Entamoeba invadens
DAIKYVCSPPMKGKESQAALWDA

SEQ ID NO: 2929135 - protein, 23 aa, Entamoeba invadens
DAIPEIGLGFIIKEIKEKVVDFS

SEQ ID NO: 2929136 - protein, 22 aa, Entamoeba invadens
DAKEIPLPKGLCSLNVAMCGKV

SEQ ID NO: 2929137 - protein, 17 aa, Entamoeba invadens
DAKEKLLAERKESEEKI

SEQ ID NO: 2929138 - protein, 20 aa, Entamoeba invadens
DAKIGLKVLYKLMDADGDGK

SEQ ID NO: 2929139 - protein, 21 aa, Entamoeba invadens
DAKKKLATCKNNLNNIFDIMD

SEQ ID NO: 2929140 - protein, 22 aa, Entamoeba invadens
DAKKLAYLYIMNYAKTQQDNAI

SEQ ID NO: 2929141 - protein, 26 aa, Entamoeba invadens
DAKKRYEFFDNLCLFESNYKNLREKI

SEQ ID NO: 2929142 - protein, 28 aa, Entamoeba invadens
DAKLPMQACTKLLCLLNGKAWNEEVPEI

SEQ ID NO: 2929143 - protein, 17 aa, Entamoeba invadens
DAKMIIDISCEHPDYAD

SEQ ID NO: 2929144 - protein, 17 aa, Entamoeba invadens
DAKQRAYTFLSIGRNGT

SEQ ID NO: 2929145 - protein, 23 aa, Entamoeba invadens
DAKRRAVDWLGDRLMEKIDRDHY

SEQ ID NO: 2929146 - protein, 19 aa, Entamoeba invadens
DAKTAFKRIVYSRYKGVPL

SEQ ID NO: 2929147 - protein, 24 aa, Entamoeba invadens
DAKVKVKALEFFLRLDEKQEELDD

SEQ ID NO: 2929148 - protein, 22 aa, Entamoeba invadens
DALCVIPKVLAQNAAKDATELL

SEQ ID NO: 2929149 - protein, 18 aa, Entamoeba invadens
DALDRFETLSSRNKDALL

SEQ ID NO: 2929150 - protein, 20 aa, Entamoeba invadens
DALECKWTPFNITTTPFASR

SEQ ID NO: 2929151 - protein, 25 aa, Entamoeba invadens
DALGITFFEAFAWEEACVDVKYFFE

SEQ ID NO: 2929152 - protein, 18 aa, Entamoeba invadens
DALKFFGSSIEELYEYED

SEQ ID NO: 2929153 - protein, 24 aa, Entamoeba invadens
DALKMARAVCKYDGIMIGNTAGLA

SEQ ID NO: 2929154 - protein, 22 aa, Entamoeba invadens
DALLVKNARSGFGFLEDINSSL

SEQ ID NO: 2929155 - protein, 27 aa, Entamoeba invadens
DALMSRCGLLVLRRLRDEDLMTIMKNA

SEQ ID NO: 2929156 - protein, 26 aa, Entamoeba invadens
DALNRYRLEVLIGKVPLWCRGNPTPI

SEQ ID NO: 2929157 - protein, 19 aa, Entamoeba invadens
DALQDPWVKDVICESDVLD

SEQ ID NO: 2929158 - protein, 18 aa, Entamoeba invadens
DALQLWYYFYSLFQDVNT

SEQ ID NO: 2929159 - protein, 17 aa, Entamoeba invadens
DALRDILDASGILYSVL

SEQ ID NO: 2929160 - protein, 19 aa, Entamoeba invadens
DALRFIASICDGDARAALN

SEQ ID NO: 2929161 - protein, 25 aa, Entamoeba invadens
DALRYLRRIRCWELRHLPRIHRIAA

SEQ ID NO: 2929162 - protein, 24 aa, Entamoeba invadens
DALSLNICDFVQLRFLFVSLTSSY

SEQ ID NO: 2929163 - protein, 25 aa, Entamoeba invadens
DALSRYEAHLTYNGKYMFYAPIKEK

SEQ ID NO: 2929164 - protein, 24 aa, Entamoeba invadens
DALWNPNIPFVIGSAGEGREIQFW

SEQ ID NO: 2929165 - protein, 24 aa, Entamoeba invadens
DAMAANNWQYYRIYIGMVKNDFTK

SEQ ID NO: 2929166 - protein, 31 aa, Entamoeba invadens
DAMAFVVYNFFKIRIEKSFTEKCVKPLKNIV

SEQ ID NO: 2929167 - protein, 24 aa, Entamoeba invadens
DAMKSECELLKMKVTELTKLNGDL

SEQ ID NO: 2929168 - protein, 30 aa, Entamoeba invadens
DAMNALKSSLCYKKFLGVVISLGNYMNGGN

SEQ ID NO: 2929169 - protein, 23 aa, Entamoeba invadens
DANALKVFILLLLGKKELAANVV

SEQ ID NO: 2929170 - protein, 18 aa, Entamoeba invadens
DANCRVCASSGERKCNTC

SEQ ID NO: 2929171 - protein, 22 aa, Entamoeba invadens
DANEVFKLLGNTLFSERVTDEH

SEQ ID NO: 2929172 - protein, 17 aa, Entamoeba invadens
DANHKFFHVFDRWDCTQ

SEQ ID NO: 2929173 - protein, 20 aa, Entamoeba invadens
DANHKVAEAEAYLEEQKRKA

SEQ ID NO: 2929174 - protein, 17 aa, Entamoeba invadens
DANKVRLVREVQDFPIF

SEQ ID NO: 2929175 - protein, 19 aa, Entamoeba invadens
DANLFKTVILTSVVEKGSF

SEQ ID NO: 2929176 - protein, 26 aa, Entamoeba invadens
DANLKRISPCTVECGGSVLVVDPKQV

SEQ ID NO: 2929177 - protein, 17 aa, Entamoeba invadens
DAPFERIRTILLDTCVE

SEQ ID NO: 2929178 - protein, 23 aa, Entamoeba invadens
DAPPHGFGCCGDGFPDGCPCGKD

SEQ ID NO: 2929179 - protein, 31 aa, Entamoeba invadens
DAPQKIALKIRKRGFVSQNVYIFRKMTDQQG

SEQ ID NO: 2929180 - protein, 18 aa, Entamoeba invadens
DAPTKIKMINNWVEQTSP

SEQ ID NO: 2929181 - protein, 20 aa, Entamoeba invadens
DAPYNLTSFILVKNNITLEI

SEQ ID NO: 2929182 - protein, 22 aa, Entamoeba invadens
DAQFLYNCIVFLVSQNVNTTLS

SEQ ID NO: 2929183 - protein, 24 aa, Entamoeba invadens
DAQFSINFKNNFATAFKSAVTDVE

SEQ ID NO: 2929184 - protein, 21 aa, Entamoeba invadens
DAQILKNLGCKNVPKPFDNKV

SEQ ID NO: 2929185 - protein, 27 aa, Entamoeba invadens
DAQKPFVCLEYVKKMLLQNLSFSVVPT

SEQ ID NO: 2929186 - protein, 25 aa, Entamoeba invadens
DAQRPEYFFGKGFFGNCSNERYWEP

SEQ ID NO: 2929187 - protein, 24 aa, Entamoeba invadens
DAQVADCLYHLLPMVEPQLSQLPL

SEQ ID NO: 2929188 - protein, 22 aa, Entamoeba invadens
DARIKRGIVGSGVVKVVPAITP

SEQ ID NO: 2929189 - protein, 21 aa, Entamoeba invadens
DARKRALRLFGNYLGNSLYDT

SEQ ID NO: 2929190 - protein, 24 aa, Entamoeba invadens
DARMRGRLFGFFNRFFEKESESKE

SEQ ID NO: 2929191 - protein, 18 aa, Entamoeba invadens
DARVKKGLPETIRVVTSC

SEQ ID NO: 2929192 - protein, 17 aa, Entamoeba invadens
DASDLKVLLDDKDRELK

SEQ ID NO: 2929193 - protein, 26 aa, Entamoeba invadens
DASEIWFKAVKEIGDYCFEDCDFRYN

SEQ ID NO: 2929194 - protein, 29 aa, Entamoeba invadens
DASEIWFKAVKEIGDYCFEDCDFRYNKKI

SEQ ID NO: 2929195 - protein, 24 aa, Entamoeba invadens
DASFKAVVVSIYLENDTRDDWACL

SEQ ID NO: 2929196 - protein, 21 aa, Entamoeba invadens
DASILPALAFVVKSLTTENKN

SEQ ID NO: 2929197 - protein, 37 aa, Entamoeba invadens
DASLTCLELPTTISKIGKYCFGCCNNLGKVNIVAPLM

SEQ ID NO: 2929198 - protein, 24 aa, Entamoeba invadens
DASMKTCLVKRNFKGNKKIEEFRV

SEQ ID NO: 2929199 - protein, 30 aa, Entamoeba invadens
DATCQLLRTLISLNIKDVFLSKIPLSKNLK

SEQ ID NO: 2929200 - protein, 25 aa, Entamoeba invadens
DATKSLRVNPWFTTPEHVVKFYQKF

SEQ ID NO: 2929201 - protein, 24 aa, Entamoeba invadens
DATLRFDYKIDFIKWCLKVPNYQR

SEQ ID NO: 2929202 - protein, 20 aa, Entamoeba invadens
DATSVLYLFVNQILKCSKMW

SEQ ID NO: 2929203 - protein, 19 aa, Entamoeba invadens
DAVCQLQTLLLLNKKDEAM

SEQ ID NO: 2929204 - protein, 26 aa, Entamoeba invadens
DAVFYYKKFWDFDIGTKYPLSKRSNN

SEQ ID NO: 2929205 - protein, 20 aa, Entamoeba invadens
DAVIPVSFCVPRKSELFQDD

SEQ ID NO: 2929206 - protein, 24 aa, Entamoeba invadens
DAVKDFFKDFTFMSFYRDVEKKGT

SEQ ID NO: 2929207 - protein, 24 aa, Entamoeba invadens
DAVMVKRLLEHGADVNQLDIRKMT

SEQ ID NO: 2929208 - protein, 19 aa, Entamoeba invadens
DAVQKTCDFIEAISKGFEA

SEQ ID NO: 2929209 - protein, 26 aa, Entamoeba invadens
DAVSIWKAEIVNLVFDSVKDIIQYDK

SEQ ID NO: 2929210 - protein, 19 aa, Entamoeba invadens
DAVVFRFIAFRNYITKHIN

SEQ ID NO: 2929211 - protein, 26 aa, Entamoeba invadens
DAVWCLVFLCEWEKYSQFLFTEQIFK

SEQ ID NO: 2929212 - protein, 20 aa, Entamoeba invadens
DAWIKAVCAHNMLRFEKILI

SEQ ID NO: 2929213 - protein, 18 aa, Entamoeba invadens
DAYCKMQVTISGSDDHLF

SEQ ID NO: 2929214 - protein, 23 aa, Entamoeba invadens
DAYCPSLRKHLEKFQSTDIPEEA

SEQ ID NO: 2929215 - protein, 18 aa, Entamoeba invadens
DAYHLHRPLRFTVDKIVE

SEQ ID NO: 2929216 - protein, 26 aa, Entamoeba invadens
DAYPKNKFQYAWSIADFVTSGKHLEK

SEQ ID NO: 2929217 - protein, 26 aa, Entamoeba invadens
DCACETLWKILYIPLVKEGLYNPLGQ

SEQ ID NO: 2929218 - protein, 19 aa, Entamoeba invadens
DCAEIAKKQGIYCVDLKRL

SEQ ID NO: 2929219 - protein, 17 aa, Entamoeba invadens
DCAKRPSDEMVSAFSHL

SEQ ID NO: 2929220 - protein, 18 aa, Entamoeba invadens
DCCFFRCSSLISITIPSS

SEQ ID NO: 2929221 - protein, 23 aa, Entamoeba invadens
DCCFKSCCKLEHINIPTLPINVG

SEQ ID NO: 2929222 - protein, 22 aa, Entamoeba invadens
DCCFYECGKLSSIIIPSSVTSI

SEQ ID NO: 2929223 - protein, 19 aa, Entamoeba invadens
DCDLLICIGTSLVVEPFAS

SEQ ID NO: 2929224 - protein, 24 aa, Entamoeba invadens
DCDMPLSASFVRKNATITMVNNTD

SEQ ID NO: 2929225 - protein, 23 aa, Entamoeba invadens
DCELPSVNNFVVWYKIPYSQTTT

SEQ ID NO: 2929226 - protein, 18 aa, Entamoeba invadens
DCESIEWLFLAALSKKYV

SEQ ID NO: 2929227 - protein, 18 aa, Entamoeba invadens
DCESLELVANHVLTKSVL

SEQ ID NO: 2929228 - protein, 17 aa, Entamoeba invadens
DCFFMCFNLDNVIIPSS

SEQ ID NO: 2929229 - protein, 18 aa, Entamoeba invadens
DCFHMMIVSKYFLTYKDF

SEQ ID NO: 2929230 - protein, 18 aa, Entamoeba invadens
DCFIECPHLSSLTIPKIK

SEQ ID NO: 2929231 - protein, 18 aa, Entamoeba invadens
DCFKTCTSLTKLSIPHLI

SEQ ID NO: 2929232 - protein, 19 aa, Entamoeba invadens
DCFMICFSVDDSDSFARIK

SEQ ID NO: 2929233 - protein, 23 aa, Entamoeba invadens
DCFRNCTKLESIAFKNSTHNFSY

SEQ ID NO: 2929234 - protein, 17 aa, Entamoeba invadens
DCFSLKIVIVNTLKDVK

SEQ ID NO: 2929235 - protein, 17 aa, Entamoeba invadens
DCFSYCYSLSSVTISSS

SEQ ID NO: 2929236 - protein, 21 aa, Entamoeba invadens
DCFSYLCSLRSVTIPSSVTSI

SEQ ID NO: 2929237 - protein, 29 aa, Entamoeba invadens
DCGCWGDCCYYYYPCQEIVYEQAELSQNG

SEQ ID NO: 2929238 - protein, 25 aa, Entamoeba invadens
DCGEYRWASTILNYVVFADKTNQKA

SEQ ID NO: 2929239 - protein, 17 aa, Entamoeba invadens
DCGFEEFVIPSTVTEIG

SEQ ID NO: 2929240 - protein, 20 aa, Entamoeba invadens
DCGYPDYAYPNLFVTNHDLL

SEQ ID NO: 2929241 - protein, 25 aa, Entamoeba invadens
DCIINFKNIFTFDFKHFNLASTTLI

SEQ ID NO: 2929242 - protein, 19 aa, Entamoeba invadens
DCIRISKFMTDRQSYKLYS

SEQ ID NO: 2929243 - protein, 21 aa, Entamoeba invadens
DCKEFCTKLASANEKSRVTKS

SEQ ID NO: 2929244 - protein, 30 aa, Entamoeba invadens
DCKLLEHIRIPKSVHFIGEMAFLNCENIKE

SEQ ID NO: 2929245 - protein, 22 aa, Entamoeba invadens
DCKNLRAQELIQSCICCSVEKS

SEQ ID NO: 2929246 - protein, 21 aa, Entamoeba invadens
DCKPFCELCARNVFQRKKLEG

SEQ ID NO: 2929247 - protein, 25 aa, Entamoeba invadens
DCKSDLFKQINLVGGAAKISGLSTR

SEQ ID NO: 2929248 - protein, 21 aa, Entamoeba invadens
DCLFDRFYDVNSFVRIKVLQT

SEQ ID NO: 2929249 - protein, 20 aa, Entamoeba invadens
DCLFEPFMWQLFSQRPTFEQ

SEQ ID NO: 2929250 - protein, 27 aa, Entamoeba invadens
DCLRSIDKYAFYCVRLLSKIELPENIT

SEQ ID NO: 2929251 - protein, 19 aa, Entamoeba invadens
DCLSSIKTLEDVNCSYNDI

SEQ ID NO: 2929252 - protein, 18 aa, Entamoeba invadens
DCMEFFFQLCDLDNDGFL

SEQ ID NO: 2929253 - protein, 18 aa, Entamoeba invadens
DCMGNCGCICIATDSTTK

SEQ ID NO: 2929254 - protein, 19 aa, Entamoeba invadens
DCMQKFPISQEGASRAFWV

SEQ ID NO: 2929255 - protein, 20 aa, Entamoeba invadens
DCNCAGRIITWCKKYSQSKQ

SEQ ID NO: 2929256 - protein, 31 aa, Entamoeba invadens
DCNCPKGDPLEHLIWLHAWKYSIEGKTWVAN

SEQ ID NO: 2929257 - protein, 26 aa, Entamoeba invadens
DCNKLDTFIFKQCRNTIFEFINAKPN

SEQ ID NO: 2929258 - protein, 26 aa, Entamoeba invadens
DCPCCRKYLNRFGCNSKICEKCNKKV

SEQ ID NO: 2929259 - protein, 22 aa, Entamoeba invadens
DCPDAWKYHDGVSHTDKEQIES

SEQ ID NO: 2929260 - protein, 24 aa, Entamoeba invadens
DCPEKGKHAPVIKTRDMKIAEQKH

SEQ ID NO: 2929261 - protein, 23 aa, Entamoeba invadens
DCPFRAMDEFDVFLDSVTRKVAI

SEQ ID NO: 2929262 - protein, 20 aa, Entamoeba invadens
DCPVEVPKYIVGQREDFSGS

SEQ ID NO: 2929263 - protein, 22 aa, Entamoeba invadens
DCPYSERLFKWFTKYNDKLKKT

SEQ ID NO: 2929264 - protein, 19 aa, Entamoeba invadens
DCQELWKINAGNPVVKNAL

SEQ ID NO: 2929265 - protein, 22 aa, Entamoeba invadens
DCQLRKRYQLWVKECKNCQMEV

SEQ ID NO: 2929266 - protein, 20 aa, Entamoeba invadens
DCQYLKRKINGIIDNIISKE

SEQ ID NO: 2929267 - protein, 17 aa, Entamoeba invadens
DCRFGCLQFNTKIADWI

SEQ ID NO: 2929268 - protein, 20 aa, Entamoeba invadens
DCSDAGIAVQCMDNSHVSLV

SEQ ID NO: 2929269 - protein, 27 aa, Entamoeba invadens
DCSNILKFGVSCFESMSSLVAITLSTN

SEQ ID NO: 2929270 - protein, 24 aa, Entamoeba invadens
DCSTKYTIPFGIKSIRKYCFYKTP

SEQ ID NO: 2929271 - protein, 22 aa, Entamoeba invadens
DCSVGKTCIIGRFTSKNFDMSY

SEQ ID NO: 2929272 - protein, 19 aa, Entamoeba invadens
DCTHNAIIVKSNLLSDYDG

SEQ ID NO: 2929273 - protein, 20 aa, Entamoeba invadens
DCTHYSTAIDIWAYGCVVAE

SEQ ID NO: 2929274 - protein, 23 aa, Entamoeba invadens
DCTSLSSLSCCVSLQLPKSTLMG

SEQ ID NO: 2929275 - protein, 20 aa, Entamoeba invadens
DCVDIPRIILPTSVVSLRMK

SEQ ID NO: 2929276 - protein, 18 aa, Entamoeba invadens
DCVHFLPVILNGLLGVTS

SEQ ID NO: 2929277 - protein, 19 aa, Entamoeba invadens
DCVHLKVVVIDAENLKIAT

SEQ ID NO: 2929278 - protein, 24 aa, Entamoeba invadens
DCVKEGYCIEIGRGAATNSTDLKE

SEQ ID NO: 2929279 - protein, 17 aa, Entamoeba invadens
DCVQNVKVVERYGEGKD

SEQ ID NO: 2929280 - protein, 26 aa, Entamoeba invadens
DCWDAEIRMSYGWVECVGHADRGDYD

SEQ ID NO: 2929281 - protein, 22 aa, Entamoeba invadens
DCWIKYTGLCYNNGMTRLAMKT

SEQ ID NO: 2929282 - protein, 17 aa, Entamoeba invadens
DCYSRIYRKIIVDKDSF

SEQ ID NO: 2929283 - protein, 33 aa, Entamoeba invadens
DCYVQTKLAKYCFRCGYPLRGYKVLYPTITYKT

SEQ ID NO: 2929284 - protein, 23 aa, Entamoeba invadens
DDAPSFYLKKTLKVMKKEKVYVV

SEQ ID NO: 2929285 - protein, 31 aa, Entamoeba invadens
DDARLFQILARGCAQLSFYAKAVAANSSVVL

SEQ ID NO: 2929286 - protein, 19 aa, Entamoeba invadens
DDAYALSLLPLVHVFSNGF

SEQ ID NO: 2929287 - protein, 26 aa, Entamoeba invadens
DDCVKEAKSVVLVIVDDVDRLLADEK

SEQ ID NO: 2929288 - protein, 25 aa, Entamoeba invadens
DDDACVLPGASVLLWEGDDFVLSFG

SEQ ID NO: 2929289 - protein, 24 aa, Entamoeba invadens
DDDCAKPRVLHMTEAFVDLDSWTS

SEQ ID NO: 2929290 - protein, 22 aa, Entamoeba invadens
DDDELPLGYVISLINNSNACID

SEQ ID NO: 2929291 - protein, 28 aa, Entamoeba invadens
DDDISLEIGRLFLMTPIENRRLLLALVN

SEQ ID NO: 2929292 - protein, 30 aa, Entamoeba invadens
DDDRRPQLVPVLYKLEFVSLIIQNIYTNTS

SEQ ID NO: 2929293 - protein, 25 aa, Entamoeba invadens
DDEEAKERLGIVSYGRKIKETLRKE

SEQ ID NO: 2929294 - protein, 35 aa, Entamoeba invadens
DDEIKYFLGEIGSGLWYLHFIKKLIHRDLKPANLL

SEQ ID NO: 2929295 - protein, 17 aa, Entamoeba invadens
DDEKYLWKPVTIPETKQ

SEQ ID NO: 2929296 - protein, 26 aa, Entamoeba invadens
DDELCPECLDALLPLVLKSDGVTIPR

SEQ ID NO: 2929297 - protein, 24 aa, Entamoeba invadens
DDELKVVSRFAFMCDVDDGFNVKC

SEQ ID NO: 2929298 - protein, 20 aa, Entamoeba invadens
DDENCAQCADDGETCYKYAF

SEQ ID NO: 2929299 - protein, 25 aa, Entamoeba invadens
DDERRLPGQIPIGLEKALKYLYANG

SEQ ID NO: 2929300 - protein, 22 aa, Entamoeba invadens
DDETRYFLVMEFCKGGELYKLL

SEQ ID NO: 2929301 - protein, 17 aa, Entamoeba invadens
DDFAMKISVWKDSGKVW

SEQ ID NO: 2929302 - protein, 20 aa, Entamoeba invadens
DDFAYYRCCELIISNFIQTD

SEQ ID NO: 2929303 - protein, 25 aa, Entamoeba invadens
DDFCGGSLGLLAVRQSELLVVLSNE

SEQ ID NO: 2929304 - protein, 17 aa, Entamoeba invadens
DDFINMILVCKKFSCIL

SEQ ID NO: 2929305 - protein, 28 aa, Entamoeba invadens
DDFKACQLIEFVLRPGPRDKKRGFISDD

SEQ ID NO: 2929306 - protein, 17 aa, Entamoeba invadens
DDFKKSEGDTMTFMLCG

SEQ ID NO: 2929307 - protein, 24 aa, Entamoeba invadens
DDFLNARACKECALKGSACETHKN

SEQ ID NO: 2929308 - protein, 24 aa, Entamoeba invadens
DDFNKAFDLLKEFITLIEATNGDI

SEQ ID NO: 2929309 - protein, 21 aa, Entamoeba invadens
DDFRGEAWTKCLGVDITKDDY

SEQ ID NO: 2929310 - protein, 17 aa, Entamoeba invadens
DDFRKACQYNLVNDGAI

SEQ ID NO: 2929311 - protein, 24 aa, Entamoeba invadens
DDFSFCLCGAFIHKIVSLLQTKTE

SEQ ID NO: 2929312 - protein, 17 aa, Entamoeba invadens
DDFSMNLLLVYIYEKRI

SEQ ID NO: 2929313 - protein, 21 aa, Entamoeba invadens
DDFVKTFVMKCCEDTPTDRLT

SEQ ID NO: 2929314 - protein, 31 aa, Entamoeba invadens
DDGECGLHFFSKSFNAMKFKSKTRKSDTAIF

SEQ ID NO: 2929315 - protein, 25 aa, Entamoeba invadens
DDGECGLHFFSKSFNTMKFKSKTRK

SEQ ID NO: 2929316 - protein, 24 aa, Entamoeba invadens
DDGEMKAALVGMFCYIANNSEDIF

SEQ ID NO: 2929317 - protein, 33 aa, Entamoeba invadens
DDGLSVLLDVCLRLCETYLLFLLFGRAMNENTN

SEQ ID NO: 2929318 - protein, 25 aa, Entamoeba invadens
DDGTGVACGLAYIELRDKFQHPALE

SEQ ID NO: 2929319 - protein, 27 aa, Entamoeba invadens
DDGVERKILRFCGAKELRSLKEKTEKE

SEQ ID NO: 2929320 - protein, 21 aa, Entamoeba invadens
DDGYFKISFCRLTGLKLSDWN

SEQ ID NO: 2929321 - protein, 20 aa, Entamoeba invadens
DDHILACDTLVYVFSLTDHA

SEQ ID NO: 2929322 - protein, 19 aa, Entamoeba invadens
DDHTICAPILQTDNKPENW

SEQ ID NO: 2929323 - protein, 25 aa, Entamoeba invadens
DDIAKGHISRAFMVYDRLRKLPLFE

SEQ ID NO: 2929324 - protein, 24 aa, Entamoeba invadens
DDICKGCDLVDNFVEDIKNNKNNK

SEQ ID NO: 2929325 - protein, 27 aa, Entamoeba invadens
DDIDKVLTCKINKLKTEKVQLEEKDKT

SEQ ID NO: 2929326 - protein, 23 aa, Entamoeba invadens
DDIKDKYNIIGITLEGVVMRFHL

SEQ ID NO: 2929327 - protein, 18 aa, Entamoeba invadens
DDIKEFLSEFDVKKVTQG

SEQ ID NO: 2929328 - protein, 24 aa, Entamoeba invadens
DDIKFRTQWKYTITVNINEKSSIE

SEQ ID NO: 2929329 - protein, 26 aa, Entamoeba invadens
DDIKGNRFGAAIFSRILHIAEPVKDK

SEQ ID NO: 2929330 - protein, 18 aa, Entamoeba invadens
DDILKNIPLVGSQRKLKP

SEQ ID NO: 2929331 - protein, 21 aa, Entamoeba invadens
DDILPRCAIRGYLFANLKGKM

SEQ ID NO: 2929332 - protein, 22 aa, Entamoeba invadens
DDIMKWNCLIFGTEGSIWEGGI

SEQ ID NO: 2929333 - protein, 20 aa, Entamoeba invadens
DDITSAFFIYFENLLGTLPW

SEQ ID NO: 2929334 - protein, 24 aa, Entamoeba invadens
DDIVKALTLSGGRISKELSELNEG

SEQ ID NO: 2929335 - protein, 18 aa, Entamoeba invadens
DDIYRPNMLHNFSLYLDG

SEQ ID NO: 2929336 - protein, 25 aa, Entamoeba invadens
DDKDFRFAWNIADFTSSGKRLHIPD

SEQ ID NO: 2929337 - protein, 23 aa, Entamoeba invadens
DDKDFSIDFARQLLERKEKGKKS

SEQ ID NO: 2929338 - protein, 26 aa, Entamoeba invadens
DDKDIANLCLLTGMKNIYATGYKIKK

SEQ ID NO: 2929339 - protein, 25 aa, Entamoeba invadens
DDKEIRMLFVLAPYSFLLFKITPTQ

SEQ ID NO: 2929340 - protein, 24 aa, Entamoeba invadens
DDKFKKFLDRCLCVDPTQRATATQ

SEQ ID NO: 2929341 - protein, 19 aa, Entamoeba invadens
DDKGVTVEICIRTTDSEIP

SEQ ID NO: 2929342 - protein, 21 aa, Entamoeba invadens
DDKIGTADLVIQKTPNGQMTS

SEQ ID NO: 2929343 - protein, 34 aa, Entamoeba invadens
DDKKCVKCSNMGVLDCDGNCIAFELSGCVSSPNT

SEQ ID NO: 2929344 - protein, 22 aa, Entamoeba invadens
DDKRECAICQSGMYPNNVKHSL

SEQ ID NO: 2929345 - protein, 24 aa, Entamoeba invadens
DDKTGCGSNLFVLKDGCDVFDAKR

SEQ ID NO: 2929346 - protein, 19 aa, Entamoeba invadens
DDKTIKCFNFDQNFAEIMT

SEQ ID NO: 2929347 - protein, 26 aa, Entamoeba invadens
DDLARSETWQWLGRREAEDRIAKDKL

SEQ ID NO: 2929348 - protein, 36 aa, Entamoeba invadens
DDLDLFPYYNSIREEIEFNLLFTLEKRKQLFQLSKL

SEQ ID NO: 2929349 - protein, 18 aa, Entamoeba invadens
DDLETLLEICRKYNDERS

SEQ ID NO: 2929350 - protein, 18 aa, Entamoeba invadens
DDLFNPKLMEEDYLEGES

SEQ ID NO: 2929351 - protein, 24 aa, Entamoeba invadens
DDLFVFCKALLYLHDDKISEALFT

SEQ ID NO: 2929352 - protein, 19 aa, Entamoeba invadens
DDLICNCFSQLFLDLFGTY

SEQ ID NO: 2929353 - protein, 24 aa, Entamoeba invadens
DDLIKADFCFFIFGECDQTNQSKT

SEQ ID NO: 2929354 - protein, 21 aa, Entamoeba invadens
DDLKGKILITLIDPSKQIQHS

SEQ ID NO: 2929355 - protein, 20 aa, Entamoeba invadens
DDLLGLFSFSILHSHVKYPF

SEQ ID NO: 2929356 - protein, 38 aa, Entamoeba invadens
DDLLHDLKDGLVLAKFLRNLSCKNIPTIIRKPTKDIEK

SEQ ID NO: 2929357 - protein, 25 aa, Entamoeba invadens
DDLLYRLRTTELLYMYEKTIVDFTL

SEQ ID NO: 2929358 - protein, 24 aa, Entamoeba invadens
DDLNFTFHVQKFFKKCSLESISLS

SEQ ID NO: 2929359 - protein, 21 aa, Entamoeba invadens
DDLQKLCIVKDIYDFYKEVPV

SEQ ID NO: 2929360 - protein, 21 aa, Entamoeba invadens
DDLRKACEVVEIISNKDLFAL

SEQ ID NO: 2929361 - protein, 20 aa, Entamoeba invadens
DDLRLKIEFEEKKIAMLNEE

SEQ ID NO: 2929362 - protein, 18 aa, Entamoeba invadens
DDLSEMKTELEALEQAAK

SEQ ID NO: 2929363 - protein, 18 aa, Entamoeba invadens
DDLVEFLKQSGLKLEETA

SEQ ID NO: 2929364 - protein, 26 aa, Entamoeba invadens
DDLVNLSACFQFKRGIHFLKSETTDL

SEQ ID NO: 2929365 - protein, 26 aa, Entamoeba invadens
DDLYGECYPVIGGSVFADVDKNGKIT

SEQ ID NO: 2929366 - protein, 25 aa, Entamoeba invadens
DDMAESFLFYANWIEPIRYISRRVV

SEQ ID NO: 2929367 - protein, 23 aa, Entamoeba invadens
DDMEKTEKIWLLEFDAEDTNRKK

SEQ ID NO: 2929368 - protein, 24 aa, Entamoeba invadens
DDMIDAFRGFKIRYLITTDVIARG

SEQ ID NO: 2929369 - protein, 24 aa, Entamoeba invadens
DDMSEMKTELEAFEQAAKTYKQSK

SEQ ID NO: 2929370 - protein, 24 aa, Entamoeba invadens
DDMSEMKTELEALEQAAKTYKQSK

SEQ ID NO: 2929371 - protein, 20 aa, Entamoeba invadens
DDMSEMKTELEALEQVAKTY

SEQ ID NO: 2929372 - protein, 24 aa, Entamoeba invadens
DDMWKCVGDYCGIDLKEVVQAWTY

SEQ ID NO: 2929373 - protein, 18 aa, Entamoeba invadens
DDNIFTIQAMDFDNKKVE

SEQ ID NO: 2929374 - protein, 24 aa, Entamoeba invadens
DDPEFKFDLAMSLNKIELAREMAE

SEQ ID NO: 2929375 - protein, 23 aa, Entamoeba invadens
DDPFEFLNKLLLFVDKVEPKYLC

SEQ ID NO: 2929376 - protein, 24 aa, Entamoeba invadens
DDPLCLKNAMTIVSYFHSFNKTNF

SEQ ID NO: 2929377 - protein, 20 aa, Entamoeba invadens
DDPSCGMGLIFGTGTNGCYI

SEQ ID NO: 2929378 - protein, 23 aa, Entamoeba invadens
DDPVEICEMKLEIVTLLVQETNC

SEQ ID NO: 2929379 - protein, 21 aa, Entamoeba invadens
DDQLRFVLERIKFRYSNLRQR

SEQ ID NO: 2929380 - protein, 30 aa, Entamoeba invadens
DDQMGVGSCKLECLPIGQTVTKDVQLNTKG

SEQ ID NO: 2929381 - protein, 17 aa, Entamoeba invadens
DDRECISSDNCSIGTIT

SEQ ID NO: 2929382 - protein, 20 aa, Entamoeba invadens
DDRESFKNVVNWYQETQRYS

SEQ ID NO: 2929383 - protein, 24 aa, Entamoeba invadens
DDRKALIWNCFKSDTSLPPEDMSQ

SEQ ID NO: 2929384 - protein, 19 aa, Entamoeba invadens
DDRKIYAMKVLRKDVVKKR

SEQ ID NO: 2929385 - protein, 23 aa, Entamoeba invadens
DDRPSTQLLRMISFVATRSHYFT

SEQ ID NO: 2929386 - protein, 19 aa, Entamoeba invadens
DDRSVLIAGVDNYVVDVDL

SEQ ID NO: 2929387 - protein, 23 aa, Entamoeba invadens
DDSDLLCAILMKKIEEEGIVVMF

SEQ ID NO: 2929388 - protein, 22 aa, Entamoeba invadens
DDSFVTLCKMLKASADNFPREE

SEQ ID NO: 2929389 - protein, 19 aa, Entamoeba invadens
DDSGYCKLKELIVDEYTNA

SEQ ID NO: 2929390 - protein, 34 aa, Entamoeba invadens
DDSLPRILVFSSHLQQLIAFKADHIFADGTYRIT

SEQ ID NO: 2929391 - protein, 25 aa, Entamoeba invadens
DDSLPRILVFSSHLQQLIASKADHI

SEQ ID NO: 2929392 - protein, 27 aa, Entamoeba invadens
DDSSFLLRYFALHLNDVVKLYKLHNII

SEQ ID NO: 2929393 - protein, 23 aa, Entamoeba invadens
DDSVFEVVVRFLIRNKDTEKVEQ

SEQ ID NO: 2929394 - protein, 18 aa, Entamoeba invadens
DDTFFVFSINNTKGSTPV

SEQ ID NO: 2929395 - protein, 24 aa, Entamoeba invadens
DDTKLKTQEEIIIKEKVENDELRK

SEQ ID NO: 2929396 - protein, 17 aa, Entamoeba invadens
DDTLCLRNATIVVNYFK

SEQ ID NO: 2929397 - protein, 24 aa, Entamoeba invadens
DDTRLGRRILRDMKFRGRTLDSIL

SEQ ID NO: 2929398 - protein, 22 aa, Entamoeba invadens
DDTSRFCLINGPNMGGKSTYIR

SEQ ID NO: 2929399 - protein, 26 aa, Entamoeba invadens
DDTTRKFLKFSWVIFLLIVKSINTYQ

SEQ ID NO: 2929400 - protein, 25 aa, Entamoeba invadens
DDVANKMSMFFAFSSPMMKVLTEAV

SEQ ID NO: 2929401 - protein, 17 aa, Entamoeba invadens
DDVCARLRKCIPEITIA

SEQ ID NO: 2929402 - protein, 28 aa, Entamoeba invadens
DDVDQLVFRKSRALKRATKVLGGNDAEV

SEQ ID NO: 2929403 - protein, 21 aa, Entamoeba invadens
DDVDVSFAFAAMRRIPQQYIE

SEQ ID NO: 2929404 - protein, 22 aa, Entamoeba invadens
DDVETMLSILFKNAINERRYVQ

SEQ ID NO: 2929405 - protein, 17 aa, Entamoeba invadens
DDVFKYLKRIEIGSKGK

SEQ ID NO: 2929406 - protein, 24 aa, Entamoeba invadens
DDVFLKIELLSGVRNDMPGFEKAY

SEQ ID NO: 2929407 - protein, 23 aa, Entamoeba invadens
DDVIAAFWWDDFCDGDLEDLETV

SEQ ID NO: 2929408 - protein, 25 aa, Entamoeba invadens
DDVKEFLSDFKIKKITQIVRTEGEL

SEQ ID NO: 2929409 - protein, 21 aa, Entamoeba invadens
DDVKTRVDALLTPNIEMDPFS

SEQ ID NO: 2929410 - protein, 20 aa, Entamoeba invadens
DDVLFSLPFLNRVSLSERSG

SEQ ID NO: 2929411 - protein, 25 aa, Entamoeba invadens
DDVLKEVISFRCAIERVKVEFKESG

SEQ ID NO: 2929412 - protein, 25 aa, Entamoeba invadens
DDVLNKFCVIQTFLDKSEVGPNIEI

SEQ ID NO: 2929413 - protein, 18 aa, Entamoeba invadens
DDVNKFIGYFKEKYMIPM

SEQ ID NO: 2929414 - protein, 22 aa, Entamoeba invadens
DDVPFNSVFAIKGKLEEGASFR

SEQ ID NO: 2929415 - protein, 21 aa, Entamoeba invadens
DDVPMQMVVVYAGVKGEAITI

SEQ ID NO: 2929416 - protein, 21 aa, Entamoeba invadens
DDVVCLKRIKADDEKLKKKRV

SEQ ID NO: 2929417 - protein, 21 aa, Entamoeba invadens
DDVVNLPSFIVEIFDEVTPSL

SEQ ID NO: 2929418 - protein, 18 aa, Entamoeba invadens
DDVVPMLVVAEFFRDFLD

SEQ ID NO: 2929419 - protein, 23 aa, Entamoeba invadens
DDWLVAALKQFSALSSQLVAAAR

SEQ ID NO: 2929420 - protein, 28 aa, Entamoeba invadens
DDYAWWKGRLSQMAQYFSAYRIDHILGF

SEQ ID NO: 2929421 - protein, 23 aa, Entamoeba invadens
DDYCIGCCNSLKNFVVPKYATSI

SEQ ID NO: 2929422 - protein, 17 aa, Entamoeba invadens
DDYFLSRMIEYVPAVNF

SEQ ID NO: 2929423 - protein, 20 aa, Entamoeba invadens
DDYKEGVDYVLLSKKNFDFM

SEQ ID NO: 2929424 - protein, 23 aa, Entamoeba invadens
DDYKEVRKFPAFSKRVRKHYKES

SEQ ID NO: 2929425 - protein, 17 aa, Entamoeba invadens
DDYKTEVSLSPKEILYE

SEQ ID NO: 2929426 - protein, 23 aa, Entamoeba invadens
DDYLKPYLRRSTLIKEIIDKNDS

SEQ ID NO: 2929427 - protein, 19 aa, Entamoeba invadens
DEALVCIDLGLNLNKTNAD

SEQ ID NO: 2929428 - protein, 21 aa, Entamoeba invadens
DECDKCGAKVPLNMMQHHKDY

SEQ ID NO: 2929429 - protein, 20 aa, Entamoeba invadens
DECFSWCFSLSSVIIPSSVR

SEQ ID NO: 2929430 - protein, 17 aa, Entamoeba invadens
DECKSIYQRGIHNKVLR

SEQ ID NO: 2929431 - protein, 18 aa, Entamoeba invadens
DECNKLTKISFCRCSNKS

SEQ ID NO: 2929432 - protein, 17 aa, Entamoeba invadens
DECNNLKKHVWRCDGTC

SEQ ID NO: 2929433 - protein, 24 aa, Entamoeba invadens
DECSPAFWKFMDLLGKRYEQNGFI

SEQ ID NO: 2929434 - protein, 25 aa, Entamoeba invadens
DECVPEDISLLAFLISKSVKQNIKM

SEQ ID NO: 2929435 - protein, 38 aa, Entamoeba invadens
DECYICKRRFGLFWTKYHCQRCGFIVCYRCSTKRKIIP

SEQ ID NO: 2929436 - protein, 23 aa, Entamoeba invadens
DEDDCCCICYSKLKDYPLNEFNT

SEQ ID NO: 2929437 - protein, 23 aa, Entamoeba invadens
DEDDIKKWVCVIFGPEDTIWENG

SEQ ID NO: 2929438 - protein, 20 aa, Entamoeba invadens
DEDRTLIALFKKANNKSHEI

SEQ ID NO: 2929439 - protein, 23 aa, Entamoeba invadens
DEDVCFYCHKKGHWTRDCPEKRG

SEQ ID NO: 2929440 - protein, 22 aa, Entamoeba invadens
DEEFKQMSAHLVVKDLPQPPKE

SEQ ID NO: 2929441 - protein, 23 aa, Entamoeba invadens
DEEIFVGVVDWVCRDEEELENLN

SEQ ID NO: 2929442 - protein, 30 aa, Entamoeba invadens
DEEKRYSLFDVEAFLPVITRVEYSKLLEGA

SEQ ID NO: 2929443 - protein, 29 aa, Entamoeba invadens
DEEKYVILVRMCKGRTFKTFPLVTQIKCG

SEQ ID NO: 2929444 - protein, 21 aa, Entamoeba invadens
DEELFNVPILFYLNKTDLPNA

SEQ ID NO: 2929445 - protein, 22 aa, Entamoeba invadens
DEELFNVPILFYLNKTDLPNAL

SEQ ID NO: 2929446 - protein, 21 aa, Entamoeba invadens
DEELINVPILFYLNKTDLPNA

SEQ ID NO: 2929447 - protein, 26 aa, Entamoeba invadens
DEESPVRFFSLLLYYHIVTSLRSLTP

SEQ ID NO: 2929448 - protein, 24 aa, Entamoeba invadens
DEESRLSWREFFAHQFVYRAMQHH

SEQ ID NO: 2929449 - protein, 19 aa, Entamoeba invadens
DEFCFKRLTIPESVTRINN

SEQ ID NO: 2929450 - protein, 29 aa, Entamoeba invadens
DEFDDIFDIILYNGRWDAVNRKYVKQRID

SEQ ID NO: 2929451 - protein, 26 aa, Entamoeba invadens
DEFGLKLRVKMCLDAIKGIVYLHTNG

SEQ ID NO: 2929452 - protein, 21 aa, Entamoeba invadens
DEFIKRLRITTEDTTQVSQVD

SEQ ID NO: 2929453 - protein, 23 aa, Entamoeba invadens
DEFKRIEKKLVFNEGSDLKKREK

SEQ ID NO: 2929454 - protein, 19 aa, Entamoeba invadens
DEFKSCFYLLLNARARFKG

SEQ ID NO: 2929455 - protein, 22 aa, Entamoeba invadens
DEFLLDVCLIDCELFADELSLL

SEQ ID NO: 2929456 - protein, 20 aa, Entamoeba invadens
DEFPCVEFLDESAFKKELDN

SEQ ID NO: 2929457 - protein, 21 aa, Entamoeba invadens
DEFRMVLTRRLCDALFDLGVI

SEQ ID NO: 2929458 - protein, 27 aa, Entamoeba invadens
DEFSLVIRYAWISANLGKLAKKLLTKD

SEQ ID NO: 2929459 - protein, 26 aa, Entamoeba invadens
DEFVEKCLPCGTLIVTEDNAISTLTK

SEQ ID NO: 2929460 - protein, 27 aa, Entamoeba invadens
DEGIKLAKEIGAFGFFKTSAEYNLNIQ

SEQ ID NO: 2929461 - protein, 23 aa, Entamoeba invadens
DEGIKVMVDRCLVSSEASYITFK

SEQ ID NO: 2929462 - protein, 24 aa, Entamoeba invadens
DEGIVFRNGERFCFGQHPEDQSDE

SEQ ID NO: 2929463 - protein, 32 aa, Entamoeba invadens
DEGKKDIAELILLIVKFRVPRNNISLYDIHAD

SEQ ID NO: 2929464 - protein, 18 aa, Entamoeba invadens
DEGLEVLLAMSLNDIELP

SEQ ID NO: 2929465 - protein, 17 aa, Entamoeba invadens
DEGRLATRSVLKATWNG

SEQ ID NO: 2929466 - protein, 23 aa, Entamoeba invadens
DEGRLGINVLAMIVSCYELDGSL

SEQ ID NO: 2929467 - protein, 21 aa, Entamoeba invadens
DEHESAFVFMQLVRGIHYLHS

SEQ ID NO: 2929468 - protein, 21 aa, Entamoeba invadens
DEHICGTPIYAAPEVTSKIVS

SEQ ID NO: 2929469 - protein, 20 aa, Entamoeba invadens
DEHKACEPTVEKPMEEIVEN

SEQ ID NO: 2929470 - protein, 31 aa, Entamoeba invadens
DEHLCAFKGKIWAKVFIKSKPQRYGIKFWKE

SEQ ID NO: 2929471 - protein, 30 aa, Entamoeba invadens
DEHLCAFKGKIWAKVFIKSKPQRYGIKFWM

SEQ ID NO: 2929472 - protein, 31 aa, Entamoeba invadens
DEHLCAFKGKIWAKVFIKSKPQRYGIKFWMC

SEQ ID NO: 2929473 - protein, 31 aa, Entamoeba invadens
DEHLCAFKGKIWAKVFIKSKPQRYGIKFWVF

SEQ ID NO: 2929474 - protein, 19 aa, Entamoeba invadens
DEHYKQWILLFKIVASNPQ

SEQ ID NO: 2929475 - protein, 20 aa, Entamoeba invadens
DEIDSLQALGWIRTNCGEPE

SEQ ID NO: 2929476 - protein, 17 aa, Entamoeba invadens
DEIEMINKFVLFNNGVF

SEQ ID NO: 2929477 - protein, 24 aa, Entamoeba invadens
DEIFNKRRVDGYEENALMLRDEIE

SEQ ID NO: 2929478 - protein, 24 aa, Entamoeba invadens
DEIFNKRRVDGYEENALMLRNEIE

SEQ ID NO: 2929479 - protein, 20 aa, Entamoeba invadens
DEIFSLNNLEIFEMERNQIS

SEQ ID NO: 2929480 - protein, 20 aa, Entamoeba invadens
DEIFSPFSSFNFKLKIKSFV

SEQ ID NO: 2929481 - protein, 24 aa, Entamoeba invadens
DEIGEFCFSGFDLLKTVQVGRNVK

SEQ ID NO: 2929482 - protein, 24 aa, Entamoeba invadens
DEIGYRKGFKSFEMEIKRLQVGEM

SEQ ID NO: 2929483 - protein, 24 aa, Entamoeba invadens
DEIHLKFHVNMVIFKKLYPYNYYN

SEQ ID NO: 2929484 - protein, 21 aa, Entamoeba invadens
DEIHTFYTWLSKQPAKYIIQV

SEQ ID NO: 2929485 - protein, 23 aa, Entamoeba invadens
DEIKAIEKHSGYLIHSQRSHFTN

SEQ ID NO: 2929486 - protein, 23 aa, Entamoeba invadens
DEIKCFLRKEVDKKVLIGAADVI

SEQ ID NO: 2929487 - protein, 23 aa, Entamoeba invadens
DEIKEAKVKPVFLYVKEQNQVQP

SEQ ID NO: 2929488 - protein, 34 aa, Entamoeba invadens
DEIKLYNSVMLIKACSVVQYFRFMNTLDNVHQVY

SEQ ID NO: 2929489 - protein, 21 aa, Entamoeba invadens
DEIKLYNSVMMIKACSVVQYV

SEQ ID NO: 2929490 - protein, 18 aa, Entamoeba invadens
DEILNTKYCFSMAVKCSR

SEQ ID NO: 2929491 - protein, 24 aa, Entamoeba invadens
DEILTRVKLYFPSIQTIRLPCFSL

SEQ ID NO: 2929492 - protein, 27 aa, Entamoeba invadens
DEITEHKATIVKRDSKLVAEEDNSKDL

SEQ ID NO: 2929493 - protein, 17 aa, Entamoeba invadens
DEITIYLMLTYKKWQLY

SEQ ID NO: 2929494 - protein, 21 aa, Entamoeba invadens
DEITLKIANYGWFEKESKIRG

SEQ ID NO: 2929495 - protein, 17 aa, Entamoeba invadens
DEIYCLNMLKKIGVCVV

SEQ ID NO: 2929496 - protein, 36 aa, Entamoeba invadens
DEIYEYKNIKGWKLLPLETQLIMTLRIDFDKKEIRK

SEQ ID NO: 2929497 - protein, 19 aa, Entamoeba invadens
DEIYVLKSKAVMFIHTLNH

SEQ ID NO: 2929498 - protein, 17 aa, Entamoeba invadens
DEKCLKGLCTNYTTKKH

SEQ ID NO: 2929499 - protein, 24 aa, Entamoeba invadens
DEKECFDVKFCLSNPTNWKTLMNS

SEQ ID NO: 2929500 - protein, 18 aa, Entamoeba invadens
DEKFTFMFQIVDGVGAWN

SEQ ID NO: 2929501 - protein, 25 aa, Entamoeba invadens
DEKIRKEMFENIVISGGNTSFKNFK

SEQ ID NO: 2929502 - protein, 21 aa, Entamoeba invadens
DEKKKWLPLFSTIEGICVTES

SEQ ID NO: 2929503 - protein, 36 aa, Entamoeba invadens
DEKKLGWFEGFKIKGEVLDKVRACGLLAQKELASTM

SEQ ID NO: 2929504 - protein, 28 aa, Entamoeba invadens
DEKLCEACLLCLGAYVFQKDDLPSSGQI

SEQ ID NO: 2929505 - protein, 18 aa, Entamoeba invadens
DEKLHLTEYLALGTVMVW

SEQ ID NO: 2929506 - protein, 21 aa, Entamoeba invadens
DEKLMKFTLVHLTDGGKKKKE

SEQ ID NO: 2929507 - protein, 18 aa, Entamoeba invadens
DEKLRMWFDKVLVSKQNN

SEQ ID NO: 2929508 - protein, 21 aa, Entamoeba invadens
DEKNQCKITENFYIDINTSEQ

SEQ ID NO: 2929509 - protein, 21 aa, Entamoeba invadens
DEKRLVLEAIVKKMIEFKEPA

SEQ ID NO: 2929510 - protein, 22 aa, Entamoeba invadens
DEKRTDQLFIGRWDGKDESVRL

SEQ ID NO: 2929511 - protein, 19 aa, Entamoeba invadens
DEKSGLCRIKIDYDDGRPT

SEQ ID NO: 2929512 - protein, 17 aa, Entamoeba invadens
DEKTLWILMDLCAVGSV

SEQ ID NO: 2929513 - protein, 22 aa, Entamoeba invadens
DEKVGPVDAIFVCDRSGSMYGK

SEQ ID NO: 2929514 - protein, 20 aa, Entamoeba invadens
DELCAFAFGEILVYKKDFRN

SEQ ID NO: 2929515 - protein, 22 aa, Entamoeba invadens
DELDFTFSCVKNYYNYRTKFQT

SEQ ID NO: 2929516 - protein, 23 aa, Entamoeba invadens
DELENKFKDKDDIIETTKKQKEE

SEQ ID NO: 2929517 - protein, 25 aa, Entamoeba invadens
DELGFSYQFVELFTEYLLMKEEDQK

SEQ ID NO: 2929518 - protein, 32 aa, Entamoeba invadens
DELIKACETRNRLVILLPWLEQRLSEGSPDVP

SEQ ID NO: 2929519 - protein, 18 aa, Entamoeba invadens
DELIPFKIDCVSERRFYK

SEQ ID NO: 2929520 - protein, 18 aa, Entamoeba invadens
DELIPIYKGKTFKLKVTC

SEQ ID NO: 2929521 - protein, 17 aa, Entamoeba invadens
DELKEFLTFAYNSISDS

SEQ ID NO: 2929522 - protein, 20 aa, Entamoeba invadens
DELKGWVGKEEFTIVFDSMK

SEQ ID NO: 2929523 - protein, 22 aa, Entamoeba invadens
DELKHICGFIEKLFVTHPPKEY

SEQ ID NO: 2929524 - protein, 26 aa, Entamoeba invadens
DELKKEHFIVLLTLMYVLVWDKVENQ

SEQ ID NO: 2929525 - protein, 25 aa, Entamoeba invadens
DELKSRIALKLAMLMEENHMCREDV

SEQ ID NO: 2929526 - protein, 28 aa, Entamoeba invadens
DELKSWKFRITKEFVFNLDVELVNVQQE

SEQ ID NO: 2929527 - protein, 30 aa, Entamoeba invadens
DELKTPVLEVGYFYSLTFEEMCSFNPSFKT

SEQ ID NO: 2929528 - protein, 19 aa, Entamoeba invadens
DELLDGIASMHYEKPSKIQ

SEQ ID NO: 2929529 - protein, 20 aa, Entamoeba invadens
DELLKAKWPKDMKINSETTK

SEQ ID NO: 2929530 - protein, 24 aa, Entamoeba invadens
DELNSCLMRIRMMVLKDWHNERKR

SEQ ID NO: 2929531 - protein, 21 aa, Entamoeba invadens
DELPVKIVLIGALGAGKTSLI

SEQ ID NO: 2929532 - protein, 24 aa, Entamoeba invadens
DELPVLRSKLPVVTKLPPPEKQQP

SEQ ID NO: 2929533 - protein, 17 aa, Entamoeba invadens
DELRRFLNSTGFASSRK

SEQ ID NO: 2929534 - protein, 17 aa, Entamoeba invadens
DELRRNYSIKDISTLQW

SEQ ID NO: 2929535 - protein, 19 aa, Entamoeba invadens
DELSFKQGDTILVVEMDQS

SEQ ID NO: 2929536 - protein, 19 aa, Entamoeba invadens
DELSGLFGLLEGGLHPPNS

SEQ ID NO: 2929537 - protein, 25 aa, Entamoeba invadens
DELYNLQMVKAMFVILSYDQQIPPN

SEQ ID NO: 2929538 - protein, 19 aa, Entamoeba invadens
DEMAILIADYFKTSHGESS

SEQ ID NO: 2929539 - protein, 19 aa, Entamoeba invadens
DEMELDKVKECLGTHIMNK

SEQ ID NO: 2929540 - protein, 23 aa, Entamoeba invadens
DEMFKPTVIGNEWSDDEEQKCVI

SEQ ID NO: 2929541 - protein, 28 aa, Entamoeba invadens
DEMGIKYIKPEGAFYIFPKIGEYDEWEF

SEQ ID NO: 2929542 - protein, 26 aa, Entamoeba invadens
DEMKELRFHKIRSRDSVYEIFQRFLI

SEQ ID NO: 2929543 - protein, 17 aa, Entamoeba invadens
DEMKKEIAVIKEMSFIE

SEQ ID NO: 2929544 - protein, 20 aa, Entamoeba invadens
DEMKQAVLLAKKPNVIVCTP

SEQ ID NO: 2929545 - protein, 22 aa, Entamoeba invadens
DEMKREIVRNFKMVSKPEPRYV

SEQ ID NO: 2929546 - protein, 20 aa, Entamoeba invadens
DEMKRYCCDFEKKDLGVCPS

SEQ ID NO: 2929547 - protein, 25 aa, Entamoeba invadens
DEMPISLKLIAFVCDETLKALTFLH

SEQ ID NO: 2929548 - protein, 27 aa, Entamoeba invadens
DEMQEICSMYANLERRQRELAEKFEKV

SEQ ID NO: 2929549 - protein, 27 aa, Entamoeba invadens
DEMSFFLATCPLDLLTFRLEIKALTST

SEQ ID NO: 2929550 - protein, 20 aa, Entamoeba invadens
DEMSSLFKIKEKVKVEKPVD

SEQ ID NO: 2929551 - protein, 18 aa, Entamoeba invadens
DEMVKKLATLKAQNKETE

SEQ ID NO: 2929552 - protein, 24 aa, Entamoeba invadens
DENCALPKLTSLRVLLSNDIIFKG

SEQ ID NO: 2929553 - protein, 20 aa, Entamoeba invadens
DENFLGKFCCNVSERKRASS

SEQ ID NO: 2929554 - protein, 22 aa, Entamoeba invadens
DENFLVKVCDFGFAESVKESKH

SEQ ID NO: 2929555 - protein, 24 aa, Entamoeba invadens
DENGCVMPAITRAYACEKLSPKQK

SEQ ID NO: 2929556 - protein, 25 aa, Entamoeba invadens
DENLRTATFLEEIFYRLRMSHENIL

SEQ ID NO: 2929557 - protein, 18 aa, Entamoeba invadens
DENVDWWGLGILIYEMLF

SEQ ID NO: 2929558 - protein, 27 aa, Entamoeba invadens
DENWKTSKTPLLFQIVWTTIKSNKLLD

SEQ ID NO: 2929559 - protein, 26 aa, Entamoeba invadens
DEPINFGKLRPVGKVHWKINLVKIKK

SEQ ID NO: 2929560 - protein, 19 aa, Entamoeba invadens
DEPNYKATFSIILEVPPTD

SEQ ID NO: 2929561 - protein, 22 aa, Entamoeba invadens
DEPVIPFKFYNQFKKCGEIVNE

SEQ ID NO: 2929562 - protein, 24 aa, Entamoeba invadens
DEQCKLPIKEFHCSCNTQYDNTTF

SEQ ID NO: 2929563 - protein, 19 aa, Entamoeba invadens
DEQKFEFFKEVDLSEPSME

SEQ ID NO: 2929564 - protein, 20 aa, Entamoeba invadens
DEQKLVFLLKILKEEWDRSS

SEQ ID NO: 2929565 - protein, 22 aa, Entamoeba invadens
DEQLRSVFYFANDIIPNSLYFL

SEQ ID NO: 2929566 - protein, 30 aa, Entamoeba invadens
DEQPPFPYPSWRSVVLPQGFVMFYYMNEWC

SEQ ID NO: 2929567 - protein, 17 aa, Entamoeba invadens
DEQPSDFCLKGHNSVTS

SEQ ID NO: 2929568 - protein, 26 aa, Entamoeba invadens
DEQRILFLYILCFCKKLIELGEKLET

SEQ ID NO: 2929569 - protein, 30 aa, Entamoeba invadens
DEQRSKRGILFLSEAMRWIVDETCFKSKGV

SEQ ID NO: 2929570 - protein, 19 aa, Entamoeba invadens
DEQYIWTGIDDFKTTGVNL

SEQ ID NO: 2929571 - protein, 29 aa, Entamoeba invadens
DERARKQYKRFVAIQVLHRMKYINSDTAH

SEQ ID NO: 2929572 - protein, 24 aa, Entamoeba invadens
DERARTVFVKKMFEQESFLTTLTQ

SEQ ID NO: 2929573 - protein, 24 aa, Entamoeba invadens
DERECSRITGIVLDYVLNNNLLFR

SEQ ID NO: 2929574 - protein, 26 aa, Entamoeba invadens
DEREEVKISLKNKIEEREEIEKRLNQ

SEQ ID NO: 2929575 - protein, 20 aa, Entamoeba invadens
DERIRVVGEFGGIGKKVEGH

SEQ ID NO: 2929576 - protein, 21 aa, Entamoeba invadens
DERLQYFACQDCANKVSVLHN

SEQ ID NO: 2929577 - protein, 26 aa, Entamoeba invadens
DERNQLFKWSGRSVGIPFVEIPLETP

SEQ ID NO: 2929578 - protein, 20 aa, Entamoeba invadens
DESCSICYEEGKMLSLGCGH

SEQ ID NO: 2929579 - protein, 21 aa, Entamoeba invadens
DESDVKCEFVAKEVNYSGILK

SEQ ID NO: 2929580 - protein, 20 aa, Entamoeba invadens
DESFIKFLWSGFLNIINVNT

SEQ ID NO: 2929581 - protein, 20 aa, Entamoeba invadens
DESGKYLWMDAIRGDDFGPN

SEQ ID NO: 2929582 - protein, 20 aa, Entamoeba invadens
DESKMPLVVKLGTIDSDGNA

SEQ ID NO: 2929583 - protein, 18 aa, Entamoeba invadens
DESLLSWMFVEMRDTPGV

SEQ ID NO: 2929584 - protein, 20 aa, Entamoeba invadens
DESQFTFKIFNKMLKQTKSS

SEQ ID NO: 2929585 - protein, 28 aa, Entamoeba invadens
DESTCIFKATVLRFVAQLIRCSPEKLNE

SEQ ID NO: 2929586 - protein, 25 aa, Entamoeba invadens
DETFIKFLFDPEFLDARRSVPKWSK

SEQ ID NO: 2929587 - protein, 20 aa, Entamoeba invadens
DETFRGMKAYADIVCVGDEK

SEQ ID NO: 2929588 - protein, 20 aa, Entamoeba invadens
DETKFGVYVQERVEIGVPLL

SEQ ID NO: 2929589 - protein, 25 aa, Entamoeba invadens
DETKKLPSLFIPRGSDIPSAILNTI

SEQ ID NO: 2929590 - protein, 23 aa, Entamoeba invadens
DETKKSFDVMSLFKTQRESNVIY

SEQ ID NO: 2929591 - protein, 30 aa, Entamoeba invadens
DETPIYLGKCFRRSKVDGSEIEFKYATPLD

SEQ ID NO: 2929592 - protein, 25 aa, Entamoeba invadens
DEVANWTSSMILIFADFKNRVAMFQ

SEQ ID NO: 2929593 - protein, 23 aa, Entamoeba invadens
DEVFAVGFVKWSDSIIEELFTMS

SEQ ID NO: 2929594 - protein, 23 aa, Entamoeba invadens
DEVFKENMGFMVERFNEQKNSMN

SEQ ID NO: 2929595 - protein, 21 aa, Entamoeba invadens
DEVINKAIERCPAGDREILKK

SEQ ID NO: 2929596 - protein, 27 aa, Entamoeba invadens
DEVIRLCKKIGFAPGEMDVNQFIEEID

SEQ ID NO: 2929597 - protein, 17 aa, Entamoeba invadens
DEVKMCAFNAVEGGDEI

SEQ ID NO: 2929598 - protein, 36 aa, Entamoeba invadens
DEVLEMAARIAISMMRMRFNLFWKPAQDLLAACIAR

SEQ ID NO: 2929599 - protein, 17 aa, Entamoeba invadens
DEVLKAAVMKYGKNEWA

SEQ ID NO: 2929600 - protein, 21 aa, Entamoeba invadens
DEVLLDFPSLKKWDSYINFIA

SEQ ID NO: 2929601 - protein, 24 aa, Entamoeba invadens
DEVMRISDEWKRNGGVFRFEEDEG

SEQ ID NO: 2929602 - protein, 23 aa, Entamoeba invadens
DEVNCVNSAVSLRICFDELEYVK

SEQ ID NO: 2929603 - protein, 26 aa, Entamoeba invadens
DEVNICITEISFIRSVHHPNVLSVIG

SEQ ID NO: 2929604 - protein, 21 aa, Entamoeba invadens
DEVQNRFSLKMPELPDDIKEI

SEQ ID NO: 2929605 - protein, 25 aa, Entamoeba invadens
DEVRHGLELISFFSVSKGYYGECGK

SEQ ID NO: 2929606 - protein, 29 aa, Entamoeba invadens
DEVVLDLSFTPRLYKRSGVRFKQNEISML

SEQ ID NO: 2929607 - protein, 29 aa, Entamoeba invadens
DEVVSFVKECLDGGILIDQICKMILNKCL

SEQ ID NO: 2929608 - protein, 19 aa, Entamoeba invadens
DEVYCCSTFYAQNRGGEAN

SEQ ID NO: 2929609 - protein, 19 aa, Entamoeba invadens
DEWVKKHFVDLTEEKLKKD

SEQ ID NO: 2929610 - protein, 17 aa, Entamoeba invadens
DEYAKGIVLDFDKIKSF

SEQ ID NO: 2929611 - protein, 24 aa, Entamoeba invadens
  misc_feature (18)..(19): Xaa can be any naturally occurring amino acid
DEYDTSGGVGFVFSWVSXXTTKTK

SEQ ID NO: 2929612 - protein, 25 aa, Entamoeba invadens
DEYDTSGGVGFVFSWVSYLSNIFST

SEQ ID NO: 2929613 - protein, 26 aa, Entamoeba invadens
DEYFIPRLTFIKALSPSTFIVGDDAN

SEQ ID NO: 2929614 - protein, 17 aa, Entamoeba invadens
DEYFKYLLNPLLPVILK

SEQ ID NO: 2929615 - protein, 29 aa, Entamoeba invadens
DEYFQFMWELRLVFSSGLTQLEEVTMGIS

SEQ ID NO: 2929616 - protein, 22 aa, Entamoeba invadens
DEYKSRTILLHFRTKLASKNFM

SEQ ID NO: 2929617 - protein, 21 aa, Entamoeba invadens
DEYYFPATFKDFAFEKTKNES

SEQ ID NO: 2929618 - protein, 18 aa, Entamoeba invadens
DFACCLMTLDGMALAAQI

SEQ ID NO: 2929619 - protein, 17 aa, Entamoeba invadens
DFAHLLKIGSMVINDSS

SEQ ID NO: 2929620 - protein, 17 aa, Entamoeba invadens
DFAKRGVKRVSIMSQGF

SEQ ID NO: 2929621 - protein, 19 aa, Entamoeba invadens
DFANYHFLFSIKESVHSTV

SEQ ID NO: 2929622 - protein, 23 aa, Entamoeba invadens
DFARKEIKRNPILSNLEIYTTDQ

SEQ ID NO: 2929623 - protein, 26 aa, Entamoeba invadens
DFAVQFLCDVMVLRYILLQTHKVAFS

SEQ ID NO: 2929624 - protein, 19 aa, Entamoeba invadens
DFCFAYCRRLGQVVIGEGV

SEQ ID NO: 2929625 - protein, 22 aa, Entamoeba invadens
DFCFCGCYALTSIHLSACLKSV

SEQ ID NO: 2929626 - protein, 18 aa, Entamoeba invadens
DFCGFKVPKKYEGKLERK

SEQ ID NO: 2929627 - protein, 25 aa, Entamoeba invadens
DFCKKINRHKFVLIQCSENWAFVDT

SEQ ID NO: 2929628 - protein, 20 aa, Entamoeba invadens
DFCLVRIGGKLMCVPHNTVI

SEQ ID NO: 2929629 - protein, 22 aa, Entamoeba invadens
DFCSYLHYTYMSFVKDNKDNLI

SEQ ID NO: 2929630 - protein, 26 aa, Entamoeba invadens
DFCVEGFPRKDGRRDVLVTFQNTEDA

SEQ ID NO: 2929631 - protein, 17 aa, Entamoeba invadens
DFDCDWDELIKVSNTIT

SEQ ID NO: 2929632 - protein, 24 aa, Entamoeba invadens
DFDDNFKVSAFVLLREIFGDEGIF

SEQ ID NO: 2929633 - protein, 27 aa, Entamoeba invadens
DFDFTLNIMTWFKFLWISTDKMDISSN

SEQ ID NO: 2929634 - protein, 18 aa, Entamoeba invadens
DFDKGISTEGDFFVTQVE

SEQ ID NO: 2929635 - protein, 18 aa, Entamoeba invadens
DFDKLLFSRRHNLLEAVV

SEQ ID NO: 2929636 - protein, 23 aa, Entamoeba invadens
DFDKYVVNFSCHLRLLNYGFHFD

SEQ ID NO: 2929637 - protein, 24 aa, Entamoeba invadens
DFDPCNPNHPISLPLKNPEDKVVE

SEQ ID NO: 2929638 - protein, 20 aa, Entamoeba invadens
DFDTVVNWFGPFFGEQAIFD

SEQ ID NO: 2929639 - protein, 26 aa, Entamoeba invadens
DFEEERKRLSLQLEDKESANLEMRKA

SEQ ID NO: 2929640 - protein, 18 aa, Entamoeba invadens
DFEICWSSLFDVEKVFQN

SEQ ID NO: 2929641 - protein, 26 aa, Entamoeba invadens
DFEIFKYRKTVIIKMCGLSGYHAMIV

SEQ ID NO: 2929642 - protein, 20 aa, Entamoeba invadens
DFEKCKKLATIHNVAMVHSQ

SEQ ID NO: 2929643 - protein, 25 aa, Entamoeba invadens
DFEKRFTFKGSDKIRCTNFNHEKNT

SEQ ID NO: 2929644 - protein, 29 aa, Entamoeba invadens
DFENAFKRTWGIGSDEFLVQVMLSSVEQF

SEQ ID NO: 2929645 - protein, 22 aa, Entamoeba invadens
DFENKRFREELSKNSYRKKEMT

SEQ ID NO: 2929646 - protein, 24 aa, Entamoeba invadens
DFENYKILIDYLFENESEQQTENM

SEQ ID NO: 2929647 - protein, 36 aa, Entamoeba invadens
DFEPAECLRVWDFFFAYPKRKLYLFFTSAIILEHAK

SEQ ID NO: 2929648 - protein, 19 aa, Entamoeba invadens
DFEREVCMLDKFRSKIIVH

SEQ ID NO: 2929649 - protein, 26 aa, Entamoeba invadens
DFESCVDFMVCELVQFLPHLATLLWV

SEQ ID NO: 2929650 - protein, 22 aa, Entamoeba invadens
DFEVVHFKDLFGSEVTIKCCHF

SEQ ID NO: 2929651 - protein, 19 aa, Entamoeba invadens
DFEYHGCIVTSNQLGYISY

SEQ ID NO: 2929652 - protein, 23 aa, Entamoeba invadens
DFEYPVGWCGSFRSRVFNSNNLT

SEQ ID NO: 2929653 - protein, 25 aa, Entamoeba invadens
DFFATWCGPCQLMGPIFEDLAKKHT

SEQ ID NO: 2929654 - protein, 35 aa, Entamoeba invadens
DFFCYKEVVYLVLISSEFVRYTFKDNKIIVKVLKH

SEQ ID NO: 2929655 - protein, 23 aa, Entamoeba invadens
DFFDKFPAFFIEKEYEDVLAALR

SEQ ID NO: 2929656 - protein, 17 aa, Entamoeba invadens
DFFDLAKIPSFLPQKCL

SEQ ID NO: 2929657 - protein, 21 aa, Entamoeba invadens
DFFKEFNKFEVFGRKRGVLES

SEQ ID NO: 2929658 - protein, 23 aa, Entamoeba invadens
DFFLFGSPYVYQTLEFYRRNKQI

SEQ ID NO: 2929659 - protein, 17 aa, Entamoeba invadens
DFFNFNEIFLKRKSERE

SEQ ID NO: 2929660 - protein, 23 aa, Entamoeba invadens
DFFNSAKVLYVFLFDNNTPITIK

SEQ ID NO: 2929661 - protein, 19 aa, Entamoeba invadens
DFFVVRPVNEYGISMIDLW

SEQ ID NO: 2929662 - protein, 17 aa, Entamoeba invadens
DFFYTKDIQLWVLNHTF

SEQ ID NO: 2929663 - protein, 18 aa, Entamoeba invadens
DFGEWKPDMESFMFQLGD

SEQ ID NO: 2929664 - protein, 17 aa, Entamoeba invadens
DFGHWKTFFDLANKEEN

SEQ ID NO: 2929665 - protein, 18 aa, Entamoeba invadens
DFHDFSLDDAITFLTQSV

SEQ ID NO: 2929666 - protein, 23 aa, Entamoeba invadens
DFHFCIFCGKMFNRRKYMKHSLE

SEQ ID NO: 2929667 - protein, 22 aa, Entamoeba invadens
DFHNGEIFKKCGVIYMEHSLNI

SEQ ID NO: 2929668 - protein, 24 aa, Entamoeba invadens
DFHPKEPWVLAALHTGSIYILNYQ

SEQ ID NO: 2929669 - protein, 27 aa, Entamoeba invadens
DFHPSLKFSSSCFKGCNLLKTLLPQCV

SEQ ID NO: 2929670 - protein, 18 aa, Entamoeba invadens
DFHVHLDIIFGNGGHSSR

SEQ ID NO: 2929671 - protein, 35 aa, Entamoeba invadens
DFIFYKTRFDFFLTWLFCRLYFINFCVTENGLSAF

SEQ ID NO: 2929672 - protein, 25 aa, Entamoeba invadens
DFIKKGEGFILFYAINSKKSYLQVQ

SEQ ID NO: 2929673 - protein, 17 aa, Entamoeba invadens
DFINRLIYMSGYNLTDA

SEQ ID NO: 2929674 - protein, 19 aa, Entamoeba invadens
DFIPNLKLNNFIGKCPDFS

SEQ ID NO: 2929675 - protein, 18 aa, Entamoeba invadens
DFIYRGNVDYQIYKLLKP

SEQ ID NO: 2929676 - protein, 25 aa, Entamoeba invadens
DFKAYLRSFKFSDRQSVIIGTMVTP

SEQ ID NO: 2929677 - protein, 22 aa, Entamoeba invadens
DFKDKPLDLSMREMFDQFVMGG

SEQ ID NO: 2929678 - protein, 21 aa, Entamoeba invadens
DFKEFKRNKFDLMIDEVSVNK

SEQ ID NO: 2929679 - protein, 21 aa, Entamoeba invadens
DFKEICNKKWCVVGYGKIGRQ

SEQ ID NO: 2929680 - protein, 19 aa, Entamoeba invadens
DFKFSVRLNWETEKDDRDP

SEQ ID NO: 2929681 - protein, 26 aa, Entamoeba invadens
DFKISSKRIIKFVLWNIVDYKTFLKE

SEQ ID NO: 2929682 - protein, 26 aa, Entamoeba invadens
DFKKLIRRLTPIKVRSEKSPRNLSAQ

SEQ ID NO: 2929683 - protein, 17 aa, Entamoeba invadens
DFKLMTLCIEKCRNCTF

SEQ ID NO: 2929684 - protein, 18 aa, Entamoeba invadens
DFKPDLCKNLMSQSMCIG

SEQ ID NO: 2929685 - protein, 19 aa, Entamoeba invadens
DFKYVKWFSDPAVDNVPYR

SEQ ID NO: 2929686 - protein, 18 aa, Entamoeba invadens
DFLFPRLVDSTFFVGTSE

SEQ ID NO: 2929687 - protein, 24 aa, Entamoeba invadens
DFLKEYRSLGGIIIVCTHGQATVI

SEQ ID NO: 2929688 - protein, 20 aa, Entamoeba invadens
DFLKSLPHFMPKITTLSSLA

SEQ ID NO: 2929689 - protein, 23 aa, Entamoeba invadens
DFLKSLPKTFSFTADLEYFAFLY

SEQ ID NO: 2929690 - protein, 24 aa, Entamoeba invadens
DFLLNKNCKADHVLPTGDNILHYI

SEQ ID NO: 2929691 - protein, 18 aa, Entamoeba invadens
DFLNFKALILPVLMKNTL

SEQ ID NO: 2929692 - protein, 23 aa, Entamoeba invadens
DFLSDVFPSLSFGGEFPSQTVGV

SEQ ID NO: 2929693 - protein, 20 aa, Entamoeba invadens
DFLTGPLLYQQSWTKLIKDG

SEQ ID NO: 2929694 - protein, 18 aa, Entamoeba invadens
DFLTSVKMYFLSMPEMQK

SEQ ID NO: 2929695 - protein, 25 aa, Entamoeba invadens
DFLVSRLCTEPTPALLNITQNFLLK

SEQ ID NO: 2929696 - protein, 22 aa, Entamoeba invadens
DFMKERYDQFVGIYADCVTLNN

SEQ ID NO: 2929697 - protein, 17 aa, Entamoeba invadens
DFMKPICEKYKKDGISV

SEQ ID NO: 2929698 - protein, 19 aa, Entamoeba invadens
DFMLLHPKGPLGLSTHMIV

SEQ ID NO: 2929699 - protein, 21 aa, Entamoeba invadens
DFNFLAGMLVAHLFNEESCNG

SEQ ID NO: 2929700 - protein, 18 aa, Entamoeba invadens
DFNMFVWDVESRQTVQSM

SEQ ID NO: 2929701 - protein, 17 aa, Entamoeba invadens
DFNSAFGVYSGIQMVNL

SEQ ID NO: 2929702 - protein, 28 aa, Entamoeba invadens
DFNTCWNDGKIVCAIIHSLFPTEFDYKK

SEQ ID NO: 2929703 - protein, 22 aa, Entamoeba invadens
DFNTRKCKKAFVVTKSGSVTGA

SEQ ID NO: 2929704 - protein, 29 aa, Entamoeba invadens
DFPCMSELPLQRLQILSSISVNSCAAMTS

SEQ ID NO: 2929705 - protein, 29 aa, Entamoeba invadens
DFPDLKGAEITKKLSEMWGNLTEDEKEAY

SEQ ID NO: 2929706 - protein, 21 aa, Entamoeba invadens
DFPEFKRLFAELLGIDQRVTA

SEQ ID NO: 2929707 - protein, 20 aa, Entamoeba invadens
DFPVCEAETLVIDMGSLHFL

SEQ ID NO: 2929708 - protein, 24 aa, Entamoeba invadens
DFQCKIGDFGLCIKECDAQSQFNS

SEQ ID NO: 2929709 - protein, 19 aa, Entamoeba invadens
DFQGIFKRKVIKGPGVLTF

SEQ ID NO: 2929710 - protein, 18 aa, Entamoeba invadens
DFQLRVGPETENIFNVKF

SEQ ID NO: 2929711 - protein, 19 aa, Entamoeba invadens
DFQNFKWLESIKVVCYSTL

SEQ ID NO: 2929712 - protein, 24 aa, Entamoeba invadens
DFQNKCFPGLKLDKPLSLQQYYDV

SEQ ID NO: 2929713 - protein, 25 aa, Entamoeba invadens
DFQNLKAGFGNYFFYITRNVENIQK

SEQ ID NO: 2929714 - protein, 19 aa, Entamoeba invadens
DFRCKYCDVTCGGKCDTTN

SEQ ID NO: 2929715 - protein, 26 aa, Entamoeba invadens
DFRDAKLFYERAFKHSIPGILSVIQQ

SEQ ID NO: 2929716 - protein, 24 aa, Entamoeba invadens
DFRIKGIRYEIPYWKDKIYDERSI

SEQ ID NO: 2929717 - protein, 23 aa, Entamoeba invadens
DFRIKSRFQFCKNIKFNTELGSF

SEQ ID NO: 2929718 - protein, 17 aa, Entamoeba invadens
DFRKEHEKCDEVIFKLK

SEQ ID NO: 2929719 - protein, 19 aa, Entamoeba invadens
DFRKGELQVNNFAEMSRDA

SEQ ID NO: 2929720 - protein, 23 aa, Entamoeba invadens
DFSCNRFELNKCMDVDIYLKNTK

SEQ ID NO: 2929721 - protein, 29 aa, Entamoeba invadens
DFSCPFPKTCWMLRNIVHFYNEAFRVLSV

SEQ ID NO: 2929722 - protein, 26 aa, Entamoeba invadens
DFSCPSNKFNGEWALTLYNAVKQDIA

SEQ ID NO: 2929723 - protein, 17 aa, Entamoeba invadens
DFSDLFEKLDLEYLLHE

SEQ ID NO: 2929724 - protein, 19 aa, Entamoeba invadens
DFSKCNKLLFLKTKNYDRR

SEQ ID NO: 2929725 - protein, 27 aa, Entamoeba invadens
DFSKECVINAFKLIALYASGNEKITNS

SEQ ID NO: 2929726 - protein, 19 aa, Entamoeba invadens
DFSKPTFDFGNIFNQPPKE

SEQ ID NO: 2929727 - protein, 19 aa, Entamoeba invadens
DFSKWGRDRFKDLFQDENG

SEQ ID NO: 2929728 - protein, 25 aa, Entamoeba invadens
DFSLFSFKMTSDFGINKNGDGTFRL

SEQ ID NO: 2929729 - protein, 21 aa, Entamoeba invadens
DFSLTYVFRLLTNVINQSQIY

SEQ ID NO: 2929730 - protein, 24 aa, Entamoeba invadens
DFSRKCKVCVIGFYPDDVFGKCVA

SEQ ID NO: 2929731 - protein, 24 aa, Entamoeba invadens
DFSSPCKRRKWAFELKKRAVKLAR

SEQ ID NO: 2929732 - protein, 19 aa, Entamoeba invadens
DFSSQCIFTPGKFVVSFDD

SEQ ID NO: 2929733 - protein, 26 aa, Entamoeba invadens
DFSVLPADLLAGVLKKFVRNLPSMLF

SEQ ID NO: 2929734 - protein, 22 aa, Entamoeba invadens
DFSVPHFKNYLGLPKHLQRALI

SEQ ID NO: 2929735 - protein, 22 aa, Entamoeba invadens
DFSYPYQRALLRYDGKTNVGYI

SEQ ID NO: 2929736 - protein, 19 aa, Entamoeba invadens
DFTEDRLKQSLMFSPGVVS

SEQ ID NO: 2929737 - protein, 23 aa, Entamoeba invadens
DFTEIGGKLWVLSGEKQTINIVD

SEQ ID NO: 2929738 - protein, 22 aa, Entamoeba invadens
DFTGFASAFCPNATDNSANTSF

SEQ ID NO: 2929739 - protein, 21 aa, Entamoeba invadens
DFTQLLRLEFVSVLIENDQIF

SEQ ID NO: 2929740 - protein, 18 aa, Entamoeba invadens
DFTRKCVTCVSGYFVFEN

SEQ ID NO: 2929741 - protein, 19 aa, Entamoeba invadens
DFTTRLPAESTFVIESNDT

SEQ ID NO: 2929742 - protein, 17 aa, Entamoeba invadens
DFTVGRSLARNNGIIAT

SEQ ID NO: 2929743 - protein, 23 aa, Entamoeba invadens
DFTVSFDVFQMFLKNGVQCKNIY

SEQ ID NO: 2929744 - protein, 19 aa, Entamoeba invadens
DFTVSYLVYKFIKDKLQLL

SEQ ID NO: 2929745 - protein, 20 aa, Entamoeba invadens
DFTVTILVKYDEMWESKKVD

SEQ ID NO: 2929746 - protein, 24 aa, Entamoeba invadens
DFTYPWKIADFVTRGLRLPKTSDM

SEQ ID NO: 2929747 - protein, 18 aa, Entamoeba invadens
DFVFKIFLLFLPLDGCIK

SEQ ID NO: 2929748 - protein, 24 aa, Entamoeba invadens
DFVIKAASLVPCLFPMKPALGPNT

SEQ ID NO: 2929749 - protein, 20 aa, Entamoeba invadens
DFVKNNGWICVAKTIEAYVV

SEQ ID NO: 2929750 - protein, 18 aa, Entamoeba invadens
DFVKNVFAEQKFTNPTPI

SEQ ID NO: 2929751 - protein, 20 aa, Entamoeba invadens
DFVKPRGYYYFEVSSKTNEG

SEQ ID NO: 2929752 - protein, 22 aa, Entamoeba invadens
DFVRVKRYVKNEGVTKDVSMET

SEQ ID NO: 2929753 - protein, 17 aa, Entamoeba invadens
DFVSWKYVAAKTKVAEK

SEQ ID NO: 2929754 - protein, 26 aa, Entamoeba invadens
DFVTVIPKECFKGCVHLQDVKIPNTL

SEQ ID NO: 2929755 - protein, 22 aa, Entamoeba invadens
DFVVHCDWIPPPVASEIIKEML

SEQ ID NO: 2929756 - protein, 23 aa, Entamoeba invadens
DFVVHCDWIPPPVASEIIKEMLD

SEQ ID NO: 2929757 - protein, 19 aa, Entamoeba invadens
DFVVSYIIFFSKLININDI

SEQ ID NO: 2929758 - protein, 18 aa, Entamoeba invadens
DFVVYWMGEMKCFKSIGV

SEQ ID NO: 2929759 - protein, 22 aa, Entamoeba invadens
DFWGDGVFFDVINKLSEFENEK

SEQ ID NO: 2929760 - protein, 19 aa, Entamoeba invadens
DFYEHYGSDCFSKCSSLQT

SEQ ID NO: 2929761 - protein, 20 aa, Entamoeba invadens
DFYFHRNELFMVMEYEPSDL

SEQ ID NO: 2929762 - protein, 22 aa, Entamoeba invadens
DGAKCIPCQIGTYSNLPGSASC

SEQ ID NO: 2929763 - protein, 19 aa, Entamoeba invadens
DGAKRLAKKYPLYMQMLTK

SEQ ID NO: 2929764 - protein, 17 aa, Entamoeba invadens
DGALCMCERLVSHPKFM

SEQ ID NO: 2929765 - protein, 24 aa, Entamoeba invadens
DGAPCGLLNHLACSCRINARFHPL

SEQ ID NO: 2929766 - protein, 17 aa, Entamoeba invadens
DGASLPLFIQVLDDFAK

SEQ ID NO: 2929767 - protein, 22 aa, Entamoeba invadens
DGAVGKTCLLISYTTNAFPNEY

SEQ ID NO: 2929768 - protein, 23 aa, Entamoeba invadens
DGCFFCCGNLRSVMIPSSVSVYQ

SEQ ID NO: 2929769 - protein, 24 aa, Entamoeba invadens
DGCFFCCGNLRSVMIPSSVSVYQN

SEQ ID NO: 2929770 - protein, 23 aa, Entamoeba invadens
DGCKELRSVTLLVGITKINFGLF

SEQ ID NO: 2929771 - protein, 19 aa, Entamoeba invadens
DGCKTVLNKIVNSYFENNP

SEQ ID NO: 2929772 - protein, 24 aa, Entamoeba invadens
DGCPCGKDFIEVLRECMKKDIVIY

SEQ ID NO: 2929773 - protein, 21 aa, Entamoeba invadens
DGCYIKCLLENADLKLSDPKD

SEQ ID NO: 2929774 - protein, 26 aa, Entamoeba invadens
DGDARAALNNVERIFLHFGKMSKPNI

SEQ ID NO: 2929775 - protein, 26 aa, Entamoeba invadens
DGDELFKMIMRCVLDFEKHCNKNEPC

SEQ ID NO: 2929776 - protein, 18 aa, Entamoeba invadens
DGDERLNVRWAFDDPNPI

SEQ ID NO: 2929777 - protein, 25 aa, Entamoeba invadens
DGDFCGCGGIDMCGEKDEGIVFRNG

SEQ ID NO: 2929778 - protein, 25 aa, Entamoeba invadens
DGDGYEMCAVWKLIEMGYREDIAEE

SEQ ID NO: 2929779 - protein, 17 aa, Entamoeba invadens
DGDWWKGKTKSGVTGIF

SEQ ID NO: 2929780 - protein, 18 aa, Entamoeba invadens
DGEAYWNSQLEDIKPSPS

SEQ ID NO: 2929781 - protein, 18 aa, Entamoeba invadens
DGEDALILTHDFTMDTLI

SEQ ID NO: 2929782 - protein, 24 aa, Entamoeba invadens
DGEKRKELGPGYQLYGDKSELLAH

SEQ ID NO: 2929783 - protein, 23 aa, Entamoeba invadens
DGELCFADFYKLLTILNHMPDKS

SEQ ID NO: 2929784 - protein, 29 aa, Entamoeba invadens
DGELNFINGSLSFKGKFDGSVESIQQDEQ

SEQ ID NO: 2929785 - protein, 18 aa, Entamoeba invadens
DGELSVKGSIEFIAEALH

SEQ ID NO: 2929786 - protein, 23 aa, Entamoeba invadens
DGELWKRLADMFKEDGDEEQYYY

SEQ ID NO: 2929787 - protein, 20 aa, Entamoeba invadens
DGELYFDKCLDFLAELYQHF

SEQ ID NO: 2929788 - protein, 21 aa, Entamoeba invadens
DGFALRNGMCLKIENREYCLD

SEQ ID NO: 2929789 - protein, 19 aa, Entamoeba invadens
DGFFKILMDSLRVSNDNAK

SEQ ID NO: 2929790 - protein, 19 aa, Entamoeba invadens
DGFINVFSGVFLDNLVKKG

SEQ ID NO: 2929791 - protein, 21 aa, Entamoeba invadens
DGFKSYARRTTIGRFDPQFNA

SEQ ID NO: 2929792 - protein, 26 aa, Entamoeba invadens
DGFMCLKAVCHFASMAPMLDVLGDEK

SEQ ID NO: 2929793 - protein, 18 aa, Entamoeba invadens
DGFNIDFLLKLRDVKDNT

SEQ ID NO: 2929794 - protein, 24 aa, Entamoeba invadens
DGFRACNSLEYLCLADNKEITGSV

SEQ ID NO: 2929795 - protein, 22 aa, Entamoeba invadens
DGFRVFKKVTLKNMFNIYNINR

SEQ ID NO: 2929796 - protein, 20 aa, Entamoeba invadens
DGFSTQFPFRADRLILHSYG

SEQ ID NO: 2929797 - protein, 19 aa, Entamoeba invadens
DGFSVVIHTCDEWLVGYDK

SEQ ID NO: 2929798 - protein, 25 aa, Entamoeba invadens
DGFTLLKTRMELYKTIFPIIKLENT

SEQ ID NO: 2929799 - protein, 29 aa, Entamoeba invadens
DGFVNSRFVPYIKEIVMRMSNNDVPDYCV

SEQ ID NO: 2929800 - protein, 24 aa, Entamoeba invadens
DGGASRPMIRWAKTFLNQIEEITT

SEQ ID NO: 2929801 - protein, 23 aa, Entamoeba invadens
DGGWKRSGSITVESGNVGMTVFT

SEQ ID NO: 2929802 - protein, 28 aa, Entamoeba invadens
DGHPFWYKFDDNWLFENSDIFVVKIPFK

SEQ ID NO: 2929803 - protein, 22 aa, Entamoeba invadens
DGHPLPFMICSIKYDNPDEKLP

SEQ ID NO: 2929804 - protein, 24 aa, Entamoeba invadens
DGHPLVLLCQINFSEMPKLVNFPT

SEQ ID NO: 2929805 - protein, 17 aa, Entamoeba invadens
DGHRLKNTLGMDIYSFT

SEQ ID NO: 2929806 - protein, 24 aa, Entamoeba invadens
DGIDARMYLLFKEEFSTYSYYYNT

SEQ ID NO: 2929807 - protein, 18 aa, Entamoeba invadens
DGIGLYLPTAKKWLDDES

SEQ ID NO: 2929808 - protein, 17 aa, Entamoeba invadens
DGIGRTKVESVMWRGNV

SEQ ID NO: 2929809 - protein, 27 aa, Entamoeba invadens
DGILRLCGSQEKMKWMKERLQFGDTSF

SEQ ID NO: 2929810 - protein, 23 aa, Entamoeba invadens
DGINMLKTIYVPKQFEGQRVNLP

SEQ ID NO: 2929811 - protein, 21 aa, Entamoeba invadens
DGITSLGLREVYISSTLRHKN

SEQ ID NO: 2929812 - protein, 23 aa, Entamoeba invadens
DGIVKYRNYWTINLASNQHSLIA

SEQ ID NO: 2929813 - protein, 22 aa, Entamoeba invadens
DGIWAALCWVSVLAGESEKAGK

SEQ ID NO: 2929814 - protein, 22 aa, Entamoeba invadens
DGKCVKCGELFPNCMECTTETC

SEQ ID NO: 2929815 - protein, 17 aa, Entamoeba invadens
DGKEIKTEVKIEKAEEK

SEQ ID NO: 2929816 - protein, 21 aa, Entamoeba invadens
DGKEKAFGCVEGENEIISKIL

SEQ ID NO: 2929817 - protein, 22 aa, Entamoeba invadens
DGKEVKKAFPYISSSIGNVSYP

SEQ ID NO: 2929818 - protein, 19 aa, Entamoeba invadens
DGKGIFCAKDKLLNKREFK

SEQ ID NO: 2929819 - protein, 20 aa, Entamoeba invadens
DGKIRFYLLDLMQFADDVQC

SEQ ID NO: 2929820 - protein, 22 aa, Entamoeba invadens
DGKIVDKITCTRCWYTNTETIN

SEQ ID NO: 2929821 - protein, 26 aa, Entamoeba invadens
DGKIYFLKENKICWESGEDQRLLSPN

SEQ ID NO: 2929822 - protein, 23 aa, Entamoeba invadens
DGKKLLRCGCGRYFCNGVGEGHI

SEQ ID NO: 2929823 - protein, 20 aa, Entamoeba invadens
DGKPDMKALINGMIDKNVEY

SEQ ID NO: 2929824 - protein, 22 aa, Entamoeba invadens
DGKPINMFWALKDFKQRTDTQT

SEQ ID NO: 2929825 - protein, 20 aa, Entamoeba invadens
DGKPVNMFWSLKDFKQRTET

SEQ ID NO: 2929826 - protein, 18 aa, Entamoeba invadens
DGKRVYVFVTKYATSRIK

SEQ ID NO: 2929827 - protein, 37 aa, Entamoeba invadens
DGKSFIYTVYWNFGGYCPAFSHGGTWGSGVPLKLVRA

SEQ ID NO: 2929828 - protein, 19 aa, Entamoeba invadens
DGKSMAIVFDFEKKFIITP

SEQ ID NO: 2929829 - protein, 22 aa, Entamoeba invadens
DGKTVNMFWSLKDFKQRTETQT

SEQ ID NO: 2929830 - protein, 22 aa, Entamoeba invadens
DGKVCVFDMKTPPLVEDVAQQP

SEQ ID NO: 2929831 - protein, 27 aa, Entamoeba invadens
DGKVILRFKGINIPGGKGLGKGYKMSK

SEQ ID NO: 2929832 - protein, 20 aa, Entamoeba invadens
DGKVKLPFKLLNEIQTQVFQ

SEQ ID NO: 2929833 - protein, 27 aa, Entamoeba invadens
DGLETIPHCAFFRCYKLSKIRIPTSVT

SEQ ID NO: 2929834 - protein, 19 aa, Entamoeba invadens
DGLGLPLLEAEQVYIDYMN

SEQ ID NO: 2929835 - protein, 17 aa, Entamoeba invadens
DGLHAWFDMYDAFEKSN

SEQ ID NO: 2929836 - protein, 22 aa, Entamoeba invadens
DGLIRPFHCFSLAESETKGLVL

SEQ ID NO: 2929837 - protein, 17 aa, Entamoeba invadens
DGLKDFVKNLVMKFKAQ

SEQ ID NO: 2929838 - protein, 18 aa, Entamoeba invadens
DGLKDGKIVISRMAEECM

SEQ ID NO: 2929839 - protein, 22 aa, Entamoeba invadens
DGLKVIPSCCFELCKNLVSVNV

SEQ ID NO: 2929840 - protein, 18 aa, Entamoeba invadens
DGLLLTWLSKAVHQTFFS

SEQ ID NO: 2929841 - protein, 19 aa, Entamoeba invadens
DGLMIPKTLKILSSLETTV

SEQ ID NO: 2929842 - protein, 20 aa, Entamoeba invadens
DGLRCLKCTENFCPTDSINK

SEQ ID NO: 2929843 - protein, 23 aa, Entamoeba invadens
DGLSEIRAAHKLFLTGTPLQNTL

SEQ ID NO: 2929844 - protein, 20 aa, Entamoeba invadens
DGLTEIRRAMFLKEEQKIFD

SEQ ID NO: 2929845 - protein, 26 aa, Entamoeba invadens
DGLVLVRGKLVWSITVCVNIINDSGN

SEQ ID NO: 2929846 - protein, 20 aa, Entamoeba invadens
DGLVWSCFSNANFGLTQEEA

SEQ ID NO: 2929847 - protein, 18 aa, Entamoeba invadens
DGMGEIDVNWGFKKFEFN

SEQ ID NO: 2929848 - protein, 18 aa, Entamoeba invadens
DGMGEIDVNWGLEKFEFD

SEQ ID NO: 2929849 - protein, 18 aa, Entamoeba invadens
DGMGEIDVNWGLKKFEFD

SEQ ID NO: 2929850 - protein, 28 aa, Entamoeba invadens
DGMKRKEEWHPYLLFCKQHREELKQEGV

SEQ ID NO: 2929851 - protein, 18 aa, Entamoeba invadens
DGMRWVKPYYHWFCTEAR

SEQ ID NO: 2929852 - protein, 23 aa, Entamoeba invadens
DGNALRILAKIISTFQVESVNLS

SEQ ID NO: 2929853 - protein, 31 aa, Entamoeba invadens
DGNAPKFAVCIQMEFCSGGDLSQMIKNRELH

SEQ ID NO: 2929854 - protein, 20 aa, Entamoeba invadens
DGNFRFSMKSKEDMDELLCD

SEQ ID NO: 2929855 - protein, 23 aa, Entamoeba invadens
DGNGKKYGPAFGVTKNKTNVVGC

SEQ ID NO: 2929856 - protein, 29 aa, Entamoeba invadens
DGNIVLKIFGDFMFQTMIINREKYDDTVN

SEQ ID NO: 2929857 - protein, 31 aa, Entamoeba invadens
DGNLKELVTRFFIVLSLYRLFIAQKQNPQEI

SEQ ID NO: 2929858 - protein, 17 aa, Entamoeba invadens
DGNLKRDDFKRVLNTYA

SEQ ID NO: 2929859 - protein, 22 aa, Entamoeba invadens
DGNPICSICYTDLYSPKCAVCG

SEQ ID NO: 2929860 - protein, 28 aa, Entamoeba invadens
DGNSEYNGWCWCGNAAYVDFINPKARDW

SEQ ID NO: 2929861 - protein, 18 aa, Entamoeba invadens
DGNVCFSENGPLIDPVRC

SEQ ID NO: 2929862 - protein, 25 aa, Entamoeba invadens
DGNVFKVLIVSSLRLKKDVTKYHDE

SEQ ID NO: 2929863 - protein, 19 aa, Entamoeba invadens
DGPFLFSFAQMIKMRLVIN

SEQ ID NO: 2929864 - protein, 17 aa, Entamoeba invadens
DGPLMNMGCDFTCMPSM

SEQ ID NO: 2929865 - protein, 19 aa, Entamoeba invadens
DGQCERLRPMVVAMCDSPI

SEQ ID NO: 2929866 - protein, 22 aa, Entamoeba invadens
DGQDFISLCLKKNPDERIKDAD

SEQ ID NO: 2929867 - protein, 20 aa, Entamoeba invadens
DGQNGFWFAVDKAFGLVQDK

SEQ ID NO: 2929868 - protein, 27 aa, Entamoeba invadens
DGQYGRGICAIFDNYFMKFKCYSPFID

SEQ ID NO: 2929869 - protein, 23 aa, Entamoeba invadens
DGRCAACQVTYCLMCNGDKYKCI

SEQ ID NO: 2929870 - protein, 17 aa, Entamoeba invadens
DGRFFHIDFGHFLGNFK

SEQ ID NO: 2929871 - protein, 17 aa, Entamoeba invadens
DGRFVFEAISQVKCEGV

SEQ ID NO: 2929872 - protein, 17 aa, Entamoeba invadens
DGRIVVTSAKFCFIDSN

SEQ ID NO: 2929873 - protein, 21 aa, Entamoeba invadens
DGRLKEGMEILEATSGNTGIG

SEQ ID NO: 2929874 - protein, 19 aa, Entamoeba invadens
DGRVGGVIDKLRERLTFLM

SEQ ID NO: 2929875 - protein, 25 aa, Entamoeba invadens
DGRVRKCFELLRDMVFEALDVKNIM

SEQ ID NO: 2929876 - protein, 26 aa, Entamoeba invadens
DGSCHLCKNDSYLLGGNCEIINSKCT

SEQ ID NO: 2929877 - protein, 30 aa, Entamoeba invadens
DGSGFSDLTIKGEILVALTKLSARVPQNYY

SEQ ID NO: 2929878 - protein, 30 aa, Entamoeba invadens
DGSKFLFQMHFLKEEFAWKISALKINPSDL

SEQ ID NO: 2929879 - protein, 22 aa, Entamoeba invadens
DGSLNFLSILALKYGLEEQDKF

SEQ ID NO: 2929880 - protein, 17 aa, Entamoeba invadens
DGSLRSCTIEFHWRSYL

SEQ ID NO: 2929881 - protein, 25 aa, Entamoeba invadens
DGSSITPAWLRFISDTPKSKMSFVV

SEQ ID NO: 2929882 - protein, 19 aa, Entamoeba invadens
DGSVFVWNLLDGKFAKRIY

SEQ ID NO: 2929883 - protein, 22 aa, Entamoeba invadens
DGTCIRDYLHVVDVAKGHVAAL

SEQ ID NO: 2929884 - protein, 25 aa, Entamoeba invadens
DGTDTRSSWFYHYFTPELKLMDKET

SEQ ID NO: 2929885 - protein, 24 aa, Entamoeba invadens
DGTFQGVLQLDGWFCNNSEIRFSF

SEQ ID NO: 2929886 - protein, 20 aa, Entamoeba invadens
DGTGCLYDPLGVDLEVMNTL

SEQ ID NO: 2929887 - protein, 18 aa, Entamoeba invadens
DGTGFILVYSIIDEKSFE

SEQ ID NO: 2929888 - protein, 38 aa, Entamoeba invadens
DGTIPLPNAIEPIPIESNSSMITLKFIEPVQSGTTGDV

SEQ ID NO: 2929889 - protein, 18 aa, Entamoeba invadens
DGTIVFSENLWMATFDQF

SEQ ID NO: 2929890 - protein, 20 aa, Entamoeba invadens
DGTTCLCVLATELNVYTANA

SEQ ID NO: 2929891 - protein, 23 aa, Entamoeba invadens
DGTTCLTAFLTDERYIISNVGDC

SEQ ID NO: 2929892 - protein, 18 aa, Entamoeba invadens
DGTVYGFEFSRSIGDIPE

SEQ ID NO: 2929893 - protein, 17 aa, Entamoeba invadens
DGVCYGFRIKGSEAEDL

SEQ ID NO: 2929894 - protein, 23 aa, Entamoeba invadens
DGVILKRYYYVFTDKFDTEKIFK

SEQ ID NO: 2929895 - protein, 17 aa, Entamoeba invadens
DGVISIFEALGDIIKTV

SEQ ID NO: 2929896 - protein, 22 aa, Entamoeba invadens
DGVKRRKTRSSTRKMEEIKNEE

SEQ ID NO: 2929897 - protein, 23 aa, Entamoeba invadens
DGVRAAVCIAAMALEYAEKGKTI

SEQ ID NO: 2929898 - protein, 27 aa, Entamoeba invadens
DGVTCLSRAGAEISYIVSGGYDGEVRV

SEQ ID NO: 2929899 - protein, 24 aa, Entamoeba invadens
DGVTRLWMKKSYIQKVGLVIIDEI

SEQ ID NO: 2929900 - protein, 25 aa, Entamoeba invadens
DGVVSIECGCFNCLYDLKEMNIPDS

SEQ ID NO: 2929901 - protein, 19 aa, Entamoeba invadens
DGVVTCNLSGGGVTDPIVL

SEQ ID NO: 2929902 - protein, 18 aa, Entamoeba invadens
DGVYSIFGGFGKKYEEKT

SEQ ID NO: 2929903 - protein, 19 aa, Entamoeba invadens
DGWAAPRLKDAPLNDDEKN

SEQ ID NO: 2929904 - protein, 19 aa, Entamoeba invadens
DGWEYSNLVSILNKKTNTM

SEQ ID NO: 2929905 - protein, 34 aa, Entamoeba invadens
DGWVFCKIGTRFGFVPKKYIERIDFTKNIGKNRM

SEQ ID NO: 2929906 - protein, 19 aa, Entamoeba invadens
DGYDLNTYVSPECQQEEVA

SEQ ID NO: 2929907 - protein, 19 aa, Entamoeba invadens
DGYKEAMKLHRDCSKHPEK

SEQ ID NO: 2929908 - protein, 20 aa, Entamoeba invadens
DGYKQFLKDVAVEISNRAEI

SEQ ID NO: 2929909 - protein, 24 aa, Entamoeba invadens
DGYNISVCLGLSVLVSKTDLQAAL

SEQ ID NO: 2929910 - protein, 18 aa, Entamoeba invadens
DGYNLSCLMVLPHHQRKG

SEQ ID NO: 2929911 - protein, 25 aa, Entamoeba invadens
DGYQSYCVMCEESLNYFSRSMLAIV

SEQ ID NO: 2929912 - protein, 17 aa, Entamoeba invadens
DHCDIEVLKEMEIVTRS

SEQ ID NO: 2929913 - protein, 23 aa, Entamoeba invadens
DHDCTKCTIGLHYDNDNNHCEVM

SEQ ID NO: 2929914 - protein, 21 aa, Entamoeba invadens
DHETNERICAILNVNKTKAKD

SEQ ID NO: 2929915 - protein, 17 aa, Entamoeba invadens
DHFPLKLNEIMNLQNCD

SEQ ID NO: 2929916 - protein, 21 aa, Entamoeba invadens
DHFYCYNPFNISQKIIPFLQT

SEQ ID NO: 2929917 - protein, 18 aa, Entamoeba invadens
DHGIGIQTKQQFLVESEI

SEQ ID NO: 2929918 - protein, 26 aa, Entamoeba invadens
DHINNRFNFEIPKQVVAEVNTEKGEE

SEQ ID NO: 2929919 - protein, 17 aa, Entamoeba invadens
DHKPVTCLLDIDVQEVD

SEQ ID NO: 2929920 - protein, 23 aa, Entamoeba invadens
DHLESLLLLIGLVYKILPYFVKS

SEQ ID NO: 2929921 - protein, 17 aa, Entamoeba invadens
DHLFCFGDICDKHNNPF

SEQ ID NO: 2929922 - protein, 24 aa, Entamoeba invadens
DHLKRCFEAGFGFALTKTYPLEKD

SEQ ID NO: 2929923 - protein, 19 aa, Entamoeba invadens
DHLLSIQVVREYAKLKHQN

SEQ ID NO: 2929924 - protein, 17 aa, Entamoeba invadens
DHLLSVFHLKYLMLEKT

SEQ ID NO: 2929925 - protein, 22 aa, Entamoeba invadens
DHLPVLCTTTLKPRRVNKEKIK

SEQ ID NO: 2929926 - protein, 22 aa, Entamoeba invadens
DHLRSLPLKELENIVEYIPMRL

SEQ ID NO: 2929927 - protein, 26 aa, Entamoeba invadens
DHLVLPSIFFKFVILLINRREIQPHH

SEQ ID NO: 2929928 - protein, 25 aa, Entamoeba invadens
DHMDEAIAFCQFHIEGVDFKTLGYI

SEQ ID NO: 2929929 - protein, 24 aa, Entamoeba invadens
DHMKEYVCLNAKLFDGLRLDNCHS

SEQ ID NO: 2929930 - protein, 26 aa, Entamoeba invadens
DHMTFCTSSLQALMRVVRQKTERKDG

SEQ ID NO: 2929931 - protein, 23 aa, Entamoeba invadens
DHNKFIVSYNCHLRLKAFGLDFN

SEQ ID NO: 2929932 - protein, 21 aa, Entamoeba invadens
DHPKGCYDIGLPSHKSLFQIQ

SEQ ID NO: 2929933 - protein, 27 aa, Entamoeba invadens
DHPRLFYITNCIFVMKRGEEGSNCISG

SEQ ID NO: 2929934 - protein, 23 aa, Entamoeba invadens
DHPSALVRYSLLFTAKAKMQYQL

SEQ ID NO: 2929935 - protein, 24 aa, Entamoeba invadens
DHRIPLHVFSSFHVICYDLMEVII

SEQ ID NO: 2929936 - protein, 24 aa, Entamoeba invadens
DHRKEFCNCLADTGMIISLVSYEM

SEQ ID NO: 2929937 - protein, 18 aa, Entamoeba invadens
DHRTRVVLATMIRNGLIK

SEQ ID NO: 2929938 - protein, 18 aa, Entamoeba invadens
DHSGCVLIKLITNTPTKE

SEQ ID NO: 2929939 - protein, 22 aa, Entamoeba invadens
DHTKHFISFDFLDREDRIELLK

SEQ ID NO: 2929940 - protein, 21 aa, Entamoeba invadens
DHVAYKKLKKFLKQEKREHEE

SEQ ID NO: 2929941 - protein, 24 aa, Entamoeba invadens
DHVDPKTGVNISFFGDVKGYVPIV

SEQ ID NO: 2929942 - protein, 17 aa, Entamoeba invadens
DHVGFDIEIKYINCDLE

SEQ ID NO: 2929943 - protein, 19 aa, Entamoeba invadens
DHVKIFIPQNCNTFSDQNN

SEQ ID NO: 2929944 - protein, 19 aa, Entamoeba invadens
DHVNNFFSLFVLFTLFNYI

SEQ ID NO: 2929945 - protein, 18 aa, Entamoeba invadens
DHVPIILVGNKCDLGNER

SEQ ID NO: 2929946 - protein, 18 aa, Entamoeba invadens
DHYIKQWIVSAPYMKAAE

SEQ ID NO: 2929947 - protein, 23 aa, Entamoeba invadens
DHYSLNVLKLFPNIKTLYLPSYR

SEQ ID NO: 2929948 - protein, 24 aa, Entamoeba invadens
DIAFCPFEDFLAVGRYKGVSTLPI

SEQ ID NO: 2929949 - protein, 28 aa, Entamoeba invadens
DIAKALARPASYICRYFGQTLAAASNTD

SEQ ID NO: 2929950 - protein, 17 aa, Entamoeba invadens
DIALNNKITCFTINENR

SEQ ID NO: 2929951 - protein, 23 aa, Entamoeba invadens
DIALPSKIVLIGSLTKNKRDIWL

SEQ ID NO: 2929952 - protein, 17 aa, Entamoeba invadens
DIARKLFVYAFECNTGY

SEQ ID NO: 2929953 - protein, 25 aa, Entamoeba invadens
DIATPRYLLGVGEKFQKSVYEKANE

SEQ ID NO: 2929954 - protein, 24 aa, Entamoeba invadens
DICGDYRPFIVIPKNFKYETFVLK

SEQ ID NO: 2929955 - protein, 19 aa, Entamoeba invadens
DICGFKVGLNPKIPEIDFS

SEQ ID NO: 2929956 - protein, 17 aa, Entamoeba invadens
DICHCKVIHSIRSKTKA

SEQ ID NO: 2929957 - protein, 23 aa, Entamoeba invadens
DICMRACAVPGYFTEYQGYLSGM

SEQ ID NO: 2929958 - protein, 25 aa, Entamoeba invadens
DICNKRIDVVWSWVNGTDPNWLESL

SEQ ID NO: 2929959 - protein, 25 aa, Entamoeba invadens
DICNNRIDVVWSWVNGTDLKWIQKL

SEQ ID NO: 2929960 - protein, 17 aa, Entamoeba invadens
DICRVLREKQTSLPAPD

SEQ ID NO: 2929961 - protein, 17 aa, Entamoeba invadens
DICSCERISKVGTSKVT

SEQ ID NO: 2929962 - protein, 24 aa, Entamoeba invadens
DICVSEVMPEFAFGATGDATRNIP

SEQ ID NO: 2929963 - protein, 18 aa, Entamoeba invadens
DIDERFTLLKQAMKTHVD

SEQ ID NO: 2929964 - protein, 25 aa, Entamoeba invadens
DIDIKILACDGYVVGSCEKNYNTTI

SEQ ID NO: 2929965 - protein, 19 aa, Entamoeba invadens
DIDKFRCIIIVSEMDGNHM

SEQ ID NO: 2929966 - protein, 19 aa, Entamoeba invadens
DIDKRHRLFYISGAIGIMK

SEQ ID NO: 2929967 - protein, 33 aa, Entamoeba invadens
DIDKYGRCVICTSDFRIKLMRPRDLGYDEIDVN

SEQ ID NO: 2929968 - protein, 24 aa, Entamoeba invadens
DIDLEKWLFEILTNYLKDTDEPTT

SEQ ID NO: 2929969 - protein, 26 aa, Entamoeba invadens
DIDLKLTEIVKMRWKKEDENRFNAVF

SEQ ID NO: 2929970 - protein, 26 aa, Entamoeba invadens
DIDLKLTEIVKMRWKKEDENRFNTVF

SEQ ID NO: 2929971 - protein, 18 aa, Entamoeba invadens
DIDVSYNFITKAPNYETW

SEQ ID NO: 2929972 - protein, 24 aa, Entamoeba invadens
DIECLKGKEIALVIRGIRTHFPKF

SEQ ID NO: 2929973 - protein, 26 aa, Entamoeba invadens
DIEDCFKRRLSDVFTPPIYHDIFYNK

SEQ ID NO: 2929974 - protein, 23 aa, Entamoeba invadens
DIEEVINFKVPFSAIQNQEEMVV

SEQ ID NO: 2929975 - protein, 26 aa, Entamoeba invadens
DIEFVRKAVQAFGRCALKLDKVADRC

SEQ ID NO: 2929976 - protein, 26 aa, Entamoeba invadens
DIEIPACVVCRFLAMNGIIMEKMGYY

SEQ ID NO: 2929977 - protein, 26 aa, Entamoeba invadens
DIEKILKKKIDSFFTEKERIKINDME

SEQ ID NO: 2929978 - protein, 26 aa, Entamoeba invadens
DIELLLRLRISYCEGITYNETHKQLL

SEQ ID NO: 2929979 - protein, 22 aa, Entamoeba invadens
DIELTPPLVMLLNGFSHPCFGN

SEQ ID NO: 2929980 - protein, 17 aa, Entamoeba invadens
DIEMFAGGIQGDSSICG

SEQ ID NO: 2929981 - protein, 24 aa, Entamoeba invadens
DIEMKEAWVPDNLAKNCMLCNLPF

SEQ ID NO: 2929982 - protein, 21 aa, Entamoeba invadens
DIENAWELYFRIYKRIHKSIN

SEQ ID NO: 2929983 - protein, 19 aa, Entamoeba invadens
DIESFPFVIVGNKSDCTDE

SEQ ID NO: 2929984 - protein, 22 aa, Entamoeba invadens
DIETFCAFFFPDTVNCNSLAVS

SEQ ID NO: 2929985 - protein, 24 aa, Entamoeba invadens
DIETIPNFSPFSFFEGSLPLTQQT

SEQ ID NO: 2929986 - protein, 23 aa, Entamoeba invadens
DIEYIEYLGCFTFVNNDLRISNK

SEQ ID NO: 2929987 - protein, 25 aa, Entamoeba invadens
DIFGKEINDFFLGRVLQTGSETFSR

SEQ ID NO: 2929988 - protein, 21 aa, Entamoeba invadens
DIFGSFLIKETESFASKNEVI

SEQ ID NO: 2929989 - protein, 19 aa, Entamoeba invadens
DIFIGVPMPKIREIVKTSM

SEQ ID NO: 2929990 - protein, 24 aa, Entamoeba invadens
DIFKELGTFLSLYRVGKLPKIFKL

SEQ ID NO: 2929991 - protein, 25 aa, Entamoeba invadens
DIFKKKFKRGFSFDSKQIDVEGTSE

SEQ ID NO: 2929992 - protein, 23 aa, Entamoeba invadens
DIFLICFSVVSPPSFDNVSTKWQ

SEQ ID NO: 2929993 - protein, 25 aa, Entamoeba invadens
DIFNLGCLFYFIALKRYTFEVLIDR

SEQ ID NO: 2929994 - protein, 32 aa, Entamoeba invadens
DIFPQIQLKFIDSRIKEVCSPSSLYIDTFGKK

SEQ ID NO: 2929995 - protein, 42 aa, Entamoeba invadens
DIFSFAITMYECFKWKDPYPKSDFKYAWSIADFVATGKHLPQ

SEQ ID NO: 2929996 - protein, 18 aa, Entamoeba invadens
DIFSFAITMYETFAWRAA

SEQ ID NO: 2929997 - protein, 24 aa, Entamoeba invadens
DIFSFGILLYEVFTLSVPYTSDDG

SEQ ID NO: 2929998 - protein, 18 aa, Entamoeba invadens
DIFTAQCAKQIKTMSFPK

SEQ ID NO: 2929999 - protein, 19 aa, Entamoeba invadens
DIFVEAGKALGCTDMAEAV

SEQ ID NO: 2930000 - protein, 24 aa, Entamoeba invadens
DIFYEVLKKPITIEEAFKEAFEVI

SEQ ID NO: 2930001 - protein, 17 aa, Entamoeba invadens
DIGDDWASSSFLGTNVS

SEQ ID NO: 2930002 - protein, 20 aa, Entamoeba invadens
DIGELLGVFYRINYDKYLYP

SEQ ID NO: 2930003 - protein, 26 aa, Entamoeba invadens
DIGGCFVKRIDGCYANIVGFPTPAFC

SEQ ID NO: 2930004 - protein, 20 aa, Entamoeba invadens
DIGKLLPILRKVLSSDANNF

SEQ ID NO: 2930005 - protein, 19 aa, Entamoeba invadens
DIHHPAILGMVGIILSSST

SEQ ID NO: 2930006 - protein, 19 aa, Entamoeba invadens
DIHMVPFLWMQVTFSCDGC

SEQ ID NO: 2930007 - protein, 22 aa, Entamoeba invadens
DIIEALKRLGFDAYCPSLRKHL

SEQ ID NO: 2930008 - protein, 19 aa, Entamoeba invadens
DIIEFLGVNGYEGIRPLIC

SEQ ID NO: 2930009 - protein, 24 aa, Entamoeba invadens
DIIEKVPVIFAFAVTTTDQSIFNE

SEQ ID NO: 2930010 - protein, 22 aa, Entamoeba invadens
DIIKDLYENIVFSNGTSMYSGI

SEQ ID NO: 2930011 - protein, 25 aa, Entamoeba invadens
DIIKKGCKINEFITQLFTYESELLL

SEQ ID NO: 2930012 - protein, 26 aa, Entamoeba invadens
DIILDPRYNIKTGLVSCQIIFKTATS

SEQ ID NO: 2930013 - protein, 18 aa, Entamoeba invadens
DIINLCINNIVADKTLFP

SEQ ID NO: 2930014 - protein, 23 aa, Entamoeba invadens
DIIQRTKLVRGFFLLNSKGSPFT

SEQ ID NO: 2930015 - protein, 17 aa, Entamoeba invadens
DIISILYVKGCYTNGIF

SEQ ID NO: 2930016 - protein, 18 aa, Entamoeba invadens
DIISSCWQQDTTSRTKIE

SEQ ID NO: 2930017 - protein, 24 aa, Entamoeba invadens
DIIVRIWCNGLAVFQKTINQINNF

SEQ ID NO: 2930018 - protein, 26 aa, Entamoeba invadens
DIKARFPCITDFTLFDNMSFLSTTLS

SEQ ID NO: 2930019 - protein, 23 aa, Entamoeba invadens
DIKDCNRFNFNCFTVMDTTKFCN

SEQ ID NO: 2930020 - protein, 25 aa, Entamoeba invadens
DIKEFPEAFYARILDLDALIHFHMH

SEQ ID NO: 2930021 - protein, 23 aa, Entamoeba invadens
DIKEKLCYVALDFNEKMQKSASS

SEQ ID NO: 2930022 - protein, 19 aa, Entamoeba invadens
DIKILIQMHTLKVVVFYLC

SEQ ID NO: 2930023 - protein, 22 aa, Entamoeba invadens
DIKIPCGVSEIGETCFNGCCHL

SEQ ID NO: 2930024 - protein, 25 aa, Entamoeba invadens
DIKLPRSVVFLIGFITASQETNFQS

SEQ ID NO: 2930025 - protein, 23 aa, Entamoeba invadens
DIKMAKVFVQWLCRKKRLADYCD

SEQ ID NO: 2930026 - protein, 26 aa, Entamoeba invadens
DIKNIKFRYGCFEEITMGNAENIEFD

SEQ ID NO: 2930027 - protein, 23 aa, Entamoeba invadens
DIKPDNFLVFSFDLNDKANAKLT

SEQ ID NO: 2930028 - protein, 22 aa, Entamoeba invadens
DIKPDNFLVFSLESEIDVNAKL

SEQ ID NO: 2930029 - protein, 21 aa, Entamoeba invadens
DIKRIAVHLFEVGRLTTDQVY

SEQ ID NO: 2930030 - protein, 21 aa, Entamoeba invadens
DIKRIRQVISKKGKLKGHAAK

SEQ ID NO: 2930031 - protein, 22 aa, Entamoeba invadens
DIKSDLAIKIERCRNYMTEEIK

SEQ ID NO: 2930032 - protein, 27 aa, Entamoeba invadens
DIKSEVRKSCGPVDRVIVFSTNPQGVV

SEQ ID NO: 2930033 - protein, 22 aa, Entamoeba invadens
DIKSICNCRTLLLTSKVPTSQC

SEQ ID NO: 2930034 - protein, 27 aa, Entamoeba invadens
DIKTKGFCFSLFLSFVMEQANVQQQHA

SEQ ID NO: 2930035 - protein, 24 aa, Entamoeba invadens
DIKVAQSWGDHFGIAFQMRDDLID

SEQ ID NO: 2930036 - protein, 21 aa, Entamoeba invadens
DILAFLSIFFYYLANFSELNK

SEQ ID NO: 2930037 - protein, 21 aa, Entamoeba invadens
DILCLKYNLNGTVLASASADK

SEQ ID NO: 2930038 - protein, 24 aa, Entamoeba invadens
DILEDIDGFCYFNTTFQGRPTPVR

SEQ ID NO: 2930039 - protein, 26 aa, Entamoeba invadens
DILEECCLSVFQRCEETINKTLEKGK

SEQ ID NO: 2930040 - protein, 18 aa, Entamoeba invadens
DILELRFNALQVSTRKYS

SEQ ID NO: 2930041 - protein, 25 aa, Entamoeba invadens
DILFLTSRWGALVLLDEGDALIEKR

SEQ ID NO: 2930042 - protein, 20 aa, Entamoeba invadens
DILGKWGWTLKEMREREDFI

SEQ ID NO: 2930043 - protein, 17 aa, Entamoeba invadens
DILHCINMLHAKLSVLI

SEQ ID NO: 2930044 - protein, 25 aa, Entamoeba invadens
DILKKHFWKTMGILPKQVKAKSFSK

SEQ ID NO: 2930045 - protein, 28 aa, Entamoeba invadens
DILKNVDLWNCKYAVSYLEKLKLFIKTM

SEQ ID NO: 2930046 - protein, 17 aa, Entamoeba invadens
DILLFSVLILLATNGHP

SEQ ID NO: 2930047 - protein, 21 aa, Entamoeba invadens
DILLGCCGNFSVKCKSCKEQG

SEQ ID NO: 2930048 - protein, 28 aa, Entamoeba invadens
DILRLTRLRLGNGYVFVYLSAQGSVGYL

SEQ ID NO: 2930049 - protein, 17 aa, Entamoeba invadens
DILRQAAKYALAQKDFV

SEQ ID NO: 2930050 - protein, 23 aa, Entamoeba invadens
DILRRAFMSRMFPPETIKKLGIK

SEQ ID NO: 2930051 - protein, 22 aa, Entamoeba invadens
DILRSLYYLQMDSIRVIHCDLK

SEQ ID NO: 2930052 - protein, 17 aa, Entamoeba invadens
DILTVNFVVNFSIPVSY

SEQ ID NO: 2930053 - protein, 18 aa, Entamoeba invadens
DILYIWKEKAVSAIQSLV

SEQ ID NO: 2930054 - protein, 17 aa, Entamoeba invadens
DIMGSGCTAGVVVIFGR

SEQ ID NO: 2930055 - protein, 24 aa, Entamoeba invadens
DIMKKKYYITFAMQKLVTGKFSVL

SEQ ID NO: 2930056 - protein, 17 aa, Entamoeba invadens
DIMKWPIDYSSFEKVFL

SEQ ID NO: 2930057 - protein, 32 aa, Entamoeba invadens
DIMPEATKALSSFCMLAVQYMYYQKAILESRS

SEQ ID NO: 2930058 - protein, 22 aa, Entamoeba invadens
DIMRFKYLIRLFGKFYNDKNCL

SEQ ID NO: 2930059 - protein, 22 aa, Entamoeba invadens
DINDWMICDALANKVVTQLLRS

SEQ ID NO: 2930060 - protein, 25 aa, Entamoeba invadens
DINERVKLVPLFQFFDSHLNQNIVY

SEQ ID NO: 2930061 - protein, 18 aa, Entamoeba invadens
DINGGSCIRPMTRQYYSR

SEQ ID NO: 2930062 - protein, 19 aa, Entamoeba invadens
DINGGSCLRPMTRQYYSRT

SEQ ID NO: 2930063 - protein, 20 aa, Entamoeba invadens
DINIGCHWLTVDGVQPQIPQ

SEQ ID NO: 2930064 - protein, 20 aa, Entamoeba invadens
DINLYGLIAVVGRETPQLVN

SEQ ID NO: 2930065 - protein, 25 aa, Entamoeba invadens
DINRLKAFHLSFVFPKPDDDRRPKR

SEQ ID NO: 2930066 - protein, 21 aa, Entamoeba invadens
DINRSALTFNRLLKLVEDHGY

SEQ ID NO: 2930067 - protein, 21 aa, Entamoeba invadens
DIPASVLSIGNFCFFACCSLS

SEQ ID NO: 2930068 - protein, 21 aa, Entamoeba invadens
DIPEDVIITFLLKMNVKLAKS

SEQ ID NO: 2930069 - protein, 20 aa, Entamoeba invadens
DIPFAEYKLGRTLDFAKEKV

SEQ ID NO: 2930070 - protein, 20 aa, Entamoeba invadens
DIPFKEFTFFTDVRNKVIEG

SEQ ID NO: 2930071 - protein, 23 aa, Entamoeba invadens
DIPGIEWAVKKSGVGVAMGNAFD

SEQ ID NO: 2930072 - protein, 17 aa, Entamoeba invadens
DIPKGVQTGEEWFDKTP

SEQ ID NO: 2930073 - protein, 23 aa, Entamoeba invadens
DIPKIANLFTYYPQDYVKNIVEY

SEQ ID NO: 2930074 - protein, 28 aa, Entamoeba invadens
DIPKSVTKIGVFSFRKCVALREIEIPKS

SEQ ID NO: 2930075 - protein, 31 aa, Entamoeba invadens
DIPKSVTRIGAFSFRKCVALKKIEIPSNVVN

SEQ ID NO: 2930076 - protein, 26 aa, Entamoeba invadens
DIPLKSCDLHVFFALHRLFIEAKTAY

SEQ ID NO: 2930077 - protein, 19 aa, Entamoeba invadens
DIPLPGPIFPPLNAPTPTL

SEQ ID NO: 2930078 - protein, 31 aa, Entamoeba invadens
DIPPCVVTIGKYCFFNCFAIEEVVIPKGIKT

SEQ ID NO: 2930079 - protein, 17 aa, Entamoeba invadens
DIPPGFTSINGHCFYCC

SEQ ID NO: 2930080 - protein, 20 aa, Entamoeba invadens
DIPQSCFYQCPVLKSVKAKA

SEQ ID NO: 2930081 - protein, 32 aa, Entamoeba invadens
DIQFKQDVVVKICWLADKFGPDTKWKFDSILE

SEQ ID NO: 2930082 - protein, 29 aa, Entamoeba invadens
DIQTKFGIEPKSTFLLVIDDVTEKPQKRY

SEQ ID NO: 2930083 - protein, 23 aa, Entamoeba invadens
DIQVEGPLAYVVFRNHATPLKIH

SEQ ID NO: 2930084 - protein, 21 aa, Entamoeba invadens
DIQVMCLVRYVYFRNPDVYVR

SEQ ID NO: 2930085 - protein, 20 aa, Entamoeba invadens
DIRCLGWCGVPDDFNSRFSC

SEQ ID NO: 2930086 - protein, 25 aa, Entamoeba invadens
DIRKCTPPEKYAVALHDYEASAETE

SEQ ID NO: 2930087 - protein, 21 aa, Entamoeba invadens
DIRNYKKGMAKYKNEMEEKNE

SEQ ID NO: 2930088 - protein, 17 aa, Entamoeba invadens
DIRRKSGNFASHTQVKS

SEQ ID NO: 2930089 - protein, 28 aa, Entamoeba invadens
DISALKRLFLLFGCFFMQIPFPKETETD

SEQ ID NO: 2930090 - protein, 22 aa, Entamoeba invadens
DISEPTFGYALTKSVVSKEEQI

SEQ ID NO: 2930091 - protein, 20 aa, Entamoeba invadens
DISFSKSVVFGTHLCFANLP

SEQ ID NO: 2930092 - protein, 20 aa, Entamoeba invadens
DISHLLVGRYECRIFGEGAV

SEQ ID NO: 2930093 - protein, 20 aa, Entamoeba invadens
DISILGTRISEWLYSQLETQ

SEQ ID NO: 2930094 - protein, 23 aa, Entamoeba invadens
DISKLSFYKSIFVNMDTSNPSII

SEQ ID NO: 2930095 - protein, 19 aa, Entamoeba invadens
DISKYEWICNQQRDSYASY

SEQ ID NO: 2930096 - protein, 21 aa, Entamoeba invadens
DISQMFLLFLFDSFTTNNNVA

SEQ ID NO: 2930097 - protein, 26 aa, Entamoeba invadens
DISSLQALWVAWKFNAKNNIITLNNF

SEQ ID NO: 2930098 - protein, 20 aa, Entamoeba invadens
DISSVFSMTFTKEGNFVCFS

SEQ ID NO: 2930099 - protein, 21 aa, Entamoeba invadens
DISVIAWGFGLERPTMISYGI

SEQ ID NO: 2930100 - protein, 26 aa, Entamoeba invadens
DITAVFKPFVCKVSKAKIDLVKEYIS

SEQ ID NO: 2930101 - protein, 25 aa, Entamoeba invadens
DITILRALYDLGFIYPTEIQKFAIP

SEQ ID NO: 2930102 - protein, 25 aa, Entamoeba invadens
DITKKSSFESVERWLNELHENADRK

SEQ ID NO: 2930103 - protein, 24 aa, Entamoeba invadens
DITKLDRRLLFLFLTQLPLADLVA

SEQ ID NO: 2930104 - protein, 23 aa, Entamoeba invadens
DITLCRYIYEVGVGMFYLYIQNS

SEQ ID NO: 2930105 - protein, 31 aa, Entamoeba invadens
DITLQSPLVFWKWANEHILAIVTATAVFHFD

SEQ ID NO: 2930106 - protein, 26 aa, Entamoeba invadens
DITLRMLRESLRFVLTNYSYLSASGV

SEQ ID NO: 2930107 - protein, 26 aa, Entamoeba invadens
DITLYIEIFYRGLGVSLIETQKVVQL

SEQ ID NO: 2930108 - protein, 26 aa, Entamoeba invadens
DITRAVIKFYAFYSFMINSDNFDYAK

SEQ ID NO: 2930109 - protein, 18 aa, Entamoeba invadens
DITSDTLLENGFKESMKN

SEQ ID NO: 2930110 - protein, 18 aa, Entamoeba invadens
DITVKGSFKEIFAIDDTL

SEQ ID NO: 2930111 - protein, 28 aa, Entamoeba invadens
DIVAKILVEFTMRIPGMYELILEKVDTF

SEQ ID NO: 2930112 - protein, 20 aa, Entamoeba invadens
DIVKSLRLFSPVFDATKPYF

SEQ ID NO: 2930113 - protein, 24 aa, Entamoeba invadens
DIVPEEVTWNFVMLIQQNIELQNY

SEQ ID NO: 2930114 - protein, 17 aa, Entamoeba invadens
DIVPLFFKKNCVTKHSF

SEQ ID NO: 2930115 - protein, 24 aa, Entamoeba invadens
DIVPRLSYDSVLGIRPFLDEVKQI

SEQ ID NO: 2930116 - protein, 18 aa, Entamoeba invadens
DIVQDLRLVNSSTIHSIK

SEQ ID NO: 2930117 - protein, 23 aa, Entamoeba invadens
DIVQERLAGIILINPQIQNSSLC

SEQ ID NO: 2930118 - protein, 23 aa, Entamoeba invadens
DIVSFCKVNHSITGLVLSEYTTG

SEQ ID NO: 2930119 - protein, 17 aa, Entamoeba invadens
DIVSRSYIYSIIPSVCP

SEQ ID NO: 2930120 - protein, 19 aa, Entamoeba invadens
DIVTVLSLMLGRIKSTTQC

SEQ ID NO: 2930121 - protein, 24 aa, Entamoeba invadens
DIVWFLECTKKFYDKEKPKIDSYV

SEQ ID NO: 2930122 - protein, 26 aa, Entamoeba invadens
DIWALGCLLYKVLFFVTPFEGSPMKI

SEQ ID NO: 2930123 - protein, 19 aa, Entamoeba invadens
DIWLHVIPQIIARIQSSVP

SEQ ID NO: 2930124 - protein, 19 aa, Entamoeba invadens
DIWLHVIPQIIARIQSTAS

SEQ ID NO: 2930125 - protein, 23 aa, Entamoeba invadens
DIWNCSLQTLVQALACEEERLSL

SEQ ID NO: 2930126 - protein, 25 aa, Entamoeba invadens
DIYFVYNCIDLLFSKLSKSLETVEL

SEQ ID NO: 2930127 - protein, 25 aa, Entamoeba invadens
DIYGYVAEHWYIFSTLKQFVTSPTK

SEQ ID NO: 2930128 - protein, 22 aa, Entamoeba invadens
DIYKDRMSLVPIFEEKKDDKML

SEQ ID NO: 2930129 - protein, 21 aa, Entamoeba invadens
DIYKELSLQGAVVMALSAFEK

SEQ ID NO: 2930130 - protein, 25 aa, Entamoeba invadens
DIYMIKKSIKWAVLIQDNCVSHIKD

SEQ ID NO: 2930131 - protein, 25 aa, Entamoeba invadens
DIYMKKFFEVFREFVQPNDLLGKVL

SEQ ID NO: 2930132 - protein, 18 aa, Entamoeba invadens
DIYNCSFTNHSVFLQHLD

SEQ ID NO: 2930133 - protein, 21 aa, Entamoeba invadens
DIYSFGIVFWEVIYKVYTKKY

SEQ ID NO: 2930134 - protein, 21 aa, Entamoeba invadens
DIYSLAIIIVEAFQKRPAYST

SEQ ID NO: 2930135 - protein, 29 aa, Entamoeba invadens
DIYSLGIVFWEIFRRVVFGAYTKPWFTEY

SEQ ID NO: 2930136 - protein, 20 aa, Entamoeba invadens
DIYSLGMVMYELFYEKIPFF

SEQ ID NO: 2930137 - protein, 23 aa, Entamoeba invadens
DIYTSDPYVVFSVNKQTYKTNTI

SEQ ID NO: 2930138 - protein, 20 aa, Entamoeba invadens
DKACQLVDMCERVIYFTDVH

SEQ ID NO: 2930139 - protein, 28 aa, Entamoeba invadens
DKAEIIYKWCFRNCKSLKEITLPKNLCY

SEQ ID NO: 2930140 - protein, 18 aa, Entamoeba invadens
DKAFKYIERYTELMQRVN

SEQ ID NO: 2930141 - protein, 18 aa, Entamoeba invadens
DKAFRYCVSLKWFEIRGD

SEQ ID NO: 2930142 - protein, 17 aa, Entamoeba invadens
DKAGKPKAYAYIELDSV

SEQ ID NO: 2930143 - protein, 25 aa, Entamoeba invadens
DKAKCKKAREWSFINDMRLLSSVCM

SEQ ID NO: 2930144 - protein, 25 aa, Entamoeba invadens
DKARGAAPCVLFFDEEAGEEIKDDL

SEQ ID NO: 2930145 - protein, 17 aa, Entamoeba invadens
DKASILLMNELDNRAEF

SEQ ID NO: 2930146 - protein, 19 aa, Entamoeba invadens
DKATCAMHLIQTVSPQQIV

SEQ ID NO: 2930147 - protein, 25 aa, Entamoeba invadens
DKATDFRQAMQWLLHEAERTTARQR

SEQ ID NO: 2930148 - protein, 30 aa, Entamoeba invadens
DKAVFKKEFFRIIVWFNVDFETVDKYNNGN

SEQ ID NO: 2930149 - protein, 31 aa, Entamoeba invadens
DKAVFKKEFFRIIVWFNVDFETVDKYNNGNI

SEQ ID NO: 2930150 - protein, 21 aa, Entamoeba invadens
DKCARIWDAIFAFPENKLHYF

SEQ ID NO: 2930151 - protein, 25 aa, Entamoeba invadens
DKCFKNCFRLQRVVLPKFLKKLGKE

SEQ ID NO: 2930152 - protein, 20 aa, Entamoeba invadens
DKCLDFLAELYQHFRDVKTK

SEQ ID NO: 2930153 - protein, 30 aa, Entamoeba invadens
DKCRPSRCRLECKKTCPINRGGALCIEVNP

SEQ ID NO: 2930154 - protein, 24 aa, Entamoeba invadens
DKCSLPHFLVTVFQFYESQAYDQI

SEQ ID NO: 2930155 - protein, 25 aa, Entamoeba invadens
DKDEVKRFRAIFVDLCNNETSHLWV

SEQ ID NO: 2930156 - protein, 29 aa, Entamoeba invadens
DKDFMKFGQLLGIKGHSLYTEKSKQFKLL

SEQ ID NO: 2930157 - protein, 31 aa, Entamoeba invadens
DKDGFLWANYFKLRLRCVDLNTRSSYLQKIE

SEQ ID NO: 2930158 - protein, 28 aa, Entamoeba invadens
DKDKDCFKLLKCLCELDVSENPCGDARQ

SEQ ID NO: 2930159 - protein, 17 aa, Entamoeba invadens
DKDKEIVETKRKKKSDR

SEQ ID NO: 2930160 - protein, 20 aa, Entamoeba invadens
DKDLFINFMRLLKPRNIEKS

SEQ ID NO: 2930161 - protein, 19 aa, Entamoeba invadens
DKDLFYKTPEFEVGNDNLA

SEQ ID NO: 2930162 - protein, 22 aa, Entamoeba invadens
DKDSKCIYCTNIRYNHKLAVYN

SEQ ID NO: 2930163 - protein, 18 aa, Entamoeba invadens
DKDVFLNIGSVFRFMYLL

SEQ ID NO: 2930164 - protein, 24 aa, Entamoeba invadens
DKDWKVLLNFSRSMFRVLSKVMPQ

SEQ ID NO: 2930165 - protein, 27 aa, Entamoeba invadens
DKEAKRCVLCMRPYVAFLNDCKDGKCR

SEQ ID NO: 2930166 - protein, 17 aa, Entamoeba invadens
DKECIGHTLRLIDHFLF

SEQ ID NO: 2930167 - protein, 20 aa, Entamoeba invadens
DKEIEALKKKLAEEIAKREA

SEQ ID NO: 2930168 - protein, 18 aa, Entamoeba invadens
DKEILSICFDLVEHNGVI

SEQ ID NO: 2930169 - protein, 27 aa, Entamoeba invadens
DKEKDEEFCCFLLPDYLFMAKIRRDEV

SEQ ID NO: 2930170 - protein, 26 aa, Entamoeba invadens
DKEKFKGRLFISAFTFCMEMLNSKKY

SEQ ID NO: 2930171 - protein, 23 aa, Entamoeba invadens
DKEKKPRKEGVREMKKRKKEELA

SEQ ID NO: 2930172 - protein, 22 aa, Entamoeba invadens
DKEKLRFVLIVRLLIEMVEKET

SEQ ID NO: 2930173 - protein, 17 aa, Entamoeba invadens
DKEKLVKFCVSSKEIIE

SEQ ID NO: 2930174 - protein, 24 aa, Entamoeba invadens
DKELPRGFYDVRVLSYTRGITYTY

SEQ ID NO: 2930175 - protein, 26 aa, Entamoeba invadens
DKELVFQIKLPLKKKEIMKTTINLSK

SEQ ID NO: 2930176 - protein, 22 aa, Entamoeba invadens
DKEMPDVAGLNIAACYSGEEEF

SEQ ID NO: 2930177 - protein, 25 aa, Entamoeba invadens
DKERFRFPWKIAEFIMSGNRLEKPE

SEQ ID NO: 2930178 - protein, 17 aa, Entamoeba invadens
DKERVGSKQVVVDEGKE

SEQ ID NO: 2930179 - protein, 24 aa, Entamoeba invadens
DKESLLKYLRRIMSDLEVNNTMKG

SEQ ID NO: 2930180 - protein, 24 aa, Entamoeba invadens
DKEVKESFLGIDLMRDNLYTPYFD

SEQ ID NO: 2930181 - protein, 23 aa, Entamoeba invadens
DKEVKICLIGCERSGKTTILNIW

SEQ ID NO: 2930182 - protein, 19 aa, Entamoeba invadens
DKFECVMPNSIWPYPSYEE

SEQ ID NO: 2930183 - protein, 21 aa, Entamoeba invadens
DKFEFNGNCTMQEFVDLIFKK

SEQ ID NO: 2930184 - protein, 17 aa, Entamoeba invadens
DKFGYKYDSVIFNSTAT

SEQ ID NO: 2930185 - protein, 25 aa, Entamoeba invadens
DKFIDKFVLCRKCENPETVMIVKNK

SEQ ID NO: 2930186 - protein, 19 aa, Entamoeba invadens
DKFKTLEAVFCVTNTKAYT

SEQ ID NO: 2930187 - protein, 18 aa, Entamoeba invadens
DKFLKFPKKILVFDTFDE

SEQ ID NO: 2930188 - protein, 18 aa, Entamoeba invadens
DKFLLSVKIGKYTMSDTP

SEQ ID NO: 2930189 - protein, 20 aa, Entamoeba invadens
DKFLSFKITFSSAYVPDKEY

SEQ ID NO: 2930190 - protein, 20 aa, Entamoeba invadens
DKFRSEYIVYFFGAVFVSNK

SEQ ID NO: 2930191 - protein, 20 aa, Entamoeba invadens
DKFTQIFGMCSAKTNREALR

SEQ ID NO: 2930192 - protein, 21 aa, Entamoeba invadens
DKFTTICFDDYPYGWASQDNI

SEQ ID NO: 2930193 - protein, 20 aa, Entamoeba invadens
DKFVALLFFVNFVTSQVKVL

SEQ ID NO: 2930194 - protein, 24 aa, Entamoeba invadens
DKFVVSYCCHLRLLNYGYHFNNIE

SEQ ID NO: 2930195 - protein, 31 aa, Entamoeba invadens
DKGFLKRLQKAMPIFVMETTAEITLDDVVLG

SEQ ID NO: 2930196 - protein, 29 aa, Entamoeba invadens
DKGKYIVPDGWKYKEARNLFLHPDVTKAD

SEQ ID NO: 2930197 - protein, 25 aa, Entamoeba invadens
DKGNLKCVMMVYKIAEYDQDAARDV

SEQ ID NO: 2930198 - protein, 23 aa, Entamoeba invadens
DKGPKGGLNIVEFNKLSQLIFEC

SEQ ID NO: 2930199 - protein, 20 aa, Entamoeba invadens
DKGRFYAFGRVFSGTIRTGG

SEQ ID NO: 2930200 - protein, 21 aa, Entamoeba invadens
DKHGTCSMKNFVGNNGIVNYI

SEQ ID NO: 2930201 - protein, 19 aa, Entamoeba invadens
DKHTLAYDKGWRVRMEFKK

SEQ ID NO: 2930202 - protein, 26 aa, Entamoeba invadens
DKIDFGLKLTKSYALIVDMAKLTTCV

SEQ ID NO: 2930203 - protein, 20 aa, Entamoeba invadens
DKIDGAVFIELIQNAFSVVS

SEQ ID NO: 2930204 - protein, 19 aa, Entamoeba invadens
DKIDTMVIQAVSLLDDLDK

SEQ ID NO: 2930205 - protein, 20 aa, Entamoeba invadens
DKIEAICVGLENKMEMWASA

SEQ ID NO: 2930206 - protein, 23 aa, Entamoeba invadens
DKIEVMCACILDSIFHFKNGRME

SEQ ID NO: 2930207 - protein, 18 aa, Entamoeba invadens
DKIIIKNPLFIVALPRSG

SEQ ID NO: 2930208 - protein, 19 aa, Entamoeba invadens
DKIKYLGRRAFYYCKNLKE

SEQ ID NO: 2930209 - protein, 19 aa, Entamoeba invadens
DKIMFGGDIIKLEKMLNAD

SEQ ID NO: 2930210 - protein, 25 aa, Entamoeba invadens
DKIMKICALREDFDMFIFPSEEKRS

SEQ ID NO: 2930211 - protein, 21 aa, Entamoeba invadens
DKIQISFDISLIRLKYNELKK

SEQ ID NO: 2930212 - protein, 26 aa, Entamoeba invadens
DKIQKFLYKVLVLRIFETEENATKNI

SEQ ID NO: 2930213 - protein, 17 aa, Entamoeba invadens
DKIRPLWRHYYQNTQAI

SEQ ID NO: 2930214 - protein, 20 aa, Entamoeba invadens
DKIRPLWRHYYQNTQAIIFV

SEQ ID NO: 2930215 - protein, 23 aa, Entamoeba invadens
DKISNKENLCFLVEDDKDNKFGG

SEQ ID NO: 2930216 - protein, 25 aa, Entamoeba invadens
DKIVIVQCLDYFDLVHLVINCSILI

SEQ ID NO: 2930217 - protein, 21 aa, Entamoeba invadens
DKIVNFDFPFSIETENSTKLN

SEQ ID NO: 2930218 - protein, 23 aa, Entamoeba invadens
DKIYECKYIKMDVQNNAAGNKYV

SEQ ID NO: 2930219 - protein, 26 aa, Entamoeba invadens
DKKAIKFCIEISFAGLSRNALNRAKT

SEQ ID NO: 2930220 - protein, 20 aa, Entamoeba invadens
DKKCFLFCLRENGNVRTRKY

SEQ ID NO: 2930221 - protein, 30 aa, Entamoeba invadens
DKKDKKWEKKEMKHFCKCKPREMRYPLNTH

SEQ ID NO: 2930222 - protein, 25 aa, Entamoeba invadens
DKKDVFLLKELEVVASKEKGIVAKT

SEQ ID NO: 2930223 - protein, 24 aa, Entamoeba invadens
DKKFFNANCKMEFNVMPIDKLEQL

SEQ ID NO: 2930224 - protein, 21 aa, Entamoeba invadens
DKKFVEEWVNNILFIGQNESD

SEQ ID NO: 2930225 - protein, 21 aa, Entamoeba invadens
DKKHHKEIFKAMEKAEKNKAK

SEQ ID NO: 2930226 - protein, 18 aa, Entamoeba invadens
DKKINFNYVPSVSSIPDD

SEQ ID NO: 2930227 - protein, 20 aa, Entamoeba invadens
DKKIRSVLLYSHDSTEQLDQ

SEQ ID NO: 2930228 - protein, 24 aa, Entamoeba invadens
DKKKRFEKRIKISKTEIGKIAKDV

SEQ ID NO: 2930229 - protein, 25 aa, Entamoeba invadens
DKKKSRISKLFGRDESFIALSNFLI

SEQ ID NO: 2930230 - protein, 20 aa, Entamoeba invadens
DKKLCSNTMMMFEGQIVCNN

SEQ ID NO: 2930231 - protein, 19 aa, Entamoeba invadens
DKKLKGIVKSVIFPCPTGV

SEQ ID NO: 2930232 - protein, 20 aa, Entamoeba invadens
DKKLKVFYISKMRNFNINFF

SEQ ID NO: 2930233 - protein, 17 aa, Entamoeba invadens
DKKLLFFNIREFVAESG

SEQ ID NO: 2930234 - protein, 22 aa, Entamoeba invadens
DKKNNKCLILGRIPTTKTQEEV

SEQ ID NO: 2930235 - protein, 25 aa, Entamoeba invadens
DKKPFFISLPCKRNISMEQYPDYIT

SEQ ID NO: 2930236 - protein, 23 aa, Entamoeba invadens
DKKRKNPIIVRLFLMRNNEKLKC

SEQ ID NO: 2930237 - protein, 22 aa, Entamoeba invadens
DKKRPMRVIRIEGNIAKVEVLK

SEQ ID NO: 2930238 - protein, 21 aa, Entamoeba invadens
DKKTALEYFDKVAITVDEVID

SEQ ID NO: 2930239 - protein, 20 aa, Entamoeba invadens
DKKTIGKRSIRVELALPEDK

SEQ ID NO: 2930240 - protein, 26 aa, Entamoeba invadens
DKKWFVCTIPETWNKGTVESKLATPL

SEQ ID NO: 2930241 - protein, 25 aa, Entamoeba invadens
DKKWKRGRRGKGRWRKKENEDPTKR

SEQ ID NO: 2930242 - protein, 20 aa, Entamoeba invadens
DKKYKDARIKLMAENPKTKT

SEQ ID NO: 2930243 - protein, 24 aa, Entamoeba invadens
DKKYRVCDLYKLLIQFDDKNSDSF

SEQ ID NO: 2930244 - protein, 17 aa, Entamoeba invadens
DKLDWKRNPAWCDRVLF

SEQ ID NO: 2930245 - protein, 29 aa, Entamoeba invadens
DKLGEWSLNMLVLLWFHICRNEVTVTQNE

SEQ ID NO: 2930246 - protein, 18 aa, Entamoeba invadens
DKLGIVMRFNVLKRQNSA

SEQ ID NO: 2930247 - protein, 19 aa, Entamoeba invadens
DKLIQMLNKGIKFHKAKNY

SEQ ID NO: 2930248 - protein, 19 aa, Entamoeba invadens
DKLKEMEFTPSIVRTKNVE

SEQ ID NO: 2930249 - protein, 23 aa, Entamoeba invadens
DKLKEVYLSNSIVNILDNSFRDC

SEQ ID NO: 2930250 - protein, 23 aa, Entamoeba invadens
DKLKGVCINAYIRNYNFVCKGQK

SEQ ID NO: 2930251 - protein, 17 aa, Entamoeba invadens
DKLKIKLSDFIVTNPDA

SEQ ID NO: 2930252 - protein, 21 aa, Entamoeba invadens
DKLKLLMTYFNKVWIVRYPPP

SEQ ID NO: 2930253 - protein, 17 aa, Entamoeba invadens
DKLKMNVFIGSNVVARP

SEQ ID NO: 2930254 - protein, 24 aa, Entamoeba invadens
DKLKPSFLKTLKFRTFNKLYKDSD

SEQ ID NO: 2930255 - protein, 23 aa, Entamoeba invadens
DKLLISCGLYFYITYAKGPLIER

SEQ ID NO: 2930256 - protein, 17 aa, Entamoeba invadens
DKLLPTLIVYRNTNHVK

SEQ ID NO: 2930257 - protein, 24 aa, Entamoeba invadens
DKLLRYKNLLAFERSMFALEKEHP

SEQ ID NO: 2930258 - protein, 27 aa, Entamoeba invadens
DKLPTEGFWLNYVIKAYGDSMEKEANV

SEQ ID NO: 2930259 - protein, 22 aa, Entamoeba invadens
DKLRGLTSYIFYLIDNNHNGTI

SEQ ID NO: 2930260 - protein, 22 aa, Entamoeba invadens
DKLRSEFIVYFYGAVFIPSKIC

SEQ ID NO: 2930261 - protein, 20 aa, Entamoeba invadens
DKLSCLHFEGKFPKCQIDTF

SEQ ID NO: 2930262 - protein, 19 aa, Entamoeba invadens
DKLSCLHFEGKFPKCQIET

SEQ ID NO: 2930263 - protein, 20 aa, Entamoeba invadens
DKLTATMAFNNIVTDQIKIK

SEQ ID NO: 2930264 - protein, 17 aa, Entamoeba invadens
DKLTLHLVGGAFNKRNR

SEQ ID NO: 2930265 - protein, 24 aa, Entamoeba invadens
DKLVKEYDCGVLLKDPNAKLSSFE

SEQ ID NO: 2930266 - protein, 25 aa, Entamoeba invadens
DKLVNLKINMCAKINTFSLTDKLES

SEQ ID NO: 2930267 - protein, 18 aa, Entamoeba invadens
DKLVRWLIQRQMPVEGGF

SEQ ID NO: 2930268 - protein, 24 aa, Entamoeba invadens
DKMDIDVFFFRGLEMREKYQSDRQ

SEQ ID NO: 2930269 - protein, 23 aa, Entamoeba invadens
DKMEKRKSVCVSETIEKNELKEH

SEQ ID NO: 2930270 - protein, 18 aa, Entamoeba invadens
DKMGLSFDHGKCVKNENN

SEQ ID NO: 2930271 - protein, 19 aa, Entamoeba invadens
DKMKCCKQIKATSEDFFLF

SEQ ID NO: 2930272 - protein, 24 aa, Entamoeba invadens
DKMLEHMPKLIGVVQFSTVKKKED

SEQ ID NO: 2930273 - protein, 17 aa, Entamoeba invadens
DKMLMVWDIRKPEVPFK

SEQ ID NO: 2930274 - protein, 24 aa, Entamoeba invadens
DKMMRIVQTWGILFPVELIDYINM

SEQ ID NO: 2930275 - protein, 23 aa, Entamoeba invadens
DKMNISGFICLCDDKIRELLRKF

SEQ ID NO: 2930276 - protein, 19 aa, Entamoeba invadens
DKNDMTSMISFFKTTLTTT

SEQ ID NO: 2930277 - protein, 18 aa, Entamoeba invadens
DKNIQRILGFSTDSTTES

SEQ ID NO: 2930278 - protein, 22 aa, Entamoeba invadens
DKNIRTYLALYNGIINRFVMIN

SEQ ID NO: 2930279 - protein, 22 aa, Entamoeba invadens
DKNLKDFILRKMINAERSAMLT

SEQ ID NO: 2930280 - protein, 18 aa, Entamoeba invadens
DKNRKIAELTKRIEDGLN

SEQ ID NO: 2930281 - protein, 18 aa, Entamoeba invadens
DKNRKLAELVKRIEDVEN

SEQ ID NO: 2930282 - protein, 17 aa, Entamoeba invadens
DKNRKLAKLTKRIEDGL

SEQ ID NO: 2930283 - protein, 20 aa, Entamoeba invadens
DKNRLVYLIATLRTLLGKSS

SEQ ID NO: 2930284 - protein, 21 aa, Entamoeba invadens
DKNTFASVVVWYEVDYETFLT

SEQ ID NO: 2930285 - protein, 20 aa, Entamoeba invadens
DKNVLKEWIMNEVPTRLETL

SEQ ID NO: 2930286 - protein, 21 aa, Entamoeba invadens
DKPDYQIGFFLKSLTDDNFIF

SEQ ID NO: 2930287 - protein, 18 aa, Entamoeba invadens
DKPFTEWLESKNKEMYGE

SEQ ID NO: 2930288 - protein, 20 aa, Entamoeba invadens
DKPKRSWTNPFTISADDENN

SEQ ID NO: 2930289 - protein, 24 aa, Entamoeba invadens
DKPLIKQAVVWLALQCNKPILQLT

SEQ ID NO: 2930290 - protein, 17 aa, Entamoeba invadens
DKPMIQNVIVNRLKDKS

SEQ ID NO: 2930291 - protein, 19 aa, Entamoeba invadens
DKPPFYGYVKRSMNRAPGP

SEQ ID NO: 2930292 - protein, 19 aa, Entamoeba invadens
DKPRRDGRRGGDRRDDGRS

SEQ ID NO: 2930293 - protein, 21 aa, Entamoeba invadens
DKPSCFPAFILNPEENSECID

SEQ ID NO: 2930294 - protein, 32 aa, Entamoeba invadens
DKQEILKLYTGIMKYGADFGLIELMFDDRTRK

SEQ ID NO: 2930295 - protein, 21 aa, Entamoeba invadens
DKQELFKWFCNEINNLKFLFK

SEQ ID NO: 2930296 - protein, 23 aa, Entamoeba invadens
DKQFYDLICQAFGGHPKFRKPRV

SEQ ID NO: 2930297 - protein, 24 aa, Entamoeba invadens
DKQFYDLICQAFGGHPKFRKPRVA

SEQ ID NO: 2930298 - protein, 24 aa, Entamoeba invadens
DKQKYGWYAVRLFLNSSKGDEYIP

SEQ ID NO: 2930299 - protein, 20 aa, Entamoeba invadens
DKQLALFVVVLKRLLKSNNM

SEQ ID NO: 2930300 - protein, 22 aa, Entamoeba invadens
DKQLASLLPRYISKVEQQKIEM

SEQ ID NO: 2930301 - protein, 17 aa, Entamoeba invadens
DKQRICRLESDLEDERD

SEQ ID NO: 2930302 - protein, 23 aa, Entamoeba invadens
DKQRLRSSVAGIFGNLEREEREL

SEQ ID NO: 2930303 - protein, 20 aa, Entamoeba invadens
DKQRVGTCSMTFTDAAYINR

SEQ ID NO: 2930304 - protein, 18 aa, Entamoeba invadens
DKRECPWYDTDVSKMEEK

SEQ ID NO: 2930305 - protein, 21 aa, Entamoeba invadens
DKRFFLFTLIEIFQANVYLSL

SEQ ID NO: 2930306 - protein, 22 aa, Entamoeba invadens
DKRFRVARYPNYEYTDTSHQTE

SEQ ID NO: 2930307 - protein, 19 aa, Entamoeba invadens
DKRLTILPFKCFSECKNLK

SEQ ID NO: 2930308 - protein, 31 aa, Entamoeba invadens
DKRLTVLPFKCFYCCRNLKEIDLYYVTNIGE

SEQ ID NO: 2930309 - protein, 21 aa, Entamoeba invadens
DKRSTFLVLMYQMMNSSIGTD

SEQ ID NO: 2930310 - protein, 21 aa, Entamoeba invadens
DKRYSLDLDKFGKREKRFCEE

SEQ ID NO: 2930311 - protein, 17 aa, Entamoeba invadens
DKSEFGNALFKAQDAAK

SEQ ID NO: 2930312 - protein, 24 aa, Entamoeba invadens
DKSFVARLVQFYKMMQKAPVTLTN

SEQ ID NO: 2930313 - protein, 18 aa, Entamoeba invadens
DKSIKIRLPFPTPEISYY

SEQ ID NO: 2930314 - protein, 23 aa, Entamoeba invadens
DKSKCKSCTFVAGEKDLTNRPEF

SEQ ID NO: 2930315 - protein, 20 aa, Entamoeba invadens
DKSKYCSKKLVSRIGECDEF

SEQ ID NO: 2930316 - protein, 18 aa, Entamoeba invadens
DKSMKSFVSAVMNKEDVY

SEQ ID NO: 2930317 - protein, 20 aa, Entamoeba invadens
DKSNVCYLIDFGLSNKYITP

SEQ ID NO: 2930318 - protein, 17 aa, Entamoeba invadens
DKSRLLFQHLKTQRLFS

SEQ ID NO: 2930319 - protein, 19 aa, Entamoeba invadens
DKSSWCMGFLFTDIFILAR

SEQ ID NO: 2930320 - protein, 23 aa, Entamoeba invadens
DKSWREFVLIGAKWVLVCKPNDA

SEQ ID NO: 2930321 - protein, 18 aa, Entamoeba invadens
DKTAFTLLLFPNKIKINN

SEQ ID NO: 2930322 - protein, 18 aa, Entamoeba invadens
DKTCIVCFGTVRQGMNSL

SEQ ID NO: 2930323 - protein, 23 aa, Entamoeba invadens
DKTCKEFSNGITIQYKSVPGGVL

SEQ ID NO: 2930324 - protein, 25 aa, Entamoeba invadens
DKTCSRPFHKIGLIYVMNNQTDQYD

SEQ ID NO: 2930325 - protein, 18 aa, Entamoeba invadens
DKTEELFLKKCTDHINEA

SEQ ID NO: 2930326 - protein, 26 aa, Entamoeba invadens
DKTFGDLWVEFLLRESGSLDSGTSHQ

SEQ ID NO: 2930327 - protein, 18 aa, Entamoeba invadens
DKTHTSTFTIVWETNDRL

SEQ ID NO: 2930328 - protein, 23 aa, Entamoeba invadens
DKTKKTLRFSFKGITQTQQEIEN

SEQ ID NO: 2930329 - protein, 22 aa, Entamoeba invadens
DKTKSGTFVSLFSQASSMQTVP

SEQ ID NO: 2930330 - protein, 22 aa, Entamoeba invadens
DKTLLVFRCIGLLVTNNKVANP

SEQ ID NO: 2930331 - protein, 26 aa, Entamoeba invadens
DKTPCLLALYRVHFIFEPNPLMQNTE

SEQ ID NO: 2930332 - protein, 20 aa, Entamoeba invadens
DKTRKSVIINGFGANKTDKD

SEQ ID NO: 2930333 - protein, 31 aa, Entamoeba invadens
DKTSFCDLACLALICREGTAKGRDGPIVIHC

SEQ ID NO: 2930334 - protein, 26 aa, Entamoeba invadens
DKTSVCLSCLGDAGGGLPALRGSGLL

SEQ ID NO: 2930335 - protein, 18 aa, Entamoeba invadens
DKTVKLWDVVSGKIKSSF

SEQ ID NO: 2930336 - protein, 17 aa, Entamoeba invadens
DKVEFVHLATVLKEYLQ

SEQ ID NO: 2930337 - protein, 20 aa, Entamoeba invadens
DKVEKCLSPFEFVTSRKVDQ

SEQ ID NO: 2930338 - protein, 20 aa, Entamoeba invadens
DKVEYCSKCEPGYFLYDENE

SEQ ID NO: 2930339 - protein, 23 aa, Entamoeba invadens
DKVFKCKGDIFPHFDELDNGFVA

SEQ ID NO: 2930340 - protein, 22 aa, Entamoeba invadens
DKVFQTLKCFSSSIKDLNQMFE

SEQ ID NO: 2930341 - protein, 20 aa, Entamoeba invadens
DKVFSCIRTTIEHEYEYVYI

SEQ ID NO: 2930342 - protein, 20 aa, Entamoeba invadens
DKVGEGFTVYYFDKTEGRVT

SEQ ID NO: 2930343 - protein, 18 aa, Entamoeba invadens
DKVHLFKMMDIESCLTAG

SEQ ID NO: 2930344 - protein, 21 aa, Entamoeba invadens
DKVIFPGCYKSAGVKISVSGI

SEQ ID NO: 2930345 - protein, 17 aa, Entamoeba invadens
DKVIKMQLWDTAGQERF

SEQ ID NO: 2930346 - protein, 27 aa, Entamoeba invadens
DKVKANLKIRLRFMTSVNIQETALHNF

SEQ ID NO: 2930347 - protein, 19 aa, Entamoeba invadens
DKVKECLGTHIMNKVNKDI

SEQ ID NO: 2930348 - protein, 22 aa, Entamoeba invadens
DKVKELLLEKEICAKNEKPSKA

SEQ ID NO: 2930349 - protein, 20 aa, Entamoeba invadens
DKVKGIGIGAFVEGKVKTIT

SEQ ID NO: 2930350 - protein, 25 aa, Entamoeba invadens
DKVKNCNTCLNIAKELLNIPPLLIP

SEQ ID NO: 2930351 - protein, 22 aa, Entamoeba invadens
DKVNCSFFYKVGACRHGDACSR

SEQ ID NO: 2930352 - protein, 19 aa, Entamoeba invadens
DKVNRWWYILEFAYSLDET

SEQ ID NO: 2930353 - protein, 25 aa, Entamoeba invadens
DKVRELIAVWGCFYPNELSEYAVLY

SEQ ID NO: 2930354 - protein, 35 aa, Entamoeba invadens
DKVRELIAVWGCFYPNELSEYAVLYQKYCSHKVID

SEQ ID NO: 2930355 - protein, 27 aa, Entamoeba invadens
DKVSGMITWISLHKCQTRFEGIRKDNT

SEQ ID NO: 2930356 - protein, 21 aa, Entamoeba invadens
DKVSVMKFIKFHGTQPKNSEM

SEQ ID NO: 2930357 - protein, 33 aa, Entamoeba invadens
DKVVVYCVGCSNVGGSIPKWIVNSMSKSAVPSM

SEQ ID NO: 2930358 - protein, 28 aa, Entamoeba invadens
DKWIPELRTYCPSALIYSVGLKTDLRTN

SEQ ID NO: 2930359 - protein, 21 aa, Entamoeba invadens
DKWIPLASYIIIEFFEEKDKT

SEQ ID NO: 2930360 - protein, 21 aa, Entamoeba invadens
DKWITGIHCGYYLGIEDSSFV

SEQ ID NO: 2930361 - protein, 25 aa, Entamoeba invadens
DKWLVKGGLILPEKCTMYINAIEDQ

SEQ ID NO: 2930362 - protein, 19 aa, Entamoeba invadens
DKWVPIGLFDFNKSGQLFA

SEQ ID NO: 2930363 - protein, 20 aa, Entamoeba invadens
DKWYPIELDKKFPKSTQKPD

SEQ ID NO: 2930364 - protein, 24 aa, Entamoeba invadens
DKYFSMLLPFVLFMLDDSDKINEW

SEQ ID NO: 2930365 - protein, 17 aa, Entamoeba invadens
DKYLTFIPIFRGFQNHN

SEQ ID NO: 2930366 - protein, 20 aa, Entamoeba invadens
DKYMPFNIVMTSGRNVYDAS

SEQ ID NO: 2930367 - protein, 23 aa, Entamoeba invadens
DKYNEVLLFPGLPASIQNEIGKM

SEQ ID NO: 2930368 - protein, 22 aa, Entamoeba invadens
DKYPKCTTQAFSVMTRNHPDVV

SEQ ID NO: 2930369 - protein, 19 aa, Entamoeba invadens
DKYSGCDIFGLYSPDCIIK

SEQ ID NO: 2930370 - protein, 19 aa, Entamoeba invadens
DKYTMPFGKYRGDVTDMFV

SEQ ID NO: 2930371 - protein, 20 aa, Entamoeba invadens
DKYTSLGWMNYALEWVDQRK

SEQ ID NO: 2930372 - protein, 18 aa, Entamoeba invadens
DLAAKSVVDAKLKDTEKE

SEQ ID NO: 2930373 - protein, 24 aa, Entamoeba invadens
DLAFFKNKFQDLLLDIPEPQPILT

SEQ ID NO: 2930374 - protein, 26 aa, Entamoeba invadens
DLAHGMCLIKLPFIKEVKKLQLKYAD

SEQ ID NO: 2930375 - protein, 28 aa, Entamoeba invadens
DLAHPLNFAKSVFKKDCQLSITLKTIMI

SEQ ID NO: 2930376 - protein, 22 aa, Entamoeba invadens
DLCFNCCFCLVSVDIPDTVTNI

SEQ ID NO: 2930377 - protein, 27 aa, Entamoeba invadens
DLCKTGLRLHKSFMKIEFSRLQNVMEL

SEQ ID NO: 2930378 - protein, 27 aa, Entamoeba invadens
DLDAYGPRAAINWGKLLGDMLAKDFLN

SEQ ID NO: 2930379 - protein, 20 aa, Entamoeba invadens
DLDELRGFKTYEDYFHKRHE

SEQ ID NO: 2930380 - protein, 19 aa, Entamoeba invadens
DLDIKASYFDRVKKSEEKI

SEQ ID NO: 2930381 - protein, 21 aa, Entamoeba invadens
DLDITAFVFYCEFSDKRAPFI

SEQ ID NO: 2930382 - protein, 17 aa, Entamoeba invadens
DLDKCLKEEGKKEKKEK

SEQ ID NO: 2930383 - protein, 19 aa, Entamoeba invadens
DLDKLYDRIDLGIFEANLN

SEQ ID NO: 2930384 - protein, 19 aa, Entamoeba invadens
DLDKLYNRIDLGIFEADSN

SEQ ID NO: 2930385 - protein, 23 aa, Entamoeba invadens
DLDKMVLESYNFMNVERKSWEDS

SEQ ID NO: 2930386 - protein, 21 aa, Entamoeba invadens
DLDLIEWFECIANFKRYKKVQ

SEQ ID NO: 2930387 - protein, 21 aa, Entamoeba invadens
DLDRLPTLIFKAIDSDNSGYI

SEQ ID NO: 2930388 - protein, 24 aa, Entamoeba invadens
DLDTMTLEILEWLKSDQEGYLIDV

SEQ ID NO: 2930389 - protein, 24 aa, Entamoeba invadens
DLDVNRNIPFYGFGDSSTRDKTTF

SEQ ID NO: 2930390 - protein, 19 aa, Entamoeba invadens
DLEARNVLVKTLLKKVNNK

SEQ ID NO: 2930391 - protein, 23 aa, Entamoeba invadens
DLEAVKLLIEYGGRPTDRTSQMV

SEQ ID NO: 2930392 - protein, 18 aa, Entamoeba invadens
DLECKKCVNTDNFKTRFE

SEQ ID NO: 2930393 - protein, 21 aa, Entamoeba invadens
DLEDIKKLVGVDNIIDSYMEI

SEQ ID NO: 2930394 - protein, 17 aa, Entamoeba invadens
DLEECVLQKITILEIHR

SEQ ID NO: 2930395 - protein, 24 aa, Entamoeba invadens
DLEELCWKFRTTVEQYIIKMATFD

SEQ ID NO: 2930396 - protein, 22 aa, Entamoeba invadens
DLEIKFYISLINEFTHDYLQKV

SEQ ID NO: 2930397 - protein, 23 aa, Entamoeba invadens
DLEKYKLGLKFIQIKKYEKAIRT

SEQ ID NO: 2930398 - protein, 19 aa, Entamoeba invadens
DLENIQRLIELGASKKLAT

SEQ ID NO: 2930399 - protein, 22 aa, Entamoeba invadens
DLENLPIIALRLVNGIKSDSDA

SEQ ID NO: 2930400 - protein, 21 aa, Entamoeba invadens
DLERIKLLLIKTTATLAEGNS

SEQ ID NO: 2930401 - protein, 20 aa, Entamoeba invadens
DLEVQQCKQTLVGHQSAIKS

SEQ ID NO: 2930402 - protein, 26 aa, Entamoeba invadens
DLFAQCCASIQWIHNRVGLIHRDIKP

SEQ ID NO: 2930403 - protein, 25 aa, Entamoeba invadens
DLFDFHAYIFQKPCICTYIDTLKAC

SEQ ID NO: 2930404 - protein, 19 aa, Entamoeba invadens
DLFFSGKYLDLIGYVVRVT

SEQ ID NO: 2930405 - protein, 20 aa, Entamoeba invadens
DLFFSISFHNLRSFDKVSSN

SEQ ID NO: 2930406 - protein, 20 aa, Entamoeba invadens
DLFGSGVMCIHVDIQIHLDS

SEQ ID NO: 2930407 - protein, 27 aa, Entamoeba invadens
DLFKIDLRASKLCYLPVLQDKIEQQKI

SEQ ID NO: 2930408 - protein, 17 aa, Entamoeba invadens
DLFKLCFELTEYPSKKG

SEQ ID NO: 2930409 - protein, 21 aa, Entamoeba invadens
DLFNRLFKKIEVVEGDQTAPL

SEQ ID NO: 2930410 - protein, 18 aa, Entamoeba invadens
DLFRNRGYYRLKTEKVVS

SEQ ID NO: 2930411 - protein, 22 aa, Entamoeba invadens
DLFRQINRGVLILYVASTNVPV

SEQ ID NO: 2930412 - protein, 24 aa, Entamoeba invadens
DLFSEAMKTIFIDSVLKCAECTQS

SEQ ID NO: 2930413 - protein, 18 aa, Entamoeba invadens
DLFSVGVVLFEMITSNSL

SEQ ID NO: 2930414 - protein, 20 aa, Entamoeba invadens
DLFTQCCIGVQWIHNRLNLI

SEQ ID NO: 2930415 - protein, 17 aa, Entamoeba invadens
DLFWSNISEKVFAEQFG

SEQ ID NO: 2930416 - protein, 18 aa, Entamoeba invadens
DLFYKIPKFEVGNDNLAK

SEQ ID NO: 2930417 - protein, 26 aa, Entamoeba invadens
DLGEALSEFVPLLSSYKMYVGHSETQ

SEQ ID NO: 2930418 - protein, 28 aa, Entamoeba invadens
DLGKQILIRRCEVGGIPSDINGINVSNN

SEQ ID NO: 2930419 - protein, 19 aa, Entamoeba invadens
DLGKSCKQSNERQSIKMFN

SEQ ID NO: 2930420 - protein, 33 aa, Entamoeba invadens
DLGKSCKQSNERQSIKMFNDVQIIRDEKNEFNT

SEQ ID NO: 2930421 - protein, 29 aa, Entamoeba invadens
DLGKYAVLCAIEFSMTLCIPIGNYSLPTP

SEQ ID NO: 2930422 - protein, 24 aa, Entamoeba invadens
DLGNRLHALIDQFLLDAVTAQNQK

SEQ ID NO: 2930423 - protein, 26 aa, Entamoeba invadens
DLGQLKWVVIGKLFGLRAVGNAQDNR

SEQ ID NO: 2930424 - protein, 21 aa, Entamoeba invadens
DLHGVIVPILFNAEDYESHLV

SEQ ID NO: 2930425 - protein, 20 aa, Entamoeba invadens
DLHTKFLSSTSWVAELNEPI

SEQ ID NO: 2930426 - protein, 17 aa, Entamoeba invadens
DLICLVRAHQVMEEGFK

SEQ ID NO: 2930427 - protein, 26 aa, Entamoeba invadens
DLICVLDAMTFKKCYMSVKLKEHQQN

SEQ ID NO: 2930428 - protein, 17 aa, Entamoeba invadens
DLIEICVHYELTHATLL

SEQ ID NO: 2930429 - protein, 19 aa, Entamoeba invadens
DLIIPCLLFLGNLASIPVH

SEQ ID NO: 2930430 - protein, 26 aa, Entamoeba invadens
DLIKNWKAEDVIAMIKEIIMYTDRYE

SEQ ID NO: 2930431 - protein, 18 aa, Entamoeba invadens
DLIKTKIFFDCVSSNNEK

SEQ ID NO: 2930432 - protein, 20 aa, Entamoeba invadens
DLILLNKFVELVGEKIATPN

SEQ ID NO: 2930433 - protein, 24 aa, Entamoeba invadens
DLILRIAKEFKVEWSELVKGVFVA

SEQ ID NO: 2930434 - protein, 18 aa, Entamoeba invadens
DLIQRKSKVFLRNIKEIK

SEQ ID NO: 2930435 - protein, 25 aa, Entamoeba invadens
DLIRERALVLLNCLYDGSLYETTAP

SEQ ID NO: 2930436 - protein, 32 aa, Entamoeba invadens
DLITDPFIFCGSIKLQMVVFIKAKPNDKIELI

SEQ ID NO: 2930437 - protein, 20 aa, Entamoeba invadens
DLKELCCEELIIQKPQQYYS

SEQ ID NO: 2930438 - protein, 28 aa, Entamoeba invadens
DLKENAFLLGRFHGFKFFEAGEGDLKVW

SEQ ID NO: 2930439 - protein, 17 aa, Entamoeba invadens
DLKEVVQAWTYKPGFPV

SEQ ID NO: 2930440 - protein, 21 aa, Entamoeba invadens
DLKHIRMFGEFCFCGCDSLSA

SEQ ID NO: 2930441 - protein, 18 aa, Entamoeba invadens
DLKIEYIDRLTLSKKYLH

SEQ ID NO: 2930442 - protein, 23 aa, Entamoeba invadens
DLKKDCYNLIFSRKLQSIPSAWP

SEQ ID NO: 2930443 - protein, 34 aa, Entamoeba invadens
DLKKEGYVIKRWVLRYVIVKHNFLIYFVSEKEFS

SEQ ID NO: 2930444 - protein, 22 aa, Entamoeba invadens
DLKKEIIVLLEMARGMKNEIQF

SEQ ID NO: 2930445 - protein, 22 aa, Entamoeba invadens
DLKKEVLHFFDFEFSDGETSVV

SEQ ID NO: 2930446 - protein, 17 aa, Entamoeba invadens
DLKKKWDDTQWDQQSLE

SEQ ID NO: 2930447 - protein, 24 aa, Entamoeba invadens
DLKLHFKGCQNISVTTQNVINSLT

SEQ ID NO: 2930448 - protein, 29 aa, Entamoeba invadens
DLKLSGNCLKGSRPILSFGNEFTQTKEGQ

SEQ ID NO: 2930449 - protein, 22 aa, Entamoeba invadens
DLKMLDRLAAFVSDDAKKLIAK

SEQ ID NO: 2930450 - protein, 22 aa, Entamoeba invadens
DLKNCVALANKIRLNVYGKDME

SEQ ID NO: 2930451 - protein, 22 aa, Entamoeba invadens
DLKQLIIQIVHKFRSDEKYIND

SEQ ID NO: 2930452 - protein, 24 aa, Entamoeba invadens
DLKRRRCTYRRYFRKLNYYYHKVM

SEQ ID NO: 2930453 - protein, 19 aa, Entamoeba invadens
DLKRVCLATGAKIQTTVSE

SEQ ID NO: 2930454 - protein, 25 aa, Entamoeba invadens
DLKSLPLAALMDFLCVHVDPKILGE

SEQ ID NO: 2930455 - protein, 26 aa, Entamoeba invadens
DLKSLRTVMFSMYLFNPVLFYIQVEI

SEQ ID NO: 2930456 - protein, 17 aa, Entamoeba invadens
DLKSRLKTVSFYNTFSY

SEQ ID NO: 2930457 - protein, 22 aa, Entamoeba invadens
DLKTLFEGFDIVSARIASYRFN

SEQ ID NO: 2930458 - protein, 25 aa, Entamoeba invadens
DLKTTECLDFWLKEIERYSDSSAPK

SEQ ID NO: 2930459 - protein, 18 aa, Entamoeba invadens
DLKYVCLENVTFDNVVVD

SEQ ID NO: 2930460 - protein, 27 aa, Entamoeba invadens
DLLAGVKKMRESLCFSNEPNKLTSYYY

SEQ ID NO: 2930461 - protein, 31 aa, Entamoeba invadens
DLLDVESKKALAISCRRIHTIVSSIANAPYS

SEQ ID NO: 2930462 - protein, 29 aa, Entamoeba invadens
DLLEEAGVAFGKKIEELFGREMTISVSAE

SEQ ID NO: 2930463 - protein, 18 aa, Entamoeba invadens
DLLEKCFERVDKKLMEKD

SEQ ID NO: 2930464 - protein, 24 aa, Entamoeba invadens
DLLEKLRPYFDVDVLTVIQNKLEH

SEQ ID NO: 2930465 - protein, 23 aa, Entamoeba invadens
DLLKEGRNVISFVTKEVVHNTFV

SEQ ID NO: 2930466 - protein, 25 aa, Entamoeba invadens
DLLKHYRLDHHDYFTLRNARDEVIK

SEQ ID NO: 2930467 - protein, 26 aa, Entamoeba invadens
DLLKKFFDRFGVGIIQFRNVLLDDCL

SEQ ID NO: 2930468 - protein, 26 aa, Entamoeba invadens
DLLKKLSLFEWAGWIEVCVSNSVVQN

SEQ ID NO: 2930469 - protein, 17 aa, Entamoeba invadens
DLLKMIEKIGLGKVKPT

SEQ ID NO: 2930470 - protein, 27 aa, Entamoeba invadens
DLLKQVFKFVWRIKDLEVEPNVAVSQI

SEQ ID NO: 2930471 - protein, 19 aa, Entamoeba invadens
DLLKRNRIDVLFLVPHSSH

SEQ ID NO: 2930472 - protein, 20 aa, Entamoeba invadens
DLLLKLKSTFPKRKNDHIND

SEQ ID NO: 2930473 - protein, 19 aa, Entamoeba invadens
DLLLLRNVAKLGIGEGVFE

SEQ ID NO: 2930474 - protein, 19 aa, Entamoeba invadens
DLLLSFYVGCDKLKELIDL

SEQ ID NO: 2930475 - protein, 23 aa, Entamoeba invadens
DLLMFKIQILMKGKLYNAVLDFI

SEQ ID NO: 2930476 - protein, 21 aa, Entamoeba invadens
DLLPQKCIEKIEKVEKVENNK

SEQ ID NO: 2930477 - protein, 18 aa, Entamoeba invadens
DLLQGPKLDWDMMNQICI

SEQ ID NO: 2930478 - protein, 18 aa, Entamoeba invadens
DLLSIDLTEDIYYDTPTS

SEQ ID NO: 2930479 - protein, 20 aa, Entamoeba invadens
DLLTKCPTLGMLEEYVKNPK

SEQ ID NO: 2930480 - protein, 19 aa, Entamoeba invadens
DLLTKEWVLEGGALVLADE

SEQ ID NO: 2930481 - protein, 17 aa, Entamoeba invadens
DLLTKFKQMIIALPNTA

SEQ ID NO: 2930482 - protein, 24 aa, Entamoeba invadens
DLLVRLINILSGYINAVATAHRIA

SEQ ID NO: 2930483 - protein, 17 aa, Entamoeba invadens
DLLVSGSRDKTLLVWNV

SEQ ID NO: 2930484 - protein, 26 aa, Entamoeba invadens
DLLWIRHLPIAFLMREHMMLLRQSEE

SEQ ID NO: 2930485 - protein, 26 aa, Entamoeba invadens
DLLWVRHLPIAYLMRQHLILLMKSEE

SEQ ID NO: 2930486 - protein, 21 aa, Entamoeba invadens
DLLYLNLLNARVFLSQNNLIE

SEQ ID NO: 2930487 - protein, 17 aa, Entamoeba invadens
DLMCKLITHEESQRIGW

SEQ ID NO: 2930488 - protein, 24 aa, Entamoeba invadens
DLMIETFGSLGLDPNMTCLKLSSL

SEQ ID NO: 2930489 - protein, 26 aa, Entamoeba invadens
DLMIKEITGVLVRKGVVLKRSHFTPE

SEQ ID NO: 2930490 - protein, 23 aa, Entamoeba invadens
DLMPFLRKPILLIIDSDVQNSFI

SEQ ID NO: 2930491 - protein, 19 aa, Entamoeba invadens
DLMSKCSYFPLPEVGKVKI

SEQ ID NO: 2930492 - protein, 28 aa, Entamoeba invadens
DLMSSPELMMFVGKLIGKMICDNMTLNL

SEQ ID NO: 2930493 - protein, 18 aa, Entamoeba invadens
DLNCPKIALPSTLEKLVC

SEQ ID NO: 2930494 - protein, 17 aa, Entamoeba invadens
DLNNWVGVATFVLQSRA

SEQ ID NO: 2930495 - protein, 25 aa, Entamoeba invadens
DLNRFPVCVRYYYATLSKELKTMQP

SEQ ID NO: 2930496 - protein, 23 aa, Entamoeba invadens
DLNSRKYFLSNIILAGGNTMFDG

SEQ ID NO: 2930497 - protein, 25 aa, Entamoeba invadens
DLNTMCLMDKLFGLMSEISKKSDVN

SEQ ID NO: 2930498 - protein, 19 aa, Entamoeba invadens
DLNVALRWIDVAKPATRLR

SEQ ID NO: 2930499 - protein, 17 aa, Entamoeba invadens
DLNYGCVVDCSKVMNYV

SEQ ID NO: 2930500 - protein, 20 aa, Entamoeba invadens
DLPACTKAGIVVMNTPGQNS

SEQ ID NO: 2930501 - protein, 21 aa, Entamoeba invadens
DLPAILKEEIEVYNTIIMLYT

SEQ ID NO: 2930502 - protein, 19 aa, Entamoeba invadens
DLPCETMDLSFFVTEFYII

SEQ ID NO: 2930503 - protein, 39 aa, Entamoeba invadens
DLPEFLIPFCEFHKICEDFGLRLVALWDLNQFYHDWIHK

SEQ ID NO: 2930504 - protein, 17 aa, Entamoeba invadens
DLPFTFETPNLLRNRAM

SEQ ID NO: 2930505 - protein, 21 aa, Entamoeba invadens
DLPICDTCYQIIKGEYDREEV

SEQ ID NO: 2930506 - protein, 21 aa, Entamoeba invadens
DLPIGKICGFGNVVCIQNESA

SEQ ID NO: 2930507 - protein, 20 aa, Entamoeba invadens
DLPKSIPVLSFLHRTDHTIS

SEQ ID NO: 2930508 - protein, 27 aa, Entamoeba invadens
DLPKTVGLLDFRKVKMIGRGNVGHVYL

SEQ ID NO: 2930509 - protein, 19 aa, Entamoeba invadens
DLPNSDVFFTGFKPIVSFS

SEQ ID NO: 2930510 - protein, 23 aa, Entamoeba invadens
DLPRTSELYVHRSGRTARAGRKG

SEQ ID NO: 2930511 - protein, 21 aa, Entamoeba invadens
DLPSPLFLCSNIVSLNISCCR

SEQ ID NO: 2930512 - protein, 19 aa, Entamoeba invadens
DLPTTSLNVDDVWNSLHFE

SEQ ID NO: 2930513 - protein, 23 aa, Entamoeba invadens
DLQDGIVFRDLLRKIGVPCGDTL

SEQ ID NO: 2930514 - protein, 24 aa, Entamoeba invadens
DLQEAFKLLSNCRHRVVPPPRVVN

SEQ ID NO: 2930515 - protein, 22 aa, Entamoeba invadens
DLQKLCEHWQLTVISSKLLSAP

SEQ ID NO: 2930516 - protein, 24 aa, Entamoeba invadens
DLQMCISSKFLALISNVNYELVEA

SEQ ID NO: 2930517 - protein, 19 aa, Entamoeba invadens
DLRFIDFAKSYSLDEEKCE

SEQ ID NO: 2930518 - protein, 20 aa, Entamoeba invadens
DLRGKFFGLCRRMGVDPLRS

SEQ ID NO: 2930519 - protein, 20 aa, Entamoeba invadens
DLRIAGLKYGIFRMSMRHTE

SEQ ID NO: 2930520 - protein, 18 aa, Entamoeba invadens
DLRITVAPKDNWEKINFV

SEQ ID NO: 2930521 - protein, 23 aa, Entamoeba invadens
DLRKEYAGWIVSVAFTAIKNFVG

SEQ ID NO: 2930522 - protein, 21 aa, Entamoeba invadens
DLRKLNAYARQKAVLSNFTPF

SEQ ID NO: 2930523 - protein, 19 aa, Entamoeba invadens
DLRKMEIIDKVRLDKDEHG

SEQ ID NO: 2930524 - protein, 23 aa, Entamoeba invadens
DLRLKNYSVFEFAKNLNKCPKDI

SEQ ID NO: 2930525 - protein, 19 aa, Entamoeba invadens
DLRRLAMDKHNIINPPSQI

SEQ ID NO: 2930526 - protein, 21 aa, Entamoeba invadens
DLRSTLIEWKSYYINVVQQME

SEQ ID NO: 2930527 - protein, 33 aa, Entamoeba invadens
DLRTSEKFWKTWNWTPCEEVIFFYFSRDSKNIQ

SEQ ID NO: 2930528 - protein, 33 aa, Entamoeba invadens
DLRVDSCPWGFLLRLLDRYKLRVPVKGGYVAWT

SEQ ID NO: 2930529 - protein, 25 aa, Entamoeba invadens
DLSAQELFALLSANLPPTGKLLSVG

SEQ ID NO: 2930530 - protein, 24 aa, Entamoeba invadens
DLSEEKKPFFGIAAALERYKAVVP

SEQ ID NO: 2930531 - protein, 25 aa, Entamoeba invadens
DLSEYNLLWWKGLVYVIDVGQAIEL

SEQ ID NO: 2930532 - protein, 24 aa, Entamoeba invadens
DLSFTRYSPLMAEIIKEKFDNLVH

SEQ ID NO: 2930533 - protein, 25 aa, Entamoeba invadens
DLSGVPLKFCDDFEYRDSVDGSVTK

SEQ ID NO: 2930534 - protein, 18 aa, Entamoeba invadens
DLSHTGIRISLSRFNTEE

SEQ ID NO: 2930535 - protein, 19 aa, Entamoeba invadens
DLSKYWQFWLDQLPSKKSP

SEQ ID NO: 2930536 - protein, 22 aa, Entamoeba invadens
DLSLLNKMCRHYIAKTKCKEVI

SEQ ID NO: 2930537 - protein, 24 aa, Entamoeba invadens
DLSMFPSAISLVIQMYYTDPKAKV

SEQ ID NO: 2930538 - protein, 20 aa, Entamoeba invadens
DLSMMLKKVIDARRDDICPN

SEQ ID NO: 2930539 - protein, 26 aa, Entamoeba invadens
DLSPKRLQTLVTMALGCAHLVMHINA

SEQ ID NO: 2930540 - protein, 22 aa, Entamoeba invadens
DLSQLISMNKIYVGQKLRVCGM

SEQ ID NO: 2930541 - protein, 22 aa, Entamoeba invadens
DLSQLSAVFPQFSMDEIEREYQ

SEQ ID NO: 2930542 - protein, 23 aa, Entamoeba invadens
DLSQSRCKLSCSAKSAVISLELM

SEQ ID NO: 2930543 - protein, 33 aa, Entamoeba invadens
DLSVFKISIFKSLKFLKLLVLYSNDPQDKYLQS

SEQ ID NO: 2930544 - protein, 34 aa, Entamoeba invadens
DLTEVILKTCILRLFTIDVPQSWVTNSAENLFHK

SEQ ID NO: 2930545 - protein, 23 aa, Entamoeba invadens
DLTFKYPAVTAVFQQYIDPKKGD

SEQ ID NO: 2930546 - protein, 17 aa, Entamoeba invadens
DLTFSKTEIDFMDTKDN

SEQ ID NO: 2930547 - protein, 23 aa, Entamoeba invadens
DLTKARFLLLQKMSETRLKMAEV

SEQ ID NO: 2930548 - protein, 25 aa, Entamoeba invadens
DLTKAWRKVSVFLFRNILLLTKPGS

SEQ ID NO: 2930549 - protein, 19 aa, Entamoeba invadens
DLTKTSFDQALRVEARVGD

SEQ ID NO: 2930550 - protein, 18 aa, Entamoeba invadens
DLTKVFDEKSVLELKMET

SEQ ID NO: 2930551 - protein, 22 aa, Entamoeba invadens
DLTLRRLLYVVLDDMVPLTSNS

SEQ ID NO: 2930552 - protein, 22 aa, Entamoeba invadens
DLTMDIAEIFGIVIELLTKISN

SEQ ID NO: 2930553 - protein, 17 aa, Entamoeba invadens
DLTSLLSNVMAARRKDI

SEQ ID NO: 2930554 - protein, 20 aa, Entamoeba invadens
DLTTIFKLKKGELIKKSPGT

SEQ ID NO: 2930555 - protein, 27 aa, Entamoeba invadens
DLTYKGCGFHRVIKDFMIQGGDFTKHN

SEQ ID NO: 2930556 - protein, 18 aa, Entamoeba invadens
DLVACGGSDGVAYIYSIS

SEQ ID NO: 2930557 - protein, 47 aa, Entamoeba invadens
DLVCLECLMKQRFLKRNFWCKICKKEFKDLLIASGRRRDEEFIRATL

SEQ ID NO: 2930558 - protein, 23 aa, Entamoeba invadens
DLVGEQIFVFNAGNVFRNEVDDT

SEQ ID NO: 2930559 - protein, 20 aa, Entamoeba invadens
DLVGFLLVERKFLFVSNSIQ

SEQ ID NO: 2930560 - protein, 22 aa, Entamoeba invadens
DLVICAFGFGLVNNFVEGTADE

SEQ ID NO: 2930561 - protein, 24 aa, Entamoeba invadens
DLVKNFKIPISLVIDILPETWEST

SEQ ID NO: 2930562 - protein, 26 aa, Entamoeba invadens
DLVLPRLLKKISIIDCTGKINMKNCR

SEQ ID NO: 2930563 - protein, 19 aa, Entamoeba invadens
DLVLQCFDVLSKVKGTLPI

SEQ ID NO: 2930564 - protein, 19 aa, Entamoeba invadens
DLVNCRLVCRMWKDMTKSI

SEQ ID NO: 2930565 - protein, 19 aa, Entamoeba invadens
DLVTMKWWDDIWLNEGFAS

SEQ ID NO: 2930566 - protein, 29 aa, Entamoeba invadens
DLVTMKWWNDLWLNEGFASYMGDLFGVNT

SEQ ID NO: 2930567 - protein, 20 aa, Entamoeba invadens
DLVVECFVVFAHHTHSKLND

SEQ ID NO: 2930568 - protein, 29 aa, Entamoeba invadens
DLVVGLNCKQIKTGAPCRSERLCKYNQLM

SEQ ID NO: 2930569 - protein, 26 aa, Entamoeba invadens
DLVYRYPNCINILIIRIEQFIDSAPP

SEQ ID NO: 2930570 - protein, 20 aa, Entamoeba invadens
DLYHRLSISSFEDFQPDLVA

SEQ ID NO: 2930571 - protein, 28 aa, Entamoeba invadens
DLYIEMKEWRKLYKIDITILRALYDLGF

SEQ ID NO: 2930572 - protein, 24 aa, Entamoeba invadens
DLYIGGDFRRSFSIVEAVHDAEVV

SEQ ID NO: 2930573 - protein, 28 aa, Entamoeba invadens
DLYIKEGDGFILVFSWASVGTFQELEKI

SEQ ID NO: 2930574 - protein, 17 aa, Entamoeba invadens
DLYKNNCIIKNGDLKIR

SEQ ID NO: 2930575 - protein, 18 aa, Entamoeba invadens
DLYLLLGSADFLGNPVGL

SEQ ID NO: 2930576 - protein, 20 aa, Entamoeba invadens
DLYTTHYLMFYTFISESSVY

SEQ ID NO: 2930577 - protein, 26 aa, Entamoeba invadens
DLYVIHLPIGPSFHFKVFNIINPQQL

SEQ ID NO: 2930578 - protein, 18 aa, Entamoeba invadens
DMAFKGKPVMKIAEENGQ

SEQ ID NO: 2930579 - protein, 18 aa, Entamoeba invadens
DMALAASFTKSSSADSLK

SEQ ID NO: 2930580 - protein, 17 aa, Entamoeba invadens
DMCNVLFSIYLSGVLKM

SEQ ID NO: 2930581 - protein, 25 aa, Entamoeba invadens
DMDEWKYSELEVMKAGGNAQFALYL

SEQ ID NO: 2930582 - protein, 31 aa, Entamoeba invadens
DMDKCTPANIPTNWVFCDGLTKSDVETPYVF

SEQ ID NO: 2930583 - protein, 25 aa, Entamoeba invadens
DMEKTEKYLAAALNEEVEAANEKLR

SEQ ID NO: 2930584 - protein, 20 aa, Entamoeba invadens
DMEKYCRCSIYTVSDNPETV

SEQ ID NO: 2930585 - protein, 18 aa, Entamoeba invadens
DMFPKDWIEFDHKNWLIE

SEQ ID NO: 2930586 - protein, 18 aa, Entamoeba invadens
DMFRELLRSDGFGDWTDY

SEQ ID NO: 2930587 - protein, 21 aa, Entamoeba invadens
DMGLEFLTRYLTDLIGDVVVF

SEQ ID NO: 2930588 - protein, 24 aa, Entamoeba invadens
DMGMFSYVVFCEADLLNKDWDKID

SEQ ID NO: 2930589 - protein, 21 aa, Entamoeba invadens
DMGYNIGIRLVEEYLAKVEGK

SEQ ID NO: 2930590 - protein, 28 aa, Entamoeba invadens
DMIDWSIIYQMNWFKTPINIRLFNDSFN

SEQ ID NO: 2930591 - protein, 17 aa, Entamoeba invadens
DMIKEKPFVSSMQTKFY

SEQ ID NO: 2930592 - protein, 18 aa, Entamoeba invadens
DMINRNGELWKFTLYIMS

SEQ ID NO: 2930593 - protein, 30 aa, Entamoeba invadens
DMIPNRWRQVPEFTTYISFFLTSVPQIPEV

SEQ ID NO: 2930594 - protein, 17 aa, Entamoeba invadens
DMIPRCSLKSISDILER

SEQ ID NO: 2930595 - protein, 25 aa, Entamoeba invadens
DMKDSPNCKFCFRILNLSNSEVDLT

SEQ ID NO: 2930596 - protein, 26 aa, Entamoeba invadens
DMKEFLEEYPILSFERLIGKKGEMKS

SEQ ID NO: 2930597 - protein, 25 aa, Entamoeba invadens
DMKETMKVLVEMSVRMEKAPLKRGR

SEQ ID NO: 2930598 - protein, 19 aa, Entamoeba invadens
DMKKVVFTPHIGWTSEEAR

SEQ ID NO: 2930599 - protein, 20 aa, Entamoeba invadens
DMLEFVKSHFDAHGEHEHLH

SEQ ID NO: 2930600 - protein, 24 aa, Entamoeba invadens
DMLFEMLKAATFMNIDMLVEATAK

SEQ ID NO: 2930601 - protein, 21 aa, Entamoeba invadens
DMLFPKFGKVRIWLMKNKTKV

SEQ ID NO: 2930602 - protein, 19 aa, Entamoeba invadens
DMLIGSSFSKEGNSCAFLP

SEQ ID NO: 2930603 - protein, 23 aa, Entamoeba invadens
DMLWLVTELMDFGELTNLIDLHQ

SEQ ID NO: 2930604 - protein, 20 aa, Entamoeba invadens
DMMDMCMKLLDEMEEQTRTE

SEQ ID NO: 2930605 - protein, 19 aa, Entamoeba invadens
DMMEVYKISKDVDMVINKP

SEQ ID NO: 2930606 - protein, 34 aa, Entamoeba invadens
DMMKTGLINNMFQCIWLCLSFSGKNLAQSVFKDM

SEQ ID NO: 2930607 - protein, 17 aa, Entamoeba invadens
DMMLFTSTFTLLRSYCE

SEQ ID NO: 2930608 - protein, 24 aa, Entamoeba invadens
DMMMLLKIKPIPDLKMCDVAQNTE

SEQ ID NO: 2930609 - protein, 26 aa, Entamoeba invadens
DMNKSCRRYILSGVCKFMTIEEDNGV

SEQ ID NO: 2930610 - protein, 25 aa, Entamoeba invadens
DMPIFELFPNLVLITLISQLLPSTD

SEQ ID NO: 2930611 - protein, 24 aa, Entamoeba invadens
DMPIGLSICEPGRIYLRRDTVLLR

SEQ ID NO: 2930612 - protein, 46 aa, Entamoeba invadens
DMRGRCSMGQKALASLIIRIALAKTFCTKCAVLALDEPTINLDADH

SEQ ID NO: 2930613 - protein, 19 aa, Entamoeba invadens
DMRIKCCKANGLRVEEGVL

SEQ ID NO: 2930614 - protein, 24 aa, Entamoeba invadens
DMRNELGENLFLYVEKYTKADEEK

SEQ ID NO: 2930615 - protein, 25 aa, Entamoeba invadens
DMRSCRVEEICIKDGYPEGTVLPLR

SEQ ID NO: 2930616 - protein, 23 aa, Entamoeba invadens
DMRVTKEWIAFGVNRYEKMIMTW

SEQ ID NO: 2930617 - protein, 17 aa, Entamoeba invadens
DMSEMKTELKALEQAAK

SEQ ID NO: 2930618 - protein, 27 aa, Entamoeba invadens
DMSLFPQSFVQFLAWQRLLQIYSKLDA

SEQ ID NO: 2930619 - protein, 23 aa, Entamoeba invadens
DMSPHWKTLVKYLCNRVGFADAL

SEQ ID NO: 2930620 - protein, 18 aa, Entamoeba invadens
DMSQEVHIGYTLEGVVVS

SEQ ID NO: 2930621 - protein, 20 aa, Entamoeba invadens
DMSSSELLEAWNETMKKLKF

SEQ ID NO: 2930622 - protein, 18 aa, Entamoeba invadens
DMTADAFGALQLATNFAA

SEQ ID NO: 2930623 - protein, 23 aa, Entamoeba invadens
DMTEETKFGLGVVGRLLVMTEGS

SEQ ID NO: 2930624 - protein, 19 aa, Entamoeba invadens
DMTQCLLFPSPYFQITPSQ

SEQ ID NO: 2930625 - protein, 28 aa, Entamoeba invadens
DMTSNFVFPTSITKIGVHNIWYGVPRKY

SEQ ID NO: 2930626 - protein, 17 aa, Entamoeba invadens
DMTTCTTLTALTLNECK

SEQ ID NO: 2930627 - protein, 24 aa, Entamoeba invadens
DMVCDVCKVSTAFIECFDCRKKFC

SEQ ID NO: 2930628 - protein, 24 aa, Entamoeba invadens
DMVGKMTELFDKWNELKVMREMAV

SEQ ID NO: 2930629 - protein, 24 aa, Entamoeba invadens
DMVKSARGKIEWNEDVEEYVNKLA

SEQ ID NO: 2930630 - protein, 21 aa, Entamoeba invadens
DMWKAVFCVCIVYHRQHVQCN

SEQ ID NO: 2930631 - protein, 29 aa, Entamoeba invadens
DMWSLGCVVAELFFGITLFAGSSEYNQLV

SEQ ID NO: 2930632 - protein, 26 aa, Entamoeba invadens
DMWSVGCIIFECLFKRPPFTGSSELE

SEQ ID NO: 2930633 - protein, 24 aa, Entamoeba invadens
DMWVGCANCSIKAIDNETLAVTEM

SEQ ID NO: 2930634 - protein, 24 aa, Entamoeba invadens
DMYIKRYLKSPIQIFDIYKESKSD

SEQ ID NO: 2930635 - protein, 25 aa, Entamoeba invadens
DMYRRSRRLICFDMDSTLIETEVID

SEQ ID NO: 2930636 - protein, 24 aa, Entamoeba invadens
DNAEAPKLPKSVIKPTNGSSGFSF

SEQ ID NO: 2930637 - protein, 19 aa, Entamoeba invadens
DNAFPKNVYVFSWTIADDV

SEQ ID NO: 2930638 - protein, 17 aa, Entamoeba invadens
DNAHWVNDKCASISKDV

SEQ ID NO: 2930639 - protein, 24 aa, Entamoeba invadens
DNAIRLFRCDPDSGILMPMLSTQL

SEQ ID NO: 2930640 - protein, 24 aa, Entamoeba invadens
DNAKRVGSLFLKDPGLLPEPQELY

SEQ ID NO: 2930641 - protein, 19 aa, Entamoeba invadens
DNALLYFVINEWKEYNENE

SEQ ID NO: 2930642 - protein, 20 aa, Entamoeba invadens
DNAVLWSWWREQLRDERTSE

SEQ ID NO: 2930643 - protein, 17 aa, Entamoeba invadens
DNCELMFERNRLEALNC

SEQ ID NO: 2930644 - protein, 21 aa, Entamoeba invadens
DNCFSCCYRLKTVNLSTQLKY

SEQ ID NO: 2930645 - protein, 17 aa, Entamoeba invadens
DNCMLRSSKWCLRCSDG

SEQ ID NO: 2930646 - protein, 18 aa, Entamoeba invadens
DNCPSLIMFEYVLEDPVL

SEQ ID NO: 2930647 - protein, 29 aa, Entamoeba invadens
DNCSIGTITECYKCRNGYILNNNNCYKED

SEQ ID NO: 2930648 - protein, 30 aa, Entamoeba invadens
DNCTLPIFHLDSRFYLDAMVTSVGNICSFF

SEQ ID NO: 2930649 - protein, 31 aa, Entamoeba invadens
DNDAIMGMKFMKEARKKEVEQLQGFVDEMNA

SEQ ID NO: 2930650 - protein, 21 aa, Entamoeba invadens
DNDIFKDLSWINLLKNTKTLI

SEQ ID NO: 2930651 - protein, 24 aa, Entamoeba invadens
DNDKFKGIAMLVCRTRKSVIKYTQ

SEQ ID NO: 2930652 - protein, 23 aa, Entamoeba invadens
DNDQLWRALLLDFLKKILEYDPA

SEQ ID NO: 2930653 - protein, 23 aa, Entamoeba invadens
DNDVYPKEIVPFVNLLEKSKSIV

SEQ ID NO: 2930654 - protein, 19 aa, Entamoeba invadens
DNEIVRFSSEWKGVSAGGC

SEQ ID NO: 2930655 - protein, 21 aa, Entamoeba invadens
DNEKPKTFTFVLESENTVFGT

SEQ ID NO: 2930656 - protein, 18 aa, Entamoeba invadens
DNELDLFIELFKSLHPTT

SEQ ID NO: 2930657 - protein, 24 aa, Entamoeba invadens
DNERKKYYFGVATFDSAQTANDVY

SEQ ID NO: 2930658 - protein, 21 aa, Entamoeba invadens
DNEVLNCLILVDYVITKQPSF

SEQ ID NO: 2930659 - protein, 23 aa, Entamoeba invadens
DNFCGPCKVPLTTPLKDMKMETL

SEQ ID NO: 2930660 - protein, 17 aa, Entamoeba invadens
DNFDWGLYTPSAFSPTD

SEQ ID NO: 2930661 - protein, 25 aa, Entamoeba invadens
DNFFCSLRLAHYLAQCGSTLLGTVR

SEQ ID NO: 2930662 - protein, 25 aa, Entamoeba invadens
DNFFCSLRLAHYLAQCGSTLLVIVR

SEQ ID NO: 2930663 - protein, 17 aa, Entamoeba invadens
DNFLLGMKFSIARFDSV

SEQ ID NO: 2930664 - protein, 17 aa, Entamoeba invadens
DNGHCKLTVEHRQYMFL

SEQ ID NO: 2930665 - protein, 25 aa, Entamoeba invadens
DNGNWIRRMYFWEGKRTNELYYTQF

SEQ ID NO: 2930666 - protein, 17 aa, Entamoeba invadens
DNHPCVVLASPGMLQDG

SEQ ID NO: 2930667 - protein, 24 aa, Entamoeba invadens
DNHRPASCDMWKKWTELLKKDGLN

SEQ ID NO: 2930668 - protein, 25 aa, Entamoeba invadens
DNIIPRFAERYVECNQSLHLSIEDV

SEQ ID NO: 2930669 - protein, 27 aa, Entamoeba invadens
DNIIYVLRFDKRFALFCSGTKSVYEAF

SEQ ID NO: 2930670 - protein, 23 aa, Entamoeba invadens
DNIKEVILFPTMRPENDAEKKER

SEQ ID NO: 2930671 - protein, 18 aa, Entamoeba invadens
DNINKLSLNDQITELNKC

SEQ ID NO: 2930672 - protein, 17 aa, Entamoeba invadens
DNIPHLLIHGGDGSGRY

SEQ ID NO: 2930673 - protein, 24 aa, Entamoeba invadens
DNIPLAGIGACFYKMNNLQEASKY

SEQ ID NO: 2930674 - protein, 17 aa, Entamoeba invadens
DNKCLKCNNCGDGNCHQ

SEQ ID NO: 2930675 - protein, 31 aa, Entamoeba invadens
DNKDVASIAICYKSRMLRDDTQTLSSINYTE

SEQ ID NO: 2930676 - protein, 27 aa, Entamoeba invadens
DNKESPCFRVSLGNLRIDSVDAAVGQS

SEQ ID NO: 2930677 - protein, 18 aa, Entamoeba invadens
DNKFLFKTHDVVPEVEDL

SEQ ID NO: 2930678 - protein, 20 aa, Entamoeba invadens
DNKKECFVTCLSDCNYTERL

SEQ ID NO: 2930679 - protein, 18 aa, Entamoeba invadens
DNKLFFNGVNSFSSLTIS

SEQ ID NO: 2930680 - protein, 20 aa, Entamoeba invadens
DNKLNCKDSVLLNERKVIRT

SEQ ID NO: 2930681 - protein, 23 aa, Entamoeba invadens
DNKLTCLLKQLFEAGYKTKEELC

SEQ ID NO: 2930682 - protein, 24 aa, Entamoeba invadens
DNKSLVRNALWFSPLTMNEMENYT

SEQ ID NO: 2930683 - protein, 23 aa, Entamoeba invadens
DNKTFFACFSAFWVDKNGKVNIN

SEQ ID NO: 2930684 - protein, 18 aa, Entamoeba invadens
DNKYRKEIFGDFEKDKEL

SEQ ID NO: 2930685 - protein, 17 aa, Entamoeba invadens
DNLAIPAPQGNRGGNTY

SEQ ID NO: 2930686 - protein, 27 aa, Entamoeba invadens
DNLAYCKACGKLEWVTRQAKKKVELAA

SEQ ID NO: 2930687 - protein, 17 aa, Entamoeba invadens
DNLEFIGNYAFNYLQIS

SEQ ID NO: 2930688 - protein, 18 aa, Entamoeba invadens
DNLESFKALSKHREKMYE

SEQ ID NO: 2930689 - protein, 24 aa, Entamoeba invadens
DNLFEVKDAFYLTNNSFKIIEKFY

SEQ ID NO: 2930690 - protein, 25 aa, Entamoeba invadens
DNLIRRECDILRQVDHPSIIKLYDV

SEQ ID NO: 2930691 - protein, 18 aa, Entamoeba invadens
DNLKRLTVIESDYVSVPE

SEQ ID NO: 2930692 - protein, 27 aa, Entamoeba invadens
DNLLPKHIYRFVGIFIYMGAHHNTKNP

SEQ ID NO: 2930693 - protein, 29 aa, Entamoeba invadens
DNLRFPNSHTLYFSVIIQMFFSANEVLAE

SEQ ID NO: 2930694 - protein, 21 aa, Entamoeba invadens
DNLRPKWLISGKMNGGTRDWR

SEQ ID NO: 2930695 - protein, 24 aa, Entamoeba invadens
DNLSFPEEFEWGSIVGSTTTCTYK

SEQ ID NO: 2930696 - protein, 20 aa, Entamoeba invadens
DNLWFPIYVSGWKPKSVSYD

SEQ ID NO: 2930697 - protein, 17 aa, Entamoeba invadens
DNMCISGATGYKFETNK

SEQ ID NO: 2930698 - protein, 18 aa, Entamoeba invadens
DNMFLPVIAEISMELKKR

SEQ ID NO: 2930699 - protein, 25 aa, Entamoeba invadens
DNMFPFGVTVSIVLDIFVNRLSKIQ

SEQ ID NO: 2930700 - protein, 25 aa, Entamoeba invadens
DNMKACAALETLACYIKFDISIVQT

SEQ ID NO: 2930701 - protein, 20 aa, Entamoeba invadens
DNMLQILDFLPRRIGDDLLK

SEQ ID NO: 2930702 - protein, 29 aa, Entamoeba invadens
DNMTLNLRFSLTFLRMLLGKRTEVEDLKV

SEQ ID NO: 2930703 - protein, 26 aa, Entamoeba invadens
DNNGYWCNMDPIAFRRITKKRSCPFR

SEQ ID NO: 2930704 - protein, 24 aa, Entamoeba invadens
DNNKLNSLLTWAFEKEVNSRGTDT

SEQ ID NO: 2930705 - protein, 31 aa, Entamoeba invadens
DNNMYLLVNGICVSLKLANPDFEDTTLSVAT

SEQ ID NO: 2930706 - protein, 18 aa, Entamoeba invadens
DNNRCVLTRVLKRNIAKN

SEQ ID NO: 2930707 - protein, 20 aa, Entamoeba invadens
DNNTACTFFRSGKPAVAIYM

SEQ ID NO: 2930708 - protein, 18 aa, Entamoeba invadens
DNNYFIWIHREPVDEIKS

SEQ ID NO: 2930709 - protein, 24 aa, Entamoeba invadens
DNPADYELVMTFAIEKLPELVINK

SEQ ID NO: 2930710 - protein, 24 aa, Entamoeba invadens
DNPMYIDYIHLMKRLINLLHYCIL

SEQ ID NO: 2930711 - protein, 24 aa, Entamoeba invadens
DNPNSLISMCYVYDLKLNGSTINT

SEQ ID NO: 2930712 - protein, 19 aa, Entamoeba invadens
DNQFPCLKSLSITNAVKII

SEQ ID NO: 2930713 - protein, 18 aa, Entamoeba invadens
DNQLEYIVLPLLSTPHQT

SEQ ID NO: 2930714 - protein, 28 aa, Entamoeba invadens
DNQLLRLLRLVSMYEIHKSTRSQSTSRQ

SEQ ID NO: 2930715 - protein, 24 aa, Entamoeba invadens
DNQRESWWLAYIMDQIEEEKSKGK

SEQ ID NO: 2930716 - protein, 31 aa, Entamoeba invadens
DNQWKEMIKLPIGFVSSCRITRFVLRNLDQV

SEQ ID NO: 2930717 - protein, 17 aa, Entamoeba invadens
DNRFEGMTIVGHIKDLE

SEQ ID NO: 2930718 - protein, 25 aa, Entamoeba invadens
DNRIPSWCDRILWKTENRHHVEVVK

SEQ ID NO: 2930719 - protein, 21 aa, Entamoeba invadens
DNRMRALKCILNIIDGVSETI

SEQ ID NO: 2930720 - protein, 17 aa, Entamoeba invadens
DNRRLCELFGIRRGTEF

SEQ ID NO: 2930721 - protein, 24 aa, Entamoeba invadens
DNRVSALLYCFEKLIQTKTMAKNE

SEQ ID NO: 2930722 - protein, 26 aa, Entamoeba invadens
DNSDWSACFSELFTTLPVVNEITPFY

SEQ ID NO: 2930723 - protein, 21 aa, Entamoeba invadens
DNSDYWGRHKAALAFLAAYTG

SEQ ID NO: 2930724 - protein, 18 aa, Entamoeba invadens
DNSFPPFLEYFLTQITSH

SEQ ID NO: 2930725 - protein, 17 aa, Entamoeba invadens
DNSHIFRFITLLNSNEI

SEQ ID NO: 2930726 - protein, 20 aa, Entamoeba invadens
DNSMVTSRIYPIVDQNTPQI

SEQ ID NO: 2930727 - protein, 25 aa, Entamoeba invadens
DNSPLRVRVCPEVKSFSTSVTSDKH

SEQ ID NO: 2930728 - protein, 18 aa, Entamoeba invadens
DNSPWEGGIFELRLTFSD

SEQ ID NO: 2930729 - protein, 21 aa, Entamoeba invadens
DNSRIPREIIIKIKEVQSDVI

SEQ ID NO: 2930730 - protein, 19 aa, Entamoeba invadens
DNTCYPVVFILLPNETEET

SEQ ID NO: 2930731 - protein, 24 aa, Entamoeba invadens
DNTHPFGICLICLEKVSTGATQLP

SEQ ID NO: 2930732 - protein, 23 aa, Entamoeba invadens
DNTKCYTDFRIFLQKMTNERLDF

SEQ ID NO: 2930733 - protein, 17 aa, Entamoeba invadens
DNTKIVVEWAKSSQIKD

SEQ ID NO: 2930734 - protein, 22 aa, Entamoeba invadens
DNTLVLYLSYFVTKETRFGSQD

SEQ ID NO: 2930735 - protein, 24 aa, Entamoeba invadens
DNTPCAIPLFDMNYFNTIQPCYVD

SEQ ID NO: 2930736 - protein, 22 aa, Entamoeba invadens
DNTRAVLLLGIGNFMKQDFLVR

SEQ ID NO: 2930737 - protein, 26 aa, Entamoeba invadens
DNTRFFKVILPYCKDAEVATHALTFV

SEQ ID NO: 2930738 - protein, 24 aa, Entamoeba invadens
DNTYPKERLDVFTEIGTYISEVND

SEQ ID NO: 2930739 - protein, 24 aa, Entamoeba invadens
DNVCPTCQMPFGRPFVVDEVLKTR

SEQ ID NO: 2930740 - protein, 25 aa, Entamoeba invadens
DNVKLYPRMFVDWVNLTSVILPNNV

SEQ ID NO: 2930741 - protein, 17 aa, Entamoeba invadens
DNVKWLVTVGHWKVATL

SEQ ID NO: 2930742 - protein, 31 aa, Entamoeba invadens
DNVPYRDAFKYCRRWLEDSLQKSVSEYKVVV

SEQ ID NO: 2930743 - protein, 19 aa, Entamoeba invadens
DNVTMLGLLAFNSFTNLCD

SEQ ID NO: 2930744 - protein, 18 aa, Entamoeba invadens
DNVTMLGLLEFNSFTNLC

SEQ ID NO: 2930745 - protein, 25 aa, Entamoeba invadens
DNWRKEKHKALIFCQTKQMLNILQK

SEQ ID NO: 2930746 - protein, 23 aa, Entamoeba invadens
DNWSRGNCVFASRVSNKSHVVVL

SEQ ID NO: 2930747 - protein, 27 aa, Entamoeba invadens
DNYAWWKGRLSQMAQYFNAYRIDHILG

SEQ ID NO: 2930748 - protein, 25 aa, Entamoeba invadens
DNYFMKFKCYSPFIDLYKRLMSDFV

SEQ ID NO: 2930749 - protein, 19 aa, Entamoeba invadens
DNYGKKWVDNTIYNTLDKA

SEQ ID NO: 2930750 - protein, 23 aa, Entamoeba invadens
DNYIKTCDGFVLMHSITSFGSFE

SEQ ID NO: 2930751 - protein, 26 aa, Entamoeba invadens
DNYKYKDLKAVVALFRQLDTQKQELS

SEQ ID NO: 2930752 - protein, 18 aa, Entamoeba invadens
DPAFLCNECFSLLHPNYD

SEQ ID NO: 2930753 - protein, 23 aa, Entamoeba invadens
DPCEPGMCGVPGTYTITLTATQR

SEQ ID NO: 2930754 - protein, 22 aa, Entamoeba invadens
DPDALQIPTYFSVIKSPMDLGT

SEQ ID NO: 2930755 - protein, 18 aa, Entamoeba invadens
DPDFKILQALVFEQNEPV

SEQ ID NO: 2930756 - protein, 22 aa, Entamoeba invadens
DPDLRWTARQALDHPFITQQPF

SEQ ID NO: 2930757 - protein, 21 aa, Entamoeba invadens
DPDSFAECVAIGKRLAEALKQ

SEQ ID NO: 2930758 - protein, 21 aa, Entamoeba invadens
DPEASGALNYYDVIKHPMDLG

SEQ ID NO: 2930759 - protein, 22 aa, Entamoeba invadens
DPECIKKNLLVDVLQNADCLRS

SEQ ID NO: 2930760 - protein, 23 aa, Entamoeba invadens
DPEEPFSALILEYLNTIKELKNE

SEQ ID NO: 2930761 - protein, 25 aa, Entamoeba invadens
DPEFLKVRKYIHLFLLKKMGKVQDL

SEQ ID NO: 2930762 - protein, 23 aa, Entamoeba invadens
DPEIYKDALIGFMLLDTREKTEK

SEQ ID NO: 2930763 - protein, 24 aa, Entamoeba invadens
DPELCCLMSNFGCCREGSVMCDPF

SEQ ID NO: 2930764 - protein, 18 aa, Entamoeba invadens
DPFVCKRPKASISATINR

SEQ ID NO: 2930765 - protein, 26 aa, Entamoeba invadens
DPGFFLFCLAGKSVLKPKKYTKKDTM

SEQ ID NO: 2930766 - protein, 24 aa, Entamoeba invadens
DPGKGAKTIYVWLGKDSNTMEKGK

SEQ ID NO: 2930767 - protein, 17 aa, Entamoeba invadens
DPGLGRRVDLFIKQIAF

SEQ ID NO: 2930768 - protein, 29 aa, Entamoeba invadens
DPHPRVRHAAIVFALKVFKLYPKTQTILS

SEQ ID NO: 2930769 - protein, 30 aa, Entamoeba invadens
DPIIPRELYPKFLACASTYYSEKFTNQNAL

SEQ ID NO: 2930770 - protein, 18 aa, Entamoeba invadens
DPILCQYDSVPSCKLDFV

SEQ ID NO: 2930771 - protein, 27 aa, Entamoeba invadens
DPIPIHVLLALMIKKFAKRNVTMAMAF

SEQ ID NO: 2930772 - protein, 26 aa, Entamoeba invadens
DPISGLYYYYSCQPNLFVEGQNVIQQ

SEQ ID NO: 2930773 - protein, 17 aa, Entamoeba invadens
DPITGKCVGCADGCQKC

SEQ ID NO: 2930774 - protein, 29 aa, Entamoeba invadens
DPKHFFFVLKRKGVSDVKKYTRKSVGYSM

SEQ ID NO: 2930775 - protein, 18 aa, Entamoeba invadens
DPKHFVFTLKNPHNIPPT

SEQ ID NO: 2930776 - protein, 22 aa, Entamoeba invadens
DPKIEIDLSCSLHNQRELLEEN

SEQ ID NO: 2930777 - protein, 25 aa, Entamoeba invadens
DPKIFSVKNYVVWYPVCYSHAKSYQ

SEQ ID NO: 2930778 - protein, 22 aa, Entamoeba invadens
DPKKRIFHFSTNYTTCVELTGD

SEQ ID NO: 2930779 - protein, 27 aa, Entamoeba invadens
DPKRSCKACVFNNFIPGYDCKIADATL

SEQ ID NO: 2930780 - protein, 26 aa, Entamoeba invadens
DPKYSHPKFMVFEVFPVAPPAVRPQA

SEQ ID NO: 2930781 - protein, 25 aa, Entamoeba invadens
DPKYWKRHSPVLFPIVGSLWGGKYT

SEQ ID NO: 2930782 - protein, 19 aa, Entamoeba invadens
DPLFDFSRTYIFLTQNNYI

SEQ ID NO: 2930783 - protein, 18 aa, Entamoeba invadens
DPLFGPVIVFGMGGVTVE

SEQ ID NO: 2930784 - protein, 25 aa, Entamoeba invadens
DPLKRREMFFKILLGVDTYESGELN

SEQ ID NO: 2930785 - protein, 19 aa, Entamoeba invadens
DPLLFIFTLFKIRRIQIKI

SEQ ID NO: 2930786 - protein, 18 aa, Entamoeba invadens
DPLPRVVPVKVQIERKER

SEQ ID NO: 2930787 - protein, 23 aa, Entamoeba invadens
DPLSIRPSCVVPTISKNQTPSQD

SEQ ID NO: 2930788 - protein, 22 aa, Entamoeba invadens
DPLTELCRLITMPLTLDIVKMK

SEQ ID NO: 2930789 - protein, 17 aa, Entamoeba invadens
DPLWRVTDIFSQNKYFL

SEQ ID NO: 2930790 - protein, 24 aa, Entamoeba invadens
DPMFCVSLPKKARTDCGINVLVHV

SEQ ID NO: 2930791 - protein, 18 aa, Entamoeba invadens
DPMFDPRFDGRFDRNYDA

SEQ ID NO: 2930792 - protein, 21 aa, Entamoeba invadens
DPMIRKAYYLYSLPIVVNDNV

SEQ ID NO: 2930793 - protein, 19 aa, Entamoeba invadens
DPMSKHVIVQTLIRAFEKS

SEQ ID NO: 2930794 - protein, 18 aa, Entamoeba invadens
DPNCETDILMVLKASKIG

SEQ ID NO: 2930795 - protein, 19 aa, Entamoeba invadens
DPNEVLKCRTDYSKEMHVA

SEQ ID NO: 2930796 - protein, 20 aa, Entamoeba invadens
DPNKLRYHRIIIMTDADVDG

SEQ ID NO: 2930797 - protein, 24 aa, Entamoeba invadens
DPPELGNFVEWIFWYINTKQEWRT

SEQ ID NO: 2930798 - protein, 20 aa, Entamoeba invadens
DPPELLKKMKIEVNMRKIGL

SEQ ID NO: 2930799 - protein, 27 aa, Entamoeba invadens
DPPKCPKCGALMKLDVVLFGEKLDRKI

SEQ ID NO: 2930800 - protein, 25 aa, Entamoeba invadens
DPPLLSRFDIILIMLDERNQQWDER

SEQ ID NO: 2930801 - protein, 18 aa, Entamoeba invadens
DPPLRALFQISTKGVPPI

SEQ ID NO: 2930802 - protein, 21 aa, Entamoeba invadens
DPPSKVCVFCKTFDNKCETCQ

SEQ ID NO: 2930803 - protein, 25 aa, Entamoeba invadens
DPQIKEGYKFVGKCTIGDKTVYVTL

SEQ ID NO: 2930804 - protein, 25 aa, Entamoeba invadens
DPQIRADLALKCLDLQAAFEACKSL

SEQ ID NO: 2930805 - protein, 19 aa, Entamoeba invadens
DPQIRKIILTAFNSGEKVA

SEQ ID NO: 2930806 - protein, 29 aa, Entamoeba invadens
DPQIRRAAIECWDVVAITVKEYALTLDNP

SEQ ID NO: 2930807 - protein, 26 aa, Entamoeba invadens
DPQKGSIVYKGINAMQQYTNTTPLEL

SEQ ID NO: 2930808 - protein, 23 aa, Entamoeba invadens
DPQLCWQDERFVELQMEKCKLHT

SEQ ID NO: 2930809 - protein, 23 aa, Entamoeba invadens
DPQLCYCLDSFRVESVFYTPRFL

SEQ ID NO: 2930810 - protein, 18 aa, Entamoeba invadens
DPQLKNFLLKLIKTQHFN

SEQ ID NO: 2930811 - protein, 19 aa, Entamoeba invadens
DPQPRVSFTAPQTPNPQLF

SEQ ID NO: 2930812 - protein, 19 aa, Entamoeba invadens
DPQQRPSIDDLLKEFTQLI

SEQ ID NO: 2930813 - protein, 18 aa, Entamoeba invadens
DPQQYAAYAAAYQQQQQS

SEQ ID NO: 2930814 - protein, 33 aa, Entamoeba invadens
DPQSKKKVVCFLCGESHLFKDCPHKTEEMYKDK

SEQ ID NO: 2930815 - protein, 21 aa, Entamoeba invadens
DPQTFSTLFVFSFSSNLDIGE

SEQ ID NO: 2930816 - protein, 24 aa, Entamoeba invadens
DPRCDMYTFALLVTKIWTDKLPYR

SEQ ID NO: 2930817 - protein, 17 aa, Entamoeba invadens
DPRELRSNISCKDRLIF

SEQ ID NO: 2930818 - protein, 19 aa, Entamoeba invadens
DPRIFTSHFNHVFIMVQPI

SEQ ID NO: 2930819 - protein, 25 aa, Entamoeba invadens
DPRIGCCMNGHQCCLTTNKNYILTP

SEQ ID NO: 2930820 - protein, 20 aa, Entamoeba invadens
DPRIYVWRTEKRRRYILGEL

SEQ ID NO: 2930821 - protein, 24 aa, Entamoeba invadens
DPRPPEQRLPLYATDNDAYEFVVK

SEQ ID NO: 2930822 - protein, 29 aa, Entamoeba invadens
DPRQIEFSKLIPGISCVSTRSGELFYSER

SEQ ID NO: 2930823 - protein, 24 aa, Entamoeba invadens
DPSAGLLKLCLKAINVSGVKQYLV

SEQ ID NO: 2930824 - protein, 23 aa, Entamoeba invadens
DPSEIEFVKPLTPSKVTFLVNTN

SEQ ID NO: 2930825 - protein, 28 aa, Entamoeba invadens
DPSELSRAFSVPMQSNFISPFMTPESAN

SEQ ID NO: 2930826 - protein, 18 aa, Entamoeba invadens
DPSEVARQLTLVISNLYQ

SEQ ID NO: 2930827 - protein, 33 aa, Entamoeba invadens
DPSLSIKPHTCYKFAVFNLGCNESVNIANAEDL

SEQ ID NO: 2930828 - protein, 23 aa, Entamoeba invadens
DPSNWRYAKMRSRIDEYSEKCEM

SEQ ID NO: 2930829 - protein, 34 aa, Entamoeba invadens
DPSSRGSKTFFQRITQCFSGFVVVVEHENDVFGA

SEQ ID NO: 2930830 - protein, 24 aa, Entamoeba invadens
DPSTTILLKLEFFNPLSSVKDRVA

SEQ ID NO: 2930831 - protein, 25 aa, Entamoeba invadens
DPSVKWQVPDSFSFAYKELKDEIYI

SEQ ID NO: 2930832 - protein, 24 aa, Entamoeba invadens
DPTFESYFFTKACFDKPDKIKLFE

SEQ ID NO: 2930833 - protein, 19 aa, Entamoeba invadens
DPTFIRALFESGPYKEYLK

SEQ ID NO: 2930834 - protein, 26 aa, Entamoeba invadens
DPTFYLFRWLSLLGALELPMEVTMQM

SEQ ID NO: 2930835 - protein, 24 aa, Entamoeba invadens
DPTGSWRCVVKVPETKEKISTVEV

SEQ ID NO: 2930836 - protein, 21 aa, Entamoeba invadens
DPTIPAALGMVMKAITYGKPK

SEQ ID NO: 2930837 - protein, 17 aa, Entamoeba invadens
DPTMFVFYSTLLTNVMV

SEQ ID NO: 2930838 - protein, 19 aa, Entamoeba invadens
DPTNVLGLYVYGRILADSK

SEQ ID NO: 2930839 - protein, 24 aa, Entamoeba invadens
DPTRLQLYLDRLEFEGNNLNIEKT

SEQ ID NO: 2930840 - protein, 26 aa, Entamoeba invadens
DPTSFKLTPNFSIYPQFMFHLRRSHF

SEQ ID NO: 2930841 - protein, 20 aa, Entamoeba invadens
DPTYEDVRRLCLTFRRMADS

SEQ ID NO: 2930842 - protein, 23 aa, Entamoeba invadens
DPVLPLFLANSISSKDKTIKDLS

SEQ ID NO: 2930843 - protein, 21 aa, Entamoeba invadens
DPVLVRQILKTVYENYLDDEI

SEQ ID NO: 2930844 - protein, 24 aa, Entamoeba invadens
DPVPNVRIHLCHAIHLIASKYPQI

SEQ ID NO: 2930845 - protein, 17 aa, Entamoeba invadens
DPVYGWTVYNVVLSKTD

SEQ ID NO: 2930846 - protein, 21 aa, Entamoeba invadens
DPWYEFRAVVYKDNLTALTQY

SEQ ID NO: 2930847 - protein, 25 aa, Entamoeba invadens
DPYDRTPLELSMVIPLPELKKKIDT

SEQ ID NO: 2930848 - protein, 26 aa, Entamoeba invadens
DPYLDKQFKFAWDIVDCVVSGKRLKR

SEQ ID NO: 2930849 - protein, 22 aa, Entamoeba invadens
DPYLRGKLFVKVSSALFNEKAK

SEQ ID NO: 2930850 - protein, 26 aa, Entamoeba invadens
DPYVGKTCFFQRFSAGEFNANTKTSI

SEQ ID NO: 2930851 - protein, 26 aa, Entamoeba invadens
DPYYFKRCLISAVALLKIVMHAKQGE

SEQ ID NO: 2930852 - protein, 23 aa, Entamoeba invadens
DQAMFWKERMDTFGVNLKNVRAL

SEQ ID NO: 2930853 - protein, 19 aa, Entamoeba invadens
DQANALNWFNTQQKVEKVE

SEQ ID NO: 2930854 - protein, 17 aa, Entamoeba invadens
DQCTSMRALKVMDCTFK

SEQ ID NO: 2930855 - protein, 21 aa, Entamoeba invadens
DQCWELFCLEHGINPDGTCTQ

SEQ ID NO: 2930856 - protein, 19 aa, Entamoeba invadens
DQECAKALVEFGVVDKFRV

SEQ ID NO: 2930857 - protein, 26 aa, Entamoeba invadens
DQEPPHIMKSFRFLLEDDTNKNKSDG

SEQ ID NO: 2930858 - protein, 18 aa, Entamoeba invadens
DQFFTINLEQDFDIEILY

SEQ ID NO: 2930859 - protein, 17 aa, Entamoeba invadens
DQFPEWALLPKTSEELM

SEQ ID NO: 2930860 - protein, 20 aa, Entamoeba invadens
DQFVLLKIITFLYCVTHNSP

SEQ ID NO: 2930861 - protein, 26 aa, Entamoeba invadens
DQFWKCSKCGKVFWVGSQTKNIVASF

SEQ ID NO: 2930862 - protein, 26 aa, Entamoeba invadens
DQFYVKGDAFILVYSIDNLNSFHSLN

SEQ ID NO: 2930863 - protein, 25 aa, Entamoeba invadens
DQGELWKFLDLEKSSLFEGLKDRYK

SEQ ID NO: 2930864 - protein, 18 aa, Entamoeba invadens
DQHAGLLAQIGWTEDDYF

SEQ ID NO: 2930865 - protein, 25 aa, Entamoeba invadens
DQIDRFNKLIQHHQLVNGAGEMPQQ

SEQ ID NO: 2930866 - protein, 18 aa, Entamoeba invadens
DQIGCGFGIRPFHQPYYG

SEQ ID NO: 2930867 - protein, 23 aa, Entamoeba invadens
DQIKYFFYRKGVVNEEEMLKILL

SEQ ID NO: 2930868 - protein, 23 aa, Entamoeba invadens
DQIVRRWKMSKVTRLEHLEKIQL

SEQ ID NO: 2930869 - protein, 26 aa, Entamoeba invadens
DQIYQLEAFYRKQIDTLNNEKSQYIV

SEQ ID NO: 2930870 - protein, 24 aa, Entamoeba invadens
DQKELPFFSGFVEKSSQCVSLNGY

SEQ ID NO: 2930871 - protein, 17 aa, Entamoeba invadens
DQKFSFKVDRYSEVHGI

SEQ ID NO: 2930872 - protein, 27 aa, Entamoeba invadens
DQKFSYELFNILPLSFFHEYLRGQNIL

SEQ ID NO: 2930873 - protein, 25 aa, Entamoeba invadens
DQKILFLHDFFELMRDLHAKNIVHR

SEQ ID NO: 2930874 - protein, 24 aa, Entamoeba invadens
DQLCSIEFPPLINTLRSYCCYKCA

SEQ ID NO: 2930875 - protein, 20 aa, Entamoeba invadens
DQLEAWTGKKVGCVIFDTNS

SEQ ID NO: 2930876 - protein, 20 aa, Entamoeba invadens
DQLERISRIVLYDPPFDLTL

SEQ ID NO: 2930877 - protein, 18 aa, Entamoeba invadens
DQLFIYKYLQNVHLTLDK

SEQ ID NO: 2930878 - protein, 22 aa, Entamoeba invadens
DQLIRAKALFDFDIPQTLHNKR

SEQ ID NO: 2930879 - protein, 20 aa, Entamoeba invadens
DQLKEFFETVELMKQDKSKE

SEQ ID NO: 2930880 - protein, 20 aa, Entamoeba invadens
DQLKEFFETVELTKQEKSKE

SEQ ID NO: 2930881 - protein, 27 aa, Entamoeba invadens
DQLKRLVSNGIRYDHIVKCGGKPKEKI

SEQ ID NO: 2930882 - protein, 28 aa, Entamoeba invadens
DQLKVSRILLAYIIRVGVYIRKRKVLCS

SEQ ID NO: 2930883 - protein, 21 aa, Entamoeba invadens
DQLLLEMCNAIAINCKVENDL

SEQ ID NO: 2930884 - protein, 27 aa, Entamoeba invadens
DQLLRLRCLPHLRYLNLKKVQVGFDPS

SEQ ID NO: 2930885 - protein, 23 aa, Entamoeba invadens
DQLRHWCAVRCSLDIQEITQLKD

SEQ ID NO: 2930886 - protein, 18 aa, Entamoeba invadens
DQLSFGMVRAQTLSVPED

SEQ ID NO: 2930887 - protein, 24 aa, Entamoeba invadens
DQLVPRLSWLCLVLSEIQANGPPL

SEQ ID NO: 2930888 - protein, 18 aa, Entamoeba invadens
DQLYTFFISHFFNSKTKF

SEQ ID NO: 2930889 - protein, 18 aa, Entamoeba invadens
DQMGCGFGIRPFHQPYYG

SEQ ID NO: 2930890 - protein, 19 aa, Entamoeba invadens
DQMYGRRAFIHHYAEFGME

SEQ ID NO: 2930891 - protein, 23 aa, Entamoeba invadens
DQNESWECFDIEKVLSEMEESEK

SEQ ID NO: 2930892 - protein, 24 aa, Entamoeba invadens
DQNRAFGFGQTRPMFFQNQHTQLF

SEQ ID NO: 2930893 - protein, 23 aa, Entamoeba invadens
DQNTCVIVPSLVFYIEIKLSGTT

SEQ ID NO: 2930894 - protein, 25 aa, Entamoeba invadens
DQNYIEFERCLKYYLISKTHPEYTR

SEQ ID NO: 2930895 - protein, 20 aa, Entamoeba invadens
DQPARVGISIADIAAGMYAY

SEQ ID NO: 2930896 - protein, 19 aa, Entamoeba invadens
DQPFSMACRYCFMPIGGNE

SEQ ID NO: 2930897 - protein, 19 aa, Entamoeba invadens
DQPLDLMVIIVTKTDLGHD

SEQ ID NO: 2930898 - protein, 19 aa, Entamoeba invadens
DQPNVRLDYIFGVSDNTER

SEQ ID NO: 2930899 - protein, 19 aa, Entamoeba invadens
DQPTRVWGYIPVKGDNPSY

SEQ ID NO: 2930900 - protein, 22 aa, Entamoeba invadens
DQQRPKKVCRIPEREDNRTYRT

SEQ ID NO: 2930901 - protein, 35 aa, Entamoeba invadens
DQRFEALILCFLRFVEVFKIYAFFINNHQKSHKMI

SEQ ID NO: 2930902 - protein, 19 aa, Entamoeba invadens
DQRSGTMLRAPDRVERRYD

SEQ ID NO: 2930903 - protein, 24 aa, Entamoeba invadens
DQRVEGDRLFKMEVENKIRMEHDM

SEQ ID NO: 2930904 - protein, 25 aa, Entamoeba invadens
DQSDRRWKTNAPASVAQEEEKNMLN

SEQ ID NO: 2930905 - protein, 25 aa, Entamoeba invadens
DQSFKGTLCYAALNIHFGKSPSRAD

SEQ ID NO: 2930906 - protein, 19 aa, Entamoeba invadens
DQSGCYRRVLCFCDSNTRD

SEQ ID NO: 2930907 - protein, 30 aa, Entamoeba invadens
DQSLRLATMEFVKFLKGLVSNSQFLLSPVD

SEQ ID NO: 2930908 - protein, 22 aa, Entamoeba invadens
DQSLRLWDLEKFESTKRFVGHE

SEQ ID NO: 2930909 - protein, 23 aa, Entamoeba invadens
DQSVPWYLQHVQFVKYEKKQESV

SEQ ID NO: 2930910 - protein, 27 aa, Entamoeba invadens
DQTFAISFMGTELWKDIVAAIQEEHDK

SEQ ID NO: 2930911 - protein, 23 aa, Entamoeba invadens
DQTFPRCFNFIDAIFEDGGAVLI

SEQ ID NO: 2930912 - protein, 23 aa, Entamoeba invadens
DQTKRPNIYSVLQLIAKTIEFNN

SEQ ID NO: 2930913 - protein, 25 aa, Entamoeba invadens
DQTLKISYFNARFVSKEIRDLMNER

SEQ ID NO: 2930914 - protein, 25 aa, Entamoeba invadens
DQVCVLFKEFCCIIKTGRSVVLKTT

SEQ ID NO: 2930915 - protein, 25 aa, Entamoeba invadens
DQVEMKIPLGKEGVLVLQLNRVREL

SEQ ID NO: 2930916 - protein, 19 aa, Entamoeba invadens
DQVGFLFTHTEYMTPHSIA

SEQ ID NO: 2930917 - protein, 27 aa, Entamoeba invadens
DQVRVMGANCLIDLYLLSHKKVTNEIR

SEQ ID NO: 2930918 - protein, 18 aa, Entamoeba invadens
DQVTEIKTTISLEEIIAK

SEQ ID NO: 2930919 - protein, 23 aa, Entamoeba invadens
DQVVALDCQLCYDEKDKECWGYS

SEQ ID NO: 2930920 - protein, 25 aa, Entamoeba invadens
DQWSTKDTKSFFVIGKMLWNVNEEC

SEQ ID NO: 2930921 - protein, 28 aa, Entamoeba invadens
DQYIKCGSCFIIIYSIDSLKSFEVAKTS

SEQ ID NO: 2930922 - protein, 17 aa, Entamoeba invadens
DQYLHRFAAYFQQGDME

SEQ ID NO: 2930923 - protein, 18 aa, Entamoeba invadens
DQYLKCFEQSLVRPSGDI

SEQ ID NO: 2930924 - protein, 31 aa, Entamoeba invadens
DRAHLELAYLPRFFLGAFKAFVNLSAVNNVN

SEQ ID NO: 2930925 - protein, 26 aa, Entamoeba invadens
DRALHLWDIRCGKGKFAEMKPHKSGV

SEQ ID NO: 2930926 - protein, 20 aa, Entamoeba invadens
DRCFKVEKILGNTSLNDGQA

SEQ ID NO: 2930927 - protein, 21 aa, Entamoeba invadens
DRCPVCRGAKVVNEEKILEVI

SEQ ID NO: 2930928 - protein, 17 aa, Entamoeba invadens
DRCTITSISSSACAISD

SEQ ID NO: 2930929 - protein, 28 aa, Entamoeba invadens
DRDERLLSCFSAFWVFKDGNVIINPDVK

SEQ ID NO: 2930930 - protein, 34 aa, Entamoeba invadens
DRDHYICIICFKRMSRGYACYHCIEEHQNITDDM

SEQ ID NO: 2930931 - protein, 21 aa, Entamoeba invadens
DRDIPEEGAFVLHRQQHEFLF

SEQ ID NO: 2930932 - protein, 17 aa, Entamoeba invadens
DRDPFALIYGEEAKKNE

SEQ ID NO: 2930933 - protein, 25 aa, Entamoeba invadens
DREFYKDKYFVDGFDFAKDYTDIID

SEQ ID NO: 2930934 - protein, 30 aa, Entamoeba invadens
DREHIRFLVCIDFLNAKKCRGLPVQQISAY

SEQ ID NO: 2930935 - protein, 25 aa, Entamoeba invadens
DREICKDIKENLCYVAGDYMDELQK

SEQ ID NO: 2930936 - protein, 25 aa, Entamoeba invadens
DRERRYEKRFPPREQRYMDRPQEKR

SEQ ID NO: 2930937 - protein, 23 aa, Entamoeba invadens
DRFKYPWKIAEFVMSGKRLERKE

SEQ ID NO: 2930938 - protein, 18 aa, Entamoeba invadens
DRFLVLACDGVFDFLSNE

SEQ ID NO: 2930939 - protein, 17 aa, Entamoeba invadens
DRFVLREVLYTSKTGTV

SEQ ID NO: 2930940 - protein, 30 aa, Entamoeba invadens
DRGDMKIMMYKRPFDGLSHLEHYINKVNGL

SEQ ID NO: 2930941 - protein, 18 aa, Entamoeba invadens
DRGKIVWDTIYKTFQEIQ

SEQ ID NO: 2930942 - protein, 24 aa, Entamoeba invadens
DRIEEILIPLGLTRLFFADCKYLK

SEQ ID NO: 2930943 - protein, 20 aa, Entamoeba invadens
DRIESCTFYRCHNLRSITLP

SEQ ID NO: 2930944 - protein, 17 aa, Entamoeba invadens
DRIHLLRGNHECRLMTS

SEQ ID NO: 2930945 - protein, 38 aa, Entamoeba invadens
DRIKESPKFDVTWNLLPFLCSRWQMPIPSVPFEKLAAA

SEQ ID NO: 2930946 - protein, 21 aa, Entamoeba invadens
DRIKTHFGLGVIDKSDIVTPE

SEQ ID NO: 2930947 - protein, 17 aa, Entamoeba invadens
DRIKTRISAVEVVSNFC

SEQ ID NO: 2930948 - protein, 17 aa, Entamoeba invadens
DRIKVGDVIGMLTKSDD

SEQ ID NO: 2930949 - protein, 21 aa, Entamoeba invadens
DRIPIYIAKTVHKSVYLSKST

SEQ ID NO: 2930950 - protein, 19 aa, Entamoeba invadens
DRIVYGCVNISRIEIPTTV

SEQ ID NO: 2930951 - protein, 21 aa, Entamoeba invadens
DRKAFCFKTQQGVFVTPTVIE

SEQ ID NO: 2930952 - protein, 22 aa, Entamoeba invadens
DRKCLSCASPYFVGINGTSCGN

SEQ ID NO: 2930953 - protein, 25 aa, Entamoeba invadens
DRKEFSNGGSIKFLVTKGSAKSQTI

SEQ ID NO: 2930954 - protein, 19 aa, Entamoeba invadens
DRKFKLIDFGSAIEENALI

SEQ ID NO: 2930955 - protein, 23 aa, Entamoeba invadens
DRKIPFLGINCGNVGFLINSIEE

SEQ ID NO: 2930956 - protein, 20 aa, Entamoeba invadens
DRKIVEAFLLKLPASAEAKN

SEQ ID NO: 2930957 - protein, 21 aa, Entamoeba invadens
DRKKALIVVSMIDIENTKEIG

SEQ ID NO: 2930958 - protein, 22 aa, Entamoeba invadens
DRKRFGCDIPKNVKRLGERCFA

SEQ ID NO: 2930959 - protein, 22 aa, Entamoeba invadens
DRKRRMVDCLTNDAFINILQET

SEQ ID NO: 2930960 - protein, 20 aa, Entamoeba invadens
DRKTAIYRQAFNQLTDKTLV

SEQ ID NO: 2930961 - protein, 20 aa, Entamoeba invadens
DRKVALYGYVRGTNMRIGSK

SEQ ID NO: 2930962 - protein, 19 aa, Entamoeba invadens
DRKVLCEDQKAFVFEETCN

SEQ ID NO: 2930963 - protein, 17 aa, Entamoeba invadens
DRLELILEYVKRYVSSL

SEQ ID NO: 2930964 - protein, 18 aa, Entamoeba invadens
DRLGCGMFGQVFKAKDLS

SEQ ID NO: 2930965 - protein, 24 aa, Entamoeba invadens
DRLGRKAFYGALGVVMQNKYLILY

SEQ ID NO: 2930966 - protein, 22 aa, Entamoeba invadens
DRLKHLELMNSFIETFKDYFEV

SEQ ID NO: 2930967 - protein, 23 aa, Entamoeba invadens
DRLKTVPYFACISAMTEEGIDAL

SEQ ID NO: 2930968 - protein, 26 aa, Entamoeba invadens
DRLLKIRYVVELDKFKFFEIDKPKAV

SEQ ID NO: 2930969 - protein, 19 aa, Entamoeba invadens
DRLLLGIVYHICKIDNIGL

SEQ ID NO: 2930970 - protein, 20 aa, Entamoeba invadens
DRLLQCPWINRTLLNIEKEI

SEQ ID NO: 2930971 - protein, 18 aa, Entamoeba invadens
DRLLTANMLFSGKNHLPN

SEQ ID NO: 2930972 - protein, 21 aa, Entamoeba invadens
DRLNKSYAFFDFRKSGTIKEL

SEQ ID NO: 2930973 - protein, 17 aa, Entamoeba invadens
DRLNNRIFFDYTANGVY

SEQ ID NO: 2930974 - protein, 20 aa, Entamoeba invadens
DRLQSVLMRGHRPFDGLISL

SEQ ID NO: 2930975 - protein, 21 aa, Entamoeba invadens
DRLRMAERIGHKFEEEKKPVA

SEQ ID NO: 2930976 - protein, 24 aa, Entamoeba invadens
DRLRRKREEAKRMREDGLTVADPT

SEQ ID NO: 2930977 - protein, 17 aa, Entamoeba invadens
DRLSFTLVMNATDYVGR

SEQ ID NO: 2930978 - protein, 17 aa, Entamoeba invadens
DRLSLILECPEKNDEPI

SEQ ID NO: 2930979 - protein, 19 aa, Entamoeba invadens
DRMGELKALLNNYSELIKV

SEQ ID NO: 2930980 - protein, 18 aa, Entamoeba invadens
DRMIEGFLIEQIDAANDI

SEQ ID NO: 2930981 - protein, 19 aa, Entamoeba invadens
DRMIRGAINIPNRDGYFVS

SEQ ID NO: 2930982 - protein, 25 aa, Entamoeba invadens
DRMKITCSLAKIVIKDLEKKGLIKA

SEQ ID NO: 2930983 - protein, 20 aa, Entamoeba invadens
DRMKVLEIIEVFFSEEYDLK

SEQ ID NO: 2930984 - protein, 22 aa, Entamoeba invadens
DRNQFPILVFELLTFLFNCVET

SEQ ID NO: 2930985 - protein, 27 aa, Entamoeba invadens
DRNYHAICGIVFAFIRIKEMDSFKNKL

SEQ ID NO: 2930986 - protein, 20 aa, Entamoeba invadens
DRPADSLVELDIDFKNTNRP

SEQ ID NO: 2930987 - protein, 24 aa, Entamoeba invadens
DRPRSLMSAFRFVNNRNYSVIPPF

SEQ ID NO: 2930988 - protein, 18 aa, Entamoeba invadens
DRPSTCVPPHISAQRFVA

SEQ ID NO: 2930989 - protein, 21 aa, Entamoeba invadens
DRPTCSIELLPDVADDPSQYS

SEQ ID NO: 2930990 - protein, 21 aa, Entamoeba invadens
DRQILAMPMFDSNGIRRPFTN

SEQ ID NO: 2930991 - protein, 20 aa, Entamoeba invadens
DRQLHCVHIIDMKSGSVRAF

SEQ ID NO: 2930992 - protein, 25 aa, Entamoeba invadens
DRQRFFCVIFWYPVSYSTTRKYTNE

SEQ ID NO: 2930993 - protein, 28 aa, Entamoeba invadens
DRQRMEKELALAKACMKKGDKTGASQHL

SEQ ID NO: 2930994 - protein, 19 aa, Entamoeba invadens
DRRAVAISVIEKIKKESGH

SEQ ID NO: 2930995 - protein, 24 aa, Entamoeba invadens
DRSAYVVKIVEDFCENMSKVFKYE

SEQ ID NO: 2930996 - protein, 27 aa, Entamoeba invadens
DRSPLFLSCFSAFWVRKSGDINFNLCF

SEQ ID NO: 2930997 - protein, 24 aa, Entamoeba invadens
DRSQKRITLIAGIFTNNTTLKPMI

SEQ ID NO: 2930998 - protein, 24 aa, Entamoeba invadens
DRSRHFSPDFPRSFSNDRTVFSQR

SEQ ID NO: 2930999 - protein, 20 aa, Entamoeba invadens
DRTIKDLPLFFVSNTTTITG

SEQ ID NO: 2931000 - protein, 23 aa, Entamoeba invadens
DRTKLDCTIPLILDANELYNVII

SEQ ID NO: 2931001 - protein, 26 aa, Entamoeba invadens
DRTKLKEMIRLFLFDGKKYEVEKIKI

SEQ ID NO: 2931002 - protein, 19 aa, Entamoeba invadens
DRTLCYSEIVPTPEVNAVK

SEQ ID NO: 2931003 - protein, 25 aa, Entamoeba invadens
DRTVCVRSGTKFGEEECLIVDDKNG

SEQ ID NO: 2931004 - protein, 22 aa, Entamoeba invadens
DRVFSCKSCLLLKRDYYYIFSD

SEQ ID NO: 2931005 - protein, 20 aa, Entamoeba invadens
DRVKEVLNLDSKVERITTEY

SEQ ID NO: 2931006 - protein, 17 aa, Entamoeba invadens
DRVSGDVFYLRRNGFHY

SEQ ID NO: 2931007 - protein, 27 aa, Entamoeba invadens
DRVSKYCKVKCLYPFLENQVVRVIRNI

SEQ ID NO: 2931008 - protein, 24 aa, Entamoeba invadens
DRYIPGMYLRYVVGAKSDLQERVY

SEQ ID NO: 2931009 - protein, 23 aa, Entamoeba invadens
DRYIPRMYLRYVVGTKSDLQERV

SEQ ID NO: 2931010 - protein, 24 aa, Entamoeba invadens
DRYISEETVELVISPPELQKLEKV

SEQ ID NO: 2931011 - protein, 18 aa, Entamoeba invadens
DRYKCIQTLFKLSLGLIR

SEQ ID NO: 2931012 - protein, 31 aa, Entamoeba invadens
DSADGTKRWNRSVVDMGYEILVVSQFTLYAI

SEQ ID NO: 2931013 - protein, 24 aa, Entamoeba invadens
DSAEVAICDNVMCRIGAGDDIVQG

SEQ ID NO: 2931014 - protein, 28 aa, Entamoeba invadens
DSALIFFRKHIKKICALSKTRFYIVTDF

SEQ ID NO: 2931015 - protein, 31 aa, Entamoeba invadens
DSAMLVWDLKKQICEDFSRDPAAVVLQTDGK

SEQ ID NO: 2931016 - protein, 25 aa, Entamoeba invadens
DSAVRCVNCGLVVHAKKCEEKLKKK

SEQ ID NO: 2931017 - protein, 24 aa, Entamoeba invadens
DSCAKTAVCSKVINLNVSKSELTS

SEQ ID NO: 2931018 - protein, 24 aa, Entamoeba invadens
DSCFSNCAALSKISLQNFVQIIGG

SEQ ID NO: 2931019 - protein, 20 aa, Entamoeba invadens
DSCFYKCFSLTGVCLPTNIT

SEQ ID NO: 2931020 - protein, 17 aa, Entamoeba invadens
DSCSFLPQSRYVVISAL

SEQ ID NO: 2931021 - protein, 27 aa, Entamoeba invadens
DSCSLYPIAIHMLKLASGKPIFIPQET

SEQ ID NO: 2931022 - protein, 17 aa, Entamoeba invadens
DSDAEYLEFRRYQEYLI

SEQ ID NO: 2931023 - protein, 21 aa, Entamoeba invadens
DSDIGRFFLCHGGLSPDLDVI

SEQ ID NO: 2931024 - protein, 24 aa, Entamoeba invadens
DSDILRFKRHMMKLSPQGILRVID

SEQ ID NO: 2931025 - protein, 24 aa, Entamoeba invadens
DSDVGKSAILHRFIEGTFTDGEKP

SEQ ID NO: 2931026 - protein, 35 aa, Entamoeba invadens
DSDVYKWAVKLDKMFDGFWKLAFDDKKVVVEKKMV

SEQ ID NO: 2931027 - protein, 25 aa, Entamoeba invadens
DSEAQCLLASCYEYGKGVSVDKQLS

SEQ ID NO: 2931028 - protein, 18 aa, Entamoeba invadens
DSEDLAALYSRLGQLENS

SEQ ID NO: 2931029 - protein, 23 aa, Entamoeba invadens
DSEIKLLFLHVFAICAQETDVQT

SEQ ID NO: 2931030 - protein, 21 aa, Entamoeba invadens
DSEKFLKNFHHFANDFQTIMN

SEQ ID NO: 2931031 - protein, 28 aa, Entamoeba invadens
DSELLKYTGYFMYYRFVGQYITATETGQ

SEQ ID NO: 2931032 - protein, 23 aa, Entamoeba invadens
DSEMFLYHMFKLHMMIIHAIVRM

SEQ ID NO: 2931033 - protein, 18 aa, Entamoeba invadens
DSEMKKWKDTVTIKNEVI

SEQ ID NO: 2931034 - protein, 17 aa, Entamoeba invadens
DSESAIFKNSFRSSVGK

SEQ ID NO: 2931035 - protein, 24 aa, Entamoeba invadens
DSETLKALVNRGVATTNVKYGYSY

SEQ ID NO: 2931036 - protein, 23 aa, Entamoeba invadens
DSFCFKNCKSLVRVGFKGNGTII

SEQ ID NO: 2931037 - protein, 20 aa, Entamoeba invadens
DSFEDLYFTIALFKKINTLN

SEQ ID NO: 2931038 - protein, 21 aa, Entamoeba invadens
DSFEQCGFCNIDKVVFDVKKI

SEQ ID NO: 2931039 - protein, 20 aa, Entamoeba invadens
DSFICIPHFAAPDHFLFAAV

SEQ ID NO: 2931040 - protein, 26 aa, Entamoeba invadens
DSFLEIENYFSLRYDNRIFLYENEIN

SEQ ID NO: 2931041 - protein, 19 aa, Entamoeba invadens
DSFQSGRFVQGLILELIFT

SEQ ID NO: 2931042 - protein, 24 aa, Entamoeba invadens
DSFRKLQNGGIFWVRAPQDKGDKL

SEQ ID NO: 2931043 - protein, 29 aa, Entamoeba invadens
DSFRNFIIRFGDLDWLIANVEIYPSVNVF

SEQ ID NO: 2931044 - protein, 26 aa, Entamoeba invadens
DSFTHALKYDRYLRVGYTEEDCGDVV

SEQ ID NO: 2931045 - protein, 26 aa, Entamoeba invadens
DSFVEAFTWLIAHDVLIRVRKYLYCI

SEQ ID NO: 2931046 - protein, 21 aa, Entamoeba invadens
DSFVLIFSITSRKSFEQIPTL

SEQ ID NO: 2931047 - protein, 23 aa, Entamoeba invadens
DSGCGKTSLVQRLSKGTFNETQQ

SEQ ID NO: 2931048 - protein, 18 aa, Entamoeba invadens
DSGDFFKPFASFYTAYEK

SEQ ID NO: 2931049 - protein, 27 aa, Entamoeba invadens
DSGFFGSGIYLTFYSDYALFYSEQRKS

SEQ ID NO: 2931050 - protein, 25 aa, Entamoeba invadens
DSGFVECPFWLPPEVISNRKWSTKS

SEQ ID NO: 2931051 - protein, 25 aa, Entamoeba invadens
DSGHSFEIVDPVAFSKEILPKYYKH

SEQ ID NO: 2931052 - protein, 24 aa, Entamoeba invadens
DSGKVWRMRAACISFVNLAKVGAM

SEQ ID NO: 2931053 - protein, 25 aa, Entamoeba invadens
DSGKVWRMRASCVTFVSLAKVGAMT

SEQ ID NO: 2931054 - protein, 21 aa, Entamoeba invadens
DSGMMQICIFMIAKNLSERAQ

SEQ ID NO: 2931055 - protein, 17 aa, Entamoeba invadens
DSGRPCVVFCTNNSLSV

SEQ ID NO: 2931056 - protein, 22 aa, Entamoeba invadens
DSGTLLKTFAITNCIPTPPTIQ

SEQ ID NO: 2931057 - protein, 17 aa, Entamoeba invadens
DSGVYNKFIELFRTLPL

SEQ ID NO: 2931058 - protein, 17 aa, Entamoeba invadens
DSGYSTPRCMSCFDGYY

SEQ ID NO: 2931059 - protein, 25 aa, Entamoeba invadens
DSHFAEPLPTLFDGLVGYFDDSLSS

SEQ ID NO: 2931060 - protein, 21 aa, Entamoeba invadens
DSHLSTVVSSCFQKVVHLKDR

SEQ ID NO: 2931061 - protein, 19 aa, Entamoeba invadens
DSHRSVWMDDNWVCSDWTD

SEQ ID NO: 2931062 - protein, 18 aa, Entamoeba invadens
DSHYCVLQNFAFTQTHPF

SEQ ID NO: 2931063 - protein, 31 aa, Entamoeba invadens
DSIAGRIDGFFPMKNYEFMTWSDNVQIVKYQ

SEQ ID NO: 2931064 - protein, 17 aa, Entamoeba invadens
DSIDFKIVSEIAKISDV

SEQ ID NO: 2931065 - protein, 19 aa, Entamoeba invadens
DSIEIWNTYFFEKLEQEQN

SEQ ID NO: 2931066 - protein, 27 aa, Entamoeba invadens
DSIELELEFSSTMFPVIPPKYNFLSPK

SEQ ID NO: 2931067 - protein, 20 aa, Entamoeba invadens
DSIERFCLILSKKPQNIKDV

SEQ ID NO: 2931068 - protein, 21 aa, Entamoeba invadens
DSIEYFLDFCFSGCCNLEDFV

SEQ ID NO: 2931069 - protein, 21 aa, Entamoeba invadens
DSIHFLPLILTSFLDSNIVMN

SEQ ID NO: 2931070 - protein, 24 aa, Entamoeba invadens
DSIIAFGDLCFFLCSNLKKISISH

SEQ ID NO: 2931071 - protein, 24 aa, Entamoeba invadens
DSIICIPNFTAPDHFLFAAVDGHL

SEQ ID NO: 2931072 - protein, 21 aa, Entamoeba invadens
DSIKGLTQYSVKKFAEAFQMV

SEQ ID NO: 2931073 - protein, 20 aa, Entamoeba invadens
DSIKRKIIYDKTVAPGDFVG

SEQ ID NO: 2931074 - protein, 17 aa, Entamoeba invadens
DSILGLFTSVEDAFKNE

SEQ ID NO: 2931075 - protein, 19 aa, Entamoeba invadens
DSILRLPLTPSTHIQTPNT

SEQ ID NO: 2931076 - protein, 25 aa, Entamoeba invadens
DSISHMHECFGRIGPANSCEPDIKR

SEQ ID NO: 2931077 - protein, 17 aa, Entamoeba invadens
DSISSMRASMVPPTRRI

SEQ ID NO: 2931078 - protein, 25 aa, Entamoeba invadens
DSITEMLQRFLLGFLQGETSNFEIV

SEQ ID NO: 2931079 - protein, 30 aa, Entamoeba invadens
DSITLPLLRPELFKKGSLTKRSKGILFFGP

SEQ ID NO: 2931080 - protein, 17 aa, Entamoeba invadens
DSIVGTLEFLRGCDLDS

SEQ ID NO: 2931081 - protein, 18 aa, Entamoeba invadens
DSIYEAFKKFTIKKKKET

SEQ ID NO: 2931082 - protein, 33 aa, Entamoeba invadens
DSKEYSKDMLLEMYEYAYDYKIMDFEKSKDTIM

SEQ ID NO: 2931083 - protein, 22 aa, Entamoeba invadens
DSKFKTLGCQNLVILKNVLMTY

SEQ ID NO: 2931084 - protein, 23 aa, Entamoeba invadens
DSKFYLKYLDVWVHQPCVEENYK

SEQ ID NO: 2931085 - protein, 23 aa, Entamoeba invadens
DSKFYPVCQQAVLVSLLNKKYAI

SEQ ID NO: 2931086 - protein, 25 aa, Entamoeba invadens
DSKICVISKEGYKEFVYDEESIEMI

SEQ ID NO: 2931087 - protein, 19 aa, Entamoeba invadens
DSKKKGCIVCVCNDMLIVY

SEQ ID NO: 2931088 - protein, 23 aa, Entamoeba invadens
DSKNLLCQLFLHVNGKFNVFNSK

SEQ ID NO: 2931089 - protein, 19 aa, Entamoeba invadens
DSKTVYPVVFGRAKDTQQS

SEQ ID NO: 2931090 - protein, 20 aa, Entamoeba invadens
DSKVSFDLLTPMIDSLLIEC

SEQ ID NO: 2931091 - protein, 20 aa, Entamoeba invadens
DSKYTTLGWSQVCDFECTDS

SEQ ID NO: 2931092 - protein, 17 aa, Entamoeba invadens
DSLCMDNFIDIVTFPLK

SEQ ID NO: 2931093 - protein, 17 aa, Entamoeba invadens
DSLDILPITILTSNGNL

SEQ ID NO: 2931094 - protein, 26 aa, Entamoeba invadens
DSLDLLLRAVPWNEFRAREEMADLIK

SEQ ID NO: 2931095 - protein, 19 aa, Entamoeba invadens
DSLDPALVRPGRIDRKIEF

SEQ ID NO: 2931096 - protein, 17 aa, Entamoeba invadens
DSLEPRTQLDLKSAEQA

SEQ ID NO: 2931097 - protein, 23 aa, Entamoeba invadens
DSLFEGCEMFKSFTIGESVTRVG

SEQ ID NO: 2931098 - protein, 23 aa, Entamoeba invadens
DSLFGHHILALTVAKLANDDYKT

SEQ ID NO: 2931099 - protein, 24 aa, Entamoeba invadens
DSLGGNCKTFIIGTVSPSMSAIRE

SEQ ID NO: 2931100 - protein, 20 aa, Entamoeba invadens
DSLGKIEPFLSCSDEEEASM

SEQ ID NO: 2931101 - protein, 35 aa, Entamoeba invadens
DSLKCSSCGLSVHSQCSQNCYLFCYPHLKEKKDEQ

SEQ ID NO: 2931102 - protein, 24 aa, Entamoeba invadens
DSLKIDEQFALKCKELSDFPIEAF

SEQ ID NO: 2931103 - protein, 23 aa, Entamoeba invadens
DSLKKKSPRRSPLSSPRKSPHSA

SEQ ID NO: 2931104 - protein, 17 aa, Entamoeba invadens
DSLKLLNTVECVGEKGE

SEQ ID NO: 2931105 - protein, 22 aa, Entamoeba invadens
DSLKSYTTRLLRDFEDKIDMVS

SEQ ID NO: 2931106 - protein, 20 aa, Entamoeba invadens
DSLNKICFEYQLTNLSQGID

SEQ ID NO: 2931107 - protein, 21 aa, Entamoeba invadens
DSLNYFEEFTKFTSHPQIVQK

SEQ ID NO: 2931108 - protein, 18 aa, Entamoeba invadens
DSLPLLRERVLKLSDRVL

SEQ ID NO: 2931109 - protein, 26 aa, Entamoeba invadens
DSLRFKTTRFFMPFTLRHEETMATLV

SEQ ID NO: 2931110 - protein, 19 aa, Entamoeba invadens
DSLRVSSLLSKSATPTTRF

SEQ ID NO: 2931111 - protein, 19 aa, Entamoeba invadens
DSLSCSTCKSNTNKYYDKD

SEQ ID NO: 2931112 - protein, 27 aa, Entamoeba invadens
DSLSSLFRKCCMHPNELVAMGAVDCLK

SEQ ID NO: 2931113 - protein, 17 aa, Entamoeba invadens
DSLTVAVSNAFKVSDRL

SEQ ID NO: 2931114 - protein, 19 aa, Entamoeba invadens
DSLVKSAERVRCTKKVENI

SEQ ID NO: 2931115 - protein, 22 aa, Entamoeba invadens
DSLYDAKFSWFFENTVQHASLK

SEQ ID NO: 2931116 - protein, 20 aa, Entamoeba invadens
DSMFGEGECDIVVLIVSDYF

SEQ ID NO: 2931117 - protein, 17 aa, Entamoeba invadens
DSMKKGWGNRSVTSSQS

SEQ ID NO: 2931118 - protein, 24 aa, Entamoeba invadens
DSMKTLSVAFQWFVGDSGDNGISP

SEQ ID NO: 2931119 - protein, 26 aa, Entamoeba invadens
DSMMCGYGIFPVEGCTSVPYQSDSTS

SEQ ID NO: 2931120 - protein, 23 aa, Entamoeba invadens
DSNETLEILTYFLRCLISSSHLL

SEQ ID NO: 2931121 - protein, 20 aa, Entamoeba invadens
DSNIKKCLCQALVDTNIFTF

SEQ ID NO: 2931122 - protein, 22 aa, Entamoeba invadens
DSNMKGDHYFLDKNITITPFYL

SEQ ID NO: 2931123 - protein, 19 aa, Entamoeba invadens
DSPDFGYDLSYRSVKGTRP

SEQ ID NO: 2931124 - protein, 26 aa, Entamoeba invadens
DSPFVVDGTNILKCALFAEGHFTINN

SEQ ID NO: 2931125 - protein, 24 aa, Entamoeba invadens
DSPLMQKFPENWAVVTSVLNQNIF

SEQ ID NO: 2931126 - protein, 25 aa, Entamoeba invadens
DSPVIQWFWEVVFDLDIEQKKQLLV

SEQ ID NO: 2931127 - protein, 19 aa, Entamoeba invadens
DSQELLSFLVDGIHEDLNK

SEQ ID NO: 2931128 - protein, 18 aa, Entamoeba invadens
DSQKLFAYVEKLNETEKE

SEQ ID NO: 2931129 - protein, 18 aa, Entamoeba invadens
DSQKTRFAEDFTEKTGQM

SEQ ID NO: 2931130 - protein, 30 aa, Entamoeba invadens
DSQNFLIHRSRRFKILGIELPKQKKDKPKK

SEQ ID NO: 2931131 - protein, 17 aa, Entamoeba invadens
DSRCGGGEQVGECTCDK

SEQ ID NO: 2931132 - protein, 20 aa, Entamoeba invadens
DSRDTVYCDVFNRLIVQIAV

SEQ ID NO: 2931133 - protein, 19 aa, Entamoeba invadens
DSRIDTVCRYILRKIDGEG

SEQ ID NO: 2931134 - protein, 19 aa, Entamoeba invadens
DSRLLRKALEYLIDNEYIE

SEQ ID NO: 2931135 - protein, 24 aa, Entamoeba invadens
DSRRLSVPGNLSFVLLENETALTK

SEQ ID NO: 2931136 - protein, 24 aa, Entamoeba invadens
DSRVGSLYLEKYLKESNEERLIQF

SEQ ID NO: 2931137 - protein, 17 aa, Entamoeba invadens
DSSAVFVIGCFAHGHIN

SEQ ID NO: 2931138 - protein, 25 aa, Entamoeba invadens
DSSDACPICYSIFYLHTTTIPNVAC

SEQ ID NO: 2931139 - protein, 19 aa, Entamoeba invadens
DSSDMLLCIGELEDKDRKD

SEQ ID NO: 2931140 - protein, 22 aa, Entamoeba invadens
DSSEMKTWYTAIQKYAEIQRNG

SEQ ID NO: 2931141 - protein, 20 aa, Entamoeba invadens
DSSFEKCYSLTKVFCENDDV

SEQ ID NO: 2931142 - protein, 18 aa, Entamoeba invadens
DSSFSVPVFNKVSLSTGL

SEQ ID NO: 2931143 - protein, 17 aa, Entamoeba invadens
DSSFTINITRSYRDLSS

SEQ ID NO: 2931144 - protein, 19 aa, Entamoeba invadens
DSSKFVFPMHLLKDKFTTK

SEQ ID NO: 2931145 - protein, 22 aa, Entamoeba invadens
DSSLILKYPSCHVFGYDEDLLK

SEQ ID NO: 2931146 - protein, 18 aa, Entamoeba invadens
DSSLRQIVRRDYTIYLLL

SEQ ID NO: 2931147 - protein, 24 aa, Entamoeba invadens
DSSMKAIICLASVLGEKFSVFISP

SEQ ID NO: 2931148 - protein, 25 aa, Entamoeba invadens
DSSNNYRGYVSFIFLSNEKTVFGID

SEQ ID NO: 2931149 - protein, 20 aa, Entamoeba invadens
DSSRVEEWLELCNSTDDFHL

SEQ ID NO: 2931150 - protein, 26 aa, Entamoeba invadens
DSSTCLRCKMPFTLNGENCFDCSDFE

SEQ ID NO: 2931151 - protein, 18 aa, Entamoeba invadens
DSSVGKTALYTRLGKGIF

SEQ ID NO: 2931152 - protein, 22 aa, Entamoeba invadens
DSSVGKTCIIGRFMTSSFCTNY

SEQ ID NO: 2931153 - protein, 25 aa, Entamoeba invadens
DSTAKIMNFICSFSVYANFTPPKEV

SEQ ID NO: 2931154 - protein, 24 aa, Entamoeba invadens
DSTGFGQPGGWSYVIGIYLDDNLS

SEQ ID NO: 2931155 - protein, 25 aa, Entamoeba invadens
DSTGYCSSCSIGLVYTNPQSQQCEV

SEQ ID NO: 2931156 - protein, 18 aa, Entamoeba invadens
DSTIHGMSALNFNSKVCG

SEQ ID NO: 2931157 - protein, 24 aa, Entamoeba invadens
DSTILGFRMQWIAPFNASQKGNDK

SEQ ID NO: 2931158 - protein, 17 aa, Entamoeba invadens
DSTMFVETFRVYFERMK

SEQ ID NO: 2931159 - protein, 24 aa, Entamoeba invadens
DSTMKSKDAIAFWRKNYTDGEVPM

SEQ ID NO: 2931160 - protein, 23 aa, Entamoeba invadens
DSTPSLKMDKLIYCTAEQAMMDY

SEQ ID NO: 2931161 - protein, 20 aa, Entamoeba invadens
DSTSIPIVLPRFLSAVNPFK

SEQ ID NO: 2931162 - protein, 17 aa, Entamoeba invadens
DSTYKNCFGCYKENTIE

SEQ ID NO: 2931163 - protein, 25 aa, Entamoeba invadens
DSVCMCVNWMDRVFKRGEHKIKAVL

SEQ ID NO: 2931164 - protein, 18 aa, Entamoeba invadens
DSVEIFLEQVRLGELDIV

SEQ ID NO: 2931165 - protein, 18 aa, Entamoeba invadens
DSVERFAGDFAMNQPHTP

SEQ ID NO: 2931166 - protein, 24 aa, Entamoeba invadens
DSVGFYFNYIKGMTFLNQPYTCSA

SEQ ID NO: 2931167 - protein, 29 aa, Entamoeba invadens
DSVKEIGCSAFWRCDIKKLCIPDSVTCIE

SEQ ID NO: 2931168 - protein, 23 aa, Entamoeba invadens
DSVKFMFKDMVVLSINKDNLESI

SEQ ID NO: 2931169 - protein, 22 aa, Entamoeba invadens
DSVKGKVLLQMGNLKKPLLHNG

SEQ ID NO: 2931170 - protein, 30 aa, Entamoeba invadens
DSVKRNCLTKELFCFSFIDFFSTIDINTIP

SEQ ID NO: 2931171 - protein, 24 aa, Entamoeba invadens
DSVKYIGDNTFCWCQSLKEVKLPT

SEQ ID NO: 2931172 - protein, 26 aa, Entamoeba invadens
DSVMTCGRLFECIVMNNTQMYWEYYQ

SEQ ID NO: 2931173 - protein, 17 aa, Entamoeba invadens
DSVRFSSEVLPYHFKHS

SEQ ID NO: 2931174 - protein, 20 aa, Entamoeba invadens
DSVSNINNWGYYASGGYGLR

SEQ ID NO: 2931175 - protein, 29 aa, Entamoeba invadens
DSVTFPSYLLTIWDRCFEFCMSLKSIKIA

SEQ ID NO: 2931176 - protein, 18 aa, Entamoeba invadens
DSVTRKVAINALMETATF

SEQ ID NO: 2931177 - protein, 20 aa, Entamoeba invadens
DSVVEFGMFVCQDCEKLRSV

SEQ ID NO: 2931178 - protein, 25 aa, Entamoeba invadens
DSVVFCGRNRLGLIDKSHSMIEDVR

SEQ ID NO: 2931179 - protein, 22 aa, Entamoeba invadens
DSVWMRRYWFIFSQDQAVKGKI

SEQ ID NO: 2931180 - protein, 39 aa, Entamoeba invadens
DSWIKFTGLCYKSGMPKLAMKTLDRLAGISLDEHLNELP

SEQ ID NO: 2931181 - protein, 18 aa, Entamoeba invadens
DSWSTVLTHWKYHLLHSS

SEQ ID NO: 2931182 - protein, 27 aa, Entamoeba invadens
DSYFKRISELSMLMLLHAPDFTSFTNI

SEQ ID NO: 2931183 - protein, 21 aa, Entamoeba invadens
DSYFYKIRPSDLVSERLNKRS

SEQ ID NO: 2931184 - protein, 41 aa, Entamoeba invadens
DSYHFYKNRCFKCSNGCLKCVKEGCVLCDTGYLLVQQNGVD

SEQ ID NO: 2931185 - protein, 23 aa, Entamoeba invadens
DSYHLNIPLRFKVENIIQNSVIL

SEQ ID NO: 2931186 - protein, 23 aa, Entamoeba invadens
DSYKYNKEVLLIYFFKMIQTVSQ

SEQ ID NO: 2931187 - protein, 23 aa, Entamoeba invadens
DSYVARLILFLAKKFTEYTQTKS

SEQ ID NO: 2931188 - protein, 24 aa, Entamoeba invadens
DSYVKERMKAVVIDVRDIDLTNET

SEQ ID NO: 2931189 - protein, 21 aa, Entamoeba invadens
DSYVKRCAILSLLKILQIPNV

SEQ ID NO: 2931190 - protein, 26 aa, Entamoeba invadens
DSYYKFLAHVYKWVLILLAEVNKTVA

SEQ ID NO: 2931191 - protein, 17 aa, Entamoeba invadens
DTAFCRRANDVALAQKF

SEQ ID NO: 2931192 - protein, 20 aa, Entamoeba invadens
DTAFDVKMIFIGNDKSPSQR

SEQ ID NO: 2931193 - protein, 18 aa, Entamoeba invadens
DTAFYLGKRCAYIYKVAV

SEQ ID NO: 2931194 - protein, 24 aa, Entamoeba invadens
DTAHCSLYLGDYVDRGTMSCEVVI

SEQ ID NO: 2931195 - protein, 25 aa, Entamoeba invadens
DTAKTEIFRDLQFGIYMKSRIGLVG

SEQ ID NO: 2931196 - protein, 22 aa, Entamoeba invadens
DTAKYFAYRPIFEGGKLIDNME

SEQ ID NO: 2931197 - protein, 24 aa, Entamoeba invadens
DTALEIFHFYSLKSFILQFKSSTE

SEQ ID NO: 2931198 - protein, 27 aa, Entamoeba invadens
DTCDLRSSVPLKFVSIFGDDKKSPLST

SEQ ID NO: 2931199 - protein, 18 aa, Entamoeba invadens
DTCFVCSRCGEKFSGSYM

SEQ ID NO: 2931200 - protein, 27 aa, Entamoeba invadens
DTCPIRSVCPFTHLGLVVCATCEGKIY

SEQ ID NO: 2931201 - protein, 25 aa, Entamoeba invadens
DTCSLSEAFLLYIRAMGGIIPIELA

SEQ ID NO: 2931202 - protein, 19 aa, Entamoeba invadens
DTDCVGCGQCTSACNFGAL

SEQ ID NO: 2931203 - protein, 26 aa, Entamoeba invadens
DTDKLCKNCEVVALPVVKQLLDHYSQ

SEQ ID NO: 2931204 - protein, 20 aa, Entamoeba invadens
DTDMKVTLCTLSGKCPQYAT

SEQ ID NO: 2931205 - protein, 20 aa, Entamoeba invadens
DTEFSCLFELVDKMKDMLIA

SEQ ID NO: 2931206 - protein, 25 aa, Entamoeba invadens
DTELVGGLHMCAKAISQRKLIEQIA

SEQ ID NO: 2931207 - protein, 24 aa, Entamoeba invadens
DTEMFVYHVVRWLNKIVSFQPVRD

SEQ ID NO: 2931208 - protein, 18 aa, Entamoeba invadens
DTEWFKYTCGVYEEEFRK

SEQ ID NO: 2931209 - protein, 24 aa, Entamoeba invadens
DTFDVDHFFCFGITSLVKLLQELH

SEQ ID NO: 2931210 - protein, 20 aa, Entamoeba invadens
DTFDYLTKRVKVNNVDYTVI

SEQ ID NO: 2931211 - protein, 21 aa, Entamoeba invadens
DTFESYGFSYYCLKWEPESYY

SEQ ID NO: 2931212 - protein, 23 aa, Entamoeba invadens
DTFFKLFELCLPNDNGKVIEDSF

SEQ ID NO: 2931213 - protein, 23 aa, Entamoeba invadens
DTFKFPWKIAEFVIQNNRLKRKD

SEQ ID NO: 2931214 - protein, 25 aa, Entamoeba invadens
DTFLEFLNRRLLSYRDYDFIITMTQ

SEQ ID NO: 2931215 - protein, 23 aa, Entamoeba invadens
DTFLLRNDVHGFAERRVIEIKLY

SEQ ID NO: 2931216 - protein, 32 aa, Entamoeba invadens
DTFNVAKVLLRWNACLFHKNQHGFTPLGTAVN

SEQ ID NO: 2931217 - protein, 24 aa, Entamoeba invadens
DTFPSKFNLLSLLIKDVTWRSNQL

SEQ ID NO: 2931218 - protein, 17 aa, Entamoeba invadens
DTFRIATLPPFITAKSC

SEQ ID NO: 2931219 - protein, 17 aa, Entamoeba invadens
DTFSRTKYNPGLIHIKY

SEQ ID NO: 2931220 - protein, 24 aa, Entamoeba invadens
DTFVCLGCTIGYYIRTGKCVACLT

SEQ ID NO: 2931221 - protein, 20 aa, Entamoeba invadens
DTGEIFAMKILDKGKVMSTK

SEQ ID NO: 2931222 - protein, 25 aa, Entamoeba invadens
DTGILMLWRKIIILFENTPEKGETL

SEQ ID NO: 2931223 - protein, 25 aa, Entamoeba invadens
DTGKFKAAGALSCIQRQRNNTYLKE

SEQ ID NO: 2931224 - protein, 23 aa, Entamoeba invadens
DTHAKFNIGLQCGNFRAALEAAK

SEQ ID NO: 2931225 - protein, 21 aa, Entamoeba invadens
DTHGIKVCVVKQKYVVQNLMV

SEQ ID NO: 2931226 - protein, 19 aa, Entamoeba invadens
DTHIIKIGMLSKCFEPFMV

SEQ ID NO: 2931227 - protein, 22 aa, Entamoeba invadens
DTHIVDFGLKMFVSATSLQSVA

SEQ ID NO: 2931228 - protein, 17 aa, Entamoeba invadens
DTHREASDFVKFLENVV

SEQ ID NO: 2931229 - protein, 19 aa, Entamoeba invadens
DTIAPFLLRRLKKDVLPTL

SEQ ID NO: 2931230 - protein, 17 aa, Entamoeba invadens
DTICETHDLLGCTCGAG

SEQ ID NO: 2931231 - protein, 28 aa, Entamoeba invadens
DTICPLSIHPSRWYPLDVNCIKEGRSFM

SEQ ID NO: 2931232 - protein, 17 aa, Entamoeba invadens
DTIFPYLGKTASAMTIK

SEQ ID NO: 2931233 - protein, 33 aa, Entamoeba invadens
DTIHTWYQFRNWVWFRLFQKVRPTLKRRRVDEE

SEQ ID NO: 2931234 - protein, 21 aa, Entamoeba invadens
DTIKNRVWSFVLINKNNADGI

SEQ ID NO: 2931235 - protein, 24 aa, Entamoeba invadens
DTIKSFGEFCFGYCFSLSEIKIPK

SEQ ID NO: 2931236 - protein, 18 aa, Entamoeba invadens
DTIMKCDIDLRRRLFENI

SEQ ID NO: 2931237 - protein, 19 aa, Entamoeba invadens
DTIPFYGFMNCLSLSSVTV

SEQ ID NO: 2931238 - protein, 24 aa, Entamoeba invadens
DTIPKLLKVRGIQIHVKFFVRNLD

SEQ ID NO: 2931239 - protein, 18 aa, Entamoeba invadens
DTISPYFLPAFDFIDKFV

SEQ ID NO: 2931240 - protein, 28 aa, Entamoeba invadens
DTIVKVIGSYAFRQCEKLEDINVPSSLQ

SEQ ID NO: 2931241 - protein, 31 aa, Entamoeba invadens
DTIYCAICSFFMCLSELQFINQNPTLKQQIF

SEQ ID NO: 2931242 - protein, 34 aa, Entamoeba invadens
DTKDNAYECCVSVKVRLLLKESGVFHENYGSYCG

SEQ ID NO: 2931243 - protein, 24 aa, Entamoeba invadens
DTKENTLRWTGRYLGRGTEPCVLT

SEQ ID NO: 2931244 - protein, 21 aa, Entamoeba invadens
DTKFCQVVFEFLMSKLSITQT

SEQ ID NO: 2931245 - protein, 21 aa, Entamoeba invadens
DTKKVLPSYVRLIQKFDPFFI

SEQ ID NO: 2931246 - protein, 28 aa, Entamoeba invadens
DTKMICGGGCVEMELSLAVEEAAKKTEG

SEQ ID NO: 2931247 - protein, 18 aa, Entamoeba invadens
DTKNLFSKYLTLRRQEME

SEQ ID NO: 2931248 - protein, 25 aa, Entamoeba invadens
DTKPAGDLNNLSFNTNLFGNTATTG

SEQ ID NO: 2931249 - protein, 19 aa, Entamoeba invadens
DTKPVCAFTAKEVYYSALD

SEQ ID NO: 2931250 - protein, 22 aa, Entamoeba invadens
DTKRMIEFMLGPFTRDEGFKKR

SEQ ID NO: 2931251 - protein, 19 aa, Entamoeba invadens
DTKSICVNDFIAVDYTSSS

SEQ ID NO: 2931252 - protein, 20 aa, Entamoeba invadens
DTLCSLKFSNHTLKEVLGLA

SEQ ID NO: 2931253 - protein, 20 aa, Entamoeba invadens
DTLFEYEAVFGWCQSLTSFD

SEQ ID NO: 2931254 - protein, 23 aa, Entamoeba invadens
DTLFKLLILDTFSSVDSDSDEQI

SEQ ID NO: 2931255 - protein, 21 aa, Entamoeba invadens
DTLIKFVEFKSNYFSYSNADY

SEQ ID NO: 2931256 - protein, 23 aa, Entamoeba invadens
DTLIKRGYELFIINAVFTENNNA

SEQ ID NO: 2931257 - protein, 22 aa, Entamoeba invadens
DTLKMRFDMPLSLDTSISLTDL

SEQ ID NO: 2931258 - protein, 19 aa, Entamoeba invadens
DTLLKEIQKGLSTSGTNSS

SEQ ID NO: 2931259 - protein, 20 aa, Entamoeba invadens
DTLLSLALSKHVPLPFDILD

SEQ ID NO: 2931260 - protein, 27 aa, Entamoeba invadens
DTLNALNGALCGIELLTGTHYLPKRME

SEQ ID NO: 2931261 - protein, 23 aa, Entamoeba invadens
DTLNCNFLPISFDYLSKPIYIRN

SEQ ID NO: 2931262 - protein, 20 aa, Entamoeba invadens
DTLNILDYVAMRKKDKINYL

SEQ ID NO: 2931263 - protein, 23 aa, Entamoeba invadens
DTLNLYMCNECPLKVNEKGEALN

SEQ ID NO: 2931264 - protein, 22 aa, Entamoeba invadens
DTLPLHLVKALYRLFPEKYHKN

SEQ ID NO: 2931265 - protein, 22 aa, Entamoeba invadens
DTLRALSLIKDCYIDVSNKPLV

SEQ ID NO: 2931266 - protein, 17 aa, Entamoeba invadens
DTLRRTIQFTLKKNPVD

SEQ ID NO: 2931267 - protein, 18 aa, Entamoeba invadens
DTLTGLFKSGSIGSSDSN

SEQ ID NO: 2931268 - protein, 21 aa, Entamoeba invadens
DTLVKCIDLLLTKKDLIVEDI

SEQ ID NO: 2931269 - protein, 17 aa, Entamoeba invadens
DTLVPPFRYVALKPEEI

SEQ ID NO: 2931270 - protein, 25 aa, Entamoeba invadens
DTLYFYKHHLELLSHNKLLNPTKQQ

SEQ ID NO: 2931271 - protein, 32 aa, Entamoeba invadens
DTLYPHFLEFYALWFCRVFNGDLSMWVLDLVM

SEQ ID NO: 2931272 - protein, 19 aa, Entamoeba invadens
DTMELFKGYVNSMVKLTSS

SEQ ID NO: 2931273 - protein, 23 aa, Entamoeba invadens
DTMFKQLHEAYAILSSPDKRKAY

SEQ ID NO: 2931274 - protein, 23 aa, Entamoeba invadens
DTMFYFGSIDFEYTVTLEMKDFI

SEQ ID NO: 2931275 - protein, 23 aa, Entamoeba invadens
DTNFKFTGVEIVKKLLEALDFSV

SEQ ID NO: 2931276 - protein, 25 aa, Entamoeba invadens
DTNGYFCAYDKFSIVNFPSDCERVI

SEQ ID NO: 2931277 - protein, 26 aa, Entamoeba invadens
DTNKNEPFMSWGCLTTPATSSTETKL

SEQ ID NO: 2931278 - protein, 20 aa, Entamoeba invadens
DTNLLVAIDYLRKVCNHPLL

SEQ ID NO: 2931279 - protein, 24 aa, Entamoeba invadens
DTNMKGDHYFLDIDLPITPFYLKN

SEQ ID NO: 2931280 - protein, 29 aa, Entamoeba invadens
DTNPPLCQIIPFVISEPIISVTDITNGLQ

SEQ ID NO: 2931281 - protein, 18 aa, Entamoeba invadens
DTNYLVKHVHYIIPALEE

SEQ ID NO: 2931282 - protein, 24 aa, Entamoeba invadens
DTPHAWPDYVFLKGTSFSSKNKDK

SEQ ID NO: 2931283 - protein, 36 aa, Entamoeba invadens
DTPSWNLWSDVFAKRTTFFELFRIPEFTAEYKEKML

SEQ ID NO: 2931284 - protein, 24 aa, Entamoeba invadens
DTPTSFNLGELGFFNKETQKRGNL

SEQ ID NO: 2931285 - protein, 26 aa, Entamoeba invadens
DTQKPKGCGFVKFMTHEDAKRCVEEA

SEQ ID NO: 2931286 - protein, 30 aa, Entamoeba invadens
DTQPLFVIHLLWLRVYHKVVLEKDKKGVLL

SEQ ID NO: 2931287 - protein, 22 aa, Entamoeba invadens
DTRCFRFCLSLDNITIPKTVTS

SEQ ID NO: 2931288 - protein, 23 aa, Entamoeba invadens
DTRPKNCTIYLGFTSEMVSSGLR

SEQ ID NO: 2931289 - protein, 34 aa, Entamoeba invadens
DTRRFPSYILVCPFPIDLMTILRRVEKGEYYHTY

SEQ ID NO: 2931290 - protein, 24 aa, Entamoeba invadens
DTRYFCKIFGYEIDSAIASYIKGL

SEQ ID NO: 2931291 - protein, 17 aa, Entamoeba invadens
DTSAVWFSILPKKGVMF

SEQ ID NO: 2931292 - protein, 18 aa, Entamoeba invadens
DTSHLSHWGELYSVPLQH

SEQ ID NO: 2931293 - protein, 25 aa, Entamoeba invadens
DTSLSLKNKLSFRIRHFSKPRLGEV

SEQ ID NO: 2931294 - protein, 18 aa, Entamoeba invadens
DTSMKECFTTITKCIPNF

SEQ ID NO: 2931295 - protein, 23 aa, Entamoeba invadens
DTSNFFIPFGKYVLYAFDTLGNN

SEQ ID NO: 2931296 - protein, 27 aa, Entamoeba invadens
DTSRRKEEWHPYLLFCKMNRESLSTEG

SEQ ID NO: 2931297 - protein, 18 aa, Entamoeba invadens
DTSSLIAVGGEFGLKFLR

SEQ ID NO: 2931298 - protein, 19 aa, Entamoeba invadens
DTTGFVFGGFVGKEIVKKE

SEQ ID NO: 2931299 - protein, 18 aa, Entamoeba invadens
DTTIKGVVSYLKLPLQPL

SEQ ID NO: 2931300 - protein, 23 aa, Entamoeba invadens
DTTIPLTFGDCGFEVVEKFMDSG

SEQ ID NO: 2931301 - protein, 20 aa, Entamoeba invadens
DTTIPSVLPTVINFAIQQIG

SEQ ID NO: 2931302 - protein, 27 aa, Entamoeba invadens
DTTKEIRRILCERVDKMLEKKKSVYDV

SEQ ID NO: 2931303 - protein, 34 aa, Entamoeba invadens
DTTKYKIVVFIPMQFPRFSTMVGKLNKVDFELLT

SEQ ID NO: 2931304 - protein, 18 aa, Entamoeba invadens
DTTMKFLKTVEKMKDIEK

SEQ ID NO: 2931305 - protein, 24 aa, Entamoeba invadens
DTTNYCTSCHGILTQKGFCQICRA

SEQ ID NO: 2931306 - protein, 26 aa, Entamoeba invadens
DTTPVLKCIVAGFFVHAAKRDAQEGY

SEQ ID NO: 2931307 - protein, 24 aa, Entamoeba invadens
DTTRIRNALLFYYRTGKTLSSQLL

SEQ ID NO: 2931308 - protein, 26 aa, Entamoeba invadens
DTTRLLFYVEMVYSFFDLKFTDLPVF

SEQ ID NO: 2931309 - protein, 32 aa, Entamoeba invadens
DTTVCKLENWMLDKRIVVLPVVHNRMHVTSAM

SEQ ID NO: 2931310 - protein, 20 aa, Entamoeba invadens
DTTVGWIYYIYILQKNSEGY

SEQ ID NO: 2931311 - protein, 26 aa, Entamoeba invadens
DTTVPRLEKFINFEVDYEQYLNDKKF

SEQ ID NO: 2931312 - protein, 17 aa, Entamoeba invadens
DTVCMLPIVDYVRRAAL

SEQ ID NO: 2931313 - protein, 20 aa, Entamoeba invadens
DTVDCLLALFLNTSPLCKDL

SEQ ID NO: 2931314 - protein, 31 aa, Entamoeba invadens
DTVDKIYVWIGKDCNRLKRTKACDAANTIKH

SEQ ID NO: 2931315 - protein, 22 aa, Entamoeba invadens
DTVDKLSYFITFIARTLLDDSL

SEQ ID NO: 2931316 - protein, 18 aa, Entamoeba invadens
DTVFDWKIYEKEFTIDKR

SEQ ID NO: 2931317 - protein, 19 aa, Entamoeba invadens
DTVFSKCPNYLTGKVVEKD

SEQ ID NO: 2931318 - protein, 19 aa, Entamoeba invadens
DTVHFGSFFIAKTGSNDMT

SEQ ID NO: 2931319 - protein, 18 aa, Entamoeba invadens
DTVKRNMDTLGFIFTEIF

SEQ ID NO: 2931320 - protein, 25 aa, Entamoeba invadens
DTVKRYDTYFGVIGRIRYFIRTTLT

SEQ ID NO: 2931321 - protein, 21 aa, Entamoeba invadens
DTVQYLPAFDAFGLDIYPINE

SEQ ID NO: 2931322 - protein, 17 aa, Entamoeba invadens
DTVRGFITVGMKLVPKD

SEQ ID NO: 2931323 - protein, 17 aa, Entamoeba invadens
DTVRVCYTIFNTMKLQS

SEQ ID NO: 2931324 - protein, 18 aa, Entamoeba invadens
DTVTLIGEMCFFKCKSLE

SEQ ID NO: 2931325 - protein, 17 aa, Entamoeba invadens
DTVTYIGVDCFGSCINL

SEQ ID NO: 2931326 - protein, 19 aa, Entamoeba invadens
DTVYFKSKTMIVVFADDCA

SEQ ID NO: 2931327 - protein, 18 aa, Entamoeba invadens
DTWTYQTICLCWKTNPKE

SEQ ID NO: 2931328 - protein, 26 aa, Entamoeba invadens
DTYAKFRSAKILEFFNLKNSNFSVET

SEQ ID NO: 2931329 - protein, 20 aa, Entamoeba invadens
DTYFKFKLTLADLPIGQESV

SEQ ID NO: 2931330 - protein, 21 aa, Entamoeba invadens
DTYFPILLSRCKLSLPPTSTH

SEQ ID NO: 2931331 - protein, 17 aa, Entamoeba invadens
DTYFYLIVFRGNVVADW

SEQ ID NO: 2931332 - protein, 21 aa, Entamoeba invadens
DVADVFDFLVSRLCTEPTPAL

SEQ ID NO: 2931333 - protein, 23 aa, Entamoeba invadens
DVAEGRKAYEACLKNIETFFKSA

SEQ ID NO: 2931334 - protein, 17 aa, Entamoeba invadens
DVAFFIRNELFRLEPQN

SEQ ID NO: 2931335 - protein, 22 aa, Entamoeba invadens
DVAGRFGFKNTIEPFTETSIEF

SEQ ID NO: 2931336 - protein, 24 aa, Entamoeba invadens
DVAIKKNGKLILNAIQSVADLKKE

SEQ ID NO: 2931337 - protein, 17 aa, Entamoeba invadens
DVAIKRFCLTCFRTTLF

SEQ ID NO: 2931338 - protein, 22 aa, Entamoeba invadens
DVASEFRVSFETKELKEKADMY

SEQ ID NO: 2931339 - protein, 25 aa, Entamoeba invadens
DVASFLKARCDTMYYSDLKSGVSDK

SEQ ID NO: 2931340 - protein, 26 aa, Entamoeba invadens
DVATIQRLCCSVVFRQKIHKTLVQRK

SEQ ID NO: 2931341 - protein, 24 aa, Entamoeba invadens
DVAVVLPDNFFKSAVSNYKLTINK

SEQ ID NO: 2931342 - protein, 20 aa, Entamoeba invadens
DVCDKYWRGTQMTFQSPMTF

SEQ ID NO: 2931343 - protein, 22 aa, Entamoeba invadens
DVCERLILGRMMLKAKTMWTVV

SEQ ID NO: 2931344 - protein, 17 aa, Entamoeba invadens
DVCMKKPQLELICEIAT

SEQ ID NO: 2931345 - protein, 17 aa, Entamoeba invadens
DVDEFFFNRQEQFLKQL

SEQ ID NO: 2931346 - protein, 25 aa, Entamoeba invadens
DVDELRFKSFWNFKKIDVTLLEQAE

SEQ ID NO: 2931347 - protein, 24 aa, Entamoeba invadens
DVDFLKYEFPHFVGEIEFKQYTMI

SEQ ID NO: 2931348 - protein, 23 aa, Entamoeba invadens
DVDFPSLITPNWYEKLVHSLAPS

SEQ ID NO: 2931349 - protein, 30 aa, Entamoeba invadens
DVDGLCSIGEKWLVDIGVCQKSSEKDKSQK

SEQ ID NO: 2931350 - protein, 17 aa, Entamoeba invadens
DVDHFKGKLPLNYKNFK

SEQ ID NO: 2931351 - protein, 17 aa, Entamoeba invadens
DVDIRKDLYGNIILSGG

SEQ ID NO: 2931352 - protein, 17 aa, Entamoeba invadens
DVDIRKDLYGNIVLSGG

SEQ ID NO: 2931353 - protein, 25 aa, Entamoeba invadens
DVDIRKELYENIVFSSGTSMYSGIN

SEQ ID NO: 2931354 - protein, 33 aa, Entamoeba invadens
DVDIRMKLRVKMMLDCFKGILYLHSNDILHRDI

SEQ ID NO: 2931355 - protein, 28 aa, Entamoeba invadens
DVDIRMKLRVKMMLDCSKGILYLHSNDI

SEQ ID NO: 2931356 - protein, 27 aa, Entamoeba invadens
DVDMKLRIKMCFDAAKRLSYLHKNGIL

SEQ ID NO: 2931357 - protein, 22 aa, Entamoeba invadens
DVDPKRLFALRALQEKVKGAEY

SEQ ID NO: 2931358 - protein, 17 aa, Entamoeba invadens
DVDRLNKSYAFFDFRKS

SEQ ID NO: 2931359 - protein, 23 aa, Entamoeba invadens
DVDSCTIYGGFYNKILLNNVNQL

SEQ ID NO: 2931360 - protein, 28 aa, Entamoeba invadens
DVDSTTRFGFCFFEKVGPDNLHVSDKKG

SEQ ID NO: 2931361 - protein, 28 aa, Entamoeba invadens
DVEALKIVGAFVFLRLLNPVLLTPQKFS

SEQ ID NO: 2931362 - protein, 22 aa, Entamoeba invadens
DVEARIKSTLMNKVPSKSSSTH

SEQ ID NO: 2931363 - protein, 24 aa, Entamoeba invadens
DVEFLRLTSLGVIGAMSKTRDPQV

SEQ ID NO: 2931364 - protein, 20 aa, Entamoeba invadens
DVEFNFKLFKSLQRVKLIFW

SEQ ID NO: 2931365 - protein, 18 aa, Entamoeba invadens
DVEKRCEVLLDIQCLTTH

SEQ ID NO: 2931366 - protein, 30 aa, Entamoeba invadens
DVEKRVSVDVLRLFSEYSFFKNEDVREHIK

SEQ ID NO: 2931367 - protein, 25 aa, Entamoeba invadens
DVELKKMVYMFLCTYCDKNLELSIL

SEQ ID NO: 2931368 - protein, 19 aa, Entamoeba invadens
DVELPKWKVSGLRESAKDY

SEQ ID NO: 2931369 - protein, 21 aa, Entamoeba invadens
DVENCDSCTFIFDSDKLERIT

SEQ ID NO: 2931370 - protein, 24 aa, Entamoeba invadens
DVEPRFVKDLVYFVVSSSLKERSE

SEQ ID NO: 2931371 - protein, 24 aa, Entamoeba invadens
DVERFKVIMNFWLDTHHQDFTQAM

SEQ ID NO: 2931372 - protein, 20 aa, Entamoeba invadens
DVEYELCSFIGKTNEKNQEV

SEQ ID NO: 2931373 - protein, 26 aa, Entamoeba invadens
DVEYRMSVCTFCTMLPSMNTKYGSAI

SEQ ID NO: 2931374 - protein, 22 aa, Entamoeba invadens
DVFCPWIPNNVQLAVCDVPPKK

SEQ ID NO: 2931375 - protein, 19 aa, Entamoeba invadens
DVFEGCASLSLILFNEEKT

SEQ ID NO: 2931376 - protein, 23 aa, Entamoeba invadens
DVFEGCASLSLILFNEEKTTYYS

SEQ ID NO: 2931377 - protein, 20 aa, Entamoeba invadens
DVFEGCASLSLILFNEEQTT

SEQ ID NO: 2931378 - protein, 18 aa, Entamoeba invadens
DVFFPTLVYVIIKGNIPY

SEQ ID NO: 2931379 - protein, 38 aa, Entamoeba invadens
DVFGVMLDAFFDMCYDRLKHLELMNSFIETFKDYFEIM

SEQ ID NO: 2931380 - protein, 18 aa, Entamoeba invadens
DVFKACIEALWNISIDPT

SEQ ID NO: 2931381 - protein, 22 aa, Entamoeba invadens
DVFKKSVQYFPGISSRKAVETK

SEQ ID NO: 2931382 - protein, 25 aa, Entamoeba invadens
DVFKQSWLPFELLRKSIKQIGADQN

SEQ ID NO: 2931383 - protein, 27 aa, Entamoeba invadens
DVFKTEFRTSCGTIRAGTTKIVNLNYR

SEQ ID NO: 2931384 - protein, 26 aa, Entamoeba invadens
DVFLICFSVVLPPSFDNVSSKWQPEV

SEQ ID NO: 2931385 - protein, 17 aa, Entamoeba invadens
DVFMTFGEIISVKLSVN

SEQ ID NO: 2931386 - protein, 26 aa, Entamoeba invadens
DVFSFGITVSEVFKWCEAYSNENYKF

SEQ ID NO: 2931387 - protein, 21 aa, Entamoeba invadens
DVFSKLGEWSLYIAQNSNSFN

SEQ ID NO: 2931388 - protein, 27 aa, Entamoeba invadens
DVFSKYGTVELVTILAKRPNYITRTIF

SEQ ID NO: 2931389 - protein, 18 aa, Entamoeba invadens
DVFWENKKGWALGQSHGK

SEQ ID NO: 2931390 - protein, 24 aa, Entamoeba invadens
DVGCGCGYTLLLLFQAGYTRLYGV

SEQ ID NO: 2931391 - protein, 22 aa, Entamoeba invadens
DVGCGWGGLVCEIGRIQSKNII

SEQ ID NO: 2931392 - protein, 28 aa, Entamoeba invadens
DVGCIKNFFWKKFGFSIEEAPRLDQIEK

SEQ ID NO: 2931393 - protein, 17 aa, Entamoeba invadens
DVGEVWFGEQIAEQVVD

SEQ ID NO: 2931394 - protein, 20 aa, Entamoeba invadens
DVGFAFAELFSGESELPTDY

SEQ ID NO: 2931395 - protein, 23 aa, Entamoeba invadens
DVGGLLRECYALALEDIVDEKTL

SEQ ID NO: 2931396 - protein, 31 aa, Entamoeba invadens
DVGIIASFLLRYEIFEPYHAFFIPPNYPHGY

SEQ ID NO: 2931397 - protein, 22 aa, Entamoeba invadens
DVGIVGACLLWKNQLDRQFDSS

SEQ ID NO: 2931398 - protein, 18 aa, Entamoeba invadens
DVGKRLTERFSDIEKAVT

SEQ ID NO: 2931399 - protein, 18 aa, Entamoeba invadens
DVGKWNFETMKLLDEANC

SEQ ID NO: 2931400 - protein, 18 aa, Entamoeba invadens
DVGLPLKLISIMEAHSFF

SEQ ID NO: 2931401 - protein, 17 aa, Entamoeba invadens
DVGRARRIFEDGVSNNR

SEQ ID NO: 2931402 - protein, 25 aa, Entamoeba invadens
DVHKIKFIPVDGFEGENLSTLSLKM

SEQ ID NO: 2931403 - protein, 26 aa, Entamoeba invadens
DVIADCGVEFIHILAAESKDVAGSAN

SEQ ID NO: 2931404 - protein, 19 aa, Entamoeba invadens
DVIATCWEDGQYLKNPRKV

SEQ ID NO: 2931405 - protein, 25 aa, Entamoeba invadens
DVIEKFKLFGIELRDDIPPEKYNAI

SEQ ID NO: 2931406 - protein, 25 aa, Entamoeba invadens
DVIEMEWFKDIDFDKLLKKEVPPPW

SEQ ID NO: 2931407 - protein, 17 aa, Entamoeba invadens
DVIEMMACLGGCLGGAG

SEQ ID NO: 2931408 - protein, 24 aa, Entamoeba invadens
DVIEPRVKPQWWVNCKNMAERAVK

SEQ ID NO: 2931409 - protein, 22 aa, Entamoeba invadens
DVIGRLLVFRSMSSVIEVTLPN

SEQ ID NO: 2931410 - protein, 26 aa, Entamoeba invadens
DVIIGNRCLFGYETLSSVAIPTSVIM

SEQ ID NO: 2931411 - protein, 22 aa, Entamoeba invadens
DVIKMMKERLIGTNPFIVYNTV

SEQ ID NO: 2931412 - protein, 17 aa, Entamoeba invadens
DVIKTERGFQIKVQLPG

SEQ ID NO: 2931413 - protein, 30 aa, Entamoeba invadens
DVILVGGPTRLCCFKKMIKNMFGKESLSQV

SEQ ID NO: 2931414 - protein, 18 aa, Entamoeba invadens
DVINELRRSNVEYVVAPY

SEQ ID NO: 2931415 - protein, 18 aa, Entamoeba invadens
DVIQFTARKNFSFWEFIL

SEQ ID NO: 2931416 - protein, 21 aa, Entamoeba invadens
DVIRFARDCVDPEIIEHIETE

SEQ ID NO: 2931417 - protein, 24 aa, Entamoeba invadens
DVISMCIPLTMLLLHQKLHTALVA

SEQ ID NO: 2931418 - protein, 26 aa, Entamoeba invadens
DVITFIIEIAREFWIGKDGIYDHALL

SEQ ID NO: 2931419 - protein, 25 aa, Entamoeba invadens
DVITIPIFFNLALKDHLNIGFKQYQ

SEQ ID NO: 2931420 - protein, 20 aa, Entamoeba invadens
DVKDAFVWGNHSEKQCPDIY

SEQ ID NO: 2931421 - protein, 19 aa, Entamoeba invadens
DVKDLISMLFVCEFHNESR

SEQ ID NO: 2931422 - protein, 18 aa, Entamoeba invadens
DVKGAMRITDIFKTIYKN

SEQ ID NO: 2931423 - protein, 30 aa, Entamoeba invadens
DVKGPSLYCVLPLVGSEKMQFPFLLNSPDF

SEQ ID NO: 2931424 - protein, 21 aa, Entamoeba invadens
DVKHFVRLVFHFISIIDSKTS

SEQ ID NO: 2931425 - protein, 25 aa, Entamoeba invadens
DVKILMYLKDVRCHSFNSQIVPYPG

SEQ ID NO: 2931426 - protein, 31 aa, Entamoeba invadens
DVKKIAAELTEFFNGIVLVVVMKTINKKDEK

SEQ ID NO: 2931427 - protein, 19 aa, Entamoeba invadens
DVKKILFYMRSVFKSLQNI

SEQ ID NO: 2931428 - protein, 20 aa, Entamoeba invadens
DVKLRNCGVNRIECFLSENI

SEQ ID NO: 2931429 - protein, 22 aa, Entamoeba invadens
DVKQECGFLIGFTAREGKGNTK

SEQ ID NO: 2931430 - protein, 25 aa, Entamoeba invadens
DVKVLRGSEAFKEIGNYFEQFVYMW

SEQ ID NO: 2931431 - protein, 17 aa, Entamoeba invadens
DVLAKVEPTRKCFRLVN

SEQ ID NO: 2931432 - protein, 24 aa, Entamoeba invadens
DVLEFKNCKALTLVIFNTKLSHTN

SEQ ID NO: 2931433 - protein, 25 aa, Entamoeba invadens
DVLEHTMRLAGFYVMKQTTEESLND

SEQ ID NO: 2931434 - protein, 27 aa, Entamoeba invadens
DVLFARLSVCLALIKTGRVTTSATLSY

SEQ ID NO: 2931435 - protein, 20 aa, Entamoeba invadens
DVLFGFRGQNMFGAKYKLVC

SEQ ID NO: 2931436 - protein, 18 aa, Entamoeba invadens
DVLKEIKIAATSKLTTRL

SEQ ID NO: 2931437 - protein, 25 aa, Entamoeba invadens
DVLKHFKQLGGLVVVVSYCDKNNIA

SEQ ID NO: 2931438 - protein, 21 aa, Entamoeba invadens
DVLKYYQRLVFLYKSRKFRKG

SEQ ID NO: 2931439 - protein, 17 aa, Entamoeba invadens
DVLLEKSLVEFKRRDVI

SEQ ID NO: 2931440 - protein, 26 aa, Entamoeba invadens
DVLLKRCVRSPATVGYWVLRAICGDC

SEQ ID NO: 2931441 - protein, 28 aa, Entamoeba invadens
DVLLRSESPIIFFEFKKVNNLLLVVDGQ

SEQ ID NO: 2931442 - protein, 19 aa, Entamoeba invadens
DVLLYCAFIPSAHKKLDKT

SEQ ID NO: 2931443 - protein, 19 aa, Entamoeba invadens
DVLNRIVLLTFDRNQQEEI

SEQ ID NO: 2931444 - protein, 29 aa, Entamoeba invadens
DVLPLEFSGFYPLWKFEVIYMAHNSTFHF

SEQ ID NO: 2931445 - protein, 28 aa, Entamoeba invadens
DVLPSRRFLCCGPLYLVVNLVSRPTAQN

SEQ ID NO: 2931446 - protein, 17 aa, Entamoeba invadens
DVLPTRNLIGVTIIYGP

SEQ ID NO: 2931447 - protein, 19 aa, Entamoeba invadens
DVLPVKIIRNTEFPEPPLL

SEQ ID NO: 2931448 - protein, 27 aa, Entamoeba invadens
DVLQFWNVFVKPKFFAHPDISSLNFVR

SEQ ID NO: 2931449 - protein, 20 aa, Entamoeba invadens
DVLRELGFGFVSKVTDGKNG

SEQ ID NO: 2931450 - protein, 17 aa, Entamoeba invadens
DVLRYGGTEFQFEAIET

SEQ ID NO: 2931451 - protein, 18 aa, Entamoeba invadens
DVLTKKSHGLYCSVCNRS

SEQ ID NO: 2931452 - protein, 17 aa, Entamoeba invadens
DVLTLWMQKQCSRPESK

SEQ ID NO: 2931453 - protein, 27 aa, Entamoeba invadens
DVLYFNGKWVVSRSVTWEINEYDAKEK

SEQ ID NO: 2931454 - protein, 23 aa, Entamoeba invadens
DVLYIKEMCCMNFNHLSSVTLST

SEQ ID NO: 2931455 - protein, 25 aa, Entamoeba invadens
DVLYLRTTRPFAVCFKNINKVFNDT

SEQ ID NO: 2931456 - protein, 17 aa, Entamoeba invadens
DVMGKGYNRCLAVLALI

SEQ ID NO: 2931457 - protein, 24 aa, Entamoeba invadens
DVMKEAPCCLIIDSLGRKFIPDRL

SEQ ID NO: 2931458 - protein, 17 aa, Entamoeba invadens
DVMRMKNAVNEEIGKVP

SEQ ID NO: 2931459 - protein, 23 aa, Entamoeba invadens
DVNKEIKNLFSIGNTTNHKVKIQ

SEQ ID NO: 2931460 - protein, 24 aa, Entamoeba invadens
DVNKEIKNLFSIGNTTNYKVKIQF

SEQ ID NO: 2931461 - protein, 24 aa, Entamoeba invadens
DVNRYSSEIGYWLAEEYWGHGIMP

SEQ ID NO: 2931462 - protein, 17 aa, Entamoeba invadens
DVNTVLCQLNIRERSIK

SEQ ID NO: 2931463 - protein, 26 aa, Entamoeba invadens
DVPHKVRLVGSFAFEKCEQLKELVFG

SEQ ID NO: 2931464 - protein, 19 aa, Entamoeba invadens
DVPSLITIVNGLRSVCDTF

SEQ ID NO: 2931465 - protein, 24 aa, Entamoeba invadens
DVPSNGEVLEFIYANDFDDEYKDC

SEQ ID NO: 2931466 - protein, 19 aa, Entamoeba invadens
DVPSNLQCRVIALDMGALI

SEQ ID NO: 2931467 - protein, 31 aa, Entamoeba invadens
DVPTAIQLFELVCKYIFIRKTFGGAYGSLYT

SEQ ID NO: 2931468 - protein, 18 aa, Entamoeba invadens
DVQKGWINMMLVVNQNDR

SEQ ID NO: 2931469 - protein, 29 aa, Entamoeba invadens
DVQSNKIMCCIPCKSTLGDKMYFMANNRY

SEQ ID NO: 2931470 - protein, 19 aa, Entamoeba invadens
DVQVGWCKYTIGYHSDDGM

SEQ ID NO: 2931471 - protein, 22 aa, Entamoeba invadens
DVRAACWMKEMFDEKNLEIVKF

SEQ ID NO: 2931472 - protein, 20 aa, Entamoeba invadens
DVRECRELLYEMLQILVDDE

SEQ ID NO: 2931473 - protein, 24 aa, Entamoeba invadens
DVREWSDDVFLEYFHERLSQKGSS

SEQ ID NO: 2931474 - protein, 22 aa, Entamoeba invadens
DVRIFYCGEYAFRIREFLGEQV

SEQ ID NO: 2931475 - protein, 21 aa, Entamoeba invadens
DVRIKRGIVCSGVVKVVPAIT

SEQ ID NO: 2931476 - protein, 23 aa, Entamoeba invadens
DVRIKRGIVGSGVVKDVPAITPN

SEQ ID NO: 2931477 - protein, 23 aa, Entamoeba invadens
DVRIKRGIVGSGVVKVVPAITPN

SEQ ID NO: 2931478 - protein, 25 aa, Entamoeba invadens
DVRIKRGIVVIVFRLTNICVLIKGI

SEQ ID NO: 2931479 - protein, 19 aa, Entamoeba invadens
DVRMKKCGFTIPAHNNIVM

SEQ ID NO: 2931480 - protein, 22 aa, Entamoeba invadens
DVRNELYGNIVLAGGNTMMPGF

SEQ ID NO: 2931481 - protein, 29 aa, Entamoeba invadens
DVRVSYEATRIVCNLIQFKPENAVEILKD

SEQ ID NO: 2931482 - protein, 25 aa, Entamoeba invadens
DVRYFEAKVGYGFFSLGVIDQLNYT

SEQ ID NO: 2931483 - protein, 19 aa, Entamoeba invadens
DVSCLIRFESYDKLFPKLD

SEQ ID NO: 2931484 - protein, 18 aa, Entamoeba invadens
DVSFLYCEFFDVYFQIRY

SEQ ID NO: 2931485 - protein, 17 aa, Entamoeba invadens
DVSKICLVYKGEKLANE

SEQ ID NO: 2931486 - protein, 19 aa, Entamoeba invadens
DVSLKYPLIPNAMYSMISV

SEQ ID NO: 2931487 - protein, 27 aa, Entamoeba invadens
DVSRGCLKRGVAVVGVGYPACSITACR

SEQ ID NO: 2931488 - protein, 17 aa, Entamoeba invadens
DVTALKFQSNFPTEEPY

SEQ ID NO: 2931489 - protein, 24 aa, Entamoeba invadens
DVTDCVAYAHLLHNCDKRCTLDAL

SEQ ID NO: 2931490 - protein, 29 aa, Entamoeba invadens
DVTEMPCLYPMAVALTFSREVFQKIASDK

SEQ ID NO: 2931491 - protein, 24 aa, Entamoeba invadens
DVTLWRLIEDCWKTQPEDRISLFL

SEQ ID NO: 2931492 - protein, 18 aa, Entamoeba invadens
DVTNWGKEWEVLRGICAV

SEQ ID NO: 2931493 - protein, 19 aa, Entamoeba invadens
DVTPKKCEPREELVTMKEA

SEQ ID NO: 2931494 - protein, 25 aa, Entamoeba invadens
DVTQCARCSSVFGRRKRKFYCKKCL

SEQ ID NO: 2931495 - protein, 25 aa, Entamoeba invadens
DVTSGMVVRPLLLVEGALSSIFYSS

SEQ ID NO: 2931496 - protein, 27 aa, Entamoeba invadens
DVTSGWGKPAFCCPYDGCPMAFEYPSF

SEQ ID NO: 2931497 - protein, 19 aa, Entamoeba invadens
DVTVWRGGILTVIGLYNTQ

SEQ ID NO: 2931498 - protein, 17 aa, Entamoeba invadens
DVTWGFYETIPIIQSYM

SEQ ID NO: 2931499 - protein, 20 aa, Entamoeba invadens
DVTYVGPHCFEFCANLEMCR

SEQ ID NO: 2931500 - protein, 17 aa, Entamoeba invadens
DVVAGVLKKFLLQMPNR

SEQ ID NO: 2931501 - protein, 19 aa, Entamoeba invadens
DVVALRLTPKAPRNSNGAL

SEQ ID NO: 2931502 - protein, 23 aa, Entamoeba invadens
DVVCVKNGVLACGCDDNTIKFYE

SEQ ID NO: 2931503 - protein, 19 aa, Entamoeba invadens
DVVEPYIFHKLRQTRKKGI

SEQ ID NO: 2931504 - protein, 17 aa, Entamoeba invadens
DVVHNFVQDTLKTVVTT

SEQ ID NO: 2931505 - protein, 24 aa, Entamoeba invadens
DVVMGCLYLRVLRVNVSKVSVDLI

SEQ ID NO: 2931506 - protein, 28 aa, Entamoeba invadens
DVVMKIGFCSRNVISLLLIKDKVIEGLL

SEQ ID NO: 2931507 - protein, 23 aa, Entamoeba invadens
DVVQVEGGFTFIIIDFYALGQLS

SEQ ID NO: 2931508 - protein, 26 aa, Entamoeba invadens
DVVSDVSCPWCYVGRRRLINAITQLS

SEQ ID NO: 2931509 - protein, 18 aa, Entamoeba invadens
DVVSKWTGIPVSRMTQSE

SEQ ID NO: 2931510 - protein, 24 aa, Entamoeba invadens
DVVTSVSVNEIWKGNLPEDEPTTA

SEQ ID NO: 2931511 - protein, 25 aa, Entamoeba invadens
DVWKAMVVTLFAWLKKNSDFSEREI

SEQ ID NO: 2931512 - protein, 28 aa, Entamoeba invadens
DVWSAGVVFYTLVCGFQPFTTTEKDTGN

SEQ ID NO: 2931513 - protein, 27 aa, Entamoeba invadens
DVWVPRLSELFPILHIEKSKTDMSPLQ

SEQ ID NO: 2931514 - protein, 25 aa, Entamoeba invadens
DVYIQKAFCTLDFALQLAQNPNRNA

SEQ ID NO: 2931515 - protein, 25 aa, Entamoeba invadens
DVYKMMNWWFEKGIDGFRMDVINMI

SEQ ID NO: 2931516 - protein, 20 aa, Entamoeba invadens
DVYLCSGLLNSLLYELPFPL

SEQ ID NO: 2931517 - protein, 18 aa, Entamoeba invadens
DVYSFAITMVECFLWSNA

SEQ ID NO: 2931518 - protein, 19 aa, Entamoeba invadens
DVYSFGIIMWELVERKEPF

SEQ ID NO: 2931519 - protein, 22 aa, Entamoeba invadens
DVYSLGVLILYLLSVATTHNTT

SEQ ID NO: 2931520 - protein, 20 aa, Entamoeba invadens
DVYSLIPFEPLQRIENKFNT

SEQ ID NO: 2931521 - protein, 20 aa, Entamoeba invadens
DVYSTISFAFLYSIQGVYSA

SEQ ID NO: 2931522 - protein, 26 aa, Entamoeba invadens
DVYTRNAYGFLVVYSITDRVSFDELD

SEQ ID NO: 2931523 - protein, 25 aa, Entamoeba invadens
DWCISRQLWWGHRIPAYLVNVKDTP

SEQ ID NO: 2931524 - protein, 24 aa, Entamoeba invadens
DWESGEKYGVFAFGRNIQEENTIE

SEQ ID NO: 2931525 - protein, 18 aa, Entamoeba invadens
DWETSYVLPSRFVAIEGS

SEQ ID NO: 2931526 - protein, 22 aa, Entamoeba invadens
DWFLNKWYYFFFVSIDGEDNGI

SEQ ID NO: 2931527 - protein, 25 aa, Entamoeba invadens
DWITKRLLILLGKRNFWCLVCNEKI

SEQ ID NO: 2931528 - protein, 21 aa, Entamoeba invadens
DWKTHLYPKFIGNEKELVKFR

SEQ ID NO: 2931529 - protein, 19 aa, Entamoeba invadens
DWKTTLFSSQFLKAPQLFV

SEQ ID NO: 2931530 - protein, 20 aa, Entamoeba invadens
DWKTTLFSSQFLKAPQLFVM

SEQ ID NO: 2931531 - protein, 24 aa, Entamoeba invadens
DWLKEYFDSCYVVAVAKNPMFSKS

SEQ ID NO: 2931532 - protein, 19 aa, Entamoeba invadens
DWLTVKFKTFEKCLDTDVL

SEQ ID NO: 2931533 - protein, 32 aa, Entamoeba invadens
DWNEAPSGLLARGEYKSNVKFFDDDKVTHLQF

SEQ ID NO: 2931534 - protein, 23 aa, Entamoeba invadens
DWQRKLKNVFVILNQGIVTKNPI

SEQ ID NO: 2931535 - protein, 20 aa, Entamoeba invadens
DWSGCATALVVLAGGKKIGF

SEQ ID NO: 2931536 - protein, 25 aa, Entamoeba invadens
DWTFYCHKCDGMASLRTCPHTKKDR

SEQ ID NO: 2931537 - protein, 25 aa, Entamoeba invadens
DWTFYCKKCDGMASLRTCPHTKKDR

SEQ ID NO: 2931538 - protein, 20 aa, Entamoeba invadens
DWVALPDFECGAMENWGIIT

SEQ ID NO: 2931539 - protein, 18 aa, Entamoeba invadens
DYAEVCFSLPESDFDQSS

SEQ ID NO: 2931540 - protein, 23 aa, Entamoeba invadens
DYALRKRNVKVVPIDLQEGVGEP

SEQ ID NO: 2931541 - protein, 23 aa, Entamoeba invadens
DYAYHFIPKFSKKVGEFQNIICV

SEQ ID NO: 2931542 - protein, 20 aa, Entamoeba invadens
DYCFCKCGSLTSVTIPSRVI

SEQ ID NO: 2931543 - protein, 18 aa, Entamoeba invadens
DYCFCKCSSLTSVKIPSS

SEQ ID NO: 2931544 - protein, 17 aa, Entamoeba invadens
DYCFNRYNKLDCINIPP

SEQ ID NO: 2931545 - protein, 17 aa, Entamoeba invadens
DYCFSRCSSLSSVIISS

SEQ ID NO: 2931546 - protein, 19 aa, Entamoeba invadens
DYCGVKVFRFYFKCTNCKN

SEQ ID NO: 2931547 - protein, 17 aa, Entamoeba invadens
DYCIPRMTVDQSLEIYK

SEQ ID NO: 2931548 - protein, 27 aa, Entamoeba invadens
DYCPGGEMYFRLTLEKSFSEERTQFYI

SEQ ID NO: 2931549 - protein, 18 aa, Entamoeba invadens
DYDACSLYPSAIHRLKLA

SEQ ID NO: 2931550 - protein, 32 aa, Entamoeba invadens
DYDACSLYPSAIHRLKLATGKPILIPKDLLNS

SEQ ID NO: 2931551 - protein, 32 aa, Entamoeba invadens
DYDACSLYPSAIHRLKLATGKPILIPKNLLNS

SEQ ID NO: 2931552 - protein, 20 aa, Entamoeba invadens
DYDKKELVRWINSQLMDNKT

SEQ ID NO: 2931553 - protein, 27 aa, Entamoeba invadens
DYDSLRFKSSRFFSTFTGTFDGKRADV

SEQ ID NO: 2931554 - protein, 18 aa, Entamoeba invadens
DYDTAEGLYDFLRNAIDQ

SEQ ID NO: 2931555 - protein, 19 aa, Entamoeba invadens
DYEMLISFYFWDKMGYTQN

SEQ ID NO: 2931556 - protein, 18 aa, Entamoeba invadens
DYETLEKMIFEFVNSSQE

SEQ ID NO: 2931557 - protein, 20 aa, Entamoeba invadens
DYFGGIIFENNVKKYFKVWH

SEQ ID NO: 2931558 - protein, 18 aa, Entamoeba invadens
DYFLKRALKGGSLTITKK

SEQ ID NO: 2931559 - protein, 29 aa, Entamoeba invadens
DYFSQRGNLEMDYCRKMIGLTDALNARST

SEQ ID NO: 2931560 - protein, 17 aa, Entamoeba invadens
DYFSSSELEEFVVPRNV

SEQ ID NO: 2931561 - protein, 25 aa, Entamoeba invadens
DYGLAHIYCMMAIFATSMAVDSVVT

SEQ ID NO: 2931562 - protein, 20 aa, Entamoeba invadens
DYGLRWRQLIHGGVFHAGSK

SEQ ID NO: 2931563 - protein, 35 aa, Entamoeba invadens
DYGTLRFGFRSIVAYAPWIKRIFLVTDGEVPDYID

SEQ ID NO: 2931564 - protein, 27 aa, Entamoeba invadens
DYHIACFKCKTCGLKLNNSNFYYDQPS

SEQ ID NO: 2931565 - protein, 28 aa, Entamoeba invadens
DYHIACFKCKTCGLKLNTSNFLYDHDTD

SEQ ID NO: 2931566 - protein, 18 aa, Entamoeba invadens
DYHIENFYTSCTHKQEIF

SEQ ID NO: 2931567 - protein, 20 aa, Entamoeba invadens
DYIESFRFGGWPHAGCGIGL

SEQ ID NO: 2931568 - protein, 32 aa, Entamoeba invadens
DYIFQCLKSRMFYERFPIERKIANALVAVAIQ

SEQ ID NO: 2931569 - protein, 26 aa, Entamoeba invadens
DYIIGFGFGHIRSWVMESNSMLNYSL

SEQ ID NO: 2931570 - protein, 22 aa, Entamoeba invadens
DYIIGGVLNLSGMREPEKQREF

SEQ ID NO: 2931571 - protein, 26 aa, Entamoeba invadens
DYITKLRLYIPFILLKDRLLIELSGE

SEQ ID NO: 2931572 - protein, 20 aa, Entamoeba invadens
DYLDYSMIYSLQRLFSDMAL

SEQ ID NO: 2931573 - protein, 21 aa, Entamoeba invadens
DYLERMPLASFVSFSSYQPMR

SEQ ID NO: 2931574 - protein, 22 aa, Entamoeba invadens
DYLEVETGLYLNILVQQIESAF

SEQ ID NO: 2931575 - protein, 35 aa, Entamoeba invadens
DYLFSVPNFFVFKKKECKVIEGFEKSYECQTTVVE

SEQ ID NO: 2931576 - protein, 18 aa, Entamoeba invadens
DYLFTLIGKKFTKEEFED

SEQ ID NO: 2931577 - protein, 19 aa, Entamoeba invadens
DYLKACGVKVRPTKTKSKE

SEQ ID NO: 2931578 - protein, 17 aa, Entamoeba invadens
DYLKDVRLSGFNQIVTP

SEQ ID NO: 2931579 - protein, 29 aa, Entamoeba invadens
DYLKLPYKLKIRMLFDTAKGMQFLHENRI

SEQ ID NO: 2931580 - protein, 17 aa, Entamoeba invadens
DYLKMPAIFEIEIAAFH

SEQ ID NO: 2931581 - protein, 22 aa, Entamoeba invadens
DYLKPYLRRTTLIKEIVEKNDC

SEQ ID NO: 2931582 - protein, 18 aa, Entamoeba invadens
DYLPEGILKKLTKKVNAK

SEQ ID NO: 2931583 - protein, 22 aa, Entamoeba invadens
DYLPKKRQTLLFSATQTKSVKD

SEQ ID NO: 2931584 - protein, 24 aa, Entamoeba invadens
DYLRFIPQLEHSFYIVDGRDQMIF

SEQ ID NO: 2931585 - protein, 19 aa, Entamoeba invadens
DYLVVRHGMKVNETIKSLS

SEQ ID NO: 2931586 - protein, 17 aa, Entamoeba invadens
DYMAKFFCNVPMTICPF

SEQ ID NO: 2931587 - protein, 24 aa, Entamoeba invadens
DYMPNDSPMCWAATSANIIDWYQN

SEQ ID NO: 2931588 - protein, 24 aa, Entamoeba invadens
DYMQKGCRIYRAIFSSITKNEIVK

SEQ ID NO: 2931589 - protein, 24 aa, Entamoeba invadens
DYNFEFNHIASLYFLDKRKNGYFL

SEQ ID NO: 2931590 - protein, 21 aa, Entamoeba invadens
DYNSMCYNFKMTEFLDKECPE

SEQ ID NO: 2931591 - protein, 31 aa, Entamoeba invadens
DYNTCSLYPSAIHRLKLATGKPILIAQESCN

SEQ ID NO: 2931592 - protein, 20 aa, Entamoeba invadens
DYNTCSVLSCVEQQSVDIAE

SEQ ID NO: 2931593 - protein, 18 aa, Entamoeba invadens
DYPCPIKTIIKIRKNKRV

SEQ ID NO: 2931594 - protein, 22 aa, Entamoeba invadens
DYPEFPGKLLVHSEEMLNERKY

SEQ ID NO: 2931595 - protein, 22 aa, Entamoeba invadens
DYPGSCALMCIIDKFGDKRTIY

SEQ ID NO: 2931596 - protein, 20 aa, Entamoeba invadens
DYPKLVEIVNILLPTFSTSV

SEQ ID NO: 2931597 - protein, 24 aa, Entamoeba invadens
DYPNLKTVVLYSEDFRIDRDAVKK

SEQ ID NO: 2931598 - protein, 18 aa, Entamoeba invadens
DYQFCNTVLLALKNTFSG

SEQ ID NO: 2931599 - protein, 20 aa, Entamoeba invadens
DYQQSYLICTLIKEGHEVTV

SEQ ID NO: 2931600 - protein, 19 aa, Entamoeba invadens
DYQQSYLICTLMKEGHEVT

SEQ ID NO: 2931601 - protein, 20 aa, Entamoeba invadens
DYQTCIKLVTSISEDVKADL

SEQ ID NO: 2931602 - protein, 23 aa, Entamoeba invadens
DYRCEECGVVSDATRSEMFEELP

SEQ ID NO: 2931603 - protein, 20 aa, Entamoeba invadens
DYRIINAFFDSCFDDRLVNM

SEQ ID NO: 2931604 - protein, 25 aa, Entamoeba invadens
DYRRRLPVVYIRLFSYELARSLAYI

SEQ ID NO: 2931605 - protein, 22 aa, Entamoeba invadens
DYRSCGPLAISAMKSLDKNVPP

SEQ ID NO: 2931606 - protein, 17 aa, Entamoeba invadens
DYSDLYFLGNDSNCNTP

SEQ ID NO: 2931607 - protein, 20 aa, Entamoeba invadens
DYSEEFKIAMNFQSKEITTA

SEQ ID NO: 2931608 - protein, 18 aa, Entamoeba invadens
DYSKEFYYDLATRLPSEK

SEQ ID NO: 2931609 - protein, 26 aa, Entamoeba invadens
DYSLDVKEIYPFIKIVNLEILEEAFP

SEQ ID NO: 2931610 - protein, 22 aa, Entamoeba invadens
DYSLSGTILKHFVIPENSVVGK

SEQ ID NO: 2931611 - protein, 22 aa, Entamoeba invadens
DYSRKCVKCLNGYYPDSNGKCV

SEQ ID NO: 2931612 - protein, 28 aa, Entamoeba invadens
DYSTEVLFYLLAHKICYPTKVYMLRGNH

SEQ ID NO: 2931613 - protein, 24 aa, Entamoeba invadens
DYSTIEVLREWILLYMNCRINQRV

SEQ ID NO: 2931614 - protein, 18 aa, Entamoeba invadens
DYSTKFVILVIDRSSQES

SEQ ID NO: 2931615 - protein, 19 aa, Entamoeba invadens
DYTADEWLLADAIKKVDVM

SEQ ID NO: 2931616 - protein, 22 aa, Entamoeba invadens
DYTHLKPTFSKMFSLSEVTFKG

SEQ ID NO: 2931617 - protein, 22 aa, Entamoeba invadens
DYTRKCIVCQSGYFTNEDADFK

SEQ ID NO: 2931618 - protein, 24 aa, Entamoeba invadens
DYVEAKALAIKWNVGLIESSTKTN

SEQ ID NO: 2931619 - protein, 20 aa, Entamoeba invadens
DYVETRWYRAPEILLGSQRY

SEQ ID NO: 2931620 - protein, 26 aa, Entamoeba invadens
DYVGYLYECIKKFKPLINKFVQEGVI

SEQ ID NO: 2931621 - protein, 24 aa, Entamoeba invadens
DYVLLRINTCFEVRSTGGVKVDRR

SEQ ID NO: 2931622 - protein, 21 aa, Entamoeba invadens
DYVLVGGIIKKIMRDMKKPIW

SEQ ID NO: 2931623 - protein, 19 aa, Entamoeba invadens
DYVPAEVALSLGYKNKLMD

SEQ ID NO: 2931624 - protein, 17 aa, Entamoeba invadens
DYVPRGVTDIGFDSFLM

SEQ ID NO: 2931625 - protein, 19 aa, Entamoeba invadens
DYVRRCVHENLPIDLVLYD

SEQ ID NO: 2931626 - protein, 30 aa, Entamoeba invadens
DYYEKNWILGWPVLLWCQFNQMIRTVNLSE

SEQ ID NO: 2931627 - protein, 19 aa, Entamoeba invadens
EAAEKRYAALTLNIGDSRA

SEQ ID NO: 2931628 - protein, 18 aa, Entamoeba invadens
EAALCDSLAFLLKIMDDP

SEQ ID NO: 2931629 - protein, 18 aa, Entamoeba invadens
EAALLYGLIHARYILTSS

SEQ ID NO: 2931630 - protein, 24 aa, Entamoeba invadens
EAAMLCIREKMALVDVEADTIPVD

SEQ ID NO: 2931631 - protein, 21 aa, Entamoeba invadens
EAANVCIDFLKTLGIENDCDE

SEQ ID NO: 2931632 - protein, 22 aa, Entamoeba invadens
EAARRLGVDVIKVIEIVLKSLK

SEQ ID NO: 2931633 - protein, 21 aa, Entamoeba invadens
EAASLLRAECFNIKETMSRDT

SEQ ID NO: 2931634 - protein, 20 aa, Entamoeba invadens
EACDYCHEHGLSVTIHAGES

SEQ ID NO: 2931635 - protein, 22 aa, Entamoeba invadens
EADCKQDLLAIFTMVINEMQIP

SEQ ID NO: 2931636 - protein, 33 aa, Entamoeba invadens
EADDGECGLHFFSKSFNAMKFKSKTRKSDTAIF

SEQ ID NO: 2931637 - protein, 20 aa, Entamoeba invadens
EADGVLEFYLEILKIATKSD

SEQ ID NO: 2931638 - protein, 26 aa, Entamoeba invadens
EADLKLFRTFWFTCVVVKYVKEGEHP

SEQ ID NO: 2931639 - protein, 21 aa, Entamoeba invadens
EADLRKLVYVNGIQNESRVLV

SEQ ID NO: 2931640 - protein, 21 aa, Entamoeba invadens
EADLYGFFVLVFEKEEDMFWA

SEQ ID NO: 2931641 - protein, 22 aa, Entamoeba invadens
EADLYWCFSSLMMNIQDHYTSN

SEQ ID NO: 2931642 - protein, 21 aa, Entamoeba invadens
EADSGDFLHGFFKEIGDVDHN

SEQ ID NO: 2931643 - protein, 22 aa, Entamoeba invadens
EADVWSCGVMLYEMTLRKNPFE

SEQ ID NO: 2931644 - protein, 20 aa, Entamoeba invadens
EAEAGIVPTGLIGSEDSSED

SEQ ID NO: 2931645 - protein, 22 aa, Entamoeba invadens
EAEDKWGNDWARVKFTLNTGFC

SEQ ID NO: 2931646 - protein, 24 aa, Entamoeba invadens
EAEEFKISGNELFIKKDYATAICE

SEQ ID NO: 2931647 - protein, 17 aa, Entamoeba invadens
EAEKQKRIEAENKRKAD

SEQ ID NO: 2931648 - protein, 21 aa, Entamoeba invadens
EAELLRLVKYLIDVFKCSRLA

SEQ ID NO: 2931649 - protein, 31 aa, Entamoeba invadens
EAELNNALIYFLKRVGFSFEEKKTKKSKCTE

SEQ ID NO: 2931650 - protein, 24 aa, Entamoeba invadens
EAEMKSEIELLKLEWERSKMETKM

SEQ ID NO: 2931651 - protein, 17 aa, Entamoeba invadens
EAENTIRGYLCTTRHGL

SEQ ID NO: 2931652 - protein, 24 aa, Entamoeba invadens
EAERIKRTVACVVLHDGSVIIGRE

SEQ ID NO: 2931653 - protein, 18 aa, Entamoeba invadens
EAFAECKTLASINIPNNV

SEQ ID NO: 2931654 - protein, 20 aa, Entamoeba invadens
EAFCECIRLLGQNEGVKVGY

SEQ ID NO: 2931655 - protein, 24 aa, Entamoeba invadens
EAFINVPGLVFILSKVIVMNTDPK

SEQ ID NO: 2931656 - protein, 19 aa, Entamoeba invadens
EAFISALFDCCIAAKADPV

SEQ ID NO: 2931657 - protein, 18 aa, Entamoeba invadens
EAFKECVSLKTIILPKSL

SEQ ID NO: 2931658 - protein, 18 aa, Entamoeba invadens
EAFKMLHINPTFNGKMVK

SEQ ID NO: 2931659 - protein, 22 aa, Entamoeba invadens
EAFKPKMARFMREFIDKQDAKF

SEQ ID NO: 2931660 - protein, 25 aa, Entamoeba invadens
EAFPKSSYIFPWTIADYVSTGKRPV

SEQ ID NO: 2931661 - protein, 29 aa, Entamoeba invadens
EAFPREMFRYPWEVVNFITGGRRLDKPAN

SEQ ID NO: 2931662 - protein, 18 aa, Entamoeba invadens
EAFQYGLVAMTKHWKKRI

SEQ ID NO: 2931663 - protein, 25 aa, Entamoeba invadens
EAFRCTEPFFQPSLIGKEMAGLPEL

SEQ ID NO: 2931664 - protein, 21 aa, Entamoeba invadens
EAFTICPYLVFTSDLVSSDFQ

SEQ ID NO: 2931665 - protein, 17 aa, Entamoeba invadens
EAFYEMFAKSYLKCFHD

SEQ ID NO: 2931666 - protein, 20 aa, Entamoeba invadens
EAFYYFKHFKLCDTELEKGK

SEQ ID NO: 2931667 - protein, 23 aa, Entamoeba invadens
EAGEVSPPWGIVTMFMSWAELLN

SEQ ID NO: 2931668 - protein, 23 aa, Entamoeba invadens
EAGKCYSCEPFGYYFNNRACLSC

SEQ ID NO: 2931669 - protein, 20 aa, Entamoeba invadens
EAGKIRVKITLNNDKVAKSP

SEQ ID NO: 2931670 - protein, 27 aa, Entamoeba invadens
EAGQVLEPYSAIGLFRGERSVIIGDLN

SEQ ID NO: 2931671 - protein, 29 aa, Entamoeba invadens
EAGRVKPQWFWYLIEEHFRENGLVKQQLS

SEQ ID NO: 2931672 - protein, 22 aa, Entamoeba invadens
EAGVCAVHYVHYIYKYIEDKVA

SEQ ID NO: 2931673 - protein, 19 aa, Entamoeba invadens
EAGVDFAPKFGVDASADLF

SEQ ID NO: 2931674 - protein, 25 aa, Entamoeba invadens
EAHCKKISLLVLRSNTFAKQFYDKL

SEQ ID NO: 2931675 - protein, 27 aa, Entamoeba invadens
EAHGGYTYCAVSALALLGRVDEIDIDK

SEQ ID NO: 2931676 - protein, 21 aa, Entamoeba invadens
EAHKAFVKNLFEVLKKSILLV

SEQ ID NO: 2931677 - protein, 20 aa, Entamoeba invadens
EAHKVLKCCEGSSVVLSGIH

SEQ ID NO: 2931678 - protein, 23 aa, Entamoeba invadens
EAHPELFESVKLVLVDEPTNLDI

SEQ ID NO: 2931679 - protein, 25 aa, Entamoeba invadens
EAHRKFKGSVLYCAPEVLMESETYG

SEQ ID NO: 2931680 - protein, 22 aa, Entamoeba invadens
EAHRQCMKFCAPGKYEFEMEAQ

SEQ ID NO: 2931681 - protein, 22 aa, Entamoeba invadens
EAIDALPKCVVCNNPISTTAWE

SEQ ID NO: 2931682 - protein, 22 aa, Entamoeba invadens
EAIEINHIIKSLKIREIIDAIY

SEQ ID NO: 2931683 - protein, 18 aa, Entamoeba invadens
EAIESSDIVMVRELCREF

SEQ ID NO: 2931684 - protein, 25 aa, Entamoeba invadens
EAIFMKIQEGVFVWPHDVEVSDKLK

SEQ ID NO: 2931685 - protein, 20 aa, Entamoeba invadens
EAIFSAAFGTFMFDTEKERV

SEQ ID NO: 2931686 - protein, 24 aa, Entamoeba invadens
EAIHGPELDGYVTLNIGKIQGGTQ

SEQ ID NO: 2931687 - protein, 19 aa, Entamoeba invadens
EAILMIKTQFLGVFEGSLK

SEQ ID NO: 2931688 - protein, 24 aa, Entamoeba invadens
EAINELWDIITICKEQNYIENIIR

SEQ ID NO: 2931689 - protein, 25 aa, Entamoeba invadens
EAINEYMVQSAMMFHSASKQNGYLS

SEQ ID NO: 2931690 - protein, 24 aa, Entamoeba invadens
EAISFSKFFVCAHWNDFVKEKYEL

SEQ ID NO: 2931691 - protein, 20 aa, Entamoeba invadens
EAIVCLPSYFLDNNKCNLCS

SEQ ID NO: 2931692 - protein, 22 aa, Entamoeba invadens
EAIYKLKLVKRNQIMGRRKSSS

SEQ ID NO: 2931693 - protein, 21 aa, Entamoeba invadens
EAIYLKSLEKLIVPPTVKVLK

SEQ ID NO: 2931694 - protein, 19 aa, Entamoeba invadens
EAKEKVVYGIALFTNNEFD

SEQ ID NO: 2931695 - protein, 17 aa, Entamoeba invadens
EAKKGIFRTRDKTVSRP

SEQ ID NO: 2931696 - protein, 18 aa, Entamoeba invadens
EAKKGRWTNFDQAAEDAI

SEQ ID NO: 2931697 - protein, 21 aa, Entamoeba invadens
EAKKRRELEELKKLKEQERLK

SEQ ID NO: 2931698 - protein, 24 aa, Entamoeba invadens
EAKKTCSQFEFAIDQTIAALDDMK

SEQ ID NO: 2931699 - protein, 18 aa, Entamoeba invadens
EAKLKHVEAALGLNASIG

SEQ ID NO: 2931700 - protein, 17 aa, Entamoeba invadens
EAKLYCQSLCLLSKMFL

SEQ ID NO: 2931701 - protein, 17 aa, Entamoeba invadens
EAKNGLENFCYSMKNTL

SEQ ID NO: 2931702 - protein, 28 aa, Entamoeba invadens
EAKPFIEMVFDLICECLTAITDDLIKAD

SEQ ID NO: 2931703 - protein, 23 aa, Entamoeba invadens
EAKTLPVTGLREFNMFMVNGLLY

SEQ ID NO: 2931704 - protein, 26 aa, Entamoeba invadens
EAKYRCPKCLIPFCSVPCFKKHKEHC

SEQ ID NO: 2931705 - protein, 20 aa, Entamoeba invadens
EALAEYKKLQIIGPDWSIYS

SEQ ID NO: 2931706 - protein, 19 aa, Entamoeba invadens
EALARIIGGFLCNAAGEST

SEQ ID NO: 2931707 - protein, 26 aa, Entamoeba invadens
EALAYVKTRRKVACPNISFECQLKLF

SEQ ID NO: 2931708 - protein, 26 aa, Entamoeba invadens
EALCISLLIRHGVEFTLLKPRKTHTN

SEQ ID NO: 2931709 - protein, 17 aa, Entamoeba invadens
EALCKSIPSNAPNTFEW

SEQ ID NO: 2931710 - protein, 20 aa, Entamoeba invadens
EALDAIELWTNRQILNVQIE

SEQ ID NO: 2931711 - protein, 22 aa, Entamoeba invadens
EALDKPKFVDACEGVRDIYVNT

SEQ ID NO: 2931712 - protein, 24 aa, Entamoeba invadens
EALDRVLSLMPRIACNSLIHQNAI

SEQ ID NO: 2931713 - protein, 24 aa, Entamoeba invadens
EALEFNYRPPFYVITPATLSLEQN

SEQ ID NO: 2931714 - protein, 25 aa, Entamoeba invadens
EALFPQHYKLILKRIYVQTREVRGE

SEQ ID NO: 2931715 - protein, 19 aa, Entamoeba invadens
EALFQPRLIGSSSDSIPLL

SEQ ID NO: 2931716 - protein, 17 aa, Entamoeba invadens
EALIISSLLRKASIPMK

SEQ ID NO: 2931717 - protein, 23 aa, Entamoeba invadens
EALKIALELLTNVSTFDEKPNGE

SEQ ID NO: 2931718 - protein, 21 aa, Entamoeba invadens
EALKIVSNCYLHLGDAEKAVS

SEQ ID NO: 2931719 - protein, 18 aa, Entamoeba invadens
EALKRIHTAAQMVNFLPI

SEQ ID NO: 2931720 - protein, 24 aa, Entamoeba invadens
EALKRLEAITIQAFDIVRKTHFIY

SEQ ID NO: 2931721 - protein, 25 aa, Entamoeba invadens
EALKSDLLFCQKLGFNTLRKHAKVE

SEQ ID NO: 2931722 - protein, 18 aa, Entamoeba invadens
EALLPFTIYEEGREKIST

SEQ ID NO: 2931723 - protein, 25 aa, Entamoeba invadens
EALLSFKYTFDLAQWEKVKEVDGML

SEQ ID NO: 2931724 - protein, 17 aa, Entamoeba invadens
EALPFLQKSIELCPKDN

SEQ ID NO: 2931725 - protein, 17 aa, Entamoeba invadens
EALPLPYGVFAMLYTLL

SEQ ID NO: 2931726 - protein, 29 aa, Entamoeba invadens
EALQEAVILPIKFPQLFTDKRKPWTGILL

SEQ ID NO: 2931727 - protein, 20 aa, Entamoeba invadens
EAMELAKQCTLNYMEVSARS

SEQ ID NO: 2931728 - protein, 18 aa, Entamoeba invadens
EAMKQKEKDEMVKKLATL

SEQ ID NO: 2931729 - protein, 29 aa, Entamoeba invadens
EAMTGKLIEMFQFLLSIDFVDDAFNLLNG

SEQ ID NO: 2931730 - protein, 20 aa, Entamoeba invadens
EANAEILLRSEEIEKQYNTI

SEQ ID NO: 2931731 - protein, 19 aa, Entamoeba invadens
EANCCEFLFNLQKMDTSRK

SEQ ID NO: 2931732 - protein, 23 aa, Entamoeba invadens
EANDKPFFAKEMEEFKKAQDNFD

SEQ ID NO: 2931733 - protein, 24 aa, Entamoeba invadens
EANERAEFMWKNEANEKIIDEFKK

SEQ ID NO: 2931734 - protein, 20 aa, Entamoeba invadens
EANLFFQVLLAVVFYVGMCG

SEQ ID NO: 2931735 - protein, 22 aa, Entamoeba invadens
EAPEKLKEGYFFLFNDVLIETV

SEQ ID NO: 2931736 - protein, 23 aa, Entamoeba invadens
EAPFDIVTTFIKWLCNSTKLKEY

SEQ ID NO: 2931737 - protein, 21 aa, Entamoeba invadens
EAPINFLPTYKFVIGTQEYHE

SEQ ID NO: 2931738 - protein, 22 aa, Entamoeba invadens
EAPRPTLYLNRNFMPGEIREKN

SEQ ID NO: 2931739 - protein, 21 aa, Entamoeba invadens
EAQAFVKKVIENFKECIFYSG

SEQ ID NO: 2931740 - protein, 17 aa, Entamoeba invadens
EAQEMLVQFKVSSSFKL

SEQ ID NO: 2931741 - protein, 25 aa, Entamoeba invadens
EAQFKSLLKMEGFVFETNDQLLSLK

SEQ ID NO: 2931742 - protein, 25 aa, Entamoeba invadens
EAQGRKAFLGMGFAERGEAFDFSVA

SEQ ID NO: 2931743 - protein, 27 aa, Entamoeba invadens
EAQQDFLVLYLDWVVKMILDGGFIAPR

SEQ ID NO: 2931744 - protein, 19 aa, Entamoeba invadens
EAQRWWVRDQKPSVEFNVG

SEQ ID NO: 2931745 - protein, 21 aa, Entamoeba invadens
EAREGADLLIEKKFIKEFPQG

SEQ ID NO: 2931746 - protein, 24 aa, Entamoeba invadens
EARHFYFYILWVLKNIEVKTLTNL

SEQ ID NO: 2931747 - protein, 20 aa, Entamoeba invadens
EARLKIYPITNYKIITQPDT

SEQ ID NO: 2931748 - protein, 19 aa, Entamoeba invadens
EARQLKGGDFFGLSSDPFV

SEQ ID NO: 2931749 - protein, 25 aa, Entamoeba invadens
EARRCLYCADANCQNCCPTNLDAKR

SEQ ID NO: 2931750 - protein, 24 aa, Entamoeba invadens
EARRFCNKENVFAYVIGIFPDEEH

SEQ ID NO: 2931751 - protein, 20 aa, Entamoeba invadens
EARVEFSKYIKVIVKAIQKG

SEQ ID NO: 2931752 - protein, 24 aa, Entamoeba invadens
EARVKRFPEEPVFGYREKKDGKYQ

SEQ ID NO: 2931753 - protein, 24 aa, Entamoeba invadens
EARWESWKFCFGLSNSPVSISKMT

SEQ ID NO: 2931754 - protein, 19 aa, Entamoeba invadens
EASCALINNNVDWVPVENL

SEQ ID NO: 2931755 - protein, 17 aa, Entamoeba invadens
EASEIKGSSFFKKTSTP

SEQ ID NO: 2931756 - protein, 17 aa, Entamoeba invadens
EASGAVNDVSWCGTNQD

SEQ ID NO: 2931757 - protein, 23 aa, Entamoeba invadens
EASKRLGVDIKDTVVFEDSKLAL

SEQ ID NO: 2931758 - protein, 24 aa, Entamoeba invadens
EASKYPISIICVGVGDGPFDKMET

SEQ ID NO: 2931759 - protein, 24 aa, Entamoeba invadens
EASNIKFLYVLKNVFYMFAKNGNN

SEQ ID NO: 2931760 - protein, 21 aa, Entamoeba invadens
EASTILELLPSLNAGELEAQH

SEQ ID NO: 2931761 - protein, 26 aa, Entamoeba invadens
EATACYRKGSFPLSTSFEEPKETILP

SEQ ID NO: 2931762 - protein, 24 aa, Entamoeba invadens
EATFVKNWDRGFGKKIGYKALKQF

SEQ ID NO: 2931763 - protein, 18 aa, Entamoeba invadens
EATLEINSTTGFVYVNQK

SEQ ID NO: 2931764 - protein, 21 aa, Entamoeba invadens
EATQKYLGIISMIDPSLDLSS

SEQ ID NO: 2931765 - protein, 20 aa, Entamoeba invadens
EATVGIDLLVQFPEISTPLV

SEQ ID NO: 2931766 - protein, 19 aa, Entamoeba invadens
EATYCKKCGEMLVKRSRFR

SEQ ID NO: 2931767 - protein, 21 aa, Entamoeba invadens
EAVEIALSHIVDVKTLQSFQK

SEQ ID NO: 2931768 - protein, 20 aa, Entamoeba invadens
EAVESVMYLKMRNEEIKNFL

SEQ ID NO: 2931769 - protein, 22 aa, Entamoeba invadens
EAVKNLMGCDSFELRVLRDTKT

SEQ ID NO: 2931770 - protein, 22 aa, Entamoeba invadens
EAVKSAVCKVNIDSDGRLAMTG

SEQ ID NO: 2931771 - protein, 22 aa, Entamoeba invadens
EAVLKKAYKQTFDFTNIISDLK

SEQ ID NO: 2931772 - protein, 19 aa, Entamoeba invadens
EAVLREFMMSYQIEDVTSP

SEQ ID NO: 2931773 - protein, 19 aa, Entamoeba invadens
EAVNQFGKNNWRSVEEVVM

SEQ ID NO: 2931774 - protein, 26 aa, Entamoeba invadens
EAVNQFGKNNWRSVEEVVMTRTRKQC

SEQ ID NO: 2931775 - protein, 23 aa, Entamoeba invadens
EAVRVCVLKAIFVDLTGYTVNGI

SEQ ID NO: 2931776 - protein, 17 aa, Entamoeba invadens
EAVSIYGPKHWQSIADR

SEQ ID NO: 2931777 - protein, 20 aa, Entamoeba invadens
EAVVQLVFFVFAYFEGQKSV

SEQ ID NO: 2931778 - protein, 23 aa, Entamoeba invadens
EAYGSDWWFPFYSKEEAVSQLEG

SEQ ID NO: 2931779 - protein, 38 aa, Entamoeba invadens
EAYKNQCLPCPINCLHCVKGKCVLCDKEYIVDVNGNCE

SEQ ID NO: 2931780 - protein, 25 aa, Entamoeba invadens
EAYPKDIFKYPWRIAEFVNSGNRMD

SEQ ID NO: 2931781 - protein, 26 aa, Entamoeba invadens
EAYPKKDFKYPWKIAEFVMNGKRLEN

SEQ ID NO: 2931782 - protein, 23 aa, Entamoeba invadens
ECAEVFLQTILNAFGYVPNDKGS

SEQ ID NO: 2931783 - protein, 22 aa, Entamoeba invadens
ECAGIEGILRLSGDSDNIQRLE

SEQ ID NO: 2931784 - protein, 28 aa, Entamoeba invadens
ECAKNIACKGCSNCTLNIDCELCETFEF

SEQ ID NO: 2931785 - protein, 22 aa, Entamoeba invadens
ECANLKVLSCSELPKNLPDSLI

SEQ ID NO: 2931786 - protein, 19 aa, Entamoeba invadens
ECASWRYNYQTSALELRNL

SEQ ID NO: 2931787 - protein, 19 aa, Entamoeba invadens
ECCGPRCYYCKQPIEDQAI

SEQ ID NO: 2931788 - protein, 21 aa, Entamoeba invadens
ECCNQCLQLKNVVLPPLIDTI

SEQ ID NO: 2931789 - protein, 26 aa, Entamoeba invadens
ECCVTKCGHAFCKSCLEEALHFNPRC

SEQ ID NO: 2931790 - protein, 33 aa, Entamoeba invadens
ECCYAASYFTYKWDEMMALDAFDLFVQNGLFNE

SEQ ID NO: 2931791 - protein, 17 aa, Entamoeba invadens
ECDHCYLCRCPLEVNHI

SEQ ID NO: 2931792 - protein, 23 aa, Entamoeba invadens
ECDVICCTCCVAGDRRLFGINNQ

SEQ ID NO: 2931793 - protein, 23 aa, Entamoeba invadens
ECEKLESVLIPFSVTKIEEFAFK

SEQ ID NO: 2931794 - protein, 22 aa, Entamoeba invadens
ECEKLQKLVIVKAFSTFQKMLF

SEQ ID NO: 2931795 - protein, 17 aa, Entamoeba invadens
ECELELTTLSLTWDTEQ

SEQ ID NO: 2931796 - protein, 28 aa, Entamoeba invadens
ECESLCVYIAMFSRFVQFSVRKYVNNFD

SEQ ID NO: 2931797 - protein, 30 aa, Entamoeba invadens
ECFDVSRCKFLRVCRIEFQNVSCWENCFSD

SEQ ID NO: 2931798 - protein, 19 aa, Entamoeba invadens
ECFELSKEIGITAAMVTDL

SEQ ID NO: 2931799 - protein, 19 aa, Entamoeba invadens
ECFHGCSSLSSVNIPSSVT

SEQ ID NO: 2931800 - protein, 17 aa, Entamoeba invadens
ECFIIRVDFPTSYNHLI

SEQ ID NO: 2931801 - protein, 24 aa, Entamoeba invadens
ECFKCIRERIKGVAPLQEEQILIS

SEQ ID NO: 2931802 - protein, 18 aa, Entamoeba invadens
ECFSGCFYLNGFKFPNVK

SEQ ID NO: 2931803 - protein, 18 aa, Entamoeba invadens
ECFSWCFSLSSVIIPSSV

SEQ ID NO: 2931804 - protein, 17 aa, Entamoeba invadens
ECFSWCRKLSGVTIPTS

SEQ ID NO: 2931805 - protein, 18 aa, Entamoeba invadens
ECFYACGLTKICVPRNVK

SEQ ID NO: 2931806 - protein, 19 aa, Entamoeba invadens
ECFYACGLTKICVPRNVKK

SEQ ID NO: 2931807 - protein, 24 aa, Entamoeba invadens
ECGCGKTSLIKRYVQGIEVKEYEP

SEQ ID NO: 2931808 - protein, 24 aa, Entamoeba invadens
ECGGKFKIYIADWFAQLNHKMGGD

SEQ ID NO: 2931809 - protein, 22 aa, Entamoeba invadens
ECGPLDALVRPLALAPCTSDTH

SEQ ID NO: 2931810 - protein, 19 aa, Entamoeba invadens
ECHLRLKALGYLFNNIKLT

SEQ ID NO: 2931811 - protein, 21 aa, Entamoeba invadens
ECHMKKLLMFYMWNSNNIKFL

SEQ ID NO: 2931812 - protein, 19 aa, Entamoeba invadens
ECHRLSAITIPSRFKDTTD

SEQ ID NO: 2931813 - protein, 20 aa, Entamoeba invadens
ECIECFCFYECESLKSIKIS

SEQ ID NO: 2931814 - protein, 33 aa, Entamoeba invadens
ECIITFAFPIIQLVAPFVSFRVVKDFNENNTKE

SEQ ID NO: 2931815 - protein, 17 aa, Entamoeba invadens
ECKDIIFLLSQFIGTSG

SEQ ID NO: 2931816 - protein, 25 aa, Entamoeba invadens
ECKKAEKEFGWKAEMGLDEMCEDAW

SEQ ID NO: 2931817 - protein, 24 aa, Entamoeba invadens
ECKKAEKELGWKTELDLEQMCEDS

SEQ ID NO: 2931818 - protein, 31 aa, Entamoeba invadens
ECKRRFDVRVWRCFCEAFRYLPVSALIEGKI

SEQ ID NO: 2931819 - protein, 18 aa, Entamoeba invadens
ECKRTMKVHDDIVTGVVC

SEQ ID NO: 2931820 - protein, 29 aa, Entamoeba invadens
ECKTCRCTRSDCPGHFGYIQLYAPVYNPV

SEQ ID NO: 2931821 - protein, 18 aa, Entamoeba invadens
ECKVCYPPFELKEGSCVE

SEQ ID NO: 2931822 - protein, 25 aa, Entamoeba invadens
ECLDAFKLKSGICAETFDENDKLKT

SEQ ID NO: 2931823 - protein, 30 aa, Entamoeba invadens
ECLDCPNNCKRCVNQKCVLCEDNYSYNSEG

SEQ ID NO: 2931824 - protein, 19 aa, Entamoeba invadens
ECLDLGMYPSWDADNVVSL

SEQ ID NO: 2931825 - protein, 25 aa, Entamoeba invadens
ECLEHFDELCEVLKYIGKKKYATRQ

SEQ ID NO: 2931826 - protein, 23 aa, Entamoeba invadens
ECLKCPTDFYLRNKTCKPFDNKN

SEQ ID NO: 2931827 - protein, 23 aa, Entamoeba invadens
ECLPDIGCKVVSLGDTKLLTAGN

SEQ ID NO: 2931828 - protein, 20 aa, Entamoeba invadens
ECLREVGQRITVTDFCTLVR

SEQ ID NO: 2931829 - protein, 19 aa, Entamoeba invadens
ECLYGDNMVKVMVLELLGL

SEQ ID NO: 2931830 - protein, 23 aa, Entamoeba invadens
ECMEKRLPPSTFRTIKNLLTNGG

SEQ ID NO: 2931831 - protein, 26 aa, Entamoeba invadens
ECMSLKSEDQIECIMCKLKNANKKDK

SEQ ID NO: 2931832 - protein, 22 aa, Entamoeba invadens
ECNAGTGPVEFVIHSVNKANVP

SEQ ID NO: 2931833 - protein, 18 aa, Entamoeba invadens
ECNKCLDGYGFVSSTMRV

SEQ ID NO: 2931834 - protein, 25 aa, Entamoeba invadens
ECNVNCKLFVACMFFTQIVLSKLKI

SEQ ID NO: 2931835 - protein, 17 aa, Entamoeba invadens
ECPDCHRSFCVEHRNQL

SEQ ID NO: 2931836 - protein, 18 aa, Entamoeba invadens
ECPEDFPNHPPKVMCLTP

SEQ ID NO: 2931837 - protein, 26 aa, Entamoeba invadens
ECPQVVPDCVEFLMKYVGHPILGKKV

SEQ ID NO: 2931838 - protein, 18 aa, Entamoeba invadens
ECPRLSSLTIPRSVQNFN

SEQ ID NO: 2931839 - protein, 20 aa, Entamoeba invadens
ECPYSVCFSVFVTFQKNNIK

SEQ ID NO: 2931840 - protein, 18 aa, Entamoeba invadens
ECQKALKPKDSAVRCVNC

SEQ ID NO: 2931841 - protein, 29 aa, Entamoeba invadens
ECQKCIKNYYMDSGVCKYFDCGEGGEFIN

SEQ ID NO: 2931842 - protein, 34 aa, Entamoeba invadens
ECQSGLRPQNVVEMSVDLCGPGVLTSQKVMYPFE

SEQ ID NO: 2931843 - protein, 22 aa, Entamoeba invadens
ECRKGVIYLTFFDSFHSGDFDS

SEQ ID NO: 2931844 - protein, 17 aa, Entamoeba invadens
ECSENSYLYDGECYSTI

SEQ ID NO: 2931845 - protein, 22 aa, Entamoeba invadens
ECSFEIIAQFYFTKLCSKNAES

SEQ ID NO: 2931846 - protein, 17 aa, Entamoeba invadens
ECSGLALYAKVYKFELE

SEQ ID NO: 2931847 - protein, 17 aa, Entamoeba invadens
ECSRLSSINIPLSVTSI

SEQ ID NO: 2931848 - protein, 18 aa, Entamoeba invadens
ECSRLSSINIPLSVTSIG

SEQ ID NO: 2931849 - protein, 18 aa, Entamoeba invadens
ECTIDVCTVCFDKMYYNT

SEQ ID NO: 2931850 - protein, 29 aa, Entamoeba invadens
ECTIECFLCRCRNPFVLGYIVLRNNPGTK

SEQ ID NO: 2931851 - protein, 19 aa, Entamoeba invadens
ECTMMVIGVSLYDANLDEV

SEQ ID NO: 2931852 - protein, 26 aa, Entamoeba invadens
ECTTDFPWEMFFVVFGELLEKKVAGM

SEQ ID NO: 2931853 - protein, 21 aa, Entamoeba invadens
ECTVFKALCVCINRTKEFNSM

SEQ ID NO: 2931854 - protein, 19 aa, Entamoeba invadens
ECVCKKYKCNMARFHFNPI

SEQ ID NO: 2931855 - protein, 23 aa, Entamoeba invadens
ECVDEFNMALGKFVMGIYLLGKK

SEQ ID NO: 2931856 - protein, 20 aa, Entamoeba invadens
ECVECQRLKKEVTKLKEEIV

SEQ ID NO: 2931857 - protein, 21 aa, Entamoeba invadens
ECVGCGVSVSVCQLSKTKMIP

SEQ ID NO: 2931858 - protein, 21 aa, Entamoeba invadens
ECVHVPPIIKSKLAFAAEGEV

SEQ ID NO: 2931859 - protein, 21 aa, Entamoeba invadens
ECVKLFTRRCYCLEDKHYIFV

SEQ ID NO: 2931860 - protein, 18 aa, Entamoeba invadens
ECVKSKLLTVSRAVFEIG

SEQ ID NO: 2931861 - protein, 25 aa, Entamoeba invadens
ECVKTLRIIFRFTAIVSVNLDNTNP

SEQ ID NO: 2931862 - protein, 17 aa, Entamoeba invadens
ECVLFFSKISFVCEIQP

SEQ ID NO: 2931863 - protein, 18 aa, Entamoeba invadens
ECVLLRFDSGDMLAIDTL

SEQ ID NO: 2931864 - protein, 20 aa, Entamoeba invadens
ECVLWGCLSLTSVTLSEGTT

SEQ ID NO: 2931865 - protein, 17 aa, Entamoeba invadens
ECVLYKNNLSFPFVNIT

SEQ ID NO: 2931866 - protein, 23 aa, Entamoeba invadens
ECVREQQLHPSLPSRATETRDER

SEQ ID NO: 2931867 - protein, 24 aa, Entamoeba invadens
ECVRQLINEKCRVIFIGRRKELGE

SEQ ID NO: 2931868 - protein, 24 aa, Entamoeba invadens
ECVSDVAFFKCFALSKIEIPKSLT

SEQ ID NO: 2931869 - protein, 25 aa, Entamoeba invadens
ECVSYKSVEFCLSANNSKCIKCDGF

SEQ ID NO: 2931870 - protein, 23 aa, Entamoeba invadens
ECYAFRWISIFFIDNFSFEDSLR

SEQ ID NO: 2931871 - protein, 22 aa, Entamoeba invadens
ECYAFSKCKMKTMKIADNVISI

SEQ ID NO: 2931872 - protein, 17 aa, Entamoeba invadens
ECYKDLFDKGQYQIYKD

SEQ ID NO: 2931873 - protein, 19 aa, Entamoeba invadens
ECYSLKNVFLIGATEIEKQ

SEQ ID NO: 2931874 - protein, 18 aa, Entamoeba invadens
EDACFSECYALEQINIPK

SEQ ID NO: 2931875 - protein, 18 aa, Entamoeba invadens
EDAEDFLAQLARKRGKLL

SEQ ID NO: 2931876 - protein, 18 aa, Entamoeba invadens
EDAEKCFLLNVLSEVLCK

SEQ ID NO: 2931877 - protein, 18 aa, Entamoeba invadens
EDAFLLCYTDLLKERIVM

SEQ ID NO: 2931878 - protein, 18 aa, Entamoeba invadens
EDAICQWTNLAMSDIIYD

SEQ ID NO: 2931879 - protein, 24 aa, Entamoeba invadens
EDAQRLATELGMLYAEASAKTGNG

SEQ ID NO: 2931880 - protein, 23 aa, Entamoeba invadens
EDAREFFSAGGLSLVSVLLGMKY

SEQ ID NO: 2931881 - protein, 21 aa, Entamoeba invadens
EDAVMYWLQRMVLAGEDPKNI

SEQ ID NO: 2931882 - protein, 17 aa, Entamoeba invadens
EDCDFRYNKKIELSEGL

SEQ ID NO: 2931883 - protein, 24 aa, Entamoeba invadens
EDDACSWIAGRIAMMIEDGEIPLK

SEQ ID NO: 2931884 - protein, 26 aa, Entamoeba invadens
EDDARLETCIVCNKHIDGEFVNALGY

SEQ ID NO: 2931885 - protein, 19 aa, Entamoeba invadens
EDDDFFAFSLKNPHNTQPL

SEQ ID NO: 2931886 - protein, 29 aa, Entamoeba invadens
EDDIKLIAKIHCKAGVIKIHRDFIINYVD

SEQ ID NO: 2931887 - protein, 21 aa, Entamoeba invadens
EDDKALLFRVMSQISTISKSY

SEQ ID NO: 2931888 - protein, 25 aa, Entamoeba invadens
EDDKIRVGMLYALKYEERAQEIIQE

SEQ ID NO: 2931889 - protein, 24 aa, Entamoeba invadens
EDDLSEMKTELEALEQAAKTYKQS

SEQ ID NO: 2931890 - protein, 27 aa, Entamoeba invadens
EDDMSEMKLKLEAFEQAAKTYKQSKNT

SEQ ID NO: 2931891 - protein, 20 aa, Entamoeba invadens
EDDRRVLFNSLALAIKIVMP

SEQ ID NO: 2931892 - protein, 23 aa, Entamoeba invadens
EDDRTRVLGLICFTVLGDINNRE

SEQ ID NO: 2931893 - protein, 27 aa, Entamoeba invadens
EDDSWLIYCYHCFYIRTNGLSKIDNTF

SEQ ID NO: 2931894 - protein, 20 aa, Entamoeba invadens
EDDVRFYAAQILLALEHMHS

SEQ ID NO: 2931895 - protein, 18 aa, Entamoeba invadens
EDEEGGGVKKRRFKVEGK

SEQ ID NO: 2931896 - protein, 18 aa, Entamoeba invadens
EDEILKNLFLINTPNSDY

SEQ ID NO: 2931897 - protein, 18 aa, Entamoeba invadens
EDELKQCLYSIADNNSYL

SEQ ID NO: 2931898 - protein, 22 aa, Entamoeba invadens
EDEMKFRLDVDFICPPDFDIDN

SEQ ID NO: 2931899 - protein, 27 aa, Entamoeba invadens
EDEMKTCPKGYVGQSIKNYEAEISRCE

SEQ ID NO: 2931900 - protein, 25 aa, Entamoeba invadens
EDENKVEALVTFFKTPTRPNGDETV

SEQ ID NO: 2931901 - protein, 19 aa, Entamoeba invadens
EDEVFLKTQMFFDSTNELR

SEQ ID NO: 2931902 - protein, 26 aa, Entamoeba invadens
EDEVFYKCGFVSFTFPKASISLENHF

SEQ ID NO: 2931903 - protein, 29 aa, Entamoeba invadens
EDEVFYKCGFVSFTFPKSVNFIGKSLFGY

SEQ ID NO: 2931904 - protein, 17 aa, Entamoeba invadens
EDEWGTSKGVLLAMKIG

SEQ ID NO: 2931905 - protein, 23 aa, Entamoeba invadens
EDEYDMAVSFDFFNKKNVEKKMK

SEQ ID NO: 2931906 - protein, 24 aa, Entamoeba invadens
EDEYKIPLMWRLTQLAMQNDGKSK

SEQ ID NO: 2931907 - protein, 17 aa, Entamoeba invadens
EDFDFASEKLSEISKKG

SEQ ID NO: 2931908 - protein, 25 aa, Entamoeba invadens
EDFEKDVLYLFGIINDFVMQKIKSG

SEQ ID NO: 2931909 - protein, 25 aa, Entamoeba invadens
EDFEKNRFGVYLTRKITDSNTFFMD

SEQ ID NO: 2931910 - protein, 26 aa, Entamoeba invadens
EDFEMWKGVIPHNFNKLKAISPFVNF

SEQ ID NO: 2931911 - protein, 20 aa, Entamoeba invadens
EDFGEAIMGSGLVLNENTHW

SEQ ID NO: 2931912 - protein, 19 aa, Entamoeba invadens
EDFIQSALRSNTCKSIALG

SEQ ID NO: 2931913 - protein, 23 aa, Entamoeba invadens
EDFKILAKQALDLIICHAAMLYI

SEQ ID NO: 2931914 - protein, 23 aa, Entamoeba invadens
EDFLNERLFEIVIKELKERYEEV

SEQ ID NO: 2931915 - protein, 23 aa, Entamoeba invadens
EDFLQDYCHLIKMVSCKKHGKTF

SEQ ID NO: 2931916 - protein, 18 aa, Entamoeba invadens
EDFSCGDITHLLSVANTL

SEQ ID NO: 2931917 - protein, 22 aa, Entamoeba invadens
EDFSLLASYMFTVYCPNFERVK

SEQ ID NO: 2931918 - protein, 19 aa, Entamoeba invadens
EDFYSLVEFCCPGSLGPLR

SEQ ID NO: 2931919 - protein, 21 aa, Entamoeba invadens
EDGELRRCCIICEYHGIRVWD

SEQ ID NO: 2931920 - protein, 25 aa, Entamoeba invadens
EDGKCKLYYIAHNDWNGWIPSFIFN

SEQ ID NO: 2931921 - protein, 17 aa, Entamoeba invadens
EDGKLVFQEGILVEAVR

SEQ ID NO: 2931922 - protein, 23 aa, Entamoeba invadens
EDGKWRRRSIVSAESSPAKENLG

SEQ ID NO: 2931923 - protein, 26 aa, Entamoeba invadens
EDGLKAVLSIAPFFPHKSIQQISLRI

SEQ ID NO: 2931924 - protein, 23 aa, Entamoeba invadens
EDHFFRVKVTVLIADKPIGEVLS

SEQ ID NO: 2931925 - protein, 27 aa, Entamoeba invadens
EDHFKLSFRITFQFNDNVFLKGNDVCI

SEQ ID NO: 2931926 - protein, 19 aa, Entamoeba invadens
EDICIKEQYNAEVIKNDLN

SEQ ID NO: 2931927 - protein, 19 aa, Entamoeba invadens
EDICLYKSPIPTMKIVVEP

SEQ ID NO: 2931928 - protein, 25 aa, Entamoeba invadens
EDIEFFGPRINSFIYHRLQNSKKVA

SEQ ID NO: 2931929 - protein, 24 aa, Entamoeba invadens
EDIEVVILNGHWVVRRSLVKDEEK

SEQ ID NO: 2931930 - protein, 29 aa, Entamoeba invadens
EDIFSRISRRAELSLSGFDIQCDGFKSAA

SEQ ID NO: 2931931 - protein, 24 aa, Entamoeba invadens
EDIKDGNVLLALSEAFSGDKFYEQ

SEQ ID NO: 2931932 - protein, 21 aa, Entamoeba invadens
EDIKGNVYAYFTSFKTDSTFY

SEQ ID NO: 2931933 - protein, 22 aa, Entamoeba invadens
EDIKPLRLFFSLADTDSNGSIN

SEQ ID NO: 2931934 - protein, 29 aa, Entamoeba invadens
EDIKSLSFCANCPLTTLYITNRETPLSYE

SEQ ID NO: 2931935 - protein, 19 aa, Entamoeba invadens
EDIKSRYTRNVKEAKRLVS

SEQ ID NO: 2931936 - protein, 24 aa, Entamoeba invadens
EDIKVVCGFIRVLFMFEIPFVNVL

SEQ ID NO: 2931937 - protein, 17 aa, Entamoeba invadens
EDIKYYISLKELKLSGV

SEQ ID NO: 2931938 - protein, 19 aa, Entamoeba invadens
EDILNLLVRNIKVTLYVER

SEQ ID NO: 2931939 - protein, 21 aa, Entamoeba invadens
EDILPPFFKALVKYVNQGKYS

SEQ ID NO: 2931940 - protein, 21 aa, Entamoeba invadens
EDILYAGLRTKVLKVRTTDEV

SEQ ID NO: 2931941 - protein, 26 aa, Entamoeba invadens
EDIMSTCSFVQLMVCCNYGTTLQPKK

SEQ ID NO: 2931942 - protein, 20 aa, Entamoeba invadens
EDINFRNGRITHFVPNVLEK

SEQ ID NO: 2931943 - protein, 19 aa, Entamoeba invadens
EDIPPLVIAAVAKMRGEEM

SEQ ID NO: 2931944 - protein, 22 aa, Entamoeba invadens
EDIRMAICPHITADIIEKVLLK

SEQ ID NO: 2931945 - protein, 23 aa, Entamoeba invadens
EDITDIFTALSFMVKYLHKEFTK

SEQ ID NO: 2931946 - protein, 19 aa, Entamoeba invadens
EDITELYLEKCIEFCAKNK

SEQ ID NO: 2931947 - protein, 22 aa, Entamoeba invadens
EDKAKKLGIKYFEVSAKSGFGL

SEQ ID NO: 2931948 - protein, 28 aa, Entamoeba invadens
EDKAQIFAWSRRSVGRVLFDYASDLPKR

SEQ ID NO: 2931949 - protein, 17 aa, Entamoeba invadens
EDKCPTTRHLIELMKQP

SEQ ID NO: 2931950 - protein, 18 aa, Entamoeba invadens
EDKCSRNVSKTCELSSCF

SEQ ID NO: 2931951 - protein, 21 aa, Entamoeba invadens
EDKEAFLFMLNKHGKHEPRMF

SEQ ID NO: 2931952 - protein, 17 aa, Entamoeba invadens
EDKEFAFTMGRHNSTKF

SEQ ID NO: 2931953 - protein, 25 aa, Entamoeba invadens
EDKEIKRNNWIVCVNTLVKPQGINL

SEQ ID NO: 2931954 - protein, 25 aa, Entamoeba invadens
EDKGFPTLPGVVYRSNLSGGTDDIE

SEQ ID NO: 2931955 - protein, 23 aa, Entamoeba invadens
EDKIYLRKSVRSELDSIKKSYKE

SEQ ID NO: 2931956 - protein, 20 aa, Entamoeba invadens
EDKKRLHLDTSFKSIMIYIY

SEQ ID NO: 2931957 - protein, 24 aa, Entamoeba invadens
EDKLPKRLMRSFDFDDEDSEVYDI

SEQ ID NO: 2931958 - protein, 19 aa, Entamoeba invadens
EDKNALVLYALLDLLEELI

SEQ ID NO: 2931959 - protein, 24 aa, Entamoeba invadens
EDKNGRLAICKVLKTLTGSNMDSR

SEQ ID NO: 2931960 - protein, 22 aa, Entamoeba invadens
EDKPFKVVCVSNVACQKTKNSP

SEQ ID NO: 2931961 - protein, 18 aa, Entamoeba invadens
EDKRPCQSIYSGYRTQFW

SEQ ID NO: 2931962 - protein, 27 aa, Entamoeba invadens
EDKVMYLVRWEKFSYLEATWILEKEVC

SEQ ID NO: 2931963 - protein, 23 aa, Entamoeba invadens
EDKWRKSLLDAINHSRFFISGKE

SEQ ID NO: 2931964 - protein, 28 aa, Entamoeba invadens
EDKYEYCVYCGKKFAKASVFGYHKKSAP

SEQ ID NO: 2931965 - protein, 17 aa, Entamoeba invadens
EDLASFVCTATLTFTDF

SEQ ID NO: 2931966 - protein, 17 aa, Entamoeba invadens
EDLCAVCMCEPREILLL

SEQ ID NO: 2931967 - protein, 19 aa, Entamoeba invadens
EDLFHCYDQVYSTTKQFLL

SEQ ID NO: 2931968 - protein, 27 aa, Entamoeba invadens
EDLGIKFVKPHGAFYFFPKIEEGNEEE

SEQ ID NO: 2931969 - protein, 25 aa, Entamoeba invadens
EDLHVLRLLPYDSIGEVDEQILEDS

SEQ ID NO: 2931970 - protein, 23 aa, Entamoeba invadens
EDLIDAFGLIVMGRFPKKIEDCK

SEQ ID NO: 2931971 - protein, 18 aa, Entamoeba invadens
EDLINMNLELTKEIDELK

SEQ ID NO: 2931972 - protein, 21 aa, Entamoeba invadens
EDLKDGIILMQLVEKLSGKKS

SEQ ID NO: 2931973 - protein, 22 aa, Entamoeba invadens
EDLKEPKVFRFEANSEAHKTLQ

SEQ ID NO: 2931974 - protein, 28 aa, Entamoeba invadens
EDLKKSVAFELVYVKWGYQDIAEVGQTI

SEQ ID NO: 2931975 - protein, 19 aa, Entamoeba invadens
EDLLVSFEIPVKVEKKDQT

SEQ ID NO: 2931976 - protein, 31 aa, Entamoeba invadens
EDLMRFHASMAITKYRFGVVYVGPGQYQENE

SEQ ID NO: 2931977 - protein, 23 aa, Entamoeba invadens
EDLNRGCGYIIDTFNEVFVYYGT

SEQ ID NO: 2931978 - protein, 29 aa, Entamoeba invadens
EDLPFKGAFRLTGKIGETFALPEDRDTLF

SEQ ID NO: 2931979 - protein, 22 aa, Entamoeba invadens
EDLQEIVTRITIMQRTKNVSSM

SEQ ID NO: 2931980 - protein, 18 aa, Entamoeba invadens
EDLQLVYGKICPQAYLLK

SEQ ID NO: 2931981 - protein, 17 aa, Entamoeba invadens
EDLQYWPEESFNVLFDK

SEQ ID NO: 2931982 - protein, 23 aa, Entamoeba invadens
EDLREIFNAIDYVINGKKTQEKK

SEQ ID NO: 2931983 - protein, 23 aa, Entamoeba invadens
EDLRIKMFLWKTLQCDKDLGTVK

SEQ ID NO: 2931984 - protein, 34 aa, Entamoeba invadens
EDLTEIGANCFLGCKSLCKLKIPQNVEKLMNSTF

SEQ ID NO: 2931985 - protein, 21 aa, Entamoeba invadens
EDLVWNIFLQINFGLAYLHSV

SEQ ID NO: 2931986 - protein, 18 aa, Entamoeba invadens
EDLYFLMKRAVSIRKHLE

SEQ ID NO: 2931987 - protein, 24 aa, Entamoeba invadens
EDLYKLGAVFEEIFMKKAATIEDK

SEQ ID NO: 2931988 - protein, 27 aa, Entamoeba invadens
EDLYKVVVPIDGFISVEDLIKNMCLPF

SEQ ID NO: 2931989 - protein, 23 aa, Entamoeba invadens
EDMDCIRYVSINALYMCSLDGAK

SEQ ID NO: 2931990 - protein, 20 aa, Entamoeba invadens
EDMFWAGVATFECEKFGLRQ

SEQ ID NO: 2931991 - protein, 17 aa, Entamoeba invadens
EDMKWTFVTRLLGFRAV

SEQ ID NO: 2931992 - protein, 28 aa, Entamoeba invadens
EDMYFLEACCIFAQYVLMLQEEPEKAKE

SEQ ID NO: 2931993 - protein, 18 aa, Entamoeba invadens
EDNCVQCTSFLRCEKCAS

SEQ ID NO: 2931994 - protein, 23 aa, Entamoeba invadens
EDNDFKPIVGYVIGTTYPIEVCY

SEQ ID NO: 2931995 - protein, 24 aa, Entamoeba invadens
EDNEMRCSFAVSAMGTVISKGKLY

SEQ ID NO: 2931996 - protein, 18 aa, Entamoeba invadens
EDNILEFAIEKEHKIDQD

SEQ ID NO: 2931997 - protein, 24 aa, Entamoeba invadens
EDNTWPQVFLKVLCNPHYELMLKV

SEQ ID NO: 2931998 - protein, 23 aa, Entamoeba invadens
EDPEFKNSFFFRSDAQKSDLKTT

SEQ ID NO: 2931999 - protein, 26 aa, Entamoeba invadens
EDPELIYMIGKPVGHNVEMTKSMLGT

SEQ ID NO: 2932000 - protein, 23 aa, Entamoeba invadens
EDPWNEYELYFSHICRDNEQKYS

SEQ ID NO: 2932001 - protein, 18 aa, Entamoeba invadens
EDQHCGWVKGSIGYFSDE

SEQ ID NO: 2932002 - protein, 24 aa, Entamoeba invadens
EDQKKIRLPFSIKIANTNKLNQFK

SEQ ID NO: 2932003 - protein, 18 aa, Entamoeba invadens
EDQPYQWDLFVKNEAEKS

SEQ ID NO: 2932004 - protein, 29 aa, Entamoeba invadens
EDRIKFVYEIKATVFLKQLQFDSAYYPLP

SEQ ID NO: 2932005 - protein, 21 aa, Entamoeba invadens
EDRKWSVIKKMRNERNRNLLL

SEQ ID NO: 2932006 - protein, 23 aa, Entamoeba invadens
EDRMCAFSDLAFHTCKSLSCIDT

SEQ ID NO: 2932007 - protein, 21 aa, Entamoeba invadens
EDRVRFPWYVAGGDYNEKDAV

SEQ ID NO: 2932008 - protein, 21 aa, Entamoeba invadens
EDRYPFLQVDFENIANIHVVR

SEQ ID NO: 2932009 - protein, 24 aa, Entamoeba invadens
EDSCKDIIFNCCSLFELNSKKNIH

SEQ ID NO: 2932010 - protein, 23 aa, Entamoeba invadens
EDSDKICCSIDFPYDKPLSPPAN

SEQ ID NO: 2932011 - protein, 23 aa, Entamoeba invadens
EDSLHIYNGFDFHSLTMQIEEEK

SEQ ID NO: 2932012 - protein, 25 aa, Entamoeba invadens
EDSLKFSYKVHFDFEPNEFFTNETI

SEQ ID NO: 2932013 - protein, 23 aa, Entamoeba invadens
EDTIFKPSLWMNLIERKFYEYNE

SEQ ID NO: 2932014 - protein, 26 aa, Entamoeba invadens
EDTIKRIQDLLVMWEKDMEKKVKRVK

SEQ ID NO: 2932015 - protein, 18 aa, Entamoeba invadens
EDTLKFFLSDNQRNKLIF

SEQ ID NO: 2932016 - protein, 22 aa, Entamoeba invadens
EDTSLCFIEKCDEVFKVMHLAH

SEQ ID NO: 2932017 - protein, 20 aa, Entamoeba invadens
EDTVHFGSFFIAKTGSNDMT

SEQ ID NO: 2932018 - protein, 17 aa, Entamoeba invadens
EDVCTRLNAMQQFQDTL

SEQ ID NO: 2932019 - protein, 25 aa, Entamoeba invadens
EDVDRLPVFFPILFNNKDDWKVFYR

SEQ ID NO: 2932020 - protein, 17 aa, Entamoeba invadens
EDVELMGILSGNHFKFE

SEQ ID NO: 2932021 - protein, 20 aa, Entamoeba invadens
EDVEPLILLFKLTDKDEDGK

SEQ ID NO: 2932022 - protein, 21 aa, Entamoeba invadens
EDVETMLSILFKNAINERRYV

SEQ ID NO: 2932023 - protein, 19 aa, Entamoeba invadens
EDVFEPKLVECIMKNTEDD

SEQ ID NO: 2932024 - protein, 24 aa, Entamoeba invadens
EDVICLGLLYGLIMRLIKYENIHK

SEQ ID NO: 2932025 - protein, 21 aa, Entamoeba invadens
EDVKGLLLIQKDVCDIIKNSD

SEQ ID NO: 2932026 - protein, 23 aa, Entamoeba invadens
EDVKNCPLFVFDIYLHGYTTKTV

SEQ ID NO: 2932027 - protein, 29 aa, Entamoeba invadens
EDVKRFLEEKGRWDSIEFESGMRALKDKR

SEQ ID NO: 2932028 - protein, 21 aa, Entamoeba invadens
EDVKYSVAIFRQLFLCLKDER

SEQ ID NO: 2932029 - protein, 37 aa, Entamoeba invadens
EDVLEVDGAFTLRFPLLDEVCEISTEISLSFKNASVK

SEQ ID NO: 2932030 - protein, 20 aa, Entamoeba invadens
EDVLKFSIIIDLYVLSGVYP

SEQ ID NO: 2932031 - protein, 24 aa, Entamoeba invadens
EDVLKHIKTLLGITTLLSITEHTK

SEQ ID NO: 2932032 - protein, 18 aa, Entamoeba invadens
EDVLRILPFYQSTPDIHN

SEQ ID NO: 2932033 - protein, 24 aa, Entamoeba invadens
EDVREHIKRVCVIYSLEHMDLQYN

SEQ ID NO: 2932034 - protein, 23 aa, Entamoeba invadens
EDVRERVKLAIGILSGKGENVVE

SEQ ID NO: 2932035 - protein, 20 aa, Entamoeba invadens
EDVVDLMFSIGLKKYVSDVK

SEQ ID NO: 2932036 - protein, 19 aa, Entamoeba invadens
EDWCKRKALECLRKAYDYR

SEQ ID NO: 2932037 - protein, 19 aa, Entamoeba invadens
EDWELLRTSMEKHFGNPFV

SEQ ID NO: 2932038 - protein, 21 aa, Entamoeba invadens
EDYALWKCCSLVRHPKFVPAK

SEQ ID NO: 2932039 - protein, 21 aa, Entamoeba invadens
EDYEMAKFCFENVYATAKETV

SEQ ID NO: 2932040 - protein, 18 aa, Entamoeba invadens
EDYINWLTKNRLILEFDD

SEQ ID NO: 2932041 - protein, 18 aa, Entamoeba invadens
EDYKFDRMLCDVPCSGDG

SEQ ID NO: 2932042 - protein, 31 aa, Entamoeba invadens
EDYKIFAADFFKEGVHGFLPRAKQFMEDEEF

SEQ ID NO: 2932043 - protein, 29 aa, Entamoeba invadens
EEACWKALIPRVDILFNFYDFSNQLKEIF

SEQ ID NO: 2932044 - protein, 17 aa, Entamoeba invadens
EEAEVWNSLLFDQIQRL

SEQ ID NO: 2932045 - protein, 20 aa, Entamoeba invadens
EEAFYTLVRCIRKQESSSDK

SEQ ID NO: 2932046 - protein, 17 aa, Entamoeba invadens
EEAIFLNIYFEKLELGI

SEQ ID NO: 2932047 - protein, 18 aa, Entamoeba invadens
EEAIHCINILIAWLEVRG

SEQ ID NO: 2932048 - protein, 18 aa, Entamoeba invadens
EEAIPLLKVEGAVLEKVV

SEQ ID NO: 2932049 - protein, 23 aa, Entamoeba invadens
EEAKEAIKVLIRMVKEGKETVEK

SEQ ID NO: 2932050 - protein, 17 aa, Entamoeba invadens
EEAKELIPMEESLQKLL

SEQ ID NO: 2932051 - protein, 25 aa, Entamoeba invadens
EEAKKAKCKLTLPIQKENAMLPAKF

SEQ ID NO: 2932052 - protein, 17 aa, Entamoeba invadens
EEAKLICKIGLKYAPKY

SEQ ID NO: 2932053 - protein, 27 aa, Entamoeba invadens
EEAKRKEIISSFEFYSDRLLDLYTLSY

SEQ ID NO: 2932054 - protein, 22 aa, Entamoeba invadens
EEALKAMALEVAEMCTEETDDP

SEQ ID NO: 2932055 - protein, 20 aa, Entamoeba invadens
EEAMTKRIVEMKMTKTDNLV

SEQ ID NO: 2932056 - protein, 43 aa, Entamoeba invadens
EEASECMRCGTPFSLFFRKHHCRNCGKVICSNCRVKSKVPKMG

SEQ ID NO: 2932057 - protein, 17 aa, Entamoeba invadens
EEASLLMGRLIKSSERL

SEQ ID NO: 2932058 - protein, 22 aa, Entamoeba invadens
EEAVFCLGSLLKVFNKAMSDNE

SEQ ID NO: 2932059 - protein, 30 aa, Entamoeba invadens
EEAYEKYSQELFKYIFGDTDVSTLNLPKIT

SEQ ID NO: 2932060 - protein, 18 aa, Entamoeba invadens
EEAYEVYTKFDLKELAMD

SEQ ID NO: 2932061 - protein, 20 aa, Entamoeba invadens
EEAYVPRFRVTEGEQAPIED

SEQ ID NO: 2932062 - protein, 19 aa, Entamoeba invadens
EECAQKAWMGGNYKCPLCG

SEQ ID NO: 2932063 - protein, 18 aa, Entamoeba invadens
EECIDRFEKVGGDYGEER

SEQ ID NO: 2932064 - protein, 19 aa, Entamoeba invadens
EECKKFVARLNVSVRELNF

SEQ ID NO: 2932065 - protein, 24 aa, Entamoeba invadens
EECKQLEEWTDLRVGNCVFDSLID

SEQ ID NO: 2932066 - protein, 24 aa, Entamoeba invadens
EECKWGNNELFGIAGCANLKALVI

SEQ ID NO: 2932067 - protein, 17 aa, Entamoeba invadens
EECLKKFGSPEMWKMCC

SEQ ID NO: 2932068 - protein, 22 aa, Entamoeba invadens
EECLRFDLDGFQGMVQLNGTEC

SEQ ID NO: 2932069 - protein, 20 aa, Entamoeba invadens
EEDFRPILKKVFDIPQCVGM

SEQ ID NO: 2932070 - protein, 18 aa, Entamoeba invadens
EEDLCQFFTSNAMDCENI

SEQ ID NO: 2932071 - protein, 21 aa, Entamoeba invadens
EEDLTAKFCIAHATEFSNLQE

SEQ ID NO: 2932072 - protein, 26 aa, Entamoeba invadens
EEDRRILLAYRIYWFEKNVEQKEGDS

SEQ ID NO: 2932073 - protein, 25 aa, Entamoeba invadens
EEDTKALLIRRAYDIAGCNPGKKVY

SEQ ID NO: 2932074 - protein, 20 aa, Entamoeba invadens
EEDTRINVSFGVDDVKSEKA

SEQ ID NO: 2932075 - protein, 33 aa, Entamoeba invadens
EEEEKVAYLFTFPFSTLKNFDWKSYQNELTEQQ

SEQ ID NO: 2932076 - protein, 19 aa, Entamoeba invadens
EEEEVEALPKFREKKTGDN

SEQ ID NO: 2932077 - protein, 19 aa, Entamoeba invadens
EEEIEDFKVPTGKISKKVI

SEQ ID NO: 2932078 - protein, 22 aa, Entamoeba invadens
EEEIRLKLTLATPRGKSKKREY

SEQ ID NO: 2932079 - protein, 23 aa, Entamoeba invadens
EEEKERMFHFLIDDFAYNRENLK

SEQ ID NO: 2932080 - protein, 21 aa, Entamoeba invadens
EEEKIRMCGFELLKKFYNEHI

SEQ ID NO: 2932081 - protein, 23 aa, Entamoeba invadens
EEEMMLWSCWFHNAGVEIRLPTP

SEQ ID NO: 2932082 - protein, 18 aa, Entamoeba invadens
EEERIAFFNRVMQANPNA

SEQ ID NO: 2932083 - protein, 24 aa, Entamoeba invadens
EEERRKKEEAKRLKEQQKKKGKKE

SEQ ID NO: 2932084 - protein, 29 aa, Entamoeba invadens
EEERTAAVLACEWVDEVVDGITWWCTPYD

SEQ ID NO: 2932085 - protein, 23 aa, Entamoeba invadens
EEESPCLRRVGNIGHDFCSDFYL

SEQ ID NO: 2932086 - protein, 25 aa, Entamoeba invadens
EEESPRLKSSFPLKTSKITHMTPIR

SEQ ID NO: 2932087 - protein, 19 aa, Entamoeba invadens
EEESVSGVECQNCKERTEH

SEQ ID NO: 2932088 - protein, 30 aa, Entamoeba invadens
EEETRYYAFLCHACYLASKGDHSGARLLLN

SEQ ID NO: 2932089 - protein, 29 aa, Entamoeba invadens
EEEVWRYIKGLKFPSGKEMVYKEFIKTSS

SEQ ID NO: 2932090 - protein, 33 aa, Entamoeba invadens
EEFAFSTNMIKVFWLFFFKRVFNELLTTIPVDD

SEQ ID NO: 2932091 - protein, 19 aa, Entamoeba invadens
EEFCKKRCRDRFLIDTKNN

SEQ ID NO: 2932092 - protein, 19 aa, Entamoeba invadens
EEFDIHKTILPYTLTSNTK

SEQ ID NO: 2932093 - protein, 27 aa, Entamoeba invadens
EEFFALAGICQTCFNGVCFDSQVDGWG

SEQ ID NO: 2932094 - protein, 19 aa, Entamoeba invadens
EEFGEGAFSISPRIKSVVL

SEQ ID NO: 2932095 - protein, 32 aa, Entamoeba invadens
EEFGVIIRMCWISSFLGKLGKKLCEKEVMKKK

SEQ ID NO: 2932096 - protein, 25 aa, Entamoeba invadens
EEFIHVFRTLPLCCLITSQHKKYLC

SEQ ID NO: 2932097 - protein, 25 aa, Entamoeba invadens
EEFILKWKNVHVVNEIVLKTEDVNE

SEQ ID NO: 2932098 - protein, 23 aa, Entamoeba invadens
EEFISRLILPLTRLLPNPILRDT

SEQ ID NO: 2932099 - protein, 23 aa, Entamoeba invadens
EEFISRLVLPLTRLLPNEILRDP

SEQ ID NO: 2932100 - protein, 17 aa, Entamoeba invadens
EEFKEKPTEEILDKAFT

SEQ ID NO: 2932101 - protein, 22 aa, Entamoeba invadens
EEFKEKVGFEYDEIFRLSNTKV

SEQ ID NO: 2932102 - protein, 25 aa, Entamoeba invadens
EEFLRTFLWVCGNIVACTQELQTNQ

SEQ ID NO: 2932103 - protein, 18 aa, Entamoeba invadens
EEFNHFMFCYDKCCDKGF

SEQ ID NO: 2932104 - protein, 17 aa, Entamoeba invadens
EEFPKYLLDPVTSPRNN

SEQ ID NO: 2932105 - protein, 23 aa, Entamoeba invadens
EEFRFGKTKIFFKVGVLAEIEEI

SEQ ID NO: 2932106 - protein, 23 aa, Entamoeba invadens
EEFRKQFKAARYIQERPPILNPN

SEQ ID NO: 2932107 - protein, 17 aa, Entamoeba invadens
EEFRLFQAISKDGSAKA

SEQ ID NO: 2932108 - protein, 22 aa, Entamoeba invadens
EEFSLAMYFSYFKSFIKSAPKK

SEQ ID NO: 2932109 - protein, 28 aa, Entamoeba invadens
EEFTKKYVKRWVAMSGPFLGAAKTIAAA

SEQ ID NO: 2932110 - protein, 20 aa, Entamoeba invadens
EEFTSLFVYGLFNKRNVVSC

SEQ ID NO: 2932111 - protein, 24 aa, Entamoeba invadens
EEGCCLCVEYCPLGDLTKYVEKRQ

SEQ ID NO: 2932112 - protein, 22 aa, Entamoeba invadens
EEGCPLNGILVSTFQCLQCNIE

SEQ ID NO: 2932113 - protein, 26 aa, Entamoeba invadens
EEGELKNIFWEFGDVKNVIFVKNKKG

SEQ ID NO: 2932114 - protein, 24 aa, Entamoeba invadens
EEGEYSYKHFLKCFHTFVDDLVQD

SEQ ID NO: 2932115 - protein, 22 aa, Entamoeba invadens
EEGFEIPIPLFYQIRKEKIALP

SEQ ID NO: 2932116 - protein, 28 aa, Entamoeba invadens
EEGFKQRLPRFVQMLMILSRRPNKNTEE

SEQ ID NO: 2932117 - protein, 22 aa, Entamoeba invadens
EEGFKRTAQSKMDMKKKKNKLR

SEQ ID NO: 2932118 - protein, 20 aa, Entamoeba invadens
EEGFMFTKCEMNFSPIPQQE

SEQ ID NO: 2932119 - protein, 22 aa, Entamoeba invadens
EEGKDVFMYAWRIKDMTEETKF

SEQ ID NO: 2932120 - protein, 18 aa, Entamoeba invadens
EEGKKLKERFDEIFGTTK

SEQ ID NO: 2932121 - protein, 18 aa, Entamoeba invadens
EEGLKQCKKLCLEAKDFT

SEQ ID NO: 2932122 - protein, 17 aa, Entamoeba invadens
EEGTFDWVQENTSNIPS

SEQ ID NO: 2932123 - protein, 30 aa, Entamoeba invadens
EEGVLKKVYFWHQGLGFTFVHNGGELKNTL

SEQ ID NO: 2932124 - protein, 18 aa, Entamoeba invadens
EEGYTLIVPRSYPDAKIS

SEQ ID NO: 2932125 - protein, 17 aa, Entamoeba invadens
EEHFCGGQKQVLYTELG

SEQ ID NO: 2932126 - protein, 24 aa, Entamoeba invadens
EEHPVMNPMMIWYLYKVNSKNESE

SEQ ID NO: 2932127 - protein, 25 aa, Entamoeba invadens
EEHVKRNPLSFSIKDIVTVYSVNDV

SEQ ID NO: 2932128 - protein, 18 aa, Entamoeba invadens
EEIASWKERCFEAEKCID

SEQ ID NO: 2932129 - protein, 17 aa, Entamoeba invadens
EEIATICAMLQVSGELF

SEQ ID NO: 2932130 - protein, 25 aa, Entamoeba invadens
EEICFKAMLGFSWVYSLCLPRLEQY

SEQ ID NO: 2932131 - protein, 23 aa, Entamoeba invadens
EEIDCDKPLVNRLRDRKKISPNP

SEQ ID NO: 2932132 - protein, 23 aa, Entamoeba invadens
EEIDFVKKVFKAMTCTSSQQTEH

SEQ ID NO: 2932133 - protein, 17 aa, Entamoeba invadens
EEIDLCNCCELKEIGIT

SEQ ID NO: 2932134 - protein, 26 aa, Entamoeba invadens
EEIEELKEEIDILKNKQDILLNTLKK

SEQ ID NO: 2932135 - protein, 23 aa, Entamoeba invadens
EEIERKWIIAIFMEKENEIGKAI

SEQ ID NO: 2932136 - protein, 17 aa, Entamoeba invadens
EEIERRVGNSKTEIAKK

SEQ ID NO: 2932137 - protein, 25 aa, Entamoeba invadens
EEIFKETKFLFGNVVYTKKDRKHHT

SEQ ID NO: 2932138 - protein, 20 aa, Entamoeba invadens
EEIFYRLRMSHENILLITAM

SEQ ID NO: 2932139 - protein, 28 aa, Entamoeba invadens
EEIHRKMRCGFILSGGPAAGGHNVVAGL

SEQ ID NO: 2932140 - protein, 19 aa, Entamoeba invadens
EEIIKNWGGIVIGKQVGHG

SEQ ID NO: 2932141 - protein, 29 aa, Entamoeba invadens
EEIKAYQKRLWGLRFIQIVNNVRGSTTHL

SEQ ID NO: 2932142 - protein, 17 aa, Entamoeba invadens
EEIKELVFGESCVIEEE

SEQ ID NO: 2932143 - protein, 20 aa, Entamoeba invadens
EEIKFPSNYYNERLDVQQEG

SEQ ID NO: 2932144 - protein, 17 aa, Entamoeba invadens
EEIKFTVFEIEQLEKMK

SEQ ID NO: 2932145 - protein, 24 aa, Entamoeba invadens
EEIKKLSDEWAIPFFETSAQNNTN

SEQ ID NO: 2932146 - protein, 24 aa, Entamoeba invadens
EEIKKVVAPYEILTFDIPRFKKDT

SEQ ID NO: 2932147 - protein, 30 aa, Entamoeba invadens
EEIKSIWTMEVKMAYNYRVLLTNTNYSIVN

SEQ ID NO: 2932148 - protein, 17 aa, Entamoeba invadens
EEINEALQIFTDKRLAD

SEQ ID NO: 2932149 - protein, 24 aa, Entamoeba invadens
EEINRISLYLMVALVSRLDLDKNL

SEQ ID NO: 2932150 - protein, 20 aa, Entamoeba invadens
EEIPDAPILDYVLEAPITKT

SEQ ID NO: 2932151 - protein, 24 aa, Entamoeba invadens
EEIPKETKFLFGNVVYTKKDKKHH

SEQ ID NO: 2932152 - protein, 24 aa, Entamoeba invadens
EEIPKETKLLFGNVVYTKKDRKHH

SEQ ID NO: 2932153 - protein, 17 aa, Entamoeba invadens
EEIQKYFTLQSEARFKG

SEQ ID NO: 2932154 - protein, 22 aa, Entamoeba invadens
EEIRKRCEVIFKTPSVPLYPSL

SEQ ID NO: 2932155 - protein, 32 aa, Entamoeba invadens
EEIRLLFIKKERDMLIYGFNYLDILSIYHPRY

SEQ ID NO: 2932156 - protein, 19 aa, Entamoeba invadens
EEIRRIVKYKGLSKGKSRV

SEQ ID NO: 2932157 - protein, 21 aa, Entamoeba invadens
EEISRRVKWAIKGDDLAANKA

SEQ ID NO: 2932158 - protein, 24 aa, Entamoeba invadens
EEIYQCKYLKFVVKNNAQNQNFLV

SEQ ID NO: 2932159 - protein, 24 aa, Entamoeba invadens
EEIYQCKYLKYVVKNNAQNQNFLV

SEQ ID NO: 2932160 - protein, 25 aa, Entamoeba invadens
EEKAVMVKTVPVFKYVPRSHRKEYY

SEQ ID NO: 2932161 - protein, 18 aa, Entamoeba invadens
EEKCFKRCEQIGEIKIQE

SEQ ID NO: 2932162 - protein, 17 aa, Entamoeba invadens
EEKCLLINEGVVVHFGD

SEQ ID NO: 2932163 - protein, 19 aa, Entamoeba invadens
EEKDHAVVVVGSQQPKPNT

SEQ ID NO: 2932164 - protein, 26 aa, Entamoeba invadens
EEKDRYCVLENGYLYVYNTLAESLSK

SEQ ID NO: 2932165 - protein, 19 aa, Entamoeba invadens
EEKEDWCMGFLFSDLFLLA

SEQ ID NO: 2932166 - protein, 21 aa, Entamoeba invadens
EEKEIRRQVARFSHERNKLEL

SEQ ID NO: 2932167 - protein, 23 aa, Entamoeba invadens
EEKEKELAEEAALKKFQEEEAKR

SEQ ID NO: 2932168 - protein, 21 aa, Entamoeba invadens
EEKFWFLKNNMIFDCVMVAMD

SEQ ID NO: 2932169 - protein, 17 aa, Entamoeba invadens
EEKGYFVQVIWQDNKKQ

SEQ ID NO: 2932170 - protein, 24 aa, Entamoeba invadens
EEKIGEILFNGWLRLFDTKIVFEN

SEQ ID NO: 2932171 - protein, 33 aa, Entamoeba invadens
EEKIHLMSLMRYFVKSCLFTQELVSTQYFLENI

SEQ ID NO: 2932172 - protein, 28 aa, Entamoeba invadens
EEKIVFFKINIWFRVGCSVAELHENTNI

SEQ ID NO: 2932173 - protein, 28 aa, Entamoeba invadens
EEKKCLGEIARAVGWFYSVVGGDETVEQ

SEQ ID NO: 2932174 - protein, 23 aa, Entamoeba invadens
EEKKDIPQAFNFSNVFQTGEKKE

SEQ ID NO: 2932175 - protein, 33 aa, Entamoeba invadens
EEKKEMTKKVSLRDLKIPVEFDEEENIEETVPQ

SEQ ID NO: 2932176 - protein, 23 aa, Entamoeba invadens
EEKKHFNVCRFVKYTKEDRLKYG

SEQ ID NO: 2932177 - protein, 21 aa, Entamoeba invadens
EEKKHILFLAGIMKGNVVLIR

SEQ ID NO: 2932178 - protein, 24 aa, Entamoeba invadens
EEKKKRLIEYVHMYYVDPTTDKPH

SEQ ID NO: 2932179 - protein, 21 aa, Entamoeba invadens
EEKKMGCLMVNNGEPKFRTMP

SEQ ID NO: 2932180 - protein, 24 aa, Entamoeba invadens
EEKKPKRKYTRRKPLKSKEAKDLK

SEQ ID NO: 2932181 - protein, 24 aa, Entamoeba invadens
EEKKRFNICHFVKYTKTDREKYGN

SEQ ID NO: 2932182 - protein, 25 aa, Entamoeba invadens
EEKKRFNICPFVKYTKEDRKKYGNT

SEQ ID NO: 2932183 - protein, 24 aa, Entamoeba invadens
EEKKRFNICPYVKYTKEDREKYGN

SEQ ID NO: 2932184 - protein, 17 aa, Entamoeba invadens
EEKKRLEEVRRQKEREE

SEQ ID NO: 2932185 - protein, 23 aa, Entamoeba invadens
EEKKVINCGIGFNEENDVDENKT

SEQ ID NO: 2932186 - protein, 26 aa, Entamoeba invadens
EEKKWIVYEHKRFFFHFFLSPENTEV

SEQ ID NO: 2932187 - protein, 17 aa, Entamoeba invadens
EEKMGAKMRKGRALIPQ

SEQ ID NO: 2932188 - protein, 22 aa, Entamoeba invadens
EEKNCWESIIYDQVLARKKTLE

SEQ ID NO: 2932189 - protein, 24 aa, Entamoeba invadens
EEKNDWRMCFLFNDVFIVANAMVP

SEQ ID NO: 2932190 - protein, 27 aa, Entamoeba invadens
EEKNLKPSWLFDSIILGKIQPRKQYEV

SEQ ID NO: 2932191 - protein, 27 aa, Entamoeba invadens
EEKNMLNARIAGIQAKLDEERQKADSA

SEQ ID NO: 2932192 - protein, 26 aa, Entamoeba invadens
EEKNMLNARIAGIQAQPDEERQKLDS

SEQ ID NO: 2932193 - protein, 25 aa, Entamoeba invadens
EEKNMLNARIAGIQTQLDEERQKVY

SEQ ID NO: 2932194 - protein, 23 aa, Entamoeba invadens
EEKQAIVVAISFEDYFMEITKTV

SEQ ID NO: 2932195 - protein, 20 aa, Entamoeba invadens
EEKRIKLSYIKECQKSDDSI

SEQ ID NO: 2932196 - protein, 23 aa, Entamoeba invadens
EEKRILLERVTKIKLDNCNLLQH

SEQ ID NO: 2932197 - protein, 25 aa, Entamoeba invadens
EEKRPSCYFCADIVAPTDSLSRRTL

SEQ ID NO: 2932198 - protein, 17 aa, Entamoeba invadens
EEKRVTGAGFKKKSGGF

SEQ ID NO: 2932199 - protein, 18 aa, Entamoeba invadens
EEKRWRCESSTTRKMEDE

SEQ ID NO: 2932200 - protein, 22 aa, Entamoeba invadens
EEKSICMNDFLAFNYEDDQTPV

SEQ ID NO: 2932201 - protein, 20 aa, Entamoeba invadens
EEKSIKIPVFTNFNAQLPLA

SEQ ID NO: 2932202 - protein, 19 aa, Entamoeba invadens
EEKSRLDPDTLSFWTQKSA

SEQ ID NO: 2932203 - protein, 35 aa, Entamoeba invadens
EEKTHAFAIAVEWYRVLKVLCWSSIQNSINEEITL

SEQ ID NO: 2932204 - protein, 18 aa, Entamoeba invadens
EEKTPCFWEYVFQNRTKF

SEQ ID NO: 2932205 - protein, 18 aa, Entamoeba invadens
EEKVELLPFQSRDFYVEK

SEQ ID NO: 2932206 - protein, 27 aa, Entamoeba invadens
EEKWKWKDMFKDFDLIQTLWKMTCEIM

SEQ ID NO: 2932207 - protein, 25 aa, Entamoeba invadens
EEKWSELKEVLKKEVDEEICYTDDI

SEQ ID NO: 2932208 - protein, 17 aa, Entamoeba invadens
EELAWYLVDNVGNSIIY

SEQ ID NO: 2932209 - protein, 17 aa, Entamoeba invadens
EELCISAFTCIRKQGSL

SEQ ID NO: 2932210 - protein, 25 aa, Entamoeba invadens
EELCSKNCEEPGCLATYTKTRFNSC

SEQ ID NO: 2932211 - protein, 23 aa, Entamoeba invadens
EELDLCNCIGFVYKTLGCAIWAL

SEQ ID NO: 2932212 - protein, 22 aa, Entamoeba invadens
EELDLFFKQMIAPMEYLQNTKK

SEQ ID NO: 2932213 - protein, 21 aa, Entamoeba invadens
EELGLKYSDILSDPDFDSKEY

SEQ ID NO: 2932214 - protein, 24 aa, Entamoeba invadens
EELGWKVCKFMNRQEKFMTNQMYQ

SEQ ID NO: 2932215 - protein, 38 aa, Entamoeba invadens
EELISRDKIQGMKGFQMSYLVSCMVNRVCINNKYICLK

SEQ ID NO: 2932216 - protein, 25 aa, Entamoeba invadens
EELKELRLENIFRLSVLKLPPQVET

SEQ ID NO: 2932217 - protein, 17 aa, Entamoeba invadens
EELKGYAKRVVIEIVTR

SEQ ID NO: 2932218 - protein, 17 aa, Entamoeba invadens
EELKKALSYKRLVLGVF

SEQ ID NO: 2932219 - protein, 17 aa, Entamoeba invadens
EELKNIEGLECLSYVRT

SEQ ID NO: 2932220 - protein, 24 aa, Entamoeba invadens
EELKQWVLEGRWFNLYSENKTFQK

SEQ ID NO: 2932221 - protein, 17 aa, Entamoeba invadens
EELKRREEINMQLVTDI

SEQ ID NO: 2932222 - protein, 24 aa, Entamoeba invadens
EELKVLFEMFTFVFNDYKTSENYK

SEQ ID NO: 2932223 - protein, 19 aa, Entamoeba invadens
EELLRKVAMMGSNVIVVEE

SEQ ID NO: 2932224 - protein, 20 aa, Entamoeba invadens
EELLTINICDGDFHQYSNSC

SEQ ID NO: 2932225 - protein, 27 aa, Entamoeba invadens
EELLVRWYQVGAFYPFFRAHAHLDTKR

SEQ ID NO: 2932226 - protein, 24 aa, Entamoeba invadens
EELNFHRFEMDYSKYSLLDTSEEI

SEQ ID NO: 2932227 - protein, 29 aa, Entamoeba invadens
EELNTLFTHLLRLCFKIAQNEKINSMGSK

SEQ ID NO: 2932228 - protein, 21 aa, Entamoeba invadens
EELRRMAKKKTLIMSSSSSKS

SEQ ID NO: 2932229 - protein, 21 aa, Entamoeba invadens
EELRVIWGVINQVDFKREDGL

SEQ ID NO: 2932230 - protein, 23 aa, Entamoeba invadens
EELSFKVGDIITILEKDEGWWKG

SEQ ID NO: 2932231 - protein, 24 aa, Entamoeba invadens
EELSFLRKKVETVQLDNYDARLTT

SEQ ID NO: 2932232 - protein, 28 aa, Entamoeba invadens
EELSPCKNCVFDLKMIGGQIRSVVKEME

SEQ ID NO: 2932233 - protein, 21 aa, Entamoeba invadens
EELSQYLALMEFIIKESDEIF

SEQ ID NO: 2932234 - protein, 26 aa, Entamoeba invadens
EELVLYYLFSVFKLPYNQMLTFVCGD

SEQ ID NO: 2932235 - protein, 25 aa, Entamoeba invadens
EELYKISVNYIITFFKLADTDILKA

SEQ ID NO: 2932236 - protein, 21 aa, Entamoeba invadens
EEMAYPLNVMFVNLFNTSAFA

SEQ ID NO: 2932237 - protein, 17 aa, Entamoeba invadens
EEMCFEHFVPPQVKGRA

SEQ ID NO: 2932238 - protein, 20 aa, Entamoeba invadens
EEMEEKIMLASRPLPVDLGK

SEQ ID NO: 2932239 - protein, 21 aa, Entamoeba invadens
EEMEEKIMLASRPLPVDLGKY

SEQ ID NO: 2932240 - protein, 25 aa, Entamoeba invadens
EEMGCKVSEEVGYYIRFDDRTSRKT

SEQ ID NO: 2932241 - protein, 22 aa, Entamoeba invadens
EEMKNSVGPLLNRCIEVVLSTP

SEQ ID NO: 2932242 - protein, 18 aa, Entamoeba invadens
EEMKYFSWALQIEKIEVG

SEQ ID NO: 2932243 - protein, 22 aa, Entamoeba invadens
EEMMKDQVFHRTMFNCVSTKCK

SEQ ID NO: 2932244 - protein, 21 aa, Entamoeba invadens
EEMMTFFGCSEVIPKILQSAP

SEQ ID NO: 2932245 - protein, 21 aa, Entamoeba invadens
EEMSSCQYGVVAAIKRVIMDK

SEQ ID NO: 2932246 - protein, 31 aa, Entamoeba invadens
EEMSWCIDFFESCITLFPLIFPDEYGMDYNT

SEQ ID NO: 2932247 - protein, 24 aa, Entamoeba invadens
EENAFPFKRDIVVYKKVHGTHKDQ

SEQ ID NO: 2932248 - protein, 22 aa, Entamoeba invadens
EENIKFAIDYTINTILPLTKKT

SEQ ID NO: 2932249 - protein, 21 aa, Entamoeba invadens
EENKDIFGLGYDFRKGELQVN

SEQ ID NO: 2932250 - protein, 27 aa, Entamoeba invadens
EENKKAWGMLRLKKRRDLMKEIYDTTV

SEQ ID NO: 2932251 - protein, 22 aa, Entamoeba invadens
EENKLRFMLYIAPLKNDSSKEG

SEQ ID NO: 2932252 - protein, 29 aa, Entamoeba invadens
EENKRMWYDAVIDYGRINWTILRDRARVG

SEQ ID NO: 2932253 - protein, 27 aa, Entamoeba invadens
EENRIPSWCDRVLWKCENGHYVQSMSY

SEQ ID NO: 2932254 - protein, 18 aa, Entamoeba invadens
EENRVVVVYCEFSKTRGP

SEQ ID NO: 2932255 - protein, 31 aa, Entamoeba invadens
EENSGFIFWEMCRTYDFYLLRLMMRHSTSTV

SEQ ID NO: 2932256 - protein, 27 aa, Entamoeba invadens
EEPEMVKNLFGLKCAPGVIGFKKSIKS

SEQ ID NO: 2932257 - protein, 20 aa, Entamoeba invadens
EEPFPIILCVTKSDLENERV

SEQ ID NO: 2932258 - protein, 22 aa, Entamoeba invadens
EEPKGRSQIVFEVKPWGEDTDM

SEQ ID NO: 2932259 - protein, 23 aa, Entamoeba invadens
EEPKVIEMTDFVLYKVPEAKPNE

SEQ ID NO: 2932260 - protein, 25 aa, Entamoeba invadens
EEPLLLSTCLKAFVNLLRYAKTYDI

SEQ ID NO: 2932261 - protein, 21 aa, Entamoeba invadens
EEPNLLALEPKYGRLSVGART

SEQ ID NO: 2932262 - protein, 22 aa, Entamoeba invadens
EEQDWRPAISVKQILLGIQELL

SEQ ID NO: 2932263 - protein, 24 aa, Entamoeba invadens
EEQEAEYQKALLLAKQQEELKAQE

SEQ ID NO: 2932264 - protein, 27 aa, Entamoeba invadens
EEQEVTEFLLLFGIECQRVSDPSLLQC

SEQ ID NO: 2932265 - protein, 26 aa, Entamoeba invadens
EEQKEVKEQIVLPSLEQAALTQKPLD

SEQ ID NO: 2932266 - protein, 21 aa, Entamoeba invadens
EEQKKRFLNAFKQFDKDKDNF

SEQ ID NO: 2932267 - protein, 20 aa, Entamoeba invadens
EEQKRLVGLRKKEIQNDIDT

SEQ ID NO: 2932268 - protein, 24 aa, Entamoeba invadens
EEQKSKIVWRTMVEFSKRETGTVV

SEQ ID NO: 2932269 - protein, 24 aa, Entamoeba invadens
EEQLKELFAITSFCPSACNLRPVK

SEQ ID NO: 2932270 - protein, 27 aa, Entamoeba invadens
EEQQVLSLRCPISFTRIKIPVRGKRCT

SEQ ID NO: 2932271 - protein, 24 aa, Entamoeba invadens
EEQRKCFIEKRVFPNINQLKKVSY

SEQ ID NO: 2932272 - protein, 25 aa, Entamoeba invadens
EEQRKEYAQCFSIAVQLLEFQTDEP

SEQ ID NO: 2932273 - protein, 21 aa, Entamoeba invadens
EEQRKRLNVIEKKLIEENKMN

SEQ ID NO: 2932274 - protein, 21 aa, Entamoeba invadens
EEQRMSFEMTFRDFAGYYEED

SEQ ID NO: 2932275 - protein, 23 aa, Entamoeba invadens
EEQYKMPPSFVVLKRVVQGRDWH

SEQ ID NO: 2932276 - protein, 23 aa, Entamoeba invadens
EEQYTLIEMCWRYDENNRISSFQ

SEQ ID NO: 2932277 - protein, 20 aa, Entamoeba invadens
EEREAYLKRIEKLKQQEEKE

SEQ ID NO: 2932278 - protein, 23 aa, Entamoeba invadens
EEREVYLHLSINNFDRIGNGNGV

SEQ ID NO: 2932279 - protein, 18 aa, Entamoeba invadens
EERFMYFGAAKLLPEAKS

SEQ ID NO: 2932280 - protein, 19 aa, Entamoeba invadens
EERKACSVSEENKDIVSNV

SEQ ID NO: 2932281 - protein, 22 aa, Entamoeba invadens
EERKKAKYSRRAERKRDELKQE

SEQ ID NO: 2932282 - protein, 22 aa, Entamoeba invadens
EERKKVLSDRFIDYNLAKTRVL

SEQ ID NO: 2932283 - protein, 24 aa, Entamoeba invadens
EERKVKLFTCVSLQTTIKKLKKLF

SEQ ID NO: 2932284 - protein, 21 aa, Entamoeba invadens
EERKYSFLFIKRMSKLKELII

SEQ ID NO: 2932285 - protein, 19 aa, Entamoeba invadens
EERLGRVSMIILEQMKIKK

SEQ ID NO: 2932286 - protein, 33 aa, Entamoeba invadens
EERLSTACVASFKSGCTEKPFLLEFNAVIKQIK

SEQ ID NO: 2932287 - protein, 20 aa, Entamoeba invadens
EERNVCGYTPVDYAVFYQRD

SEQ ID NO: 2932288 - protein, 21 aa, Entamoeba invadens
EERQIIALVGFLMKQETMNLN

SEQ ID NO: 2932289 - protein, 18 aa, Entamoeba invadens
EERQRAALEEARKREEEI

SEQ ID NO: 2932290 - protein, 21 aa, Entamoeba invadens
EERRAKLKAEREAQQAADAEK

SEQ ID NO: 2932291 - protein, 26 aa, Entamoeba invadens
EERSCVAMGSIIEKYVESLRVYLSYI

SEQ ID NO: 2932292 - protein, 21 aa, Entamoeba invadens
EERSKALSLLKILITVTYEAD

SEQ ID NO: 2932293 - protein, 17 aa, Entamoeba invadens
EERSVILTEDFELSYKV

SEQ ID NO: 2932294 - protein, 26 aa, Entamoeba invadens
EERVCKICFAQAMGMEVLPKIEKREK

SEQ ID NO: 2932295 - protein, 28 aa, Entamoeba invadens
EESHPGMIPLAVLQIFKTIRDLEKIGWV

SEQ ID NO: 2932296 - protein, 28 aa, Entamoeba invadens
EESIKWLMTSCEIFPPEPLPHVKVSPIK

SEQ ID NO: 2932297 - protein, 24 aa, Entamoeba invadens
EESKDIHMAWSLKRTPGISQYLKQ

SEQ ID NO: 2932298 - protein, 22 aa, Entamoeba invadens
EESKFMPRDALNILKEMTDEDV

SEQ ID NO: 2932299 - protein, 23 aa, Entamoeba invadens
EESKRVKFVFVSWAGEGIKKPKL

SEQ ID NO: 2932300 - protein, 23 aa, Entamoeba invadens
EESMNACGEKVYVTTQFGKATVN

SEQ ID NO: 2932301 - protein, 24 aa, Entamoeba invadens
EESNPVVYCKAITKDVTRDLQTEQ

SEQ ID NO: 2932302 - protein, 23 aa, Entamoeba invadens
EESPMKIQFCKYSVPNANFSEKV

SEQ ID NO: 2932303 - protein, 17 aa, Entamoeba invadens
EESQMCFMFFNMRAKQK

SEQ ID NO: 2932304 - protein, 23 aa, Entamoeba invadens
EESRKTFESMRVLNGLSEVFAKD

SEQ ID NO: 2932305 - protein, 23 aa, Entamoeba invadens
EESSDAWTSLSIPLQYYGFTQIQ

SEQ ID NO: 2932306 - protein, 19 aa, Entamoeba invadens
EESTFCINIPQKLFLLKAE

SEQ ID NO: 2932307 - protein, 26 aa, Entamoeba invadens
EESVEFRLGAVFSFLNTLQPYFSHLY

SEQ ID NO: 2932308 - protein, 20 aa, Entamoeba invadens
EESYMRLLPSKGIEKGSPDD

SEQ ID NO: 2932309 - protein, 23 aa, Entamoeba invadens
EETEFDANLFFDLNHDEEKLEEN

SEQ ID NO: 2932310 - protein, 23 aa, Entamoeba invadens
EETERAMPIIVRMEELKGEWEQL

SEQ ID NO: 2932311 - protein, 24 aa, Entamoeba invadens
EETERKERCPVLFLEGNDDMAKYL

SEQ ID NO: 2932312 - protein, 21 aa, Entamoeba invadens
EETFKKLNVVVNKEKRKSRQF

SEQ ID NO: 2932313 - protein, 23 aa, Entamoeba invadens
EETKQGFIKKMFNLLTNFKDNLN

SEQ ID NO: 2932314 - protein, 25 aa, Entamoeba invadens
EETLWKSERLCLVESSTPNIYKRKV

SEQ ID NO: 2932315 - protein, 36 aa, Entamoeba invadens
EETQIALSICDEFLYKTEESLEVFLPALNKQANCLL

SEQ ID NO: 2932316 - protein, 17 aa, Entamoeba invadens
EETRFSRSFSGEMKGET

SEQ ID NO: 2932317 - protein, 22 aa, Entamoeba invadens
EETRKKITDCISGTTKEYSQNE

SEQ ID NO: 2932318 - protein, 23 aa, Entamoeba invadens
EETSDLFSPLPFYYQEVAYSLMK

SEQ ID NO: 2932319 - protein, 27 aa, Entamoeba invadens
EETYNCSFCPFTFCVECYKHLCLTLGT

SEQ ID NO: 2932320 - protein, 22 aa, Entamoeba invadens
EEVCAANFLAYMMKAFNTEKHT

SEQ ID NO: 2932321 - protein, 21 aa, Entamoeba invadens
EEVDGIDVFDCDMPLSASFVR

SEQ ID NO: 2932322 - protein, 18 aa, Entamoeba invadens
EEVDRYFASYIRDSPTKF

SEQ ID NO: 2932323 - protein, 25 aa, Entamoeba invadens
EEVFKKLLLNYPFFDYKLRMLDQIA

SEQ ID NO: 2932324 - protein, 24 aa, Entamoeba invadens
EEVFPINRCIPFTTEDGTSIQYTR

SEQ ID NO: 2932325 - protein, 24 aa, Entamoeba invadens
EEVFPRTLANYAHMLLKKGSKIEP

SEQ ID NO: 2932326 - protein, 19 aa, Entamoeba invadens
EEVILCSDEIPILMYLTIL

SEQ ID NO: 2932327 - protein, 21 aa, Entamoeba invadens
EEVNAAYRRMRDRGDVPDIHR

SEQ ID NO: 2932328 - protein, 17 aa, Entamoeba invadens
EEVPIRVGDPITCKYCQ

SEQ ID NO: 2932329 - protein, 22 aa, Entamoeba invadens
EEVRAKSVAFLKSLGVNKPVEP

SEQ ID NO: 2932330 - protein, 22 aa, Entamoeba invadens
EEVREVLDRLGLNTREQNDFIV

SEQ ID NO: 2932331 - protein, 17 aa, Entamoeba invadens
EEVTGDHHFFVFSCKNS

SEQ ID NO: 2932332 - protein, 21 aa, Entamoeba invadens
EEVTRAAAIIGNEEMTKKCAT

SEQ ID NO: 2932333 - protein, 23 aa, Entamoeba invadens
EEVVQAVNFLKSRVDDSNSRVQY

SEQ ID NO: 2932334 - protein, 18 aa, Entamoeba invadens
EEVYPFFMNTMLPENWII

SEQ ID NO: 2932335 - protein, 21 aa, Entamoeba invadens
EEVYSTFTFKLFQKGIFYRQF

SEQ ID NO: 2932336 - protein, 19 aa, Entamoeba invadens
EEWEILYHIIEYSKTQNAV

SEQ ID NO: 2932337 - protein, 17 aa, Entamoeba invadens
EEYDMLISMNFYNESEK

SEQ ID NO: 2932338 - protein, 17 aa, Entamoeba invadens
EEYESFRPLSYPSTDIF

SEQ ID NO: 2932339 - protein, 29 aa, Entamoeba invadens
EEYHLRLCLCPLCKHGMEVFGAKRPVSWI

SEQ ID NO: 2932340 - protein, 23 aa, Entamoeba invadens
EEYIKCLIEKNVRFTLSEIQKDK

SEQ ID NO: 2932341 - protein, 23 aa, Entamoeba invadens
EEYIKYIYYDGVLLFNSNSIQIF

SEQ ID NO: 2932342 - protein, 24 aa, Entamoeba invadens
EEYKEPFTPISSVLLKYFTPEMLD

SEQ ID NO: 2932343 - protein, 26 aa, Entamoeba invadens
EEYKKRWKGEWSLYIYQSGNEVNREN

SEQ ID NO: 2932344 - protein, 19 aa, Entamoeba invadens
EEYKRLRKERGFVDPNGRT

SEQ ID NO: 2932345 - protein, 21 aa, Entamoeba invadens
EEYNVRTTLSFVLTILRERKG

SEQ ID NO: 2932346 - protein, 20 aa, Entamoeba invadens
EEYPKFKVSQFNNGNTENCI

SEQ ID NO: 2932347 - protein, 21 aa, Entamoeba invadens
EEYPTVFSTVFYPFNSHTSEH

SEQ ID NO: 2932348 - protein, 21 aa, Entamoeba invadens
EEYQRRLLLDINLFEIRIDII

SEQ ID NO: 2932349 - protein, 17 aa, Entamoeba invadens
EEYQRTLGLFTRIAGKW

SEQ ID NO: 2932350 - protein, 27 aa, Entamoeba invadens
EEYSLFRIGFKGGIRIGKPNTFNSYCY

SEQ ID NO: 2932351 - protein, 17 aa, Entamoeba invadens
EEYWGHGIMPRAVKESM

SEQ ID NO: 2932352 - protein, 19 aa, Entamoeba invadens
EFAICSGPVFVPPDAFFGN

SEQ ID NO: 2932353 - protein, 29 aa, Entamoeba invadens
EFAKQCPNPLSFCSFVFVFRTALDKNYFI

SEQ ID NO: 2932354 - protein, 27 aa, Entamoeba invadens
EFAKVMFGERAWRIDPKLPCEIDDDSF

SEQ ID NO: 2932355 - protein, 18 aa, Entamoeba invadens
EFAVPSKERKRCNFVITV

SEQ ID NO: 2932356 - protein, 19 aa, Entamoeba invadens
EFAYLKYILLFSRNPILPN

SEQ ID NO: 2932357 - protein, 25 aa, Entamoeba invadens
EFCVCSICHVAYCVEHKSELEIVIP

SEQ ID NO: 2932358 - protein, 18 aa, Entamoeba invadens
EFCVKECKDDKVNVLDIN

SEQ ID NO: 2932359 - protein, 24 aa, Entamoeba invadens
EFDAESFVRRLLGMGDLKGINKLA

SEQ ID NO: 2932360 - protein, 18 aa, Entamoeba invadens
EFDEILLDEMLRAERIID

SEQ ID NO: 2932361 - protein, 19 aa, Entamoeba invadens
EFDGFLRICFLRKHKTLKS

SEQ ID NO: 2932362 - protein, 24 aa, Entamoeba invadens
EFDKHGSCTLDVFKGERGPLDYYW

SEQ ID NO: 2932363 - protein, 25 aa, Entamoeba invadens
EFDKYGIVIKTQFRKEGSLQQLNAH

SEQ ID NO: 2932364 - protein, 19 aa, Entamoeba invadens
EFDKYLGNFSRSILTDEVI

SEQ ID NO: 2932365 - protein, 19 aa, Entamoeba invadens
EFDLNCFTYALKQANVDDE

SEQ ID NO: 2932366 - protein, 21 aa, Entamoeba invadens
EFDPDKRSTIGVEFATRSIVY

SEQ ID NO: 2932367 - protein, 26 aa, Entamoeba invadens
EFDSRFPADKGGNCYYVVNNDVYSPD

SEQ ID NO: 2932368 - protein, 28 aa, Entamoeba invadens
EFDVFKLFIDFRCNSHFPQFISASIKKF

SEQ ID NO: 2932369 - protein, 29 aa, Entamoeba invadens
EFDVLLTFVTCNWLYGWNLPTITTAASPL

SEQ ID NO: 2932370 - protein, 25 aa, Entamoeba invadens
EFDVWPLEVFCESLLLLLSALSKPV

SEQ ID NO: 2932371 - protein, 22 aa, Entamoeba invadens
EFDVWRCFYEINKKVSQEYQAM

SEQ ID NO: 2932372 - protein, 19 aa, Entamoeba invadens
EFEEKFVFLRDVFIKLNVN

SEQ ID NO: 2932373 - protein, 19 aa, Entamoeba invadens
EFEEMKSAFNMMFETQEKL

SEQ ID NO: 2932374 - protein, 25 aa, Entamoeba invadens
EFEHIIKLKPEFESVRDKQKNGTLS

SEQ ID NO: 2932375 - protein, 19 aa, Entamoeba invadens
EFEILLTLKCTTKMDESVV

SEQ ID NO: 2932376 - protein, 18 aa, Entamoeba invadens
EFEKFIFVILKKLMPSEN

SEQ ID NO: 2932377 - protein, 25 aa, Entamoeba invadens
EFEKSPKKGIAFFIEKEMCTNTASS

SEQ ID NO: 2932378 - protein, 20 aa, Entamoeba invadens
EFEKVCAAIPKFSKSKQDMI

SEQ ID NO: 2932379 - protein, 19 aa, Entamoeba invadens
EFEKYCGDFVGLFLNALLN

SEQ ID NO: 2932380 - protein, 25 aa, Entamoeba invadens
EFELNLPNVCVAFWDGLVWLSKSLF

SEQ ID NO: 2932381 - protein, 18 aa, Entamoeba invadens
EFERWGAMARRVHNRNSH

SEQ ID NO: 2932382 - protein, 22 aa, Entamoeba invadens
EFEVFLTPFCTMNLCDEIMIIS

SEQ ID NO: 2932383 - protein, 22 aa, Entamoeba invadens
EFFESLCGSMLILKLLTETKVG

SEQ ID NO: 2932384 - protein, 25 aa, Entamoeba invadens
EFFKLVRNAVNFNLCDSVIGQQAIQ

SEQ ID NO: 2932385 - protein, 20 aa, Entamoeba invadens
EFFNFPMLLILTQFKEFLTV

SEQ ID NO: 2932386 - protein, 24 aa, Entamoeba invadens
EFFREMKFIRAPHNIHVASIYGYS

SEQ ID NO: 2932387 - protein, 17 aa, Entamoeba invadens
EFFSCINLVSLTLSPFI

SEQ ID NO: 2932388 - protein, 24 aa, Entamoeba invadens
EFFSFRFDVCNFVDLHSCVLKELT

SEQ ID NO: 2932389 - protein, 20 aa, Entamoeba invadens
EFGDRGDVKLSHMGCTIVEN

SEQ ID NO: 2932390 - protein, 23 aa, Entamoeba invadens
EFGDVKLGDEFLVKEQKEISFEG

SEQ ID NO: 2932391 - protein, 22 aa, Entamoeba invadens
EFGLECFKNCFSMKEIKIKNSN

SEQ ID NO: 2932392 - protein, 24 aa, Entamoeba invadens
EFGLKLRVKMCLDAIKGIVYLHTN

SEQ ID NO: 2932393 - protein, 24 aa, Entamoeba invadens
EFGLKLRVKMCLDAIKGIVYLYTN

SEQ ID NO: 2932394 - protein, 23 aa, Entamoeba invadens
EFGNLRGTILYSLKTEQTVAKPL

SEQ ID NO: 2932395 - protein, 18 aa, Entamoeba invadens
EFGVNSFSVFKTSNTPNM

SEQ ID NO: 2932396 - protein, 21 aa, Entamoeba invadens
EFGVPSALRMDIWKMFLQPKR

SEQ ID NO: 2932397 - protein, 20 aa, Entamoeba invadens
EFHNVVLGSMAVFEVYDHDD

SEQ ID NO: 2932398 - protein, 19 aa, Entamoeba invadens
EFHSELALFRDRDIPSNTV

SEQ ID NO: 2932399 - protein, 27 aa, Entamoeba invadens
EFIAQFCNFFFERGRFMVVMDLMDKKN

SEQ ID NO: 2932400 - protein, 20 aa, Entamoeba invadens
EFIEIIKGCVSVLETYIELK

SEQ ID NO: 2932401 - protein, 18 aa, Entamoeba invadens
EFIGFIGSVVEKLKLERA

SEQ ID NO: 2932402 - protein, 23 aa, Entamoeba invadens
EFILRLPHHTYTLDVFKLIHRII

SEQ ID NO: 2932403 - protein, 25 aa, Entamoeba invadens
EFINSCPRDWLLCQTHFVENAEKLD

SEQ ID NO: 2932404 - protein, 26 aa, Entamoeba invadens
EFINSCPRDWLLCQTHFVENAEKLDC

SEQ ID NO: 2932405 - protein, 18 aa, Entamoeba invadens
EFIQCAVYGGRNMCRDNT

SEQ ID NO: 2932406 - protein, 18 aa, Entamoeba invadens
EFIQGAIYGGRCMTRDNK

SEQ ID NO: 2932407 - protein, 26 aa, Entamoeba invadens
EFISERGICMRICMSRNIEENNEEKN

SEQ ID NO: 2932408 - protein, 23 aa, Entamoeba invadens
EFITPLFPFIKMMLRSIVVSLCV

SEQ ID NO: 2932409 - protein, 23 aa, Entamoeba invadens
EFIVCGDGGFVSLIRDVSKEVVQ

SEQ ID NO: 2932410 - protein, 25 aa, Entamoeba invadens
EFKDFVWRGKFRGCDVVVDNRSDES

SEQ ID NO: 2932411 - protein, 28 aa, Entamoeba invadens
EFKDIKGSVYRPEILNGVEPKNCIVEGQ

SEQ ID NO: 2932412 - protein, 19 aa, Entamoeba invadens
EFKEETMVCFERVESVADS

SEQ ID NO: 2932413 - protein, 33 aa, Entamoeba invadens
EFKERKWVDVYWLKAKIFGGVCSLEALRTTHFN

SEQ ID NO: 2932414 - protein, 28 aa, Entamoeba invadens
EFKESGEGWFFGCWQPRDILSGKNDIYD

SEQ ID NO: 2932415 - protein, 30 aa, Entamoeba invadens
EFKGEKPPTCPRVLFSFVGSAFETDEQFKM

SEQ ID NO: 2932416 - protein, 18 aa, Entamoeba invadens
EFKKAVCEKNERPDINEV

SEQ ID NO: 2932417 - protein, 24 aa, Entamoeba invadens
EFKLLRAPFDLEIKKLEDAKNRKM

SEQ ID NO: 2932418 - protein, 20 aa, Entamoeba invadens
EFKLWRKKPDVQIVAQEVKT

SEQ ID NO: 2932419 - protein, 22 aa, Entamoeba invadens
EFKPVCVTFVQPLLDQKRCNIK

SEQ ID NO: 2932420 - protein, 19 aa, Entamoeba invadens
EFKRNFCEKRDKLQEEERK

SEQ ID NO: 2932421 - protein, 31 aa, Entamoeba invadens
EFKYGKFKLKRICAIPSFIVTFVAEIDTQAP

SEQ ID NO: 2932422 - protein, 19 aa, Entamoeba invadens
EFKYPWKKAEFVNSGNRLQ

SEQ ID NO: 2932423 - protein, 19 aa, Entamoeba invadens
EFLALYNFVKLCLDTFKNF

SEQ ID NO: 2932424 - protein, 18 aa, Entamoeba invadens
EFLCGFTGSAAVVVITQQ

SEQ ID NO: 2932425 - protein, 18 aa, Entamoeba invadens
EFLDARRSVPKWSKIEKE

SEQ ID NO: 2932426 - protein, 17 aa, Entamoeba invadens
EFLDGCLQEIGLKDRVV

SEQ ID NO: 2932427 - protein, 25 aa, Entamoeba invadens
EFLEEFQNAQMCFMFLDEREQALNE

SEQ ID NO: 2932428 - protein, 23 aa, Entamoeba invadens
EFLKEFRRRGGIIAVCSHSTQDD

SEQ ID NO: 2932429 - protein, 19 aa, Entamoeba invadens
EFLKEVFDKLEIDIRLQSR

SEQ ID NO: 2932430 - protein, 17 aa, Entamoeba invadens
EFLKRLKNYGMTREHDL

SEQ ID NO: 2932431 - protein, 25 aa, Entamoeba invadens
EFLLTCYSAFWLTSSRKVYLHQLFK

SEQ ID NO: 2932432 - protein, 22 aa, Entamoeba invadens
EFLMKEFNVHVFVKGNYQEDFH

SEQ ID NO: 2932433 - protein, 25 aa, Entamoeba invadens
EFLNMPMNFVFRGNIDFTIYDVLKN

SEQ ID NO: 2932434 - protein, 17 aa, Entamoeba invadens
EFLRCYCAELVKGKMAP

SEQ ID NO: 2932435 - protein, 19 aa, Entamoeba invadens
EFLTRLSNIEELDFTNNKL

SEQ ID NO: 2932436 - protein, 24 aa, Entamoeba invadens
EFLVNRMKICLEREKNAIEKVEYK

SEQ ID NO: 2932437 - protein, 23 aa, Entamoeba invadens
EFMKMDWFKDIDFDKLLKKEISP

SEQ ID NO: 2932438 - protein, 24 aa, Entamoeba invadens
EFNETCFHNNFDIKGCDIENITLI

SEQ ID NO: 2932439 - protein, 19 aa, Entamoeba invadens
EFNIACAKYDLYTNEKLPN

SEQ ID NO: 2932440 - protein, 24 aa, Entamoeba invadens
EFNILRLLESISLYDKRNDREGND

SEQ ID NO: 2932441 - protein, 23 aa, Entamoeba invadens
EFNNECLNEFVFQNNKEMRITLR

SEQ ID NO: 2932442 - protein, 29 aa, Entamoeba invadens
EFNQLLDFRIKEFLRKLMSGKKVEVKECY

SEQ ID NO: 2932443 - protein, 27 aa, Entamoeba invadens
EFNQLLEFRIRMLLRKLFAGKKLECKQ

SEQ ID NO: 2932444 - protein, 27 aa, Entamoeba invadens
EFNRTCDTYAFSLVIYQIFTQRLIFTN

SEQ ID NO: 2932445 - protein, 19 aa, Entamoeba invadens
EFNSACFIPYYPPTENMVK

SEQ ID NO: 2932446 - protein, 18 aa, Entamoeba invadens
EFNTFLITCFNQKAENVF

SEQ ID NO: 2932447 - protein, 21 aa, Entamoeba invadens
EFPDFKDAIVLPAKKATVENI

SEQ ID NO: 2932448 - protein, 18 aa, Entamoeba invadens
EFPFRYGMVKTLRILFSS

SEQ ID NO: 2932449 - protein, 22 aa, Entamoeba invadens
EFPFSKEETLCLLQQLVDEGVI

SEQ ID NO: 2932450 - protein, 20 aa, Entamoeba invadens
EFPKVLVLQFNRFIYDRVQL

SEQ ID NO: 2932451 - protein, 19 aa, Entamoeba invadens
EFPVYLVVGCESGEVLSID

SEQ ID NO: 2932452 - protein, 20 aa, Entamoeba invadens
EFQNRLKATISDFAAQGINS

SEQ ID NO: 2932453 - protein, 17 aa, Entamoeba invadens
EFQPRGYYNAGYQQQQF

SEQ ID NO: 2932454 - protein, 20 aa, Entamoeba invadens
EFQVRFFKKDCEIVNGIDTN

SEQ ID NO: 2932455 - protein, 19 aa, Entamoeba invadens
EFREVFVNTISLFFSPDNV

SEQ ID NO: 2932456 - protein, 25 aa, Entamoeba invadens
EFRGKDWVECFLFNDILVIAKIDVT

SEQ ID NO: 2932457 - protein, 28 aa, Entamoeba invadens
EFSDEIRKGVQFVFGNAILCNTAEEAME

SEQ ID NO: 2932458 - protein, 21 aa, Entamoeba invadens
EFSDILELYKTGVISQDDIIK

SEQ ID NO: 2932459 - protein, 26 aa, Entamoeba invadens
EFSEEFKNRFEPILIVTQKLVAEMDR

SEQ ID NO: 2932460 - protein, 22 aa, Entamoeba invadens
EFSFPRQHRYPVSKDAKDLIRE

SEQ ID NO: 2932461 - protein, 24 aa, Entamoeba invadens
EFSLESAVIPNLFFFNRNKTEASS

SEQ ID NO: 2932462 - protein, 27 aa, Entamoeba invadens
EFSRLKCLKLKWTTYFLNYNLECLEQL

SEQ ID NO: 2932463 - protein, 19 aa, Entamoeba invadens
EFSSKFVTYEGRQVEIRLW

SEQ ID NO: 2932464 - protein, 19 aa, Entamoeba invadens
EFSTLKFSTLIEKDMSATE

SEQ ID NO: 2932465 - protein, 20 aa, Entamoeba invadens
EFTFCAKLEIFQIFEEEIRR

SEQ ID NO: 2932466 - protein, 39 aa, Entamoeba invadens
EFTLRITPSVVTVYKWCASEIRLFLTINYTIKTNTTIPL

SEQ ID NO: 2932467 - protein, 24 aa, Entamoeba invadens
EFTNIPLNFVFEGSVDYYIFKVIK

SEQ ID NO: 2932468 - protein, 20 aa, Entamoeba invadens
EFTSLNGFLLVIGKMNRAEL

SEQ ID NO: 2932469 - protein, 24 aa, Entamoeba invadens
EFVALYNWVKLCFATFNRFDKDNS

SEQ ID NO: 2932470 - protein, 30 aa, Entamoeba invadens
EFVDSSLGFFCCKLCKQLHLKKNPTKSSEK

SEQ ID NO: 2932471 - protein, 20 aa, Entamoeba invadens
EFVELYRSSKRIVINGTLIT

SEQ ID NO: 2932472 - protein, 18 aa, Entamoeba invadens
EFVFCLTPLSGDDVTPVA

SEQ ID NO: 2932473 - protein, 25 aa, Entamoeba invadens
EFVIFKEYFHDLAVKDENFIETDIV

SEQ ID NO: 2932474 - protein, 25 aa, Entamoeba invadens
EFVLQNCLESILVMSGGSGSVIREI

SEQ ID NO: 2932475 - protein, 18 aa, Entamoeba invadens
EFVVGGAVASDFFMESLK

SEQ ID NO: 2932476 - protein, 19 aa, Entamoeba invadens
EFVVKCLKLPHEETITLSL

SEQ ID NO: 2932477 - protein, 27 aa, Entamoeba invadens
EFVVLKKNIFWRIVKILKNGGMKYIND

SEQ ID NO: 2932478 - protein, 18 aa, Entamoeba invadens
EFVYKQCTDNKYFEKGNA

SEQ ID NO: 2932479 - protein, 20 aa, Entamoeba invadens
EFYDLPLTRKGRIEDFNVFM

SEQ ID NO: 2932480 - protein, 24 aa, Entamoeba invadens
EFYDLPLTRKWWIEDFNVFMGGGR

SEQ ID NO: 2932481 - protein, 26 aa, Entamoeba invadens
EFYFHSIFLFHHIPEFVNTIIESQDI

SEQ ID NO: 2932482 - protein, 21 aa, Entamoeba invadens
EGAEVIKMMQAAQCEGVSQVE

SEQ ID NO: 2932483 - protein, 18 aa, Entamoeba invadens
EGAFRVCSGKTEMDEYVK

SEQ ID NO: 2932484 - protein, 25 aa, Entamoeba invadens
EGAFSISPRIKSVVLGGTTKLPKDT

SEQ ID NO: 2932485 - protein, 21 aa, Entamoeba invadens
EGAGQGTIWFMQREVTEKKKF

SEQ ID NO: 2932486 - protein, 18 aa, Entamoeba invadens
EGALEVYKTYMISYSLSI

SEQ ID NO: 2932487 - protein, 18 aa, Entamoeba invadens
EGALPLVHQLIISPSLHK

SEQ ID NO: 2932488 - protein, 31 aa, Entamoeba invadens
EGAPTYRKVVMKRLVTWDGCELNEYISGVEE

SEQ ID NO: 2932489 - protein, 24 aa, Entamoeba invadens
EGATHFRGKIFFWPPYDDSPLVSY

SEQ ID NO: 2932490 - protein, 19 aa, Entamoeba invadens
EGCAEHLKRAFSELHEEVC

SEQ ID NO: 2932491 - protein, 18 aa, Entamoeba invadens
EGCEECYILDTLLPNNDS

SEQ ID NO: 2932492 - protein, 21 aa, Entamoeba invadens
EGCELKFYLAPKFDEGQPEAQ

SEQ ID NO: 2932493 - protein, 32 aa, Entamoeba invadens
EGCFPAIELVDICRRQKLELSGVILLNPSELK

SEQ ID NO: 2932494 - protein, 24 aa, Entamoeba invadens
EGCFRDCKELHNVEIPFGVSAIYP

SEQ ID NO: 2932495 - protein, 20 aa, Entamoeba invadens
EGCISFVRTYYDEVSNELYV

SEQ ID NO: 2932496 - protein, 25 aa, Entamoeba invadens
EGCLLKFEIPISVVDLSFIESITDT

SEQ ID NO: 2932497 - protein, 26 aa, Entamoeba invadens
EGCLVPFKVILIVTIKHINEVSGVVS

SEQ ID NO: 2932498 - protein, 24 aa, Entamoeba invadens
EGCPSSRIISDFMRIVRTIFPNEM

SEQ ID NO: 2932499 - protein, 17 aa, Entamoeba invadens
EGDDVDVSFAFAAMRRI

SEQ ID NO: 2932500 - protein, 26 aa, Entamoeba invadens
EGDEVWAQEEWKRYKMRNDSIITTLF

SEQ ID NO: 2932501 - protein, 23 aa, Entamoeba invadens
EGDFKDSIYIFKCENSTIRVKGK

SEQ ID NO: 2932502 - protein, 17 aa, Entamoeba invadens
EGDGDLLVNIRNKVLQN

SEQ ID NO: 2932503 - protein, 27 aa, Entamoeba invadens
EGDLFNFNKLRIMYNVVMNVINYQPNN

SEQ ID NO: 2932504 - protein, 17 aa, Entamoeba invadens
EGDLKDQRHVVAIQGLT

SEQ ID NO: 2932505 - protein, 24 aa, Entamoeba invadens
EGDRHKGFCLLTYKNPKSCVLAVD

SEQ ID NO: 2932506 - protein, 22 aa, Entamoeba invadens
EGDRLPLETVQTIFGQIASACR

SEQ ID NO: 2932507 - protein, 17 aa, Entamoeba invadens
EGDSVFAKVHTKFFQTM

SEQ ID NO: 2932508 - protein, 28 aa, Entamoeba invadens
EGDVTRITAWICGFHYVIQAEKMREEDT

SEQ ID NO: 2932509 - protein, 38 aa, Entamoeba invadens
EGDYSEFKRLTLLLTKLPRKRLRDVSSRLEYYKAVETN

SEQ ID NO: 2932510 - protein, 21 aa, Entamoeba invadens
EGEASMTSHCNLLGKFELSGI

SEQ ID NO: 2932511 - protein, 24 aa, Entamoeba invadens
EGEEFKMRVTFRVQHQPVLGFRIL

SEQ ID NO: 2932512 - protein, 21 aa, Entamoeba invadens
EGEGAFGLLSSCDFPRDMGET

SEQ ID NO: 2932513 - protein, 27 aa, Entamoeba invadens
EGEIKYGRDNLYFEYGTVVSKLVGKTS

SEQ ID NO: 2932514 - protein, 19 aa, Entamoeba invadens
EGEISIRFCEKSLKSKQHV

SEQ ID NO: 2932515 - protein, 23 aa, Entamoeba invadens
EGEIYKYNCWEEIPYETIGINKQ

SEQ ID NO: 2932516 - protein, 25 aa, Entamoeba invadens
EGELKTFRSGFLIRQKLYEELYEHQ

SEQ ID NO: 2932517 - protein, 24 aa, Entamoeba invadens
EGELPIIGADFVKNIQFLKMAATY

SEQ ID NO: 2932518 - protein, 20 aa, Entamoeba invadens
EGELVCKTCFIERVETIVYD

SEQ ID NO: 2932519 - protein, 22 aa, Entamoeba invadens
EGEMKSQIVVMCCKHFAFNQEI

SEQ ID NO: 2932520 - protein, 24 aa, Entamoeba invadens
EGERLAEKWGCMFFEISSKLGVNI

SEQ ID NO: 2932521 - protein, 24 aa, Entamoeba invadens
EGESILRVRIGEGYVLSKRKNSNV

SEQ ID NO: 2932522 - protein, 26 aa, Entamoeba invadens
EGEVESFAKLITFRKGDQVFKGHYAS

SEQ ID NO: 2932523 - protein, 18 aa, Entamoeba invadens
EGEVIKLNGVEYVVKYLK

SEQ ID NO: 2932524 - protein, 23 aa, Entamoeba invadens
EGEYFVQSVIDFRSSDPGVLSFR

SEQ ID NO: 2932525 - protein, 25 aa, Entamoeba invadens
EGFCERARFEKVFVYATSCATYYPE

SEQ ID NO: 2932526 - protein, 20 aa, Entamoeba invadens
EGFCKVFKTLLSKLLSLNSE

SEQ ID NO: 2932527 - protein, 17 aa, Entamoeba invadens
EGFGTRGITWGVEMMSC

SEQ ID NO: 2932528 - protein, 19 aa, Entamoeba invadens
EGFICHTCHVCATEEEIEE

SEQ ID NO: 2932529 - protein, 22 aa, Entamoeba invadens
EGFSGSDLFALGQVVAMRPIKE

SEQ ID NO: 2932530 - protein, 25 aa, Entamoeba invadens
EGGCKTCDLAKFVIHAIKPNGEPCA

SEQ ID NO: 2932531 - protein, 28 aa, Entamoeba invadens
EGGGWKSWKRRWFALNGNSLMYYKDQLM

SEQ ID NO: 2932532 - protein, 21 aa, Entamoeba invadens
EGGIFELRLTFSDEYPLNPPH

SEQ ID NO: 2932533 - protein, 22 aa, Entamoeba invadens
EGGKKASFFGVFDGHGGDQVAD

SEQ ID NO: 2932534 - protein, 25 aa, Entamoeba invadens
EGGLEKSMFERLLLNKVPYVLLNTQ

SEQ ID NO: 2932535 - protein, 17 aa, Entamoeba invadens
EGGRPTLSAMLMKSTLD

SEQ ID NO: 2932536 - protein, 24 aa, Entamoeba invadens
EGGSARTSLDIGIAQNDVKKNIFP

SEQ ID NO: 2932537 - protein, 17 aa, Entamoeba invadens
EGGSTVRAIACDMPVPG

SEQ ID NO: 2932538 - protein, 24 aa, Entamoeba invadens
EGGYTYYAPMVFKEWVRRPKKAKA

SEQ ID NO: 2932539 - protein, 20 aa, Entamoeba invadens
EGGYVEWLYAFTNLYDKILP

SEQ ID NO: 2932540 - protein, 24 aa, Entamoeba invadens
EGHDELKTRLGLVEDDFTKIEDEN

SEQ ID NO: 2932541 - protein, 24 aa, Entamoeba invadens
EGHPKIYLTSCVLAELVGQKLPPH

SEQ ID NO: 2932542 - protein, 25 aa, Entamoeba invadens
EGIFRVSPVFEWLKRVKEQLDSGQD

SEQ ID NO: 2932543 - protein, 24 aa, Entamoeba invadens
EGIKAKEYVATCLTELGKKQEALD

SEQ ID NO: 2932544 - protein, 25 aa, Entamoeba invadens
EGIKQLKTLYGLRVLNLNGCKQLTD

SEQ ID NO: 2932545 - protein, 26 aa, Entamoeba invadens
EGIMKFPMTLYIAFKRIFDGIPSIYK

SEQ ID NO: 2932546 - protein, 20 aa, Entamoeba invadens
EGINEIFFNAAFPNREFTYP

SEQ ID NO: 2932547 - protein, 18 aa, Entamoeba invadens
EGINWKRMNTQPVDSFEF

SEQ ID NO: 2932548 - protein, 17 aa, Entamoeba invadens
EGIPLYHTIPVDLTTKM

SEQ ID NO: 2932549 - protein, 27 aa, Entamoeba invadens
EGIPRIIECLKKHLLEKVKAVFENPSG

SEQ ID NO: 2932550 - protein, 25 aa, Entamoeba invadens
EGISELYRALFICHLGGFVSNSALV

SEQ ID NO: 2932551 - protein, 28 aa, Entamoeba invadens
EGITEIPAWCFGKCFSLRIVSLPKSVER

SEQ ID NO: 2932552 - protein, 25 aa, Entamoeba invadens
EGIVPAIRVCVERIYPTRYKFSDTK

SEQ ID NO: 2932553 - protein, 17 aa, Entamoeba invadens
EGIYRIVAHLLDKKIPL

SEQ ID NO: 2932554 - protein, 20 aa, Entamoeba invadens
EGKAGLQLDCKEIKQDLEEF

SEQ ID NO: 2932555 - protein, 22 aa, Entamoeba invadens
EGKAVTAGDCLKIMQSVTSVFE

SEQ ID NO: 2932556 - protein, 20 aa, Entamoeba invadens
EGKDTMALSFYKKAIDITPK

SEQ ID NO: 2932557 - protein, 25 aa, Entamoeba invadens
EGKECGFMYMDVLKIIGTPDISLKQ

SEQ ID NO: 2932558 - protein, 28 aa, Entamoeba invadens
EGKFNPSTIIPWRNETNLGLYDTTNHFF

SEQ ID NO: 2932559 - protein, 24 aa, Entamoeba invadens
EGKILKGDVPGIVDLFCNDERNNL

SEQ ID NO: 2932560 - protein, 18 aa, Entamoeba invadens
EGKLLLDKVRGVCKTNYF

SEQ ID NO: 2932561 - protein, 38 aa, Entamoeba invadens
EGKMLKAMGKFWHPECFVCSMCGGKISGGFGNLDGKPI

SEQ ID NO: 2932562 - protein, 32 aa, Entamoeba invadens
EGKNKGVLKREFFRIIVWFNVDFETVDRNKSR

SEQ ID NO: 2932563 - protein, 19 aa, Entamoeba invadens
EGKREVCELENFYKELKET

SEQ ID NO: 2932564 - protein, 19 aa, Entamoeba invadens
EGKRKLFFDEYRTQQMNGN

SEQ ID NO: 2932565 - protein, 29 aa, Entamoeba invadens
EGKRRKPVVGCFFELLVLKTQGVIDLEQQ

SEQ ID NO: 2932566 - protein, 17 aa, Entamoeba invadens
EGKSFKPAYVVALSWSK

SEQ ID NO: 2932567 - protein, 24 aa, Entamoeba invadens
EGKSWVLECLLKMTTIQTTQRQHF

SEQ ID NO: 2932568 - protein, 22 aa, Entamoeba invadens
EGKWKPEIDEYALGTPFLLIGT

SEQ ID NO: 2932569 - protein, 18 aa, Entamoeba invadens
EGLCCVLSVKVPEPKFSS

SEQ ID NO: 2932570 - protein, 18 aa, Entamoeba invadens
EGLDWAVTEDTVYFNTNH

SEQ ID NO: 2932571 - protein, 17 aa, Entamoeba invadens
EGLDYDENVDWWGLGIL

SEQ ID NO: 2932572 - protein, 24 aa, Entamoeba invadens
EGLFPNNEFPVMFVHCKGDEFYGT

SEQ ID NO: 2932573 - protein, 19 aa, Entamoeba invadens
EGLIDEFERVLGSLERMIT

SEQ ID NO: 2932574 - protein, 26 aa, Entamoeba invadens
EGLIEFMPTFKICIGEGTYKGNRIPS

SEQ ID NO: 2932575 - protein, 17 aa, Entamoeba invadens
EGLKEQFIAFLRAEATG

SEQ ID NO: 2932576 - protein, 19 aa, Entamoeba invadens
EGLKLCPLGSYQCGTASCN

SEQ ID NO: 2932577 - protein, 19 aa, Entamoeba invadens
EGLKPVVLEEMEFDTFLNG

SEQ ID NO: 2932578 - protein, 22 aa, Entamoeba invadens
EGLKRKGIVVHMLSGKTEAGCE

SEQ ID NO: 2932579 - protein, 17 aa, Entamoeba invadens
EGLKVIGNFCFLRCGSL

SEQ ID NO: 2932580 - protein, 19 aa, Entamoeba invadens
EGLLLSHIMFHLSSTGHKN

SEQ ID NO: 2932581 - protein, 24 aa, Entamoeba invadens
EGLNTRLPLTLTFDRLPQNVETMV

SEQ ID NO: 2932582 - protein, 19 aa, Entamoeba invadens
EGLPECLEEDDVHFLESVT

SEQ ID NO: 2932583 - protein, 27 aa, Entamoeba invadens
EGLSFGCFSHKIFPRSPKKGHSYVKND

SEQ ID NO: 2932584 - protein, 21 aa, Entamoeba invadens
EGLSGRFVKYDAEVFGKIKGV

SEQ ID NO: 2932585 - protein, 18 aa, Entamoeba invadens
EGLTKFIVTQVCYEDDTV

SEQ ID NO: 2932586 - protein, 18 aa, Entamoeba invadens
EGLVAIFNKFGRNKISSE

SEQ ID NO: 2932587 - protein, 20 aa, Entamoeba invadens
EGLVKFPSELLKISSSVTTV

SEQ ID NO: 2932588 - protein, 20 aa, Entamoeba invadens
EGLVLNAMIYLLAGEGYSVT

SEQ ID NO: 2932589 - protein, 19 aa, Entamoeba invadens
EGLVLNAMIYLLAQEGFSV

SEQ ID NO: 2932590 - protein, 17 aa, Entamoeba invadens
EGMCITIEPGVYLENEF

SEQ ID NO: 2932591 - protein, 27 aa, Entamoeba invadens
EGMDLILCSNCIARGNYFHDIFPIMFY

SEQ ID NO: 2932592 - protein, 21 aa, Entamoeba invadens
EGMISFNPCVKDFYDIKSPSF

SEQ ID NO: 2932593 - protein, 18 aa, Entamoeba invadens
EGMKELKSENIAIQMQCT

SEQ ID NO: 2932594 - protein, 22 aa, Entamoeba invadens
EGMNILKWPIPKTLLVPQKMTI

SEQ ID NO: 2932595 - protein, 19 aa, Entamoeba invadens
EGNAMCFNSGAIYNKVGII

SEQ ID NO: 2932596 - protein, 23 aa, Entamoeba invadens
EGNEKIPLVTFIMHYTQADMFGD

SEQ ID NO: 2932597 - protein, 31 aa, Entamoeba invadens
EGNNILHYVCKYPVPRRLLVITSLIKTNAFL

SEQ ID NO: 2932598 - protein, 29 aa, Entamoeba invadens
EGNSALAQFLVRMLNIWNRGDVSKMMENH

SEQ ID NO: 2932599 - protein, 24 aa, Entamoeba invadens
EGNTLKVVFGISVEDRLGRKAFYG

SEQ ID NO: 2932600 - protein, 25 aa, Entamoeba invadens
EGNTRFVCKEGWFEYATHKDAKLVE

SEQ ID NO: 2932601 - protein, 17 aa, Entamoeba invadens
EGPDFGETVYFEEQKQE

SEQ ID NO: 2932602 - protein, 18 aa, Entamoeba invadens
EGPIRFVKTSLLEQVELP

SEQ ID NO: 2932603 - protein, 19 aa, Entamoeba invadens
EGQDLMVEWHLQKGKEKKS

SEQ ID NO: 2932604 - protein, 18 aa, Entamoeba invadens
EGQEWVKKVEIWLYRGAW

SEQ ID NO: 2932605 - protein, 20 aa, Entamoeba invadens
EGQGVTWLEEFNTVSLHDIA

SEQ ID NO: 2932606 - protein, 27 aa, Entamoeba invadens
EGQNLYEWLSVNGFDFLDEIQLLYSPI

SEQ ID NO: 2932607 - protein, 18 aa, Entamoeba invadens
EGQQIGVVADIFGQVVAP

SEQ ID NO: 2932608 - protein, 19 aa, Entamoeba invadens
EGQSSYKIMAVRAGEAPKL

SEQ ID NO: 2932609 - protein, 20 aa, Entamoeba invadens
EGQYFIMFDVLLKYISVFEN

SEQ ID NO: 2932610 - protein, 19 aa, Entamoeba invadens
EGRCFYGCVSLEHIELPNT

SEQ ID NO: 2932611 - protein, 22 aa, Entamoeba invadens
EGREWAEQNGFTYAETSASNDI

SEQ ID NO: 2932612 - protein, 19 aa, Entamoeba invadens
EGRKIGHIVRVFKNEISRI

SEQ ID NO: 2932613 - protein, 24 aa, Entamoeba invadens
EGRKLGRLPTFIVVANKIDCNNRT

SEQ ID NO: 2932614 - protein, 23 aa, Entamoeba invadens
EGRKSPEMWRMKTTEFGGIKLIR

SEQ ID NO: 2932615 - protein, 24 aa, Entamoeba invadens
EGSEEIDMLYGIDYDRVLQVLKTI

SEQ ID NO: 2932616 - protein, 38 aa, Entamoeba invadens
EGSEHWLIMRCCTYIVSLLSYLCTLDIFEIDAETDGKV

SEQ ID NO: 2932617 - protein, 18 aa, Entamoeba invadens
EGSFAVVYLGLFRGNAVA

SEQ ID NO: 2932618 - protein, 20 aa, Entamoeba invadens
EGSFGIVIKGKFRGNEVAIK

SEQ ID NO: 2932619 - protein, 20 aa, Entamoeba invadens
EGSFGIVYKGIFRENIVAIK

SEQ ID NO: 2932620 - protein, 20 aa, Entamoeba invadens
EGSFGIVYKGIFRGNMVAIK

SEQ ID NO: 2932621 - protein, 31 aa, Entamoeba invadens
EGSFGIVYKGIFRKEIVAIKKMREVSDTENA

SEQ ID NO: 2932622 - protein, 22 aa, Entamoeba invadens
EGSFGVVFKGNFRGNIVAIKKM

SEQ ID NO: 2932623 - protein, 23 aa, Entamoeba invadens
EGSFGVVFKGTFRDNIVAIKKMK

SEQ ID NO: 2932624 - protein, 22 aa, Entamoeba invadens
EGSFGVVFKGTFRDNIVALKKM

SEQ ID NO: 2932625 - protein, 23 aa, Entamoeba invadens
EGSFGVVFKGTFRDNIVVIKKMK

SEQ ID NO: 2932626 - protein, 20 aa, Entamoeba invadens
EGSFGVVFKGTFRGNSVAIK

SEQ ID NO: 2932627 - protein, 24 aa, Entamoeba invadens
EGSFGVVYKGIFRGNTVAIKKMKI

SEQ ID NO: 2932628 - protein, 17 aa, Entamoeba invadens
EGSGRYTRALLYLQNMF

SEQ ID NO: 2932629 - protein, 24 aa, Entamoeba invadens
EGSKIEKGVSCLELARQDEKEANK

SEQ ID NO: 2932630 - protein, 23 aa, Entamoeba invadens
EGSKLFVKREFHALKVNPKGKAQ

SEQ ID NO: 2932631 - protein, 28 aa, Entamoeba invadens
EGSKVYWKWFLALSEVPRRSGNRLPPSE

SEQ ID NO: 2932632 - protein, 20 aa, Entamoeba invadens
EGSRLCALSLLINLAKSDNM

SEQ ID NO: 2932633 - protein, 17 aa, Entamoeba invadens
EGSRMLYSNGFDGSVNV

SEQ ID NO: 2932634 - protein, 17 aa, Entamoeba invadens
EGSVFVLNCPWTGAELE

SEQ ID NO: 2932635 - protein, 23 aa, Entamoeba invadens
EGSVGKSALCLQFVREVFSAEYN

SEQ ID NO: 2932636 - protein, 18 aa, Entamoeba invadens
EGSVIVCQNEIPIETTRT

SEQ ID NO: 2932637 - protein, 18 aa, Entamoeba invadens
EGSVWRAYLAVEKTRKGL

SEQ ID NO: 2932638 - protein, 25 aa, Entamoeba invadens
EGSVYKSACLIIKGIPKILFFEPKP

SEQ ID NO: 2932639 - protein, 21 aa, Entamoeba invadens
EGTEVFMKWRRGDKKENKGHL

SEQ ID NO: 2932640 - protein, 22 aa, Entamoeba invadens
EGTFRITCEKVMEVLRENKDSL

SEQ ID NO: 2932641 - protein, 19 aa, Entamoeba invadens
EGTIKAGLYNTAQHEEGSK

SEQ ID NO: 2932642 - protein, 26 aa, Entamoeba invadens
EGTKLSFFSWNCWNGHIPALFVNKAT

SEQ ID NO: 2932643 - protein, 37 aa, Entamoeba invadens
EGTKLSFFSWNSWNGWIPNWVVNKCSKYMIADIIQQL

SEQ ID NO: 2932644 - protein, 24 aa, Entamoeba invadens
EGTNTMWSKESWMMGCNLRDDGVC

SEQ ID NO: 2932645 - protein, 25 aa, Entamoeba invadens
EGTQFNYFVARSFKGDTHAIAKKIK

SEQ ID NO: 2932646 - protein, 23 aa, Entamoeba invadens
EGTTAKYGFRFSGMTLSTLHKSY

SEQ ID NO: 2932647 - protein, 24 aa, Entamoeba invadens
EGTTFPATYLFNFSETAKFNSIQF

SEQ ID NO: 2932648 - protein, 24 aa, Entamoeba invadens
EGTTFPATYLFNFSETAKFNSLQL

SEQ ID NO: 2932649 - protein, 21 aa, Entamoeba invadens
EGTVKKSAKWMFQKYNSEEFV

SEQ ID NO: 2932650 - protein, 26 aa, Entamoeba invadens
EGTVLPLRIKRVFLDGVTVKELNFEE

SEQ ID NO: 2932651 - protein, 17 aa, Entamoeba invadens
EGTYEFTGETWDNVSAK

SEQ ID NO: 2932652 - protein, 22 aa, Entamoeba invadens
EGVAFKKCFSYAGFEQQPKLFV

SEQ ID NO: 2932653 - protein, 19 aa, Entamoeba invadens
EGVAVILINEFFKKWLEAL

SEQ ID NO: 2932654 - protein, 17 aa, Entamoeba invadens
EGVCCQCASVRNTNEMV

SEQ ID NO: 2932655 - protein, 17 aa, Entamoeba invadens
EGVCKYIKNGGKNEGML

SEQ ID NO: 2932656 - protein, 24 aa, Entamoeba invadens
EGVDRLRFTANFVTPLYPSTSDLT

SEQ ID NO: 2932657 - protein, 21 aa, Entamoeba invadens
EGVDVAIKWFIPQKYGNVYGQ

SEQ ID NO: 2932658 - protein, 18 aa, Entamoeba invadens
EGVFKVIMNVAKTTMDDV

SEQ ID NO: 2932659 - protein, 24 aa, Entamoeba invadens
EGVGCAYSKCIACSKKIVEEYKQR

SEQ ID NO: 2932660 - protein, 29 aa, Entamoeba invadens
EGVGKVGPKRAIQIIKMFDTPEQFAKVMH

SEQ ID NO: 2932661 - protein, 19 aa, Entamoeba invadens
EGVKAIKNTGCLKNLILLF

SEQ ID NO: 2932662 - protein, 24 aa, Entamoeba invadens
EGVKCTKCNFGSYIENGKCVEVKA

SEQ ID NO: 2932663 - protein, 19 aa, Entamoeba invadens
EGVKDAFYSFLGRIEPEVD

SEQ ID NO: 2932664 - protein, 23 aa, Entamoeba invadens
EGVKEDFQCFVFSLLNPTNTIQR

SEQ ID NO: 2932665 - protein, 29 aa, Entamoeba invadens
EGVKFGLKKCGKFMLGDDMGLGKTIQTIA

SEQ ID NO: 2932666 - protein, 24 aa, Entamoeba invadens
EGVKMELTDGCFPLVKGIVASNKT

SEQ ID NO: 2932667 - protein, 30 aa, Entamoeba invadens
EGVKSFDPRLFTSHFNHVFVIVQPINEETY

SEQ ID NO: 2932668 - protein, 26 aa, Entamoeba invadens
EGVLECAQCGKRICNGALSNSSKCQL

SEQ ID NO: 2932669 - protein, 18 aa, Entamoeba invadens
EGVLKVGRREEWRLYLEC

SEQ ID NO: 2932670 - protein, 23 aa, Entamoeba invadens
EGVMRIAGVLACHDAFTPQLVTI

SEQ ID NO: 2932671 - protein, 26 aa, Entamoeba invadens
EGVNFGIKCVNVMPGGFKTDFFKNTS

SEQ ID NO: 2932672 - protein, 22 aa, Entamoeba invadens
EGVPRLKELLNMSKMPKTPSMT

SEQ ID NO: 2932673 - protein, 20 aa, Entamoeba invadens
EGVREVLERLGLNLREQNDF

SEQ ID NO: 2932674 - protein, 20 aa, Entamoeba invadens
EGVREVLERLGLNSREQNDF

SEQ ID NO: 2932675 - protein, 24 aa, Entamoeba invadens
EGVVLDIFKGYTMWVKTFENSKFV

SEQ ID NO: 2932676 - protein, 30 aa, Entamoeba invadens
EGWVPQDIWNCFPKVTILFAKKICKKVPLC

SEQ ID NO: 2932677 - protein, 18 aa, Entamoeba invadens
EGYLKEISRMLGEILTRK

SEQ ID NO: 2932678 - protein, 42 aa, Entamoeba invadens
EGYQQLVDGCRLCGTNCIKLLQIVYGASFKKLANEQENLNKL

SEQ ID NO: 2932679 - protein, 20 aa, Entamoeba invadens
EGYVPLDVISKFKLVSQHNK

SEQ ID NO: 2932680 - protein, 26 aa, Entamoeba invadens
EGYYSRYAECVKCDSNCLACVDESIC

SEQ ID NO: 2932681 - protein, 26 aa, Entamoeba invadens
EHAAILWRISRFNGMTQQTITVDVDL

SEQ ID NO: 2932682 - protein, 18 aa, Entamoeba invadens
EHAESPYFGRNVVKTDLF

SEQ ID NO: 2932683 - protein, 18 aa, Entamoeba invadens
EHALPAEMGHVWVDAHAC

SEQ ID NO: 2932684 - protein, 18 aa, Entamoeba invadens
EHCKNFKINLLKFNTQVV

SEQ ID NO: 2932685 - protein, 23 aa, Entamoeba invadens
EHDKAVKLLGLWDQHGINKESIP

SEQ ID NO: 2932686 - protein, 17 aa, Entamoeba invadens
EHDLGRNDIEWINKSAV

SEQ ID NO: 2932687 - protein, 19 aa, Entamoeba invadens
EHECVKNGIATTFFGNTES

SEQ ID NO: 2932688 - protein, 26 aa, Entamoeba invadens
EHEKLLFFWKQMFLLVSNASCVSQGN

SEQ ID NO: 2932689 - protein, 26 aa, Entamoeba invadens
EHELCYGCLPLEFLKKEEYLNLMMTK

SEQ ID NO: 2932690 - protein, 24 aa, Entamoeba invadens
EHFAARYAECFKKELDELQIGSSQ

SEQ ID NO: 2932691 - protein, 19 aa, Entamoeba invadens
EHFEFPKLDKATLLETICI

SEQ ID NO: 2932692 - protein, 21 aa, Entamoeba invadens
EHFNLKIAFYKNSHLFLQKLE

SEQ ID NO: 2932693 - protein, 24 aa, Entamoeba invadens
EHFSYRATAHIVRAAKILHCQIPI

SEQ ID NO: 2932694 - protein, 22 aa, Entamoeba invadens
EHFTCLNYIITFMASLSRSEKS

SEQ ID NO: 2932695 - protein, 18 aa, Entamoeba invadens
EHFVPPQVKGRAFPEIYK

SEQ ID NO: 2932696 - protein, 21 aa, Entamoeba invadens
EHIHEVKLLLIQDVTGQVVWD

SEQ ID NO: 2932697 - protein, 22 aa, Entamoeba invadens
EHILSSLGYVCHNIYFEFTCGD

SEQ ID NO: 2932698 - protein, 24 aa, Entamoeba invadens
EHINQCFICGKYGHKKADCPEKGK

SEQ ID NO: 2932699 - protein, 22 aa, Entamoeba invadens
EHIPIVLCGNKSDLESVRTVSI

SEQ ID NO: 2932700 - protein, 27 aa, Entamoeba invadens
EHIRMFGEFCFYWCDKLSAITLGTNIV

SEQ ID NO: 2932701 - protein, 17 aa, Entamoeba invadens
EHKEGSSICGFQSDSLV

SEQ ID NO: 2932702 - protein, 30 aa, Entamoeba invadens
EHKIFVQGCIWNVNSFDQWGVELGKQLAKA

SEQ ID NO: 2932703 - protein, 25 aa, Entamoeba invadens
EHKKVKGKDALRCYPLSDRYGQTTR

SEQ ID NO: 2932704 - protein, 22 aa, Entamoeba invadens
EHKVNSFIPWYLLNTSDKTPED

SEQ ID NO: 2932705 - protein, 25 aa, Entamoeba invadens
EHLAGKWPFWLSPRQIMVATVSEKF

SEQ ID NO: 2932706 - protein, 26 aa, Entamoeba invadens
EHLCAFKGKIWAKVFIKSKPQRYGIK

SEQ ID NO: 2932707 - protein, 30 aa, Entamoeba invadens
EHLCAFKGKIWAKVFIKSKPQRYGIKFWMC

SEQ ID NO: 2932708 - protein, 27 aa, Entamoeba invadens
EHLCAFKGKIWAKVFIKSKPQRYSIKF

SEQ ID NO: 2932709 - protein, 25 aa, Entamoeba invadens
EHLCSYKGHMWAKVFIKSKPGRYGI

SEQ ID NO: 2932710 - protein, 23 aa, Entamoeba invadens
EHLHNCAPFIAKLYSLVNTIEYK

SEQ ID NO: 2932711 - protein, 17 aa, Entamoeba invadens
EHLKMTFGEPEETFEFD

SEQ ID NO: 2932712 - protein, 19 aa, Entamoeba invadens
EHLLGAKIITFLLRVLDRC

SEQ ID NO: 2932713 - protein, 19 aa, Entamoeba invadens
EHLNFGTAVILSEHTVTER

SEQ ID NO: 2932714 - protein, 19 aa, Entamoeba invadens
EHLNTLLLKKGLLLENTRI

SEQ ID NO: 2932715 - protein, 28 aa, Entamoeba invadens
EHLSKLGRTTVCFGEWFEGLDDRVIVVG

SEQ ID NO: 2932716 - protein, 23 aa, Entamoeba invadens
EHMKFLICICFLNATSSKRLPVS

SEQ ID NO: 2932717 - protein, 17 aa, Entamoeba invadens
EHMPPHKIISVLEILSN

SEQ ID NO: 2932718 - protein, 25 aa, Entamoeba invadens
EHNIKGYFPRADFVVFGHIKTINKT

SEQ ID NO: 2932719 - protein, 17 aa, Entamoeba invadens
EHNMWNLQFYFDMIQKD

SEQ ID NO: 2932720 - protein, 22 aa, Entamoeba invadens
EHNVKILAKLTEHYEQKLAEEK

SEQ ID NO: 2932721 - protein, 20 aa, Entamoeba invadens
EHPLMYPDFVIGDRDKNADL

SEQ ID NO: 2932722 - protein, 20 aa, Entamoeba invadens
EHPSGWGYGVCGRNCGVIKM

SEQ ID NO: 2932723 - protein, 20 aa, Entamoeba invadens
EHPTKSWVSLYMRPTVIPAV

SEQ ID NO: 2932724 - protein, 18 aa, Entamoeba invadens
EHQGIRIDFVGTIEYSYD

SEQ ID NO: 2932725 - protein, 29 aa, Entamoeba invadens
EHQLVFKSSLKLCFKIAKNSFINAMDEKN

SEQ ID NO: 2932726 - protein, 19 aa, Entamoeba invadens
EHQRFYSNLIFYLHRCKTQ

SEQ ID NO: 2932727 - protein, 30 aa, Entamoeba invadens
EHQSAFLKRFMKGDIKIVHKCFEMITRGCE

SEQ ID NO: 2932728 - protein, 28 aa, Entamoeba invadens
EHSKRLKIKLTVEKEVFKNTLIQQDFTV

SEQ ID NO: 2932729 - protein, 24 aa, Entamoeba invadens
EHSLKHFYHAISFAMSSESDKVLA

SEQ ID NO: 2932730 - protein, 30 aa, Entamoeba invadens
EHTLPPIYWRYAFEEHVWSDPIPLNIYLHS

SEQ ID NO: 2932731 - protein, 19 aa, Entamoeba invadens
EHVCDVCGKAFLRKSECEI

SEQ ID NO: 2932732 - protein, 23 aa, Entamoeba invadens
EHVEPKIPIIALLMGDMVRLNDM

SEQ ID NO: 2932733 - protein, 22 aa, Entamoeba invadens
EHVLVVRCVYFYMKCFTENFIL

SEQ ID NO: 2932734 - protein, 18 aa, Entamoeba invadens
EHVSEFGTKCFIGCDSLS

SEQ ID NO: 2932735 - protein, 23 aa, Entamoeba invadens
EHYKFNSIMFHSFIQLKKYNEAA

SEQ ID NO: 2932736 - protein, 18 aa, Entamoeba invadens
EIAAQICRQAGLVKHKGL

SEQ ID NO: 2932737 - protein, 17 aa, Entamoeba invadens
EIADLFLTIPQISRTRV

SEQ ID NO: 2932738 - protein, 18 aa, Entamoeba invadens
EIAFKKSEVEFMIITERS

SEQ ID NO: 2932739 - protein, 26 aa, Entamoeba invadens
EIAGKRLNVKFAKLKEGKSFSRHSPP

SEQ ID NO: 2932740 - protein, 20 aa, Entamoeba invadens
EIAHFLPVIMEDILEFFREK

SEQ ID NO: 2932741 - protein, 19 aa, Entamoeba invadens
EIAKLAALTLRKQPKGIWT

SEQ ID NO: 2932742 - protein, 29 aa, Entamoeba invadens
EIAQIMAKKCPRCKMYISKENGCNTITCK

SEQ ID NO: 2932743 - protein, 20 aa, Entamoeba invadens
EIARIGAEIAKYVVGLESID

SEQ ID NO: 2932744 - protein, 27 aa, Entamoeba invadens
EIASGLWYLHFCKHIIHRDLKLENFLL

SEQ ID NO: 2932745 - protein, 20 aa, Entamoeba invadens
EICGNVKFNCKIGVEEIAFC

SEQ ID NO: 2932746 - protein, 22 aa, Entamoeba invadens
EICIGKNLECIGGHAFENCINL

SEQ ID NO: 2932747 - protein, 25 aa, Entamoeba invadens
EICNNRIDVVWTWVNGTDPLWLSHL

SEQ ID NO: 2932748 - protein, 20 aa, Entamoeba invadens
EICQNYPLIINRQVVERPKQ

SEQ ID NO: 2932749 - protein, 17 aa, Entamoeba invadens
EICVAARETLELIKGMV

SEQ ID NO: 2932750 - protein, 22 aa, Entamoeba invadens
EIDFPVSFGVFQKFLKNGVQCK

SEQ ID NO: 2932751 - protein, 23 aa, Entamoeba invadens
EIDMKLRIKFLLDALKGIQYLHE

SEQ ID NO: 2932752 - protein, 24 aa, Entamoeba invadens
EIDMKLRVKICLDAAKDNILVFSL

SEQ ID NO: 2932753 - protein, 20 aa, Entamoeba invadens
EIDMKLRVKILLDGAKGIQY

SEQ ID NO: 2932754 - protein, 19 aa, Entamoeba invadens
EIDRDAVLESIRRFSYDHD

SEQ ID NO: 2932755 - protein, 26 aa, Entamoeba invadens
EIDRLDCKLHVYIPKATKGEVFPDLD

SEQ ID NO: 2932756 - protein, 18 aa, Entamoeba invadens
EIDSHFLFNLGIENALLP

SEQ ID NO: 2932757 - protein, 27 aa, Entamoeba invadens
EIDSLILKERFNVFMYQSHIDKKNKEI

SEQ ID NO: 2932758 - protein, 26 aa, Entamoeba invadens
EIDSTCKHNFLFRGNSPFTRVYSAYL

SEQ ID NO: 2932759 - protein, 21 aa, Entamoeba invadens
EIDTAAPYFLGFDQHDSQELT

SEQ ID NO: 2932760 - protein, 25 aa, Entamoeba invadens
EIDVSLRYIEHWSNSALMKPTLVGD

SEQ ID NO: 2932761 - protein, 18 aa, Entamoeba invadens
EIDVYIPYIIILKNTKLR

SEQ ID NO: 2932762 - protein, 23 aa, Entamoeba invadens
EIEALKKKLAEEIAKREVAEMAL

SEQ ID NO: 2932763 - protein, 23 aa, Entamoeba invadens
EIEALKKKLAEEIAKSEAVEKAL

SEQ ID NO: 2932764 - protein, 17 aa, Entamoeba invadens
EIEDWLFISGETTASEP

SEQ ID NO: 2932765 - protein, 26 aa, Entamoeba invadens
EIEECFRTPSSIFRRNSIFTRIIRVF

SEQ ID NO: 2932766 - protein, 25 aa, Entamoeba invadens
EIEELSHAVYIYWRAKEMVKTKEYE

SEQ ID NO: 2932767 - protein, 25 aa, Entamoeba invadens
EIEFCPGTYQFPFNFTLPPTFPPTL

SEQ ID NO: 2932768 - protein, 22 aa, Entamoeba invadens
EIEGRSVLLYAVQFKTEIGVLL

SEQ ID NO: 2932769 - protein, 20 aa, Entamoeba invadens
EIEITKHFVVGRLVRVMIED

SEQ ID NO: 2932770 - protein, 31 aa, Entamoeba invadens
EIEKEKKEAHEIIENIKLLKNNLEEKVNTLQ

SEQ ID NO: 2932771 - protein, 34 aa, Entamoeba invadens
EIEKIDIDICKKIAKESLPFALEYFLAIESSQYE

SEQ ID NO: 2932772 - protein, 18 aa, Entamoeba invadens
EIEKMSGLQVSDIIFEGK

SEQ ID NO: 2932773 - protein, 19 aa, Entamoeba invadens
EIEKRKVLVNFLDFREQDE

SEQ ID NO: 2932774 - protein, 24 aa, Entamoeba invadens
EIEKVCTPGGITIKGVNQLDHDNF

SEQ ID NO: 2932775 - protein, 24 aa, Entamoeba invadens
EIELFKYSQLISAKQSFDVELKKR

SEQ ID NO: 2932776 - protein, 43 aa, Entamoeba invadens
EIENFDIHFSMFLVAIQRWLKLKIKSAMKIALLTGTNMRELTV

SEQ ID NO: 2932777 - protein, 18 aa, Entamoeba invadens
EIENYFVLANTFKIAKMI

SEQ ID NO: 2932778 - protein, 28 aa, Entamoeba invadens
EIEREKGRVCAFVFAMILDFLKQSLVYA

SEQ ID NO: 2932779 - protein, 17 aa, Entamoeba invadens
EIERIVSVGGYVTKGRV

SEQ ID NO: 2932780 - protein, 24 aa, Entamoeba invadens
EIETICKLKLGGFGGNVNLTENGY

SEQ ID NO: 2932781 - protein, 25 aa, Entamoeba invadens
EIFDWAMKRITSFTHNIIYHDPVEG

SEQ ID NO: 2932782 - protein, 19 aa, Entamoeba invadens
EIFEKPFIVKWFNENNPWE

SEQ ID NO: 2932783 - protein, 19 aa, Entamoeba invadens
EIFFKCLDLSVFKRPEDKS

SEQ ID NO: 2932784 - protein, 20 aa, Entamoeba invadens
EIFKCNKCGHIRRFPRYNNP

SEQ ID NO: 2932785 - protein, 20 aa, Entamoeba invadens
EIFKKSIHVLTCIETTTTLF

SEQ ID NO: 2932786 - protein, 24 aa, Entamoeba invadens
EIFKQNSKCLIGMFASKKDTEDQT

SEQ ID NO: 2932787 - protein, 21 aa, Entamoeba invadens
EIFLQTLLNIFGFVPSEKGSD

SEQ ID NO: 2932788 - protein, 20 aa, Entamoeba invadens
EIFMSGLINKFFNLGSNMEL

SEQ ID NO: 2932789 - protein, 25 aa, Entamoeba invadens
EIFNELKIDVMFVREMQSKKKTKED

SEQ ID NO: 2932790 - protein, 18 aa, Entamoeba invadens
EIFPRGLYILVIPFYQDY

SEQ ID NO: 2932791 - protein, 19 aa, Entamoeba invadens
EIFVKRKIGTLTNNLVYIV

SEQ ID NO: 2932792 - protein, 18 aa, Entamoeba invadens
EIGDFCFKNYSSASLKEL

SEQ ID NO: 2932793 - protein, 24 aa, Entamoeba invadens
EIGDFCFYCCSGLRSVTINPGVIN

SEQ ID NO: 2932794 - protein, 23 aa, Entamoeba invadens
EIGESWEKVKIIGIVFDMNVLMV

SEQ ID NO: 2932795 - protein, 26 aa, Entamoeba invadens
EIGFAKCCIHKYILKVYDIFEDGDSI

SEQ ID NO: 2932796 - protein, 19 aa, Entamoeba invadens
EIGIGFVSDYRRLNVSLTR

SEQ ID NO: 2932797 - protein, 19 aa, Entamoeba invadens
EIGKEILFEVVQHLRSGSC

SEQ ID NO: 2932798 - protein, 23 aa, Entamoeba invadens
EIGLKLRVKMMIDGSKGITYLHE

SEQ ID NO: 2932799 - protein, 18 aa, Entamoeba invadens
EIGLPIDISMTMNQLKTV

SEQ ID NO: 2932800 - protein, 25 aa, Entamoeba invadens
EIGNCLRYGTPNALYLLPKYAEKLM

SEQ ID NO: 2932801 - protein, 18 aa, Entamoeba invadens
EIGNKRIAVHTAISEEKR

SEQ ID NO: 2932802 - protein, 22 aa, Entamoeba invadens
EIGNLPVVFLIEDSHYEVHRSM

SEQ ID NO: 2932803 - protein, 29 aa, Entamoeba invadens
EIGSKLYAIGSCCFRGCHNLEDLILPNGL

SEQ ID NO: 2932804 - protein, 17 aa, Entamoeba invadens
EIGSNCFGGCKNLQEVK

SEQ ID NO: 2932805 - protein, 24 aa, Entamoeba invadens
EIGTSCFYKCYKLDFNDIPVQLRS

SEQ ID NO: 2932806 - protein, 23 aa, Entamoeba invadens
EIHDMSFVFLQIFAGKTVYVDTK

SEQ ID NO: 2932807 - protein, 22 aa, Entamoeba invadens
EIHDYCNINRFFTYEVKDTEIK

SEQ ID NO: 2932808 - protein, 19 aa, Entamoeba invadens
EIHIPSIVTSIGFNSFEEC

SEQ ID NO: 2932809 - protein, 17 aa, Entamoeba invadens
EIICKRAFFNCQKLENF

SEQ ID NO: 2932810 - protein, 24 aa, Entamoeba invadens
EIIEFCYERKLCLMADEVYQENIW

SEQ ID NO: 2932811 - protein, 18 aa, Entamoeba invadens
EIIESVLMAVTFEAGDAD

SEQ ID NO: 2932812 - protein, 19 aa, Entamoeba invadens
EIIEYVKTKIGGEVVQFGS

SEQ ID NO: 2932813 - protein, 26 aa, Entamoeba invadens
EIIIPPDFPKSVPIGSQITPTATNNI

SEQ ID NO: 2932814 - protein, 28 aa, Entamoeba invadens
EIIIRPYPLVIRQKHPIIDVDEINEQTS

SEQ ID NO: 2932815 - protein, 24 aa, Entamoeba invadens
EIIKCSKCGDSNIFNLKCNVLKEI

SEQ ID NO: 2932816 - protein, 23 aa, Entamoeba invadens
EIIKKELDGLGGMTQPVALQVLD

SEQ ID NO: 2932817 - protein, 20 aa, Entamoeba invadens
EIILGLPYSCAIDMWSFGCV

SEQ ID NO: 2932818 - protein, 30 aa, Entamoeba invadens
EIILGLPYTCAIDMWSFGCIIAEMMIGIPI

SEQ ID NO: 2932819 - protein, 17 aa, Entamoeba invadens
EIINFTINYEKPIVTDL

SEQ ID NO: 2932820 - protein, 28 aa, Entamoeba invadens
EIIPELKSLIPGCLAVRGNFVGDVGLDD

SEQ ID NO: 2932821 - protein, 20 aa, Entamoeba invadens
EIIPFPPYVEDVWYEHGEGF

SEQ ID NO: 2932822 - protein, 25 aa, Entamoeba invadens
EIIQLKIKFLRAALKGDKKLQPEDL

SEQ ID NO: 2932823 - protein, 25 aa, Entamoeba invadens
EIIRGKMTLDFHLQMLPKITRDQSD

SEQ ID NO: 2932824 - protein, 20 aa, Entamoeba invadens
EIISDIFVRVGLTRQQVTEM

SEQ ID NO: 2932825 - protein, 19 aa, Entamoeba invadens
EIISRCIPLSINNNSFSPV

SEQ ID NO: 2932826 - protein, 18 aa, Entamoeba invadens
EIISYKFDTSIHVAPQDV

SEQ ID NO: 2932827 - protein, 18 aa, Entamoeba invadens
EIITELEEILLLKKRKNE

SEQ ID NO: 2932828 - protein, 21 aa, Entamoeba invadens
EIITFCMSLSMFPESDTPNDY

SEQ ID NO: 2932829 - protein, 19 aa, Entamoeba invadens
EIIVISRLLLLTLTPFKLI

SEQ ID NO: 2932830 - protein, 26 aa, Entamoeba invadens
EIIYRCFHKYLAWVFGSYKKYIWFDQ

SEQ ID NO: 2932831 - protein, 19 aa, Entamoeba invadens
EIKAELIAKGIKFVSETDT

SEQ ID NO: 2932832 - protein, 26 aa, Entamoeba invadens
EIKAHNFFKGVKFQLIRNITPPIIPK

SEQ ID NO: 2932833 - protein, 24 aa, Entamoeba invadens
EIKATCTEAGMFALRERRSHVTQE

SEQ ID NO: 2932834 - protein, 20 aa, Entamoeba invadens
EIKDQVPYPVFKKFNDFVYY

SEQ ID NO: 2932835 - protein, 27 aa, Entamoeba invadens
EIKEMKLKRYAYKVLRRENKDRTLFTF

SEQ ID NO: 2932836 - protein, 22 aa, Entamoeba invadens
EIKENMKNLAYDKDQLSSEKKK

SEQ ID NO: 2932837 - protein, 21 aa, Entamoeba invadens
EIKEWTFNHCFSLKKINIPQS

SEQ ID NO: 2932838 - protein, 23 aa, Entamoeba invadens
EIKKAKESLTYQMATQFDAMEKE

SEQ ID NO: 2932839 - protein, 21 aa, Entamoeba invadens
EIKKSSTPEEREIIKQERKKR

SEQ ID NO: 2932840 - protein, 21 aa, Entamoeba invadens
EIKKVTCNIVIDQNEVTKDSQ

SEQ ID NO: 2932841 - protein, 18 aa, Entamoeba invadens
EIKLEPIDVFILKMESST

SEQ ID NO: 2932842 - protein, 17 aa, Entamoeba invadens
EIKLSERHIAYVVRETN

SEQ ID NO: 2932843 - protein, 23 aa, Entamoeba invadens
EIKNFWCSAHRVALTGEGLDKEP

SEQ ID NO: 2932844 - protein, 25 aa, Entamoeba invadens
EIKQSFYKTVVWFRVHYEDTLDPAY

SEQ ID NO: 2932845 - protein, 39 aa, Entamoeba invadens
EIKQVMKKNFLLKMDYFRLKLGCMIHLAKFLNYDRDGLF

SEQ ID NO: 2932846 - protein, 27 aa, Entamoeba invadens
EILELEGRLPTQLPQVIETMINYLYTK

SEQ ID NO: 2932847 - protein, 20 aa, Entamoeba invadens
EILELGFDVVAMWKPESLTY

SEQ ID NO: 2932848 - protein, 17 aa, Entamoeba invadens
EILELYNKFEVNYLEQM

SEQ ID NO: 2932849 - protein, 24 aa, Entamoeba invadens
EILGDLKKSCDLVEQLNKEIEKLK

SEQ ID NO: 2932850 - protein, 21 aa, Entamoeba invadens
EILGSCYENLAPYIVKTPDQF

SEQ ID NO: 2932851 - protein, 24 aa, Entamoeba invadens
EILHDISLDYLKKVFTKRIQYYSA

SEQ ID NO: 2932852 - protein, 19 aa, Entamoeba invadens
EILIYLCACKINYPKRFML

SEQ ID NO: 2932853 - protein, 19 aa, Entamoeba invadens
EILKELKIEGDEKIEKIFC

SEQ ID NO: 2932854 - protein, 25 aa, Entamoeba invadens
EILKKDFNVAILMLRQQNVEVFDCE

SEQ ID NO: 2932855 - protein, 18 aa, Entamoeba invadens
EILLDMTDKFDVDWKYDL

SEQ ID NO: 2932856 - protein, 19 aa, Entamoeba invadens
EILNVCNKLPVTQHETDIR

SEQ ID NO: 2932857 - protein, 22 aa, Entamoeba invadens
EILPEAFDGTILNKIITISIQK

SEQ ID NO: 2932858 - protein, 25 aa, Entamoeba invadens
EILPSSDFFPLFWDIVSKNLESTAP

SEQ ID NO: 2932859 - protein, 19 aa, Entamoeba invadens
EILQEAYKYSCDERPKYRI

SEQ ID NO: 2932860 - protein, 20 aa, Entamoeba invadens
EILQILLNLCEFIEREGIKV

SEQ ID NO: 2932861 - protein, 25 aa, Entamoeba invadens
EILQKSPGGGLVFFSSYKIMEKIHK

SEQ ID NO: 2932862 - protein, 24 aa, Entamoeba invadens
EILQRMRRGIIYGAFQSANPILAQ

SEQ ID NO: 2932863 - protein, 19 aa, Entamoeba invadens
EILSKTVLYAIHRAILLKD

SEQ ID NO: 2932864 - protein, 34 aa, Entamoeba invadens
EILSPLRLKIMNFIRIWMKNAWKDFEAKDELIDK

SEQ ID NO: 2932865 - protein, 18 aa, Entamoeba invadens
EILTFDFNFFKMATLTYK

SEQ ID NO: 2932866 - protein, 18 aa, Entamoeba invadens
EIMKGVSNDPAFFEPKLK

SEQ ID NO: 2932867 - protein, 24 aa, Entamoeba invadens
EIMREVDDILLLPNIADYLDPYVL

SEQ ID NO: 2932868 - protein, 22 aa, Entamoeba invadens
EIMSQFIKIYGYDINLPNVYDQ

SEQ ID NO: 2932869 - protein, 26 aa, Entamoeba invadens
EIMWRVKTMRKVRLFLAKLQCEQKTV

SEQ ID NO: 2932870 - protein, 27 aa, Entamoeba invadens
EINDIFCASGNLGHRGAKNFFSALCQI

SEQ ID NO: 2932871 - protein, 30 aa, Entamoeba invadens
EINEVKKPIFLFLLKIVKKLILHFKSPTLI

SEQ ID NO: 2932872 - protein, 25 aa, Entamoeba invadens
EINKCRRVICPFKTYSMCQDKGFFY

SEQ ID NO: 2932873 - protein, 21 aa, Entamoeba invadens
EINLALPVFHIGFFRPIIQVL

SEQ ID NO: 2932874 - protein, 18 aa, Entamoeba invadens
EINSAVFEAMEKGEAIGK

SEQ ID NO: 2932875 - protein, 34 aa, Entamoeba invadens
EINSFCSLCGVSLFKWEKDILVLFGKTHFEFRYN

SEQ ID NO: 2932876 - protein, 33 aa, Entamoeba invadens
EIPEKAFYASLCMKHFQIPFGVTRLCTQSFSFC

SEQ ID NO: 2932877 - protein, 21 aa, Entamoeba invadens
EIPEKCFYQCASLKIVLPNTP

SEQ ID NO: 2932878 - protein, 22 aa, Entamoeba invadens
EIPENLRSIFGIVRDTVDEIFP

SEQ ID NO: 2932879 - protein, 17 aa, Entamoeba invadens
EIPEYIDTLYACMNFAE

SEQ ID NO: 2932880 - protein, 19 aa, Entamoeba invadens
EIPFQCFDNCYSLQSISLP

SEQ ID NO: 2932881 - protein, 18 aa, Entamoeba invadens
EIPGCLIPEKAIYTFEKW

SEQ ID NO: 2932882 - protein, 23 aa, Entamoeba invadens
EIPHEGAFCDLMWSDPDDSIDDM

SEQ ID NO: 2932883 - protein, 24 aa, Entamoeba invadens
EIPHEGAMCDLLWSDPDPTTNDWK

SEQ ID NO: 2932884 - protein, 22 aa, Entamoeba invadens
EIPKGCFSECGALSEITIPSGV

SEQ ID NO: 2932885 - protein, 23 aa, Entamoeba invadens
EIPKITFKLSQRTTFFATKAMLR

SEQ ID NO: 2932886 - protein, 19 aa, Entamoeba invadens
EIPKKCIVVPEVMKSSQII

SEQ ID NO: 2932887 - protein, 28 aa, Entamoeba invadens
EIPKSLTKIGVFAFRGCESLKEVEIPET

SEQ ID NO: 2932888 - protein, 17 aa, Entamoeba invadens
EIPLFCFKDCSNLSSVM

SEQ ID NO: 2932889 - protein, 23 aa, Entamoeba invadens
EIPNDIKTNLAFYKRVSTFLENA

SEQ ID NO: 2932890 - protein, 20 aa, Entamoeba invadens
EIPNFSGLFGDMYFSTSKLN

SEQ ID NO: 2932891 - protein, 18 aa, Entamoeba invadens
EIPNSVSECIRILQIEHY

SEQ ID NO: 2932892 - protein, 24 aa, Entamoeba invadens
EIPPDITAAVYKKFLREIPGHIFN

SEQ ID NO: 2932893 - protein, 19 aa, Entamoeba invadens
EIPPRVVIDIFQYEHFACL

SEQ ID NO: 2932894 - protein, 20 aa, Entamoeba invadens
EIPPSVLSIGNFCFLGCNNL

SEQ ID NO: 2932895 - protein, 27 aa, Entamoeba invadens
EIPQLLFMKGGNFSINIHEEILEFNVP

SEQ ID NO: 2932896 - protein, 17 aa, Entamoeba invadens
EIPVMQWQEVQTRLTEE

SEQ ID NO: 2932897 - protein, 18 aa, Entamoeba invadens
EIPYCQVTPLLAQATYVP

SEQ ID NO: 2932898 - protein, 23 aa, Entamoeba invadens
EIPYLINVLLHFNFETARLFEQI

SEQ ID NO: 2932899 - protein, 17 aa, Entamoeba invadens
EIQAHCICIKDMAGLFK

SEQ ID NO: 2932900 - protein, 22 aa, Entamoeba invadens
EIQETLKLVIWYTVDYQSSLKL

SEQ ID NO: 2932901 - protein, 29 aa, Entamoeba invadens
EIQFSLDYFKPHHKAIFINIPVTKYRKGK

SEQ ID NO: 2932902 - protein, 33 aa, Entamoeba invadens
EIQHDLRSLLIMPIQRIPRYVLLLKELKKNTTQ

SEQ ID NO: 2932903 - protein, 20 aa, Entamoeba invadens
EIQNYFAMELFSFYNGQPLT

SEQ ID NO: 2932904 - protein, 24 aa, Entamoeba invadens
EIQPEVLNSFNFLKDYAKNDIEET

SEQ ID NO: 2932905 - protein, 23 aa, Entamoeba invadens
EIQRIKNAIELFEKNHQQVEAKI

SEQ ID NO: 2932906 - protein, 29 aa, Entamoeba invadens
EIQRRFLCNVIDWKIQMDIDISKQLSQFE

SEQ ID NO: 2932907 - protein, 22 aa, Entamoeba invadens
EIQSFAFRGCLSLKDVNLPETI

SEQ ID NO: 2932908 - protein, 21 aa, Entamoeba invadens
EIQVCSSFEIVGVRKENQQKL

SEQ ID NO: 2932909 - protein, 25 aa, Entamoeba invadens
EIRAICCSHGPVLRTHIKENIERYR

SEQ ID NO: 2932910 - protein, 18 aa, Entamoeba invadens
EIRERADLEKKRQTEITE

SEQ ID NO: 2932911 - protein, 25 aa, Entamoeba invadens
EIRHYEPKCRVMLVGTKTDCRNDEA

SEQ ID NO: 2932912 - protein, 21 aa, Entamoeba invadens
EIRKIAEISFRLGDPNLVVFN

SEQ ID NO: 2932913 - protein, 24 aa, Entamoeba invadens
EIRKKPDLLIWAVYNVVRSVDYLH

SEQ ID NO: 2932914 - protein, 31 aa, Entamoeba invadens
EIRLSPVCALECYKLMNLRRLFIFCEAENTL

SEQ ID NO: 2932915 - protein, 18 aa, Entamoeba invadens
EIRLTVLQMLDERFDNFL

SEQ ID NO: 2932916 - protein, 26 aa, Entamoeba invadens
EIRMKNLRYIQSFKHSIVNRYTRIVD

SEQ ID NO: 2932917 - protein, 22 aa, Entamoeba invadens
EIRPRYLCGIMFLHEQGIVHMD

SEQ ID NO: 2932918 - protein, 18 aa, Entamoeba invadens
EIRRYYARHSPEMKKLKQ

SEQ ID NO: 2932919 - protein, 25 aa, Entamoeba invadens
EISDLKTKVSGFVSESSILNAELDK

SEQ ID NO: 2932920 - protein, 17 aa, Entamoeba invadens
EISDTMGYMTFKDDIYC

SEQ ID NO: 2932921 - protein, 23 aa, Entamoeba invadens
EISEIPLHWDLPSLTSVDLSQNN

SEQ ID NO: 2932922 - protein, 26 aa, Entamoeba invadens
EISEYNFGYLIYCEFTSLSIKMEYAE

SEQ ID NO: 2932923 - protein, 27 aa, Entamoeba invadens
EISEYNFGYLIYCEFTSLSIKMEYAEA

SEQ ID NO: 2932924 - protein, 21 aa, Entamoeba invadens
EISFFTVPQFNEWKEEKIHEG

SEQ ID NO: 2932925 - protein, 18 aa, Entamoeba invadens
EISGIVFPAIPTLESDVR

SEQ ID NO: 2932926 - protein, 33 aa, Entamoeba invadens
EISGLHHLYRCQGCGYALCSGCVKKTPPCRCVN

SEQ ID NO: 2932927 - protein, 22 aa, Entamoeba invadens
EISGVLSGSIWGMADSQHKNLL

SEQ ID NO: 2932928 - protein, 19 aa, Entamoeba invadens
EISKIALVVNETIKERERK

SEQ ID NO: 2932929 - protein, 19 aa, Entamoeba invadens
EISKLGVGVHSDFELIDKT

SEQ ID NO: 2932930 - protein, 24 aa, Entamoeba invadens
EISLDYRDLVNLGFTGEYTRMAPL

SEQ ID NO: 2932931 - protein, 24 aa, Entamoeba invadens
EISLMRRLRHKNIVRLLDVYENNE

SEQ ID NO: 2932932 - protein, 19 aa, Entamoeba invadens
EISMPLGVVSNVTKTLQEQ

SEQ ID NO: 2932933 - protein, 24 aa, Entamoeba invadens
EISNLRSTLILGLIEDGKIPDLHA

SEQ ID NO: 2932934 - protein, 17 aa, Entamoeba invadens
EISNYCFCNCIKLKEIN

SEQ ID NO: 2932935 - protein, 20 aa, Entamoeba invadens
EISPLCYEMINTLNSQKAFS

SEQ ID NO: 2932936 - protein, 18 aa, Entamoeba invadens
EISPRLLAEQLYVTDLYL

SEQ ID NO: 2932937 - protein, 22 aa, Entamoeba invadens
EISTALELVEFLLKTQKNITQL

SEQ ID NO: 2932938 - protein, 31 aa, Entamoeba invadens
EISTEGVSLFSFGLCMNEFIDTFMTGDTTHV

SEQ ID NO: 2932939 - protein, 20 aa, Entamoeba invadens
EITCSACIFDQAQQKLKTEI

SEQ ID NO: 2932940 - protein, 20 aa, Entamoeba invadens
EITESIPWFFEHFDSEHFTI

SEQ ID NO: 2932941 - protein, 19 aa, Entamoeba invadens
EITESWNYFDQIWAHSIDA

SEQ ID NO: 2932942 - protein, 17 aa, Entamoeba invadens
EITEYLLSLSNTCAQSN

SEQ ID NO: 2932943 - protein, 21 aa, Entamoeba invadens
EITFCANIVKAAKNAFEDAIS

SEQ ID NO: 2932944 - protein, 20 aa, Entamoeba invadens
EITGLPVLCFEYPGFYPNTT

SEQ ID NO: 2932945 - protein, 23 aa, Entamoeba invadens
EITHLMMEYPFLKGYGMSAIKAY

SEQ ID NO: 2932946 - protein, 24 aa, Entamoeba invadens
EITKDLFDQISWIDGSKFLFQMHF

SEQ ID NO: 2932947 - protein, 20 aa, Entamoeba invadens
EITKKFCVVNNISFVDYYQT

SEQ ID NO: 2932948 - protein, 23 aa, Entamoeba invadens
EITLSHNILCLFDEDSLASGSFV

SEQ ID NO: 2932949 - protein, 17 aa, Entamoeba invadens
EITPEWVSVIKRTREKY

SEQ ID NO: 2932950 - protein, 23 aa, Entamoeba invadens
EITRGRGGAAFSHNHSEQYTFVN

SEQ ID NO: 2932951 - protein, 20 aa, Entamoeba invadens
EITSAMSIVGYEIKRQMSNL

SEQ ID NO: 2932952 - protein, 24 aa, Entamoeba invadens
EITTIRQAQSFSFKVLSPTPITHP

SEQ ID NO: 2932953 - protein, 25 aa, Entamoeba invadens
EITTLCGWLKTTRPSKVIYDSSDKT

SEQ ID NO: 2932954 - protein, 27 aa, Entamoeba invadens
EITTLHFVKNVYRGCSYIYGVEAMKDF

SEQ ID NO: 2932955 - protein, 22 aa, Entamoeba invadens
EIVDRYYFDYGVFNVFSNNKKE

SEQ ID NO: 2932956 - protein, 18 aa, Entamoeba invadens
EIVEIKVVLASHEKPTDI

SEQ ID NO: 2932957 - protein, 23 aa, Entamoeba invadens
EIVESAINWDLFNEYTPDNTVIK

SEQ ID NO: 2932958 - protein, 18 aa, Entamoeba invadens
EIVEVLFSQGILKVLFAT

SEQ ID NO: 2932959 - protein, 19 aa, Entamoeba invadens
EIVFLKNRLAYFHENVQVA

SEQ ID NO: 2932960 - protein, 23 aa, Entamoeba invadens
EIVGSAFALPLSHAVLTQRALDI

SEQ ID NO: 2932961 - protein, 27 aa, Entamoeba invadens
EIVHLLMDIGHRFGWDVETTREENCGF

SEQ ID NO: 2932962 - protein, 24 aa, Entamoeba invadens
EIVIPHFVKEVGWMCFDASLSKIT

SEQ ID NO: 2932963 - protein, 18 aa, Entamoeba invadens
EIVKAWSQYFPFKISVFG

SEQ ID NO: 2932964 - protein, 19 aa, Entamoeba invadens
EIVKCIKSDLEILFSYEVT

SEQ ID NO: 2932965 - protein, 31 aa, Entamoeba invadens
EIVKFLPERIRMVSPEFLFCSSVDGLSLRTL

SEQ ID NO: 2932966 - protein, 32 aa, Entamoeba invadens
EIVKRLNENFLLKSSELLDVIVPAFVQDKFDL

SEQ ID NO: 2932967 - protein, 25 aa, Entamoeba invadens
EIVLESVLLNLAFRNQYESGLWMQT

SEQ ID NO: 2932968 - protein, 26 aa, Entamoeba invadens
EIVLKLKTLFLEEFCLHLPSNAFSVF

SEQ ID NO: 2932969 - protein, 25 aa, Entamoeba invadens
EIVLKVGALLIKMATARMEANPSNC

SEQ ID NO: 2932970 - protein, 19 aa, Entamoeba invadens
EIVLPKLIVFEVVSKSQSL

SEQ ID NO: 2932971 - protein, 18 aa, Entamoeba invadens
EIVLPTTIKIFGDSIFDK

SEQ ID NO: 2932972 - protein, 17 aa, Entamoeba invadens
EIVLSFDGKIRGNLDAL

SEQ ID NO: 2932973 - protein, 21 aa, Entamoeba invadens
EIVNCKPLFPGTSTLNQLDKI

SEQ ID NO: 2932974 - protein, 18 aa, Entamoeba invadens
EIVNCTRGKMTHNLLYPW

SEQ ID NO: 2932975 - protein, 26 aa, Entamoeba invadens
EIVQMLKRILIIYSIIHTNRGYFQGL

SEQ ID NO: 2932976 - protein, 24 aa, Entamoeba invadens
EIVVKRGKQVIVFVHTRRETYLTA

SEQ ID NO: 2932977 - protein, 20 aa, Entamoeba invadens
EIWEKYRLFMNVLGREEFEK

SEQ ID NO: 2932978 - protein, 20 aa, Entamoeba invadens
EIYDKVTFCSDWIFHYFTPE

SEQ ID NO: 2932979 - protein, 22 aa, Entamoeba invadens
EIYEFKIPQILKICNQLISNHY

SEQ ID NO: 2932980 - protein, 19 aa, Entamoeba invadens
EIYKGEITLFVDLHVENCK

SEQ ID NO: 2932981 - protein, 22 aa, Entamoeba invadens
EIYKYNCWEEIFYENIGINTQD

SEQ ID NO: 2932982 - protein, 25 aa, Entamoeba invadens
EIYKYNCWKEIPVEYIGIDKKDGCK

SEQ ID NO: 2932983 - protein, 19 aa, Entamoeba invadens
EIYLCLPTEILQAKVSNAI

SEQ ID NO: 2932984 - protein, 27 aa, Entamoeba invadens
EIYPKKDFQFAWSIADFISAGKRVERD

SEQ ID NO: 2932985 - protein, 19 aa, Entamoeba invadens
EIYTFWRVTIISTFHISRR

SEQ ID NO: 2932986 - protein, 19 aa, Entamoeba invadens
EKAEKILLPQKVEMADGIK

SEQ ID NO: 2932987 - protein, 17 aa, Entamoeba invadens
EKAFEILDEDYQKKLHL

SEQ ID NO: 2932988 - protein, 24 aa, Entamoeba invadens
EKAFKSRFEQMWGVVDATVVELNI

SEQ ID NO: 2932989 - protein, 18 aa, Entamoeba invadens
EKAFLRQTMQLKKQQTRA

SEQ ID NO: 2932990 - protein, 18 aa, Entamoeba invadens
EKAIRFAPQDAEFVQIIN

SEQ ID NO: 2932991 - protein, 22 aa, Entamoeba invadens
EKAKHMLEEVTVLFESAQKKAE

SEQ ID NO: 2932992 - protein, 22 aa, Entamoeba invadens
EKAKRCGFDTSLFDRLLQCPWI

SEQ ID NO: 2932993 - protein, 26 aa, Entamoeba invadens
EKALAALPEILAAKPIEMEKLPDIFG

SEQ ID NO: 2932994 - protein, 24 aa, Entamoeba invadens
EKALKKARLELVQKFDKERKERKD

SEQ ID NO: 2932995 - protein, 25 aa, Entamoeba invadens
EKALYELYAIFLIRKRRDSSFFTYT

SEQ ID NO: 2932996 - protein, 17 aa, Entamoeba invadens
EKAMFKKETENMLKENY

SEQ ID NO: 2932997 - protein, 19 aa, Entamoeba invadens
EKAQLLGLTKATRFLQIQN

SEQ ID NO: 2932998 - protein, 29 aa, Entamoeba invadens
EKATKYVLLKYFYWRYTEPSVMSLHETYK

SEQ ID NO: 2932999 - protein, 26 aa, Entamoeba invadens
EKAVELCLKIGRYADALVMTEGNAEL

SEQ ID NO: 2933000 - protein, 17 aa, Entamoeba invadens
EKAVVLELFHQIKGKPN

SEQ ID NO: 2933001 - protein, 19 aa, Entamoeba invadens
EKAYVYGRMVSMPISPLSF

SEQ ID NO: 2933002 - protein, 19 aa, Entamoeba invadens
EKCDLRDPKFVWGAKYIEY

SEQ ID NO: 2933003 - protein, 19 aa, Entamoeba invadens
EKCFKSCDVIREMVIPQKV

SEQ ID NO: 2933004 - protein, 18 aa, Entamoeba invadens
EKCFYGCTLLYKIELPDS

SEQ ID NO: 2933005 - protein, 24 aa, Entamoeba invadens
EKCGKYLTTCFELLRVKFTAVEDD

SEQ ID NO: 2933006 - protein, 23 aa, Entamoeba invadens
EKCIGCSLCASVCPVNAIQYQSI

SEQ ID NO: 2933007 - protein, 17 aa, Entamoeba invadens
EKCLKCEDNFVLVNDKC

SEQ ID NO: 2933008 - protein, 18 aa, Entamoeba invadens
EKCLLREVMREEFEKIIS

SEQ ID NO: 2933009 - protein, 20 aa, Entamoeba invadens
EKCRALSKYIIDWIQCTKYP

SEQ ID NO: 2933010 - protein, 24 aa, Entamoeba invadens
EKCRMMCKIVRMFDETNIKGFNFK

SEQ ID NO: 2933011 - protein, 26 aa, Entamoeba invadens
EKCSTNFKGWEWFIIEKSPEKKMYTI

SEQ ID NO: 2933012 - protein, 19 aa, Entamoeba invadens
EKCWSDYKSIVVMKNKHKM

SEQ ID NO: 2933013 - protein, 23 aa, Entamoeba invadens
EKCYETFLWIFGKVIQKEETDLI

SEQ ID NO: 2933014 - protein, 27 aa, Entamoeba invadens
EKDAHAEEIWNFVNLFSSLEQENGKEG

SEQ ID NO: 2933015 - protein, 25 aa, Entamoeba invadens
EKDEIDRIIKFGAANIFGKDEGEQK

SEQ ID NO: 2933016 - protein, 26 aa, Entamoeba invadens
EKDGILTFHFECRGVQYGFIVPELCI

SEQ ID NO: 2933017 - protein, 26 aa, Entamoeba invadens
EKDGKIVDKIVCTRCWYTNTETINSF

SEQ ID NO: 2933018 - protein, 25 aa, Entamoeba invadens
EKDHPYVIKCCGGFFASPYNNLEFW

SEQ ID NO: 2933019 - protein, 29 aa, Entamoeba invadens
EKDHTYEVPLWVGLYFKTNKMCKVIIPSW

SEQ ID NO: 2933020 - protein, 24 aa, Entamoeba invadens
EKDILYNIKTCFIGDPSTNDDRKA

SEQ ID NO: 2933021 - protein, 28 aa, Entamoeba invadens
EKDKGVIPYAWECFESMHATLTNEKYYI

SEQ ID NO: 2933022 - protein, 21 aa, Entamoeba invadens
EKDKWQFSEFLSFEDVAIFGT

SEQ ID NO: 2933023 - protein, 25 aa, Entamoeba invadens
EKDLRQFAVKGVLQLFNAISEHQLK

SEQ ID NO: 2933024 - protein, 29 aa, Entamoeba invadens
EKDNDAFIFFGVVCESYFLLNTQIPDLKI

SEQ ID NO: 2933025 - protein, 25 aa, Entamoeba invadens
EKDNPWVRLFEQCKTDLAAAETAKT

SEQ ID NO: 2933026 - protein, 18 aa, Entamoeba invadens
EKDPKIAVAKLITLLYKP

SEQ ID NO: 2933027 - protein, 20 aa, Entamoeba invadens
EKDVECSLKKARFVEEIVMD

SEQ ID NO: 2933028 - protein, 22 aa, Entamoeba invadens
EKDVKSFGVLENFRVVTDSFLG

SEQ ID NO: 2933029 - protein, 21 aa, Entamoeba invadens
EKDVLKRAYILLKTDDGDVNS

SEQ ID NO: 2933030 - protein, 23 aa, Entamoeba invadens
EKDVLRKGFFINKILVKRIKDNA

SEQ ID NO: 2933031 - protein, 21 aa, Entamoeba invadens
EKEAIHWVDVFYKENTDHFLY

SEQ ID NO: 2933032 - protein, 18 aa, Entamoeba invadens
EKEALLPKLKWKTDEVDL

SEQ ID NO: 2933033 - protein, 21 aa, Entamoeba invadens
EKEARINFWTLQEVVVELMKS

SEQ ID NO: 2933034 - protein, 19 aa, Entamoeba invadens
EKEAYRLPDYIEATGVGQL

SEQ ID NO: 2933035 - protein, 31 aa, Entamoeba invadens
EKEDNIMKCPSRKNVPLPKGRKRMTKNNKQI

SEQ ID NO: 2933036 - protein, 24 aa, Entamoeba invadens
EKEEGKMLECWLKEVKRYTEDIPR

SEQ ID NO: 2933037 - protein, 36 aa, Entamoeba invadens
EKEEITRLEIPMAMFHFGGTFTHIIGEKPVEMTIEA

SEQ ID NO: 2933038 - protein, 27 aa, Entamoeba invadens
EKEEVKGLFWIWGDLWRRVYSALLDYD

SEQ ID NO: 2933039 - protein, 23 aa, Entamoeba invadens
EKEFEGMCLNFAIGDINEESVSR

SEQ ID NO: 2933040 - protein, 24 aa, Entamoeba invadens
EKEFQRFQLGLIVSPIYYIENSPM

SEQ ID NO: 2933041 - protein, 18 aa, Entamoeba invadens
EKEIAYSQPVYDGFEAQF

SEQ ID NO: 2933042 - protein, 18 aa, Entamoeba invadens
EKEIFAAMPQLGFDLNNM

SEQ ID NO: 2933043 - protein, 20 aa, Entamoeba invadens
EKEIGCLELTTNQRKILLGK

SEQ ID NO: 2933044 - protein, 18 aa, Entamoeba invadens
EKEILVKTNHEFARYITH

SEQ ID NO: 2933045 - protein, 25 aa, Entamoeba invadens
EKEIYKFEVSYTFYLQMKNIHINCE

SEQ ID NO: 2933046 - protein, 26 aa, Entamoeba invadens
EKEIYKFEVSYTFYLQMKNIPIYCEN

SEQ ID NO: 2933047 - protein, 24 aa, Entamoeba invadens
EKEKEMRVIESLAHLDNEGVKNLT

SEQ ID NO: 2933048 - protein, 24 aa, Entamoeba invadens
EKEKEVLRGQLIEKESQYIQTTKQ

SEQ ID NO: 2933049 - protein, 25 aa, Entamoeba invadens
EKEKFLNIRIDNMVNAYKGLELVNR

SEQ ID NO: 2933050 - protein, 23 aa, Entamoeba invadens
EKEKKSSKKYCVFLEDDEGRVCS

SEQ ID NO: 2933051 - protein, 24 aa, Entamoeba invadens
EKEKLKLFAVFTVGKLEKAVMKGD

SEQ ID NO: 2933052 - protein, 33 aa, Entamoeba invadens
EKEKMGIPFLLRCCSDCANALMYLSSHNIIHRN

SEQ ID NO: 2933053 - protein, 21 aa, Entamoeba invadens
EKEKNRIASELNDSKSQNERL

SEQ ID NO: 2933054 - protein, 24 aa, Entamoeba invadens
EKEKSGWGFSSLVNKMNTSINEIT

SEQ ID NO: 2933055 - protein, 18 aa, Entamoeba invadens
EKEKVAALAKSEYERDFA

SEQ ID NO: 2933056 - protein, 18 aa, Entamoeba invadens
EKELEVVKCKQKNVEQLN

SEQ ID NO: 2933057 - protein, 18 aa, Entamoeba invadens
EKELMPIVEINIVALKKL

SEQ ID NO: 2933058 - protein, 24 aa, Entamoeba invadens
EKEMKEWVCVLCGEENKLFQVGTP

SEQ ID NO: 2933059 - protein, 17 aa, Entamoeba invadens
EKEMKMVDGYGVKGQSH

SEQ ID NO: 2933060 - protein, 26 aa, Entamoeba invadens
EKENCAAMFLPFVVQFLEKFDNFADW

SEQ ID NO: 2933061 - protein, 25 aa, Entamoeba invadens
EKENKECLWMVLSTEESRTVFLSAI

SEQ ID NO: 2933062 - protein, 20 aa, Entamoeba invadens
EKEPVGWSSIQIEKLGKMAK

SEQ ID NO: 2933063 - protein, 25 aa, Entamoeba invadens
EKEQILKWSGRSVGDLIFTYKNNLK

SEQ ID NO: 2933064 - protein, 19 aa, Entamoeba invadens
EKERMKALQVAEEKAKAEA

SEQ ID NO: 2933065 - protein, 23 aa, Entamoeba invadens
EKERVTNMMCEWISSDKKSEFKA

SEQ ID NO: 2933066 - protein, 21 aa, Entamoeba invadens
EKESECVMFITMTVSSSVMLK

SEQ ID NO: 2933067 - protein, 23 aa, Entamoeba invadens
EKESRSFGRLAIFACDNNFQNEN

SEQ ID NO: 2933068 - protein, 21 aa, Entamoeba invadens
EKESWVLAAKEGLFCCELWDT

SEQ ID NO: 2933069 - protein, 20 aa, Entamoeba invadens
EKETEYKKLFTIIEVPSSVT

SEQ ID NO: 2933070 - protein, 24 aa, Entamoeba invadens
EKETKEFYDWLSLNQNSSVIKQLQ

SEQ ID NO: 2933071 - protein, 18 aa, Entamoeba invadens
EKETLEMERKEMMKEMNS

SEQ ID NO: 2933072 - protein, 17 aa, Entamoeba invadens
EKEVAMLDKFRCDYIVH

SEQ ID NO: 2933073 - protein, 21 aa, Entamoeba invadens
EKEVMLGPHFKNFSKENSDKT

SEQ ID NO: 2933074 - protein, 21 aa, Entamoeba invadens
EKEVTYSPMFGKGNIFYKVKL

SEQ ID NO: 2933075 - protein, 19 aa, Entamoeba invadens
EKFAMKILLVLDLSEKKSK

SEQ ID NO: 2933076 - protein, 17 aa, Entamoeba invadens
EKFELTDKPWVNTVPTM

SEQ ID NO: 2933077 - protein, 19 aa, Entamoeba invadens
EKFETIKHVVMGGAVVPDA

SEQ ID NO: 2933078 - protein, 17 aa, Entamoeba invadens
EKFFKYFIQIGVLEKLK

SEQ ID NO: 2933079 - protein, 20 aa, Entamoeba invadens
EKFGCLCCGDEHQCSPDCRC

SEQ ID NO: 2933080 - protein, 20 aa, Entamoeba invadens
EKFGGDGFAIFTGEDESGRW

SEQ ID NO: 2933081 - protein, 25 aa, Entamoeba invadens
EKFGKECFCKCRVSSIAFSQNVNEI

SEQ ID NO: 2933082 - protein, 28 aa, Entamoeba invadens
EKFKGCLRCGDGYYIFNSLCVKCEYPCT

SEQ ID NO: 2933083 - protein, 21 aa, Entamoeba invadens
EKFKIGTEVDRSFVELLCESI

SEQ ID NO: 2933084 - protein, 18 aa, Entamoeba invadens
EKFKLPVGIQELDIDTSS

SEQ ID NO: 2933085 - protein, 17 aa, Entamoeba invadens
EKFNGTKTWSAFTVADF

SEQ ID NO: 2933086 - protein, 26 aa, Entamoeba invadens
EKFPERIPFRLTRMIVNAMDVSGIEG

SEQ ID NO: 2933087 - protein, 19 aa, Entamoeba invadens
EKFPLLTQINCRLSNLPVK

SEQ ID NO: 2933088 - protein, 22 aa, Entamoeba invadens
EKFPRMGDALVSFGPCQTPTLG

SEQ ID NO: 2933089 - protein, 24 aa, Entamoeba invadens
EKFRKVKLYEMLLWANGEKDRCVN

SEQ ID NO: 2933090 - protein, 32 aa, Entamoeba invadens
EKFSNVQMMACLKCEFSEFIELQGQIIHVLPK

SEQ ID NO: 2933091 - protein, 17 aa, Entamoeba invadens
EKFTILGEKSFSECKLK

SEQ ID NO: 2933092 - protein, 25 aa, Entamoeba invadens
EKFVFELFTRIQLIDEVIYNISRKD

SEQ ID NO: 2933093 - protein, 17 aa, Entamoeba invadens
EKFVFKKGEKTSVNDFE

SEQ ID NO: 2933094 - protein, 17 aa, Entamoeba invadens
EKFYIYFTDCEVGEDLL

SEQ ID NO: 2933095 - protein, 19 aa, Entamoeba invadens
EKGAKEFFKIAPEAIKQGL

SEQ ID NO: 2933096 - protein, 22 aa, Entamoeba invadens
EKGDGKSIIWAILKQQAGWVGT

SEQ ID NO: 2933097 - protein, 20 aa, Entamoeba invadens
EKGEAAIVTIEFLNTLCPSG

SEQ ID NO: 2933098 - protein, 22 aa, Entamoeba invadens
EKGEKKLKCEKSEFGTTNECLE

SEQ ID NO: 2933099 - protein, 19 aa, Entamoeba invadens
EKGELMSRVEGVEGVKRIW

SEQ ID NO: 2933100 - protein, 20 aa, Entamoeba invadens
EKGELMSVCDQIEHAISSQA

SEQ ID NO: 2933101 - protein, 23 aa, Entamoeba invadens
EKGEYQWAITMLNNVVFKNPQNS

SEQ ID NO: 2933102 - protein, 25 aa, Entamoeba invadens
EKGIDLRLSPIRVRPKSPKSVVLLS

SEQ ID NO: 2933103 - protein, 17 aa, Entamoeba invadens
EKGIIRVEQYASFGSLL

SEQ ID NO: 2933104 - protein, 19 aa, Entamoeba invadens
EKGIVELLCKLYENSVDSP

SEQ ID NO: 2933105 - protein, 25 aa, Entamoeba invadens
EKGIWWDGNPCLWTLDNVEGPCRMR

SEQ ID NO: 2933106 - protein, 26 aa, Entamoeba invadens
EKGKEGQLTMFFPVDVDFDGWLADLR

SEQ ID NO: 2933107 - protein, 17 aa, Entamoeba invadens
EKGKYLLSFNKDANTEI

SEQ ID NO: 2933108 - protein, 23 aa, Entamoeba invadens
EKGMTPDSFPLVFQRELISPQPI

SEQ ID NO: 2933109 - protein, 25 aa, Entamoeba invadens
EKGNETFKIVIQIGRNSEKQRVMSL

SEQ ID NO: 2933110 - protein, 32 aa, Entamoeba invadens
EKGPGVGFWGPMWRVWVFLLRGIIPILERWLG

SEQ ID NO: 2933111 - protein, 18 aa, Entamoeba invadens
EKGPKVKAEIEVKEKKQK

SEQ ID NO: 2933112 - protein, 24 aa, Entamoeba invadens
EKGQWKMSKFVSMSPRVEVVGNKI

SEQ ID NO: 2933113 - protein, 28 aa, Entamoeba invadens
EKGREQTLRFKIRIMSNVYTQSKNVHKL

SEQ ID NO: 2933114 - protein, 21 aa, Entamoeba invadens
EKGVHSMKQFIARQTVSVTQR

SEQ ID NO: 2933115 - protein, 24 aa, Entamoeba invadens
EKGYALNCQLTFQFDKNDIIDEGA

SEQ ID NO: 2933116 - protein, 32 aa, Entamoeba invadens
EKHAFSLGNVVCFGCASLLENYYAFLVYSIDE

SEQ ID NO: 2933117 - protein, 23 aa, Entamoeba invadens
EKHILRSDVLVLVYSITDRQSYS

SEQ ID NO: 2933118 - protein, 23 aa, Entamoeba invadens
EKHKEKRLEGIPNVEISQECSFK

SEQ ID NO: 2933119 - protein, 24 aa, Entamoeba invadens
EKHLECVKRLASLGIGEHEKEKIG

SEQ ID NO: 2933120 - protein, 21 aa, Entamoeba invadens
EKHSGEVLSIIFLSETLACSS

SEQ ID NO: 2933121 - protein, 23 aa, Entamoeba invadens
EKHVVSFSFQLARSLTYIHSLGI

SEQ ID NO: 2933122 - protein, 18 aa, Entamoeba invadens
EKHWLYPENCVVDCNVPY

SEQ ID NO: 2933123 - protein, 24 aa, Entamoeba invadens
EKHYLRLVKVITPDSVRPLDVLQK

SEQ ID NO: 2933124 - protein, 23 aa, Entamoeba invadens
EKIEGFEGMVALLKTQLEKSKVD

SEQ ID NO: 2933125 - protein, 28 aa, Entamoeba invadens
EKIEIPESVISLGDNCFKHCEDLEEVIL

SEQ ID NO: 2933126 - protein, 18 aa, Entamoeba invadens
EKIELWVCDVIEQDDYMN

SEQ ID NO: 2933127 - protein, 23 aa, Entamoeba invadens
EKIERLRLYNCKDITEVKMKNCE

SEQ ID NO: 2933128 - protein, 18 aa, Entamoeba invadens
EKIESVKFDFKFDPNCET

SEQ ID NO: 2933129 - protein, 28 aa, Entamoeba invadens
EKIFNELFFTYTICQNVNDPFMLMFDDD

SEQ ID NO: 2933130 - protein, 17 aa, Entamoeba invadens
EKIGCAVNRGIVVDERM

SEQ ID NO: 2933131 - protein, 19 aa, Entamoeba invadens
EKIGECLANLYVVRFDEDH

SEQ ID NO: 2933132 - protein, 29 aa, Entamoeba invadens
EKIIDEFKKAAAVQIVMLGGEYIGNKRKR

SEQ ID NO: 2933133 - protein, 24 aa, Entamoeba invadens
EKIIKEKQEALAKRKAEAEKKRAE

SEQ ID NO: 2933134 - protein, 21 aa, Entamoeba invadens
EKIIKEREDELNVSTQRIEEI

SEQ ID NO: 2933135 - protein, 26 aa, Entamoeba invadens
EKIIQPPWYVCVVCRRQFDTEEMLRL

SEQ ID NO: 2933136 - protein, 19 aa, Entamoeba invadens
EKIKEFLGLIPKEKLSVAA

SEQ ID NO: 2933137 - protein, 19 aa, Entamoeba invadens
EKIKESDLIEGMKEDRSKD

SEQ ID NO: 2933138 - protein, 21 aa, Entamoeba invadens
EKIKKLFSVLQTFYLVFDEIN

SEQ ID NO: 2933139 - protein, 21 aa, Entamoeba invadens
EKIKQFGFYVDGIRAAVMSGA

SEQ ID NO: 2933140 - protein, 24 aa, Entamoeba invadens
EKIKSPLFKNEIDKLFNGDGNLIS

SEQ ID NO: 2933141 - protein, 23 aa, Entamoeba invadens
EKILFRDLNFALTMESRVALVGR

SEQ ID NO: 2933142 - protein, 22 aa, Entamoeba invadens
EKILYKELRDMYNIRPVLDECA

SEQ ID NO: 2933143 - protein, 20 aa, Entamoeba invadens
EKIMEWTKGYIWRLTNKFNI

SEQ ID NO: 2933144 - protein, 18 aa, Entamoeba invadens
EKIMSVMSDEMWMKKREQ

SEQ ID NO: 2933145 - protein, 22 aa, Entamoeba invadens
EKIPENCCRVVKLSNTKYSVNT

SEQ ID NO: 2933146 - protein, 19 aa, Entamoeba invadens
EKIPMCIGISKISIDQPAI

SEQ ID NO: 2933147 - protein, 17 aa, Entamoeba invadens
EKIRLSADCNFIMVITN

SEQ ID NO: 2933148 - protein, 25 aa, Entamoeba invadens
EKIRWDIGTTIPLSVSVNMTSEEKS

SEQ ID NO: 2933149 - protein, 24 aa, Entamoeba invadens
EKIRWKKDVKFPVRHVVISGNGDT

SEQ ID NO: 2933150 - protein, 24 aa, Entamoeba invadens
EKITSICDYCFKNYNFLEEIVLSD

SEQ ID NO: 2933151 - protein, 18 aa, Entamoeba invadens
EKIVIFAYHVDVITGLTQ

SEQ ID NO: 2933152 - protein, 18 aa, Entamoeba invadens
EKIYKRTVMVSGSSEYRI

SEQ ID NO: 2933153 - protein, 18 aa, Entamoeba invadens
EKIYLARVVGEFPETLVV

SEQ ID NO: 2933154 - protein, 20 aa, Entamoeba invadens
EKKARKALEKVGLVEVLNVI

SEQ ID NO: 2933155 - protein, 22 aa, Entamoeba invadens
EKKEIFDIVDFMLIITKMIENY

SEQ ID NO: 2933156 - protein, 30 aa, Entamoeba invadens
EKKELKKRVTAICRFNLFVVVGLADGKAKF

SEQ ID NO: 2933157 - protein, 25 aa, Entamoeba invadens
EKKELRYDMEIARWSERFRALKSQW

SEQ ID NO: 2933158 - protein, 22 aa, Entamoeba invadens
EKKFDPFSMFKGWKEKLEAHPK

SEQ ID NO: 2933159 - protein, 26 aa, Entamoeba invadens
EKKFIRLLCVLYRLMDIDQEYFILAH

SEQ ID NO: 2933160 - protein, 25 aa, Entamoeba invadens
EKKFYEFLNCVGHVIGDGKNKIEES

SEQ ID NO: 2933161 - protein, 23 aa, Entamoeba invadens
EKKFYRIIVWFNVEFGTVDRNKQ

SEQ ID NO: 2933162 - protein, 22 aa, Entamoeba invadens
EKKGLKYVMKVTHIEIYNEKVF

SEQ ID NO: 2933163 - protein, 21 aa, Entamoeba invadens
EKKHFNICHFVKYTKTDREKC

SEQ ID NO: 2933164 - protein, 25 aa, Entamoeba invadens
EKKIKKVFMPPPMTKKDSKIEKPVY

SEQ ID NO: 2933165 - protein, 26 aa, Entamoeba invadens
EKKIKLKPLRLCKNGDPDLVTCARLV

SEQ ID NO: 2933166 - protein, 30 aa, Entamoeba invadens
EKKISGPILELIKKFIFRMMGEKDEIIIAF

SEQ ID NO: 2933167 - protein, 21 aa, Entamoeba invadens
EKKKAELIAGMNDVFNAVMIK

SEQ ID NO: 2933168 - protein, 22 aa, Entamoeba invadens
EKKKGGGFMSLFKKKKEEEEIM

SEQ ID NO: 2933169 - protein, 21 aa, Entamoeba invadens
EKKKIFEYMGSVNISERSAAT

SEQ ID NO: 2933170 - protein, 17 aa, Entamoeba invadens
EKKKILDAIFYKIHDTF

SEQ ID NO: 2933171 - protein, 22 aa, Entamoeba invadens
EKKKIVFPKIHMKINEIETVMT

SEQ ID NO: 2933172 - protein, 24 aa, Entamoeba invadens
EKKKKVVIYKLCLPDSGEKIKEED

SEQ ID NO: 2933173 - protein, 31 aa, Entamoeba invadens
EKKKLDPFLPIFLELFFDVSFVVFNDKTKSK

SEQ ID NO: 2933174 - protein, 24 aa, Entamoeba invadens
EKKKNSGGLLGFLKKEEKKEEKKE

SEQ ID NO: 2933175 - protein, 22 aa, Entamoeba invadens
EKKKRLIEYVHMYYVDPTTDKP

SEQ ID NO: 2933176 - protein, 23 aa, Entamoeba invadens
EKKKTVKMWKRKIQELIASEKEH

SEQ ID NO: 2933177 - protein, 21 aa, Entamoeba invadens
EKKKYRLLDPSGFDLKTGNSK

SEQ ID NO: 2933178 - protein, 20 aa, Entamoeba invadens
EKKLGEGLFGIVYKVTYRGN

SEQ ID NO: 2933179 - protein, 19 aa, Entamoeba invadens
EKKLNLAPGSLRFESQKYI

SEQ ID NO: 2933180 - protein, 22 aa, Entamoeba invadens
EKKLRNVVLFLVSKYREKYGFK

SEQ ID NO: 2933181 - protein, 23 aa, Entamoeba invadens
EKKLSCFNAKFNLINVNPPELVN

SEQ ID NO: 2933182 - protein, 24 aa, Entamoeba invadens
EKKLSESLLLPPFNSLMVQNGSEN

SEQ ID NO: 2933183 - protein, 20 aa, Entamoeba invadens
EKKMFWQFANCFKNAPKEIV

SEQ ID NO: 2933184 - protein, 22 aa, Entamoeba invadens
EKKMKRYAFKVFKREDKDHSTV

SEQ ID NO: 2933185 - protein, 25 aa, Entamoeba invadens
EKKMSEEKLEILDAEIKRKESELVE

SEQ ID NO: 2933186 - protein, 19 aa, Entamoeba invadens
EKKMVGPFLKDLGTKEFET

SEQ ID NO: 2933187 - protein, 31 aa, Entamoeba invadens
EKKMVIDFTGPFKRLSYVDALEEKFGEKIPR

SEQ ID NO: 2933188 - protein, 23 aa, Entamoeba invadens
EKKPGWPDRVIFKTIKRHYVEVL

SEQ ID NO: 2933189 - protein, 23 aa, Entamoeba invadens
EKKQCGVCKKHLINTIFSCGHAC

SEQ ID NO: 2933190 - protein, 17 aa, Entamoeba invadens
EKKQWIFHDKEQEKKFM

SEQ ID NO: 2933191 - protein, 24 aa, Entamoeba invadens
EKKQWVVKAKSIWENIQRNKEEKW

SEQ ID NO: 2933192 - protein, 24 aa, Entamoeba invadens
EKKREPFMCPALYLISPSQESVDK

SEQ ID NO: 2933193 - protein, 22 aa, Entamoeba invadens
EKKRFIELWFCGDDPLKLIQFK

SEQ ID NO: 2933194 - protein, 23 aa, Entamoeba invadens
EKKRKFFGVFYFYKMAEVDIEDV

SEQ ID NO: 2933195 - protein, 25 aa, Entamoeba invadens
EKKRMKAKGGIVFNGRVYGSMQVSR

SEQ ID NO: 2933196 - protein, 21 aa, Entamoeba invadens
EKKRMPVVFDITKYMGQLKFD

SEQ ID NO: 2933197 - protein, 23 aa, Entamoeba invadens
EKKRRKYYKLAISESPFLLTSGG

SEQ ID NO: 2933198 - protein, 24 aa, Entamoeba invadens
EKKRVHIVWFVLNSVSGRLQPFEE

SEQ ID NO: 2933199 - protein, 27 aa, Entamoeba invadens
EKKRYENSRGWFGFGYQIPQLDEKTIK

SEQ ID NO: 2933200 - protein, 25 aa, Entamoeba invadens
EKKSKGEVFTMVFIGVNGVGKSTSL

SEQ ID NO: 2933201 - protein, 26 aa, Entamoeba invadens
EKKSKKEKKGCDEWWMKEMKKHSKGY

SEQ ID NO: 2933202 - protein, 18 aa, Entamoeba invadens
EKKVDCINSVCGVGISLN

SEQ ID NO: 2933203 - protein, 19 aa, Entamoeba invadens
EKKVEEKVVKKEEPKAKEH

SEQ ID NO: 2933204 - protein, 24 aa, Entamoeba invadens
EKKVFYQIVVWFGVGVDVVNRTIS

SEQ ID NO: 2933205 - protein, 20 aa, Entamoeba invadens
EKKWTVMLDEWVKTSKTPRY

SEQ ID NO: 2933206 - protein, 27 aa, Entamoeba invadens
EKKYFVKLLVCFYELKGKRESEVSEIE

SEQ ID NO: 2933207 - protein, 20 aa, Entamoeba invadens
EKKYRAETQLIKGKYEKDIA

SEQ ID NO: 2933208 - protein, 21 aa, Entamoeba invadens
EKLAEMLLRRTTFGGVTMLQN

SEQ ID NO: 2933209 - protein, 26 aa, Entamoeba invadens
EKLAFSSRLTWVGDLCFKDCSSLSIL

SEQ ID NO: 2933210 - protein, 21 aa, Entamoeba invadens
EKLAPFIPKIFEGVFVTLNTN

SEQ ID NO: 2933211 - protein, 23 aa, Entamoeba invadens
EKLARPPIKVCHVKAQPLSVSKM

SEQ ID NO: 2933212 - protein, 27 aa, Entamoeba invadens
EKLAYVKQTKCFVCGKTGHTKSNCPEV

SEQ ID NO: 2933213 - protein, 21 aa, Entamoeba invadens
EKLDEVLAVLDLAKTGKSKVS

SEQ ID NO: 2933214 - protein, 21 aa, Entamoeba invadens
EKLEGTCFLFYSLTNGEVDQN

SEQ ID NO: 2933215 - protein, 18 aa, Entamoeba invadens
EKLEKKDKSLAHVKKMME

SEQ ID NO: 2933216 - protein, 17 aa, Entamoeba invadens
EKLELERNLQLLSQEKE

SEQ ID NO: 2933217 - protein, 19 aa, Entamoeba invadens
EKLELGIVVNLEIYNTRVT

SEQ ID NO: 2933218 - protein, 21 aa, Entamoeba invadens
EKLERMRAFLDKYVVFVHKHV

SEQ ID NO: 2933219 - protein, 25 aa, Entamoeba invadens
EKLFDCVKDLSIYSNYCIFYERVVN

SEQ ID NO: 2933220 - protein, 20 aa, Entamoeba invadens
EKLFECCSLSSEYKKSDILE

SEQ ID NO: 2933221 - protein, 21 aa, Entamoeba invadens
EKLFKKCDLLTSEVESLLNVR

SEQ ID NO: 2933222 - protein, 38 aa, Entamoeba invadens
EKLFKTSEFILKMKKILYSLGVAFEFFDLKYSDLPKVL

SEQ ID NO: 2933223 - protein, 36 aa, Entamoeba invadens
EKLGFFTKWCELCGAQICKKCSLVGEIYDTRSKSFV

SEQ ID NO: 2933224 - protein, 23 aa, Entamoeba invadens
EKLHLKGYIPLAFGTITRSPEMK

SEQ ID NO: 2933225 - protein, 20 aa, Entamoeba invadens
EKLILFKTFLVDVFAVVITK

SEQ ID NO: 2933226 - protein, 18 aa, Entamoeba invadens
EKLILGIHYYLYKNTTNY

SEQ ID NO: 2933227 - protein, 26 aa, Entamoeba invadens
EKLIQTWAALCSKINASVQTYIDSTS

SEQ ID NO: 2933228 - protein, 31 aa, Entamoeba invadens
EKLIRLCCAVLRRAKANIPDILYLIEKGEDH

SEQ ID NO: 2933229 - protein, 29 aa, Entamoeba invadens
EKLISGIYLGWLSRLVIRELMQKKVCFER

SEQ ID NO: 2933230 - protein, 22 aa, Entamoeba invadens
EKLKEKKGIFVRSRAQSTKQQQ

SEQ ID NO: 2933231 - protein, 17 aa, Entamoeba invadens
EKLKIAKLAEEKAKAEA

SEQ ID NO: 2933232 - protein, 26 aa, Entamoeba invadens
EKLKIKFSELVSVYYLLESPILPLQI

SEQ ID NO: 2933233 - protein, 19 aa, Entamoeba invadens
EKLKKKKEENWEEEKREKV

SEQ ID NO: 2933234 - protein, 19 aa, Entamoeba invadens
EKLKLFSREYIFVEERFNF

SEQ ID NO: 2933235 - protein, 17 aa, Entamoeba invadens
EKLKNALATNAKINKDK

SEQ ID NO: 2933236 - protein, 28 aa, Entamoeba invadens
EKLKNLFDPFGVVLKFYVIENGGKKTWI

SEQ ID NO: 2933237 - protein, 21 aa, Entamoeba invadens
EKLKSIIKRLSLIEKGVNEVK

SEQ ID NO: 2933238 - protein, 24 aa, Entamoeba invadens
EKLLEYRKLLTILLNYGTGAAPSI

SEQ ID NO: 2933239 - protein, 21 aa, Entamoeba invadens
EKLLIPFCGLYQVYEVSDDIL

SEQ ID NO: 2933240 - protein, 20 aa, Entamoeba invadens
EKLLRLNELVQIFNSQAEVL

SEQ ID NO: 2933241 - protein, 20 aa, Entamoeba invadens
EKLLRVGYSSIYVVDSKTKK

SEQ ID NO: 2933242 - protein, 22 aa, Entamoeba invadens
EKLLSIPRFCFSYCSNLKTITF

SEQ ID NO: 2933243 - protein, 17 aa, Entamoeba invadens
EKLMEGIRVWYETNENE

SEQ ID NO: 2933244 - protein, 17 aa, Entamoeba invadens
EKLNIFLQRHHDLTVLF

SEQ ID NO: 2933245 - protein, 23 aa, Entamoeba invadens
EKLPKTTFVNMNWEVKNTIICFI

SEQ ID NO: 2933246 - protein, 18 aa, Entamoeba invadens
EKLRCIGERTLLTNLECS

SEQ ID NO: 2933247 - protein, 27 aa, Entamoeba invadens
EKLSGKPLHQFLRRGFYYSEIDFEEVI

SEQ ID NO: 2933248 - protein, 24 aa, Entamoeba invadens
EKLSHFLKTYCSYINSTDAINEHE

SEQ ID NO: 2933249 - protein, 25 aa, Entamoeba invadens
EKLSKLPPNVCVYISYLSDTILDSL

SEQ ID NO: 2933250 - protein, 22 aa, Entamoeba invadens
EKLTLVLCGNKSDLEHMREVTT

SEQ ID NO: 2933251 - protein, 23 aa, Entamoeba invadens
EKLVVKSCELLEEIVIGENTQSV

SEQ ID NO: 2933252 - protein, 24 aa, Entamoeba invadens
EKLVVKSCELLEEIVIGENTQSVH

SEQ ID NO: 2933253 - protein, 24 aa, Entamoeba invadens
EKLVVKSCELLEEIVLGENTQRVH

SEQ ID NO: 2933254 - protein, 38 aa, Entamoeba invadens
EKLWRTCQFVIKMEKILYSLGVAFEFFDLKYSELPKVL

SEQ ID NO: 2933255 - protein, 24 aa, Entamoeba invadens
EKLYEMPKELSFPKVDPYAVKEPK

SEQ ID NO: 2933256 - protein, 22 aa, Entamoeba invadens
EKLYENIQMCWAQEKANRASID

SEQ ID NO: 2933257 - protein, 26 aa, Entamoeba invadens
EKMETVCTWEIGKLIHRIEYVAPKYF

SEQ ID NO: 2933258 - protein, 19 aa, Entamoeba invadens
EKMFFDFSKNLKMLFTARI

SEQ ID NO: 2933259 - protein, 24 aa, Entamoeba invadens
EKMGKLDHTTICLVKVGDIEKQMI

SEQ ID NO: 2933260 - protein, 17 aa, Entamoeba invadens
EKMGLDIPEEFCDTIMG

SEQ ID NO: 2933261 - protein, 22 aa, Entamoeba invadens
EKMIKEKIAMMQNLQNVQVNEQ

SEQ ID NO: 2933262 - protein, 32 aa, Entamoeba invadens
EKMITWPKRVTFFLQLLLLRKINMVLVNHNVN

SEQ ID NO: 2933263 - protein, 23 aa, Entamoeba invadens
EKMKCGFCELELGYYIDGNDCNK

SEQ ID NO: 2933264 - protein, 36 aa, Entamoeba invadens
EKMKEDKIVLENELNFAKDKAHKIAKELVATKEENT

SEQ ID NO: 2933265 - protein, 24 aa, Entamoeba invadens
EKMKFPAIVYKMVLEPGRPSEIRS

SEQ ID NO: 2933266 - protein, 25 aa, Entamoeba invadens
EKMKKWLTHPALCNKNIEGCKLEFI

SEQ ID NO: 2933267 - protein, 18 aa, Entamoeba invadens
EKMLDVFGLENKKVSGSS

SEQ ID NO: 2933268 - protein, 24 aa, Entamoeba invadens
EKMLERVSSEFGRLKQFSTSMSEM

SEQ ID NO: 2933269 - protein, 17 aa, Entamoeba invadens
EKMLKEDLNSFVAVVDW

SEQ ID NO: 2933270 - protein, 26 aa, Entamoeba invadens
EKMLPLPDKTLFGFCDGKTEYLCSPK

SEQ ID NO: 2933271 - protein, 22 aa, Entamoeba invadens
EKMLYESGCYLVSFNLPTPSTR

SEQ ID NO: 2933272 - protein, 19 aa, Entamoeba invadens
EKMLYIGNYCFNNCSNLKE

SEQ ID NO: 2933273 - protein, 21 aa, Entamoeba invadens
EKMMCRCIPNSFGCSEESTCV

SEQ ID NO: 2933274 - protein, 22 aa, Entamoeba invadens
EKMMYPSIMILRGEFELSSEIP

SEQ ID NO: 2933275 - protein, 23 aa, Entamoeba invadens
EKMMYPSIMILRGEFELSSEIPN

SEQ ID NO: 2933276 - protein, 25 aa, Entamoeba invadens
EKMPIPLYDVIKMCWVQEQTNRITI

SEQ ID NO: 2933277 - protein, 28 aa, Entamoeba invadens
EKMPTMSILCGEILHLEDRLSCQKTESI

SEQ ID NO: 2933278 - protein, 18 aa, Entamoeba invadens
EKMQWERVEEIIQSAKEN

SEQ ID NO: 2933279 - protein, 19 aa, Entamoeba invadens
EKMRIYLNVTNDFNEEESL

SEQ ID NO: 2933280 - protein, 23 aa, Entamoeba invadens
EKMTIDTFINVVNWYISPSEVEW

SEQ ID NO: 2933281 - protein, 21 aa, Entamoeba invadens
EKMVRGVVFVHVIKSVIALLS

SEQ ID NO: 2933282 - protein, 23 aa, Entamoeba invadens
EKMVWWCGRLFQSEFEMLMKSIA

SEQ ID NO: 2933283 - protein, 19 aa, Entamoeba invadens
EKMWKCFENAGDMSDDYKE

SEQ ID NO: 2933284 - protein, 23 aa, Entamoeba invadens
EKNCFKGKVLLYYFETLSLKIEK

SEQ ID NO: 2933285 - protein, 18 aa, Entamoeba invadens
EKNCSIYPPVDFKEFRSL

SEQ ID NO: 2933286 - protein, 27 aa, Entamoeba invadens
EKNDAFKCPVCGLYFKELKRHTEWHTR

SEQ ID NO: 2933287 - protein, 24 aa, Entamoeba invadens
EKNEKDKQIEFGNKERIELQSSIE

SEQ ID NO: 2933288 - protein, 25 aa, Entamoeba invadens
EKNFRFSKILCFARNTITTSDSKEL

SEQ ID NO: 2933289 - protein, 28 aa, Entamoeba invadens
EKNFVFTMFSAFWLKSDGKLAFHAMWKD

SEQ ID NO: 2933290 - protein, 24 aa, Entamoeba invadens
EKNFVVTCFCAFWVTSDGKIYVHH

SEQ ID NO: 2933291 - protein, 25 aa, Entamoeba invadens
EKNGRPLFSLLMSSLMKLFSEIAEF

SEQ ID NO: 2933292 - protein, 19 aa, Entamoeba invadens
EKNIFGCVVTKSIESEDIT

SEQ ID NO: 2933293 - protein, 21 aa, Entamoeba invadens
EKNKAFKLFNWKEDVNEVQFE

SEQ ID NO: 2933294 - protein, 25 aa, Entamoeba invadens
EKNKCLDCFCCVGGDSIQHATQNFS

SEQ ID NO: 2933295 - protein, 26 aa, Entamoeba invadens
EKNKFRCGNLFEGVVIWVTGNTTPTA

SEQ ID NO: 2933296 - protein, 20 aa, Entamoeba invadens
EKNKNCILEIEKLKSENEKI

SEQ ID NO: 2933297 - protein, 25 aa, Entamoeba invadens
EKNKPKRGEIIPLQINTTTQDYLIP

SEQ ID NO: 2933298 - protein, 24 aa, Entamoeba invadens
EKNLCLKKSLKYNILSQYTSFIVI

SEQ ID NO: 2933299 - protein, 20 aa, Entamoeba invadens
EKNLITFSGIEQHKKIKDVQ

SEQ ID NO: 2933300 - protein, 36 aa, Entamoeba invadens
EKNLMICLTPSLKISPRILSNILFRHDQLFDRFPSS

SEQ ID NO: 2933301 - protein, 18 aa, Entamoeba invadens
EKNMKEKNWNGGENLAHE

SEQ ID NO: 2933302 - protein, 24 aa, Entamoeba invadens
EKNMLNARFAEIQAQPDEERQNAD

SEQ ID NO: 2933303 - protein, 21 aa, Entamoeba invadens
EKNMLNARIAEIQAQLDEERQ

SEQ ID NO: 2933304 - protein, 25 aa, Entamoeba invadens
EKNNALLEWVKKIASNYGLEVTGFK

SEQ ID NO: 2933305 - protein, 27 aa, Entamoeba invadens
EKNNALLEWVKKVTTGYGLEVTSFKSS

SEQ ID NO: 2933306 - protein, 23 aa, Entamoeba invadens
EKNPDYAIIMAFDVPVDKDAREY

SEQ ID NO: 2933307 - protein, 23 aa, Entamoeba invadens
EKNTKMSLLLSARVAEDERAKRE

SEQ ID NO: 2933308 - protein, 17 aa, Entamoeba invadens
EKNWNGGENLAHEYVLL

SEQ ID NO: 2933309 - protein, 20 aa, Entamoeba invadens
EKPDVANRFGFLHTDDKEKC

SEQ ID NO: 2933310 - protein, 22 aa, Entamoeba invadens
EKPEFLSAKVSPYVSQVLSPRN

SEQ ID NO: 2933311 - protein, 18 aa, Entamoeba invadens
EKPHPVVLPTAAPKEQPK

SEQ ID NO: 2933312 - protein, 20 aa, Entamoeba invadens
EKPKDLAFVGYTYKGFLNVV

SEQ ID NO: 2933313 - protein, 22 aa, Entamoeba invadens
EKPKLDAFDLLGMKPTQQPANT

SEQ ID NO: 2933314 - protein, 23 aa, Entamoeba invadens
EKPLPKFVIWFPVTYDYAKEFEG

SEQ ID NO: 2933315 - protein, 17 aa, Entamoeba invadens
EKPRPAVLETGDEVASS

SEQ ID NO: 2933316 - protein, 24 aa, Entamoeba invadens
EKQEFSETLVFVGNLAFAATDDDL

SEQ ID NO: 2933317 - protein, 23 aa, Entamoeba invadens
EKQFKFPWKIAEFVTNGKRLEKT

SEQ ID NO: 2933318 - protein, 23 aa, Entamoeba invadens
EKQIRKGNVLVFDFGGGTLDVTL

SEQ ID NO: 2933319 - protein, 20 aa, Entamoeba invadens
EKQKEEWQRISFTENKIRGC

SEQ ID NO: 2933320 - protein, 19 aa, Entamoeba invadens
EKQMRDFMGTRTAFEAYLP

SEQ ID NO: 2933321 - protein, 19 aa, Entamoeba invadens
EKQPPVDLFAKMKSDIDKK

SEQ ID NO: 2933322 - protein, 19 aa, Entamoeba invadens
EKQRFPASIELYSKQIGKK

SEQ ID NO: 2933323 - protein, 20 aa, Entamoeba invadens
EKQRRSSFGIEELTVGSDLM

SEQ ID NO: 2933324 - protein, 20 aa, Entamoeba invadens
EKQVDNFVDFVVWFIEEHPV

SEQ ID NO: 2933325 - protein, 21 aa, Entamoeba invadens
EKQYLMAFVFALHLNDEGLIK

SEQ ID NO: 2933326 - protein, 20 aa, Entamoeba invadens
EKQYVLYRMHLHGKKETYEG

SEQ ID NO: 2933327 - protein, 20 aa, Entamoeba invadens
EKRDAFVFTDGCWKDNESRF

SEQ ID NO: 2933328 - protein, 19 aa, Entamoeba invadens
EKRDECFNSIKLHGKGHIF

SEQ ID NO: 2933329 - protein, 28 aa, Entamoeba invadens
EKREKWRKERREVYKLVNVIVDITDFLP

SEQ ID NO: 2933330 - protein, 25 aa, Entamoeba invadens
EKREMKRKHFVTVKGLDLDDLDEQI

SEQ ID NO: 2933331 - protein, 19 aa, Entamoeba invadens
EKRERKIKEICEHVKNAPT

SEQ ID NO: 2933332 - protein, 23 aa, Entamoeba invadens
EKRFDYSVSAPFELGKLKNKDCL

SEQ ID NO: 2933333 - protein, 24 aa, Entamoeba invadens
EKRGERFIMAFGVGAPQKMFLTRK

SEQ ID NO: 2933334 - protein, 19 aa, Entamoeba invadens
EKRGESCIPKKLDQIKETF

SEQ ID NO: 2933335 - protein, 30 aa, Entamoeba invadens
EKRGFDLIKTVWVDKQFVGQSVTIFINIDI

SEQ ID NO: 2933336 - protein, 28 aa, Entamoeba invadens
EKRGFDLIKTVWVEKQYVGQSVTIPINI

SEQ ID NO: 2933337 - protein, 21 aa, Entamoeba invadens
EKRGGIKEEVKEVVATDKKAA

SEQ ID NO: 2933338 - protein, 24 aa, Entamoeba invadens
EKRGMRFLIDYLIDRCKENFVLGN

SEQ ID NO: 2933339 - protein, 17 aa, Entamoeba invadens
EKRGYLFQLKEIVGKFY

SEQ ID NO: 2933340 - protein, 24 aa, Entamoeba invadens
EKRHVSFYKKCFVEEMYNENDKLQ

SEQ ID NO: 2933341 - protein, 21 aa, Entamoeba invadens
EKRIARSKTLRSFLGHSVDGD

SEQ ID NO: 2933342 - protein, 18 aa, Entamoeba invadens
EKRIETIVAAQQEKEKEM

SEQ ID NO: 2933343 - protein, 19 aa, Entamoeba invadens
EKRILKYILTPMINSIRIL

SEQ ID NO: 2933344 - protein, 21 aa, Entamoeba invadens
EKRKKLDKRREHLASKSVYRF

SEQ ID NO: 2933345 - protein, 21 aa, Entamoeba invadens
EKRKLVISTDMLVRLLKETEV

SEQ ID NO: 2933346 - protein, 18 aa, Entamoeba invadens
EKRKQLFQLSKLMDNEID

SEQ ID NO: 2933347 - protein, 19 aa, Entamoeba invadens
EKRLKNENLKTCLRQAALK

SEQ ID NO: 2933348 - protein, 19 aa, Entamoeba invadens
EKRMFAGMMKEVFEESDRE

SEQ ID NO: 2933349 - protein, 21 aa, Entamoeba invadens
EKRMFVKRVGWITNEDLQMCI

SEQ ID NO: 2933350 - protein, 22 aa, Entamoeba invadens
EKRRPAFCDRILFRSESEVINC

SEQ ID NO: 2933351 - protein, 18 aa, Entamoeba invadens
EKRTCASPNSGFLEQLSQ

SEQ ID NO: 2933352 - protein, 25 aa, Entamoeba invadens
EKRVLYKKRLFEVVQSLNATIPLIE

SEQ ID NO: 2933353 - protein, 23 aa, Entamoeba invadens
EKRVSGYPGTLVDPHRVLLKEGS

SEQ ID NO: 2933354 - protein, 30 aa, Entamoeba invadens
EKRVTGAGFKRPNGGFGDFVIRKIKDRIPE

SEQ ID NO: 2933355 - protein, 19 aa, Entamoeba invadens
EKRVVFQGFLKRVDKEKDE

SEQ ID NO: 2933356 - protein, 26 aa, Entamoeba invadens
EKRVYRPRASTVFVDARTDTKTKTSS

SEQ ID NO: 2933357 - protein, 19 aa, Entamoeba invadens
EKRWWMYAVDALKKKKQDD

SEQ ID NO: 2933358 - protein, 17 aa, Entamoeba invadens
EKRYHNISSSKTVVQTR

SEQ ID NO: 2933359 - protein, 19 aa, Entamoeba invadens
EKRYHPARYPNWEYTNTST

SEQ ID NO: 2933360 - protein, 24 aa, Entamoeba invadens
EKSEVEKLREWTGLRHKVLVFDSA

SEQ ID NO: 2933361 - protein, 17 aa, Entamoeba invadens
EKSFEEFDPSIKTLDMY

SEQ ID NO: 2933362 - protein, 19 aa, Entamoeba invadens
EKSFLFSMMSGFLPVAKSI

SEQ ID NO: 2933363 - protein, 27 aa, Entamoeba invadens
EKSGWKIPLPLYRFIPFLEDMGYYQTP

SEQ ID NO: 2933364 - protein, 19 aa, Entamoeba invadens
EKSIKRVISSGSPVASLSL

SEQ ID NO: 2933365 - protein, 20 aa, Entamoeba invadens
EKSKDLICWSHEQNRPGFVV

SEQ ID NO: 2933366 - protein, 22 aa, Entamoeba invadens
EKSKELLCNMFNTMDPNNKSDS

SEQ ID NO: 2933367 - protein, 23 aa, Entamoeba invadens
EKSKEYSKECCKEEEKGGKAQIT

SEQ ID NO: 2933368 - protein, 20 aa, Entamoeba invadens
EKSKFCLPSGITQLQVDEPP

SEQ ID NO: 2933369 - protein, 21 aa, Entamoeba invadens
EKSKMAVMKMLGFTNDKEIIT

SEQ ID NO: 2933370 - protein, 21 aa, Entamoeba invadens
EKSLNRCAFIIFTGNHFDVLC

SEQ ID NO: 2933371 - protein, 17 aa, Entamoeba invadens
EKSMAGCLMRVLDDESV

SEQ ID NO: 2933372 - protein, 26 aa, Entamoeba invadens
EKSNCAAMFLPFVVQFLEKFDDFVSW

SEQ ID NO: 2933373 - protein, 23 aa, Entamoeba invadens
EKSNRKLNGFKREYDDILKKNVQ

SEQ ID NO: 2933374 - protein, 18 aa, Entamoeba invadens
EKSPKGWVGCGLGTESGA

SEQ ID NO: 2933375 - protein, 25 aa, Entamoeba invadens
EKSQKCLHFKAAYIALHNFYEKSVP

SEQ ID NO: 2933376 - protein, 25 aa, Entamoeba invadens
EKSRFLFNIPEGVQRACMEYKLKLP

SEQ ID NO: 2933377 - protein, 24 aa, Entamoeba invadens
EKSRPCLPGDLLMKSGEDAVNEMY

SEQ ID NO: 2933378 - protein, 26 aa, Entamoeba invadens
EKSRTLLDWLFDLMIEVSHNREVNKM

SEQ ID NO: 2933379 - protein, 25 aa, Entamoeba invadens
EKSSASLVLGFVWGLLDKFQEKKIK

SEQ ID NO: 2933380 - protein, 25 aa, Entamoeba invadens
EKSSRCIPGTYIAQLGDLMDDKYFN

SEQ ID NO: 2933381 - protein, 19 aa, Entamoeba invadens
EKSVHVVLIGLPKTGKTAL

SEQ ID NO: 2933382 - protein, 17 aa, Entamoeba invadens
EKSVIIIYCEFSQRRGP

SEQ ID NO: 2933383 - protein, 25 aa, Entamoeba invadens
EKSVKALVKRNVFGNVLTLFEISKI

SEQ ID NO: 2933384 - protein, 27 aa, Entamoeba invadens
EKSVRIGWLYCLRGYETGYIPQNFTST

SEQ ID NO: 2933385 - protein, 18 aa, Entamoeba invadens
EKTATPVLTQKEEKPVRF

SEQ ID NO: 2933386 - protein, 25 aa, Entamoeba invadens
EKTCVAYLKSINKFFATLDDLSILL

SEQ ID NO: 2933387 - protein, 23 aa, Entamoeba invadens
EKTELPVYLGREGKEFKEKGTFV

SEQ ID NO: 2933388 - protein, 25 aa, Entamoeba invadens
EKTEMPLHLLLSFSTNCLKTNLTIK

SEQ ID NO: 2933389 - protein, 17 aa, Entamoeba invadens
EKTEVTNFFYLSKQLYY

SEQ ID NO: 2933390 - protein, 20 aa, Entamoeba invadens
EKTFFLYPGAPFFMNYDEYN

SEQ ID NO: 2933391 - protein, 17 aa, Entamoeba invadens
EKTFGFKITRTAKKYYL

SEQ ID NO: 2933392 - protein, 21 aa, Entamoeba invadens
EKTFIKLRGFIGGKEKEQKEM

SEQ ID NO: 2933393 - protein, 23 aa, Entamoeba invadens
EKTFYRIIVWFSVDYNTFNKNKN

SEQ ID NO: 2933394 - protein, 25 aa, Entamoeba invadens
EKTGTCNVIGIGIVFVVFQTECDIF

SEQ ID NO: 2933395 - protein, 19 aa, Entamoeba invadens
EKTHCRWGQDGFYDVLVVP

SEQ ID NO: 2933396 - protein, 25 aa, Entamoeba invadens
EKTIEMFDRQVLKNYAYLHIQTVHF

SEQ ID NO: 2933397 - protein, 24 aa, Entamoeba invadens
EKTIPSLLPIVLDNINFVKFTSFI

SEQ ID NO: 2933398 - protein, 24 aa, Entamoeba invadens
EKTKMMRNTVNFSLVESGSSSMFG

SEQ ID NO: 2933399 - protein, 23 aa, Entamoeba invadens
EKTKMVFWYFWFLSFAFEQPDKP

SEQ ID NO: 2933400 - protein, 24 aa, Entamoeba invadens
EKTKNCGYILFDMVSESGNISRPT

SEQ ID NO: 2933401 - protein, 19 aa, Entamoeba invadens
EKTLAMMVSNFLSFQLSFT

SEQ ID NO: 2933402 - protein, 20 aa, Entamoeba invadens
EKTLEITPIIPIINENKESP

SEQ ID NO: 2933403 - protein, 25 aa, Entamoeba invadens
EKTLFPSEFALLIDTLYECNNTSLD

SEQ ID NO: 2933404 - protein, 23 aa, Entamoeba invadens
EKTLIPFHFIKPFQHYETFIGEA

SEQ ID NO: 2933405 - protein, 25 aa, Entamoeba invadens
EKTMKLEPKKILKYEDDHTPSKPLE

SEQ ID NO: 2933406 - protein, 28 aa, Entamoeba invadens
EKTPRDLFFARIKSVLSRNAIASTVFRY

SEQ ID NO: 2933407 - protein, 24 aa, Entamoeba invadens
EKTRRHAYEVLKQMKKKIESYKLR

SEQ ID NO: 2933408 - protein, 21 aa, Entamoeba invadens
EKTRRLFEQLQRDMAEKQAAD

SEQ ID NO: 2933409 - protein, 19 aa, Entamoeba invadens
EKTRVIFSYRTKRFPPKHV

SEQ ID NO: 2933410 - protein, 26 aa, Entamoeba invadens
EKTTNKPGWCFDDFDGAGTIKPKIYA

SEQ ID NO: 2933411 - protein, 19 aa, Entamoeba invadens
EKVDEFLMIINLTNLPIHV

SEQ ID NO: 2933412 - protein, 21 aa, Entamoeba invadens
EKVDVWSLGIMCMEMSDGMPP

SEQ ID NO: 2933413 - protein, 19 aa, Entamoeba invadens
EKVEFGFNVFENCSSLRGF

SEQ ID NO: 2933414 - protein, 17 aa, Entamoeba invadens
EKVELKLPLNVIEEKEG

SEQ ID NO: 2933415 - protein, 23 aa, Entamoeba invadens
EKVERKLSFTFAKKEKKDKTESR

SEQ ID NO: 2933416 - protein, 22 aa, Entamoeba invadens
EKVGKAPYEVCVGEGVDNNKTG

SEQ ID NO: 2933417 - protein, 22 aa, Entamoeba invadens
EKVGRRECGCFGTEHRAAANCQ

SEQ ID NO: 2933418 - protein, 25 aa, Entamoeba invadens
EKVGWTMKVLEIFIKEKRVNEVLFW

SEQ ID NO: 2933419 - protein, 22 aa, Entamoeba invadens
EKVIEALFLWSSDNVLFDKVQK

SEQ ID NO: 2933420 - protein, 18 aa, Entamoeba invadens
EKVILDKTQIVFGNISDI

SEQ ID NO: 2933421 - protein, 19 aa, Entamoeba invadens
EKVIPTLHLKNTLYVGQLL

SEQ ID NO: 2933422 - protein, 26 aa, Entamoeba invadens
EKVIYELFNIFWTRKGREGKFSFIAK

SEQ ID NO: 2933423 - protein, 30 aa, Entamoeba invadens
EKVKEALAGLKFHGMGVVVQECTEEDSNKI

SEQ ID NO: 2933424 - protein, 26 aa, Entamoeba invadens
EKVKRRFVKIQKLFGLLKETRGSVYC

SEQ ID NO: 2933425 - protein, 28 aa, Entamoeba invadens
EKVKSYRKALFVKSLVAKIKFERLENYS

SEQ ID NO: 2933426 - protein, 19 aa, Entamoeba invadens
EKVKYVYRAVEDVYIILIT

SEQ ID NO: 2933427 - protein, 18 aa, Entamoeba invadens
EKVLLPFGNYDMGSLTNY

SEQ ID NO: 2933428 - protein, 18 aa, Entamoeba invadens
EKVLRNGFGYALKDPITN

SEQ ID NO: 2933429 - protein, 19 aa, Entamoeba invadens
EKVLSVWDDRMLKIPVVSI

SEQ ID NO: 2933430 - protein, 29 aa, Entamoeba invadens
EKVMKEIKKFSARVEPELPNVKRVPESDN

SEQ ID NO: 2933431 - protein, 23 aa, Entamoeba invadens
EKVMKKKMSAIVLTDALVLVKEK

SEQ ID NO: 2933432 - protein, 20 aa, Entamoeba invadens
EKVNEACFFDCNQLKEITIQ

SEQ ID NO: 2933433 - protein, 23 aa, Entamoeba invadens
EKVPFGIATSSGWENVEVFVEKF

SEQ ID NO: 2933434 - protein, 33 aa, Entamoeba invadens
EKVPRGSANICSRCKSDDICVFVKQNVVFCNAC

SEQ ID NO: 2933435 - protein, 22 aa, Entamoeba invadens
EKVPTSIAFVCFTSQEAFNKAM

SEQ ID NO: 2933436 - protein, 17 aa, Entamoeba invadens
EKVQARSDVSCEYKQFM

SEQ ID NO: 2933437 - protein, 30 aa, Entamoeba invadens
EKVQKCIDVAYARLNIPKLIMADYVAQGTV

SEQ ID NO: 2933438 - protein, 20 aa, Entamoeba invadens
EKVQLPRKWNHIGVVCKSKK

SEQ ID NO: 2933439 - protein, 20 aa, Entamoeba invadens
EKVRPICMGAVLRGINFTDA

SEQ ID NO: 2933440 - protein, 25 aa, Entamoeba invadens
EKVVPEFSESVILSYTNEKYVDDFL

SEQ ID NO: 2933441 - protein, 24 aa, Entamoeba invadens
EKVWSVPDCVLKFKLFNIESPRDQ

SEQ ID NO: 2933442 - protein, 24 aa, Entamoeba invadens
EKWEMKYAEGWETRAVITNDCVKE

SEQ ID NO: 2933443 - protein, 27 aa, Entamoeba invadens
EKWQLPNNCDFCFSLRSLFSKSPTLLL

SEQ ID NO: 2933444 - protein, 20 aa, Entamoeba invadens
EKYALVFGILNALKMANVRY

SEQ ID NO: 2933445 - protein, 29 aa, Entamoeba invadens
EKYCFLATFCKTRFNSCCKSLETALQMEK

SEQ ID NO: 2933446 - protein, 20 aa, Entamoeba invadens
EKYCRLSGGLRSMRCSAKTG

SEQ ID NO: 2933447 - protein, 17 aa, Entamoeba invadens
EKYDFLVLVLLVLFCKT

SEQ ID NO: 2933448 - protein, 21 aa, Entamoeba invadens
EKYFEMVREFAKKCGNTIPEW

SEQ ID NO: 2933449 - protein, 21 aa, Entamoeba invadens
EKYFSRLLQLRVIKHIVASYS

SEQ ID NO: 2933450 - protein, 18 aa, Entamoeba invadens
EKYIFESALHDFIIAKII

SEQ ID NO: 2933451 - protein, 21 aa, Entamoeba invadens
EKYKDSSIVKLCMEYHTHTTN

SEQ ID NO: 2933452 - protein, 22 aa, Entamoeba invadens
EKYKGFDFDTMMAEMGIQPQSP

SEQ ID NO: 2933453 - protein, 17 aa, Entamoeba invadens
EKYKMSADIFSFGITIY

SEQ ID NO: 2933454 - protein, 17 aa, Entamoeba invadens
EKYKMSADIFSFGVTIY

SEQ ID NO: 2933455 - protein, 18 aa, Entamoeba invadens
EKYLGSIERAMLSVFKLT

SEQ ID NO: 2933456 - protein, 29 aa, Entamoeba invadens
EKYLRMILYAKPNHPIAVARPSWEGKGAH

SEQ ID NO: 2933457 - protein, 19 aa, Entamoeba invadens
EKYLYDQNGFVFSLVSKTK

SEQ ID NO: 2933458 - protein, 26 aa, Entamoeba invadens
EKYMIPMQFWLYYVIDVEKHKLAYIQ

SEQ ID NO: 2933459 - protein, 20 aa, Entamoeba invadens
EKYMKSVLFSKVPGYADFFT

SEQ ID NO: 2933460 - protein, 19 aa, Entamoeba invadens
EKYMKYNLYFGQNIGSVIA

SEQ ID NO: 2933461 - protein, 30 aa, Entamoeba invadens
EKYMVYDFLYSYCFPFLVYKQRILTNQTLL

SEQ ID NO: 2933462 - protein, 31 aa, Entamoeba invadens
EKYPAHINRYFRVVSEFALEAGDFSTVVIGL

SEQ ID NO: 2933463 - protein, 19 aa, Entamoeba invadens
EKYPDQFKPVVVIENEQIE

SEQ ID NO: 2933464 - protein, 17 aa, Entamoeba invadens
EKYPLEVYLDFIYCGFI

SEQ ID NO: 2933465 - protein, 24 aa, Entamoeba invadens
EKYQFEVSYSFYLLMKNIHISCEN

SEQ ID NO: 2933466 - protein, 24 aa, Entamoeba invadens
EKYQFEVSYSFYLQMKNIHIYCEN

SEQ ID NO: 2933467 - protein, 20 aa, Entamoeba invadens
EKYRDQFICFGFMGVQDLIL

SEQ ID NO: 2933468 - protein, 17 aa, Entamoeba invadens
EKYREAQRMKYEAIHLS

SEQ ID NO: 2933469 - protein, 19 aa, Entamoeba invadens
EKYRMLSDIFSFAITMYEI

SEQ ID NO: 2933470 - protein, 25 aa, Entamoeba invadens
EKYRMPSDIFSFAITMYEIFNWEKC

SEQ ID NO: 2933471 - protein, 17 aa, Entamoeba invadens
EKYRVRSVFGMYLVASS

SEQ ID NO: 2933472 - protein, 26 aa, Entamoeba invadens
EKYSEVPWILSPILRTVRWLNKMNTL

SEQ ID NO: 2933473 - protein, 27 aa, Entamoeba invadens
EKYSKWTIRMLLGYNKIVAMGIDVDND

SEQ ID NO: 2933474 - protein, 24 aa, Entamoeba invadens
EKYSPFEILSCLMENVITALDDNL

SEQ ID NO: 2933475 - protein, 22 aa, Entamoeba invadens
EKYSRFYRKWVNGNMQEHKPKQ

SEQ ID NO: 2933476 - protein, 19 aa, Entamoeba invadens
EKYTFTLLADTGRSVDPTQ

SEQ ID NO: 2933477 - protein, 19 aa, Entamoeba invadens
EKYTVRFGVTDVVGQYVDE

SEQ ID NO: 2933478 - protein, 20 aa, Entamoeba invadens
EKYVFPSNFLSLLTESDKKI

SEQ ID NO: 2933479 - protein, 20 aa, Entamoeba invadens
EKYVKVLGFFVEDTKKPQAP

SEQ ID NO: 2933480 - protein, 26 aa, Entamoeba invadens
EKYYCLFPVFYRNSSIVIIVYDPNNS

SEQ ID NO: 2933481 - protein, 25 aa, Entamoeba invadens
EKYYEPRPLCLKELVSVTKIEKKVW

SEQ ID NO: 2933482 - protein, 34 aa, Entamoeba invadens
EKYYLACVIPYLGHWKDLLHFGFVNKKCFDTLLM

SEQ ID NO: 2933483 - protein, 21 aa, Entamoeba invadens
ELADVCKTCQSIFKEYLAHIH

SEQ ID NO: 2933484 - protein, 25 aa, Entamoeba invadens
ELAEKCKLFLLSGVDCAACNEGYIL

SEQ ID NO: 2933485 - protein, 25 aa, Entamoeba invadens
ELAEKCKLFLLSGVDCATCNEGYIL

SEQ ID NO: 2933486 - protein, 19 aa, Entamoeba invadens
ELAIGMMIYAFRNMFQPGT

SEQ ID NO: 2933487 - protein, 26 aa, Entamoeba invadens
ELAILRILHHPHIINYYASYETSKLL

SEQ ID NO: 2933488 - protein, 17 aa, Entamoeba invadens
ELAKFQKYYERTAAKKK

SEQ ID NO: 2933489 - protein, 17 aa, Entamoeba invadens
ELALKALLLGGTPSALS

SEQ ID NO: 2933490 - protein, 27 aa, Entamoeba invadens
ELATTFFRLCCYIPVFISKLSKTPSAC

SEQ ID NO: 2933491 - protein, 20 aa, Entamoeba invadens
ELAVKIRRVCPCAFLETSAK

SEQ ID NO: 2933492 - protein, 18 aa, Entamoeba invadens
ELCEDIPIVLYGNKCDLE

SEQ ID NO: 2933493 - protein, 18 aa, Entamoeba invadens
ELCEFFFEVPDEVGLNKF

SEQ ID NO: 2933494 - protein, 18 aa, Entamoeba invadens
ELCIALANHLDWYTTLYA

SEQ ID NO: 2933495 - protein, 26 aa, Entamoeba invadens
ELCKRARLAKANAYIVSYLREQMPTF

SEQ ID NO: 2933496 - protein, 17 aa, Entamoeba invadens
ELCLDGKAEVVEKDKVN

SEQ ID NO: 2933497 - protein, 22 aa, Entamoeba invadens
ELCLSLRDRFVELFKKVRKVPY

SEQ ID NO: 2933498 - protein, 25 aa, Entamoeba invadens
ELCMKMFPQRTDIITATLLNSSVGY

SEQ ID NO: 2933499 - protein, 18 aa, Entamoeba invadens
ELCREFGVPSALRMDIWK

SEQ ID NO: 2933500 - protein, 18 aa, Entamoeba invadens
ELCRGCGMCARDCIAQCL

SEQ ID NO: 2933501 - protein, 18 aa, Entamoeba invadens
ELCRGCGMCARDCITQCL

SEQ ID NO: 2933502 - protein, 19 aa, Entamoeba invadens
ELCSKNCEEPGCLATYTKT

SEQ ID NO: 2933503 - protein, 17 aa, Entamoeba invadens
ELCSRLDVVQNLNRIGS

SEQ ID NO: 2933504 - protein, 24 aa, Entamoeba invadens
ELDAKAIASMELLKKLFPKSQNNY

SEQ ID NO: 2933505 - protein, 19 aa, Entamoeba invadens
ELDCAKYMECSALTRKGLV

SEQ ID NO: 2933506 - protein, 23 aa, Entamoeba invadens
ELDFEISSVMARKSGKAMQVERI

SEQ ID NO: 2933507 - protein, 24 aa, Entamoeba invadens
ELDFLKAYIESFGGVVPKSEDIPK

SEQ ID NO: 2933508 - protein, 31 aa, Entamoeba invadens
ELDKEWDKRLPSIFGQFRPDTIFSLFSSTTA

SEQ ID NO: 2933509 - protein, 18 aa, Entamoeba invadens
ELDKGLVDDFLKKVEKGS

SEQ ID NO: 2933510 - protein, 26 aa, Entamoeba invadens
ELDKNILERFGCEKGIEEWRKAVDHL

SEQ ID NO: 2933511 - protein, 20 aa, Entamoeba invadens
ELDKSKVFDSIICLQNYSGA

SEQ ID NO: 2933512 - protein, 19 aa, Entamoeba invadens
ELDLSWNKLEEFDYDCLAP

SEQ ID NO: 2933513 - protein, 24 aa, Entamoeba invadens
ELDNYRCGIRFVHPGTSVLLMTDG

SEQ ID NO: 2933514 - protein, 24 aa, Entamoeba invadens
ELDQFKGLIPVLIEYFNNAKKGDI

SEQ ID NO: 2933515 - protein, 23 aa, Entamoeba invadens
ELDRFMKVLKEWAGAKSVTKVFE

SEQ ID NO: 2933516 - protein, 17 aa, Entamoeba invadens
ELDSCTHTKGTLSGEST

SEQ ID NO: 2933517 - protein, 19 aa, Entamoeba invadens
ELDSLKFCRKICEKPLRIV

SEQ ID NO: 2933518 - protein, 17 aa, Entamoeba invadens
ELECKKVEGFEPYDDTF

SEQ ID NO: 2933519 - protein, 23 aa, Entamoeba invadens
ELECKLEDVVPVLPPKPRRLSQN

SEQ ID NO: 2933520 - protein, 25 aa, Entamoeba invadens
ELECLKCKEKFLWEGYKEKDMKCHC

SEQ ID NO: 2933521 - protein, 22 aa, Entamoeba invadens
ELEDIKMLILLILNTRGNITEY

SEQ ID NO: 2933522 - protein, 19 aa, Entamoeba invadens
ELEEKVGITRSVERKGDTN

SEQ ID NO: 2933523 - protein, 21 aa, Entamoeba invadens
ELEIGECFRLSSLDISSLTKL

SEQ ID NO: 2933524 - protein, 20 aa, Entamoeba invadens
ELEKANWDLKDTINELNNKL

SEQ ID NO: 2933525 - protein, 21 aa, Entamoeba invadens
ELEKIKSKIWITSERGKVGEE

SEQ ID NO: 2933526 - protein, 23 aa, Entamoeba invadens
ELEKIPELVWMFTRKEIVEGSGV

SEQ ID NO: 2933527 - protein, 23 aa, Entamoeba invadens
ELEKLEGVGMKVLRVDLEDIKSR

SEQ ID NO: 2933528 - protein, 23 aa, Entamoeba invadens
ELELCVQPKIPFNIRKVESSLKK

SEQ ID NO: 2933529 - protein, 22 aa, Entamoeba invadens
ELELPTTLTFLIMKKVPRGLLK

SEQ ID NO: 2933530 - protein, 24 aa, Entamoeba invadens
ELEMKAVVAASVYQFAEILSNNDM

SEQ ID NO: 2933531 - protein, 22 aa, Entamoeba invadens
ELEMQDCCNLIFSHSIENIETL

SEQ ID NO: 2933532 - protein, 21 aa, Entamoeba invadens
ELEMTFRVLLDGSKVTDAILV

SEQ ID NO: 2933533 - protein, 20 aa, Entamoeba invadens
ELEMTRLKEVLAESRTANEE

SEQ ID NO: 2933534 - protein, 20 aa, Entamoeba invadens
ELEMTYCPILKVVNLPSTLK

SEQ ID NO: 2933535 - protein, 28 aa, Entamoeba invadens
ELEMYPAEMKNVWYRWLENIHDWCISRQ

SEQ ID NO: 2933536 - protein, 22 aa, Entamoeba invadens
ELENKFKDKDDIIETTKKQKEE

SEQ ID NO: 2933537 - protein, 18 aa, Entamoeba invadens
ELENRFNLHKILQLSTHR

SEQ ID NO: 2933538 - protein, 17 aa, Entamoeba invadens
ELERAREILKYGIDHVG

SEQ ID NO: 2933539 - protein, 19 aa, Entamoeba invadens
ELESCNFKSFKLGEVSKSV

SEQ ID NO: 2933540 - protein, 21 aa, Entamoeba invadens
ELESFSFQFCDSITSIQFTEK

SEQ ID NO: 2933541 - protein, 24 aa, Entamoeba invadens
ELESFSFQFCDSITSIQFTGKMKK

SEQ ID NO: 2933542 - protein, 18 aa, Entamoeba invadens
ELETTIKQFDAIKKRMDE

SEQ ID NO: 2933543 - protein, 19 aa, Entamoeba invadens
ELEYIRVLPVRNIAFVRYR

SEQ ID NO: 2933544 - protein, 25 aa, Entamoeba invadens
ELFDSSMCFLCVLGTNNGMEDPLKK

SEQ ID NO: 2933545 - protein, 26 aa, Entamoeba invadens
ELFDTFSFKISKYYCKISSSTQRINF

SEQ ID NO: 2933546 - protein, 19 aa, Entamoeba invadens
ELFEGCVVEAEKKEKPKKD

SEQ ID NO: 2933547 - protein, 24 aa, Entamoeba invadens
ELFEKYKKECIVLDLKVDNTITPI

SEQ ID NO: 2933548 - protein, 21 aa, Entamoeba invadens
ELFELMNEYGLVYSFKRALSV

SEQ ID NO: 2933549 - protein, 25 aa, Entamoeba invadens
ELFFQEMIGFSWTYSLSLPRLEQYR

SEQ ID NO: 2933550 - protein, 18 aa, Entamoeba invadens
ELFIDYCDVPSFNVEKIH

SEQ ID NO: 2933551 - protein, 32 aa, Entamoeba invadens
ELFKETFPSRVLRLKMTRKILFIVFQTEVKIY

SEQ ID NO: 2933552 - protein, 25 aa, Entamoeba invadens
ELFKGRCKIDQLFKIFSQLGTPTEE

SEQ ID NO: 2933553 - protein, 18 aa, Entamoeba invadens
ELFPSLYSTIPVKIDDIT

SEQ ID NO: 2933554 - protein, 22 aa, Entamoeba invadens
ELFQVLKMIIGGSFTDEQLQQV

SEQ ID NO: 2933555 - protein, 24 aa, Entamoeba invadens
ELFRISNGWKMFRSGDVRRYVKSI

SEQ ID NO: 2933556 - protein, 21 aa, Entamoeba invadens
ELFRITPCDVIIRDTFDSLII

SEQ ID NO: 2933557 - protein, 20 aa, Entamoeba invadens
ELFSQCCKAIQWLHNQMNLI

SEQ ID NO: 2933558 - protein, 19 aa, Entamoeba invadens
ELFVPLIQSLHQFYCNTLT

SEQ ID NO: 2933559 - protein, 26 aa, Entamoeba invadens
ELGDCKKQWRLSASFLGSSGGKKVSR

SEQ ID NO: 2933560 - protein, 19 aa, Entamoeba invadens
ELGDFLCCHGGFSPDMDRI

SEQ ID NO: 2933561 - protein, 17 aa, Entamoeba invadens
ELGEMLKAFNNYIDQQL

SEQ ID NO: 2933562 - protein, 30 aa, Entamoeba invadens
ELGIIPTTFGLRWVRMLFSREFTIENTIKL

SEQ ID NO: 2933563 - protein, 26 aa, Entamoeba invadens
ELGKIYDCWSSLALPLEVWTTKFSSY

SEQ ID NO: 2933564 - protein, 24 aa, Entamoeba invadens
ELGKRPFCVSILYQTYPKVIDYMD

SEQ ID NO: 2933565 - protein, 25 aa, Entamoeba invadens
ELGKYYIIMILPKFMKETHVTLSMK

SEQ ID NO: 2933566 - protein, 23 aa, Entamoeba invadens
ELGPQVIEKIRFSARTLKRRYDE

SEQ ID NO: 2933567 - protein, 19 aa, Entamoeba invadens
ELGQYCFYKCKGLRSVTIP

SEQ ID NO: 2933568 - protein, 18 aa, Entamoeba invadens
ELGVLKATQGLQAFVGEI

SEQ ID NO: 2933569 - protein, 17 aa, Entamoeba invadens
ELHAKTGLFPSNYVTLM

SEQ ID NO: 2933570 - protein, 18 aa, Entamoeba invadens
ELHGRGWNSLYLNNHDQP

SEQ ID NO: 2933571 - protein, 20 aa, Entamoeba invadens
ELHNLKTLRIISSGKGQLKH

SEQ ID NO: 2933572 - protein, 21 aa, Entamoeba invadens
ELHSLKTIRIFAGAKGQLKYF

SEQ ID NO: 2933573 - protein, 23 aa, Entamoeba invadens
ELHSSYIALSWAGGKDGREKIDC

SEQ ID NO: 2933574 - protein, 19 aa, Entamoeba invadens
ELIDRMKPTMSFDTSSLCM

SEQ ID NO: 2933575 - protein, 20 aa, Entamoeba invadens
ELIDTWNLIKKFECTDAEII

SEQ ID NO: 2933576 - protein, 25 aa, Entamoeba invadens
ELIEHFKELELRVNDTQDIVTALNT

SEQ ID NO: 2933577 - protein, 21 aa, Entamoeba invadens
ELIELRTDWTLFNEFTEDNIQ

SEQ ID NO: 2933578 - protein, 24 aa, Entamoeba invadens
ELIGRIELHPSISNRPFPSLAKSL

SEQ ID NO: 2933579 - protein, 18 aa, Entamoeba invadens
ELIIKRKDKTIAEVLHTF

SEQ ID NO: 2933580 - protein, 24 aa, Entamoeba invadens
ELIKCALPQDIWFHVDSESSAHVY

SEQ ID NO: 2933581 - protein, 23 aa, Entamoeba invadens
ELIKEQNLHWLVMENTDIYCNVF

SEQ ID NO: 2933582 - protein, 18 aa, Entamoeba invadens
ELIKFCVEKCRALVMYSD

SEQ ID NO: 2933583 - protein, 21 aa, Entamoeba invadens
ELIKKLPAAYTPYIDGKIQEK

SEQ ID NO: 2933584 - protein, 25 aa, Entamoeba invadens
ELIPEFFYFPEFLRNFDKFDLKKRN

SEQ ID NO: 2933585 - protein, 23 aa, Entamoeba invadens
ELIPEFFYLPQFLINFNQINFAK

SEQ ID NO: 2933586 - protein, 17 aa, Entamoeba invadens
ELIRIAENILLGVFPKI

SEQ ID NO: 2933587 - protein, 20 aa, Entamoeba invadens
ELIRKQRKPITFGEQDLGEL

SEQ ID NO: 2933588 - protein, 26 aa, Entamoeba invadens
ELITPPNRIIVCLEQSTTEWANSVSR

SEQ ID NO: 2933589 - protein, 23 aa, Entamoeba invadens
ELIVPNIPFCFENISPRSITGNS

SEQ ID NO: 2933590 - protein, 24 aa, Entamoeba invadens
ELKAVCCSHGPVLRTNIKENIERY

SEQ ID NO: 2933591 - protein, 21 aa, Entamoeba invadens
ELKCLQLLTTPFIVPAPLSHY

SEQ ID NO: 2933592 - protein, 23 aa, Entamoeba invadens
ELKDLPKSFAFFKTMIDSLVEPL

SEQ ID NO: 2933593 - protein, 22 aa, Entamoeba invadens
ELKELIKRCWDQNDLIRPDFDE

SEQ ID NO: 2933594 - protein, 17 aa, Entamoeba invadens
ELKEVKYHCSFTPIHSI

SEQ ID NO: 2933595 - protein, 21 aa, Entamoeba invadens
ELKEYFQRYGRVVDVVVMESV

SEQ ID NO: 2933596 - protein, 21 aa, Entamoeba invadens
ELKGFPKFKGGLDVNNGETGT

SEQ ID NO: 2933597 - protein, 18 aa, Entamoeba invadens
ELKGIKYSISVKFGSNPV

SEQ ID NO: 2933598 - protein, 24 aa, Entamoeba invadens
ELKGNVCKICLGRGHMAKCCPSWN

SEQ ID NO: 2933599 - protein, 20 aa, Entamoeba invadens
ELKGRTCIAQMFMTEAETVV

SEQ ID NO: 2933600 - protein, 23 aa, Entamoeba invadens
ELKHSRASKFFFLNFKNEFPDVQ

SEQ ID NO: 2933601 - protein, 24 aa, Entamoeba invadens
ELKIPQNVKICYRSGDQPNNAFTL

SEQ ID NO: 2933602 - protein, 19 aa, Entamoeba invadens
ELKIRDPVIRKWVEQLGGE

SEQ ID NO: 2933603 - protein, 23 aa, Entamoeba invadens
ELKKAEKTIDVFIQVNSSGEEQK

SEQ ID NO: 2933604 - protein, 20 aa, Entamoeba invadens
ELKKAFEEMQPWIDGKKSLS

SEQ ID NO: 2933605 - protein, 24 aa, Entamoeba invadens
ELKKCKKLGPKKVDSLWKVLHAPF

SEQ ID NO: 2933606 - protein, 24 aa, Entamoeba invadens
ELKKCTWLEVVYLFNTHVTEKSVK

SEQ ID NO: 2933607 - protein, 21 aa, Entamoeba invadens
ELKKWEIKYYKGLGTSKDSDA

SEQ ID NO: 2933608 - protein, 17 aa, Entamoeba invadens
ELKLSGVDLKTLDGEVL

SEQ ID NO: 2933609 - protein, 21 aa, Entamoeba invadens
ELKLSSIPFLAFKKVKHITPY

SEQ ID NO: 2933610 - protein, 20 aa, Entamoeba invadens
ELKMRGVHFHIRFDSHNEKT

SEQ ID NO: 2933611 - protein, 20 aa, Entamoeba invadens
ELKNFLKINGKPFKEDEVRK

SEQ ID NO: 2933612 - protein, 20 aa, Entamoeba invadens
ELKNYFSYQQGVVVALVNQF

SEQ ID NO: 2933613 - protein, 18 aa, Entamoeba invadens
ELKREMFYESGCVTVVRM

SEQ ID NO: 2933614 - protein, 24 aa, Entamoeba invadens
ELKRNRECYVLDEIEMCWMTEVLL

SEQ ID NO: 2933615 - protein, 17 aa, Entamoeba invadens
ELKRVVVDIQKIQQLFN

SEQ ID NO: 2933616 - protein, 17 aa, Entamoeba invadens
ELKSFKWITQNCNEKKA

SEQ ID NO: 2933617 - protein, 21 aa, Entamoeba invadens
ELKSPESVLGRKNVETLFEFL

SEQ ID NO: 2933618 - protein, 26 aa, Entamoeba invadens
ELKSWKFRITKEFVFNLDVELVNVQQ

SEQ ID NO: 2933619 - protein, 24 aa, Entamoeba invadens
ELKTHKFLCDMGINESEEYIKQES

SEQ ID NO: 2933620 - protein, 22 aa, Entamoeba invadens
ELKTTLSSLEIENYFVLANTFK

SEQ ID NO: 2933621 - protein, 19 aa, Entamoeba invadens
ELKVPKYKQYYIFFTSPIN

SEQ ID NO: 2933622 - protein, 34 aa, Entamoeba invadens
ELKVTLCCGENVYVPSIHTFNGFGSFTGNMFISA

SEQ ID NO: 2933623 - protein, 23 aa, Entamoeba invadens
ELLEGRAGVDPNIYGQTVSDEGL

SEQ ID NO: 2933624 - protein, 28 aa, Entamoeba invadens
ELLESLKTWLEEKWNVVEGQIVKIKEQN

SEQ ID NO: 2933625 - protein, 18 aa, Entamoeba invadens
ELLEVYPVPQKKFSVSDF

SEQ ID NO: 2933626 - protein, 26 aa, Entamoeba invadens
ELLHNFKLVRLFFFTRFYQTTQEKFY

SEQ ID NO: 2933627 - protein, 20 aa, Entamoeba invadens
ELLIGLKYLHDAGIVYRDLK

SEQ ID NO: 2933628 - protein, 19 aa, Entamoeba invadens
ELLKKVDFSKIMKQLKGRE

SEQ ID NO: 2933629 - protein, 17 aa, Entamoeba invadens
ELLKNKRTVVVEQNDQF

SEQ ID NO: 2933630 - protein, 24 aa, Entamoeba invadens
ELLKSNCYSYIYGSAMSPIEARQI

SEQ ID NO: 2933631 - protein, 19 aa, Entamoeba invadens
ELLKWKPHAVVIKNPDIME

SEQ ID NO: 2933632 - protein, 18 aa, Entamoeba invadens
ELLLCGYDDLTIYKNRNK

SEQ ID NO: 2933633 - protein, 30 aa, Entamoeba invadens
ELLMKFPEIKRYALEKVLTFSMENLSDATT

SEQ ID NO: 2933634 - protein, 19 aa, Entamoeba invadens
ELLNIPPLLIPQYVSDIDD

SEQ ID NO: 2933635 - protein, 17 aa, Entamoeba invadens
ELLPLIHTFDGKKLPPK

SEQ ID NO: 2933636 - protein, 22 aa, Entamoeba invadens
ELLPMKQYPIFNGITKNPSILR

SEQ ID NO: 2933637 - protein, 20 aa, Entamoeba invadens
ELLRRAFEDLDEMEPITIVV

SEQ ID NO: 2933638 - protein, 25 aa, Entamoeba invadens
ELLRTFLQYDCCRTPFISECVSDIF

SEQ ID NO: 2933639 - protein, 25 aa, Entamoeba invadens
ELLRVIDDLHVMVGKCVDNPDLVIR

SEQ ID NO: 2933640 - protein, 18 aa, Entamoeba invadens
ELLSETCINSDKNYQPTK

SEQ ID NO: 2933641 - protein, 19 aa, Entamoeba invadens
ELMCKVKTDFTLVSAAIGF

SEQ ID NO: 2933642 - protein, 17 aa, Entamoeba invadens
ELMFCALNNILINPSFT

SEQ ID NO: 2933643 - protein, 17 aa, Entamoeba invadens
ELMFDLVILRITVMLSF

SEQ ID NO: 2933644 - protein, 18 aa, Entamoeba invadens
ELMGILSGNHFKFEKSIF

SEQ ID NO: 2933645 - protein, 26 aa, Entamoeba invadens
ELMLKVFRKVLTFKPHMWSYGLDTFR

SEQ ID NO: 2933646 - protein, 18 aa, Entamoeba invadens
ELMMKYKKDGVLLDLEVD

SEQ ID NO: 2933647 - protein, 20 aa, Entamoeba invadens
ELMRPIPFAISFTDNKINVF

SEQ ID NO: 2933648 - protein, 17 aa, Entamoeba invadens
ELMTKFVNISGENKKIK

SEQ ID NO: 2933649 - protein, 23 aa, Entamoeba invadens
ELMYKERHDLMFIATYDKDVYYP

SEQ ID NO: 2933650 - protein, 25 aa, Entamoeba invadens
ELNDAVKCIFVLPETLGKLTDLKKV

SEQ ID NO: 2933651 - protein, 25 aa, Entamoeba invadens
ELNFKESTKFCGIDTLTNCTKLSAL

SEQ ID NO: 2933652 - protein, 24 aa, Entamoeba invadens
ELNGKYIGTRPCMLKKGEWEKRSD

SEQ ID NO: 2933653 - protein, 24 aa, Entamoeba invadens
ELNKEQMLKCLKDISQNLVEKSQI

SEQ ID NO: 2933654 - protein, 22 aa, Entamoeba invadens
ELNKMEKFVCTLKKKCKQLSYQ

SEQ ID NO: 2933655 - protein, 24 aa, Entamoeba invadens
ELNKPRIILWNSTYIHLNKNINGR

SEQ ID NO: 2933656 - protein, 25 aa, Entamoeba invadens
ELNLRSNCLQKLPIDLTKLSNLVMC

SEQ ID NO: 2933657 - protein, 18 aa, Entamoeba invadens
ELNLSFNNIETFPQLTLS

SEQ ID NO: 2933658 - protein, 19 aa, Entamoeba invadens
ELNMNCLVYALKQAKIDDK

SEQ ID NO: 2933659 - protein, 21 aa, Entamoeba invadens
ELNNALLYMLHKVGFEFEEKK

SEQ ID NO: 2933660 - protein, 22 aa, Entamoeba invadens
ELNNKYLFAFGGGYDIAVAKKG

SEQ ID NO: 2933661 - protein, 19 aa, Entamoeba invadens
ELNNNCLIYALQQATINEK

SEQ ID NO: 2933662 - protein, 25 aa, Entamoeba invadens
  misc_feature (20)..(21): Xaa can be any naturally occurring amino acid
ELNNRIDQLFSWAFKQDIVXXQILH

SEQ ID NO: 2933663 - protein, 19 aa, Entamoeba invadens
ELNTFGGVVYNEIEKTGEN

SEQ ID NO: 2933664 - protein, 28 aa, Entamoeba invadens
ELPEGGKAWKGKEMMFRIDGKYPKKPDI

SEQ ID NO: 2933665 - protein, 17 aa, Entamoeba invadens
ELPELFDTYQRTILKLI

SEQ ID NO: 2933666 - protein, 18 aa, Entamoeba invadens
ELPIGINYETLVQIPQQF

SEQ ID NO: 2933667 - protein, 25 aa, Entamoeba invadens
ELPKELMEIGAYCFANDISLTGVVV

SEQ ID NO: 2933668 - protein, 29 aa, Entamoeba invadens
ELPKKLKFIKTSVFNGCIQLEYVNIPESV

SEQ ID NO: 2933669 - protein, 23 aa, Entamoeba invadens
ELPKKRLFRNYDVTITRSKTQKQ

SEQ ID NO: 2933670 - protein, 27 aa, Entamoeba invadens
ELPKSICSLGAFTFAECCNLKIVKLPR

SEQ ID NO: 2933671 - protein, 23 aa, Entamoeba invadens
ELPKSLVSVGWRCFSDCSSLSAI

SEQ ID NO: 2933672 - protein, 24 aa, Entamoeba invadens
ELPMMPPFACKHGPNQILEFTGNG

SEQ ID NO: 2933673 - protein, 21 aa, Entamoeba invadens
ELPNPLIPFNCYTSFIQIGKL

SEQ ID NO: 2933674 - protein, 20 aa, Entamoeba invadens
ELPPKRKSSSTNRPIVNVTI

SEQ ID NO: 2933675 - protein, 24 aa, Entamoeba invadens
ELPQSLKSIENWAFTECGITKIDI

SEQ ID NO: 2933676 - protein, 18 aa, Entamoeba invadens
ELPRKCFKKCFKLEIIEL

SEQ ID NO: 2933677 - protein, 23 aa, Entamoeba invadens
ELPSLRSKKIYTFLEIVESSLNE

SEQ ID NO: 2933678 - protein, 19 aa, Entamoeba invadens
ELPSNIIKLVLAYIDCEVV

SEQ ID NO: 2933679 - protein, 20 aa, Entamoeba invadens
ELPTDLLRVLRIVNLSLVEA

SEQ ID NO: 2933680 - protein, 23 aa, Entamoeba invadens
ELPYRNSSGLKEFVVINRDGVGK

SEQ ID NO: 2933681 - protein, 28 aa, Entamoeba invadens
ELQCRSNVFEMVFARNFCKINDVAANDK

SEQ ID NO: 2933682 - protein, 26 aa, Entamoeba invadens
ELQELFPYVDADTIKSVLIDCNYDKN

SEQ ID NO: 2933683 - protein, 19 aa, Entamoeba invadens
ELQFAKKLLETLKLKVSGS

SEQ ID NO: 2933684 - protein, 19 aa, Entamoeba invadens
ELQIPLNPLKGFEKELPGG

SEQ ID NO: 2933685 - protein, 23 aa, Entamoeba invadens
ELQKKLDNEFAIFEQKKAQKLER

SEQ ID NO: 2933686 - protein, 24 aa, Entamoeba invadens
ELQKKSVSMLYALIKKDYVFNKSS

SEQ ID NO: 2933687 - protein, 22 aa, Entamoeba invadens
ELQKRLFTRYPFLHDENPTILY

SEQ ID NO: 2933688 - protein, 20 aa, Entamoeba invadens
ELQKRLVGVPDTFTLSVGSR

SEQ ID NO: 2933689 - protein, 20 aa, Entamoeba invadens
ELQKSCFIFCTSLKKIILPT

SEQ ID NO: 2933690 - protein, 22 aa, Entamoeba invadens
ELQLPILDCRALQVQGKFGNGK

SEQ ID NO: 2933691 - protein, 21 aa, Entamoeba invadens
ELQMEKAQICEELSKTSNVLK

SEQ ID NO: 2933692 - protein, 25 aa, Entamoeba invadens
ELQNEFLMDYSLYFLAFEIENLIRI

SEQ ID NO: 2933693 - protein, 32 aa, Entamoeba invadens
ELQNLFKRRELLKIAFKLGKRVIEELDIANND

SEQ ID NO: 2933694 - protein, 25 aa, Entamoeba invadens
ELQQRAIEFSQFFNYNELRMDAMNR

SEQ ID NO: 2933695 - protein, 25 aa, Entamoeba invadens
ELRAYNCIIKRGWERLERSKGAFEG

SEQ ID NO: 2933696 - protein, 25 aa, Entamoeba invadens
ELRAYNCIIKRGWERLERSKSCLEG

SEQ ID NO: 2933697 - protein, 24 aa, Entamoeba invadens
ELREFLVGMAVCYGADEFLYALPR

SEQ ID NO: 2933698 - protein, 19 aa, Entamoeba invadens
ELRELLANVVFSMRSERKG

SEQ ID NO: 2933699 - protein, 24 aa, Entamoeba invadens
ELREMKKQKDALILQRDMIKNRLE

SEQ ID NO: 2933700 - protein, 18 aa, Entamoeba invadens
ELRFQNERLRAMKIDECQ

SEQ ID NO: 2933701 - protein, 19 aa, Entamoeba invadens
ELRHLPRIHRIAAPTNVAR

SEQ ID NO: 2933702 - protein, 20 aa, Entamoeba invadens
ELRKGVAKPTAFRRYEKNKR

SEQ ID NO: 2933703 - protein, 26 aa, Entamoeba invadens
ELRKKCPNCVVLDGTIYVHGFIESPG

SEQ ID NO: 2933704 - protein, 26 aa, Entamoeba invadens
ELRKRKRQAFNFKFIRDGSSSVDDST

SEQ ID NO: 2933705 - protein, 19 aa, Entamoeba invadens
ELRLKLSSIDCFCATDDVL

SEQ ID NO: 2933706 - protein, 22 aa, Entamoeba invadens
ELRNKITRMCYVFAKDNPLKNY

SEQ ID NO: 2933707 - protein, 19 aa, Entamoeba invadens
ELRQCGNEAYSIGVIANTA

SEQ ID NO: 2933708 - protein, 24 aa, Entamoeba invadens
ELRRKNCPQEWAVLIQDNCVSHIK

SEQ ID NO: 2933709 - protein, 21 aa, Entamoeba invadens
ELRRSTLCCHVLCQACLNTKH

SEQ ID NO: 2933710 - protein, 19 aa, Entamoeba invadens
ELSCVKVREIIREKCAVYT

SEQ ID NO: 2933711 - protein, 19 aa, Entamoeba invadens
ELSDEVFQYIASVADGDGR

SEQ ID NO: 2933712 - protein, 17 aa, Entamoeba invadens
ELSDFPIEAFRPTRNIH

SEQ ID NO: 2933713 - protein, 17 aa, Entamoeba invadens
ELSDIAWNFMLDFQENT

SEQ ID NO: 2933714 - protein, 24 aa, Entamoeba invadens
ELSETDFRCSVILRSTLPPAKIVE

SEQ ID NO: 2933715 - protein, 23 aa, Entamoeba invadens
ELSEVRKTLPVYKKRDEFLKLLR

SEQ ID NO: 2933716 - protein, 20 aa, Entamoeba invadens
ELSIKMGEMQSMTDEIKKKE

SEQ ID NO: 2933717 - protein, 24 aa, Entamoeba invadens
ELSNMLSLKILRIGYNKLSGNIDV

SEQ ID NO: 2933718 - protein, 25 aa, Entamoeba invadens
ELSPELRKRLILFDCEDPNTCSDGL

SEQ ID NO: 2933719 - protein, 28 aa, Entamoeba invadens
ELSPFYLKMDFLQRVALTLGNSNEYLLK

SEQ ID NO: 2933720 - protein, 18 aa, Entamoeba invadens
ELSPTVFECCNNLKDVNF

SEQ ID NO: 2933721 - protein, 21 aa, Entamoeba invadens
ELSQFPPFLIEILKHEEYTNS

SEQ ID NO: 2933722 - protein, 19 aa, Entamoeba invadens
ELSQNVVVCQFEYEAENET

SEQ ID NO: 2933723 - protein, 17 aa, Entamoeba invadens
ELSSLKVSYDGKQNESP

SEQ ID NO: 2933724 - protein, 24 aa, Entamoeba invadens
ELSTRLDMSLIIPALDEYVKESII

SEQ ID NO: 2933725 - protein, 21 aa, Entamoeba invadens
ELSVVLKLERNEVIKAEVVKK

SEQ ID NO: 2933726 - protein, 18 aa, Entamoeba invadens
ELTAKFAFEALKLPSTDA

SEQ ID NO: 2933727 - protein, 24 aa, Entamoeba invadens
ELTDLKATFLNESIKTKELEQQLV

SEQ ID NO: 2933728 - protein, 18 aa, Entamoeba invadens
ELTEETGFIGERVLRMTS

SEQ ID NO: 2933729 - protein, 18 aa, Entamoeba invadens
ELTGRWGVLEQQMLTEEQ

SEQ ID NO: 2933730 - protein, 20 aa, Entamoeba invadens
ELTGVITRREQEVAEANEEF

SEQ ID NO: 2933731 - protein, 25 aa, Entamoeba invadens
ELTIPRETFQFIQRKFITSEDPTLL

SEQ ID NO: 2933732 - protein, 30 aa, Entamoeba invadens
ELTIYRNFARFGAIESANCLFEPNTTVCRG

SEQ ID NO: 2933733 - protein, 18 aa, Entamoeba invadens
ELTKILVMVSHPQTLEYC

SEQ ID NO: 2933734 - protein, 21 aa, Entamoeba invadens
ELTKKFTATKVFDITKLSPRA

SEQ ID NO: 2933735 - protein, 30 aa, Entamoeba invadens
ELTMIMLDFIKRGMKHLGVLLSGYFLYHKN

SEQ ID NO: 2933736 - protein, 19 aa, Entamoeba invadens
ELTNNVCKLDEKITKLEQQ

SEQ ID NO: 2933737 - protein, 25 aa, Entamoeba invadens
ELTQFSQFFFKPILPAVSENLLQIC

SEQ ID NO: 2933738 - protein, 21 aa, Entamoeba invadens
ELTVGSDLMYFQIRPNGKKGR

SEQ ID NO: 2933739 - protein, 32 aa, Entamoeba invadens
ELVACQKAGFVLPNLRLFRADVSNVYIKNIES

SEQ ID NO: 2933740 - protein, 17 aa, Entamoeba invadens
ELVCKGPNVSGGYTTEE

SEQ ID NO: 2933741 - protein, 17 aa, Entamoeba invadens
ELVCKKCRFNLDKFHFN

SEQ ID NO: 2933742 - protein, 20 aa, Entamoeba invadens
ELVDLTRIEGVKGRRARELY

SEQ ID NO: 2933743 - protein, 18 aa, Entamoeba invadens
ELVDTAAAIGISREPILV

SEQ ID NO: 2933744 - protein, 17 aa, Entamoeba invadens
ELVELDLSFNKIDDFSP

SEQ ID NO: 2933745 - protein, 25 aa, Entamoeba invadens
ELVELGEALSSICFEITEVTKKLVS

SEQ ID NO: 2933746 - protein, 30 aa, Entamoeba invadens
ELVEYPLLHPEIYKHVGIDPPRGILLHGPP

SEQ ID NO: 2933747 - protein, 20 aa, Entamoeba invadens
ELVIAFVTLVGRFYRNPNFS

SEQ ID NO: 2933748 - protein, 25 aa, Entamoeba invadens
ELVKHMNCIVCPRGCPIEVKIDTKT

SEQ ID NO: 2933749 - protein, 26 aa, Entamoeba invadens
ELVKRAGEILPTFPWPKEFEKSVFES

SEQ ID NO: 2933750 - protein, 22 aa, Entamoeba invadens
ELVKRLVSRRVVVNARNDLGET

SEQ ID NO: 2933751 - protein, 24 aa, Entamoeba invadens
ELVLWEEQLFKLKGDLDKRQLEIE

SEQ ID NO: 2933752 - protein, 20 aa, Entamoeba invadens
ELVNLSWSYTDYKAVTVNFD

SEQ ID NO: 2933753 - protein, 20 aa, Entamoeba invadens
ELVNYKFLLTSVIFGNPNRQ

SEQ ID NO: 2933754 - protein, 21 aa, Entamoeba invadens
ELVPFPLSTVYSGGIYNCHGV

SEQ ID NO: 2933755 - protein, 17 aa, Entamoeba invadens
ELVRCTFDNKSLQLVVN

SEQ ID NO: 2933756 - protein, 19 aa, Entamoeba invadens
ELVRVAVLWHESWHEALEE

SEQ ID NO: 2933757 - protein, 20 aa, Entamoeba invadens
ELVRVAVLWHESWHESLEEA

SEQ ID NO: 2933758 - protein, 24 aa, Entamoeba invadens
ELVSAGYILRHMKYLVKTLSDTSI

SEQ ID NO: 2933759 - protein, 21 aa, Entamoeba invadens
ELVSLNSVWFISTLIKVTTNV

SEQ ID NO: 2933760 - protein, 25 aa, Entamoeba invadens
ELWPESYRYICYVLYNETKKLNIIK

SEQ ID NO: 2933761 - protein, 25 aa, Entamoeba invadens
ELYARCLAEGFQLPLLNDTNFIINA

SEQ ID NO: 2933762 - protein, 21 aa, Entamoeba invadens
ELYCPKCKKYIHLPPNAPDIL

SEQ ID NO: 2933763 - protein, 18 aa, Entamoeba invadens
ELYELCMKYCGASQQEQR

SEQ ID NO: 2933764 - protein, 27 aa, Entamoeba invadens
ELYIKLSKYLCCFGPVTSWHDGNNKVP

SEQ ID NO: 2933765 - protein, 20 aa, Entamoeba invadens
ELYMDVCAVTPSVYSLNTSP

SEQ ID NO: 2933766 - protein, 22 aa, Entamoeba invadens
ELYNLNKLRIMHGVVVDIINYQ

SEQ ID NO: 2933767 - protein, 27 aa, Entamoeba invadens
ELYNSLLHRVRCFVFRYPSISVENLCK

SEQ ID NO: 2933768 - protein, 25 aa, Entamoeba invadens
ELYRDFPLAHVLRDSVFIVHGGLPE

SEQ ID NO: 2933769 - protein, 23 aa, Entamoeba invadens
ELYSLGVCLYRLAASKYPFGATK

SEQ ID NO: 2933770 - protein, 24 aa, Entamoeba invadens
ELYSSIPEISVLNGPKFSPTSNPL

SEQ ID NO: 2933771 - protein, 19 aa, Entamoeba invadens
ELYSSVMSLMVPKLKAAVD

SEQ ID NO: 2933772 - protein, 18 aa, Entamoeba invadens
ELYSVYKKPYIDLELLDS

SEQ ID NO: 2933773 - protein, 18 aa, Entamoeba invadens
EMAELIKAIAALPSPADD

SEQ ID NO: 2933774 - protein, 22 aa, Entamoeba invadens
EMAELYPPYYNIYPMKVLMLIH

SEQ ID NO: 2933775 - protein, 18 aa, Entamoeba invadens
EMAFLKCVTDIFTNFGDI

SEQ ID NO: 2933776 - protein, 25 aa, Entamoeba invadens
EMANCELHMVFYLISVLKIEIDVSE

SEQ ID NO: 2933777 - protein, 24 aa, Entamoeba invadens
EMANFKRMRMLNLNTADMLEKITQ

SEQ ID NO: 2933778 - protein, 32 aa, Entamoeba invadens
EMAQMQFQYGMQLCFVSEKFYFTDNVDTSKLV

SEQ ID NO: 2933779 - protein, 19 aa, Entamoeba invadens
EMCDLRFFESGLSTKEIPK

SEQ ID NO: 2933780 - protein, 19 aa, Entamoeba invadens
EMCICPEMNNFFFPEHLGV

SEQ ID NO: 2933781 - protein, 24 aa, Entamoeba invadens
EMCPGEVPPGIISLLGRSDGAFKP

SEQ ID NO: 2933782 - protein, 23 aa, Entamoeba invadens
EMDKEIARRVSFILEDKTKVYKR

SEQ ID NO: 2933783 - protein, 21 aa, Entamoeba invadens
EMDNGIRLVVPILGKENIIIT

SEQ ID NO: 2933784 - protein, 23 aa, Entamoeba invadens
EMDNGIRLVVPILGKENIIITLL

SEQ ID NO: 2933785 - protein, 24 aa, Entamoeba invadens
EMDNRPASALPLKISAAKLEALTG

SEQ ID NO: 2933786 - protein, 18 aa, Entamoeba invadens
EMDRRVSFDEGQQMANDL

SEQ ID NO: 2933787 - protein, 18 aa, Entamoeba invadens
EMDTRRTLDYKFCEGKAD

SEQ ID NO: 2933788 - protein, 26 aa, Entamoeba invadens
EMEEWKIPPCISNWKNKNGYTIALDK

SEQ ID NO: 2933789 - protein, 18 aa, Entamoeba invadens
EMEGVVFVLERLVFADSE

SEQ ID NO: 2933790 - protein, 29 aa, Entamoeba invadens
EMEITDLKSKRMEDEKMLKEKDVETQQLY

SEQ ID NO: 2933791 - protein, 32 aa, Entamoeba invadens
EMEKEKKCDVWPRLVHLYHYFGEKYTTFLDVQ

SEQ ID NO: 2933792 - protein, 22 aa, Entamoeba invadens
EMEKLPDIFGSILPANMSSALN

SEQ ID NO: 2933793 - protein, 26 aa, Entamoeba invadens
EMELEFVMCNLIFKGIMKSQLYHEHK

SEQ ID NO: 2933794 - protein, 23 aa, Entamoeba invadens
EMELRKLVCMYIVSHSEKDPTNA

SEQ ID NO: 2933795 - protein, 23 aa, Entamoeba invadens
EMERCFSRMQILVGRHTTDTSND

SEQ ID NO: 2933796 - protein, 19 aa, Entamoeba invadens
EMESLSLEEFCKLRNLEVP

SEQ ID NO: 2933797 - protein, 20 aa, Entamoeba invadens
EMETLECLDAMLSARSCIAL

SEQ ID NO: 2933798 - protein, 17 aa, Entamoeba invadens
EMFCYKGVPITVNDFQR

SEQ ID NO: 2933799 - protein, 25 aa, Entamoeba invadens
EMFGECGKQLLGEDYFEIIKGILQN

SEQ ID NO: 2933800 - protein, 19 aa, Entamoeba invadens
EMFGGAVVKKDVKVFDDSV

SEQ ID NO: 2933801 - protein, 19 aa, Entamoeba invadens
EMFKCIVESEIIPDSIARN

SEQ ID NO: 2933802 - protein, 20 aa, Entamoeba invadens
EMFLKSVAPLISIGVSNEAK

SEQ ID NO: 2933803 - protein, 20 aa, Entamoeba invadens
EMFQTLSILFFSTFSYNGGS

SEQ ID NO: 2933804 - protein, 24 aa, Entamoeba invadens
EMGDAGLVQWLIKLSDFTIFARKE

SEQ ID NO: 2933805 - protein, 24 aa, Entamoeba invadens
EMGFPDYISIFALKKFNWDINECI

SEQ ID NO: 2933806 - protein, 18 aa, Entamoeba invadens
EMGGKWGTLLKGIGESSE

SEQ ID NO: 2933807 - protein, 19 aa, Entamoeba invadens
EMGLAQAMGRIIKFLPKQR

SEQ ID NO: 2933808 - protein, 18 aa, Entamoeba invadens
EMGYKNKELFSLDKEDDR

SEQ ID NO: 2933809 - protein, 23 aa, Entamoeba invadens
EMGYWEILKKVDFEKEAKMSKEE

SEQ ID NO: 2933810 - protein, 17 aa, Entamoeba invadens
EMHRLLARWPLLQPEEA

SEQ ID NO: 2933811 - protein, 30 aa, Entamoeba invadens
EMIDLKCKIQAIRFLTVWISNFSNEIKKSD

SEQ ID NO: 2933812 - protein, 23 aa, Entamoeba invadens
EMIERLKALIGVPGILPIVESTF

SEQ ID NO: 2933813 - protein, 23 aa, Entamoeba invadens
EMIIKLGEAIWTYCSNKFNEEQR

SEQ ID NO: 2933814 - protein, 19 aa, Entamoeba invadens
EMIKLAAEFNDEMVQLNRA

SEQ ID NO: 2933815 - protein, 26 aa, Entamoeba invadens
EMIKNLKILKSFSFQNQNFFTSQFWA

SEQ ID NO: 2933816 - protein, 18 aa, Entamoeba invadens
EMIVGVPPFSCHDPQGIF

SEQ ID NO: 2933817 - protein, 22 aa, Entamoeba invadens
EMKEHKEKIITLNTKIAENEKQ

SEQ ID NO: 2933818 - protein, 22 aa, Entamoeba invadens
EMKEIRSKFDLGKDYDPEGFTD

SEQ ID NO: 2933819 - protein, 23 aa, Entamoeba invadens
EMKEKRPKLSRFTGSESASGSET

SEQ ID NO: 2933820 - protein, 22 aa, Entamoeba invadens
EMKEYNLGFEMMKVIDSVLETK

SEQ ID NO: 2933821 - protein, 30 aa, Entamoeba invadens
EMKGKSAFVKNDWKHFVFMFEGKNQIGTKF

SEQ ID NO: 2933822 - protein, 24 aa, Entamoeba invadens
EMKGKYRLERMVVAFLEVQKKSVI

SEQ ID NO: 2933823 - protein, 26 aa, Entamoeba invadens
EMKGPEDLIAIGMSFGLTRSQAHDSI

SEQ ID NO: 2933824 - protein, 22 aa, Entamoeba invadens
EMKILLKSVSSFFRKFCNDVNE

SEQ ID NO: 2933825 - protein, 20 aa, Entamoeba invadens
EMKKAGCVRTLVDMNLNEKE

SEQ ID NO: 2933826 - protein, 20 aa, Entamoeba invadens
EMKKTMFAGQTFQVATSFGV

SEQ ID NO: 2933827 - protein, 20 aa, Entamoeba invadens
EMKLKNEIIKGIQKEIKTES

SEQ ID NO: 2933828 - protein, 21 aa, Entamoeba invadens
EMKNWKFVIQICQNVIDKIDC

SEQ ID NO: 2933829 - protein, 21 aa, Entamoeba invadens
EMKPHKSGVIGLDTFDDNKFG

SEQ ID NO: 2933830 - protein, 20 aa, Entamoeba invadens
EMKTLYRTREEVIQYRDTPT

SEQ ID NO: 2933831 - protein, 19 aa, Entamoeba invadens
EMKVFKHLDTFKVHFRELE

SEQ ID NO: 2933832 - protein, 21 aa, Entamoeba invadens
EMKVPPGVKEIYCVVSVGQQA

SEQ ID NO: 2933833 - protein, 20 aa, Entamoeba invadens
EMKYIVLNIVNFIVTNREGR

SEQ ID NO: 2933834 - protein, 23 aa, Entamoeba invadens
EMLAHRLGLIPIYADPRKFQFAP

SEQ ID NO: 2933835 - protein, 18 aa, Entamoeba invadens
EMLEEIIKEYSELKRTTI

SEQ ID NO: 2933836 - protein, 25 aa, Entamoeba invadens
EMLFIFCSPSFKKTKAFYNFQREFE

SEQ ID NO: 2933837 - protein, 26 aa, Entamoeba invadens
EMLNEAKGWWGGLSFSEIYSTISDLT

SEQ ID NO: 2933838 - protein, 24 aa, Entamoeba invadens
EMLREGKLLYTLCKDLSIEIYKKA

SEQ ID NO: 2933839 - protein, 24 aa, Entamoeba invadens
EMLSDFRIWISFSATLQKYVLAKV

SEQ ID NO: 2933840 - protein, 21 aa, Entamoeba invadens
EMLTKLTALDLFQCFYHAGVS

SEQ ID NO: 2933841 - protein, 20 aa, Entamoeba invadens
EMMDMCMKLLDEMEEQTRTE

SEQ ID NO: 2933842 - protein, 35 aa, Entamoeba invadens
EMMEDEHYCALAFNGDEHKNFFGIFDGYSGVQAAF

SEQ ID NO: 2933843 - protein, 26 aa, Entamoeba invadens
EMMIYGVVCAILYSRIRKIQSDITSL

SEQ ID NO: 2933844 - protein, 23 aa, Entamoeba invadens
EMMQELMVLFIHRLEKGGLVEFT

SEQ ID NO: 2933845 - protein, 23 aa, Entamoeba invadens
EMNFKNLAVCLAPTLMTMSKDES

SEQ ID NO: 2933846 - protein, 24 aa, Entamoeba invadens
EMNGSWKKATLDISKKGKLYIEYK

SEQ ID NO: 2933847 - protein, 18 aa, Entamoeba invadens
EMNKRKCEVEEEIEELEE

SEQ ID NO: 2933848 - protein, 19 aa, Entamoeba invadens
EMNNFFFPEHLGVPLSQRK

SEQ ID NO: 2933849 - protein, 18 aa, Entamoeba invadens
EMNRGGVMNYLYSFNESY

SEQ ID NO: 2933850 - protein, 29 aa, Entamoeba invadens
EMNYLIKYPFMISNMLPRVVNVSIEKNSM

SEQ ID NO: 2933851 - protein, 17 aa, Entamoeba invadens
EMNYVVAELNCFERILK

SEQ ID NO: 2933852 - protein, 18 aa, Entamoeba invadens
EMPAFKLVVRDLTATANE

SEQ ID NO: 2933853 - protein, 20 aa, Entamoeba invadens
EMPCDVVANVYKRFLRNIPG

SEQ ID NO: 2933854 - protein, 19 aa, Entamoeba invadens
EMPDCCIKFLKTFTDQWST

SEQ ID NO: 2933855 - protein, 26 aa, Entamoeba invadens
EMPILVRMAINLVNSFYSTFLRIINK

SEQ ID NO: 2933856 - protein, 22 aa, Entamoeba invadens
EMPKILLDFAHEIFMKVPGEVD

SEQ ID NO: 2933857 - protein, 23 aa, Entamoeba invadens
EMPKLKRLSIGYTEVKTSMVSKL

SEQ ID NO: 2933858 - protein, 21 aa, Entamoeba invadens
EMPKVGKVCKTVVLEKNEEND

SEQ ID NO: 2933859 - protein, 28 aa, Entamoeba invadens
EMPNSLKIVEGFAFVGCENLEELLFTEE

SEQ ID NO: 2933860 - protein, 17 aa, Entamoeba invadens
EMPRKGAAIELAKKEAV

SEQ ID NO: 2933861 - protein, 27 aa, Entamoeba invadens
EMPSFDGACMFSALSLFQSHSVLSKSY

SEQ ID NO: 2933862 - protein, 21 aa, Entamoeba invadens
EMQENVELSAKREHILSKVTE

SEQ ID NO: 2933863 - protein, 23 aa, Entamoeba invadens
EMQGHIVELLFPRGCETKNAIDF

SEQ ID NO: 2933864 - protein, 29 aa, Entamoeba invadens
EMQRKEMREEFKPKIEVVKKEKVDPTCYT

SEQ ID NO: 2933865 - protein, 21 aa, Entamoeba invadens
EMQSFKMAINVVEKNTLETLK

SEQ ID NO: 2933866 - protein, 19 aa, Entamoeba invadens
EMQSGFFIKGEDVLTSVEL

SEQ ID NO: 2933867 - protein, 27 aa, Entamoeba invadens
EMREKQCGPAITSCCPAWIELLEKEYP

SEQ ID NO: 2933868 - protein, 17 aa, Entamoeba invadens
EMRELIKRRDEVFKERK

SEQ ID NO: 2933869 - protein, 23 aa, Entamoeba invadens
EMRKLNNFEGMKAVYSALMSTPI

SEQ ID NO: 2933870 - protein, 24 aa, Entamoeba invadens
EMRLMKIALGWVVPDVFDESGYLD

SEQ ID NO: 2933871 - protein, 27 aa, Entamoeba invadens
EMRLNEIRGGMEIEKRAKIARNYIEQM

SEQ ID NO: 2933872 - protein, 23 aa, Entamoeba invadens
EMRRLNNFEGMKAVFGALGSFPI

SEQ ID NO: 2933873 - protein, 26 aa, Entamoeba invadens
EMSAKSCGVVYGMLKQLEKFRECKKE

SEQ ID NO: 2933874 - protein, 23 aa, Entamoeba invadens
EMSEQRLLGVINLFTGFIYDDST

SEQ ID NO: 2933875 - protein, 23 aa, Entamoeba invadens
EMSESLSKCGLRRVEEIDAMLDI

SEQ ID NO: 2933876 - protein, 22 aa, Entamoeba invadens
EMSGILKCCLYLLQDENNRKNF

SEQ ID NO: 2933877 - protein, 24 aa, Entamoeba invadens
EMSKDLDGKVFRTTKIKLVCIDDC

SEQ ID NO: 2933878 - protein, 19 aa, Entamoeba invadens
EMSMLGGRVHQAFVNGVST

SEQ ID NO: 2933879 - protein, 26 aa, Entamoeba invadens
EMSNVKLPNWSIVWAKQKGYPWWPAK

SEQ ID NO: 2933880 - protein, 19 aa, Entamoeba invadens
EMSSMEFLEKITLLENLYD

SEQ ID NO: 2933881 - protein, 21 aa, Entamoeba invadens
EMSVVSGFLSSLVESVINKLV

SEQ ID NO: 2933882 - protein, 19 aa, Entamoeba invadens
EMTFLLFRDEDMLIFGNRN

SEQ ID NO: 2933883 - protein, 26 aa, Entamoeba invadens
EMTKEQIEFWGFLGAVKVFYEKHNRT

SEQ ID NO: 2933884 - protein, 24 aa, Entamoeba invadens
EMTKIRGGIEYDQKEFLVIVKHGD

SEQ ID NO: 2933885 - protein, 29 aa, Entamoeba invadens
EMTLKCYTLEMAVFLFGIKFVDFPDSIKE

SEQ ID NO: 2933886 - protein, 20 aa, Entamoeba invadens
EMTNTVFAVMSFRESTPENV

SEQ ID NO: 2933887 - protein, 26 aa, Entamoeba invadens
EMTRCGVLLLQHFECDGGILQVEDNV

SEQ ID NO: 2933888 - protein, 25 aa, Entamoeba invadens
EMTYKNGFEELLFVLKRKSYWNNKD

SEQ ID NO: 2933889 - protein, 17 aa, Entamoeba invadens
EMVCGGGAVEMEIAKEL

SEQ ID NO: 2933890 - protein, 23 aa, Entamoeba invadens
EMVDIFKLLLLVTNYKSLLEEKK

SEQ ID NO: 2933891 - protein, 22 aa, Entamoeba invadens
EMVHSGRFPKYFHLDFSENRMQ

SEQ ID NO: 2933892 - protein, 28 aa, Entamoeba invadens
EMVKALFYTKVRLVLILSGLDDKILEEL

SEQ ID NO: 2933893 - protein, 18 aa, Entamoeba invadens
EMVKMCLTVLTKKTEASR

SEQ ID NO: 2933894 - protein, 30 aa, Entamoeba invadens
EMVLQMTELFDRWALLKVAREKLVNGVIEL

SEQ ID NO: 2933895 - protein, 26 aa, Entamoeba invadens
EMVLSYLRCELMLLHTQAPYSQILKI

SEQ ID NO: 2933896 - protein, 23 aa, Entamoeba invadens
EMVNCKWLEVLYLIRTKVSDKAI

SEQ ID NO: 2933897 - protein, 23 aa, Entamoeba invadens
EMVPLIVQCRTALIALLADLHVE

SEQ ID NO: 2933898 - protein, 24 aa, Entamoeba invadens
EMVQTAWGVFFSRLEKSIKKCSDM

SEQ ID NO: 2933899 - protein, 22 aa, Entamoeba invadens
EMVSCFVKAMACTDNQISTNVI

SEQ ID NO: 2933900 - protein, 17 aa, Entamoeba invadens
EMWHKDFTCEQAKSLQR

SEQ ID NO: 2933901 - protein, 25 aa, Entamoeba invadens
EMWKEKDELLRLGEDSHLIQTRTTL

SEQ ID NO: 2933902 - protein, 29 aa, Entamoeba invadens
EMYACLKNDYIVKYFCSFKDTSLGIETIN

SEQ ID NO: 2933903 - protein, 22 aa, Entamoeba invadens
EMYCKRLAPPLVSIVLSNSSKH

SEQ ID NO: 2933904 - protein, 24 aa, Entamoeba invadens
EMYLKTKLAMCKILYAQCGGKGKF

SEQ ID NO: 2933905 - protein, 26 aa, Entamoeba invadens
ENACTRCVIKRPFLQRMTNDCCKSCT

SEQ ID NO: 2933906 - protein, 22 aa, Entamoeba invadens
ENADIPFLISLEEQDRLENLLN

SEQ ID NO: 2933907 - protein, 25 aa, Entamoeba invadens
ENAFKSCKSFENFVIPNTVVEFGMN

SEQ ID NO: 2933908 - protein, 21 aa, Entamoeba invadens
ENAFSCCDFLTKVVFSQKLKN

SEQ ID NO: 2933909 - protein, 24 aa, Entamoeba invadens
ENAHLPTTIKFVGERCFENCYSLK

SEQ ID NO: 2933910 - protein, 19 aa, Entamoeba invadens
ENAIICYVEDCCDGVTLSF

SEQ ID NO: 2933911 - protein, 24 aa, Entamoeba invadens
ENAKRKLEYMKMAMNKDPRFRKEV

SEQ ID NO: 2933912 - protein, 20 aa, Entamoeba invadens
ENAQRLVFCLKTVLENQSTP

SEQ ID NO: 2933913 - protein, 18 aa, Entamoeba invadens
ENAVKFKTILSVLKESKS

SEQ ID NO: 2933914 - protein, 19 aa, Entamoeba invadens
ENCDARSTLFVGVSNCTSC

SEQ ID NO: 2933915 - protein, 24 aa, Entamoeba invadens
ENCKEISDFAFFRCLSLTKIDIPK

SEQ ID NO: 2933916 - protein, 25 aa, Entamoeba invadens
ENCKTIIGGICIELGGAFDYENKEF

SEQ ID NO: 2933917 - protein, 23 aa, Entamoeba invadens
ENCPIIVRRVLRKVYDELSLKFP

SEQ ID NO: 2933918 - protein, 18 aa, Entamoeba invadens
ENCRECFDDFVMSLGNCY

SEQ ID NO: 2933919 - protein, 19 aa, Entamoeba invadens
ENDCIKYVLSKIMKLSYEQ

SEQ ID NO: 2933920 - protein, 26 aa, Entamoeba invadens
ENDCKRRIIFETAQPLPSILRRQIVF

SEQ ID NO: 2933921 - protein, 22 aa, Entamoeba invadens
ENDKIKFAFNIFDADEDGKISK

SEQ ID NO: 2933922 - protein, 26 aa, Entamoeba invadens
ENDLKISESLGFILEKFTPVNENEIE

SEQ ID NO: 2933923 - protein, 17 aa, Entamoeba invadens
ENDMAGAISNMNQKDKD

SEQ ID NO: 2933924 - protein, 25 aa, Entamoeba invadens
ENDTIRRCCLAINTSDYLGGRLEQL

SEQ ID NO: 2933925 - protein, 21 aa, Entamoeba invadens
ENDVAFWSEELFEVVNKALCR

SEQ ID NO: 2933926 - protein, 18 aa, Entamoeba invadens
ENEAFTFCLFNLPFYFNP

SEQ ID NO: 2933927 - protein, 17 aa, Entamoeba invadens
ENECVHVPPIIKSKLAF

SEQ ID NO: 2933928 - protein, 23 aa, Entamoeba invadens
ENECYRTHMRWIVNNFGITESKR

SEQ ID NO: 2933929 - protein, 20 aa, Entamoeba invadens
ENEFKKWLGDKAPRVVAIAS

SEQ ID NO: 2933930 - protein, 23 aa, Entamoeba invadens
ENEIISRVALIPKIFSYAHIVVE

SEQ ID NO: 2933931 - protein, 18 aa, Entamoeba invadens
ENEISFFFTFPRNQMNSS

SEQ ID NO: 2933932 - protein, 18 aa, Entamoeba invadens
ENEKAFIECCSSVVADII

SEQ ID NO: 2933933 - protein, 24 aa, Entamoeba invadens
ENEKEIFERLGIEVLNVMKSKCVN

SEQ ID NO: 2933934 - protein, 18 aa, Entamoeba invadens
ENEKFLATANAEFEEMEK

SEQ ID NO: 2933935 - protein, 19 aa, Entamoeba invadens
ENEKFPGFIEAVGVQSPGL

SEQ ID NO: 2933936 - protein, 18 aa, Entamoeba invadens
ENEKLCGEIETLKDELFL

SEQ ID NO: 2933937 - protein, 40 aa, Entamoeba invadens
ENEKLIGGVFYDFFPRKGKRGGACQEIVWRDYVKKNGTKR

SEQ ID NO: 2933938 - protein, 17 aa, Entamoeba invadens
ENEKYCRKVAWDAQSRL

SEQ ID NO: 2933939 - protein, 25 aa, Entamoeba invadens
ENELKEKKEEIVVCTKDIQEKEKHL

SEQ ID NO: 2933940 - protein, 17 aa, Entamoeba invadens
ENEPEIFARFKALEEEV

SEQ ID NO: 2933941 - protein, 34 aa, Entamoeba invadens
ENEPFWLNVYHIMLLHGLMYWKHRPNVEFKDMMS

SEQ ID NO: 2933942 - protein, 24 aa, Entamoeba invadens
ENESIKAGLTFSFAVNQEAINKGE

SEQ ID NO: 2933943 - protein, 17 aa, Entamoeba invadens
ENEVPKPLFGFNQEQPQ

SEQ ID NO: 2933944 - protein, 17 aa, Entamoeba invadens
ENEVSMLDKFRCEYIVH

SEQ ID NO: 2933945 - protein, 20 aa, Entamoeba invadens
ENEYFWSYKNYGAFKTQKKQ

SEQ ID NO: 2933946 - protein, 23 aa, Entamoeba invadens
ENFAYWHSWALVNFEVVNFIENG

SEQ ID NO: 2933947 - protein, 26 aa, Entamoeba invadens
ENFDRRPICELSKWLESITMKNELIL

SEQ ID NO: 2933948 - protein, 26 aa, Entamoeba invadens
ENFESCVVTGFGFRPKPILEQIERVF

SEQ ID NO: 2933949 - protein, 17 aa, Entamoeba invadens
ENFETFISFVFDTFNVV

SEQ ID NO: 2933950 - protein, 23 aa, Entamoeba invadens
ENFFCRVIWYEVDFAHYCNTDKK

SEQ ID NO: 2933951 - protein, 17 aa, Entamoeba invadens
ENFGNGFLIKFNKNHVY

SEQ ID NO: 2933952 - protein, 24 aa, Entamoeba invadens
ENFGNTCKLLFAPIQTVVLQLYQA

SEQ ID NO: 2933953 - protein, 20 aa, Entamoeba invadens
ENFIRENLLIARNLHQNEIA

SEQ ID NO: 2933954 - protein, 18 aa, Entamoeba invadens
ENFKDQFVLLKIITFLYC

SEQ ID NO: 2933955 - protein, 19 aa, Entamoeba invadens
ENFKLCYLKIGPNGNCYSW

SEQ ID NO: 2933956 - protein, 23 aa, Entamoeba invadens
ENFLLKKHEPYPIVKMTDFGFGR

SEQ ID NO: 2933957 - protein, 26 aa, Entamoeba invadens
ENFLPKCCFTCCSMLENIKFPTLLKT

SEQ ID NO: 2933958 - protein, 20 aa, Entamoeba invadens
ENFPTTGILQIFIFPDDCYG

SEQ ID NO: 2933959 - protein, 17 aa, Entamoeba invadens
ENFPTTGILQIFMFPNY

SEQ ID NO: 2933960 - protein, 17 aa, Entamoeba invadens
ENFTLEIILPFEVPYIF

SEQ ID NO: 2933961 - protein, 18 aa, Entamoeba invadens
ENGFLCSLILRHPLPVLV

SEQ ID NO: 2933962 - protein, 24 aa, Entamoeba invadens
ENGFVYRIYYHIGKKEPLTVQRFT

SEQ ID NO: 2933963 - protein, 20 aa, Entamoeba invadens
ENGGGLFASCSMKENTMPGI

SEQ ID NO: 2933964 - protein, 18 aa, Entamoeba invadens
ENGGLMVEHVVAFVSYVQ

SEQ ID NO: 2933965 - protein, 24 aa, Entamoeba invadens
ENGIRKLDLEYGDFPDDGYDYSKH

SEQ ID NO: 2933966 - protein, 22 aa, Entamoeba invadens
ENGKLKTVELVDSFDKTKDDAL

SEQ ID NO: 2933967 - protein, 18 aa, Entamoeba invadens
ENGRGCIVDCSISQNKKP

SEQ ID NO: 2933968 - protein, 25 aa, Entamoeba invadens
ENGRLTKEMLFKAFFKLIDYDNDGV

SEQ ID NO: 2933969 - protein, 29 aa, Entamoeba invadens
ENHFARLVTCFPRMDAVWNNNLTLYKLSV

SEQ ID NO: 2933970 - protein, 27 aa, Entamoeba invadens
ENHFARLVTYFPRMDAVWNNNLTIYKL

SEQ ID NO: 2933971 - protein, 26 aa, Entamoeba invadens
ENHFYYQKCHGAFLLFDLHSENSFKR

SEQ ID NO: 2933972 - protein, 26 aa, Entamoeba invadens
ENHGDESYLRYCVKPLEKLLTNYKRI

SEQ ID NO: 2933973 - protein, 25 aa, Entamoeba invadens
ENHLKRKDVEILHPLKRVPLKDERV

SEQ ID NO: 2933974 - protein, 17 aa, Entamoeba invadens
ENICTNLGNGFNMRTFD

SEQ ID NO: 2933975 - protein, 18 aa, Entamoeba invadens
ENIDLAKWALFNIQDVKR

SEQ ID NO: 2933976 - protein, 25 aa, Entamoeba invadens
ENIEKRFALKHVKPPTVVEVNYDRP

SEQ ID NO: 2933977 - protein, 24 aa, Entamoeba invadens
ENIELKVFFDRTGIFSLNSGILRL

SEQ ID NO: 2933978 - protein, 23 aa, Entamoeba invadens
ENIEYIGSSAFQACEKLKTAVLQ

SEQ ID NO: 2933979 - protein, 23 aa, Entamoeba invadens
ENIFKIANACFSLASDGTGAIFR

SEQ ID NO: 2933980 - protein, 17 aa, Entamoeba invadens
ENIFKIEVEVVPNKDIT

SEQ ID NO: 2933981 - protein, 22 aa, Entamoeba invadens
ENIFRFVQCNFMTGENVKELFE

SEQ ID NO: 2933982 - protein, 17 aa, Entamoeba invadens
ENIFRLCLLQLPDVDIV

SEQ ID NO: 2933983 - protein, 20 aa, Entamoeba invadens
ENIICLRLFNTMVRNGFTRL

SEQ ID NO: 2933984 - protein, 17 aa, Entamoeba invadens
ENIISIGEYCFSKCVNL

SEQ ID NO: 2933985 - protein, 17 aa, Entamoeba invadens
ENIKETLFYTALDVNDE

SEQ ID NO: 2933986 - protein, 26 aa, Entamoeba invadens
ENIKKLLTSFGIEWVKSKILPSVISL

SEQ ID NO: 2933987 - protein, 21 aa, Entamoeba invadens
ENIKVLKKHLYALDQLSTNRD

SEQ ID NO: 2933988 - protein, 17 aa, Entamoeba invadens
ENILDLTIAYTLHGDLF

SEQ ID NO: 2933989 - protein, 23 aa, Entamoeba invadens
ENILEMIKPLLVSPQPQVLSSAI

SEQ ID NO: 2933990 - protein, 25 aa, Entamoeba invadens
ENIMRFSGIIDRMMRDYSREAIKKL

SEQ ID NO: 2933991 - protein, 18 aa, Entamoeba invadens
ENINIWKEFNDLIYKIEQ

SEQ ID NO: 2933992 - protein, 17 aa, Entamoeba invadens
ENIPLKTFKVGVKTFFM

SEQ ID NO: 2933993 - protein, 24 aa, Entamoeba invadens
ENIRLNKEHCLLREENRQLKYQNN

SEQ ID NO: 2933994 - protein, 25 aa, Entamoeba invadens
ENISVKFGCKFIMCVDRQPPFPTCK

SEQ ID NO: 2933995 - protein, 17 aa, Entamoeba invadens
ENITLRYGHYKEELKEL

SEQ ID NO: 2933996 - protein, 19 aa, Entamoeba invadens
ENIVGGYLYPMLSSSMQTT

SEQ ID NO: 2933997 - protein, 25 aa, Entamoeba invadens
ENIYAVRGFRNLYFLGAENEEQQHP

SEQ ID NO: 2933998 - protein, 23 aa, Entamoeba invadens
ENIYFRSCKEIDFDVLPETVKIL

SEQ ID NO: 2933999 - protein, 18 aa, Entamoeba invadens
ENKACALRSLQDKESVDE

SEQ ID NO: 2934000 - protein, 23 aa, Entamoeba invadens
ENKAKMRLEEAVKAIERHTFELE

SEQ ID NO: 2934001 - protein, 23 aa, Entamoeba invadens
ENKDIIKFWHFFRDLKDTNCVKG

SEQ ID NO: 2934002 - protein, 18 aa, Entamoeba invadens
ENKECLIKVETLEREVEV

SEQ ID NO: 2934003 - protein, 18 aa, Entamoeba invadens
ENKECLKKVELLEKEVEV

SEQ ID NO: 2934004 - protein, 26 aa, Entamoeba invadens
ENKEDRIALAKSLELAAREIPQVVEN

SEQ ID NO: 2934005 - protein, 28 aa, Entamoeba invadens
ENKEDVIFAFNFFKGIGMIELAKVLQQT

SEQ ID NO: 2934006 - protein, 23 aa, Entamoeba invadens
ENKEKLLNEQKVIFEERNAKLRK

SEQ ID NO: 2934007 - protein, 23 aa, Entamoeba invadens
ENKEMKVYAWGSVEQSPSVNNPA

SEQ ID NO: 2934008 - protein, 31 aa, Entamoeba invadens
ENKGVLKREFFRIIVWFNVDFETVDRNINRN

SEQ ID NO: 2934009 - protein, 21 aa, Entamoeba invadens
ENKIVICGKIAKIIEEENIKG

SEQ ID NO: 2934010 - protein, 36 aa, Entamoeba invadens
ENKKMFKWVYNRIVMVKLGIRIERTYGREIETFFCK

SEQ ID NO: 2934011 - protein, 24 aa, Entamoeba invadens
ENKKNEIEAILALTNNQLENNEKA

SEQ ID NO: 2934012 - protein, 24 aa, Entamoeba invadens
ENKRGKRFYCSIKNGVYGVYDTPN

SEQ ID NO: 2934013 - protein, 22 aa, Entamoeba invadens
ENKRSTGMACQWNMPLSRFTAM

SEQ ID NO: 2934014 - protein, 21 aa, Entamoeba invadens
ENKTDFALEFVVKNTQNSTSF

SEQ ID NO: 2934015 - protein, 35 aa, Entamoeba invadens
ENKTVCKMGIELLWVHPFFKRRGFGKSLVELSLVF

SEQ ID NO: 2934016 - protein, 39 aa, Entamoeba invadens
ENKVCPYHYSKWVVTKVRLVLCPYNFITNPSIRSTSSIF

SEQ ID NO: 2934017 - protein, 37 aa, Entamoeba invadens
ENKVLPFNSVFALKGKLKEGASFRWYKADQIIDKMAL

SEQ ID NO: 2934018 - protein, 17 aa, Entamoeba invadens
ENKVYYVNHLLRKCYSD

SEQ ID NO: 2934019 - protein, 18 aa, Entamoeba invadens
ENLDKFTQIFGMCSAKTN

SEQ ID NO: 2934020 - protein, 24 aa, Entamoeba invadens
ENLDMLNLFKSCISKFATPSPLVF

SEQ ID NO: 2934021 - protein, 17 aa, Entamoeba invadens
ENLDMWKVSYICSSLCW

SEQ ID NO: 2934022 - protein, 25 aa, Entamoeba invadens
ENLEALKSVITFRLHMDQMMFKEER

SEQ ID NO: 2934023 - protein, 27 aa, Entamoeba invadens
ENLEFIGDQAFEWCFNFKEIVLKEKVN

SEQ ID NO: 2934024 - protein, 19 aa, Entamoeba invadens
ENLENFRFFVGYEDVTDVK

SEQ ID NO: 2934025 - protein, 18 aa, Entamoeba invadens
ENLFKFQEVCVSDKECRE

SEQ ID NO: 2934026 - protein, 17 aa, Entamoeba invadens
ENLIAVTFGRQIPKCEI

SEQ ID NO: 2934027 - protein, 18 aa, Entamoeba invadens
ENLIAVTFGRQIPKCEID

SEQ ID NO: 2934028 - protein, 22 aa, Entamoeba invadens
ENLIRHSLRIERVLDMLDTKMN

SEQ ID NO: 2934029 - protein, 18 aa, Entamoeba invadens
ENLISVGVHPSVLTLEIG

SEQ ID NO: 2934030 - protein, 24 aa, Entamoeba invadens
ENLIVEWFSKFGLQVKNFDKDFND

SEQ ID NO: 2934031 - protein, 17 aa, Entamoeba invadens
ENLKCMLNEISVEITGK

SEQ ID NO: 2934032 - protein, 24 aa, Entamoeba invadens
ENLKFRMLQKLVIKKSINEKLKIK

SEQ ID NO: 2934033 - protein, 24 aa, Entamoeba invadens
ENLKKKHWSMLGEVAAYDRPADSL

SEQ ID NO: 2934034 - protein, 30 aa, Entamoeba invadens
ENLKLKNEIKIKDCELDKTMNQINEMINQN

SEQ ID NO: 2934035 - protein, 28 aa, Entamoeba invadens
ENLKMIGRSAFRKCGLTEIVIPKNVSCV

SEQ ID NO: 2934036 - protein, 26 aa, Entamoeba invadens
ENLKRIKEMPVDVKVELNKNSADPTK

SEQ ID NO: 2934037 - protein, 22 aa, Entamoeba invadens
ENLKVNGCIDYLYDTYKYFPKS

SEQ ID NO: 2934038 - protein, 20 aa, Entamoeba invadens
ENLLAGIAMERRSIFMFGHN

SEQ ID NO: 2934039 - protein, 26 aa, Entamoeba invadens
ENLLKKVCSVLMLLSVSYGEKVGEWI

SEQ ID NO: 2934040 - protein, 19 aa, Entamoeba invadens
ENLLRVAFIAVNDVETMYG

SEQ ID NO: 2934041 - protein, 18 aa, Entamoeba invadens
ENLLRYAFDENMQVDASA

SEQ ID NO: 2934042 - protein, 19 aa, Entamoeba invadens
ENLLSVFSLFYSVCLPQLS

SEQ ID NO: 2934043 - protein, 20 aa, Entamoeba invadens
ENLNKFFLSKSHTTWLLEVI

SEQ ID NO: 2934044 - protein, 17 aa, Entamoeba invadens
ENLNKFTLPKSVKTLKL

SEQ ID NO: 2934045 - protein, 23 aa, Entamoeba invadens
ENLPKRFFDSFKYVKDCDLLICI

SEQ ID NO: 2934046 - protein, 24 aa, Entamoeba invadens
ENLPWPNYIQFLFALTQEQNIIQQ

SEQ ID NO: 2934047 - protein, 26 aa, Entamoeba invadens
ENLSWKCKFCGTENKIADVLPEELPD

SEQ ID NO: 2934048 - protein, 19 aa, Entamoeba invadens
ENLVMKSAKSFTFKNSFFE

SEQ ID NO: 2934049 - protein, 17 aa, Entamoeba invadens
ENLWMATFDQFEIDYSL

SEQ ID NO: 2934050 - protein, 21 aa, Entamoeba invadens
ENLYPILIIFIGKKIHNIIKS

SEQ ID NO: 2934051 - protein, 20 aa, Entamoeba invadens
ENLYTVGIMPCVAKKVEAAR

SEQ ID NO: 2934052 - protein, 25 aa, Entamoeba invadens
ENMAKRFNAFFMETSCLNGNGVNKA

SEQ ID NO: 2934053 - protein, 18 aa, Entamoeba invadens
ENMCYCVISNRVGKDKLM

SEQ ID NO: 2934054 - protein, 20 aa, Entamoeba invadens
ENMIRGGIEINELSMKVLLD

SEQ ID NO: 2934055 - protein, 26 aa, Entamoeba invadens
ENMLCSDLSCSVCELGSLLNHTGPIG

SEQ ID NO: 2934056 - protein, 18 aa, Entamoeba invadens
ENMLKANFPVISMHAEMP

SEQ ID NO: 2934057 - protein, 23 aa, Entamoeba invadens
ENMMESVLVCYTRLFKGANQTVL

SEQ ID NO: 2934058 - protein, 24 aa, Entamoeba invadens
ENMNLPVGWAMGYFRNERYFFNVK

SEQ ID NO: 2934059 - protein, 18 aa, Entamoeba invadens
ENMYRKEVEKMQQTIETY

SEQ ID NO: 2934060 - protein, 31 aa, Entamoeba invadens
ENNILFFQFAFRWINCFLLRELSPEQGMRLW

SEQ ID NO: 2934061 - protein, 26 aa, Entamoeba invadens
ENNIPMIADLLRYFFHFVKSTCPYIV

SEQ ID NO: 2934062 - protein, 24 aa, Entamoeba invadens
ENNLKLLIMIFSEWTKTSEGKAIS

SEQ ID NO: 2934063 - protein, 25 aa, Entamoeba invadens
ENNLVVYFCAKWCGPCCAFQPIFDE

SEQ ID NO: 2934064 - protein, 28 aa, Entamoeba invadens
ENNPSVCAFPFVFGERGLGIEMKNTVCL

SEQ ID NO: 2934065 - protein, 24 aa, Entamoeba invadens
ENNQKRLLAFLSEKLGIYQEKIHC

SEQ ID NO: 2934066 - protein, 36 aa, Entamoeba invadens
ENNRLKTLGIRKRLPRACKGAPMPRFSESSFAQKEQ

SEQ ID NO: 2934067 - protein, 20 aa, Entamoeba invadens
ENPLIKFLVEKMGLESENDK

SEQ ID NO: 2934068 - protein, 25 aa, Entamoeba invadens
ENPPERFVELLGVVSFFKAKTHIKV

SEQ ID NO: 2934069 - protein, 23 aa, Entamoeba invadens
ENPRSFIINEITKFISGKIIPAM

SEQ ID NO: 2934070 - protein, 18 aa, Entamoeba invadens
ENPRSFIINEIVDNSINF

SEQ ID NO: 2934071 - protein, 17 aa, Entamoeba invadens
ENPSTIVGHGFSFGLSS

SEQ ID NO: 2934072 - protein, 17 aa, Entamoeba invadens
ENPTFVGKLVMGEEEKE

SEQ ID NO: 2934073 - protein, 18 aa, Entamoeba invadens
ENQGFRVTIDMVAPQLCM

SEQ ID NO: 2934074 - protein, 19 aa, Entamoeba invadens
ENQGFRVTIDMVAPQLCMG

SEQ ID NO: 2934075 - protein, 20 aa, Entamoeba invadens
ENQPEFFARFKALEEEVNQQ

SEQ ID NO: 2934076 - protein, 21 aa, Entamoeba invadens
ENRAFGAFWGSVVYANQSTTT

SEQ ID NO: 2934077 - protein, 24 aa, Entamoeba invadens
ENRDHAACIGGAIFASLSTFESAC

SEQ ID NO: 2934078 - protein, 21 aa, Entamoeba invadens
ENRGRVMYLLSHFKYNKESDI

SEQ ID NO: 2934079 - protein, 26 aa, Entamoeba invadens
ENRIPSWCDRVLWKTENCHFAETQKY

SEQ ID NO: 2934080 - protein, 23 aa, Entamoeba invadens
ENRKRPSSDLELINPEKPMYTPP

SEQ ID NO: 2934081 - protein, 26 aa, Entamoeba invadens
ENRLREFPRALIFFSNLVNIKLQNND

SEQ ID NO: 2934082 - protein, 35 aa, Entamoeba invadens
ENRMLQRFSELNVPCPKVLFCNQLDIVMEYIDGVT

SEQ ID NO: 2934083 - protein, 23 aa, Entamoeba invadens
ENRSNLYAFLGMANVYYKFGKNN

SEQ ID NO: 2934084 - protein, 21 aa, Entamoeba invadens
ENRVKAAIRFIQIADYLNKLN

SEQ ID NO: 2934085 - protein, 29 aa, Entamoeba invadens
ENRVTELICGLHMCAKAFAQRKLIEQKRN

SEQ ID NO: 2934086 - protein, 22 aa, Entamoeba invadens
ENRYEYAIHLSIQYLKDYSTIE

SEQ ID NO: 2934087 - protein, 24 aa, Entamoeba invadens
ENRYRFCSVTDPLLASKFKATYKA

SEQ ID NO: 2934088 - protein, 21 aa, Entamoeba invadens
ENSEGYLLKFFKNVNHKMTLV

SEQ ID NO: 2934089 - protein, 25 aa, Entamoeba invadens
ENSEWVCGTHCGFYIGSVRNSFISN

SEQ ID NO: 2934090 - protein, 24 aa, Entamoeba invadens
ENSHKELLARVSLLESSKDISKNV

SEQ ID NO: 2934091 - protein, 19 aa, Entamoeba invadens
ENSIYQLPIVISRLALFGI

SEQ ID NO: 2934092 - protein, 24 aa, Entamoeba invadens
ENSIYRKRLTCVLHGHTHNSRGLV

SEQ ID NO: 2934093 - protein, 20 aa, Entamoeba invadens
ENSKEALLLLGEVLSQIKFD

SEQ ID NO: 2934094 - protein, 20 aa, Entamoeba invadens
ENSKLLVKITELEKEKVDFE

SEQ ID NO: 2934095 - protein, 27 aa, Entamoeba invadens
ENSKTFPWKMCLGVFKNFPKSFDDNLP

SEQ ID NO: 2934096 - protein, 20 aa, Entamoeba invadens
ENSLIRWAHKVTSQSPVFLY

SEQ ID NO: 2934097 - protein, 20 aa, Entamoeba invadens
ENSLRTVTDFTLKETAQRMA

SEQ ID NO: 2934098 - protein, 23 aa, Entamoeba invadens
ENSNGAISYGVFETCTKKGWSYS

SEQ ID NO: 2934099 - protein, 20 aa, Entamoeba invadens
ENSQRFVLVKWRGMSYLHVD

SEQ ID NO: 2934100 - protein, 24 aa, Entamoeba invadens
ENSVGICYEITPIIYALKNKKITG

SEQ ID NO: 2934101 - protein, 22 aa, Entamoeba invadens
ENTDLRKGFNDSISKIEQQQNK

SEQ ID NO: 2934102 - protein, 21 aa, Entamoeba invadens
ENTEIERKIGFLMRANTYYES

SEQ ID NO: 2934103 - protein, 25 aa, Entamoeba invadens
ENTEIKFVPAYGGRIKRGIYGFSIG

SEQ ID NO: 2934104 - protein, 25 aa, Entamoeba invadens
ENTELERKIGFLIRANTYYESLDED

SEQ ID NO: 2934105 - protein, 26 aa, Entamoeba invadens
ENTEQALKFIIADGVHLVNIDAQNIC

SEQ ID NO: 2934106 - protein, 20 aa, Entamoeba invadens
ENTFIKEGRAFIGDFGSGVV

SEQ ID NO: 2934107 - protein, 24 aa, Entamoeba invadens
ENTIRYLWEFGNLRIDAEEWVYNR

SEQ ID NO: 2934108 - protein, 29 aa, Entamoeba invadens
ENTKISCAVLYCWCVSILLERLNVSEKVP

SEQ ID NO: 2934109 - protein, 20 aa, Entamoeba invadens
ENTKLRCSVDTLSEQVMSKQ

SEQ ID NO: 2934110 - protein, 27 aa, Entamoeba invadens
ENTLFWLLKLVMDFLQPFYFCGNDVIM

SEQ ID NO: 2934111 - protein, 19 aa, Entamoeba invadens
ENTLKIVIEPTLSEMYLVS

SEQ ID NO: 2934112 - protein, 24 aa, Entamoeba invadens
ENTLKRIMKVLLLDDNCIEHLLNL

SEQ ID NO: 2934113 - protein, 27 aa, Entamoeba invadens
ENTLLWYKTFCRVCLSNYQNRLVGINI

SEQ ID NO: 2934114 - protein, 19 aa, Entamoeba invadens
ENTLMGIIQEFERSVKDLN

SEQ ID NO: 2934115 - protein, 19 aa, Entamoeba invadens
ENTPFRAMRDVNKEEKGKA

SEQ ID NO: 2934116 - protein, 17 aa, Entamoeba invadens
ENTQLCCDVSNLKREKD

SEQ ID NO: 2934117 - protein, 17 aa, Entamoeba invadens
ENTRPLTELPLRMTQST

SEQ ID NO: 2934118 - protein, 31 aa, Entamoeba invadens
ENTVKCFSYLALRPVWEIYTVVKQYFDKETH

SEQ ID NO: 2934119 - protein, 17 aa, Entamoeba invadens
ENVEVSDTFVFVKNLPY

SEQ ID NO: 2934120 - protein, 24 aa, Entamoeba invadens
ENVFEFPHPFCVIRSDKSRVDAIT

SEQ ID NO: 2934121 - protein, 19 aa, Entamoeba invadens
ENVFMLYVVFVRNCLECVS

SEQ ID NO: 2934122 - protein, 23 aa, Entamoeba invadens
ENVFSSEWYKLRLQTRQKTEVAK

SEQ ID NO: 2934123 - protein, 23 aa, Entamoeba invadens
ENVGLKINLHFNNENTIQNTNEE

SEQ ID NO: 2934124 - protein, 20 aa, Entamoeba invadens
ENVIECVFQRTHLHPTKCLF

SEQ ID NO: 2934125 - protein, 23 aa, Entamoeba invadens
ENVIKAAIGSVLFPPKPTDGSEE

SEQ ID NO: 2934126 - protein, 18 aa, Entamoeba invadens
ENVKELFETIGNSFEAQQ

SEQ ID NO: 2934127 - protein, 23 aa, Entamoeba invadens
ENVLELKSYFPVPSLNEMWYVFK

SEQ ID NO: 2934128 - protein, 26 aa, Entamoeba invadens
ENVLNIYYKFYWVMVNVSGYKKYSSE

SEQ ID NO: 2934129 - protein, 27 aa, Entamoeba invadens
ENVLSIGRECFKQCLSLSSIKIPNSVT

SEQ ID NO: 2934130 - protein, 23 aa, Entamoeba invadens
ENVMRLSMKLSRKNVVTLTQLMK

SEQ ID NO: 2934131 - protein, 20 aa, Entamoeba invadens
ENVNIIGCRAFFNCERISKV

SEQ ID NO: 2934132 - protein, 20 aa, Entamoeba invadens
ENVNNIAWYCCSHDDTLEIV

SEQ ID NO: 2934133 - protein, 20 aa, Entamoeba invadens
ENVPLFKALLWEFKIKSENL

SEQ ID NO: 2934134 - protein, 22 aa, Entamoeba invadens
ENVRLQSILAFEFPRASTRLED

SEQ ID NO: 2934135 - protein, 24 aa, Entamoeba invadens
ENVRTAFILLKLFFLFLPTPILPP

SEQ ID NO: 2934136 - protein, 24 aa, Entamoeba invadens
ENVRYKLLVYSSWKKHSGLQKDEE

SEQ ID NO: 2934137 - protein, 18 aa, Entamoeba invadens
ENVSKGYGFVTLKSAEQQ

SEQ ID NO: 2934138 - protein, 33 aa, Entamoeba invadens
ENVSLEFIKFGSEFSIIITRDILEECCLSVFQR

SEQ ID NO: 2934139 - protein, 25 aa, Entamoeba invadens
ENVSLIISCCLHFNKNLNIENGTVI

SEQ ID NO: 2934140 - protein, 20 aa, Entamoeba invadens
ENVVEFWKYWMDSTPQPDAL

SEQ ID NO: 2934141 - protein, 19 aa, Entamoeba invadens
ENVVLRKSYLSSLDSKARG

SEQ ID NO: 2934142 - protein, 24 aa, Entamoeba invadens
ENWEYKHGTGHGVGLYMMVHESPP

SEQ ID NO: 2934143 - protein, 22 aa, Entamoeba invadens
ENWMVKELLENIDVKARGIRQG

SEQ ID NO: 2934144 - protein, 21 aa, Entamoeba invadens
ENWSSDIHYLYIVKEKEDVEK

SEQ ID NO: 2934145 - protein, 19 aa, Entamoeba invadens
ENWTKMKVGTVVFDSNSDD

SEQ ID NO: 2934146 - protein, 24 aa, Entamoeba invadens
ENYARSVFIYRRIRKEKVLPIGKV

SEQ ID NO: 2934147 - protein, 21 aa, Entamoeba invadens
ENYCERRRVLASGQSVSKRDE

SEQ ID NO: 2934148 - protein, 20 aa, Entamoeba invadens
ENYCKVADPVLKKYGKVAGM

SEQ ID NO: 2934149 - protein, 17 aa, Entamoeba invadens
ENYEMFENAYITDFENL

SEQ ID NO: 2934150 - protein, 21 aa, Entamoeba invadens
ENYFFCSLFLFSVEIAQIRRE

SEQ ID NO: 2934151 - protein, 18 aa, Entamoeba invadens
ENYIYRWATNLSTGTNLS

SEQ ID NO: 2934152 - protein, 18 aa, Entamoeba invadens
ENYLCLPSTELLGKCDKI

SEQ ID NO: 2934153 - protein, 28 aa, Entamoeba invadens
ENYLKVRNVWRMACYVLLIEKDEKLRAM

SEQ ID NO: 2934154 - protein, 20 aa, Entamoeba invadens
ENYLRFQSHDDFTKIVFVAQ

SEQ ID NO: 2934155 - protein, 22 aa, Entamoeba invadens
ENYLYRTLMIFLEYAWSHGQTE

SEQ ID NO: 2934156 - protein, 19 aa, Entamoeba invadens
ENYRFTITLNLLVDLLSEF

SEQ ID NO: 2934157 - protein, 20 aa, Entamoeba invadens
EPACQISIPLDLAGQAVECF

SEQ ID NO: 2934158 - protein, 17 aa, Entamoeba invadens
EPAGSHGVWGIDDYQFL

SEQ ID NO: 2934159 - protein, 26 aa, Entamoeba invadens
EPAKARTMLLETYLYIRDLYNEYGTD

SEQ ID NO: 2934160 - protein, 31 aa, Entamoeba invadens
EPAMEYFKFPLFCLISQPVLSLLSTGKSTGF

SEQ ID NO: 2934161 - protein, 22 aa, Entamoeba invadens
EPAPPRRLLIRVFGEGNATWAA

SEQ ID NO: 2934162 - protein, 26 aa, Entamoeba invadens
EPCECCECVQHELELNSNEEVEEDKS

SEQ ID NO: 2934163 - protein, 17 aa, Entamoeba invadens
EPCEESFVLGGHYFFDF

SEQ ID NO: 2934164 - protein, 17 aa, Entamoeba invadens
EPCVLTIENGEYEYLFW

SEQ ID NO: 2934165 - protein, 17 aa, Entamoeba invadens
EPCVLTIENSEFEYLLW

SEQ ID NO: 2934166 - protein, 20 aa, Entamoeba invadens
EPDCEFLPVMKAFLLASQSD

SEQ ID NO: 2934167 - protein, 19 aa, Entamoeba invadens
EPDFKMGIFNHSNIEITEC

SEQ ID NO: 2934168 - protein, 19 aa, Entamoeba invadens
EPDFLKGKVKQIFETNLLE

SEQ ID NO: 2934169 - protein, 20 aa, Entamoeba invadens
EPDKRISMNDVLNHKFIHDC

SEQ ID NO: 2934170 - protein, 27 aa, Entamoeba invadens
EPEERKMGGILGSRRGRRVAQKSEVSE

SEQ ID NO: 2934171 - protein, 23 aa, Entamoeba invadens
EPEFVKRGFQLGRNKPKNIRDML

SEQ ID NO: 2934172 - protein, 27 aa, Entamoeba invadens
EPEIKMLKILCQWFCRKRKSSDYNQHC

SEQ ID NO: 2934173 - protein, 21 aa, Entamoeba invadens
EPEKFSIVYGAEKCTIKVPGS

SEQ ID NO: 2934174 - protein, 18 aa, Entamoeba invadens
EPEKGMLYLSKSTTLIRH

SEQ ID NO: 2934175 - protein, 24 aa, Entamoeba invadens
EPELGSLFLILKILSEKTVSISPP

SEQ ID NO: 2934176 - protein, 23 aa, Entamoeba invadens
EPEMFKKTMSVRVDTAINPFLKF

SEQ ID NO: 2934177 - protein, 19 aa, Entamoeba invadens
EPENLPILLTESVHNTTQS

SEQ ID NO: 2934178 - protein, 19 aa, Entamoeba invadens
EPENLPILLTESVNNTTQS

SEQ ID NO: 2934179 - protein, 18 aa, Entamoeba invadens
EPESRVSLFQSNNFITGH

SEQ ID NO: 2934180 - protein, 17 aa, Entamoeba invadens
EPETFEVARLVAIEWLN

SEQ ID NO: 2934181 - protein, 26 aa, Entamoeba invadens
EPEYVFSSLCDREYLATKESNDLKFD

SEQ ID NO: 2934182 - protein, 18 aa, Entamoeba invadens
EPFDCGKLKIPKSVKKMK

SEQ ID NO: 2934183 - protein, 19 aa, Entamoeba invadens
EPFFHLCEIVYKTKPDPTI

SEQ ID NO: 2934184 - protein, 19 aa, Entamoeba invadens
EPFIIRMGKKYQLIAHQLI

SEQ ID NO: 2934185 - protein, 25 aa, Entamoeba invadens
EPFIQINYKCCKAVESLSTNPWSEY

SEQ ID NO: 2934186 - protein, 17 aa, Entamoeba invadens
EPFKEEFMYPFVEYVTT

SEQ ID NO: 2934187 - protein, 17 aa, Entamoeba invadens
EPFKILSQEEMKDQIEG

SEQ ID NO: 2934188 - protein, 17 aa, Entamoeba invadens
EPFKPTLVFLPIIMDQL

SEQ ID NO: 2934189 - protein, 26 aa, Entamoeba invadens
EPFKYQKYRMAFILALHDKAGVIQQF

SEQ ID NO: 2934190 - protein, 27 aa, Entamoeba invadens
EPFPKKRFKYAWDIADFVGKGNHLTYD

SEQ ID NO: 2934191 - protein, 18 aa, Entamoeba invadens
EPFRHDYDDIISLIQTSI

SEQ ID NO: 2934192 - protein, 26 aa, Entamoeba invadens
EPFTIEIYASLLFNVKKDFVVTLTGM

SEQ ID NO: 2934193 - protein, 17 aa, Entamoeba invadens
EPFYKYNMSGSYREVFD

SEQ ID NO: 2934194 - protein, 22 aa, Entamoeba invadens
EPGTEAAREWELLSEQYKAAKI

SEQ ID NO: 2934195 - protein, 25 aa, Entamoeba invadens
EPHEKLDFFDRNDLILGEDQIIRER

SEQ ID NO: 2934196 - protein, 19 aa, Entamoeba invadens
EPIFVYGLLDQGYWPDGLY

SEQ ID NO: 2934197 - protein, 24 aa, Entamoeba invadens
EPIISRFDLVMIVRDTVEYTRDLA

SEQ ID NO: 2934198 - protein, 25 aa, Entamoeba invadens
EPIKMKRLFSSNVLTFLTDMINSYI

SEQ ID NO: 2934199 - protein, 25 aa, Entamoeba invadens
EPILPEKRIQNFITVLEIQQSKYLG

SEQ ID NO: 2934200 - protein, 19 aa, Entamoeba invadens
EPINVLKWCPIEQHQDTVS

SEQ ID NO: 2934201 - protein, 20 aa, Entamoeba invadens
EPIPPPPFPKYVVKKKKGAD

SEQ ID NO: 2934202 - protein, 19 aa, Entamoeba invadens
EPISEISRVLLLGDKSVLA

SEQ ID NO: 2934203 - protein, 17 aa, Entamoeba invadens
EPITPRKSEAMKVKSIE

SEQ ID NO: 2934204 - protein, 20 aa, Entamoeba invadens
EPKAAAYFYGVKKMKDGLFF

SEQ ID NO: 2934205 - protein, 23 aa, Entamoeba invadens
EPKCMKMLIEKGNVFNNLERTGS

SEQ ID NO: 2934206 - protein, 18 aa, Entamoeba invadens
EPKGCIYLSSTTVLKERT

SEQ ID NO: 2934207 - protein, 24 aa, Entamoeba invadens
EPKKEIPKEFFIERDDVISTLVEA

SEQ ID NO: 2934208 - protein, 19 aa, Entamoeba invadens
EPKKQGPLVPQFKEPENQG

SEQ ID NO: 2934209 - protein, 25 aa, Entamoeba invadens
EPKKVNLWIGAGVMMEYSFEEAEKT

SEQ ID NO: 2934210 - protein, 27 aa, Entamoeba invadens
EPKMVFTCNGAFWVVSDSLVFFHPAIK

SEQ ID NO: 2934211 - protein, 27 aa, Entamoeba invadens
EPKTKLKPSCFIFLKFFVKEKSTNNRG

SEQ ID NO: 2934212 - protein, 18 aa, Entamoeba invadens
EPKTRADATIAFATKDLI

SEQ ID NO: 2934213 - protein, 20 aa, Entamoeba invadens
EPLCKSEIALIKKIDKRVRN

SEQ ID NO: 2934214 - protein, 25 aa, Entamoeba invadens
EPLFNPVVMLCFKIVSVSVETCVAV

SEQ ID NO: 2934215 - protein, 25 aa, Entamoeba invadens
EPLKRAFVQFCFEPIQKLFVSIMDG

SEQ ID NO: 2934216 - protein, 17 aa, Entamoeba invadens
EPLLRPPKHVVFTKSDS

SEQ ID NO: 2934217 - protein, 19 aa, Entamoeba invadens
EPMCPVYLDVVGKTNGTTA

SEQ ID NO: 2934218 - protein, 25 aa, Entamoeba invadens
EPMTPYFRFEELFNGFVEDEARKIE

SEQ ID NO: 2934219 - protein, 17 aa, Entamoeba invadens
EPNCDYSGILQLHNSQI

SEQ ID NO: 2934220 - protein, 17 aa, Entamoeba invadens
EPNEYTNYFGFNLCMGM

SEQ ID NO: 2934221 - protein, 25 aa, Entamoeba invadens
EPNGKALEAWGWDVYKRELSERYGN

SEQ ID NO: 2934222 - protein, 26 aa, Entamoeba invadens
EPNPEFSWFEGYNWQIIVCVQCGTHV

SEQ ID NO: 2934223 - protein, 19 aa, Entamoeba invadens
EPPFSMDLFLSDSGYDGKK

SEQ ID NO: 2934224 - protein, 23 aa, Entamoeba invadens
EPPKELFYYFLFNDILIQTKPKK

SEQ ID NO: 2934225 - protein, 27 aa, Entamoeba invadens
EPPKYPAFQPMALFPLNMVLSTNRTPI

SEQ ID NO: 2934226 - protein, 20 aa, Entamoeba invadens
EPPNDGVFCDLLWSDPISDA

SEQ ID NO: 2934227 - protein, 19 aa, Entamoeba invadens
EPPNEGLFCDILWADPVTD

SEQ ID NO: 2934228 - protein, 21 aa, Entamoeba invadens
EPPSEGSLCDLLWSDPISEWD

SEQ ID NO: 2934229 - protein, 21 aa, Entamoeba invadens
EPPSRGAICDILWSDPLEEPQ

SEQ ID NO: 2934230 - protein, 23 aa, Entamoeba invadens
EPQEDCALWSIKVFPGNHEYMMR

SEQ ID NO: 2934231 - protein, 23 aa, Entamoeba invadens
EPQEIKIFLEILIMFHTVDPEKN

SEQ ID NO: 2934232 - protein, 24 aa, Entamoeba invadens
EPQHPRLGLPKVPSKPPISQEDIV

SEQ ID NO: 2934233 - protein, 24 aa, Entamoeba invadens
EPQKPRMAGILGGNRARKVEEVQS

SEQ ID NO: 2934234 - protein, 27 aa, Entamoeba invadens
EPQPMLFAYCKIMIKGVELIEGRINSR

SEQ ID NO: 2934235 - protein, 21 aa, Entamoeba invadens
EPQRKSMIITSSFDAEKAFKT

SEQ ID NO: 2934236 - protein, 21 aa, Entamoeba invadens
EPRAKFYAAEIGLVLHYIHSQ

SEQ ID NO: 2934237 - protein, 18 aa, Entamoeba invadens
EPRPYKTTFTYQVRTEDN

SEQ ID NO: 2934238 - protein, 21 aa, Entamoeba invadens
EPRYYKNEWSKVDYCQYGSGF

SEQ ID NO: 2934239 - protein, 20 aa, Entamoeba invadens
EPRYYKNEWSKVNYCQYGSG

SEQ ID NO: 2934240 - protein, 25 aa, Entamoeba invadens
EPSALPVCVSLVLLDEVYVVDPSHT

SEQ ID NO: 2934241 - protein, 24 aa, Entamoeba invadens
EPSDFWKVLFGLDHLKGNDQRLES

SEQ ID NO: 2934242 - protein, 22 aa, Entamoeba invadens
EPSGFKQMHHVGVGSDGQVNLD

SEQ ID NO: 2934243 - protein, 22 aa, Entamoeba invadens
EPSRGRFIIFEIHEEKIIEVSN

SEQ ID NO: 2934244 - protein, 19 aa, Entamoeba invadens
EPSSVCLWGDKLFVSDGLN

SEQ ID NO: 2934245 - protein, 20 aa, Entamoeba invadens
EPSVKIKRLVPDTKDEAIPL

SEQ ID NO: 2934246 - protein, 22 aa, Entamoeba invadens
EPTIRPNPYVKFLKNLPKRPEF

SEQ ID NO: 2934247 - protein, 21 aa, Entamoeba invadens
EPTKPIVFPVIKGIKFEPPQR

SEQ ID NO: 2934248 - protein, 22 aa, Entamoeba invadens
EPTPLLLTAIVNFLKTEKWMSQ

SEQ ID NO: 2934249 - protein, 20 aa, Entamoeba invadens
EPTVAAGCCFIGRIVTDLID

SEQ ID NO: 2934250 - protein, 20 aa, Entamoeba invadens
EPVAVPFKMFLQPLHLAPSS

SEQ ID NO: 2934251 - protein, 19 aa, Entamoeba invadens
EPVFLMNVVLYIQQTDIVT

SEQ ID NO: 2934252 - protein, 23 aa, Entamoeba invadens
EPVSSLLYVKGMYIIGGTVSGKV

SEQ ID NO: 2934253 - protein, 20 aa, Entamoeba invadens
EPVVKARTAVSSSINEFSNE

SEQ ID NO: 2934254 - protein, 20 aa, Entamoeba invadens
EPVVSSFLFKDDFYVSTNTK

SEQ ID NO: 2934255 - protein, 23 aa, Entamoeba invadens
EPYEHLKTWKFSDETITFDFAKY

SEQ ID NO: 2934256 - protein, 20 aa, Entamoeba invadens
EPYFRAPASFLPIRERREET

SEQ ID NO: 2934257 - protein, 30 aa, Entamoeba invadens
EPYGFKVDIWACGVVMYSLLFGKFPFDGEG

SEQ ID NO: 2934258 - protein, 25 aa, Entamoeba invadens
EPYHLKLCFCPLCQNGMTVLAKERT

SEQ ID NO: 2934259 - protein, 22 aa, Entamoeba invadens
EPYKEFKSIFEIKNYVENGKRL

SEQ ID NO: 2934260 - protein, 23 aa, Entamoeba invadens
EPYKSKVCGHIFSKDAIFNLIGH

SEQ ID NO: 2934261 - protein, 26 aa, Entamoeba invadens
EPYLDKQFKFAWDIVDFVVSGKRLKK

SEQ ID NO: 2934262 - protein, 20 aa, Entamoeba invadens
EPYSKPGFDNMTLIVVKFNG

SEQ ID NO: 2934263 - protein, 21 aa, Entamoeba invadens
EPYSYFHIKLFDGHFDSQRLF

SEQ ID NO: 2934264 - protein, 27 aa, Entamoeba invadens
EQAIGKMCPICGCKFVDMERHMKYHQV

SEQ ID NO: 2934265 - protein, 20 aa, Entamoeba invadens
EQAVVSFIRLMKTHPVDPSS

SEQ ID NO: 2934266 - protein, 18 aa, Entamoeba invadens
EQCLPLIMEAMKNCTIDA

SEQ ID NO: 2934267 - protein, 25 aa, Entamoeba invadens
EQCVPKLEYGEQIARLQLAVQALDR

SEQ ID NO: 2934268 - protein, 24 aa, Entamoeba invadens
EQDASTGLCVFKIVYNGKTITLKP

SEQ ID NO: 2934269 - protein, 25 aa, Entamoeba invadens
EQDKAWKYLERYKELIERVNKFESK

SEQ ID NO: 2934270 - protein, 31 aa, Entamoeba invadens
EQDKFDWAINFVKFLKEMVVYIKQYHTTGLT

SEQ ID NO: 2934271 - protein, 22 aa, Entamoeba invadens
EQDKLKAVLSMIDIQLDVLPSR

SEQ ID NO: 2934272 - protein, 27 aa, Entamoeba invadens
EQDKRAEELWNLVVLFSSLELENGKEG

SEQ ID NO: 2934273 - protein, 23 aa, Entamoeba invadens
EQDLNLILYRIFVGGTRLISVDI

SEQ ID NO: 2934274 - protein, 19 aa, Entamoeba invadens
EQEEFDASPELRLEAIKVI

SEQ ID NO: 2934275 - protein, 26 aa, Entamoeba invadens
EQEEYLREGIEWTRQNFGNDLQPVID

SEQ ID NO: 2934276 - protein, 27 aa, Entamoeba invadens
EQEEYLREGIEWTRQNFGNDLQPVIDL

SEQ ID NO: 2934277 - protein, 23 aa, Entamoeba invadens
EQEIFCVMLRLVKGRKCYSMPII

SEQ ID NO: 2934278 - protein, 18 aa, Entamoeba invadens
EQEIKAFLTRVTGIKNIT

SEQ ID NO: 2934279 - protein, 22 aa, Entamoeba invadens
EQEKICFQNGFTQMLESIQSET

SEQ ID NO: 2934280 - protein, 23 aa, Entamoeba invadens
EQEMKRLQARLDELTLKSKEETP

SEQ ID NO: 2934281 - protein, 25 aa, Entamoeba invadens
EQEQLKTALLLGEKEELGGVKDNVL

SEQ ID NO: 2934282 - protein, 24 aa, Entamoeba invadens
EQFGLDLPFRWVTFDQYQQKEYRQ

SEQ ID NO: 2934283 - protein, 17 aa, Entamoeba invadens
EQFKKLFFKTVAVSYAF

SEQ ID NO: 2934284 - protein, 17 aa, Entamoeba invadens
EQFKKLFFKTVAVSYEF

SEQ ID NO: 2934285 - protein, 20 aa, Entamoeba invadens
EQFLVRIYQKAMLCAENAGR

SEQ ID NO: 2934286 - protein, 25 aa, Entamoeba invadens
EQFMNCVKYLFGEVCDEKKTKSYLH

SEQ ID NO: 2934287 - protein, 17 aa, Entamoeba invadens
EQFPNKFSFSVSHTTRK

SEQ ID NO: 2934288 - protein, 22 aa, Entamoeba invadens
EQFRQILCSTVGNGQPLASKQP

SEQ ID NO: 2934289 - protein, 30 aa, Entamoeba invadens
EQFYSYKRSVAVPVVFDLVYSRQLTQTRCT

SEQ ID NO: 2934290 - protein, 20 aa, Entamoeba invadens
EQHGRKCVGRPYVVKPLTLL

SEQ ID NO: 2934291 - protein, 17 aa, Entamoeba invadens
EQIERAKRLAALRSAMF

SEQ ID NO: 2934292 - protein, 25 aa, Entamoeba invadens
EQIGFPRAKMFLENLLQNKYKESLA

SEQ ID NO: 2934293 - protein, 25 aa, Entamoeba invadens
EQIGPQFVCGAQFEILHSTQKFTLN

SEQ ID NO: 2934294 - protein, 20 aa, Entamoeba invadens
EQIIDPALALFLHNLTSNNE

SEQ ID NO: 2934295 - protein, 17 aa, Entamoeba invadens
EQIKELLISRVPDNIEV

SEQ ID NO: 2934296 - protein, 22 aa, Entamoeba invadens
EQIKIARSFTGGEGFGDDSNEF

SEQ ID NO: 2934297 - protein, 19 aa, Entamoeba invadens
EQIKQLCIEMGRNDENGQK

SEQ ID NO: 2934298 - protein, 22 aa, Entamoeba invadens
EQIKVRLANAIKEMEGEKDADY

SEQ ID NO: 2934299 - protein, 24 aa, Entamoeba invadens
EQILKDWTCANSMELIYDSSKHFF

SEQ ID NO: 2934300 - protein, 27 aa, Entamoeba invadens
EQISEGISHLIFWARASGVKVANACWV

SEQ ID NO: 2934301 - protein, 17 aa, Entamoeba invadens
EQITLMVCPGQFRQVYI

SEQ ID NO: 2934302 - protein, 24 aa, Entamoeba invadens
EQIVKSAKTISVFAETSLFKLEAF

SEQ ID NO: 2934303 - protein, 28 aa, Entamoeba invadens
EQIYKLKMAGRCLGMKTFRKVLLGMKGE

SEQ ID NO: 2934304 - protein, 23 aa, Entamoeba invadens
EQKEISFEGSRSFVNSVDPINSF

SEQ ID NO: 2934305 - protein, 29 aa, Entamoeba invadens
EQKEKFSAECDCMKTTIAELEEELQKEQQ

SEQ ID NO: 2934306 - protein, 18 aa, Entamoeba invadens
EQKFCVVFKKTGKEVYCG

SEQ ID NO: 2934307 - protein, 18 aa, Entamoeba invadens
EQKMCSKALFDAGFLLAK

SEQ ID NO: 2934308 - protein, 17 aa, Entamoeba invadens
EQKQCKVISNFTEKKSE

SEQ ID NO: 2934309 - protein, 21 aa, Entamoeba invadens
EQKRLKVPIVNTFVESPIMFQ

SEQ ID NO: 2934310 - protein, 26 aa, Entamoeba invadens
EQKSHLKEILPFFVYLAGNKIIQKDI

SEQ ID NO: 2934311 - protein, 25 aa, Entamoeba invadens
EQLDEEYPLLVSKSRAVYSAYTGTV

SEQ ID NO: 2934312 - protein, 17 aa, Entamoeba invadens
EQLDLERITAQQAKAQK

SEQ ID NO: 2934313 - protein, 17 aa, Entamoeba invadens
EQLDLERITAQQAKTQK

SEQ ID NO: 2934314 - protein, 22 aa, Entamoeba invadens
EQLFALDLWLMKKLTIFDFLSK

SEQ ID NO: 2934315 - protein, 22 aa, Entamoeba invadens
EQLFGLCVDDLFNSQMKTDPWS

SEQ ID NO: 2934316 - protein, 18 aa, Entamoeba invadens
EQLFRMPFYLPANGDVVT

SEQ ID NO: 2934317 - protein, 19 aa, Entamoeba invadens
EQLFRVNGGITHFMSSFMR

SEQ ID NO: 2934318 - protein, 23 aa, Entamoeba invadens
EQLHLLMDVLREFGYKFESRYTS

SEQ ID NO: 2934319 - protein, 18 aa, Entamoeba invadens
EQLIKIILNPSVQNPPDL

SEQ ID NO: 2934320 - protein, 19 aa, Entamoeba invadens
EQLKCENNEYFLMHQKMNI

SEQ ID NO: 2934321 - protein, 22 aa, Entamoeba invadens
EQLKELQEVVGLKSDGNKKVEE

SEQ ID NO: 2934322 - protein, 17 aa, Entamoeba invadens
EQLKKEKENVLNELNTT

SEQ ID NO: 2934323 - protein, 21 aa, Entamoeba invadens
EQLKLASGYDHCYVLKKQKCG

SEQ ID NO: 2934324 - protein, 17 aa, Entamoeba invadens
EQLKLTTNEKVELEKTI

SEQ ID NO: 2934325 - protein, 23 aa, Entamoeba invadens
EQLKRSGPFGGINVNYPEIYVLE

SEQ ID NO: 2934326 - protein, 24 aa, Entamoeba invadens
EQLLEVWIGLYFWYWHSDGRPYQQ

SEQ ID NO: 2934327 - protein, 19 aa, Entamoeba invadens
EQLLKMEIVLGKFPQTVAS

SEQ ID NO: 2934328 - protein, 29 aa, Entamoeba invadens
EQLPLKFVLRCCVNLATALQYLSSEKILH

SEQ ID NO: 2934329 - protein, 23 aa, Entamoeba invadens
EQLPVMWHQGLLVFVQRYGKDLK

SEQ ID NO: 2934330 - protein, 17 aa, Entamoeba invadens
EQLRVVLSALRVEQNFW

SEQ ID NO: 2934331 - protein, 19 aa, Entamoeba invadens
EQLVDWSITPFVKKVVLFL

SEQ ID NO: 2934332 - protein, 22 aa, Entamoeba invadens
EQLWEFISKTLFEVSWSEYYSV

SEQ ID NO: 2934333 - protein, 32 aa, Entamoeba invadens
EQMKEKKALPKKMVVKCKKIPTKMSEDDEKLT

SEQ ID NO: 2934334 - protein, 17 aa, Entamoeba invadens
EQNCSKDSLSLVITTLQ

SEQ ID NO: 2934335 - protein, 23 aa, Entamoeba invadens
EQNKRVTFIVKMMDLADPSDDDI

SEQ ID NO: 2934336 - protein, 18 aa, Entamoeba invadens
EQNKVLCCPPLNRLDLLF

SEQ ID NO: 2934337 - protein, 22 aa, Entamoeba invadens
EQNRLIALWRYIAKRYCNEEGI

SEQ ID NO: 2934338 - protein, 22 aa, Entamoeba invadens
EQNRLIALWRYIAKRYNNEEGV

SEQ ID NO: 2934339 - protein, 20 aa, Entamoeba invadens
EQNRRVTLMYGDNTFDTTVS

SEQ ID NO: 2934340 - protein, 27 aa, Entamoeba invadens
EQNWLLQFVCGAALKKGGIERSIESLR

SEQ ID NO: 2934341 - protein, 25 aa, Entamoeba invadens
EQPDSRVSYGLVKKVLEQQHLLPAK

SEQ ID NO: 2934342 - protein, 25 aa, Entamoeba invadens
EQPKELKFEDFVCVNNCEKPIERSE

SEQ ID NO: 2934343 - protein, 24 aa, Entamoeba invadens
EQPKNNFSVFNFGTQEIKENHKNE

SEQ ID NO: 2934344 - protein, 20 aa, Entamoeba invadens
EQPLLKCLSLIKDTDIKVKR

SEQ ID NO: 2934345 - protein, 19 aa, Entamoeba invadens
EQPRKVIPTCYIVEEDEDG

SEQ ID NO: 2934346 - protein, 19 aa, Entamoeba invadens
EQQFSSGDFLRLQKELEET

SEQ ID NO: 2934347 - protein, 23 aa, Entamoeba invadens
EQQKFKIGIWPVVNTKVRGTMKH

SEQ ID NO: 2934348 - protein, 23 aa, Entamoeba invadens
EQQKKMFWECASVVLQQTDTVKY

SEQ ID NO: 2934349 - protein, 20 aa, Entamoeba invadens
EQQQRIPLNEPKNNILRTKG

SEQ ID NO: 2934350 - protein, 21 aa, Entamoeba invadens
EQRIITLLLNEQFGLRSNIPC

SEQ ID NO: 2934351 - protein, 28 aa, Entamoeba invadens
EQRKSVQLSPRFDVAHMHVRKSIRTSAH

SEQ ID NO: 2934352 - protein, 26 aa, Entamoeba invadens
EQRKWKDERVMGVFVGIYDMSNADVA

SEQ ID NO: 2934353 - protein, 19 aa, Entamoeba invadens
EQRLLSFLKSSREPFTKIK

SEQ ID NO: 2934354 - protein, 20 aa, Entamoeba invadens
EQRMRLIYDLLISFDISPEL

SEQ ID NO: 2934355 - protein, 18 aa, Entamoeba invadens
EQSFHFVSTFILKSRKEQ

SEQ ID NO: 2934356 - protein, 20 aa, Entamoeba invadens
EQSIQFSVIENANYDFEGFG

SEQ ID NO: 2934357 - protein, 17 aa, Entamoeba invadens
EQSRMDYLGVMNQIVTL

SEQ ID NO: 2934358 - protein, 24 aa, Entamoeba invadens
EQTKRGICINAEMATSAEVNNLVK

SEQ ID NO: 2934359 - protein, 22 aa, Entamoeba invadens
EQTLRLLFPYQERFDSKNEVAT

SEQ ID NO: 2934360 - protein, 21 aa, Entamoeba invadens
EQTWETLLFQRGEYLKTRSQY

SEQ ID NO: 2934361 - protein, 19 aa, Entamoeba invadens
EQVFWYKYFEYLFNSEDKP

SEQ ID NO: 2934362 - protein, 24 aa, Entamoeba invadens
EQVMPCAPMLMSFENTRSEMERTI

SEQ ID NO: 2934363 - protein, 23 aa, Entamoeba invadens
EQVREVYKNRSVVLTALDDVCWL

SEQ ID NO: 2934364 - protein, 20 aa, Entamoeba invadens
EQWMVKDLLESIDVKPRGIR

SEQ ID NO: 2934365 - protein, 27 aa, Entamoeba invadens
EQYIDFLKCWSSLTLKHKGAASTFLRL

SEQ ID NO: 2934366 - protein, 20 aa, Entamoeba invadens
EQYIKIMPFELVVLNAFHHM

SEQ ID NO: 2934367 - protein, 19 aa, Entamoeba invadens
EQYKLFRILDDINWADVDS

SEQ ID NO: 2934368 - protein, 22 aa, Entamoeba invadens
EQYKLISNCWAHKKEDRNTIEI

SEQ ID NO: 2934369 - protein, 17 aa, Entamoeba invadens
EQYKLISNCWAHNKEDR

SEQ ID NO: 2934370 - protein, 18 aa, Entamoeba invadens
EQYPKAYVTDSIVSSTLQ

SEQ ID NO: 2934371 - protein, 25 aa, Entamoeba invadens
EQYYLKGDAFVLVYSIDNKNSFHAL

SEQ ID NO: 2934372 - protein, 25 aa, Entamoeba invadens
EQYYLKGDGFVLVYSIENKASFLAI

SEQ ID NO: 2934373 - protein, 18 aa, Entamoeba invadens
ERAFTCLKTANQTFEQKR

SEQ ID NO: 2934374 - protein, 19 aa, Entamoeba invadens
ERAFYKCLALSTIDIPKCA

SEQ ID NO: 2934375 - protein, 31 aa, Entamoeba invadens
ERAKDVIVLYGRVGWKVMKPVILLYDSTPVK

SEQ ID NO: 2934376 - protein, 25 aa, Entamoeba invadens
ERAKEIKECFSEFVEGGKTAFAEPE

SEQ ID NO: 2934377 - protein, 26 aa, Entamoeba invadens
ERAKRLAALRSAMFFDQQNARRQNKI

SEQ ID NO: 2934378 - protein, 19 aa, Entamoeba invadens
ERALMLYLTLFNRNDKMEQ

SEQ ID NO: 2934379 - protein, 21 aa, Entamoeba invadens
ERALYVYAYFLARVAAGMVAE

SEQ ID NO: 2934380 - protein, 20 aa, Entamoeba invadens
ERASMKLGLDQAILSNINHE

SEQ ID NO: 2934381 - protein, 35 aa, Entamoeba invadens
ERCEKEFLSKLVMFLKERFDVLKKSKSFECESFVH

SEQ ID NO: 2934382 - protein, 18 aa, Entamoeba invadens
ERCEQGPCWADSIGKNFN

SEQ ID NO: 2934383 - protein, 20 aa, Entamoeba invadens
ERCFEGCVLLTSISCNTNVI

SEQ ID NO: 2934384 - protein, 21 aa, Entamoeba invadens
ERCFEGCVLLTSISCNTNVIL

SEQ ID NO: 2934385 - protein, 22 aa, Entamoeba invadens
ERCIQRVSLDIANGVSGKTAER

SEQ ID NO: 2934386 - protein, 21 aa, Entamoeba invadens
ERCKYPVIINRQFSNHCTQKK

SEQ ID NO: 2934387 - protein, 18 aa, Entamoeba invadens
ERCSRNSHLFAGRQLSKF

SEQ ID NO: 2934388 - protein, 17 aa, Entamoeba invadens
ERDKALYVKGFDLRTEI

SEQ ID NO: 2934389 - protein, 21 aa, Entamoeba invadens
ERDPECLLLTFDIIKTVSANN

SEQ ID NO: 2934390 - protein, 21 aa, Entamoeba invadens
ERDVFKIIDWGLAEFYHPQKP

SEQ ID NO: 2934391 - protein, 23 aa, Entamoeba invadens
ERECLPLQPIAGMKCSKDFTNDL

SEQ ID NO: 2934392 - protein, 25 aa, Entamoeba invadens
ERECVSSCVLLRSLLLNILFDKSGG

SEQ ID NO: 2934393 - protein, 18 aa, Entamoeba invadens
EREEGLLLNVFKVDKTDG

SEQ ID NO: 2934394 - protein, 19 aa, Entamoeba invadens
EREKMELFDEKKEKNLEDK

SEQ ID NO: 2934395 - protein, 18 aa, Entamoeba invadens
EREMREMIEESQAYLAIQ

SEQ ID NO: 2934396 - protein, 17 aa, Entamoeba invadens
ERENCHVREELRKQHEK

SEQ ID NO: 2934397 - protein, 24 aa, Entamoeba invadens
ERESWLRTFETVRIVFQRNNPERL

SEQ ID NO: 2934398 - protein, 22 aa, Entamoeba invadens
  misc_feature (16)..(17): Xaa can be any naturally occurring amino acid
EREWVWKYNSTYIWYXXSWGYL

SEQ ID NO: 2934399 - protein, 21 aa, Entamoeba invadens
ERFEKLCSFEDNYKNLRNQTI

SEQ ID NO: 2934400 - protein, 51 aa, Entamoeba invadens
ERFFGRLKTVFAFARTKFVKAFENFDAMFVFSCCFCNVDIQINPLIAEDAA

SEQ ID NO: 2934401 - protein, 31 aa, Entamoeba invadens
ERFGFKSECMVKYDFEIYNLFISTFECLPLA

SEQ ID NO: 2934402 - protein, 28 aa, Entamoeba invadens
ERFIELLAYYKRFWIEKIGTKRWSQFFV

SEQ ID NO: 2934403 - protein, 23 aa, Entamoeba invadens
ERFNFPITFQKQYFRVESPLQWL

SEQ ID NO: 2934404 - protein, 18 aa, Entamoeba invadens
ERFNHAAGVINMIDYGDS

SEQ ID NO: 2934405 - protein, 24 aa, Entamoeba invadens
ERFRCPEALFQPSFLGMEASGIHE

SEQ ID NO: 2934406 - protein, 24 aa, Entamoeba invadens
ERFRCPEALFQPSFLVMEASGIHE

SEQ ID NO: 2934407 - protein, 26 aa, Entamoeba invadens
ERFRCPEALFVPGYIGLECDGIHETT

SEQ ID NO: 2934408 - protein, 22 aa, Entamoeba invadens
ERFRSVMPVYFRGATSAIIVYD

SEQ ID NO: 2934409 - protein, 20 aa, Entamoeba invadens
ERFSNGKVCVVDYYDNSLVK

SEQ ID NO: 2934410 - protein, 18 aa, Entamoeba invadens
ERFVDVFDCHDVAKLDAG

SEQ ID NO: 2934411 - protein, 23 aa, Entamoeba invadens
ERGDMHFYLVGFYGSVFGKNAEK

SEQ ID NO: 2934412 - protein, 17 aa, Entamoeba invadens
ERGFLKKMMDKHVVNAY

SEQ ID NO: 2934413 - protein, 19 aa, Entamoeba invadens
ERGLVYGFYCYQKLSPSQD

SEQ ID NO: 2934414 - protein, 18 aa, Entamoeba invadens
ERGTVCVGRGSLWGIEGD

SEQ ID NO: 2934415 - protein, 20 aa, Entamoeba invadens
ERGYIFGSYFEKVIDKMDVW

SEQ ID NO: 2934416 - protein, 17 aa, Entamoeba invadens
ERHAFDVDDLLKKLQSA

SEQ ID NO: 2934417 - protein, 23 aa, Entamoeba invadens
ERHEKLFLKCPVERGIVNNYDDF

SEQ ID NO: 2934418 - protein, 17 aa, Entamoeba invadens
ERICGKKNILFLIITNE

SEQ ID NO: 2934419 - protein, 27 aa, Entamoeba invadens
ERICSCEIKDSIALFGIPFTITRMKIV

SEQ ID NO: 2934420 - protein, 17 aa, Entamoeba invadens
ERICTAADMSMGFDLNE

SEQ ID NO: 2934421 - protein, 17 aa, Entamoeba invadens
ERIDREILRLHEQSDEG

SEQ ID NO: 2934422 - protein, 19 aa, Entamoeba invadens
ERIEACLKALSALINIAAV

SEQ ID NO: 2934423 - protein, 20 aa, Entamoeba invadens
ERIGYCVSLGRLNYLKRHSE

SEQ ID NO: 2934424 - protein, 24 aa, Entamoeba invadens
ERIKALEAEEKWALERDQQNKVNS

SEQ ID NO: 2934425 - protein, 23 aa, Entamoeba invadens
ERIKDGCFMNCLSLKEVKCEGNT

SEQ ID NO: 2934426 - protein, 20 aa, Entamoeba invadens
ERIKGLRLFNRNIQVFSNNY

SEQ ID NO: 2934427 - protein, 24 aa, Entamoeba invadens
ERIKLEHWERYKGGLDVKKNCTGT

SEQ ID NO: 2934428 - protein, 27 aa, Entamoeba invadens
ERIKNGDVMGCGYLADKKMIFFTKNGH

SEQ ID NO: 2934429 - protein, 18 aa, Entamoeba invadens
ERIKRYRIYLGLDTSEST

SEQ ID NO: 2934430 - protein, 22 aa, Entamoeba invadens
ERILCPKCLTLGGEDLGSCVPK

SEQ ID NO: 2934431 - protein, 17 aa, Entamoeba invadens
ERILREWLTSIDSYTSS

SEQ ID NO: 2934432 - protein, 17 aa, Entamoeba invadens
ERIPIGVIYDADVLYQE

SEQ ID NO: 2934433 - protein, 17 aa, Entamoeba invadens
ERISKTILMTFGTASPN

SEQ ID NO: 2934434 - protein, 28 aa, Entamoeba invadens
ERITIPSILTFFGKNAFKNCNKLTSIEF

SEQ ID NO: 2934435 - protein, 17 aa, Entamoeba invadens
ERKDIFVPSELTKPKAV

SEQ ID NO: 2934436 - protein, 22 aa, Entamoeba invadens
ERKEAKCPLTANSKDAEIGGHD

SEQ ID NO: 2934437 - protein, 18 aa, Entamoeba invadens
ERKEAKLIRREQKEKRRQ

SEQ ID NO: 2934438 - protein, 21 aa, Entamoeba invadens
ERKGKMIEVFVRYFKGNCQQR

SEQ ID NO: 2934439 - protein, 22 aa, Entamoeba invadens
ERKILERQFEVLVHLSCSDKKM

SEQ ID NO: 2934440 - protein, 25 aa, Entamoeba invadens
ERKILKEVCTLVVKRSGYLASAVTV

SEQ ID NO: 2934441 - protein, 20 aa, Entamoeba invadens
ERKKKVFALLKTESKNAEKR

SEQ ID NO: 2934442 - protein, 24 aa, Entamoeba invadens
ERKKRAKHNFKIRTLPVTARALDS

SEQ ID NO: 2934443 - protein, 21 aa, Entamoeba invadens
ERKKVELASIVLKESDDTESS

SEQ ID NO: 2934444 - protein, 26 aa, Entamoeba invadens
ERKLIFDFLSKIFVFEADKRMSPFEA

SEQ ID NO: 2934445 - protein, 19 aa, Entamoeba invadens
ERKLVKCDELVSFIEESRK

SEQ ID NO: 2934446 - protein, 24 aa, Entamoeba invadens
ERKMHFKILMGFINELVDNSISFF

SEQ ID NO: 2934447 - protein, 19 aa, Entamoeba invadens
ERKNSELGFRMSNDGNCVF

SEQ ID NO: 2934448 - protein, 23 aa, Entamoeba invadens
ERKPEFMVALNSCFLSEYEKVKQ

SEQ ID NO: 2934449 - protein, 25 aa, Entamoeba invadens
ERKRRLEKILLYFLSIEETFDDDVK

SEQ ID NO: 2934450 - protein, 22 aa, Entamoeba invadens
ERKTEWIQSPIFSFTVTLPDGC

SEQ ID NO: 2934451 - protein, 24 aa, Entamoeba invadens
ERKTPRIRDVWAYAPPKSKRSPMM

SEQ ID NO: 2934452 - protein, 18 aa, Entamoeba invadens
ERKVCFRDQSCLNLSSDW

SEQ ID NO: 2934453 - protein, 27 aa, Entamoeba invadens
ERKVLPPKLPDSLRHDTIDRSEKDEKS

SEQ ID NO: 2934454 - protein, 24 aa, Entamoeba invadens
ERKYVKLYVQFFIYIRSLMQRDPQ

SEQ ID NO: 2934455 - protein, 22 aa, Entamoeba invadens
ERLDLSHVISFGVQNYMTRLTA

SEQ ID NO: 2934456 - protein, 17 aa, Entamoeba invadens
ERLEAERVIKEKEEQER

SEQ ID NO: 2934457 - protein, 21 aa, Entamoeba invadens
ERLEIRPCDFLLICGDVTNRG

SEQ ID NO: 2934458 - protein, 25 aa, Entamoeba invadens
ERLELSYYRRDECAFRIGKDTMNWS

SEQ ID NO: 2934459 - protein, 17 aa, Entamoeba invadens
ERLETAIYLQFHQSTTL

SEQ ID NO: 2934460 - protein, 24 aa, Entamoeba invadens
ERLKEGRGFSVMRNVIYKMCEIFA

SEQ ID NO: 2934461 - protein, 25 aa, Entamoeba invadens
ERLKGGLEGLKFTRYRRSTVNRISS

SEQ ID NO: 2934462 - protein, 19 aa, Entamoeba invadens
ERLKKASIQGGKRFAQEGT

SEQ ID NO: 2934463 - protein, 25 aa, Entamoeba invadens
ERLKRFNTMQSWGVLLMTIRVGACG

SEQ ID NO: 2934464 - protein, 18 aa, Entamoeba invadens
ERLLECGLNVTLLTQQYR

SEQ ID NO: 2934465 - protein, 21 aa, Entamoeba invadens
ERLLLKKMIDFCGGYYMEDME

SEQ ID NO: 2934466 - protein, 23 aa, Entamoeba invadens
ERLLLKNMIDFCGGMYMEDMESR

SEQ ID NO: 2934467 - protein, 25 aa, Entamoeba invadens
ERLNMPSPRPKKMTIAKLSLSQTEP

SEQ ID NO: 2934468 - protein, 20 aa, Entamoeba invadens
ERLPLLSFKTPSTLGTNSEI

SEQ ID NO: 2934469 - protein, 20 aa, Entamoeba invadens
ERLRFIKVIQSLAPTTKHGV

SEQ ID NO: 2934470 - protein, 20 aa, Entamoeba invadens
ERLRMVKIVSYYVLNCQLPP

SEQ ID NO: 2934471 - protein, 26 aa, Entamoeba invadens
ERLSDICLRSSAAPTYFEPYQMYVDG

SEQ ID NO: 2934472 - protein, 18 aa, Entamoeba invadens
ERLTKRVNSSFCSEANEC

SEQ ID NO: 2934473 - protein, 24 aa, Entamoeba invadens
ERLVLKTPFFLSLKLFGGKLIPVM

SEQ ID NO: 2934474 - protein, 19 aa, Entamoeba invadens
ERLVTIRGMVTRVSNLIPS

SEQ ID NO: 2934475 - protein, 18 aa, Entamoeba invadens
ERLYEPGEITFSCLTKIE

SEQ ID NO: 2934476 - protein, 18 aa, Entamoeba invadens
ERLYRVIETCWKQKPVER

SEQ ID NO: 2934477 - protein, 20 aa, Entamoeba invadens
ERMEEEFLYILKKFLIKMDC

SEQ ID NO: 2934478 - protein, 18 aa, Entamoeba invadens
ERMELKGKVVFKIVSKKK

SEQ ID NO: 2934479 - protein, 17 aa, Entamoeba invadens
ERMKFIVTQLLEQRRKG

SEQ ID NO: 2934480 - protein, 22 aa, Entamoeba invadens
ERMRCISSGVILTSSIQETPGY

SEQ ID NO: 2934481 - protein, 17 aa, Entamoeba invadens
ERMTFDFSNSGVLFQTE

SEQ ID NO: 2934482 - protein, 23 aa, Entamoeba invadens
ERMYGCLAKFAIVRAIKRIPRLS

SEQ ID NO: 2934483 - protein, 33 aa, Entamoeba invadens
ERNAFEEILEVPRRCQLLCKKNKISTVTVQKKV

SEQ ID NO: 2934484 - protein, 19 aa, Entamoeba invadens
ERNCACALFQIYNKITTTY

SEQ ID NO: 2934485 - protein, 23 aa, Entamoeba invadens
ERNIKLGIDFPKYPCVIPHPKIP

SEQ ID NO: 2934486 - protein, 20 aa, Entamoeba invadens
ERNKASGVAHIYFYRNNPLF

SEQ ID NO: 2934487 - protein, 22 aa, Entamoeba invadens
ERNLAVQSCQWVDEVVDGINIW

SEQ ID NO: 2934488 - protein, 17 aa, Entamoeba invadens
ERNRRLFEEKIRQENER

SEQ ID NO: 2934489 - protein, 21 aa, Entamoeba invadens
ERNWMCREFKEIVYDPRDTID

SEQ ID NO: 2934490 - protein, 23 aa, Entamoeba invadens
ERPDKKLSFSFFRRKKETPKLTE

SEQ ID NO: 2934491 - protein, 47 aa, Entamoeba invadens
ERPKYRIKKRIEWCQNKSTALEILGHIKCEFEVAMTKIKHMDCEKER

SEQ ID NO: 2934492 - protein, 18 aa, Entamoeba invadens
ERPLDVFVGNNNRIENVN

SEQ ID NO: 2934493 - protein, 19 aa, Entamoeba invadens
ERPLFLPCVETCFQLIPKF

SEQ ID NO: 2934494 - protein, 20 aa, Entamoeba invadens
ERPNFHISIRTNRNGSNPTQ

SEQ ID NO: 2934495 - protein, 28 aa, Entamoeba invadens
ERPPLYQGKVLYDFVMKNSECLSVHSND

SEQ ID NO: 2934496 - protein, 19 aa, Entamoeba invadens
ERPRLQKKKGIPPIQSVEH

SEQ ID NO: 2934497 - protein, 24 aa, Entamoeba invadens
ERQFYMKYLKIMRSEIRRVDEENV

SEQ ID NO: 2934498 - protein, 18 aa, Entamoeba invadens
ERQHEVKIGRITEKCDKV

SEQ ID NO: 2934499 - protein, 23 aa, Entamoeba invadens
ERQNLRYLPQFFGMEQSALTKAC

SEQ ID NO: 2934500 - protein, 22 aa, Entamoeba invadens
ERREMCMQFIKLLDAPQKVILG

SEQ ID NO: 2934501 - protein, 19 aa, Entamoeba invadens
ERRGWLNEHTHAIVSLKNQ

SEQ ID NO: 2934502 - protein, 20 aa, Entamoeba invadens
ERRIKKSVTLFSKKDVAFEV

SEQ ID NO: 2934503 - protein, 25 aa, Entamoeba invadens
ERRILGRSGLKRFVNKEATRTNTKK

SEQ ID NO: 2934504 - protein, 23 aa, Entamoeba invadens
ERRPFKCILDVGLARTTTGARIF

SEQ ID NO: 2934505 - protein, 17 aa, Entamoeba invadens
ERRQMKRMWKWQMMNQM

SEQ ID NO: 2934506 - protein, 28 aa, Entamoeba invadens
ERRRKRHEFRMNPLLSIFGVTEQKTIAS

SEQ ID NO: 2934507 - protein, 19 aa, Entamoeba invadens
ERRVFRSVALEGYVVKFIS

SEQ ID NO: 2934508 - protein, 17 aa, Entamoeba invadens
ERRVTTLDGCFEPLMSA

SEQ ID NO: 2934509 - protein, 19 aa, Entamoeba invadens
ERRYAFKAYSEIVKKIAKE

SEQ ID NO: 2934510 - protein, 17 aa, Entamoeba invadens
ERRYQDWTEISKMKITY

SEQ ID NO: 2934511 - protein, 27 aa, Entamoeba invadens
ERRYVQLYVKFFVKVRNAMLVVDTKKD

SEQ ID NO: 2934512 - protein, 30 aa, Entamoeba invadens
ERSLKLDIDFSCICSLRICNCNNVEFDNEF

SEQ ID NO: 2934513 - protein, 27 aa, Entamoeba invadens
ERSLLEKWSGLKFRKVLFDSTKDDYAV

SEQ ID NO: 2934514 - protein, 21 aa, Entamoeba invadens
ERTEKLLKERTEAVEQAEKEL

SEQ ID NO: 2934515 - protein, 17 aa, Entamoeba invadens
ERTHPTGYSMKKSTPLS

SEQ ID NO: 2934516 - protein, 18 aa, Entamoeba invadens
ERTLGIMLDVPFKVLMER

SEQ ID NO: 2934517 - protein, 27 aa, Entamoeba invadens
ERTLKVVTAICLGRWVVNEEWIQECIE

SEQ ID NO: 2934518 - protein, 26 aa, Entamoeba invadens
ERTPFKFTGHFAHVMGGRGAPNFKLF

SEQ ID NO: 2934519 - protein, 18 aa, Entamoeba invadens
ERTPLGVYRVQSRMTIGQ

SEQ ID NO: 2934520 - protein, 19 aa, Entamoeba invadens
ERTQFYIAQIILAIECLHQ

SEQ ID NO: 2934521 - protein, 29 aa, Entamoeba invadens
ERTRNVISWQYICKVIFYCLSYIHKDNIF

SEQ ID NO: 2934522 - protein, 24 aa, Entamoeba invadens
ERTVDYFLHYKVSPSTTYISHPAS

SEQ ID NO: 2934523 - protein, 20 aa, Entamoeba invadens
ERTVPITVCIVAEKSDCLFS

SEQ ID NO: 2934524 - protein, 20 aa, Entamoeba invadens
ERVCKQCYEEYLATHSDKKI

SEQ ID NO: 2934525 - protein, 26 aa, Entamoeba invadens
ERVEEVIRIVILRYGFGITPFVSEFM

SEQ ID NO: 2934526 - protein, 23 aa, Entamoeba invadens
ERVENWCGLKIGQVLFDSTTDDW

SEQ ID NO: 2934527 - protein, 27 aa, Entamoeba invadens
ERVKKMKCFICGEIGHSNHRCPNKDGK

SEQ ID NO: 2934528 - protein, 21 aa, Entamoeba invadens
ERVKRLAKYRIRQYEKQHAVL

SEQ ID NO: 2934529 - protein, 22 aa, Entamoeba invadens
ERVLGSWAICKIEFEKNDYRKF

SEQ ID NO: 2934530 - protein, 18 aa, Entamoeba invadens
ERVSSYVFDLLKDKSKFV

SEQ ID NO: 2934531 - protein, 21 aa, Entamoeba invadens
ERVTLNITGPIFSYCKTKMFD

SEQ ID NO: 2934532 - protein, 20 aa, Entamoeba invadens
ERVTTVALKRGAAFENSINK

SEQ ID NO: 2934533 - protein, 20 aa, Entamoeba invadens
ERVVRYIKYLFGVLEQLKND

SEQ ID NO: 2934534 - protein, 17 aa, Entamoeba invadens
ERVWISGEEDLMFTLMV

SEQ ID NO: 2934535 - protein, 21 aa, Entamoeba invadens
ERYEAYGWNVLHCDGNCVEQV

SEQ ID NO: 2934536 - protein, 21 aa, Entamoeba invadens
ERYGFPEALFNPSVIGLTQEG

SEQ ID NO: 2934537 - protein, 17 aa, Entamoeba invadens
ERYILAFIVDIEITKIN

SEQ ID NO: 2934538 - protein, 20 aa, Entamoeba invadens
ERYISAFIVDIEITKGNKHL

SEQ ID NO: 2934539 - protein, 20 aa, Entamoeba invadens
ERYISAFIVDIEITKINKEL

SEQ ID NO: 2934540 - protein, 20 aa, Entamoeba invadens
ERYISAFIVKIEITKVNKHL

SEQ ID NO: 2934541 - protein, 21 aa, Entamoeba invadens
ERYISAFIVYIEITKVNKHLH

SEQ ID NO: 2934542 - protein, 35 aa, Entamoeba invadens
ERYKNLLKMTGEFKLEFFGQFGLPKNSVFEDFHTL

SEQ ID NO: 2934543 - protein, 19 aa, Entamoeba invadens
ERYMFERASMKLGLDQAIL

SEQ ID NO: 2934544 - protein, 22 aa, Entamoeba invadens
ERYMMADLFGLLPHAKKEAKYD

SEQ ID NO: 2934545 - protein, 20 aa, Entamoeba invadens
ERYNFVMFLFCEVFENHDVH

SEQ ID NO: 2934546 - protein, 25 aa, Entamoeba invadens
ERYPHQLACKLFRPNEENILEQITE

SEQ ID NO: 2934547 - protein, 27 aa, Entamoeba invadens
ERYQSIPAMLFRNCLGAVVVYDITSRE

SEQ ID NO: 2934548 - protein, 20 aa, Entamoeba invadens
ERYRRWRLSTKEELAQKLKI

SEQ ID NO: 2934549 - protein, 21 aa, Entamoeba invadens
ERYRSLSAIYYRNATVALLVF

SEQ ID NO: 2934550 - protein, 26 aa, Entamoeba invadens
ERYSVPLNMALLFHKKYNIFSGKYVV

SEQ ID NO: 2934551 - protein, 20 aa, Entamoeba invadens
ERYSYGSLRNHQACVEAVML

SEQ ID NO: 2934552 - protein, 26 aa, Entamoeba invadens
ESAFAFCVPYAFAIGINGVSTISPKF

SEQ ID NO: 2934553 - protein, 21 aa, Entamoeba invadens
ESAFENCDWLTAVTLGGISEM

SEQ ID NO: 2934554 - protein, 18 aa, Entamoeba invadens
ESAFKYFMMKKSCDFAEF

SEQ ID NO: 2934555 - protein, 19 aa, Entamoeba invadens
ESAFRLCSFQRISLPESIL

SEQ ID NO: 2934556 - protein, 19 aa, Entamoeba invadens
ESAGFSRSNPYYIVQQNRV

SEQ ID NO: 2934557 - protein, 19 aa, Entamoeba invadens
ESAIEYYFRYCYGTKGMKI

SEQ ID NO: 2934558 - protein, 25 aa, Entamoeba invadens
ESAKLHVIPSFNKRRTVGIFDAPIH

SEQ ID NO: 2934559 - protein, 20 aa, Entamoeba invadens
ESAKRLSFFDERNKTIGNEK

SEQ ID NO: 2934560 - protein, 21 aa, Entamoeba invadens
ESALEKLLMAHGVTTPLEHMF

SEQ ID NO: 2934561 - protein, 20 aa, Entamoeba invadens
ESALHIGCLCGNKNVVEVLR

SEQ ID NO: 2934562 - protein, 20 aa, Entamoeba invadens
ESAMKILLARYYGGRMIQPS

SEQ ID NO: 2934563 - protein, 17 aa, Entamoeba invadens
ESAPFVLTVDFLYVITM

SEQ ID NO: 2934564 - protein, 17 aa, Entamoeba invadens
ESATMKTICHIHVVAFH

SEQ ID NO: 2934565 - protein, 19 aa, Entamoeba invadens
ESAYRVIGMLGRGSFGQVF

SEQ ID NO: 2934566 - protein, 19 aa, Entamoeba invadens
ESCFCGCSNLSYVTIPLNV

SEQ ID NO: 2934567 - protein, 27 aa, Entamoeba invadens
ESCFKECSKLSCIVIPSSVTFIGKNCF

SEQ ID NO: 2934568 - protein, 24 aa, Entamoeba invadens
ESCKIAEPMKALLTKPNEIKAEEA

SEQ ID NO: 2934569 - protein, 19 aa, Entamoeba invadens
ESDCVIIYFGDLIRDNHTT

SEQ ID NO: 2934570 - protein, 22 aa, Entamoeba invadens
ESDEIFKRKNVKKIGTRKTQIP

SEQ ID NO: 2934571 - protein, 28 aa, Entamoeba invadens
ESDFCFNEWDALFLMKRTINEYLSRTAR

SEQ ID NO: 2934572 - protein, 22 aa, Entamoeba invadens
ESDFMFKGALPQFDSAFRLEEM

SEQ ID NO: 2934573 - protein, 24 aa, Entamoeba invadens
ESDFPYELETIWMTAAKEVSHGFF

SEQ ID NO: 2934574 - protein, 22 aa, Entamoeba invadens
ESDGESMCEWIFNSLAFDTNKE

SEQ ID NO: 2934575 - protein, 18 aa, Entamoeba invadens
ESDIFLVVFNINEFNRIN

SEQ ID NO: 2934576 - protein, 24 aa, Entamoeba invadens
ESDLFKNVEWELVFERTCTTVSFE

SEQ ID NO: 2934577 - protein, 23 aa, Entamoeba invadens
ESDLPRTCDFLSSEILKYLQDNC

SEQ ID NO: 2934578 - protein, 27 aa, Entamoeba invadens
ESDLSCVLHFEKGCEGMTTDIPITLLS

SEQ ID NO: 2934579 - protein, 23 aa, Entamoeba invadens
ESDNVKAYCCFYMTSEDFLRLGK

SEQ ID NO: 2934580 - protein, 26 aa, Entamoeba invadens
ESDTKCLSCKYGFYMGENYLCLPSTE

SEQ ID NO: 2934581 - protein, 27 aa, Entamoeba invadens
ESDVFWILKSIMEFMGVFYRKDEKRKK

SEQ ID NO: 2934582 - protein, 20 aa, Entamoeba invadens
ESDVKCEFVAKEVNYNGILK

SEQ ID NO: 2934583 - protein, 25 aa, Entamoeba invadens
ESDVLPMYARACVYISNLYENLGVK

SEQ ID NO: 2934584 - protein, 25 aa, Entamoeba invadens
ESEDIRPKFIIKNKVDEIPHFASET

SEQ ID NO: 2934585 - protein, 23 aa, Entamoeba invadens
ESEDLWKLKKKPLLMTYDEMSKC

SEQ ID NO: 2934586 - protein, 23 aa, Entamoeba invadens
ESEDRIPIMFTVFSSAGYNGNNK

SEQ ID NO: 2934587 - protein, 24 aa, Entamoeba invadens
ESEFDVWNSIIFDQIEKIKNGDVN

SEQ ID NO: 2934588 - protein, 18 aa, Entamoeba invadens
ESEHLVNIDLKFDDVRKA

SEQ ID NO: 2934589 - protein, 21 aa, Entamoeba invadens
ESEIFKLLQIAHRNRSVAETE

SEQ ID NO: 2934590 - protein, 23 aa, Entamoeba invadens
ESEITRDCKIGISGLFSVQDTGK

SEQ ID NO: 2934591 - protein, 26 aa, Entamoeba invadens
ESEIYKYLDFLAVDGVFMYLNNKIIR

SEQ ID NO: 2934592 - protein, 25 aa, Entamoeba invadens
ESEKKIFMRLGIKVLNVMKSEEIVE

SEQ ID NO: 2934593 - protein, 26 aa, Entamoeba invadens
ESEKKIFMRLGIKVLNVMKSEEIVEK

SEQ ID NO: 2934594 - protein, 25 aa, Entamoeba invadens
ESEKYKFAYILIEGYNGSIPKDDKI

SEQ ID NO: 2934595 - protein, 19 aa, Entamoeba invadens
ESELRRLFRRFKKLDTKSK

SEQ ID NO: 2934596 - protein, 21 aa, Entamoeba invadens
ESERRLALFRMKKVLTNYKEF

SEQ ID NO: 2934597 - protein, 21 aa, Entamoeba invadens
ESERSSRSCVEFSVRGTPSDL

SEQ ID NO: 2934598 - protein, 21 aa, Entamoeba invadens
ESESFLQFMADVIDAHNRILE

SEQ ID NO: 2934599 - protein, 18 aa, Entamoeba invadens
ESETIFEKSLKYLEGKSD

SEQ ID NO: 2934600 - protein, 24 aa, Entamoeba invadens
ESFALIPMRMREMYPINFEDTEEM

SEQ ID NO: 2934601 - protein, 26 aa, Entamoeba invadens
ESFAPLKMCVDCVVVTYNIFELIWQH

SEQ ID NO: 2934602 - protein, 22 aa, Entamoeba invadens
ESFDKFLKRCERECVSSCVLLR

SEQ ID NO: 2934603 - protein, 17 aa, Entamoeba invadens
ESFEVLRCYVFSLENGF

SEQ ID NO: 2934604 - protein, 19 aa, Entamoeba invadens
ESFFKKFILPYLDALKKNT

SEQ ID NO: 2934605 - protein, 29 aa, Entamoeba invadens
ESFGKVKECRLMIYRGYSKGFGFVEYETE

SEQ ID NO: 2934606 - protein, 25 aa, Entamoeba invadens
ESFGVQSFYCCLTLESIELPKYIKK

SEQ ID NO: 2934607 - protein, 24 aa, Entamoeba invadens
ESFKTQFNHCFVIVGFDTTQKNPP

SEQ ID NO: 2934608 - protein, 24 aa, Entamoeba invadens
ESFKVPSLYICRPSVLPIYSAGTT

SEQ ID NO: 2934609 - protein, 20 aa, Entamoeba invadens
ESFPQFLAKEYIPVLFDVSF

SEQ ID NO: 2934610 - protein, 25 aa, Entamoeba invadens
ESFRFTKEKMRLCRVNTKGLYSKYT

SEQ ID NO: 2934611 - protein, 17 aa, Entamoeba invadens
ESFRGCKNVTKIVIPST

SEQ ID NO: 2934612 - protein, 22 aa, Entamoeba invadens
ESFRPLSYPSTDIFLLCFNVIQ

SEQ ID NO: 2934613 - protein, 19 aa, Entamoeba invadens
ESFTLRLVDFTMKEKENNK

SEQ ID NO: 2934614 - protein, 23 aa, Entamoeba invadens
ESGFPTHTFLQVFPLEKNSENFF

SEQ ID NO: 2934615 - protein, 22 aa, Entamoeba invadens
ESGHCTKCFSSFLISQNSKCES

SEQ ID NO: 2934616 - protein, 26 aa, Entamoeba invadens
ESGHWNLYVVCCSGLVEGGSDEFQES

SEQ ID NO: 2934617 - protein, 18 aa, Entamoeba invadens
ESGIKQKTAFRRTQSNKR

SEQ ID NO: 2934618 - protein, 31 aa, Entamoeba invadens
ESGKSVYLDTRFEWDIGTVITDYIVKISSEF

SEQ ID NO: 2934619 - protein, 17 aa, Entamoeba invadens
ESGKTSLIRRFVHGAQI

SEQ ID NO: 2934620 - protein, 20 aa, Entamoeba invadens
ESGLLCRGAFKGRTVFTSVI

SEQ ID NO: 2934621 - protein, 32 aa, Entamoeba invadens
ESGLNKSLRPLAWRIFLGVLPSEFGEGWEKII

SEQ ID NO: 2934622 - protein, 19 aa, Entamoeba invadens
ESGNFIFSFHCPDEFDGTF

SEQ ID NO: 2934623 - protein, 22 aa, Entamoeba invadens
ESGRVPSPLGISLSTISLSNSF

SEQ ID NO: 2934624 - protein, 20 aa, Entamoeba invadens
ESGTFPLYYAVKAKNTNVMQ

SEQ ID NO: 2934625 - protein, 22 aa, Entamoeba invadens
ESHKKFKNVLAVIQKLAPTLHA

SEQ ID NO: 2934626 - protein, 18 aa, Entamoeba invadens
ESHLFGFFFSGGVTATER

SEQ ID NO: 2934627 - protein, 26 aa, Entamoeba invadens
ESHLPPKTVHWFKNFDSYEYSFFISL

SEQ ID NO: 2934628 - protein, 20 aa, Entamoeba invadens
ESHLRFFKKQPSGAFEQMLI

SEQ ID NO: 2934629 - protein, 19 aa, Entamoeba invadens
ESHRVKFVLISWASESITK

SEQ ID NO: 2934630 - protein, 19 aa, Entamoeba invadens
ESHVLFPVSLELSPINVCA

SEQ ID NO: 2934631 - protein, 20 aa, Entamoeba invadens
ESHVSFGKDVILEIKKDIPE

SEQ ID NO: 2934632 - protein, 22 aa, Entamoeba invadens
ESIAEAMLVMFERCKIISEGAG

SEQ ID NO: 2934633 - protein, 26 aa, Entamoeba invadens
ESIAHAMVMMLERCKIVSEGAGATPV

SEQ ID NO: 2934634 - protein, 17 aa, Entamoeba invadens
ESIELSSLIKSSGLIPS

SEQ ID NO: 2934635 - protein, 21 aa, Entamoeba invadens
ESIEVKAVFLKQGELEMEKKV

SEQ ID NO: 2934636 - protein, 21 aa, Entamoeba invadens
ESIFLCSSLTFFIFPLSLRRI

SEQ ID NO: 2934637 - protein, 20 aa, Entamoeba invadens
ESIGSLGMYCMFTVVETLPN

SEQ ID NO: 2934638 - protein, 24 aa, Entamoeba invadens
ESIHLPKTLTFIGEECFKFCSSLK

SEQ ID NO: 2934639 - protein, 17 aa, Entamoeba invadens
ESIKNFCNSELCLVIGD

SEQ ID NO: 2934640 - protein, 33 aa, Entamoeba invadens
ESIKQMSGFGIIVGGFFRPFVTYKQTPLSSDAN

SEQ ID NO: 2934641 - protein, 28 aa, Entamoeba invadens
ESILIKLLLPYCDIVFCKPSKRTTTTFQ

SEQ ID NO: 2934642 - protein, 21 aa, Entamoeba invadens
ESILRINCIVTTFVISDDKTT

SEQ ID NO: 2934643 - protein, 18 aa, Entamoeba invadens
ESIPFVPLTISFCSESKP

SEQ ID NO: 2934644 - protein, 19 aa, Entamoeba invadens
ESIQMYTLIFYKDKEVEVD

SEQ ID NO: 2934645 - protein, 22 aa, Entamoeba invadens
ESIQSSGFFCWHGSDDNCIQSI

SEQ ID NO: 2934646 - protein, 22 aa, Entamoeba invadens
ESISRLKVNPCYQELSLETILQ

SEQ ID NO: 2934647 - protein, 27 aa, Entamoeba invadens
ESITKPKLRASMSMLKGEMKNEIFKNF

SEQ ID NO: 2934648 - protein, 21 aa, Entamoeba invadens
ESITMFCCKNLNKFTLPKSVK

SEQ ID NO: 2934649 - protein, 20 aa, Entamoeba invadens
ESITSIGMSCFSCCNISSIN

SEQ ID NO: 2934650 - protein, 26 aa, Entamoeba invadens
ESKDRFRLLYTFLRKYKGKKMIVFMS

SEQ ID NO: 2934651 - protein, 25 aa, Entamoeba invadens
ESKEFICESSGLPLTRIYELEHLHK

SEQ ID NO: 2934652 - protein, 23 aa, Entamoeba invadens
ESKEHWCGLKHANLSVEKLRMFS

SEQ ID NO: 2934653 - protein, 31 aa, Entamoeba invadens
ESKETFYMMCLKLSHVFSYLDRFFVKHQKAV

SEQ ID NO: 2934654 - protein, 20 aa, Entamoeba invadens
ESKIGVGFDEKHFIFTLSPT

SEQ ID NO: 2934655 - protein, 25 aa, Entamoeba invadens
ESKIIYIRRYFDYIVDLFDLDKKRM

SEQ ID NO: 2934656 - protein, 19 aa, Entamoeba invadens
ESKKKGKLVTEVITDEVTL

SEQ ID NO: 2934657 - protein, 25 aa, Entamoeba invadens
ESKMFSPKFLKAFFIYCQAKDVISA

SEQ ID NO: 2934658 - protein, 28 aa, Entamoeba invadens
ESKREIDLRVGFAFTRLSTSLLRTQFST

SEQ ID NO: 2934659 - protein, 27 aa, Entamoeba invadens
ESKREIDLRVGFAFTRLSTSLLTTQFS

SEQ ID NO: 2934660 - protein, 24 aa, Entamoeba invadens
ESKSDFLLKEARVMRLCVHPNVVA

SEQ ID NO: 2934661 - protein, 17 aa, Entamoeba invadens
ESKSGWNSTDMVSFGYE

SEQ ID NO: 2934662 - protein, 21 aa, Entamoeba invadens
ESKTERNSPCTLTKREKGKTV

SEQ ID NO: 2934663 - protein, 33 aa, Entamoeba invadens
ESKTQFSYEGLRNDFSLAVRFLISQNISQLKKC

SEQ ID NO: 2934664 - protein, 30 aa, Entamoeba invadens
ESKTSINPIEFRAQVVLHCVEGISRFYKIV

SEQ ID NO: 2934665 - protein, 22 aa, Entamoeba invadens
ESKTSTGEYVFDRPTFIYLDET

SEQ ID NO: 2934666 - protein, 19 aa, Entamoeba invadens
ESLAVMFTSFKYLRFLNTD

SEQ ID NO: 2934667 - protein, 24 aa, Entamoeba invadens
ESLERFSYIPIRRMKSCLDFIAFE

SEQ ID NO: 2934668 - protein, 21 aa, Entamoeba invadens
ESLEVRLSLMIATAKVYQALP

SEQ ID NO: 2934669 - protein, 26 aa, Entamoeba invadens
ESLFEFLKLKPLVFLALQPIVGDIYL

SEQ ID NO: 2934670 - protein, 19 aa, Entamoeba invadens
ESLFGYEAFTYCSSLQTIY

SEQ ID NO: 2934671 - protein, 27 aa, Entamoeba invadens
ESLGNMCFCGCSSLKSFDLSNFRSVGK

SEQ ID NO: 2934672 - protein, 20 aa, Entamoeba invadens
ESLGTFLIELRQTCVVNMIR

SEQ ID NO: 2934673 - protein, 23 aa, Entamoeba invadens
ESLHLPKSLKFIKMTNVPIYEDM

SEQ ID NO: 2934674 - protein, 20 aa, Entamoeba invadens
ESLIKVLMLLKLSAKGTSSK

SEQ ID NO: 2934675 - protein, 23 aa, Entamoeba invadens
ESLKAELTALVTKSKMIEDKNIE

SEQ ID NO: 2934676 - protein, 18 aa, Entamoeba invadens
ESLKCIDIPEGVIDISDN

SEQ ID NO: 2934677 - protein, 18 aa, Entamoeba invadens
ESLKCIDIPEGVIDISND

SEQ ID NO: 2934678 - protein, 19 aa, Entamoeba invadens
ESLKLDHRIATGKDDYVPV

SEQ ID NO: 2934679 - protein, 20 aa, Entamoeba invadens
ESLKSIGSLAFSGCGLTQVS

SEQ ID NO: 2934680 - protein, 18 aa, Entamoeba invadens
ESLLQCRLLQKIYIVVAT

SEQ ID NO: 2934681 - protein, 26 aa, Entamoeba invadens
ESLMKKYFGVLFMKLGSENTNDFLEI

SEQ ID NO: 2934682 - protein, 20 aa, Entamoeba invadens
ESLPHGFSIQGGEKNKATWG

SEQ ID NO: 2934683 - protein, 19 aa, Entamoeba invadens
ESLPIFRELVTPSNGKKTT

SEQ ID NO: 2934684 - protein, 21 aa, Entamoeba invadens
ESLPLSLGMQYIRNMATLLRG

SEQ ID NO: 2934685 - protein, 21 aa, Entamoeba invadens
ESLRKEEIVLGRHEYGLRVAL

SEQ ID NO: 2934686 - protein, 20 aa, Entamoeba invadens
ESLRNLIITCLKKVSDTEYF

SEQ ID NO: 2934687 - protein, 19 aa, Entamoeba invadens
ESLSLKIEALDIIVNKLYD

SEQ ID NO: 2934688 - protein, 25 aa, Entamoeba invadens
ESLSMTHIFGFEREWVWKYNSTYIW

SEQ ID NO: 2934689 - protein, 20 aa, Entamoeba invadens
ESLSVFPYYSILTNLIGRLK

SEQ ID NO: 2934690 - protein, 33 aa, Entamoeba invadens
ESLSWKLRYEECKEVYYKKMHDLYLTKTEKNTI

SEQ ID NO: 2934691 - protein, 18 aa, Entamoeba invadens
ESLTEICLPLSLTSIGES

SEQ ID NO: 2934692 - protein, 17 aa, Entamoeba invadens
ESLTEMTSKIISNQLKN

SEQ ID NO: 2934693 - protein, 20 aa, Entamoeba invadens
ESLTKGFPLFSIADKYYTRS

SEQ ID NO: 2934694 - protein, 20 aa, Entamoeba invadens
ESLTKMFSILGIAFNSKYLM

SEQ ID NO: 2934695 - protein, 23 aa, Entamoeba invadens
ESLTKVPYCMKLIMTELLSTEEK

SEQ ID NO: 2934696 - protein, 26 aa, Entamoeba invadens
ESLTQLGDGCFRKCVSLNSIELPKSL

SEQ ID NO: 2934697 - protein, 18 aa, Entamoeba invadens
ESLTTMGKTCFTQCDNLM

SEQ ID NO: 2934698 - protein, 17 aa, Entamoeba invadens
ESLWLYYKVNLECPNVV

SEQ ID NO: 2934699 - protein, 26 aa, Entamoeba invadens
ESMCGNSLLDCFTHVIPLLQYTIHYN

SEQ ID NO: 2934700 - protein, 19 aa, Entamoeba invadens
ESMIRLSEALARLYLDKLV

SEQ ID NO: 2934701 - protein, 19 aa, Entamoeba invadens
ESMKKLVLYADLITPNATE

SEQ ID NO: 2934702 - protein, 17 aa, Entamoeba invadens
ESMKNGLSFITQIPELQ

SEQ ID NO: 2934703 - protein, 25 aa, Entamoeba invadens
ESMLKCEYIDFPICENMANNLNSFD

SEQ ID NO: 2934704 - protein, 18 aa, Entamoeba invadens
ESMPIRVFLANLDLTPSY

SEQ ID NO: 2934705 - protein, 33 aa, Entamoeba invadens
ESNEPKRLIIPPHLLQGPVLYQGYSYYTQQQYE

SEQ ID NO: 2934706 - protein, 26 aa, Entamoeba invadens
ESNGNLKGIRPHDAVEKSGNLTTPAF

SEQ ID NO: 2934707 - protein, 24 aa, Entamoeba invadens
ESNIKVYLKWSALVSNWVAFALIN

SEQ ID NO: 2934708 - protein, 26 aa, Entamoeba invadens
ESNINTLLAMKVFSSVFYGVRGKMDT

SEQ ID NO: 2934709 - protein, 24 aa, Entamoeba invadens
ESNISGFRLVGPQNRIIVMSEINV

SEQ ID NO: 2934710 - protein, 24 aa, Entamoeba invadens
ESNKVFGCYCADIVPLPQYINTKL

SEQ ID NO: 2934711 - protein, 21 aa, Entamoeba invadens
ESNLPFYNLGAFFSNQQESIQ

SEQ ID NO: 2934712 - protein, 22 aa, Entamoeba invadens
ESNPRLHLTWFNKMADKNKENG

SEQ ID NO: 2934713 - protein, 25 aa, Entamoeba invadens
ESNRGDNCAFVFAFYTQKLIQHKTD

SEQ ID NO: 2934714 - protein, 19 aa, Entamoeba invadens
ESNVINALIFFDSLESVRT

SEQ ID NO: 2934715 - protein, 21 aa, Entamoeba invadens
ESNVINALIFFDSLESVRTAE

SEQ ID NO: 2934716 - protein, 22 aa, Entamoeba invadens
ESPDCRVMLIGSKSDLSMARQI

SEQ ID NO: 2934717 - protein, 24 aa, Entamoeba invadens
ESPECALCKSKFSFVNRRHHCRKC

SEQ ID NO: 2934718 - protein, 19 aa, Entamoeba invadens
ESPIEWKRDKDVRYKLVKK

SEQ ID NO: 2934719 - protein, 19 aa, Entamoeba invadens
ESPIMFQPTYKFIPNTQEY

SEQ ID NO: 2934720 - protein, 24 aa, Entamoeba invadens
ESPKSCARHNEFRQTVGMATNSLN

SEQ ID NO: 2934721 - protein, 22 aa, Entamoeba invadens
ESPLIENACLIGLDLNESTSEE

SEQ ID NO: 2934722 - protein, 17 aa, Entamoeba invadens
ESPLMFKMKKECADKAF

SEQ ID NO: 2934723 - protein, 17 aa, Entamoeba invadens
ESPRRKVLHGPKKSSAK

SEQ ID NO: 2934724 - protein, 24 aa, Entamoeba invadens
ESPRSGSKLSFLVPSFMKKKKRRG

SEQ ID NO: 2934725 - protein, 18 aa, Entamoeba invadens
ESPWLCVCLFLLFFHVDI

SEQ ID NO: 2934726 - protein, 21 aa, Entamoeba invadens
ESPYFGRNVVKTDLFRGILSQ

SEQ ID NO: 2934727 - protein, 24 aa, Entamoeba invadens
ESQATKELLKWDVVFWSEPESNVK

SEQ ID NO: 2934728 - protein, 18 aa, Entamoeba invadens
ESQFRVKIEIFETFERVV

SEQ ID NO: 2934729 - protein, 25 aa, Entamoeba invadens
ESQIKALTLENARLKEDIDNKFKQI

SEQ ID NO: 2934730 - protein, 21 aa, Entamoeba invadens
ESQKALAVLLHLFTAKAEGFD

SEQ ID NO: 2934731 - protein, 24 aa, Entamoeba invadens
ESQKKITYSMCRHFDEIKTLQNID

SEQ ID NO: 2934732 - protein, 25 aa, Entamoeba invadens
ESQSLSIRPSCEFATVSSGNKVQFI

SEQ ID NO: 2934733 - protein, 24 aa, Entamoeba invadens
ESQYPDSIAFVFCYSITSSASFEE

SEQ ID NO: 2934734 - protein, 27 aa, Entamoeba invadens
ESRECSYYYGYNAVRSFLMNNDLRAII

SEQ ID NO: 2934735 - protein, 31 aa, Entamoeba invadens
ESREKIEMFAKLPFLISNVVEILDMPPEETD

SEQ ID NO: 2934736 - protein, 24 aa, Entamoeba invadens
ESRFRWLYRPMRKMSPYHLVLFKA

SEQ ID NO: 2934737 - protein, 24 aa, Entamoeba invadens
ESRIKTILGGLQFTPQDLYRPTKE

SEQ ID NO: 2934738 - protein, 20 aa, Entamoeba invadens
ESRKKHWSFGVSFKHKKDKD

SEQ ID NO: 2934739 - protein, 18 aa, Entamoeba invadens
ESRLRPTYLKEIEDGIAK

SEQ ID NO: 2934740 - protein, 30 aa, Entamoeba invadens
ESRLRYILLVDALNFCFWPTANFEYDNLTV

SEQ ID NO: 2934741 - protein, 24 aa, Entamoeba invadens
ESRMKRLAKGSGRDIREVGELFEQ

SEQ ID NO: 2934742 - protein, 27 aa, Entamoeba invadens
ESRNRPDFVALDFDKIVVRRMLERIEL

SEQ ID NO: 2934743 - protein, 33 aa, Entamoeba invadens
ESRQTFYLISLLAKHCCVRFIVTHPLQSTLAVP

SEQ ID NO: 2934744 - protein, 27 aa, Entamoeba invadens
ESRRCLSCSVASCSRCDTTGKCVECNT

SEQ ID NO: 2934745 - protein, 22 aa, Entamoeba invadens
ESRTYMKLQFLGILEGLLSLGD

SEQ ID NO: 2934746 - protein, 20 aa, Entamoeba invadens
ESRVYPEKCEFEIEVDGTDA

SEQ ID NO: 2934747 - protein, 18 aa, Entamoeba invadens
ESSEYLCDLIDKLVTLKV

SEQ ID NO: 2934748 - protein, 17 aa, Entamoeba invadens
ESSFFVWANRGKQSLAA

SEQ ID NO: 2934749 - protein, 22 aa, Entamoeba invadens
ESSKAISFKGIKKENIVKMTSS

SEQ ID NO: 2934750 - protein, 20 aa, Entamoeba invadens
ESSNLIIGVDFTKSNTWTGK

SEQ ID NO: 2934751 - protein, 21 aa, Entamoeba invadens
ESSPYRALFCDADGHIAGTSD

SEQ ID NO: 2934752 - protein, 20 aa, Entamoeba invadens
ESSRFGVTFCNLCVAAKNVN

SEQ ID NO: 2934753 - protein, 25 aa, Entamoeba invadens
ESSRRLKTEFLVRLDGAGTTTDERI

SEQ ID NO: 2934754 - protein, 23 aa, Entamoeba invadens
ESSSAYPFCSFVNLAMDSIKDVK

SEQ ID NO: 2934755 - protein, 18 aa, Entamoeba invadens
ESSTVCTLIPSSAPTEER

SEQ ID NO: 2934756 - protein, 17 aa, Entamoeba invadens
ESTCFMNCRALSAIKLP

SEQ ID NO: 2934757 - protein, 23 aa, Entamoeba invadens
ESTCLLCNSNYFLANGVCQQTTR

SEQ ID NO: 2934758 - protein, 23 aa, Entamoeba invadens
ESTKLLGRDEVRAINYREALVKK

SEQ ID NO: 2934759 - protein, 23 aa, Entamoeba invadens
ESTKRFATDFFYGLSTRHPNPNS

SEQ ID NO: 2934760 - protein, 19 aa, Entamoeba invadens
ESTLWKAMSQKLVSMGNSG

SEQ ID NO: 2934761 - protein, 19 aa, Entamoeba invadens
ESTLYLGLFTPIMNEKPFA

SEQ ID NO: 2934762 - protein, 18 aa, Entamoeba invadens
ESTPSYLENFVCAMFKGA

SEQ ID NO: 2934763 - protein, 25 aa, Entamoeba invadens
ESTQMFNFISSFFVNLFLNTTVLEE

SEQ ID NO: 2934764 - protein, 25 aa, Entamoeba invadens
ESTRYRQKALLLLRQKKQVDQHRDM

SEQ ID NO: 2934765 - protein, 25 aa, Entamoeba invadens
ESTTLKPGCTFGILHNRDCVINHTT

SEQ ID NO: 2934766 - protein, 26 aa, Entamoeba invadens
ESTWMDTRYPIIMWCQYLQNIRTNNF

SEQ ID NO: 2934767 - protein, 21 aa, Entamoeba invadens
ESVAKWLLDELLLLGIPLNKL

SEQ ID NO: 2934768 - protein, 28 aa, Entamoeba invadens
ESVANFLFPTRKVFWEIQKKIYYSNNFR

SEQ ID NO: 2934769 - protein, 24 aa, Entamoeba invadens
ESVARVALGIAMKIKRVSKVMYWY

SEQ ID NO: 2934770 - protein, 24 aa, Entamoeba invadens
ESVDLRSLRGLTLVQCLKIKDISF

SEQ ID NO: 2934771 - protein, 24 aa, Entamoeba invadens
ESVEACGLFSAVFTVTVGDISEDI

SEQ ID NO: 2934772 - protein, 20 aa, Entamoeba invadens
ESVEVIGSRCFSDCKELSQI

SEQ ID NO: 2934773 - protein, 17 aa, Entamoeba invadens
ESVFALIERKVFIVDKL

SEQ ID NO: 2934774 - protein, 18 aa, Entamoeba invadens
ESVFVWDVEYEKCVENYE

SEQ ID NO: 2934775 - protein, 17 aa, Entamoeba invadens
ESVHIRFKHQAVDNPFY

SEQ ID NO: 2934776 - protein, 30 aa, Entamoeba invadens
ESVKLILKMMLRYLEACGVLTASSQTIYSS

SEQ ID NO: 2934777 - protein, 20 aa, Entamoeba invadens
ESVKSIGMSCFSRCNISSIN

SEQ ID NO: 2934778 - protein, 24 aa, Entamoeba invadens
ESVKTLGDKCFKGCISLKTVVVPK

SEQ ID NO: 2934779 - protein, 20 aa, Entamoeba invadens
ESVLLRYAKSAEMYTTLNVG

SEQ ID NO: 2934780 - protein, 25 aa, Entamoeba invadens
ESVLLRYAKSAEMYTTLNVGSVKAA

SEQ ID NO: 2934781 - protein, 23 aa, Entamoeba invadens
ESVMKYQMEIDGLKKDLLDAKKD

SEQ ID NO: 2934782 - protein, 29 aa, Entamoeba invadens
ESVPSLIGILGMICSFHLFVTSHVDSNFL

SEQ ID NO: 2934783 - protein, 21 aa, Entamoeba invadens
ESVQSIILFSRLMQSLFVTTQ

SEQ ID NO: 2934784 - protein, 20 aa, Entamoeba invadens
ESVRCSPAVFTIALQNQGIF

SEQ ID NO: 2934785 - protein, 28 aa, Entamoeba invadens
ESVRKLRAVCVFCGNKASFSMRTTEEES

SEQ ID NO: 2934786 - protein, 19 aa, Entamoeba invadens
ESVSHLYLLFKNNDVDGDN

SEQ ID NO: 2934787 - protein, 17 aa, Entamoeba invadens
ESVTCAFSTAVEYDFRQ

SEQ ID NO: 2934788 - protein, 19 aa, Entamoeba invadens
ESVTKIGDRCFKQCFKLNE

SEQ ID NO: 2934789 - protein, 19 aa, Entamoeba invadens
ESVTKIGDRCFNRCFKLNE

SEQ ID NO: 2934790 - protein, 20 aa, Entamoeba invadens
ESVTKIGDRCFNRCFKLNEI

SEQ ID NO: 2934791 - protein, 19 aa, Entamoeba invadens
ESVTSIGMFCFSSCNISSI

SEQ ID NO: 2934792 - protein, 19 aa, Entamoeba invadens
ESVTVLCVNMLDRFKDVFE

SEQ ID NO: 2934793 - protein, 29 aa, Entamoeba invadens
ESVVKEFIDWLLKTVCSYDTYIKMAKYFE

SEQ ID NO: 2934794 - protein, 17 aa, Entamoeba invadens
ESVYKKIFCPSRATLYY

SEQ ID NO: 2934795 - protein, 17 aa, Entamoeba invadens
ESWKASYEMCCTKSAQI

SEQ ID NO: 2934796 - protein, 23 aa, Entamoeba invadens
ESWTKEKAEFIIKVNTFEEEKAQ

SEQ ID NO: 2934797 - protein, 29 aa, Entamoeba invadens
ESYDFPYVIPGSEAKFVVMDYDKNSKDDQ

SEQ ID NO: 2934798 - protein, 17 aa, Entamoeba invadens
ESYDWKPTISIKQILVG

SEQ ID NO: 2934799 - protein, 26 aa, Entamoeba invadens
ESYESGEYQWAITLLNNVVFKNPQNY

SEQ ID NO: 2934800 - protein, 19 aa, Entamoeba invadens
ESYHVFFLNSDYALFNVEL

SEQ ID NO: 2934801 - protein, 25 aa, Entamoeba invadens
ESYITKMHVCLEVYKPKLQANLSLI

SEQ ID NO: 2934802 - protein, 24 aa, Entamoeba invadens
ESYLFNRRLMRIIYQVSQGKSKIA

SEQ ID NO: 2934803 - protein, 29 aa, Entamoeba invadens
ESYNGAYVRLRYLLRVVILAKSPIFPVEY

SEQ ID NO: 2934804 - protein, 20 aa, Entamoeba invadens
ETAAVVLARCASYKADAESG

SEQ ID NO: 2934805 - protein, 24 aa, Entamoeba invadens
ETAECYVYLVEVGRILRDNEVVKE

SEQ ID NO: 2934806 - protein, 18 aa, Entamoeba invadens
ETAELIWNPEMKRDVGQF

SEQ ID NO: 2934807 - protein, 25 aa, Entamoeba invadens
ETAFEFKGDLLIFLLDSLYDCQFAN

SEQ ID NO: 2934808 - protein, 23 aa, Entamoeba invadens
ETAFSCLNNALLVVDPSFQITIE

SEQ ID NO: 2934809 - protein, 24 aa, Entamoeba invadens
ETAHLEIKNSLLLEDTQDVPHTVD

SEQ ID NO: 2934810 - protein, 17 aa, Entamoeba invadens
ETAIFPISVFKVMEGVN

SEQ ID NO: 2934811 - protein, 28 aa, Entamoeba invadens
ETAKGVYYKVSWGREYCMKGQLFDEKYG

SEQ ID NO: 2934812 - protein, 27 aa, Entamoeba invadens
ETAKRKSRHCCFCQNKLAIGYDDGIIK

SEQ ID NO: 2934813 - protein, 21 aa, Entamoeba invadens
ETALKFANLMKSACVFCSALL

SEQ ID NO: 2934814 - protein, 18 aa, Entamoeba invadens
ETAPIPMYAPISSVPEIE

SEQ ID NO: 2934815 - protein, 23 aa, Entamoeba invadens
ETAPNKPYALLFLYIPINSFSIR

SEQ ID NO: 2934816 - protein, 30 aa, Entamoeba invadens
ETCFQQAICLMLFHFFGEFTILKPVKQSSA

SEQ ID NO: 2934817 - protein, 21 aa, Entamoeba invadens
ETCLIYEGIISKCFDGYMDFY

SEQ ID NO: 2934818 - protein, 19 aa, Entamoeba invadens
ETDAPFMAPIPFRGKPSHS

SEQ ID NO: 2934819 - protein, 18 aa, Entamoeba invadens
ETDCDLTWATIVAKALES

SEQ ID NO: 2934820 - protein, 17 aa, Entamoeba invadens
ETDCPYCSLKRNSAGTK

SEQ ID NO: 2934821 - protein, 22 aa, Entamoeba invadens
ETDKLHLYFTCFEKNKKLQISS

SEQ ID NO: 2934822 - protein, 18 aa, Entamoeba invadens
ETDLFVWEAVIIGPEGTE

SEQ ID NO: 2934823 - protein, 23 aa, Entamoeba invadens
ETDLKNGVTMFRFTQALTGKGNA

SEQ ID NO: 2934824 - protein, 26 aa, Entamoeba invadens
ETDNVKEFVKWVSGHLINGYNNAFPI

SEQ ID NO: 2934825 - protein, 19 aa, Entamoeba invadens
ETDRARMFEMQLAQLKAEK

SEQ ID NO: 2934826 - protein, 25 aa, Entamoeba invadens
ETDTHFQIILLFTLEVLKDGVDKEY

SEQ ID NO: 2934827 - protein, 24 aa, Entamoeba invadens
ETDVRRVIVFWKYKGTNTCTNCFF

SEQ ID NO: 2934828 - protein, 19 aa, Entamoeba invadens
ETEEKLKLLEVEKEKIVNE

SEQ ID NO: 2934829 - protein, 17 aa, Entamoeba invadens
ETEEWKAAKGQAKVVGK

SEQ ID NO: 2934830 - protein, 24 aa, Entamoeba invadens
ETEGFKISPILKIFEVKLFRYTQG

SEQ ID NO: 2934831 - protein, 26 aa, Entamoeba invadens
ETEHTWKFPDCVSTYGLFATNTNEYI

SEQ ID NO: 2934832 - protein, 21 aa, Entamoeba invadens
ETEIKKLAIIELKDKKEIMYV

SEQ ID NO: 2934833 - protein, 26 aa, Entamoeba invadens
ETEKDDGKCGLQFFFKNKTRKGDTAI

SEQ ID NO: 2934834 - protein, 28 aa, Entamoeba invadens
ETEKDDGKCGLQFFSKSFKTMKIKSKTR

SEQ ID NO: 2934835 - protein, 22 aa, Entamoeba invadens
ETEKFKGIDFSVLTIDSLASKP

SEQ ID NO: 2934836 - protein, 23 aa, Entamoeba invadens
ETEMKNAISIGNRLSEYIKSLDE

SEQ ID NO: 2934837 - protein, 25 aa, Entamoeba invadens
ETESSLRLRALRIVLQSLNLYNSYD

SEQ ID NO: 2934838 - protein, 20 aa, Entamoeba invadens
ETEVPFKITATVTNENEVEL

SEQ ID NO: 2934839 - protein, 26 aa, Entamoeba invadens
ETFANRFNVGMAFIRKSRSFEDTHVI

SEQ ID NO: 2934840 - protein, 18 aa, Entamoeba invadens
ETFCDLSPSTLQYWIQKF

SEQ ID NO: 2934841 - protein, 20 aa, Entamoeba invadens
ETFFKRKYVFCVDCDFYQKN

SEQ ID NO: 2934842 - protein, 17 aa, Entamoeba invadens
ETFIVKVGCRVVDRTIT

SEQ ID NO: 2934843 - protein, 23 aa, Entamoeba invadens
ETFKDHLNWLLTQKNLYEQNSIM

SEQ ID NO: 2934844 - protein, 18 aa, Entamoeba invadens
ETFKNCFSLTEFEFAYGT

SEQ ID NO: 2934845 - protein, 17 aa, Entamoeba invadens
ETFKQWISKAVKIVSDF

SEQ ID NO: 2934846 - protein, 17 aa, Entamoeba invadens
ETFKTKCEEMKEEYEKR

SEQ ID NO: 2934847 - protein, 17 aa, Entamoeba invadens
ETFKTTCEEMSEEYEKR

SEQ ID NO: 2934848 - protein, 33 aa, Entamoeba invadens
ETFLKSSCEAFKYRVLLDVSRAIGYVHSFGLIV

SEQ ID NO: 2934849 - protein, 24 aa, Entamoeba invadens
ETFMLFKSFNSFVGDFFRKQTAND

SEQ ID NO: 2934850 - protein, 24 aa, Entamoeba invadens
ETFRGCSSLEIIEIPKQVTQIGYL

SEQ ID NO: 2934851 - protein, 23 aa, Entamoeba invadens
ETGDGRYCAPEVFRGSTSPLADV

SEQ ID NO: 2934852 - protein, 17 aa, Entamoeba invadens
ETGDLFLTKVLKRLQIQ

SEQ ID NO: 2934853 - protein, 18 aa, Entamoeba invadens
ETGKWNFETLKLLDKANC

SEQ ID NO: 2934854 - protein, 26 aa, Entamoeba invadens
ETGRKLYKRKIEELLHKTKSAVITSE

SEQ ID NO: 2934855 - protein, 17 aa, Entamoeba invadens
ETGRYYLNNGFSIPYDI

SEQ ID NO: 2934856 - protein, 19 aa, Entamoeba invadens
ETGTCRKGEHCNFSHDLSL

SEQ ID NO: 2934857 - protein, 24 aa, Entamoeba invadens
ETGVTRLSSLLGDVKDQAMLSQCI

SEQ ID NO: 2934858 - protein, 23 aa, Entamoeba invadens
ETHATEIMECLTLQQQMKLLKSE

SEQ ID NO: 2934859 - protein, 22 aa, Entamoeba invadens
ETHKCEKCGYLNEISNVKIGDI

SEQ ID NO: 2934860 - protein, 17 aa, Entamoeba invadens
ETHKIGIVYVARGQSTE

SEQ ID NO: 2934861 - protein, 20 aa, Entamoeba invadens
ETHLNWCFSQLDFVRNNLST

SEQ ID NO: 2934862 - protein, 20 aa, Entamoeba invadens
ETHTEGFSGFGYPTDLVTIN

SEQ ID NO: 2934863 - protein, 34 aa, Entamoeba invadens
ETHTFISCPFCKYRVARCDLLKHIGEDGSCEKKT

SEQ ID NO: 2934864 - protein, 22 aa, Entamoeba invadens
ETICFVCLSLSAKMYEKRKRWV

SEQ ID NO: 2934865 - protein, 19 aa, Entamoeba invadens
ETICKCPSLTQLEIDNNNF

SEQ ID NO: 2934866 - protein, 18 aa, Entamoeba invadens
ETICKSRLTIAINKEGEV

SEQ ID NO: 2934867 - protein, 25 aa, Entamoeba invadens
ETIDDCVWAIMAIKEVGGKLQKTTR

SEQ ID NO: 2934868 - protein, 23 aa, Entamoeba invadens
ETIDLKIALKLVQKELTNNTQNP

SEQ ID NO: 2934869 - protein, 20 aa, Entamoeba invadens
ETIEIPDFVTEIGRCAFFSC

SEQ ID NO: 2934870 - protein, 18 aa, Entamoeba invadens
ETIFGMGVKKQSNLPQMK

SEQ ID NO: 2934871 - protein, 25 aa, Entamoeba invadens
ETIFSDEVLLPIGLYDKYVKEEQKT

SEQ ID NO: 2934872 - protein, 17 aa, Entamoeba invadens
ETIGIDMMLGFWTSKGC

SEQ ID NO: 2934873 - protein, 17 aa, Entamoeba invadens
ETIIYKRGEHVLAQNSH

SEQ ID NO: 2934874 - protein, 24 aa, Entamoeba invadens
ETIKELLLHNTVLCISTKAVPPVF

SEQ ID NO: 2934875 - protein, 26 aa, Entamoeba invadens
ETIKLELIKVFGIIGAIDTYRYKLLT

SEQ ID NO: 2934876 - protein, 24 aa, Entamoeba invadens
ETILNFKGSDDFSKGACKKLFGHF

SEQ ID NO: 2934877 - protein, 34 aa, Entamoeba invadens
ETIMMVSRMGFIYCFYAGDGTLLFQGKALDDTVY

SEQ ID NO: 2934878 - protein, 21 aa, Entamoeba invadens
ETIPFCRYYNSVVFTEAEYKT

SEQ ID NO: 2934879 - protein, 19 aa, Entamoeba invadens
ETIRDFGLSVNRTIIDRMA

SEQ ID NO: 2934880 - protein, 19 aa, Entamoeba invadens
ETITQIGDFCFSKCTSLTH

SEQ ID NO: 2934881 - protein, 21 aa, Entamoeba invadens
ETITSFGERAFYKCLALSTID

SEQ ID NO: 2934882 - protein, 19 aa, Entamoeba invadens
ETIVFRYAKITTELNENRV

SEQ ID NO: 2934883 - protein, 19 aa, Entamoeba invadens
ETIYFPIFNYLTNSYDPSM

SEQ ID NO: 2934884 - protein, 27 aa, Entamoeba invadens
ETIYKPLRIFKDKSYKSADVEIHEFET

SEQ ID NO: 2934885 - protein, 17 aa, Entamoeba invadens
ETKAIKKLLLIDTCVEL

SEQ ID NO: 2934886 - protein, 21 aa, Entamoeba invadens
ETKASPLLPSIAQLVKSNTLS

SEQ ID NO: 2934887 - protein, 24 aa, Entamoeba invadens
ETKAVFSLFTFPLGMMMRTNPVGD

SEQ ID NO: 2934888 - protein, 19 aa, Entamoeba invadens
ETKEIFKEYIIGRLLGIGC

SEQ ID NO: 2934889 - protein, 22 aa, Entamoeba invadens
ETKELCKVGNQFVRILTQFIQV

SEQ ID NO: 2934890 - protein, 20 aa, Entamoeba invadens
ETKEWYDYQQSYLICTLIKE

SEQ ID NO: 2934891 - protein, 19 aa, Entamoeba invadens
ETKEWYDYQQSYLICTLMK

SEQ ID NO: 2934892 - protein, 21 aa, Entamoeba invadens
ETKISVALVKAMACLNEDATK

SEQ ID NO: 2934893 - protein, 24 aa, Entamoeba invadens
ETKKEFAIVISLDYQVFMDLLEYF

SEQ ID NO: 2934894 - protein, 26 aa, Entamoeba invadens
ETKKNKGCAFVKFKTSEEAQQCLSSF

SEQ ID NO: 2934895 - protein, 24 aa, Entamoeba invadens
ETKKSYKTAACFMREMLMSQNLEN

SEQ ID NO: 2934896 - protein, 26 aa, Entamoeba invadens
ETKKVVKILQFFPALENYKNFFIDFS

SEQ ID NO: 2934897 - protein, 21 aa, Entamoeba invadens
ETKKYRFGFITKTGDLTENCF

SEQ ID NO: 2934898 - protein, 19 aa, Entamoeba invadens
ETKNLIYERFLKGIHDSSI

SEQ ID NO: 2934899 - protein, 24 aa, Entamoeba invadens
ETKNNLRIFFGFFAGSDKLFELLY

SEQ ID NO: 2934900 - protein, 23 aa, Entamoeba invadens
ETKNRLNAIKVYSDVVFTSNKLK

SEQ ID NO: 2934901 - protein, 17 aa, Entamoeba invadens
ETKPKYFAKTLIVHELV

SEQ ID NO: 2934902 - protein, 25 aa, Entamoeba invadens
ETKPVWKTTCEEIIRTIVLSQSVDL

SEQ ID NO: 2934903 - protein, 23 aa, Entamoeba invadens
ETKRCRRLSLLELFDTLEQLNLV

SEQ ID NO: 2934904 - protein, 52 aa, Entamoeba invadens
ETKTFCGTPDYLAPEILKGVGHGVGVDWWSLGILIYEMLVGIPPFYDEDVSI

SEQ ID NO: 2934905 - protein, 20 aa, Entamoeba invadens
ETKTPAPFKIITRNRIGQPL

SEQ ID NO: 2934906 - protein, 21 aa, Entamoeba invadens
ETLCGPFSMISKWPEADVLKY

SEQ ID NO: 2934907 - protein, 20 aa, Entamoeba invadens
ETLCVICGTVMKEYRSDTFK

SEQ ID NO: 2934908 - protein, 24 aa, Entamoeba invadens
ETLEMCKKVKYNLGEFMQQKFEES

SEQ ID NO: 2934909 - protein, 24 aa, Entamoeba invadens
ETLESSTTWILYWTLNSLRLLKAN

SEQ ID NO: 2934910 - protein, 21 aa, Entamoeba invadens
ETLEYCKLASYNLREVDVSLV

SEQ ID NO: 2934911 - protein, 21 aa, Entamoeba invadens
ETLFFLCEFCDDNTYFEDSFV

SEQ ID NO: 2934912 - protein, 18 aa, Entamoeba invadens
ETLFKMIMQLMVSTNNKV

SEQ ID NO: 2934913 - protein, 18 aa, Entamoeba invadens
ETLGDIEGLCVIITQLIE

SEQ ID NO: 2934914 - protein, 20 aa, Entamoeba invadens
ETLHIWKKYSENFGNGFVVS

SEQ ID NO: 2934915 - protein, 17 aa, Entamoeba invadens
ETLHLWSKEDETFGNGF

SEQ ID NO: 2934916 - protein, 17 aa, Entamoeba invadens
ETLHLWSREDENFGNVI

SEQ ID NO: 2934917 - protein, 18 aa, Entamoeba invadens
ETLIFPFLKDVGMYSSKF

SEQ ID NO: 2934918 - protein, 20 aa, Entamoeba invadens
ETLINAGIVERLIGYINRSS

SEQ ID NO: 2934919 - protein, 23 aa, Entamoeba invadens
ETLKCGFCELELGYYVSGNDCNR

SEQ ID NO: 2934920 - protein, 20 aa, Entamoeba invadens
ETLKKLHILYDIQYFNCVNV

SEQ ID NO: 2934921 - protein, 23 aa, Entamoeba invadens
ETLKQQLLKENNFNLKSDDEIFV

SEQ ID NO: 2934922 - protein, 25 aa, Entamoeba invadens
ETLKSFRSSKQFPHLLLCGQPGIGK

SEQ ID NO: 2934923 - protein, 28 aa, Entamoeba invadens
ETLMDTVRLAVKQGKVPKILLQQLEESQ

SEQ ID NO: 2934924 - protein, 24 aa, Entamoeba invadens
ETLNQIRMGMTMISQGYRGSAAFS

SEQ ID NO: 2934925 - protein, 20 aa, Entamoeba invadens
ETLPSLPSLLLKKISEADST

SEQ ID NO: 2934926 - protein, 19 aa, Entamoeba invadens
ETLPTVIIFHLRKEVFRFT

SEQ ID NO: 2934927 - protein, 21 aa, Entamoeba invadens
ETLRFPNFIERYTTQRFVINV

SEQ ID NO: 2934928 - protein, 21 aa, Entamoeba invadens
ETLRNVRFVAEKDLINEFMDN

SEQ ID NO: 2934929 - protein, 24 aa, Entamoeba invadens
ETLRRGCFMLCSALSCVKMSCKVK

SEQ ID NO: 2934930 - protein, 22 aa, Entamoeba invadens
ETLSSLKFNYVVFMCKNSKSLV

SEQ ID NO: 2934931 - protein, 17 aa, Entamoeba invadens
ETLTRVSRRFGEAPNTL

SEQ ID NO: 2934932 - protein, 18 aa, Entamoeba invadens
ETLYIWKKEDENFGNPII

SEQ ID NO: 2934933 - protein, 24 aa, Entamoeba invadens
ETLYPIEIVKCWNKKIVIGEKNVV

SEQ ID NO: 2934934 - protein, 17 aa, Entamoeba invadens
ETMDKRRVDAWLNTDFV

SEQ ID NO: 2934935 - protein, 18 aa, Entamoeba invadens
ETMINYLYTKGCGTYGIF

SEQ ID NO: 2934936 - protein, 17 aa, Entamoeba invadens
ETMKLLLALCNAVDLKK

SEQ ID NO: 2934937 - protein, 18 aa, Entamoeba invadens
ETMLTKGRIENVDIQNLI

SEQ ID NO: 2934938 - protein, 23 aa, Entamoeba invadens
ETMRTPLHYLCRNPKLDDKTISL

SEQ ID NO: 2934939 - protein, 25 aa, Entamoeba invadens
ETNAFRKARLKEEFDQKELELAAMM

SEQ ID NO: 2934940 - protein, 20 aa, Entamoeba invadens
ETNAMGVLYIIELDTAVVQD

SEQ ID NO: 2934941 - protein, 24 aa, Entamoeba invadens
ETNARRDCCFINFATKEIAEKAIE

SEQ ID NO: 2934942 - protein, 23 aa, Entamoeba invadens
ETNCKPKEGLSPVKNKVELPQPQ

SEQ ID NO: 2934943 - protein, 25 aa, Entamoeba invadens
ETNDSRLAPWLGGSIIASIENNGQF

SEQ ID NO: 2934944 - protein, 19 aa, Entamoeba invadens
ETNDYFKWMFRSSDKSGKM

SEQ ID NO: 2934945 - protein, 22 aa, Entamoeba invadens
ETNEVILNIGFNGTFNQNVKTL

SEQ ID NO: 2934946 - protein, 25 aa, Entamoeba invadens
ETNGLKDLIVYIGIDYTASNSRASN

SEQ ID NO: 2934947 - protein, 26 aa, Entamoeba invadens
ETNIKKLMSAWVYRGFIRTLNNSLVH

SEQ ID NO: 2934948 - protein, 21 aa, Entamoeba invadens
ETNLKVTNSFRKRPHGNEDFE

SEQ ID NO: 2934949 - protein, 26 aa, Entamoeba invadens
ETNLNLPICRNRVGWKEGAVGMHSDD

SEQ ID NO: 2934950 - protein, 22 aa, Entamoeba invadens
ETNRRLAEEVLNAKQAVENVKN

SEQ ID NO: 2934951 - protein, 22 aa, Entamoeba invadens
ETNTFSALLARFTLESPTSLLY

SEQ ID NO: 2934952 - protein, 27 aa, Entamoeba invadens
ETPEIYRNTAFFTFSFCESTKNEKTSE

SEQ ID NO: 2934953 - protein, 25 aa, Entamoeba invadens
ETPEYWLEAGNPWEIVRKDVNHEVR

SEQ ID NO: 2934954 - protein, 18 aa, Entamoeba invadens
ETPFKFDLNKLKKEKSGW

SEQ ID NO: 2934955 - protein, 24 aa, Entamoeba invadens
ETPILPKCQTVLCKNFVVNAFCEN

SEQ ID NO: 2934956 - protein, 24 aa, Entamoeba invadens
ETPKNWKYFFLFNDRLVMSEVVSY

SEQ ID NO: 2934957 - protein, 24 aa, Entamoeba invadens
ETPLCGLDEMINLTMTIRDKDPNH

SEQ ID NO: 2934958 - protein, 20 aa, Entamoeba invadens
ETPNTISIIIKELKLHNQWL

SEQ ID NO: 2934959 - protein, 25 aa, Entamoeba invadens
ETPQRKLIRVSLYGVDQMLKFNPAN

SEQ ID NO: 2934960 - protein, 18 aa, Entamoeba invadens
ETPSDFGVDEFLLDVCLI

SEQ ID NO: 2934961 - protein, 19 aa, Entamoeba invadens
ETPVYLKQATKQGSWTIRV

SEQ ID NO: 2934962 - protein, 21 aa, Entamoeba invadens
ETQGLRTSYFLYYSDKDVLKR

SEQ ID NO: 2934963 - protein, 18 aa, Entamoeba invadens
ETQGRISMFIASPSPMMN

SEQ ID NO: 2934964 - protein, 20 aa, Entamoeba invadens
ETQKVIPVIGEKLPMEIEPP

SEQ ID NO: 2934965 - protein, 24 aa, Entamoeba invadens
ETQKVSLIVPIRINATAFYRETII

SEQ ID NO: 2934966 - protein, 26 aa, Entamoeba invadens
ETQLSYPFCTFVNLSMDGIKEIKQSF

SEQ ID NO: 2934967 - protein, 18 aa, Entamoeba invadens
ETQNRIDPSFSRLQTSVE

SEQ ID NO: 2934968 - protein, 17 aa, Entamoeba invadens
ETREMYEQIMLPQIKKI

SEQ ID NO: 2934969 - protein, 21 aa, Entamoeba invadens
ETRHRFSFIDYMMFQYNKTLK

SEQ ID NO: 2934970 - protein, 20 aa, Entamoeba invadens
ETRISFKKHKTVKFSKPLQF

SEQ ID NO: 2934971 - protein, 26 aa, Entamoeba invadens
ETRKCFKCLDGFYLLSGQCALCNKTT

SEQ ID NO: 2934972 - protein, 20 aa, Entamoeba invadens
ETRKLELIKSISKQNYYYGF

SEQ ID NO: 2934973 - protein, 24 aa, Entamoeba invadens
ETRMFCTTLQKFAFVETELPNDLN

SEQ ID NO: 2934974 - protein, 25 aa, Entamoeba invadens
ETRRKFKQFLNLRQKMIEQEDIPID

SEQ ID NO: 2934975 - protein, 33 aa, Entamoeba invadens
ETRYKGEYVYRSQLKLGEFAEYLVNMYKKVQAE

SEQ ID NO: 2934976 - protein, 23 aa, Entamoeba invadens
ETRYPITCPLVLLDDVIPTFNLQ

SEQ ID NO: 2934977 - protein, 23 aa, Entamoeba invadens
ETSDVLRPKFLIYEKTVASENFQ

SEQ ID NO: 2934978 - protein, 27 aa, Entamoeba invadens
ETSEECLKVYLGVGLDWAPVNSIVGSL

SEQ ID NO: 2934979 - protein, 25 aa, Entamoeba invadens
ETSEILPIRKGEFVMLRGPSGGGKT

SEQ ID NO: 2934980 - protein, 25 aa, Entamoeba invadens
ETSFRTPCLFCKEFNDLDKVLEHLQ

SEQ ID NO: 2934981 - protein, 22 aa, Entamoeba invadens
ETSFTLVKWRSLVPTAPPYGLF

SEQ ID NO: 2934982 - protein, 20 aa, Entamoeba invadens
ETSHLWVLKTLKEVYLPALS

SEQ ID NO: 2934983 - protein, 25 aa, Entamoeba invadens
ETSKRVATMLVEIFAVTALHVRDLN

SEQ ID NO: 2934984 - protein, 29 aa, Entamoeba invadens
ETSKYIGIPCFWGRLFVIEKLSEDGDFEA

SEQ ID NO: 2934985 - protein, 26 aa, Entamoeba invadens
ETSLYPHSRPLIFKGSVFGHTMMTYN

SEQ ID NO: 2934986 - protein, 18 aa, Entamoeba invadens
ETSPESYHVFFLNSDYAL

SEQ ID NO: 2934987 - protein, 21 aa, Entamoeba invadens
ETSPFLKQYISVILDNQQNAK

SEQ ID NO: 2934988 - protein, 30 aa, Entamoeba invadens
ETSTRLEFISGVFLEMWNPSQGFLQEFTLP

SEQ ID NO: 2934989 - protein, 23 aa, Entamoeba invadens
ETSVKKRALIAMRQLYKQQPQIL

SEQ ID NO: 2934990 - protein, 25 aa, Entamoeba invadens
ETSVYVPPCCGIVQYPRSCDGHNPV

SEQ ID NO: 2934991 - protein, 17 aa, Entamoeba invadens
ETSYKAHEFIPSIEEGA

SEQ ID NO: 2934992 - protein, 25 aa, Entamoeba invadens
ETTCPPPLDKLECISKVVSKVPGAL

SEQ ID NO: 2934993 - protein, 19 aa, Entamoeba invadens
ETTFRSSAIALMVKLTRLK

SEQ ID NO: 2934994 - protein, 24 aa, Entamoeba invadens
ETTHFLSIFSKFVVRLGKDPVAKL

SEQ ID NO: 2934995 - protein, 27 aa, Entamoeba invadens
ETTLRFNFWDKITFKFEVDAIGKIKLV

SEQ ID NO: 2934996 - protein, 32 aa, Entamoeba invadens
ETTLRFNFWDKITFKFEVEIIGKIKLVVLDKD

SEQ ID NO: 2934997 - protein, 17 aa, Entamoeba invadens
ETTPTKLPRIVYNSDES

SEQ ID NO: 2934998 - protein, 32 aa, Entamoeba invadens
ETTPYEIFSLFFTKELKDFVILQSNNYGKVAT

SEQ ID NO: 2934999 - protein, 20 aa, Entamoeba invadens
ETTSELLALFYPDKPKQITN

SEQ ID NO: 2935000 - protein, 24 aa, Entamoeba invadens
ETVELKTNVLVITNFQEKQMRDFM

SEQ ID NO: 2935001 - protein, 23 aa, Entamoeba invadens
ETVIPSFWVNDFINMPLGAPLPF

SEQ ID NO: 2935002 - protein, 25 aa, Entamoeba invadens
ETVKEAKTLFGNRFLRVDPILPGSI

SEQ ID NO: 2935003 - protein, 17 aa, Entamoeba invadens
ETVKVVSLMTCQHTHDF

SEQ ID NO: 2935004 - protein, 21 aa, Entamoeba invadens
ETVLFLLSLVPGVFFTKPNLK

SEQ ID NO: 2935005 - protein, 19 aa, Entamoeba invadens
ETVRVLPLIDYQNFQMNIS

SEQ ID NO: 2935006 - protein, 17 aa, Entamoeba invadens
ETWKRRPTDFFELFAKS

SEQ ID NO: 2935007 - protein, 23 aa, Entamoeba invadens
ETWTSQYTTLNWFLLSLEDGRHF

SEQ ID NO: 2935008 - protein, 18 aa, Entamoeba invadens
ETYCTLLLHLVTSNTIYT

SEQ ID NO: 2935009 - protein, 17 aa, Entamoeba invadens
ETYIGSKRNCVGVALTI

SEQ ID NO: 2935010 - protein, 20 aa, Entamoeba invadens
ETYKFIQLINRYTKLENVSK

SEQ ID NO: 2935011 - protein, 23 aa, Entamoeba invadens
ETYLKRKVVIQSFADVLKELDVI

SEQ ID NO: 2935012 - protein, 19 aa, Entamoeba invadens
ETYPFFSAFNYQYTIDNFF

SEQ ID NO: 2935013 - protein, 21 aa, Entamoeba invadens
ETYRANVFNRRMDLMKNVESD

SEQ ID NO: 2935014 - protein, 25 aa, Entamoeba invadens
ETYRKCALMRKHWRQSLYSEHTSDG

SEQ ID NO: 2935015 - protein, 29 aa, Entamoeba invadens
ETYTGRVKLRIAYDKVRHSAGDVYVHIPD

SEQ ID NO: 2935016 - protein, 19 aa, Entamoeba invadens
ETYYPFSCNALRDRLVQTN

SEQ ID NO: 2935017 - protein, 18 aa, Entamoeba invadens
ETYYPFSCNTLRDRLVQT

SEQ ID NO: 2935018 - protein, 18 aa, Entamoeba invadens
EVAASFALKQIAEFAKSA

SEQ ID NO: 2935019 - protein, 30 aa, Entamoeba invadens
EVACRYCAFTKHCALVCLNDGIDFGRDEIS

SEQ ID NO: 2935020 - protein, 33 aa, Entamoeba invadens
EVAFSNSYIRVFYKGVDFSFCLQHHCWILKSGE

SEQ ID NO: 2935021 - protein, 21 aa, Entamoeba invadens
EVAKMRYFIKVGLECLKLNSF

SEQ ID NO: 2935022 - protein, 21 aa, Entamoeba invadens
EVAKWTNSRVSAVKEENLYYS

SEQ ID NO: 2935023 - protein, 23 aa, Entamoeba invadens
EVAPGKHLFPFSIPIKNFPISVG

SEQ ID NO: 2935024 - protein, 22 aa, Entamoeba invadens
EVARDEAKCMIDAYKNGEKSLV

SEQ ID NO: 2935025 - protein, 19 aa, Entamoeba invadens
EVATCKNIQSSFNRSGLVC

SEQ ID NO: 2935026 - protein, 20 aa, Entamoeba invadens
EVAYSYPFVTFRCFDGCINL

SEQ ID NO: 2935027 - protein, 22 aa, Entamoeba invadens
EVCDLCYPPFVLNTDASSCSKC

SEQ ID NO: 2935028 - protein, 24 aa, Entamoeba invadens
EVCETKFLPEFFKFLREAFELVKE

SEQ ID NO: 2935029 - protein, 25 aa, Entamoeba invadens
EVCKTKIVVFVGILGKTVFFVGIKM

SEQ ID NO: 2935030 - protein, 26 aa, Entamoeba invadens
EVCPSKGFVDMCYICSNIVAYQPTSA

SEQ ID NO: 2935031 - protein, 23 aa, Entamoeba invadens
EVCTKGVCKLVSYYNEKKKLVLI

SEQ ID NO: 2935032 - protein, 18 aa, Entamoeba invadens
EVDCAYMVIVNRNDITVF

SEQ ID NO: 2935033 - protein, 19 aa, Entamoeba invadens
EVDCYKLRFNKGDYSIFKE

SEQ ID NO: 2935034 - protein, 20 aa, Entamoeba invadens
EVDEEICYTDDITIIDDTKD

SEQ ID NO: 2935035 - protein, 25 aa, Entamoeba invadens
EVDELCVRLGIVKYFECTAFDNNNV

SEQ ID NO: 2935036 - protein, 21 aa, Entamoeba invadens
EVDGLLLVKFDETFRENAENI

SEQ ID NO: 2935037 - protein, 25 aa, Entamoeba invadens
EVDHAKCYVKLKVHKDLPYDFFKNS

SEQ ID NO: 2935038 - protein, 24 aa, Entamoeba invadens
EVDKETKPEFAPVLNVSTASQGPL

SEQ ID NO: 2935039 - protein, 19 aa, Entamoeba invadens
EVDKNYLKVFAFYEKMKRD

SEQ ID NO: 2935040 - protein, 25 aa, Entamoeba invadens
EVDLKRFQFLILQFGNFYEDKKAFE

SEQ ID NO: 2935041 - protein, 21 aa, Entamoeba invadens
EVDMKLGIKFLLDASKGIEYL

SEQ ID NO: 2935042 - protein, 23 aa, Entamoeba invadens
EVDMKLRLKMMLDASRGILYLHE

SEQ ID NO: 2935043 - protein, 19 aa, Entamoeba invadens
EVDMKLRVKYMIDAAKGIS

SEQ ID NO: 2935044 - protein, 27 aa, Entamoeba invadens
EVDRFFKEFKWSATNFENLELLRVSCC

SEQ ID NO: 2935045 - protein, 28 aa, Entamoeba invadens
EVDVSFKEGFKYLVIYFGDIFEKCATVW

SEQ ID NO: 2935046 - protein, 29 aa, Entamoeba invadens
EVDVTLKLLSGIAPRLDKIDSFSTCTDVL

SEQ ID NO: 2935047 - protein, 20 aa, Entamoeba invadens
EVDYAVGCFFNCTALALPFP

SEQ ID NO: 2935048 - protein, 19 aa, Entamoeba invadens
EVDYCKLCRIKENGKSKGT

SEQ ID NO: 2935049 - protein, 23 aa, Entamoeba invadens
EVECFRYLGILLYMGAHHDVINP

SEQ ID NO: 2935050 - protein, 21 aa, Entamoeba invadens
EVEEMISPLFCIYQQHKEFHS

SEQ ID NO: 2935051 - protein, 23 aa, Entamoeba invadens
EVEEYRRKIGFGENFDKFNFEKE

SEQ ID NO: 2935052 - protein, 19 aa, Entamoeba invadens
EVEGIFRLSGDAEEMKKIR

SEQ ID NO: 2935053 - protein, 18 aa, Entamoeba invadens
EVEGKVCVVSEEVPTIEK

SEQ ID NO: 2935054 - protein, 18 aa, Entamoeba invadens
EVEKCCRDDLKGVKEKHV

SEQ ID NO: 2935055 - protein, 19 aa, Entamoeba invadens
EVEKEWKEKYEKKNEELSK

SEQ ID NO: 2935056 - protein, 24 aa, Entamoeba invadens
EVEKGICLEYCILESHVCGLERME

SEQ ID NO: 2935057 - protein, 26 aa, Entamoeba invadens
EVEKRLTKVVTRWYLELRSVVDTIGE

SEQ ID NO: 2935058 - protein, 27 aa, Entamoeba invadens
EVEKSLPPKKERILRVGLSGLQKQYYR

SEQ ID NO: 2935059 - protein, 28 aa, Entamoeba invadens
EVELKKFRTGFICRPCLESLHFKRFRYF

SEQ ID NO: 2935060 - protein, 22 aa, Entamoeba invadens
EVELKLPKIVRFDEHVQKVVDS

SEQ ID NO: 2935061 - protein, 17 aa, Entamoeba invadens
EVELSLGLKEQLRLSEA

SEQ ID NO: 2935062 - protein, 24 aa, Entamoeba invadens
EVENLPSAWVAFFKKAGVKKSDLA

SEQ ID NO: 2935063 - protein, 19 aa, Entamoeba invadens
EVEPFWLNIYHTMLLHGLL

SEQ ID NO: 2935064 - protein, 17 aa, Entamoeba invadens
EVESLLNVREMNANITA

SEQ ID NO: 2935065 - protein, 19 aa, Entamoeba invadens
EVFEVMVGHQNCVLGTVKT

SEQ ID NO: 2935066 - protein, 17 aa, Entamoeba invadens
EVFGCFHEEALPNASYE

SEQ ID NO: 2935067 - protein, 25 aa, Entamoeba invadens
EVFKALDGKNVWEVIEQGKSEMGSM

SEQ ID NO: 2935068 - protein, 17 aa, Entamoeba invadens
EVFKMLLEIHKNAKVTL

SEQ ID NO: 2935069 - protein, 17 aa, Entamoeba invadens
EVFKVCLTNTTTVSNVL

SEQ ID NO: 2935070 - protein, 23 aa, Entamoeba invadens
EVFLTKLKVVFADFVNDKTVEEA

SEQ ID NO: 2935071 - protein, 24 aa, Entamoeba invadens
EVFTSLEGKNVWEVVEEGKSQMGS

SEQ ID NO: 2935072 - protein, 27 aa, Entamoeba invadens
EVGDIFYVERFVGSWALVYVNEEKYVF

SEQ ID NO: 2935073 - protein, 22 aa, Entamoeba invadens
EVGHKIVCKKGVNKPLKKKDKY

SEQ ID NO: 2935074 - protein, 22 aa, Entamoeba invadens
EVGKKIGGVKVMECSAKEGVGI

SEQ ID NO: 2935075 - protein, 17 aa, Entamoeba invadens
EVGKMLIRKNVGVWNCI

SEQ ID NO: 2935076 - protein, 23 aa, Entamoeba invadens
EVGYHLDADFSRKLCEDLNVPFL

SEQ ID NO: 2935077 - protein, 26 aa, Entamoeba invadens
EVHKLSSACPYVARLVDSTVINLNSQ

SEQ ID NO: 2935078 - protein, 23 aa, Entamoeba invadens
EVHLLDKFQCEFIINFYGAVFIK

SEQ ID NO: 2935079 - protein, 20 aa, Entamoeba invadens
EVHPILYLVCVDAANAAQNV

SEQ ID NO: 2935080 - protein, 20 aa, Entamoeba invadens
EVHQLRPLKQLKNVIDTQPN

SEQ ID NO: 2935081 - protein, 22 aa, Entamoeba invadens
EVHRSMMLGRKYYFSMRLKTMV

SEQ ID NO: 2935082 - protein, 25 aa, Entamoeba invadens
EVICVGKGCFKYCYSLKNVILSTNI

SEQ ID NO: 2935083 - protein, 17 aa, Entamoeba invadens
EVIEFSRNVNATLLNKE

SEQ ID NO: 2935084 - protein, 20 aa, Entamoeba invadens
EVIGCFARVTATHFVTNTNP

SEQ ID NO: 2935085 - protein, 19 aa, Entamoeba invadens
EVIGCGLTLPVDDHKTIAH

SEQ ID NO: 2935086 - protein, 18 aa, Entamoeba invadens
EVIHHCPTAKYMVVGTKS

SEQ ID NO: 2935087 - protein, 17 aa, Entamoeba invadens
EVIKKPISYCSSQVVLS

SEQ ID NO: 2935088 - protein, 23 aa, Entamoeba invadens
EVIKNSLKYGILSIYTSFVAVDK

SEQ ID NO: 2935089 - protein, 19 aa, Entamoeba invadens
EVILGIKYNSAIDMWSFGC

SEQ ID NO: 2935090 - protein, 17 aa, Entamoeba invadens
EVIMCKEGKYTQDAKSI

SEQ ID NO: 2935091 - protein, 30 aa, Entamoeba invadens
EVIMRGCVSMSHYFVFDSLDKALCFLDRVI

SEQ ID NO: 2935092 - protein, 17 aa, Entamoeba invadens
EVIPSFFECVKRSEERN

SEQ ID NO: 2935093 - protein, 20 aa, Entamoeba invadens
EVIPYRLGQLRSFVLTATPP

SEQ ID NO: 2935094 - protein, 27 aa, Entamoeba invadens
EVIRIICRLTTYNLCFMMPSFRDILAK

SEQ ID NO: 2935095 - protein, 18 aa, Entamoeba invadens
EVIRRNKVNYNFIRNYNT

SEQ ID NO: 2935096 - protein, 22 aa, Entamoeba invadens
EVISARFSDRIFGYLRSAGKSK

SEQ ID NO: 2935097 - protein, 28 aa, Entamoeba invadens
EVISEFIEKLCVISPFQRKTRLFGTKRN

SEQ ID NO: 2935098 - protein, 27 aa, Entamoeba invadens
EVIYMLGVDLGQAFGYSIIKILFEGKD

SEQ ID NO: 2935099 - protein, 23 aa, Entamoeba invadens
EVKDIYLLFDVIKHFIQSELNNF

SEQ ID NO: 2935100 - protein, 17 aa, Entamoeba invadens
EVKELGIYAFYNCNNLS

SEQ ID NO: 2935101 - protein, 21 aa, Entamoeba invadens
EVKEVLKLGFRVEDITFSQVF

SEQ ID NO: 2935102 - protein, 18 aa, Entamoeba invadens
EVKHVFSALLREYKVIRN

SEQ ID NO: 2935103 - protein, 26 aa, Entamoeba invadens
EVKKCFICGSTEHLARDCPKVTNSSS

SEQ ID NO: 2935104 - protein, 26 aa, Entamoeba invadens
EVKKEERKAPVLPTRGQVVPPKSEEK

SEQ ID NO: 2935105 - protein, 18 aa, Entamoeba invadens
EVKKEFLMLKKQCERKAL

SEQ ID NO: 2935106 - protein, 26 aa, Entamoeba invadens
EVKKMITVAPWFFVEITLLKRTANLE

SEQ ID NO: 2935107 - protein, 30 aa, Entamoeba invadens
EVKKRIVSMVCKFFTVFPGDFYVSERGGTL

SEQ ID NO: 2935108 - protein, 19 aa, Entamoeba invadens
EVKMKMRVKMMLDALRGIS

SEQ ID NO: 2935109 - protein, 26 aa, Entamoeba invadens
EVKMMHSGELPKAFDSDDLLGLFSFS

SEQ ID NO: 2935110 - protein, 24 aa, Entamoeba invadens
EVKRAAVLCLGFVLLKKVDELCKT

SEQ ID NO: 2935111 - protein, 25 aa, Entamoeba invadens
EVKRSFYKTVVWFRVPYENTLDPAY

SEQ ID NO: 2935112 - protein, 24 aa, Entamoeba invadens
EVKSCINLYFDEVFFNANKEKGAA

SEQ ID NO: 2935113 - protein, 22 aa, Entamoeba invadens
EVKSLHMYTDFIFLVMELITDG

SEQ ID NO: 2935114 - protein, 23 aa, Entamoeba invadens
EVKTEILYATDFVDQTKNWINSH

SEQ ID NO: 2935115 - protein, 26 aa, Entamoeba invadens
EVKTKFEIANGLYLPVTISEPKKVNL

SEQ ID NO: 2935116 - protein, 20 aa, Entamoeba invadens
EVKTQIESIVQFNKVIQTKL

SEQ ID NO: 2935117 - protein, 19 aa, Entamoeba invadens
EVKTVIVKIGFTIKKENVV

SEQ ID NO: 2935118 - protein, 20 aa, Entamoeba invadens
EVKVAPPLPNGVNTFSSNLN

SEQ ID NO: 2935119 - protein, 26 aa, Entamoeba invadens
EVKYFPNNECDLIFLNDHKYMMVVDT

SEQ ID NO: 2935120 - protein, 18 aa, Entamoeba invadens
EVLARDVIRVNDEKDEQE

SEQ ID NO: 2935121 - protein, 17 aa, Entamoeba invadens
EVLDCVDIPRIILPTSV

SEQ ID NO: 2935122 - protein, 21 aa, Entamoeba invadens
EVLDKFPIVQHFLFGKILPFE

SEQ ID NO: 2935123 - protein, 21 aa, Entamoeba invadens
EVLDMSLNFLQVFPADHPTLK

SEQ ID NO: 2935124 - protein, 21 aa, Entamoeba invadens
EVLDQTFLITLHDHFMHDGVL

SEQ ID NO: 2935125 - protein, 22 aa, Entamoeba invadens
EVLDSTGAFLLFEYFKHCILEM

SEQ ID NO: 2935126 - protein, 24 aa, Entamoeba invadens
EVLELVDAFAATLIHTLKLKKGDS

SEQ ID NO: 2935127 - protein, 33 aa, Entamoeba invadens
EVLERADLLRGIVWKGYVAVVLVQCGINDMSEE

SEQ ID NO: 2935128 - protein, 35 aa, Entamoeba invadens
EVLESAWKSLEFEEIIRLEFDTIICVKGMCTTLPS

SEQ ID NO: 2935129 - protein, 19 aa, Entamoeba invadens
EVLFSLSYKEKVSSSPVNQ

SEQ ID NO: 2935130 - protein, 26 aa, Entamoeba invadens
EVLGEYCFYHCKKLGIIELPTTVKTL

SEQ ID NO: 2935131 - protein, 21 aa, Entamoeba invadens
EVLGYLRVLLFPVDFKETEDV

SEQ ID NO: 2935132 - protein, 25 aa, Entamoeba invadens
EVLKIDKCDNVSCYVNEKCAKYFSV

SEQ ID NO: 2935133 - protein, 17 aa, Entamoeba invadens
EVLKRLETEGANEKQSD

SEQ ID NO: 2935134 - protein, 30 aa, Entamoeba invadens
EVLKSSTVPLFLSQCFEIFNMYNTSLSKQC

SEQ ID NO: 2935135 - protein, 20 aa, Entamoeba invadens
EVLLILKVNPIFPRKNTPST

SEQ ID NO: 2935136 - protein, 20 aa, Entamoeba invadens
EVLLKICWEGDTQPVEKECV

SEQ ID NO: 2935137 - protein, 17 aa, Entamoeba invadens
EVLNDFVTIEERFCASS

SEQ ID NO: 2935138 - protein, 25 aa, Entamoeba invadens
EVLPRILHKMLKMKFQLTAVHLIDS

SEQ ID NO: 2935139 - protein, 20 aa, Entamoeba invadens
EVLQNIPLVYVHKFVMQNSE

SEQ ID NO: 2935140 - protein, 56 aa, Entamoeba invadens
EVLRGEFKPTITLLFYIMYRYRLNDVPVRIIDFSRWFRFVLKITNPLFDLKSEFGD

SEQ ID NO: 2935141 - protein, 22 aa, Entamoeba invadens
EVLRIDLLSIMSSFPYFVEISV

SEQ ID NO: 2935142 - protein, 18 aa, Entamoeba invadens
EVLRIKRKQLREQKEKSE

SEQ ID NO: 2935143 - protein, 20 aa, Entamoeba invadens
EVLSFTVYELLNFNPEIIYR

SEQ ID NO: 2935144 - protein, 19 aa, Entamoeba invadens
EVLTLTQLYSIEFGDNLIQ

SEQ ID NO: 2935145 - protein, 27 aa, Entamoeba invadens
EVLVAKGYGIGVDWWSLGCVSYEMMVG

SEQ ID NO: 2935146 - protein, 19 aa, Entamoeba invadens
EVLYHRWVPHNSKVLEIAF

SEQ ID NO: 2935147 - protein, 17 aa, Entamoeba invadens
EVMCLAEDLNIPIYYQD

SEQ ID NO: 2935148 - protein, 22 aa, Entamoeba invadens
EVMIGLLGCDMLYAEQLEEVRA

SEQ ID NO: 2935149 - protein, 19 aa, Entamoeba invadens
EVMTCCFREGTLDLFTSGN

SEQ ID NO: 2935150 - protein, 23 aa, Entamoeba invadens
EVMYHITGALTFVTEIPRVIEPV

SEQ ID NO: 2935151 - protein, 31 aa, Entamoeba invadens
EVNCNRGAQARCISCVHLLFEDSYITKGGKL

SEQ ID NO: 2935152 - protein, 25 aa, Entamoeba invadens
EVNDCTSLVIKECIPNGQLKAFPWN

SEQ ID NO: 2935153 - protein, 27 aa, Entamoeba invadens
EVNELHMKLLLKIDGFVGLNETYRPIR

SEQ ID NO: 2935154 - protein, 23 aa, Entamoeba invadens
EVNFECLQRLVVVPNITGTLQVT

SEQ ID NO: 2935155 - protein, 18 aa, Entamoeba invadens
EVNGKLPTFEKLEEISAF

SEQ ID NO: 2935156 - protein, 20 aa, Entamoeba invadens
EVNIPSDFTITGRDNNGKEV

SEQ ID NO: 2935157 - protein, 25 aa, Entamoeba invadens
EVNKKFYLALRRLRDTHQLYTTIGN

SEQ ID NO: 2935158 - protein, 22 aa, Entamoeba invadens
EVNLDKAIDVTRQMKETANMTD

SEQ ID NO: 2935159 - protein, 26 aa, Entamoeba invadens
EVNPSCMCANCIQTAVDITEGIPKQV

SEQ ID NO: 2935160 - protein, 26 aa, Entamoeba invadens
EVNRIKGELLGQMRAAEEIKKLEMQK

SEQ ID NO: 2935161 - protein, 25 aa, Entamoeba invadens
EVNRLEKRTSLKLLKTNVVVFCDIP

SEQ ID NO: 2935162 - protein, 28 aa, Entamoeba invadens
EVNTPKCFPLPPEFRVFPQVVYTPKRIR

SEQ ID NO: 2935163 - protein, 20 aa, Entamoeba invadens
EVNVRYLALDTFVLLGQANY

SEQ ID NO: 2935164 - protein, 23 aa, Entamoeba invadens
EVPDCGGRIGPFVDKLFPDLRNG

SEQ ID NO: 2935165 - protein, 20 aa, Entamoeba invadens
EVPDFKEVVSKIIPTILNTP

SEQ ID NO: 2935166 - protein, 19 aa, Entamoeba invadens
EVPHEGPMCDLLWSDPEEK

SEQ ID NO: 2935167 - protein, 18 aa, Entamoeba invadens
EVPHVIEFSLKRQGTKFV

SEQ ID NO: 2935168 - protein, 25 aa, Entamoeba invadens
EVPLKCGYEAAYLTAMKNKRENVVL

SEQ ID NO: 2935169 - protein, 24 aa, Entamoeba invadens
EVPLVIECAIMYFSSRVETISVEG

SEQ ID NO: 2935170 - protein, 18 aa, Entamoeba invadens
EVPNEIEVDCCFENVIKW

SEQ ID NO: 2935171 - protein, 22 aa, Entamoeba invadens
EVPQKRQAVILVENEIVDMQCN

SEQ ID NO: 2935172 - protein, 25 aa, Entamoeba invadens
EVPQKVRCVGSFAFENCVQLKELVF

SEQ ID NO: 2935173 - protein, 23 aa, Entamoeba invadens
EVPSSGLFCDLLWSDPYVPEIDN

SEQ ID NO: 2935174 - protein, 29 aa, Entamoeba invadens
EVPTEYKGKCLFMSVLFLTKLQGYFSDLE

SEQ ID NO: 2935175 - protein, 19 aa, Entamoeba invadens
EVPVKITAGSVVFGNQNAK

SEQ ID NO: 2935176 - protein, 25 aa, Entamoeba invadens
EVQIAFPLNLRKLFLTNAKITNINL

SEQ ID NO: 2935177 - protein, 18 aa, Entamoeba invadens
EVQKCIREFYATPLRSSC

SEQ ID NO: 2935178 - protein, 23 aa, Entamoeba invadens
EVQKEIHSALGVDVLLNTQNQCR

SEQ ID NO: 2935179 - protein, 21 aa, Entamoeba invadens
EVQKFRDWYCVNIEKVEEIAN

SEQ ID NO: 2935180 - protein, 25 aa, Entamoeba invadens
EVQKSLLSWKEMKNKMGTFSPGVIV

SEQ ID NO: 2935181 - protein, 18 aa, Entamoeba invadens
EVQMSLLVPYGMRSIEQY

SEQ ID NO: 2935182 - protein, 20 aa, Entamoeba invadens
EVQNPFHLDKVVLKRREGCK

SEQ ID NO: 2935183 - protein, 20 aa, Entamoeba invadens
EVQPQCPYCGAYSIRPLLFK

SEQ ID NO: 2935184 - protein, 26 aa, Entamoeba invadens
EVQRIIKERIEGIAAISGVKEAISSA

SEQ ID NO: 2935185 - protein, 21 aa, Entamoeba invadens
EVQSVLRRVLVKDFYDEQNFC

SEQ ID NO: 2935186 - protein, 19 aa, Entamoeba invadens
EVQSVYRMLLWKTFLNAMN

SEQ ID NO: 2935187 - protein, 20 aa, Entamoeba invadens
EVQTICAKVCLKNVKDLPDN

SEQ ID NO: 2935188 - protein, 20 aa, Entamoeba invadens
EVQTKFGVLASYLRNKTGKV

SEQ ID NO: 2935189 - protein, 21 aa, Entamoeba invadens
EVRASFEMLYQVPIRLILEHR

SEQ ID NO: 2935190 - protein, 19 aa, Entamoeba invadens
EVRGKGHLFTFEFHEQRKL

SEQ ID NO: 2935191 - protein, 24 aa, Entamoeba invadens
EVRIPQTTKFVARYTFLKKTLIIK

SEQ ID NO: 2935192 - protein, 19 aa, Entamoeba invadens
EVRRAMLAMFKNNFDNPEK

SEQ ID NO: 2935193 - protein, 25 aa, Entamoeba invadens
EVRSWALLCLSKLWEGCVEIKIRAF

SEQ ID NO: 2935194 - protein, 23 aa, Entamoeba invadens
EVRVTGFLSGYLYKGLDTDPDFN

SEQ ID NO: 2935195 - protein, 25 aa, Entamoeba invadens
EVRYIKVRGSGVAFIEFRDEQSSEI

SEQ ID NO: 2935196 - protein, 26 aa, Entamoeba invadens
EVSALSLLKFPLKFSNLKNAKKAAEF

SEQ ID NO: 2935197 - protein, 25 aa, Entamoeba invadens
EVSGLNWLCSNNFVGLMLNSFLDEI

SEQ ID NO: 2935198 - protein, 23 aa, Entamoeba invadens
EVSNELYVSIDITMKNSRSSIDN

SEQ ID NO: 2935199 - protein, 17 aa, Entamoeba invadens
EVSPEVTVSLEIWDTAG

SEQ ID NO: 2935200 - protein, 21 aa, Entamoeba invadens
EVSPLFPVLMNRVSRLHLVLG

SEQ ID NO: 2935201 - protein, 24 aa, Entamoeba invadens
EVSPRFCRCGGQLTLRGSSEALGE

SEQ ID NO: 2935202 - protein, 23 aa, Entamoeba invadens
EVSRATLAINILNEFPEELIGVE

SEQ ID NO: 2935203 - protein, 26 aa, Entamoeba invadens
EVSSLLLSLRWKLFLKCLPTDGTQWT

SEQ ID NO: 2935204 - protein, 23 aa, Entamoeba invadens
EVSTKYPAFCLNKENGKLFSQRI

SEQ ID NO: 2935205 - protein, 25 aa, Entamoeba invadens
EVSYAQSVSLLWVKYDVMGDSVTMD

SEQ ID NO: 2935206 - protein, 25 aa, Entamoeba invadens
EVTAEFKFLFEVFQMEVDGRKGINV

SEQ ID NO: 2935207 - protein, 18 aa, Entamoeba invadens
EVTFAQPVMMSFGIVSTC

SEQ ID NO: 2935208 - protein, 24 aa, Entamoeba invadens
EVTGTCERCVFVGDENSGKTRLIL

SEQ ID NO: 2935209 - protein, 20 aa, Entamoeba invadens
EVTISYDFFGFIPHILLFVR

SEQ ID NO: 2935210 - protein, 23 aa, Entamoeba invadens
EVTKNMWAIKSFSLYEEERVFGV

SEQ ID NO: 2935211 - protein, 24 aa, Entamoeba invadens
EVTLPEGMTVVLESCFMNCAQLEK

SEQ ID NO: 2935212 - protein, 17 aa, Entamoeba invadens
EVTNIFSYMGIDEKGVV

SEQ ID NO: 2935213 - protein, 19 aa, Entamoeba invadens
EVTPLPHFEDIYELIRIAE

SEQ ID NO: 2935214 - protein, 21 aa, Entamoeba invadens
EVTQPTLLFIPRIVTKSERNF

SEQ ID NO: 2935215 - protein, 21 aa, Entamoeba invadens
EVTRQVHLYGIFQAVYTSGTD

SEQ ID NO: 2935216 - protein, 24 aa, Entamoeba invadens
EVVCLPFYTFIVRYLYPRHEHITK

SEQ ID NO: 2935217 - protein, 19 aa, Entamoeba invadens
EVVDCLNLLFENREQAQKP

SEQ ID NO: 2935218 - protein, 25 aa, Entamoeba invadens
EVVDMKPKEILAMIEEVTGTKMYQT

SEQ ID NO: 2935219 - protein, 18 aa, Entamoeba invadens
EVVDYLVSHYDTFLKENW

SEQ ID NO: 2935220 - protein, 24 aa, Entamoeba invadens
EVVEIKNWLEHDFGDDDDQEVYED

SEQ ID NO: 2935221 - protein, 21 aa, Entamoeba invadens
EVVELGSFVKTRFKNLLDNSY

SEQ ID NO: 2935222 - protein, 17 aa, Entamoeba invadens
EVVEVNLSFLFDSTVGY

SEQ ID NO: 2935223 - protein, 19 aa, Entamoeba invadens
EVVFKTVIDTVSFDRLENS

SEQ ID NO: 2935224 - protein, 24 aa, Entamoeba invadens
EVVFRTEQIIAMLLVQVKKFTEEF

SEQ ID NO: 2935225 - protein, 17 aa, Entamoeba invadens
EVVHQWKQGVVCTCRDG

SEQ ID NO: 2935226 - protein, 18 aa, Entamoeba invadens
EVVIGGFKKTTSLETIKE

SEQ ID NO: 2935227 - protein, 23 aa, Entamoeba invadens
EVVIKIRIKMMLDAAKGICYLHK

SEQ ID NO: 2935228 - protein, 27 aa, Entamoeba invadens
EVVISPDQFKILLIFLKTFFSEESSGE

SEQ ID NO: 2935229 - protein, 18 aa, Entamoeba invadens
EVVITLLFMKLITPNKVY

SEQ ID NO: 2935230 - protein, 31 aa, Entamoeba invadens
EVVKCSYCDGFLALFIRPLMWSTGKMTEFDL

SEQ ID NO: 2935231 - protein, 26 aa, Entamoeba invadens
EVVKIKLYLCCTCYDVYNVMKASQVL

SEQ ID NO: 2935232 - protein, 20 aa, Entamoeba invadens
EVVKPHPQFMLFATQNPPNT

SEQ ID NO: 2935233 - protein, 22 aa, Entamoeba invadens
EVVKPHPQFMLFATQNPPNTYG

SEQ ID NO: 2935234 - protein, 28 aa, Entamoeba invadens
EVVKQPAYFVPEFMCPTGMTDAMRADNR

SEQ ID NO: 2935235 - protein, 21 aa, Entamoeba invadens
EVVKSVHWLEFYGSGYMKERI

SEQ ID NO: 2935236 - protein, 26 aa, Entamoeba invadens
EVVLPGYMFGAAPNWAFYNNATKCGV

SEQ ID NO: 2935237 - protein, 26 aa, Entamoeba invadens
EVVLPRLLKKISILDCTGKINMKNCR

SEQ ID NO: 2935238 - protein, 21 aa, Entamoeba invadens
EVVQAWTYKPGFPVVSLELKD

SEQ ID NO: 2935239 - protein, 25 aa, Entamoeba invadens
EVVRLLMDILLEFGYVVIAENETVD

SEQ ID NO: 2935240 - protein, 18 aa, Entamoeba invadens
EVVRQINLQSGKVSNKNT

SEQ ID NO: 2935241 - protein, 18 aa, Entamoeba invadens
EVVRVCVYQLFANYHKLP

SEQ ID NO: 2935242 - protein, 22 aa, Entamoeba invadens
EVVSACVRRGVTYPLVRNYDLA

SEQ ID NO: 2935243 - protein, 21 aa, Entamoeba invadens
EVVSFKLKDPVHHDTPHKVDT

SEQ ID NO: 2935244 - protein, 25 aa, Entamoeba invadens
EVVSSEFLLRIGVSSFRKCSNLRNF

SEQ ID NO: 2935245 - protein, 25 aa, Entamoeba invadens
EVVTLPVVRNLLIGFNDVVNSIKTS

SEQ ID NO: 2935246 - protein, 24 aa, Entamoeba invadens
EVVVPLLGILFNFSQTDSMEEEVH

SEQ ID NO: 2935247 - protein, 18 aa, Entamoeba invadens
EVVYLFEVFEHFFMEFLP

SEQ ID NO: 2935248 - protein, 19 aa, Entamoeba invadens
EVWTPEEHALFVEGLNLYH

SEQ ID NO: 2935249 - protein, 29 aa, Entamoeba invadens
EVYDMKEMVGRGGFSVVHRVVNRESGQEE

SEQ ID NO: 2935250 - protein, 26 aa, Entamoeba invadens
EVYEIPKSLAVAFDFYTKFYTEKFET

SEQ ID NO: 2935251 - protein, 19 aa, Entamoeba invadens
EVYFPSTLTHIGRDVFSGC

SEQ ID NO: 2935252 - protein, 24 aa, Entamoeba invadens
EVYGCDMEGFILVLSSLKLMHPVL

SEQ ID NO: 2935253 - protein, 21 aa, Entamoeba invadens
EVYIPKDFFKVMVSENLLAGV

SEQ ID NO: 2935254 - protein, 19 aa, Entamoeba invadens
EVYKACLDQSGLVDKGMFS

SEQ ID NO: 2935255 - protein, 20 aa, Entamoeba invadens
EVYKSNWIVGEKVNIPSRLA

SEQ ID NO: 2935256 - protein, 21 aa, Entamoeba invadens
EVYLIKYLPLFTSLAASATGK

SEQ ID NO: 2935257 - protein, 23 aa, Entamoeba invadens
EVYLKNFIGSFVLSRAVLHHGIS

SEQ ID NO: 2935258 - protein, 18 aa, Entamoeba invadens
EVYPPRFVSKDEEALFAQ

SEQ ID NO: 2935259 - protein, 24 aa, Entamoeba invadens
EVYSKINSRCRIGLTATFVREDSK

SEQ ID NO: 2935260 - protein, 18 aa, Entamoeba invadens
EWAIKYKLQRFVEDNSNI

SEQ ID NO: 2935261 - protein, 18 aa, Entamoeba invadens
EWAKSAMNPLKYLNRMQS

SEQ ID NO: 2935262 - protein, 18 aa, Entamoeba invadens
EWDGVKVIIYFDKTDPSR

SEQ ID NO: 2935263 - protein, 22 aa, Entamoeba invadens
EWDIHCYAIAPAPIFGENLATN

SEQ ID NO: 2935264 - protein, 21 aa, Entamoeba invadens
EWFMKNKIGELYLCPHSSHLS

SEQ ID NO: 2935265 - protein, 18 aa, Entamoeba invadens
EWGELNIGTVFKRYKTNM

SEQ ID NO: 2935266 - protein, 25 aa, Entamoeba invadens
EWHEFPLKECLMFGDVVFPLLHINT

SEQ ID NO: 2935267 - protein, 26 aa, Entamoeba invadens
EWISKLAQVAHTWGVFGYPIECAVKK

SEQ ID NO: 2935268 - protein, 23 aa, Entamoeba invadens
EWKIFTEKIMTWLLYPDVFDKFE

SEQ ID NO: 2935269 - protein, 23 aa, Entamoeba invadens
EWKNMAVDFLVEMLREHLSEGTI

SEQ ID NO: 2935270 - protein, 24 aa, Entamoeba invadens
EWLFWDVSGAPKFRGLWKSYYPNV

SEQ ID NO: 2935271 - protein, 18 aa, Entamoeba invadens
EWMGYNLLFEGMLSSVLT

SEQ ID NO: 2935272 - protein, 19 aa, Entamoeba invadens
EWMLKLFKESCGIKILESS

SEQ ID NO: 2935273 - protein, 20 aa, Entamoeba invadens
EWRGKVYRTILVVDQSNYII

SEQ ID NO: 2935274 - protein, 25 aa, Entamoeba invadens
EWRWQVWKYLLRYVPVEKNRTEKVL

SEQ ID NO: 2935275 - protein, 18 aa, Entamoeba invadens
EWSGRTVGKAVFNSLTDV

SEQ ID NO: 2935276 - protein, 18 aa, Entamoeba invadens
EWSSPVVPVEKWEMKYAE

SEQ ID NO: 2935277 - protein, 21 aa, Entamoeba invadens
EWTDIRAAYNMYIEKYTALTK

SEQ ID NO: 2935278 - protein, 22 aa, Entamoeba invadens
EWTHKTVSGILFNSEVDNWSRG

SEQ ID NO: 2935279 - protein, 19 aa, Entamoeba invadens
EWTNSCGFEEIYNNTSGKR

SEQ ID NO: 2935280 - protein, 17 aa, Entamoeba invadens
EWVPVEVGDVVMFEGLY

SEQ ID NO: 2935281 - protein, 17 aa, Entamoeba invadens
EWVRRPKKAKAPCVRVK

SEQ ID NO: 2935282 - protein, 19 aa, Entamoeba invadens
EYACSIPQHQFCYWDKSGT

SEQ ID NO: 2935283 - protein, 17 aa, Entamoeba invadens
EYAGLKLFYQKPEDDAH

SEQ ID NO: 2935284 - protein, 17 aa, Entamoeba invadens
EYAKESILVLFKPLDYA

SEQ ID NO: 2935285 - protein, 20 aa, Entamoeba invadens
EYCDGCAKRLVIPAEVSDSP

SEQ ID NO: 2935286 - protein, 17 aa, Entamoeba invadens
EYCGEIRPYVTMNDDII

SEQ ID NO: 2935287 - protein, 17 aa, Entamoeba invadens
EYCYFPFDDHNAPQFEI

SEQ ID NO: 2935288 - protein, 24 aa, Entamoeba invadens
EYDLLERTFRVFGNGSIYKVTKEN

SEQ ID NO: 2935289 - protein, 18 aa, Entamoeba invadens
EYDLYKKYHFLRMMSENF

SEQ ID NO: 2935290 - protein, 32 aa, Entamoeba invadens
EYDMMKKRLLDMSAEFKKAIVTIESLPKTVVL

SEQ ID NO: 2935291 - protein, 21 aa, Entamoeba invadens
EYDPSYCIYYAFLCTNKKNGV

SEQ ID NO: 2935292 - protein, 20 aa, Entamoeba invadens
EYDTALKLYNEWDKSNTQDI

SEQ ID NO: 2935293 - protein, 21 aa, Entamoeba invadens
EYDYSTLFLGDYVDRGLMSCE

SEQ ID NO: 2935294 - protein, 26 aa, Entamoeba invadens
EYEEGGKVFEHWVTFFSNVGEHLFKM

SEQ ID NO: 2935295 - protein, 22 aa, Entamoeba invadens
EYEIKLANFQTHKHDKDLSVPS

SEQ ID NO: 2935296 - protein, 31 aa, Entamoeba invadens
EYENLPANACRFVIDLFLEYNALSKALVLDK

SEQ ID NO: 2935297 - protein, 22 aa, Entamoeba invadens
EYERDFALKIHQFQASFPQTLK

SEQ ID NO: 2935298 - protein, 18 aa, Entamoeba invadens
EYESRILALVKVVEQCKN

SEQ ID NO: 2935299 - protein, 19 aa, Entamoeba invadens
EYEVHGDLKHSDGFKAQKF

SEQ ID NO: 2935300 - protein, 17 aa, Entamoeba invadens
EYFECFESAELGFDTPV

SEQ ID NO: 2935301 - protein, 17 aa, Entamoeba invadens
EYFFKRGTFTQNIKMFL

SEQ ID NO: 2935302 - protein, 23 aa, Entamoeba invadens
EYFFWKEVLCMTNEYNEYLTRKV

SEQ ID NO: 2935303 - protein, 27 aa, Entamoeba invadens
EYFKSLKVLKTLVLYIDYYGSYTNDTE

SEQ ID NO: 2935304 - protein, 22 aa, Entamoeba invadens
EYFLPTCIIYSSLCCVIQHNIN

SEQ ID NO: 2935305 - protein, 25 aa, Entamoeba invadens
EYFMYKIAYICRLRDIGIYKTQFGM

SEQ ID NO: 2935306 - protein, 18 aa, Entamoeba invadens
EYFPQLSQYSRFVSTGLF

SEQ ID NO: 2935307 - protein, 29 aa, Entamoeba invadens
EYFRFEVGKGLPKVLTFVIENDGKRMSEV

SEQ ID NO: 2935308 - protein, 22 aa, Entamoeba invadens
EYFYKFFNFEEIDDMLFCPLLR

SEQ ID NO: 2935309 - protein, 23 aa, Entamoeba invadens
EYGHLPLSALPRIVLEDQEKYEE

SEQ ID NO: 2935310 - protein, 26 aa, Entamoeba invadens
EYGIPILLHKIYHNMICCVEDEPLRG

SEQ ID NO: 2935311 - protein, 25 aa, Entamoeba invadens
EYGKLKKRDTAIFLGNSVPINYTKK

SEQ ID NO: 2935312 - protein, 19 aa, Entamoeba invadens
EYHPDIILDPRYNIKTGLV

SEQ ID NO: 2935313 - protein, 29 aa, Entamoeba invadens
EYHSSQLFPERWFDLVVVLRTDNTVLYDR

SEQ ID NO: 2935314 - protein, 24 aa, Entamoeba invadens
EYHVKLSNWILPHIDSIKNISYYK

SEQ ID NO: 2935315 - protein, 25 aa, Entamoeba invadens
EYIEEFPPLLSEVGMGARIRNYCRR

SEQ ID NO: 2935316 - protein, 18 aa, Entamoeba invadens
EYIIHFYGAVFIPKKICL

SEQ ID NO: 2935317 - protein, 19 aa, Entamoeba invadens
EYIKEVDISLVIERVTKKC

SEQ ID NO: 2935318 - protein, 24 aa, Entamoeba invadens
EYIKKELNIHFVLGERSAYEMSCL

SEQ ID NO: 2935319 - protein, 25 aa, Entamoeba invadens
EYIKSNLSGLMFANYVLHKNVREIF

SEQ ID NO: 2935320 - protein, 24 aa, Entamoeba invadens
EYINRILEVVFKYGKNRKMFFSSF

SEQ ID NO: 2935321 - protein, 23 aa, Entamoeba invadens
EYIPRPRKPFLPQATFLAKSGVS

SEQ ID NO: 2935322 - protein, 20 aa, Entamoeba invadens
EYIQKICFWILSNISAGSFE

SEQ ID NO: 2935323 - protein, 26 aa, Entamoeba invadens
EYIRRGIKISVGRKGVADKVRQRVMW

SEQ ID NO: 2935324 - protein, 21 aa, Entamoeba invadens
EYITAGSLFARIMKKPLSEQE

SEQ ID NO: 2935325 - protein, 18 aa, Entamoeba invadens
EYIVHFYGAVLIPNKICM

SEQ ID NO: 2935326 - protein, 26 aa, Entamoeba invadens
EYKGKEWRLCVLFNDIFVIGKVDIRD

SEQ ID NO: 2935327 - protein, 18 aa, Entamoeba invadens
EYKITYPYLYAQRPREVK

SEQ ID NO: 2935328 - protein, 20 aa, Entamoeba invadens
EYKKCKSVFLVQPKKQQKWE

SEQ ID NO: 2935329 - protein, 21 aa, Entamoeba invadens
EYKLCYACYYPYKDAHGRIPY

SEQ ID NO: 2935330 - protein, 17 aa, Entamoeba invadens
EYKNCGFKDFIQQPHFV

SEQ ID NO: 2935331 - protein, 17 aa, Entamoeba invadens
EYKQFMRSLGWYVDASS

SEQ ID NO: 2935332 - protein, 18 aa, Entamoeba invadens
EYKRLMLRLRQETERVKI

SEQ ID NO: 2935333 - protein, 19 aa, Entamoeba invadens
EYKSDFVYVEYAIPTIQLP

SEQ ID NO: 2935334 - protein, 21 aa, Entamoeba invadens
EYKVESNFTRFKHLIDNGWTV

SEQ ID NO: 2935335 - protein, 24 aa, Entamoeba invadens
EYLCLKGSKITSFGIQDLVILSHI

SEQ ID NO: 2935336 - protein, 24 aa, Entamoeba invadens
EYLCSLLRDILFDRMKEMENVKTE

SEQ ID NO: 2935337 - protein, 18 aa, Entamoeba invadens
EYLDCLIPLIQQDKLIFS

SEQ ID NO: 2935338 - protein, 20 aa, Entamoeba invadens
EYLEKCKMVSKKGRASLPAG

SEQ ID NO: 2935339 - protein, 17 aa, Entamoeba invadens
EYLFKSAQYFSSEIIVI

SEQ ID NO: 2935340 - protein, 38 aa, Entamoeba invadens
EYLFVTNPTFCFDLINGIIGYCRSPSLVVRKNATSVLY

SEQ ID NO: 2935341 - protein, 18 aa, Entamoeba invadens
EYLIRTGEEIHRAILAKQ

SEQ ID NO: 2935342 - protein, 20 aa, Entamoeba invadens
EYLLSFLGGDSIHIQIVPGD

SEQ ID NO: 2935343 - protein, 23 aa, Entamoeba invadens
EYLLSSRYTFFIGVEDGKVVSLL

SEQ ID NO: 2935344 - protein, 18 aa, Entamoeba invadens
EYLQAFKHRRSQLQGVGL

SEQ ID NO: 2935345 - protein, 18 aa, Entamoeba invadens
EYLYKYALLSLRKKKSLD

SEQ ID NO: 2935346 - protein, 20 aa, Entamoeba invadens
EYMHCKSCTDAHQKGDLSRV

SEQ ID NO: 2935347 - protein, 25 aa, Entamoeba invadens
EYMIFACVFEALRFTTRGWETMDPN

SEQ ID NO: 2935348 - protein, 21 aa, Entamoeba invadens
EYMKIKRCNAYGLRVEENVLK

SEQ ID NO: 2935349 - protein, 21 aa, Entamoeba invadens
EYMSRLLRACGYIYTTSAQME

SEQ ID NO: 2935350 - protein, 26 aa, Entamoeba invadens
EYMTCEYKKLLVLRHAKFTLKQNKKI

SEQ ID NO: 2935351 - protein, 18 aa, Entamoeba invadens
EYMTFLLECHCKYTIKIY

SEQ ID NO: 2935352 - protein, 24 aa, Entamoeba invadens
EYMVNRLNLLLLQHIQKCLPGLRQ

SEQ ID NO: 2935353 - protein, 18 aa, Entamoeba invadens
EYNLLDFVISRPIHYNVW

SEQ ID NO: 2935354 - protein, 18 aa, Entamoeba invadens
EYNMLYKWINFLGYPPKK

SEQ ID NO: 2935355 - protein, 26 aa, Entamoeba invadens
EYPLAMKCGKFDVSVKEFKHLTYICL

SEQ ID NO: 2935356 - protein, 22 aa, Entamoeba invadens
EYPQQRRFGGMLGNKQPRRIES

SEQ ID NO: 2935357 - protein, 20 aa, Entamoeba invadens
EYQEALQLLEKCIDEIKRRV

SEQ ID NO: 2935358 - protein, 23 aa, Entamoeba invadens
EYQEFAEGLGWTVDMKKHNGFIG

SEQ ID NO: 2935359 - protein, 18 aa, Entamoeba invadens
EYQKCCVMMLSTCLSFAI

SEQ ID NO: 2935360 - protein, 19 aa, Entamoeba invadens
EYQKTRVAYALTFPYSEDA

SEQ ID NO: 2935361 - protein, 19 aa, Entamoeba invadens
EYQNVLLIYEDWIEKTKIL

SEQ ID NO: 2935362 - protein, 30 aa, Entamoeba invadens
EYRDTIRVWIRMTCYSVKYDSTIHGMSALN

SEQ ID NO: 2935363 - protein, 21 aa, Entamoeba invadens
EYRDVKWKKMISNWTPTNVPR

SEQ ID NO: 2935364 - protein, 20 aa, Entamoeba invadens
EYRECIIQNALLLIKKYIEM

SEQ ID NO: 2935365 - protein, 21 aa, Entamoeba invadens
EYRLNSCSFYFEPKMLTKDFI

SEQ ID NO: 2935366 - protein, 27 aa, Entamoeba invadens
EYRPNKPFPCRLVEFLERWKCSMDQEE

SEQ ID NO: 2935367 - protein, 19 aa, Entamoeba invadens
EYSALRFQYMRTGDGYVIV

SEQ ID NO: 2935368 - protein, 18 aa, Entamoeba invadens
EYSDGSICIKCNTGNVYN

SEQ ID NO: 2935369 - protein, 23 aa, Entamoeba invadens
EYSEIMPLFLDIQVKNFETIQKV

SEQ ID NO: 2935370 - protein, 18 aa, Entamoeba invadens
EYSFQYMLSYYAHTSAMD

SEQ ID NO: 2935371 - protein, 20 aa, Entamoeba invadens
EYSIRDVVFYMFERDSTRFL

SEQ ID NO: 2935372 - protein, 24 aa, Entamoeba invadens
EYSKDKWACFSSMSQKAANALIQN

SEQ ID NO: 2935373 - protein, 17 aa, Entamoeba invadens
EYTFYKGKFDFENYKIL

SEQ ID NO: 2935374 - protein, 22 aa, Entamoeba invadens
EYTHCVVEWELGEGVKDYLGRI

SEQ ID NO: 2935375 - protein, 22 aa, Entamoeba invadens
EYTNYFGFNLCMGMCTEFNDLI

SEQ ID NO: 2935376 - protein, 19 aa, Entamoeba invadens
EYTPFVAQMFYDYSTVVEG

SEQ ID NO: 2935377 - protein, 25 aa, Entamoeba invadens
EYTPIKVVLNKGGITLDIVFGKFSF

SEQ ID NO: 2935378 - protein, 23 aa, Entamoeba invadens
EYTQRLNNIGAFAKLKEVLSSQL

SEQ ID NO: 2935379 - protein, 23 aa, Entamoeba invadens
EYTSCFANGSAIMIGDNLGRVTF

SEQ ID NO: 2935380 - protein, 26 aa, Entamoeba invadens
EYVIPKRFERGYVPIKTISKYSMLKT

SEQ ID NO: 2935381 - protein, 23 aa, Entamoeba invadens
EYVKESIISKDFFVIMSDKRFMF

SEQ ID NO: 2935382 - protein, 20 aa, Entamoeba invadens
EYVKLLSDFREELEEHEKQR

SEQ ID NO: 2935383 - protein, 24 aa, Entamoeba invadens
EYVQAHPTVVEWAMEYLEKVGEPK

SEQ ID NO: 2935384 - protein, 20 aa, Entamoeba invadens
EYYAQLDLKIRVTGGGQVSQ

SEQ ID NO: 2935385 - protein, 17 aa, Entamoeba invadens
EYYFREVSSGSKDCNIV

SEQ ID NO: 2935386 - protein, 22 aa, Entamoeba invadens
EYYIKYIDTYIWMKGEQRKIYN

SEQ ID NO: 2935387 - protein, 18 aa, Entamoeba invadens
EYYKEFVNFIPLSGVEQN

SEQ ID NO: 2935388 - protein, 20 aa, Entamoeba invadens
EYYWPNSHILLYGGKDVYAY

SEQ ID NO: 2935389 - protein, 20 aa, Entamoeba invadens
FAAEMVVAMRSERKGIVQTK

SEQ ID NO: 2935390 - protein, 18 aa, Entamoeba invadens
FAAIAVEICGSFYINYSS

SEQ ID NO: 2935391 - protein, 17 aa, Entamoeba invadens
FAALLKKDIHIHSIRKN

SEQ ID NO: 2935392 - protein, 21 aa, Entamoeba invadens
FAAQCRSCYQVIFSNTYYGAM

SEQ ID NO: 2935393 - protein, 24 aa, Entamoeba invadens
FAAYKMYTSFVYPKRVHDIRGGAN

SEQ ID NO: 2935394 - protein, 18 aa, Entamoeba invadens
FACATQLERVVLPSSITE

SEQ ID NO: 2935395 - protein, 26 aa, Entamoeba invadens
FACDILILKKICDLGFGLESEYIQHR

SEQ ID NO: 2935396 - protein, 17 aa, Entamoeba invadens
FADAAHRIHDLITITYR

SEQ ID NO: 2935397 - protein, 29 aa, Entamoeba invadens
FADARRGTLISGREKKEFIGMRESLSRSL

SEQ ID NO: 2935398 - protein, 20 aa, Entamoeba invadens
FADFAISVAVIHHFSSEERR

SEQ ID NO: 2935399 - protein, 18 aa, Entamoeba invadens
FADIMKKYGMSREEVKEY

SEQ ID NO: 2935400 - protein, 25 aa, Entamoeba invadens
FADISAYLCALIPLFESDRVDVQRK

SEQ ID NO: 2935401 - protein, 31 aa, Entamoeba invadens
FADNEFKAIFSMCDGCSLFHKKDGKLSRKEF

SEQ ID NO: 2935402 - protein, 22 aa, Entamoeba invadens
FADRSKMPLLYKKLGEAQLDEF

SEQ ID NO: 2935403 - protein, 22 aa, Entamoeba invadens
FADSYKRYGLVRGTENQNGKDV

SEQ ID NO: 2935404 - protein, 18 aa, Entamoeba invadens
FADVKMLFNHNNIKFDLV

SEQ ID NO: 2935405 - protein, 23 aa, Entamoeba invadens
FAECLSEYISIFVGENGYFKMGD

SEQ ID NO: 2935406 - protein, 17 aa, Entamoeba invadens
FAECPNLKVVVIPNSVE

SEQ ID NO: 2935407 - protein, 19 aa, Entamoeba invadens
FAECPNLKVVVIPNSVESI

SEQ ID NO: 2935408 - protein, 30 aa, Entamoeba invadens
FAEELKQKWPDFIYTSGVPKVISALLVNIM

SEQ ID NO: 2935409 - protein, 18 aa, Entamoeba invadens
FAEEYKFLVEKQEMEIDE

SEQ ID NO: 2935410 - protein, 19 aa, Entamoeba invadens
FAEFIPPLITKASLDKEMR

SEQ ID NO: 2935411 - protein, 22 aa, Entamoeba invadens
FAEMADLLKLFTVVNAKIPLPK

SEQ ID NO: 2935412 - protein, 23 aa, Entamoeba invadens
FAEMKKCCMTRGIGDITSITGER

SEQ ID NO: 2935413 - protein, 29 aa, Entamoeba invadens
FAESVKGFADFSLKLVMRQSAIKAEEIFK

SEQ ID NO: 2935414 - protein, 22 aa, Entamoeba invadens
FAETFRRKEVVNGKSTELKQYS

SEQ ID NO: 2935415 - protein, 21 aa, Entamoeba invadens
FAEVLRNVFQPCFEATLHPNE

SEQ ID NO: 2935416 - protein, 25 aa, Entamoeba invadens
FAFESCGFVNITIPVTIRYIGDRVF

SEQ ID NO: 2935417 - protein, 19 aa, Entamoeba invadens
FAFKECAKLERVKFTKIPL

SEQ ID NO: 2935418 - protein, 23 aa, Entamoeba invadens
FAFKEKKLVFFIAAVMIIHNKRI

SEQ ID NO: 2935419 - protein, 21 aa, Entamoeba invadens
FAFMGCPLTSIVLSKNLHSLP

SEQ ID NO: 2935420 - protein, 18 aa, Entamoeba invadens
FAFNQEIQFDVGFVDFRS

SEQ ID NO: 2935421 - protein, 17 aa, Entamoeba invadens
FAFSECVSLEEISLPNS

SEQ ID NO: 2935422 - protein, 18 aa, Entamoeba invadens
FAFSRCSSLSKILIGKSV

SEQ ID NO: 2935423 - protein, 19 aa, Entamoeba invadens
FAFYACVKLKKVVLSESIT

SEQ ID NO: 2935424 - protein, 25 aa, Entamoeba invadens
FAGCIALPEIHIPTSLVELPDSCFL

SEQ ID NO: 2935425 - protein, 17 aa, Entamoeba invadens
FAGCPYFVAIGGDSGLF

SEQ ID NO: 2935426 - protein, 17 aa, Entamoeba invadens
FAGIPVYKIGCTENQFI

SEQ ID NO: 2935427 - protein, 18 aa, Entamoeba invadens
FAGLSVCGISEFFDYVKG

SEQ ID NO: 2935428 - protein, 24 aa, Entamoeba invadens
FAGSGTRAIAIIIFHRLITPALIS

SEQ ID NO: 2935429 - protein, 22 aa, Entamoeba invadens
FAIDEIEEWCLSNLIFFSTESV

SEQ ID NO: 2935430 - protein, 18 aa, Entamoeba invadens
FAIGDIHLNLGLQQKIQK

SEQ ID NO: 2935431 - protein, 26 aa, Entamoeba invadens
FAIGSRKGCCDIAMKYGATDIINYKN

SEQ ID NO: 2935432 - protein, 23 aa, Entamoeba invadens
FAIKTICKELSYKIDKDSHNRIT

SEQ ID NO: 2935433 - protein, 25 aa, Entamoeba invadens
FAIQRCDPAPFYLFDEIDSNLDNVY

SEQ ID NO: 2935434 - protein, 17 aa, Entamoeba invadens
FAIRKACDMVRSGELTS

SEQ ID NO: 2935435 - protein, 26 aa, Entamoeba invadens
FAISMYECFVWGNAYPKEKFNFPWKI

SEQ ID NO: 2935436 - protein, 17 aa, Entamoeba invadens
FAITMFECFGWCEAYPL

SEQ ID NO: 2935437 - protein, 25 aa, Entamoeba invadens
FAITMFECFGWQKAYSGMEFNFSWK

SEQ ID NO: 2935438 - protein, 39 aa, Entamoeba invadens
FAITMFECFSWKDAYPITTFKFPWKIAEFVSSRKRPENG

SEQ ID NO: 2935439 - protein, 17 aa, Entamoeba invadens
FAITMFETISWREAYIK

SEQ ID NO: 2935440 - protein, 39 aa, Entamoeba invadens
FAITMYECFTWSDAFPKDVYRYAWDIADSVCYGKRPDLM

SEQ ID NO: 2935441 - protein, 26 aa, Entamoeba invadens
FAITMYETFAWRAAYSKEKFKFEWSI

SEQ ID NO: 2935442 - protein, 19 aa, Entamoeba invadens
FAITNCIPTPPTIQTRNAT

SEQ ID NO: 2935443 - protein, 22 aa, Entamoeba invadens
FAKDEIQNFVPFIPKLLETIGT

SEQ ID NO: 2935444 - protein, 27 aa, Entamoeba invadens
FAKEDVKCGIFLREEDEVMSWIGNSDF

SEQ ID NO: 2935445 - protein, 31 aa, Entamoeba invadens
FAKEKRKNFQIYRLDGFGGNLLNIKIIKDPF

SEQ ID NO: 2935446 - protein, 19 aa, Entamoeba invadens
FAKELRIGEIVERHLEDGD

SEQ ID NO: 2935447 - protein, 18 aa, Entamoeba invadens
FAKEMLKDSDIGVVLESL

SEQ ID NO: 2935448 - protein, 25 aa, Entamoeba invadens
FAKHLFSMLCHIGFVSGDDLFGEHL

SEQ ID NO: 2935449 - protein, 18 aa, Entamoeba invadens
FAKMWSEKFGIDKQRMLE

SEQ ID NO: 2935450 - protein, 20 aa, Entamoeba invadens
FAKQLLEGMSKKTVKIMLKM

SEQ ID NO: 2935451 - protein, 20 aa, Entamoeba invadens
FAKRYEDMMTYKDDKSFKYV

SEQ ID NO: 2935452 - protein, 19 aa, Entamoeba invadens
FAKTEIEKFCKNHCEEYFV

SEQ ID NO: 2935453 - protein, 17 aa, Entamoeba invadens
FALAKCYTKSMSTFLSK

SEQ ID NO: 2935454 - protein, 21 aa, Entamoeba invadens
FALEIVDGILMRKPDASSLNF

SEQ ID NO: 2935455 - protein, 18 aa, Entamoeba invadens
FALFFAAFCDFQANARHY

SEQ ID NO: 2935456 - protein, 41 aa, Entamoeba invadens
FALHHYRPTPIYVMDEIDAALDFRNVSIIAHYIKERTKNAQ

SEQ ID NO: 2935457 - protein, 21 aa, Entamoeba invadens
FALIIQRGFNSLVIKSTDKEY

SEQ ID NO: 2935458 - protein, 17 aa, Entamoeba invadens
FALIRVILDKFIFNLVN

SEQ ID NO: 2935459 - protein, 17 aa, Entamoeba invadens
FALLKLSVYKTHTLENI

SEQ ID NO: 2935460 - protein, 24 aa, Entamoeba invadens
FALNLKVLVIYSTLTLNGGVVTIN

SEQ ID NO: 2935461 - protein, 21 aa, Entamoeba invadens
FALRNFMKLILPNNIHEIHEN

SEQ ID NO: 2935462 - protein, 17 aa, Entamoeba invadens
FALVEYKDHNPGDEFAF

SEQ ID NO: 2935463 - protein, 23 aa, Entamoeba invadens
FAMEPCTIALQLVDKANMLVKKC

SEQ ID NO: 2935464 - protein, 21 aa, Entamoeba invadens
FAMFDQCPKLSYIKYSDSLKS

SEQ ID NO: 2935465 - protein, 19 aa, Entamoeba invadens
FANCYKLSKMDIPYKLVEI

SEQ ID NO: 2935466 - protein, 24 aa, Entamoeba invadens
FANHLDWYTTLFANQTFSLDNTIS

SEQ ID NO: 2935467 - protein, 21 aa, Entamoeba invadens
FANKYLGGGVLRGGNVQEEIM

SEQ ID NO: 2935468 - protein, 25 aa, Entamoeba invadens
FANLTAVRGKTGWIIIDCMTTNHAS

SEQ ID NO: 2935469 - protein, 21 aa, Entamoeba invadens
FANNKFRGVSYIYGIEAMKDF

SEQ ID NO: 2935470 - protein, 24 aa, Entamoeba invadens
FANRKDLRDAVGFNAYGEIESLRL

SEQ ID NO: 2935471 - protein, 21 aa, Entamoeba invadens
FANTFIPYILKQVQITTDFQN

SEQ ID NO: 2935472 - protein, 23 aa, Entamoeba invadens
FAPKILCVELTHLDVPLQLEENV

SEQ ID NO: 2935473 - protein, 18 aa, Entamoeba invadens
FAPLKALCNELVFQNTEL

SEQ ID NO: 2935474 - protein, 19 aa, Entamoeba invadens
FAPLPRFSVGVAQTRGLRQ

SEQ ID NO: 2935475 - protein, 17 aa, Entamoeba invadens
FAPNKGQLPQIVCANKC

SEQ ID NO: 2935476 - protein, 27 aa, Entamoeba invadens
FAPTQRICRYELLLSTILKDVQKESKL

SEQ ID NO: 2935477 - protein, 26 aa, Entamoeba invadens
FAPYKMFISFVYPKRVHDIRGGAAQN

SEQ ID NO: 2935478 - protein, 19 aa, Entamoeba invadens
FAPYPGLGDGYLFLRNKTR

SEQ ID NO: 2935479 - protein, 27 aa, Entamoeba invadens
FAQEKRKKFCIYRVQCFGSNKLYVNVI

SEQ ID NO: 2935480 - protein, 24 aa, Entamoeba invadens
FAQNKFYVCYRLEPLTQASEKSDD

SEQ ID NO: 2935481 - protein, 21 aa, Entamoeba invadens
FAQPFKKYYPFVAGYIALYSN

SEQ ID NO: 2935482 - protein, 23 aa, Entamoeba invadens
FARALRQLPMIIADNAGYDSADL

SEQ ID NO: 2935483 - protein, 19 aa, Entamoeba invadens
FARDFSVIGQRCFAGCFML

SEQ ID NO: 2935484 - protein, 24 aa, Entamoeba invadens
FARELSLFPKLRVFDIYGNAPQMQ

SEQ ID NO: 2935485 - protein, 22 aa, Entamoeba invadens
FARGTCWAHAVIGFVESDYRAN

SEQ ID NO: 2935486 - protein, 19 aa, Entamoeba invadens
FARHCIGKGAMNRTELSDY

SEQ ID NO: 2935487 - protein, 17 aa, Entamoeba invadens
FARIKTKWVPEVVDNCG

SEQ ID NO: 2935488 - protein, 18 aa, Entamoeba invadens
FARKCVNCVAGSYPQTAG

SEQ ID NO: 2935489 - protein, 20 aa, Entamoeba invadens
FARKEIKTNPILSNLEIYTT

SEQ ID NO: 2935490 - protein, 26 aa, Entamoeba invadens
FARKKCLRLKFCLNAANNLLYLHENG

SEQ ID NO: 2935491 - protein, 35 aa, Entamoeba invadens
FARTKFVKEFENFDAMFVFCCCFCNVDIQINPLIV

SEQ ID NO: 2935492 - protein, 28 aa, Entamoeba invadens
FARVSSEIILPCLMKIMANPLTRLVDVT

SEQ ID NO: 2935493 - protein, 18 aa, Entamoeba invadens
FASICYITASIIKTNKDT

SEQ ID NO: 2935494 - protein, 17 aa, Entamoeba invadens
FASRKLRDYQTCQQGIF

SEQ ID NO: 2935495 - protein, 24 aa, Entamoeba invadens
FASRLCKKHTALLLDCKTQETTNK

SEQ ID NO: 2935496 - protein, 27 aa, Entamoeba invadens
FATFYNLFEPLKWSKALYHQCITSNNL

SEQ ID NO: 2935497 - protein, 29 aa, Entamoeba invadens
FATLSSNYFRSALGGVIVFDVSNRQSFEN

SEQ ID NO: 2935498 - protein, 18 aa, Entamoeba invadens
FATSEGDLIDGDKFTPKR

SEQ ID NO: 2935499 - protein, 28 aa, Entamoeba invadens
FATTSNHCKFMWLYMLRNAFYKNCKMHM

SEQ ID NO: 2935500 - protein, 18 aa, Entamoeba invadens
FATTVVELVDKCIKEGLV

SEQ ID NO: 2935501 - protein, 17 aa, Entamoeba invadens
FATVLSLQQLINFNDPL

SEQ ID NO: 2935502 - protein, 18 aa, Entamoeba invadens
FATVVFVPLRMMRKIRPI

SEQ ID NO: 2935503 - protein, 24 aa, Entamoeba invadens
FAVGVLKLLKLLFVKVKTTPEEME

SEQ ID NO: 2935504 - protein, 17 aa, Entamoeba invadens
FAVKLPLDYRLSKLVFF

SEQ ID NO: 2935505 - protein, 18 aa, Entamoeba invadens
FAVTAGFKITCEDCFVIA

SEQ ID NO: 2935506 - protein, 33 aa, Entamoeba invadens
FAVTMFEVFGWKEAYPINTFKFPWKIAEFVIAG

SEQ ID NO: 2935507 - protein, 22 aa, Entamoeba invadens
FAVTMYECFAWSRSYASNEFLY

SEQ ID NO: 2935508 - protein, 31 aa, Entamoeba invadens
FAVTMYQTFKWKEPYPINVFEHSWDIANFIV

SEQ ID NO: 2935509 - protein, 24 aa, Entamoeba invadens
FAWCKSADSPNLFAGFSPENAKKS

SEQ ID NO: 2935510 - protein, 18 aa, Entamoeba invadens
FAYESCYENLFSEAKLTK

SEQ ID NO: 2935511 - protein, 30 aa, Entamoeba invadens
FAYKELKDEIYIGGVFIRILNKNPSSPLNN

SEQ ID NO: 2935512 - protein, 34 aa, Entamoeba invadens
FAYLRYEMDQTKKFLSVCWCGQGSQDKLKTKFVY

SEQ ID NO: 2935513 - protein, 17 aa, Entamoeba invadens
FAYMSFIQLGQVVRSGD

SEQ ID NO: 2935514 - protein, 20 aa, Entamoeba invadens
FAYTCDMHVLVILTDMSSYA

SEQ ID NO: 2935515 - protein, 20 aa, Entamoeba invadens
FCACRRLSSVDIPSSITSIP

SEQ ID NO: 2935516 - protein, 19 aa, Entamoeba invadens
FCALNNILINPSFTKNTIS

SEQ ID NO: 2935517 - protein, 17 aa, Entamoeba invadens
FCAPEIIFRQPYSAKSD

SEQ ID NO: 2935518 - protein, 17 aa, Entamoeba invadens
FCAPEKVAAFIHEIFFQ

SEQ ID NO: 2935519 - protein, 25 aa, Entamoeba invadens
FCAVGTSLGCTRCINGFYYSYNTKT

SEQ ID NO: 2935520 - protein, 18 aa, Entamoeba invadens
FCAVTRWTFNGQTLCGEI

SEQ ID NO: 2935521 - protein, 22 aa, Entamoeba invadens
FCAYRIPTTMVFVRSRKGLSHC

SEQ ID NO: 2935522 - protein, 21 aa, Entamoeba invadens
FCCCFSHSRDIKKKKIVNNKK

SEQ ID NO: 2935523 - protein, 17 aa, Entamoeba invadens
FCCTRRYLPESKTLRGM

SEQ ID NO: 2935524 - protein, 24 aa, Entamoeba invadens
FCCVECKREKIGKEHHQIVKKKNI

SEQ ID NO: 2935525 - protein, 20 aa, Entamoeba invadens
FCCYFDCFFDHHSILTTQPG

SEQ ID NO: 2935526 - protein, 17 aa, Entamoeba invadens
FCDCKNLVLVKNLKKSM

SEQ ID NO: 2935527 - protein, 26 aa, Entamoeba invadens
FCDDCVKAYSILRNKASLIVSFFTNM

SEQ ID NO: 2935528 - protein, 26 aa, Entamoeba invadens
FCDGYLVKFCHLKSIEVRSCVTEIKR

SEQ ID NO: 2935529 - protein, 19 aa, Entamoeba invadens
FCDHLCIVFELLDKNLYQY

SEQ ID NO: 2935530 - protein, 19 aa, Entamoeba invadens
FCECRSLSSITIPLSVTLI

SEQ ID NO: 2935531 - protein, 18 aa, Entamoeba invadens
FCEFNLDLRFLPDDLELP

SEQ ID NO: 2935532 - protein, 20 aa, Entamoeba invadens
FCEKAGISFGPFIQTLQKKR

SEQ ID NO: 2935533 - protein, 19 aa, Entamoeba invadens
FCELVKITGCSTVEDVWCI

SEQ ID NO: 2935534 - protein, 17 aa, Entamoeba invadens
FCERHAFDVDDLLKKLQ

SEQ ID NO: 2935535 - protein, 20 aa, Entamoeba invadens
FCFCGCDSLSAITLGTNIIK

SEQ ID NO: 2935536 - protein, 21 aa, Entamoeba invadens
FCFCGCDSLSAITLGTNITKS

SEQ ID NO: 2935537 - protein, 18 aa, Entamoeba invadens
FCFDGCTNLLSITFKSKI

SEQ ID NO: 2935538 - protein, 18 aa, Entamoeba invadens
FCFEKCKSLKTIELPESL

SEQ ID NO: 2935539 - protein, 21 aa, Entamoeba invadens
FCFFNCRKLRSCTVKDTVTFG

SEQ ID NO: 2935540 - protein, 18 aa, Entamoeba invadens
FCFFTCVALSEFNFPLNL

SEQ ID NO: 2935541 - protein, 26 aa, Entamoeba invadens
FCFLLSTRAGGLGINLTSADTVIIYD

SEQ ID NO: 2935542 - protein, 23 aa, Entamoeba invadens
FCFNECKNIISVLIPTGLTSIGI

SEQ ID NO: 2935543 - protein, 19 aa, Entamoeba invadens
FCFQNCRSLTAIGLPNTLK

SEQ ID NO: 2935544 - protein, 19 aa, Entamoeba invadens
FCFSACSLFAKHFQEKKAA

SEQ ID NO: 2935545 - protein, 22 aa, Entamoeba invadens
FCFSDDYLNAVLVCKKFACILD

SEQ ID NO: 2935546 - protein, 22 aa, Entamoeba invadens
FCFSGCKALHSVLLPKKMREVG

SEQ ID NO: 2935547 - protein, 17 aa, Entamoeba invadens
FCFSKLYELRDVPTLQT

SEQ ID NO: 2935548 - protein, 20 aa, Entamoeba invadens
FCGCEKLQIFLFPTQLHKIE

SEQ ID NO: 2935549 - protein, 17 aa, Entamoeba invadens
FCGCINLADVVLPSRLN

SEQ ID NO: 2935550 - protein, 18 aa, Entamoeba invadens
FCGCKGLKSVTIPATVTS

SEQ ID NO: 2935551 - protein, 18 aa, Entamoeba invadens
FCGCKKLETIALSSRTCY

SEQ ID NO: 2935552 - protein, 19 aa, Entamoeba invadens
FCGCSSLSYIQLPSAITKI

SEQ ID NO: 2935553 - protein, 24 aa, Entamoeba invadens
FCGDILLEEALGFIEEGKMKEVFT

SEQ ID NO: 2935554 - protein, 17 aa, Entamoeba invadens
FCGKCICDDCSKYRMPL

SEQ ID NO: 2935555 - protein, 26 aa, Entamoeba invadens
FCGKRLKLEPSRPGGIRQRLLSSAVR

SEQ ID NO: 2935556 - protein, 17 aa, Entamoeba invadens
FCGLSVYGGTLVVGEII

SEQ ID NO: 2935557 - protein, 19 aa, Entamoeba invadens
FCGMKRTIGDQVYSYDREL

SEQ ID NO: 2935558 - protein, 25 aa, Entamoeba invadens
FCGTPEYLAPEILLGNGYGFAVDWW

SEQ ID NO: 2935559 - protein, 22 aa, Entamoeba invadens
FCGTPEYLAPEVVEGLDYDENV

SEQ ID NO: 2935560 - protein, 23 aa, Entamoeba invadens
FCGTPEYLAPEVVIGKEYAETVD

SEQ ID NO: 2935561 - protein, 19 aa, Entamoeba invadens
FCHKEQKPSENFAFQFRLY

SEQ ID NO: 2935562 - protein, 19 aa, Entamoeba invadens
FCIDCSGTMEGDRLNMMRY

SEQ ID NO: 2935563 - protein, 17 aa, Entamoeba invadens
FCIGYGCEKGVVIDDLR

SEQ ID NO: 2935564 - protein, 19 aa, Entamoeba invadens
FCIRNCTIAPVLDKGPNVM

SEQ ID NO: 2935565 - protein, 17 aa, Entamoeba invadens
FCKCSNLSHIIIPPSVT

SEQ ID NO: 2935566 - protein, 17 aa, Entamoeba invadens
FCKKSGGVISVGELFQK

SEQ ID NO: 2935567 - protein, 19 aa, Entamoeba invadens
FCKLYGVANTNKFVLESPH

SEQ ID NO: 2935568 - protein, 26 aa, Entamoeba invadens
FCKQKQRSLCVFGEKDICIGKRKRGS

SEQ ID NO: 2935569 - protein, 22 aa, Entamoeba invadens
FCLAKRIGMNFGAMVKGKRWED

SEQ ID NO: 2935570 - protein, 18 aa, Entamoeba invadens
FCLFSCRLTYEGVPNVNR

SEQ ID NO: 2935571 - protein, 19 aa, Entamoeba invadens
FCLLMSVSQSFQDRPRSLM

SEQ ID NO: 2935572 - protein, 20 aa, Entamoeba invadens
FCLQHHCWILKSGEKDHSSY

SEQ ID NO: 2935573 - protein, 20 aa, Entamoeba invadens
FCLTCSKIYCESHTEIHYEQ

SEQ ID NO: 2935574 - protein, 19 aa, Entamoeba invadens
FCMSAPKLLYLNLSNNPIQ

SEQ ID NO: 2935575 - protein, 21 aa, Entamoeba invadens
FCNFKSFIDFASQSVLREFTI

SEQ ID NO: 2935576 - protein, 25 aa, Entamoeba invadens
FCNGIKAQCKLGLTATLVREDKNIN

SEQ ID NO: 2935577 - protein, 20 aa, Entamoeba invadens
FCNKQGLNMSSVRFLSDGVR

SEQ ID NO: 2935578 - protein, 24 aa, Entamoeba invadens
FCNSELCLVIGDGKQFDWCIDNSI

SEQ ID NO: 2935579 - protein, 17 aa, Entamoeba invadens
FCNVDIQINPLIAEDAA

SEQ ID NO: 2935580 - protein, 24 aa, Entamoeba invadens
FCPGFPPCFVPFEIYQTDRVVVCQ

SEQ ID NO: 2935581 - protein, 18 aa, Entamoeba invadens
FCPGGDLRCLLSHVGALD

SEQ ID NO: 2935582 - protein, 18 aa, Entamoeba invadens
FCPKCKDLYIPMDPHESK

SEQ ID NO: 2935583 - protein, 17 aa, Entamoeba invadens
FCPSVFYNKVEELGSAV

SEQ ID NO: 2935584 - protein, 21 aa, Entamoeba invadens
FCPVDTCGRAIHYFDTSRHEV

SEQ ID NO: 2935585 - protein, 22 aa, Entamoeba invadens
FCQCKNWKTALEKVMPQRKQET

SEQ ID NO: 2935586 - protein, 18 aa, Entamoeba invadens
FCQCNALKTLSIPSTVTF

SEQ ID NO: 2935587 - protein, 17 aa, Entamoeba invadens
FCQCSSMSSLEFPSKVE

SEQ ID NO: 2935588 - protein, 19 aa, Entamoeba invadens
FCQEICTGNTLKLVLRDLL

SEQ ID NO: 2935589 - protein, 17 aa, Entamoeba invadens
FCQTSCATNGDGLYEGL

SEQ ID NO: 2935590 - protein, 17 aa, Entamoeba invadens
FCRCAFADIPIKYLPRH

SEQ ID NO: 2935591 - protein, 18 aa, Entamoeba invadens
FCRCNSLSAITLGTNIIK

SEQ ID NO: 2935592 - protein, 17 aa, Entamoeba invadens
FCREFGIPTEFRLQIWN

SEQ ID NO: 2935593 - protein, 24 aa, Entamoeba invadens
FCSDFYLSSIPSFLQMDSSCDSES

SEQ ID NO: 2935594 - protein, 22 aa, Entamoeba invadens
FCSGYACDRCNVAGKKVFNYTS

SEQ ID NO: 2935595 - protein, 20 aa, Entamoeba invadens
FCSLPKGLQPSSCKKEEIVI

SEQ ID NO: 2935596 - protein, 19 aa, Entamoeba invadens
FCSNKEFFDPQLVAQVSLS

SEQ ID NO: 2935597 - protein, 20 aa, Entamoeba invadens
FCSPARKYVAIGVSEIYVFP

SEQ ID NO: 2935598 - protein, 25 aa, Entamoeba invadens
FCSQRCVKLASALTRLINSSAVKNE

SEQ ID NO: 2935599 - protein, 23 aa, Entamoeba invadens
FCSVCKCSVTSKNGLICTKCGTI

SEQ ID NO: 2935600 - protein, 27 aa, Entamoeba invadens
FCSVIKRGPFLARLRVFLSKQEKEAFL

SEQ ID NO: 2935601 - protein, 19 aa, Entamoeba invadens
FCSVPRNLTTITQLKSLNL

SEQ ID NO: 2935602 - protein, 25 aa, Entamoeba invadens
FCTERCVSHPLTITKMFAKVLSATY

SEQ ID NO: 2935603 - protein, 18 aa, Entamoeba invadens
FCTQICGKYLEKVVLFTR

SEQ ID NO: 2935604 - protein, 19 aa, Entamoeba invadens
FCTVGSEKVLSVWDDRMLK

SEQ ID NO: 2935605 - protein, 24 aa, Entamoeba invadens
FCVDTPGNVFGFFFESIGEISYDE

SEQ ID NO: 2935606 - protein, 22 aa, Entamoeba invadens
FCVFEKGKIALLLLYVISKNKD

SEQ ID NO: 2935607 - protein, 25 aa, Entamoeba invadens
FCVFEKNDAISLLFLCKPGSPNMML

SEQ ID NO: 2935608 - protein, 29 aa, Entamoeba invadens
FCVIKEFLRRLPLPVFHPLLEFLNPDNMK

SEQ ID NO: 2935609 - protein, 26 aa, Entamoeba invadens
FCVPLFGYHCFCWCSSLSSITIPTSV

SEQ ID NO: 2935610 - protein, 23 aa, Entamoeba invadens
FCVQRYKDILNFVPKAYYIVKVN

SEQ ID NO: 2935611 - protein, 21 aa, Entamoeba invadens
FCVQYLKLALNDSVRQRALNV

SEQ ID NO: 2935612 - protein, 17 aa, Entamoeba invadens
FCVVLAKVGDLEENEIM

SEQ ID NO: 2935613 - protein, 19 aa, Entamoeba invadens
FCYSACSIFTKNFVEKKSA

SEQ ID NO: 2935614 - protein, 19 aa, Entamoeba invadens
FCYYNCRNLESFTFAEQQN

SEQ ID NO: 2935615 - protein, 18 aa, Entamoeba invadens
FDAAKDWMKLFANDKVRV

SEQ ID NO: 2935616 - protein, 25 aa, Entamoeba invadens
FDAALRYLATLGFDKLNIPKQDYDV

SEQ ID NO: 2935617 - protein, 24 aa, Entamoeba invadens
FDAGEFKYLFDVMRVDNSMRKVVI

SEQ ID NO: 2935618 - protein, 18 aa, Entamoeba invadens
FDAKRPNLSAAMSSAMCR

SEQ ID NO: 2935619 - protein, 18 aa, Entamoeba invadens
FDALKAFWKYSRQVMDGE

SEQ ID NO: 2935620 - protein, 21 aa, Entamoeba invadens
FDASPELRLEAIKVINVIMDK

SEQ ID NO: 2935621 - protein, 18 aa, Entamoeba invadens
FDCDGDGYLTLNEFTMLV

SEQ ID NO: 2935622 - protein, 24 aa, Entamoeba invadens
FDCKFDCWQFNEFEIPNGVKEVEE

SEQ ID NO: 2935623 - protein, 24 aa, Entamoeba invadens
FDCLPLAIVLDSDIGRFFLCHGGL

SEQ ID NO: 2935624 - protein, 18 aa, Entamoeba invadens
FDCNIAFSNLKRVIQKTQ

SEQ ID NO: 2935625 - protein, 20 aa, Entamoeba invadens
FDCSQGWFGNYRTLYRHQDE

SEQ ID NO: 2935626 - protein, 21 aa, Entamoeba invadens
FDCVLPFCKLLNIPFAALVQL

SEQ ID NO: 2935627 - protein, 24 aa, Entamoeba invadens
FDDALVSLCCTKIPSLKVLNLEHS

SEQ ID NO: 2935628 - protein, 18 aa, Entamoeba invadens
FDDAWLFAKVYNIGEEAK

SEQ ID NO: 2935629 - protein, 23 aa, Entamoeba invadens
FDDFCVPNLIGVQILSMSKRIMN

SEQ ID NO: 2935630 - protein, 20 aa, Entamoeba invadens
FDDFCVSNLIGVQILSMSKR

SEQ ID NO: 2935631 - protein, 18 aa, Entamoeba invadens
FDDFRDFINLELVCKKFR

SEQ ID NO: 2935632 - protein, 19 aa, Entamoeba invadens
FDDIFLASVGVDFKFKEVT

SEQ ID NO: 2935633 - protein, 23 aa, Entamoeba invadens
FDDKEVFETYAMEGWGNDSSETN

SEQ ID NO: 2935634 - protein, 24 aa, Entamoeba invadens
FDDKLRIVADYAGREGIVQAKFSV

SEQ ID NO: 2935635 - protein, 25 aa, Entamoeba invadens
FDDNCLFNLISIRPPLEILSVSNCP

SEQ ID NO: 2935636 - protein, 25 aa, Entamoeba invadens
FDDRGCGTVCVVPKRAEKFVFSEQK

SEQ ID NO: 2935637 - protein, 19 aa, Entamoeba invadens
FDDVLSFNTALFMEMKKLK

SEQ ID NO: 2935638 - protein, 17 aa, Entamoeba invadens
FDECCFLDTLDIGKNKE

SEQ ID NO: 2935639 - protein, 23 aa, Entamoeba invadens
FDEESSFKNVINWYKESQRFCNL

SEQ ID NO: 2935640 - protein, 23 aa, Entamoeba invadens
FDEIFKVALARQVRMVKKQQDKI

SEQ ID NO: 2935641 - protein, 17 aa, Entamoeba invadens
FDEKKFFDEQGLNKEIN

SEQ ID NO: 2935642 - protein, 22 aa, Entamoeba invadens
FDELCKLMKYKNGYYSVNRESE

SEQ ID NO: 2935643 - protein, 20 aa, Entamoeba invadens
FDELILPKVHFENIQHTNSV

SEQ ID NO: 2935644 - protein, 18 aa, Entamoeba invadens
FDEMKRAGLFENEPSVTS

SEQ ID NO: 2935645 - protein, 18 aa, Entamoeba invadens
FDENEWYLTQEIKPLIKI

SEQ ID NO: 2935646 - protein, 24 aa, Entamoeba invadens
FDEPRLMCMYVDKVLNGAHAVQTL

SEQ ID NO: 2935647 - protein, 17 aa, Entamoeba invadens
FDEPRPVVIDKPFYFSI

SEQ ID NO: 2935648 - protein, 33 aa, Entamoeba invadens
FDERILKRKDEVFRKACVLKRIEESARPQLEET

SEQ ID NO: 2935649 - protein, 18 aa, Entamoeba invadens
FDEWKNVRKYLLFVFSCL

SEQ ID NO: 2935650 - protein, 20 aa, Entamoeba invadens
FDFASIWSAFEKIESVEGEV

SEQ ID NO: 2935651 - protein, 20 aa, Entamoeba invadens
FDFCNCFESLKTISISCGSH

SEQ ID NO: 2935652 - protein, 25 aa, Entamoeba invadens
FDFEKCQFLQCKEGFQLDEQNKCVK

SEQ ID NO: 2935653 - protein, 18 aa, Entamoeba invadens
FDFEKKFIITPTILEGNY

SEQ ID NO: 2935654 - protein, 23 aa, Entamoeba invadens
FDFFIRVGYKCLIYGDYNASFLV

SEQ ID NO: 2935655 - protein, 22 aa, Entamoeba invadens
FDFKAFMELYLPYSYTGSQTEF

SEQ ID NO: 2935656 - protein, 23 aa, Entamoeba invadens
FDFKSEMEKAFAQDGSSFTCVSD

SEQ ID NO: 2935657 - protein, 20 aa, Entamoeba invadens
FDFKTDFNNFNFKQLLLNAN

SEQ ID NO: 2935658 - protein, 23 aa, Entamoeba invadens
FDFLCLLWEAVGYPTFVYGKQNH

SEQ ID NO: 2935659 - protein, 21 aa, Entamoeba invadens
FDFLDEIQLLYSPISDLCTPS

SEQ ID NO: 2935660 - protein, 19 aa, Entamoeba invadens
FDFLPLESLLCVSASCKTL

SEQ ID NO: 2935661 - protein, 19 aa, Entamoeba invadens
FDFYLLRKMTISDFLHTTM

SEQ ID NO: 2935662 - protein, 20 aa, Entamoeba invadens
FDGAGSFELFSKIQPRITSL

SEQ ID NO: 2935663 - protein, 17 aa, Entamoeba invadens
FDGATVLRGTEINKKVV

SEQ ID NO: 2935664 - protein, 17 aa, Entamoeba invadens
FDGAYVLIRNGGLSGKL

SEQ ID NO: 2935665 - protein, 22 aa, Entamoeba invadens
FDGCIRPESVLELATEQHITLP

SEQ ID NO: 2935666 - protein, 24 aa, Entamoeba invadens
FDGFGLPKCDGVGCGDLYVTTKIE

SEQ ID NO: 2935667 - protein, 17 aa, Entamoeba invadens
FDGILLLEMLYRHGKMW

SEQ ID NO: 2935668 - protein, 18 aa, Entamoeba invadens
FDGKFDWTGFKGQKSEDR

SEQ ID NO: 2935669 - protein, 23 aa, Entamoeba invadens
FDGKQCKTSFEFSIGKDKELNEE

SEQ ID NO: 2935670 - protein, 26 aa, Entamoeba invadens
FDGLLYPVCTKSIFEGILITLKYFYT

SEQ ID NO: 2935671 - protein, 20 aa, Entamoeba invadens
FDGLSRLLTFVFDGGDVLVD

SEQ ID NO: 2935672 - protein, 26 aa, Entamoeba invadens
FDGSKFVFKHNWHLVELDRKTGKLID

SEQ ID NO: 2935673 - protein, 18 aa, Entamoeba invadens
FDGSYVLIRNGGLSGKLL

SEQ ID NO: 2935674 - protein, 17 aa, Entamoeba invadens
FDGTIRVWKCSEETEWE

SEQ ID NO: 2935675 - protein, 18 aa, Entamoeba invadens
FDGVKVYYYNSAEDAKFI

SEQ ID NO: 2935676 - protein, 17 aa, Entamoeba invadens
FDHGKSIYRNSMPHDMF

SEQ ID NO: 2935677 - protein, 20 aa, Entamoeba invadens
FDHLETLILWLFIPNNNNYL

SEQ ID NO: 2935678 - protein, 18 aa, Entamoeba invadens
FDHPNLLSLFDYIESSES

SEQ ID NO: 2935679 - protein, 27 aa, Entamoeba invadens
FDHRVEAISLFSILRVRVSSVEKGKIT

SEQ ID NO: 2935680 - protein, 18 aa, Entamoeba invadens
FDICCPFKELDLSDIKKF

SEQ ID NO: 2935681 - protein, 19 aa, Entamoeba invadens
FDIDYLVKHVHYIIPALEE

SEQ ID NO: 2935682 - protein, 17 aa, Entamoeba invadens
FDIFDYRMKACGEHDGY

SEQ ID NO: 2935683 - protein, 19 aa, Entamoeba invadens
FDIFNMMFGGGSGRKGKSS

SEQ ID NO: 2935684 - protein, 26 aa, Entamoeba invadens
FDIGVCKYGLQANHCVQSSFDYRGFK

SEQ ID NO: 2935685 - protein, 20 aa, Entamoeba invadens
FDIGWLLREVPILKTVQVQF

SEQ ID NO: 2935686 - protein, 23 aa, Entamoeba invadens
FDIKAGYEKYDFKMNNNTLSFGN

SEQ ID NO: 2935687 - protein, 22 aa, Entamoeba invadens
FDIKLEKCIALSLQDGLRKMKS

SEQ ID NO: 2935688 - protein, 20 aa, Entamoeba invadens
FDIKTFVWKQHPVVLEDFQD

SEQ ID NO: 2935689 - protein, 19 aa, Entamoeba invadens
FDILNLFITKDLPKVTLED

SEQ ID NO: 2935690 - protein, 28 aa, Entamoeba invadens
FDIMESRWNPDICGFVGSVAEEFNVHIW

SEQ ID NO: 2935691 - protein, 23 aa, Entamoeba invadens
FDINKEVLFPIAQIYGQHTRWCI

SEQ ID NO: 2935692 - protein, 18 aa, Entamoeba invadens
FDIPITLSTVVNRINGAP

SEQ ID NO: 2935693 - protein, 22 aa, Entamoeba invadens
FDIPQCVGMVGGKPNLAFFFHT

SEQ ID NO: 2935694 - protein, 22 aa, Entamoeba invadens
FDIQCDGFKSAASVSMSKDSIE

SEQ ID NO: 2935695 - protein, 17 aa, Entamoeba invadens
FDISFSGISKFTAEVDV

SEQ ID NO: 2935696 - protein, 19 aa, Entamoeba invadens
FDITFSVKSARLKSVTANM

SEQ ID NO: 2935697 - protein, 31 aa, Entamoeba invadens
FDITREIAQSWLANRVDGFFIVRLSSKSPEA

SEQ ID NO: 2935698 - protein, 23 aa, Entamoeba invadens
FDIWLRRNLTSIPYVHVDGLVSQ

SEQ ID NO: 2935699 - protein, 19 aa, Entamoeba invadens
FDIYDAYTIHREQIDIMKN

SEQ ID NO: 2935700 - protein, 27 aa, Entamoeba invadens
FDKARQAAPCVLFFDELDSIGKARGGG

SEQ ID NO: 2935701 - protein, 19 aa, Entamoeba invadens
FDKCFEGCSTLSKVTLPKH

SEQ ID NO: 2935702 - protein, 25 aa, Entamoeba invadens
FDKCKTMKFPIVSSVLRVIEQTKAL

SEQ ID NO: 2935703 - protein, 17 aa, Entamoeba invadens
FDKDYFLRLIVTDQVEK

SEQ ID NO: 2935704 - protein, 20 aa, Entamoeba invadens
FDKEVRRFPNLHFPTKVVIT

SEQ ID NO: 2935705 - protein, 21 aa, Entamoeba invadens
FDKFVVSYCCHLRLLNCGYHF

SEQ ID NO: 2935706 - protein, 23 aa, Entamoeba invadens
FDKFVVSYCCHLRLLNYRYHFNN

SEQ ID NO: 2935707 - protein, 24 aa, Entamoeba invadens
FDKFVVSYCCHLRLLNYRYHFNTI

SEQ ID NO: 2935708 - protein, 30 aa, Entamoeba invadens
FDKGIPAFWFCVLRNSMLFDSAMGSEADIE

SEQ ID NO: 2935709 - protein, 17 aa, Entamoeba invadens
FDKIKSFGNKYFEQVER

SEQ ID NO: 2935710 - protein, 25 aa, Entamoeba invadens
FDKKIKNIQVILSFLPILYYNTLKL

SEQ ID NO: 2935711 - protein, 25 aa, Entamoeba invadens
FDKKQRVADDINFYSDRGRDYYVRE

SEQ ID NO: 2935712 - protein, 25 aa, Entamoeba invadens
FDKKVALEFYDKVAITIDEVIDDGI

SEQ ID NO: 2935713 - protein, 24 aa, Entamoeba invadens
FDKLQNLNCVFDYLKDEKLNLTSS

SEQ ID NO: 2935714 - protein, 26 aa, Entamoeba invadens
FDKNNVKAFYRIGVVLNKKKSYPLAL

SEQ ID NO: 2935715 - protein, 17 aa, Entamoeba invadens
FDKPFAFESTPTPSDTQ

SEQ ID NO: 2935716 - protein, 17 aa, Entamoeba invadens
FDKQFNIKTREHFTRKI

SEQ ID NO: 2935717 - protein, 24 aa, Entamoeba invadens
FDKRADILTVLFSPFKLLSLFAAQ

SEQ ID NO: 2935718 - protein, 18 aa, Entamoeba invadens
FDKSCVKYIAHEVGNLVQ

SEQ ID NO: 2935719 - protein, 17 aa, Entamoeba invadens
FDKSVDFWDLRKLDMTA

SEQ ID NO: 2935720 - protein, 18 aa, Entamoeba invadens
FDKTRVIVTLNQMVEFNK

SEQ ID NO: 2935721 - protein, 20 aa, Entamoeba invadens
FDKYVVNYACHLRLLNFGYH

SEQ ID NO: 2935722 - protein, 21 aa, Entamoeba invadens
FDLAKIPSFLPQKCLTSDVSC

SEQ ID NO: 2935723 - protein, 19 aa, Entamoeba invadens
FDLCGKKVKLRELFEKATI

SEQ ID NO: 2935724 - protein, 18 aa, Entamoeba invadens
FDLFPRKGKRSGGYHEII

SEQ ID NO: 2935725 - protein, 18 aa, Entamoeba invadens
FDLIGGKNKEAFVLCSKE

SEQ ID NO: 2935726 - protein, 19 aa, Entamoeba invadens
FDLIKHLFETRSFIDTEEF

SEQ ID NO: 2935727 - protein, 27 aa, Entamoeba invadens
FDLIQTLWKMTCEIMKEKYPEMFECFK

SEQ ID NO: 2935728 - protein, 21 aa, Entamoeba invadens
FDLKKGCELLNLHFALERQKY

SEQ ID NO: 2935729 - protein, 21 aa, Entamoeba invadens
FDLKLLREHFMKGGLVSENTL

SEQ ID NO: 2935730 - protein, 18 aa, Entamoeba invadens
FDLKNGKNQEVFGVYNEK

SEQ ID NO: 2935731 - protein, 20 aa, Entamoeba invadens
FDLKQSLADGIIFAQLLNYL

SEQ ID NO: 2935732 - protein, 21 aa, Entamoeba invadens
FDLKRCFPTEQWLDNVDLNNI

SEQ ID NO: 2935733 - protein, 24 aa, Entamoeba invadens
FDLKTIPVGLQFNERVDAWDDDTN

SEQ ID NO: 2935734 - protein, 25 aa, Entamoeba invadens
FDLKTKKGEKFPCQVSVQSLGGLEV

SEQ ID NO: 2935735 - protein, 30 aa, Entamoeba invadens
FDLLKTKGIDYVWMMGVWQLGNYGLEIDKK

SEQ ID NO: 2935736 - protein, 23 aa, Entamoeba invadens
FDLPELKLLFLNNNKLAFVDSML

SEQ ID NO: 2935737 - protein, 20 aa, Entamoeba invadens
FDLPHLDHILHFIYTSPQQN

SEQ ID NO: 2935738 - protein, 20 aa, Entamoeba invadens
FDLPYPYCIIDVSHNKVVKS

SEQ ID NO: 2935739 - protein, 19 aa, Entamoeba invadens
FDLRFIDFAHTWCLDKEEC

SEQ ID NO: 2935740 - protein, 26 aa, Entamoeba invadens
FDLVILRITVMLSFYTSVFDINSLHS

SEQ ID NO: 2935741 - protein, 17 aa, Entamoeba invadens
FDLVLSLAEFCEDGQYI

SEQ ID NO: 2935742 - protein, 17 aa, Entamoeba invadens
FDLYGVIVHLGRTKHGG

SEQ ID NO: 2935743 - protein, 22 aa, Entamoeba invadens
FDMICSLGKIYDVFNMDKELIK

SEQ ID NO: 2935744 - protein, 19 aa, Entamoeba invadens
FDMLFTIKSTGEFYVQNRM

SEQ ID NO: 2935745 - protein, 19 aa, Entamoeba invadens
FDMLRLNSYLQYKKSEERK

SEQ ID NO: 2935746 - protein, 26 aa, Entamoeba invadens
FDMRLYCKFYCCQDVRILKEGHIKFR

SEQ ID NO: 2935747 - protein, 28 aa, Entamoeba invadens
FDMSDGSSFVLCFCNTFGTRNSVYEILM

SEQ ID NO: 2935748 - protein, 21 aa, Entamoeba invadens
FDMYEKLFIQYGARVDLWPQE

SEQ ID NO: 2935749 - protein, 32 aa, Entamoeba invadens
FDNAIGCAINLFFKNCNDVISIASGVVKPELK

SEQ ID NO: 2935750 - protein, 19 aa, Entamoeba invadens
FDNALPFVVPSYEFKTRDE

SEQ ID NO: 2935751 - protein, 19 aa, Entamoeba invadens
FDNEFLCLESLSVVKSVAT

SEQ ID NO: 2935752 - protein, 20 aa, Entamoeba invadens
FDNKHYFLVSTFFEIFISNM

SEQ ID NO: 2935753 - protein, 22 aa, Entamoeba invadens
FDNKKECFVTCLSDCNYTERLK

SEQ ID NO: 2935754 - protein, 23 aa, Entamoeba invadens
FDNKKECFVTCLSDCNYTERLKK

SEQ ID NO: 2935755 - protein, 20 aa, Entamoeba invadens
FDNMIFLFSFEVLTNGVYGD

SEQ ID NO: 2935756 - protein, 17 aa, Entamoeba invadens
FDNMTLIVVKFNGYEVE

SEQ ID NO: 2935757 - protein, 19 aa, Entamoeba invadens
FDNPIPFTSLQPFLEYLFA

SEQ ID NO: 2935758 - protein, 21 aa, Entamoeba invadens
FDNRMVNHFIAKFKRKHKKDI

SEQ ID NO: 2935759 - protein, 17 aa, Entamoeba invadens
FDNRMVNHFITEFKRKY

SEQ ID NO: 2935760 - protein, 17 aa, Entamoeba invadens
FDNTVFWTFNVPDELCK

SEQ ID NO: 2935761 - protein, 24 aa, Entamoeba invadens
FDNVVSSWCFGDCTVSCNYNTLSS

SEQ ID NO: 2935762 - protein, 23 aa, Entamoeba invadens
FDNYFKMGITFIEESDRFKVMKE

SEQ ID NO: 2935763 - protein, 18 aa, Entamoeba invadens
FDPEESFVTSDDIKRILD

SEQ ID NO: 2935764 - protein, 27 aa, Entamoeba invadens
FDPKAVFASEWYKLRLQTRQKVEEKKL

SEQ ID NO: 2935765 - protein, 21 aa, Entamoeba invadens
FDPLFGLGLDYFMMQIITLQL

SEQ ID NO: 2935766 - protein, 24 aa, Entamoeba invadens
FDPMKRWTPSQALCHPFITQSQFF

SEQ ID NO: 2935767 - protein, 17 aa, Entamoeba invadens
FDPPNCYAPHFSFLQPQ

SEQ ID NO: 2935768 - protein, 23 aa, Entamoeba invadens
FDPSKEVPLEFVEQKLFSVTKAI

SEQ ID NO: 2935769 - protein, 19 aa, Entamoeba invadens
FDQANGTLCRYFETADNEV

SEQ ID NO: 2935770 - protein, 34 aa, Entamoeba invadens
FDQDELRSFIIIFLKQCTAYGLKFEINKRYFVQL

SEQ ID NO: 2935771 - protein, 18 aa, Entamoeba invadens
FDQKKKERETVERQITGL

SEQ ID NO: 2935772 - protein, 25 aa, Entamoeba invadens
FDQLKLKTKEMEKRLKVIETTLNSQ

SEQ ID NO: 2935773 - protein, 18 aa, Entamoeba invadens
FDQLYRATIGVDFAVKFE

SEQ ID NO: 2935774 - protein, 18 aa, Entamoeba invadens
FDQQCNLVMDTLRDNRDQ

SEQ ID NO: 2935775 - protein, 17 aa, Entamoeba invadens
FDQRAVEITRWMFSTLR

SEQ ID NO: 2935776 - protein, 22 aa, Entamoeba invadens
FDQSGHLFGVFIYEQVKRGEWI

SEQ ID NO: 2935777 - protein, 25 aa, Entamoeba invadens
FDRDAYGFKGNPFVFPLQNENQNLP

SEQ ID NO: 2935778 - protein, 17 aa, Entamoeba invadens
FDSFLLNNGLTFGLYKN

SEQ ID NO: 2935779 - protein, 18 aa, Entamoeba invadens
FDSIICLQNYSGAFGGVE

SEQ ID NO: 2935780 - protein, 17 aa, Entamoeba invadens
FDSIKKLFCSKEENKDK

SEQ ID NO: 2935781 - protein, 17 aa, Entamoeba invadens
FDSINFWIDDFKKSEGD

SEQ ID NO: 2935782 - protein, 23 aa, Entamoeba invadens
FDSKPDQKIFCLYSDENPSWIFG

SEQ ID NO: 2935783 - protein, 20 aa, Entamoeba invadens
FDSLDKALCFLDRVIQVGCY

SEQ ID NO: 2935784 - protein, 18 aa, Entamoeba invadens
FDSLDYFYSHAISVIEQY

SEQ ID NO: 2935785 - protein, 18 aa, Entamoeba invadens
FDSLKEVFSLAIQNYIGV

SEQ ID NO: 2935786 - protein, 26 aa, Entamoeba invadens
FDSLKGDLFDLMLDLFGNYVVQKFIE

SEQ ID NO: 2935787 - protein, 23 aa, Entamoeba invadens
FDSLKGLIFKTVETRGDLLMYLY

SEQ ID NO: 2935788 - protein, 24 aa, Entamoeba invadens
FDSLKRLTVISSEFVYLPEIDFSN

SEQ ID NO: 2935789 - protein, 18 aa, Entamoeba invadens
FDSLKRWFNELKNVSPKC

SEQ ID NO: 2935790 - protein, 20 aa, Entamoeba invadens
FDSLSSLSCFSKSDKSEKKT

SEQ ID NO: 2935791 - protein, 17 aa, Entamoeba invadens
FDSRFDYFLSQTANISN

SEQ ID NO: 2935792 - protein, 25 aa, Entamoeba invadens
FDSRFPSDKGGNCYYVVNNDIYSPE

SEQ ID NO: 2935793 - protein, 24 aa, Entamoeba invadens
FDSRFPSDKGGNCYYVVNNDVYSP

SEQ ID NO: 2935794 - protein, 22 aa, Entamoeba invadens
FDSRLNYGVQCFMHSIPRNEIM

SEQ ID NO: 2935795 - protein, 18 aa, Entamoeba invadens
FDSRVLKSAISFKENIIF

SEQ ID NO: 2935796 - protein, 18 aa, Entamoeba invadens
FDSVHSFNNILVQLTKKL

SEQ ID NO: 2935797 - protein, 17 aa, Entamoeba invadens
FDSVVSWFDDIQEKSLG

SEQ ID NO: 2935798 - protein, 17 aa, Entamoeba invadens
FDSYEYSFFISLKEENK

SEQ ID NO: 2935799 - protein, 24 aa, Entamoeba invadens
FDTETPPSLFGFEHNFKPFLALMT

SEQ ID NO: 2935800 - protein, 26 aa, Entamoeba invadens
FDTFGKLYVGYKWMRGVSEKYKEIMS

SEQ ID NO: 2935801 - protein, 23 aa, Entamoeba invadens
FDTFLRSRLDDFFEDDIQRGVSY

SEQ ID NO: 2935802 - protein, 17 aa, Entamoeba invadens
FDTIKSFQLGKFSFNKN

SEQ ID NO: 2935803 - protein, 17 aa, Entamoeba invadens
FDTINVLQIIQVRSKEQ

SEQ ID NO: 2935804 - protein, 26 aa, Entamoeba invadens
FDTKLPLDKKVSGWVVMDTGKCLLIS

SEQ ID NO: 2935805 - protein, 17 aa, Entamoeba invadens
FDTLSFAIIEDSIQTPF

SEQ ID NO: 2935806 - protein, 18 aa, Entamoeba invadens
FDTMVLFQESWRCVQSTT

SEQ ID NO: 2935807 - protein, 18 aa, Entamoeba invadens
FDTVCSLPIDKPSRDLLC

SEQ ID NO: 2935808 - protein, 24 aa, Entamoeba invadens
FDVARVVIYQANFVSPWTDKGPLL

SEQ ID NO: 2935809 - protein, 25 aa, Entamoeba invadens
FDVARVVIYQANFVSPWTDRGPLLP

SEQ ID NO: 2935810 - protein, 24 aa, Entamoeba invadens
FDVDPNVYQAYTWIEQNRNKFEAE

SEQ ID NO: 2935811 - protein, 26 aa, Entamoeba invadens
FDVFFFKIPTQFWFELNDAVKCIFVL

SEQ ID NO: 2935812 - protein, 17 aa, Entamoeba invadens
FDVFKSFTKGYLTHSQW

SEQ ID NO: 2935813 - protein, 17 aa, Entamoeba invadens
FDVFPDVICDLTKVTIL

SEQ ID NO: 2935814 - protein, 17 aa, Entamoeba invadens
FDVFSFRDQNVIDRPNQ

SEQ ID NO: 2935815 - protein, 20 aa, Entamoeba invadens
FDVIKIPRPNDFGSVAQVSL

SEQ ID NO: 2935816 - protein, 19 aa, Entamoeba invadens
FDVIQKCWAQDMSKRIDAT

SEQ ID NO: 2935817 - protein, 20 aa, Entamoeba invadens
FDVIQKCWAQDMSKRIDSTT

SEQ ID NO: 2935818 - protein, 20 aa, Entamoeba invadens
FDVIRRCQKSGLVIYSVAAE

SEQ ID NO: 2935819 - protein, 24 aa, Entamoeba invadens
FDVKELKKNCVYESYNEESLQVVW

SEQ ID NO: 2935820 - protein, 21 aa, Entamoeba invadens
FDVKIPTSFFSHVYPVALCDL

SEQ ID NO: 2935821 - protein, 20 aa, Entamoeba invadens
FDVKITLPLVKTGELMGNTI

SEQ ID NO: 2935822 - protein, 22 aa, Entamoeba invadens
FDVLLKQMFPVSVFLYNSDNSK

SEQ ID NO: 2935823 - protein, 17 aa, Entamoeba invadens
FDVMKRYNLKKEDILVV

SEQ ID NO: 2935824 - protein, 25 aa, Entamoeba invadens
FDVWTGRWKYLIYRYDKPKPNHISV

SEQ ID NO: 2935825 - protein, 19 aa, Entamoeba invadens
FDVYCWYGSQVSIAKRGVC

SEQ ID NO: 2935826 - protein, 35 aa, Entamoeba invadens
FDYFKRCGVDYSFCFRWIVLLFKRDFETKLCLQVW

SEQ ID NO: 2935827 - protein, 24 aa, Entamoeba invadens
FDYFRMAIELWKKNDVWKILKDSR

SEQ ID NO: 2935828 - protein, 19 aa, Entamoeba invadens
FDYKLAKKMCGLEKEDIVE

SEQ ID NO: 2935829 - protein, 24 aa, Entamoeba invadens
FDYKNCTQTICGVDGSVIFNIQKF

SEQ ID NO: 2935830 - protein, 19 aa, Entamoeba invadens
FDYKSLYAINEDVLHQNPV

SEQ ID NO: 2935831 - protein, 17 aa, Entamoeba invadens
FDYKSLYTINENVLHQN

SEQ ID NO: 2935832 - protein, 22 aa, Entamoeba invadens
FDYLPLCAIIKEKVFCVHGGIS

SEQ ID NO: 2935833 - protein, 24 aa, Entamoeba invadens
FDYRLAMSCPDLWVEYLKTKKDED

SEQ ID NO: 2935834 - protein, 24 aa, Entamoeba invadens
FDYRMKACGEHDGYVRKESENVNY

SEQ ID NO: 2935835 - protein, 17 aa, Entamoeba invadens
FDYTLWVNKVFKGTVFG

SEQ ID NO: 2935836 - protein, 24 aa, Entamoeba invadens
FDYVKTMVCGESFLSVKNDLVTLV

SEQ ID NO: 2935837 - protein, 25 aa, Entamoeba invadens
FEACKSLESPQMWKSLGNAAMISGH

SEQ ID NO: 2935838 - protein, 27 aa, Entamoeba invadens
FEADGTRFLYRLCEDVYIVVITTLSSN

SEQ ID NO: 2935839 - protein, 17 aa, Entamoeba invadens
FEADWWFGKITMNDTLK

SEQ ID NO: 2935840 - protein, 20 aa, Entamoeba invadens
FEAFTWKDAFENVKYFFEIP

SEQ ID NO: 2935841 - protein, 25 aa, Entamoeba invadens
FEAHHLFIDFLRDMGYSFASQYTSG

SEQ ID NO: 2935842 - protein, 17 aa, Entamoeba invadens
FEAHLKSDIVFLNDYGM

SEQ ID NO: 2935843 - protein, 19 aa, Entamoeba invadens
FEALFKPGCALKVREGKLS

SEQ ID NO: 2935844 - protein, 17 aa, Entamoeba invadens
FEALKLPSTDAITAMTL

SEQ ID NO: 2935845 - protein, 20 aa, Entamoeba invadens
FEALTKWTVQFVKEGKRNRL

SEQ ID NO: 2935846 - protein, 22 aa, Entamoeba invadens
FEANGCKQCEFILPHINGENCG

SEQ ID NO: 2935847 - protein, 19 aa, Entamoeba invadens
FEANGVWKITVENINFELK

SEQ ID NO: 2935848 - protein, 23 aa, Entamoeba invadens
FEAPDSLSAKGWIDLPPGTDVKD

SEQ ID NO: 2935849 - protein, 18 aa, Entamoeba invadens
FECAIHFVLSCRNLTNFE

SEQ ID NO: 2935850 - protein, 23 aa, Entamoeba invadens
FECCERLKKVVFEFYSNENPKNL

SEQ ID NO: 2935851 - protein, 23 aa, Entamoeba invadens
FECEIPLTFPLMFVSDKVGLKYY

SEQ ID NO: 2935852 - protein, 25 aa, Entamoeba invadens
FECFFEMSQLYPFFIKNLPNALLHK

SEQ ID NO: 2935853 - protein, 25 aa, Entamoeba invadens
FECGTPNPSWASIPYGIFICIQCSG

SEQ ID NO: 2935854 - protein, 23 aa, Entamoeba invadens
FECLDFFKKEMQILKSLKHPCLI

SEQ ID NO: 2935855 - protein, 17 aa, Entamoeba invadens
FECNKSFDDFFVPNLIG

SEQ ID NO: 2935856 - protein, 33 aa, Entamoeba invadens
FECTFGCQGYHGYKCICGTDVLFGIEISMTVID

SEQ ID NO: 2935857 - protein, 25 aa, Entamoeba invadens
FECVCKKCQIAIISVYINPYRLSEL

SEQ ID NO: 2935858 - protein, 19 aa, Entamoeba invadens
FEDAAKCFCIKKLVVYIKP

SEQ ID NO: 2935859 - protein, 18 aa, Entamoeba invadens
FEDASGWLYFGEQHSNAS

SEQ ID NO: 2935860 - protein, 18 aa, Entamoeba invadens
FEDICTKGFLILRTNAKT

SEQ ID NO: 2935861 - protein, 24 aa, Entamoeba invadens
FEDIPRTRVFLNFKTKSGKDVDIM

SEQ ID NO: 2935862 - protein, 19 aa, Entamoeba invadens
FEDITALYVKRANALLNEA

SEQ ID NO: 2935863 - protein, 17 aa, Entamoeba invadens
FEDKKCFLFCLRENGNV

SEQ ID NO: 2935864 - protein, 26 aa, Entamoeba invadens
FEDLAEPCLFLGIGTTDGVCYGFRIK

SEQ ID NO: 2935865 - protein, 23 aa, Entamoeba invadens
FEDLKKYLLKGLEETVRVLPLID

SEQ ID NO: 2935866 - protein, 20 aa, Entamoeba invadens
FEDNMASFKHCLTSFHKFWK

SEQ ID NO: 2935867 - protein, 23 aa, Entamoeba invadens
FEDSKLEAHRGAFNEVQIYMNEE

SEQ ID NO: 2935868 - protein, 19 aa, Entamoeba invadens
FEDSLQITECLNYVVERMV

SEQ ID NO: 2935869 - protein, 26 aa, Entamoeba invadens
FEEAFGLDSVETFKLKNRRVVSIITS

SEQ ID NO: 2935870 - protein, 31 aa, Entamoeba invadens
FEEAKHIRGLKCLGIESSIEYFDICRIKDAI

SEQ ID NO: 2935871 - protein, 17 aa, Entamoeba invadens
FEECKALSLLSFHDNIV

SEQ ID NO: 2935872 - protein, 18 aa, Entamoeba invadens
FEEFKGRYFTTPRKMGAE

SEQ ID NO: 2935873 - protein, 22 aa, Entamoeba invadens
FEEKAQLFAWSGRSVGNLVYDS

SEQ ID NO: 2935874 - protein, 20 aa, Entamoeba invadens
FEEKTWLIILNFFGQETLFE

SEQ ID NO: 2935875 - protein, 18 aa, Entamoeba invadens
FEELKLVIIDEIHLLHDT

SEQ ID NO: 2935876 - protein, 22 aa, Entamoeba invadens
FEELKQRLVLVDSMKTCGLVVI

SEQ ID NO: 2935877 - protein, 26 aa, Entamoeba invadens
FEENEWFPDIELSKKISYLYNDTYTC

SEQ ID NO: 2935878 - protein, 20 aa, Entamoeba invadens
FEEQEIIVGIGRQVTELRAK

SEQ ID NO: 2935879 - protein, 17 aa, Entamoeba invadens
FEERLKAILKKVKESKN

SEQ ID NO: 2935880 - protein, 23 aa, Entamoeba invadens
FEESGLIFELFEFMDYPYNERTT

SEQ ID NO: 2935881 - protein, 19 aa, Entamoeba invadens
FEEVFVRSSKLILVDVQNN

SEQ ID NO: 2935882 - protein, 18 aa, Entamoeba invadens
FEFFKEVDLSEPSMEQLK

SEQ ID NO: 2935883 - protein, 17 aa, Entamoeba invadens
FEFGDFNSAQDPKKNDW

SEQ ID NO: 2935884 - protein, 18 aa, Entamoeba invadens
FEFKRVQYERVEWEYYDD

SEQ ID NO: 2935885 - protein, 24 aa, Entamoeba invadens
FEFLRDRIGQNFKEICVTNIEGLS

SEQ ID NO: 2935886 - protein, 18 aa, Entamoeba invadens
FEFNGNCTMQEFVDLIFK

SEQ ID NO: 2935887 - protein, 17 aa, Entamoeba invadens
FEFNGVMCRTMAPMDPT

SEQ ID NO: 2935888 - protein, 18 aa, Entamoeba invadens
FEFNLQIEKTVRHQITLS

SEQ ID NO: 2935889 - protein, 26 aa, Entamoeba invadens
FEFQSFVLDCYDLQLTDFCSTKKLII

SEQ ID NO: 2935890 - protein, 21 aa, Entamoeba invadens
FEFTCGDAFETLEYVNPNMIN

SEQ ID NO: 2935891 - protein, 25 aa, Entamoeba invadens
FEGENPFKELLPLKIRAAYNQYMAK

SEQ ID NO: 2935892 - protein, 17 aa, Entamoeba invadens
FEGESRFHLSAQVGDVM

SEQ ID NO: 2935893 - protein, 40 aa, Entamoeba invadens
FEGEVCMIIVWPFKLFIYIRLKTIYIRHFVLKKFVISKQR

SEQ ID NO: 2935894 - protein, 22 aa, Entamoeba invadens
FEGGKFKLKIVLPDEYPQKPPV

SEQ ID NO: 2935895 - protein, 19 aa, Entamoeba invadens
FEGGSPIPVRYVLSKENPF

SEQ ID NO: 2935896 - protein, 19 aa, Entamoeba invadens
FEGIKEFGSVILKNSVLNN

SEQ ID NO: 2935897 - protein, 26 aa, Entamoeba invadens
FEGKLKRKTECMGCHFVSEQTESFYC

SEQ ID NO: 2935898 - protein, 21 aa, Entamoeba invadens
FEGLCKALSGSLDFTILAVVH

SEQ ID NO: 2935899 - protein, 19 aa, Entamoeba invadens
FEGLDGVFVLSIRNMKHRN

SEQ ID NO: 2935900 - protein, 20 aa, Entamoeba invadens
FEGPFEMWVPFHVTNKREII

SEQ ID NO: 2935901 - protein, 26 aa, Entamoeba invadens
FEGQILNSYFCSLNDQMVNLKKIGSD

SEQ ID NO: 2935902 - protein, 18 aa, Entamoeba invadens
FEHDLGRNDIEWINKYVL

SEQ ID NO: 2935903 - protein, 20 aa, Entamoeba invadens
FEHEVCYIFVLGYGRVAFNC

SEQ ID NO: 2935904 - protein, 26 aa, Entamoeba invadens
FEHFESWKPKIFFIATENINVINSHK

SEQ ID NO: 2935905 - protein, 24 aa, Entamoeba invadens
FEHFTKVFLPWYMEIGTKKNTLIM

SEQ ID NO: 2935906 - protein, 23 aa, Entamoeba invadens
FEHLEVWRKEFISGGNPSDPETF

SEQ ID NO: 2935907 - protein, 20 aa, Entamoeba invadens
FEHPSDPLVFTAVRDVVRPN

SEQ ID NO: 2935908 - protein, 20 aa, Entamoeba invadens
FEHRDVHNIYGLSYQAATYK

SEQ ID NO: 2935909 - protein, 19 aa, Entamoeba invadens
FEHTEFYFYFFKKMSSKLI

SEQ ID NO: 2935910 - protein, 17 aa, Entamoeba invadens
FEHVANLTPGRQYRMAR

SEQ ID NO: 2935911 - protein, 17 aa, Entamoeba invadens
FEHWKNGELIYDSDKDP

SEQ ID NO: 2935912 - protein, 25 aa, Entamoeba invadens
FEIARLNMFSHLSVFIENPYYNPNY

SEQ ID NO: 2935913 - protein, 20 aa, Entamoeba invadens
FEICGFPFLVKMSDSRFVTL

SEQ ID NO: 2935914 - protein, 22 aa, Entamoeba invadens
FEICKACVDNGFSNVMIDGSAL

SEQ ID NO: 2935915 - protein, 19 aa, Entamoeba invadens
FEICKDGKNGKSYVTICEN

SEQ ID NO: 2935916 - protein, 17 aa, Entamoeba invadens
FEICKDVYCDVTVHYFF

SEQ ID NO: 2935917 - protein, 18 aa, Entamoeba invadens
FEIDVRFFTRGQAFVQSR

SEQ ID NO: 2935918 - protein, 34 aa, Entamoeba invadens
FEIEAHSTLRCPVCLGVTGGFFLRIKKEEKDNEE

SEQ ID NO: 2935919 - protein, 17 aa, Entamoeba invadens
FEIEGVLSIGTKPLYVS

SEQ ID NO: 2935920 - protein, 17 aa, Entamoeba invadens
FEIERLRQIASGWGEQA

SEQ ID NO: 2935921 - protein, 17 aa, Entamoeba invadens
FEIFITPHCTLNLNDNI

SEQ ID NO: 2935922 - protein, 17 aa, Entamoeba invadens
FEIFLTPLCTMNLNDEV

SEQ ID NO: 2935923 - protein, 18 aa, Entamoeba invadens
FEIFLTPYCTMQLIDEII

SEQ ID NO: 2935924 - protein, 20 aa, Entamoeba invadens
FEIFVLRKVTVMKQRGMDGL

SEQ ID NO: 2935925 - protein, 27 aa, Entamoeba invadens
FEIGFYLKSARDFIHIMFTCKKFRLFT

SEQ ID NO: 2935926 - protein, 35 aa, Entamoeba invadens
FEIGQKYNCCFRLPNKSSKILFKFGEKGDLVVKFD

SEQ ID NO: 2935927 - protein, 18 aa, Entamoeba invadens
FEILGLSGKYVLGNLPET

SEQ ID NO: 2935928 - protein, 17 aa, Entamoeba invadens
FEILNNILATSVYVDVQ

SEQ ID NO: 2935929 - protein, 18 aa, Entamoeba invadens
FEILNPTGNLKCFDTISL

SEQ ID NO: 2935930 - protein, 18 aa, Entamoeba invadens
FEIMVDYFRTLLIPDKSI

SEQ ID NO: 2935931 - protein, 20 aa, Entamoeba invadens
FEIPAEFCIHKKFQKLLKEY

SEQ ID NO: 2935932 - protein, 22 aa, Entamoeba invadens
FEIPLICLNAIFINATHTDAKS

SEQ ID NO: 2935933 - protein, 26 aa, Entamoeba invadens
FEIRCAPPLMTLKPGYACEFEIFIKP

SEQ ID NO: 2935934 - protein, 25 aa, Entamoeba invadens
FEIVHGIACGVAYLHAHSPALVYFN

SEQ ID NO: 2935935 - protein, 22 aa, Entamoeba invadens
FEIVKLKTKIVFGNESESSSED

SEQ ID NO: 2935936 - protein, 18 aa, Entamoeba invadens
FEIYSWWKNNIEAQEFTD

SEQ ID NO: 2935937 - protein, 21 aa, Entamoeba invadens
FEKCRMMAKQLFVIKELQDNQ

SEQ ID NO: 2935938 - protein, 17 aa, Entamoeba invadens
FEKDFINSILMCKKFSF

SEQ ID NO: 2935939 - protein, 19 aa, Entamoeba invadens
FEKEKEGLIVYIKDKDVEN

SEQ ID NO: 2935940 - protein, 20 aa, Entamoeba invadens
FEKEKVFQLGEDFMNKQQSI

SEQ ID NO: 2935941 - protein, 19 aa, Entamoeba invadens
FEKELIRQLLLPHTNSDDS

SEQ ID NO: 2935942 - protein, 18 aa, Entamoeba invadens
FEKEVAMLDKFRCDYIVH

SEQ ID NO: 2935943 - protein, 17 aa, Entamoeba invadens
FEKEVLKQEETFKKLNV

SEQ ID NO: 2935944 - protein, 18 aa, Entamoeba invadens
FEKEVSMLDKFRCEYLVH

SEQ ID NO: 2935945 - protein, 24 aa, Entamoeba invadens
FEKFPKLGTFLLRDNGKVVATGRV

SEQ ID NO: 2935946 - protein, 18 aa, Entamoeba invadens
FEKICSFENNYSALRNEI

SEQ ID NO: 2935947 - protein, 18 aa, Entamoeba invadens
FEKKRFDLKNGKNQEVFG

SEQ ID NO: 2935948 - protein, 25 aa, Entamoeba invadens
FEKLKEIGTVLSFDKIDEIYEYKNI

SEQ ID NO: 2935949 - protein, 36 aa, Entamoeba invadens
FEKLKKVMMCLYDIIKRYSLGNSFIFVPKNDDNTFI

SEQ ID NO: 2935950 - protein, 18 aa, Entamoeba invadens
FEKRICYTKFYGIFQILI

SEQ ID NO: 2935951 - protein, 17 aa, Entamoeba invadens
FEKRIRREWFEEDVSLV

SEQ ID NO: 2935952 - protein, 26 aa, Entamoeba invadens
FEKRKIYINECIKLAKERALKIHLWV

SEQ ID NO: 2935953 - protein, 25 aa, Entamoeba invadens
FEKRMLKIVQDYRLKKVTSPNTLMY

SEQ ID NO: 2935954 - protein, 17 aa, Entamoeba invadens
FEKRPSLREKLVVQTKC

SEQ ID NO: 2935955 - protein, 23 aa, Entamoeba invadens
FEKSEINFVWLYEAYFIHTSFQT

SEQ ID NO: 2935956 - protein, 23 aa, Entamoeba invadens
FEKSPKLTWRDVEKCFCFDNDNT

SEQ ID NO: 2935957 - protein, 17 aa, Entamoeba invadens
FEKTHGYDSYDGPYDPL

SEQ ID NO: 2935958 - protein, 29 aa, Entamoeba invadens
FEKVFSKMFNLRWINFIGNPIDDKGFLKR

SEQ ID NO: 2935959 - protein, 17 aa, Entamoeba invadens
FEKVITWFQDVMEHNMV

SEQ ID NO: 2935960 - protein, 23 aa, Entamoeba invadens
FEKVRLCSVQRVIEPNTFKISGI

SEQ ID NO: 2935961 - protein, 23 aa, Entamoeba invadens
FEKYPFDIIIQFVNVGILEFSMM

SEQ ID NO: 2935962 - protein, 20 aa, Entamoeba invadens
FEKYVGFTWISDQTITHFEG

SEQ ID NO: 2935963 - protein, 20 aa, Entamoeba invadens
FELCARVKGSLPEEVNPFTK

SEQ ID NO: 2935964 - protein, 27 aa, Entamoeba invadens
FELCGYPKIPITAMWMGEVIRFDDLPT

SEQ ID NO: 2935965 - protein, 17 aa, Entamoeba invadens
FELCQRNKLSAISNTFA

SEQ ID NO: 2935966 - protein, 18 aa, Entamoeba invadens
FELCSKVGRDKLDVLGCS

SEQ ID NO: 2935967 - protein, 17 aa, Entamoeba invadens
FELDDPIITKMFPNEQI

SEQ ID NO: 2935968 - protein, 19 aa, Entamoeba invadens
FELDMSRCPSVTKLAVESL

SEQ ID NO: 2935969 - protein, 30 aa, Entamoeba invadens
FELEQLEWKWGICMAIGLSEFIDIRLNKGT

SEQ ID NO: 2935970 - protein, 18 aa, Entamoeba invadens
FELESFQFGDLCDGDTKT

SEQ ID NO: 2935971 - protein, 17 aa, Entamoeba invadens
FELFNPKKSFTLKIIDS

SEQ ID NO: 2935972 - protein, 21 aa, Entamoeba invadens
FELFVQLTLLGGLERRRVVFD

SEQ ID NO: 2935973 - protein, 19 aa, Entamoeba invadens
FELICKTFVITGTQVPEWK

SEQ ID NO: 2935974 - protein, 21 aa, Entamoeba invadens
FELLFRVVKRIWKLDIYGEYF

SEQ ID NO: 2935975 - protein, 20 aa, Entamoeba invadens
FELLVSPLLQVRIIVADTIL

SEQ ID NO: 2935976 - protein, 18 aa, Entamoeba invadens
FELRHKVVLTDYLEKIKY

SEQ ID NO: 2935977 - protein, 27 aa, Entamoeba invadens
FELRIFPPYPCSKIILENRLSEVDYVF

SEQ ID NO: 2935978 - protein, 17 aa, Entamoeba invadens
FELRMINAIILFKQNDE

SEQ ID NO: 2935979 - protein, 17 aa, Entamoeba invadens
FELSLLIKECFDCEDVL

SEQ ID NO: 2935980 - protein, 30 aa, Entamoeba invadens
FELSTSICADVDCACELARTLAGDIVEQAI

SEQ ID NO: 2935981 - protein, 28 aa, Entamoeba invadens
FELTEHNFLKFVGIGGVLPLLANDLSQP

SEQ ID NO: 2935982 - protein, 17 aa, Entamoeba invadens
FELYVPIIEPVPFSYFV

SEQ ID NO: 2935983 - protein, 25 aa, Entamoeba invadens
FEMARTRHKFAFYIGTNRSTRLIDF

SEQ ID NO: 2935984 - protein, 17 aa, Entamoeba invadens
FEMCIQLKELVFNNNVV

SEQ ID NO: 2935985 - protein, 19 aa, Entamoeba invadens
FEMEYPLKLQIDIPGSLID

SEQ ID NO: 2935986 - protein, 21 aa, Entamoeba invadens
FEMGSILAAINMDYLRRQRES

SEQ ID NO: 2935987 - protein, 18 aa, Entamoeba invadens
FEMIKESMKAFTLDEQLL

SEQ ID NO: 2935988 - protein, 19 aa, Entamoeba invadens
FEMIVGTVCFLRIDDKEKY

SEQ ID NO: 2935989 - protein, 27 aa, Entamoeba invadens
FEMQYMRCWIEHVTLFAKDDIKEFPGY

SEQ ID NO: 2935990 - protein, 18 aa, Entamoeba invadens
FEMVKSALNRFFKNSEDE

SEQ ID NO: 2935991 - protein, 27 aa, Entamoeba invadens
FEMVTALEIPHVFSPWEAEAQCAYYNK

SEQ ID NO: 2935992 - protein, 19 aa, Entamoeba invadens
FEMVYPIYSKIEIFGTSIS

SEQ ID NO: 2935993 - protein, 26 aa, Entamoeba invadens
FENANEWFCCYIAAVKRNIWKRLLHI

SEQ ID NO: 2935994 - protein, 30 aa, Entamoeba invadens
FENCEIFKIEFCRNCEFVFENSKMKFLKIV

SEQ ID NO: 2935995 - protein, 17 aa, Entamoeba invadens
FENCEILEVSFCEHLNF

SEQ ID NO: 2935996 - protein, 22 aa, Entamoeba invadens
FENCEKLEGVVFPNKLGQLEES

SEQ ID NO: 2935997 - protein, 19 aa, Entamoeba invadens
FENCMRLAKIELPNTLSTI

SEQ ID NO: 2935998 - protein, 18 aa, Entamoeba invadens
FENEIFKSVGCEKETFKN

SEQ ID NO: 2935999 - protein, 25 aa, Entamoeba invadens
FENEVSMLDKFRCEYIVHFYGAVFI

SEQ ID NO: 2936000 - protein, 26 aa, Entamoeba invadens
FENEVSMLDKFRCEYIVHFYGAVFIP

SEQ ID NO: 2936001 - protein, 33 aa, Entamoeba invadens
FENGFYELCLFNAYCRMDWLLCTKRIKDNSGCT

SEQ ID NO: 2936002 - protein, 27 aa, Entamoeba invadens
FENIKRVWCKPELFGNGSKIVLIATKV

SEQ ID NO: 2936003 - protein, 19 aa, Entamoeba invadens
FENINNFLVYVQQISQFTE

SEQ ID NO: 2936004 - protein, 18 aa, Entamoeba invadens
FENLEGWIKNQRAPYIRY

SEQ ID NO: 2936005 - protein, 21 aa, Entamoeba invadens
FENLKKLKLYGCTIHYNIDQF

SEQ ID NO: 2936006 - protein, 19 aa, Entamoeba invadens
FENLYKYKEEILRHKDKDT

SEQ ID NO: 2936007 - protein, 30 aa, Entamoeba invadens
FENMNVSDLFIKLNILLNNELNKLSPNNDS

SEQ ID NO: 2936008 - protein, 45 aa, Entamoeba invadens
FENPFPVSFALRLFGRFYPIIPLKFIQKEFEWLGIDLNEWDEKIE

SEQ ID NO: 2936009 - protein, 19 aa, Entamoeba invadens
FENPLRYLDAISILYIKYN

SEQ ID NO: 2936010 - protein, 18 aa, Entamoeba invadens
FENRVVRFSSKRENSVFP

SEQ ID NO: 2936011 - protein, 24 aa, Entamoeba invadens
FENSHVAIVYGFRNIQNVVRMTKT

SEQ ID NO: 2936012 - protein, 21 aa, Entamoeba invadens
FENTPFLGVRFRYEGKEMFVN

SEQ ID NO: 2936013 - protein, 18 aa, Entamoeba invadens
FENVAFLSPKGHYDVKIY

SEQ ID NO: 2936014 - protein, 26 aa, Entamoeba invadens
FENYKIPSLFVLPSTFLTVLGNGLEC

SEQ ID NO: 2936015 - protein, 23 aa, Entamoeba invadens
FEPEKILFLLVESFLKTLDGNKP

SEQ ID NO: 2936016 - protein, 17 aa, Entamoeba invadens
FEPELVRVATTFGNQYF

SEQ ID NO: 2936017 - protein, 24 aa, Entamoeba invadens
FEPFSPKFFHDFVYSRPVEERFSL

SEQ ID NO: 2936018 - protein, 19 aa, Entamoeba invadens
FEPHCGDIFDFVRRLDTTD

SEQ ID NO: 2936019 - protein, 28 aa, Entamoeba invadens
FEPPTSFCKLAIRLEEILGEEDKTKVFD

SEQ ID NO: 2936020 - protein, 20 aa, Entamoeba invadens
FEPQKHKVRSLRVFLPTKCL

SEQ ID NO: 2936021 - protein, 17 aa, Entamoeba invadens
FEPSGLVQQESFLGGTP

SEQ ID NO: 2936022 - protein, 19 aa, Entamoeba invadens
FEPTCVGRVAQLLVDLTEL

SEQ ID NO: 2936023 - protein, 17 aa, Entamoeba invadens
FEQFFIPLVDFLRTENI

SEQ ID NO: 2936024 - protein, 28 aa, Entamoeba invadens
FEQFVCSKLRVLYKLNWPVDVIKHNPQC

SEQ ID NO: 2936025 - protein, 22 aa, Entamoeba invadens
FEQIKMFQAMIDRLPKAMRAQL

SEQ ID NO: 2936026 - protein, 19 aa, Entamoeba invadens
FEQKETFYVDGLNDVTQLM

SEQ ID NO: 2936027 - protein, 17 aa, Entamoeba invadens
FEQKVVIRPSVLDNEEV

SEQ ID NO: 2936028 - protein, 17 aa, Entamoeba invadens
FEQLQFLFIDYTMTTKE

SEQ ID NO: 2936029 - protein, 32 aa, Entamoeba invadens
FEQRMFFMTKYFRTMAFWVFKAILENDLRTNE

SEQ ID NO: 2936030 - protein, 17 aa, Entamoeba invadens
FERCCLLEDIGFTVVPK

SEQ ID NO: 2936031 - protein, 20 aa, Entamoeba invadens
FERECVWKYNSTIYNEFIEL

SEQ ID NO: 2936032 - protein, 24 aa, Entamoeba invadens
FERKCITCSNGYYLSGGKCVRCDS

SEQ ID NO: 2936033 - protein, 18 aa, Entamoeba invadens
FERKVACTEMEGCGVAHA

SEQ ID NO: 2936034 - protein, 19 aa, Entamoeba invadens
FERLMKFAVVFRDEKETGA

SEQ ID NO: 2936035 - protein, 24 aa, Entamoeba invadens
FERVCGGSVDAVFLWVNGTSQRHL

SEQ ID NO: 2936036 - protein, 17 aa, Entamoeba invadens
FERVKAVLVRSTLMTQK

SEQ ID NO: 2936037 - protein, 22 aa, Entamoeba invadens
FERVYFYNCHKLTKISFTECKN

SEQ ID NO: 2936038 - protein, 21 aa, Entamoeba invadens
FERYANAVGTGFVIENGQIMK

SEQ ID NO: 2936039 - protein, 17 aa, Entamoeba invadens
FERYIPQFMKFFEDNMA

SEQ ID NO: 2936040 - protein, 25 aa, Entamoeba invadens
FERYSSMILNCVDLVSRLCEGVAGV

SEQ ID NO: 2936041 - protein, 18 aa, Entamoeba invadens
FESALVLDKTCLDALVSL

SEQ ID NO: 2936042 - protein, 18 aa, Entamoeba invadens
FESCVSLRAINTLSTLKY

SEQ ID NO: 2936043 - protein, 17 aa, Entamoeba invadens
FESDCLIIGNDESKNKP

SEQ ID NO: 2936044 - protein, 23 aa, Entamoeba invadens
FESEVAMLDKFRCDYIVHFYGAV

SEQ ID NO: 2936045 - protein, 25 aa, Entamoeba invadens
FESFGKIKECHLITFRGYSKGFAFV

SEQ ID NO: 2936046 - protein, 18 aa, Entamoeba invadens
FESFKGKFIVLLFYPLDW

SEQ ID NO: 2936047 - protein, 20 aa, Entamoeba invadens
FESFPVWNLPLKHPVNVAYE

SEQ ID NO: 2936048 - protein, 23 aa, Entamoeba invadens
FESKAYFLGYMTNHFLSVYTGKR

SEQ ID NO: 2936049 - protein, 17 aa, Entamoeba invadens
FESKTKFVEPSIITNDL

SEQ ID NO: 2936050 - protein, 23 aa, Entamoeba invadens
FESNGRMNKPRMFPIKRESSAKA

SEQ ID NO: 2936051 - protein, 18 aa, Entamoeba invadens
FESQWGLAFESFLDGLTV

SEQ ID NO: 2936052 - protein, 19 aa, Entamoeba invadens
FESQWGLAIESFLDGLTVQ

SEQ ID NO: 2936053 - protein, 30 aa, Entamoeba invadens
FESRLTVPLKYPIKRGIIIDFDLMDSIWDA

SEQ ID NO: 2936054 - protein, 29 aa, Entamoeba invadens
FESTSGLNKVCFSKCVFKTNYNIDDNNEF

SEQ ID NO: 2936055 - protein, 17 aa, Entamoeba invadens
FESWNIESKTHFAFFNN

SEQ ID NO: 2936056 - protein, 24 aa, Entamoeba invadens
FESYTCSALALFLLKRALKSRGDI

SEQ ID NO: 2936057 - protein, 18 aa, Entamoeba invadens
FETANGFEIEYLVEDDPM

SEQ ID NO: 2936058 - protein, 24 aa, Entamoeba invadens
FETDSGRTFSIFFSKPQKKILFIT

SEQ ID NO: 2936059 - protein, 18 aa, Entamoeba invadens
FETFAWCYPLHCSSADFL

SEQ ID NO: 2936060 - protein, 24 aa, Entamoeba invadens
FETFIRPYFGDAFRPVKKGDHFLC

SEQ ID NO: 2936061 - protein, 23 aa, Entamoeba invadens
FETFSDFVSLMFVCKKYRENIER

SEQ ID NO: 2936062 - protein, 25 aa, Entamoeba invadens
FETFVPREVVLPVHFEKTYECEKGE

SEQ ID NO: 2936063 - protein, 26 aa, Entamoeba invadens
FETIELKIPLETGGFRATKVVVMKDL

SEQ ID NO: 2936064 - protein, 27 aa, Entamoeba invadens
FETIKTWPGLLSLTSMNGIECLVVALH

SEQ ID NO: 2936065 - protein, 32 aa, Entamoeba invadens
FETKSFLRVAKFSSQCTTEWMWSNDNASIICA

SEQ ID NO: 2936066 - protein, 29 aa, Entamoeba invadens
FETKSGFVPYKIVYTDGFLFFYKNSSEPN

SEQ ID NO: 2936067 - protein, 19 aa, Entamoeba invadens
FETLKNGGIEWVEKKFGIM

SEQ ID NO: 2936068 - protein, 24 aa, Entamoeba invadens
FETLNIPELFPFDGEEKPPKGYLK

SEQ ID NO: 2936069 - protein, 22 aa, Entamoeba invadens
FETLYIKDCLKQIEIFARSLNM

SEQ ID NO: 2936070 - protein, 17 aa, Entamoeba invadens
FETMKVKMLLLVVPTFQ

SEQ ID NO: 2936071 - protein, 17 aa, Entamoeba invadens
FETPNLLRNRAMQEHQI

SEQ ID NO: 2936072 - protein, 23 aa, Entamoeba invadens
FETRLLWKDGPVFQSLNYENSYA

SEQ ID NO: 2936073 - protein, 17 aa, Entamoeba invadens
FETRSFIDTEEFEQLPF

SEQ ID NO: 2936074 - protein, 18 aa, Entamoeba invadens
FETSLSFLAKACMSGQID

SEQ ID NO: 2936075 - protein, 17 aa, Entamoeba invadens
FETVGAVTKCIIIREPS

SEQ ID NO: 2936076 - protein, 17 aa, Entamoeba invadens
FETYDYVISNVFDTTWN

SEQ ID NO: 2936077 - protein, 17 aa, Entamoeba invadens
FETYTKMGVVFPQLQIP

SEQ ID NO: 2936078 - protein, 24 aa, Entamoeba invadens
FEVASELFQMWELQPFYLDEDKPL

SEQ ID NO: 2936079 - protein, 19 aa, Entamoeba invadens
FEVFLTPYCTFNLEDKIAI

SEQ ID NO: 2936080 - protein, 21 aa, Entamoeba invadens
FEVGSILAAINLDFLKRQDDR

SEQ ID NO: 2936081 - protein, 23 aa, Entamoeba invadens
FEVIQCEFVKMGVKDGACVTVVF

SEQ ID NO: 2936082 - protein, 17 aa, Entamoeba invadens
FEVKAKLPGNAIGNHLT

SEQ ID NO: 2936083 - protein, 22 aa, Entamoeba invadens
FEVLQIKTLRKVYIIFTTTTLQ

SEQ ID NO: 2936084 - protein, 17 aa, Entamoeba invadens
FEVPENKVEVGVTGLVR

SEQ ID NO: 2936085 - protein, 21 aa, Entamoeba invadens
FEVPSKYFSDAVKVALNINYT

SEQ ID NO: 2936086 - protein, 25 aa, Entamoeba invadens
FEVSELEFEISRLKLLEKDKRNELN

SEQ ID NO: 2936087 - protein, 19 aa, Entamoeba invadens
FEVTESYGSPVLLTEPALN

SEQ ID NO: 2936088 - protein, 21 aa, Entamoeba invadens
FEVVDSLKVIPLAWKPETPNL

SEQ ID NO: 2936089 - protein, 19 aa, Entamoeba invadens
FEVYYKNFTYIFATNNNNC

SEQ ID NO: 2936090 - protein, 17 aa, Entamoeba invadens
FEYDFSAPYSFIKLENT

SEQ ID NO: 2936091 - protein, 18 aa, Entamoeba invadens
FEYELEFIQCLANPYYLQ

SEQ ID NO: 2936092 - protein, 17 aa, Entamoeba invadens
FEYIKVNISTLFRSNPY

SEQ ID NO: 2936093 - protein, 22 aa, Entamoeba invadens
FEYKTKWLEMFYLKTMPIEKSF

SEQ ID NO: 2936094 - protein, 19 aa, Entamoeba invadens
FEYLLDAFGHFFKSKPLMK

SEQ ID NO: 2936095 - protein, 20 aa, Entamoeba invadens
FEYNNCRVILGYAKSLCTLK

SEQ ID NO: 2936096 - protein, 24 aa, Entamoeba invadens
FEYQMKWAEWFNSVVYCAISKLEI

SEQ ID NO: 2936097 - protein, 26 aa, Entamoeba invadens
FEYSKEVLKSIFGALKYEMKGTDNNV

SEQ ID NO: 2936098 - protein, 19 aa, Entamoeba invadens
FEYVERLELFESYIDILLN

SEQ ID NO: 2936099 - protein, 36 aa, Entamoeba invadens
FEYYSELLLILKLNFLRMSAIFEVSKTTLVKGVLEG

SEQ ID NO: 2936100 - protein, 20 aa, Entamoeba invadens
FFADCKYLKLLDGMSDLTNL

SEQ ID NO: 2936101 - protein, 19 aa, Entamoeba invadens
FFAEGCTLRSLPTEYYNHR

SEQ ID NO: 2936102 - protein, 19 aa, Entamoeba invadens
FFAGCERLNELVGFENLLK

SEQ ID NO: 2936103 - protein, 21 aa, Entamoeba invadens
FFAIMRNRITSSFVDLFNFLK

SEQ ID NO: 2936104 - protein, 27 aa, Entamoeba invadens
FFAKKRQPLSLPFVLLFLTNLIGDEEH

SEQ ID NO: 2936105 - protein, 24 aa, Entamoeba invadens
FFANEDCLHMFAVFDDDKEGLFAV

SEQ ID NO: 2936106 - protein, 19 aa, Entamoeba invadens
FFAPVKMRVHNGLFEIDPR

SEQ ID NO: 2936107 - protein, 18 aa, Entamoeba invadens
FFASIKFALIRNMTPPIV

SEQ ID NO: 2936108 - protein, 26 aa, Entamoeba invadens
FFATWCGPCKSIAPVFEDLANKNPKV

SEQ ID NO: 2936109 - protein, 19 aa, Entamoeba invadens
FFAVNSFKEMEFVVLKKNI

SEQ ID NO: 2936110 - protein, 17 aa, Entamoeba invadens
FFCCSSLEYIDIPDNVW

SEQ ID NO: 2936111 - protein, 19 aa, Entamoeba invadens
FFCNVPMTICPFVVDTFTS

SEQ ID NO: 2936112 - protein, 26 aa, Entamoeba invadens
FFCTLKLSHYLAAFGCQLLGTMRMNR

SEQ ID NO: 2936113 - protein, 17 aa, Entamoeba invadens
FFDCKNGSLGVLRQLYL

SEQ ID NO: 2936114 - protein, 30 aa, Entamoeba invadens
FFDEIKIEIPFPLLQSHYLLFDVVELHDGN

SEQ ID NO: 2936115 - protein, 18 aa, Entamoeba invadens
FFDEVIEFSRNVNATLLN

SEQ ID NO: 2936116 - protein, 20 aa, Entamoeba invadens
FFDFTVKTAERFYTQHNFFG

SEQ ID NO: 2936117 - protein, 21 aa, Entamoeba invadens
FFDIKKGYEKYDFKMNNNTLS

SEQ ID NO: 2936118 - protein, 24 aa, Entamoeba invadens
FFDILRLAIFMSVQVKKDKPFLYV

SEQ ID NO: 2936119 - protein, 23 aa, Entamoeba invadens
FFDKEFTQYIPLQIYELLQTLGA

SEQ ID NO: 2936120 - protein, 32 aa, Entamoeba invadens
FFDLKEGMEPFVFRYERPFKIIFGGKLQIGDL

SEQ ID NO: 2936121 - protein, 18 aa, Entamoeba invadens
FFDLKFTDLPVFIQEKIK

SEQ ID NO: 2936122 - protein, 18 aa, Entamoeba invadens
FFDNYPLSLALNAVLHLQ

SEQ ID NO: 2936123 - protein, 24 aa, Entamoeba invadens
FFDQKSLEWFLRKFTVDTVDLNYL

SEQ ID NO: 2936124 - protein, 19 aa, Entamoeba invadens
FFDYKLRMLDQIALFLNME

SEQ ID NO: 2936125 - protein, 28 aa, Entamoeba invadens
FFEDFIKCGLLDFYVKIVQNFIPDRMPN

SEQ ID NO: 2936126 - protein, 18 aa, Entamoeba invadens
FFEENLKNFKNCKSSKDS

SEQ ID NO: 2936127 - protein, 20 aa, Entamoeba invadens
FFEFLKKTELNNEMIVCSYI

SEQ ID NO: 2936128 - protein, 18 aa, Entamoeba invadens
FFEIDKPKAVQIFSNVKS

SEQ ID NO: 2936129 - protein, 20 aa, Entamoeba invadens
FFEINWTNHVAICIEALTVD

SEQ ID NO: 2936130 - protein, 23 aa, Entamoeba invadens
FFEKYKEKIFFVAKTLQKMEYET

SEQ ID NO: 2936131 - protein, 20 aa, Entamoeba invadens
FFERYRWIMHDVVLITKSGE

SEQ ID NO: 2936132 - protein, 21 aa, Entamoeba invadens
FFERYRWIMHDVVLMQKNGET

SEQ ID NO: 2936133 - protein, 30 aa, Entamoeba invadens
FFETFKQLRCGLELNLLYGKQSANSRYSRY

SEQ ID NO: 2936134 - protein, 30 aa, Entamoeba invadens
FFETMRLTFEFIARWLLMLFKREFKRNLVL

SEQ ID NO: 2936135 - protein, 21 aa, Entamoeba invadens
FFETRNGILFDEDVAINECYG

SEQ ID NO: 2936136 - protein, 25 aa, Entamoeba invadens
FFFETICPSTLYKIALSDTGKVFRL

SEQ ID NO: 2936137 - protein, 17 aa, Entamoeba invadens
FFFPSPSCYVKCGESTV

SEQ ID NO: 2936138 - protein, 19 aa, Entamoeba invadens
FFFTPKELCKLCVEEALLP

SEQ ID NO: 2936139 - protein, 20 aa, Entamoeba invadens
FFGDSYGFVYGWNAQQQGAS

SEQ ID NO: 2936140 - protein, 17 aa, Entamoeba invadens
FFGNGYREYSIRDVIFY

SEQ ID NO: 2936141 - protein, 17 aa, Entamoeba invadens
FFIAQPFSREDYDMDTY

SEQ ID NO: 2936142 - protein, 25 aa, Entamoeba invadens
FFIDCLHCIYQSRARVNISLLLSNI

SEQ ID NO: 2936143 - protein, 23 aa, Entamoeba invadens
FFIENTGRFLAFNDYFRNSLNRQ

SEQ ID NO: 2936144 - protein, 17 aa, Entamoeba invadens
FFIETYLQRKPCRKEVA

SEQ ID NO: 2936145 - protein, 22 aa, Entamoeba invadens
FFIGRCCVNLVTALQYLSSEGI

SEQ ID NO: 2936146 - protein, 18 aa, Entamoeba invadens
FFIISYLRDFPFMRMNKE

SEQ ID NO: 2936147 - protein, 24 aa, Entamoeba invadens
FFIKNCICTTLLIEQHIDFLPNIK

SEQ ID NO: 2936148 - protein, 20 aa, Entamoeba invadens
FFIMNCFEIRMKKSNLETFE

SEQ ID NO: 2936149 - protein, 19 aa, Entamoeba invadens
FFIRLNKLYLGLLNNQLNG

SEQ ID NO: 2936150 - protein, 25 aa, Entamoeba invadens
FFIYNRYKFGVLYAGIGQTKEREFY

SEQ ID NO: 2936151 - protein, 18 aa, Entamoeba invadens
FFKAFKRSLVPPTVTQTY

SEQ ID NO: 2936152 - protein, 17 aa, Entamoeba invadens
FFKCGSLRSVILPSSVT

SEQ ID NO: 2936153 - protein, 26 aa, Entamoeba invadens
FFKGFFKKDFQTISSFFPDIVEHKEN

SEQ ID NO: 2936154 - protein, 17 aa, Entamoeba invadens
FFKHSNFSSFVRQLNIY

SEQ ID NO: 2936155 - protein, 17 aa, Entamoeba invadens
FFKKVLEQFLKLDTKKV

SEQ ID NO: 2936156 - protein, 33 aa, Entamoeba invadens
FFKQCWQFKYIQPIPIESMFSVFDMSSVKILGK

SEQ ID NO: 2936157 - protein, 26 aa, Entamoeba invadens
FFKSSSWSLKCEVCINDDKEENLGYP

SEQ ID NO: 2936158 - protein, 17 aa, Entamoeba invadens
FFKTNIIKFNNFSTKTC

SEQ ID NO: 2936159 - protein, 22 aa, Entamoeba invadens
FFKVVKKDALFKEVMEKNLGNL

SEQ ID NO: 2936160 - protein, 18 aa, Entamoeba invadens
FFLCCYSDGRCYFIDENM

SEQ ID NO: 2936161 - protein, 17 aa, Entamoeba invadens
FFLCHGGLSPSMKYVGD

SEQ ID NO: 2936162 - protein, 21 aa, Entamoeba invadens
FFLHIERFVCNSLAFHVTINP

SEQ ID NO: 2936163 - protein, 22 aa, Entamoeba invadens
FFLKGKCKLISYFNEKKKLVLV

SEQ ID NO: 2936164 - protein, 20 aa, Entamoeba invadens
FFLKGKRLVEVEVKIISVPG

SEQ ID NO: 2936165 - protein, 25 aa, Entamoeba invadens
FFLRATECGNGFVIVIDDIKGNRFG

SEQ ID NO: 2936166 - protein, 17 aa, Entamoeba invadens
FFLSTLRTMKLANDELL

SEQ ID NO: 2936167 - protein, 17 aa, Entamoeba invadens
FFLTFKRLLETKEVQYH

SEQ ID NO: 2936168 - protein, 18 aa, Entamoeba invadens
FFLYKNTNLHSTMFNVWF

SEQ ID NO: 2936169 - protein, 24 aa, Entamoeba invadens
FFMHWCSYVRDAFHVLLLYRMTLG

SEQ ID NO: 2936170 - protein, 30 aa, Entamoeba invadens
FFMKQSYDPKVWGKKQCPPPFPLPTDAKEF

SEQ ID NO: 2936171 - protein, 24 aa, Entamoeba invadens
FFMKRELECPFLITKRDQKKTNFS

SEQ ID NO: 2936172 - protein, 17 aa, Entamoeba invadens
FFNFRQECCFKYGDQIY

SEQ ID NO: 2936173 - protein, 20 aa, Entamoeba invadens
FFNKVEFIDNLIIDYEINVN

SEQ ID NO: 2936174 - protein, 26 aa, Entamoeba invadens
FFNQNLKVIGGFAFYNCTGLTAIELP

SEQ ID NO: 2936175 - protein, 17 aa, Entamoeba invadens
FFNTYKPDYALFQQSYA

SEQ ID NO: 2936176 - protein, 20 aa, Entamoeba invadens
FFNYPRKFPIYFIVHCALNS

SEQ ID NO: 2936177 - protein, 18 aa, Entamoeba invadens
FFPETGVITAPDFDVTVN

SEQ ID NO: 2936178 - protein, 25 aa, Entamoeba invadens
FFPKELLKPYVMYFVNGLLVFCNAQ

SEQ ID NO: 2936179 - protein, 22 aa, Entamoeba invadens
FFPRGDIPLGTNLDFSNFYNVT

SEQ ID NO: 2936180 - protein, 25 aa, Entamoeba invadens
FFPRLKSKCLQLICSYLSKKDILSL

SEQ ID NO: 2936181 - protein, 25 aa, Entamoeba invadens
FFPYHYTPEFEIFSKYLVTAQIFSS

SEQ ID NO: 2936182 - protein, 21 aa, Entamoeba invadens
FFQEFYNTFVYDNFEKLKQLA

SEQ ID NO: 2936183 - protein, 25 aa, Entamoeba invadens
FFQILGEKCFSDFHYLKTIDLPPTI

SEQ ID NO: 2936184 - protein, 24 aa, Entamoeba invadens
FFQTCKQVRFFFETFKQLRCGLEL

SEQ ID NO: 2936185 - protein, 18 aa, Entamoeba invadens
FFQTESFWSQVIQTLLQN

SEQ ID NO: 2936186 - protein, 19 aa, Entamoeba invadens
FFREFTRPLATSFDGIRHD

SEQ ID NO: 2936187 - protein, 18 aa, Entamoeba invadens
FFREVSLLQTLQHKNIIK

SEQ ID NO: 2936188 - protein, 20 aa, Entamoeba invadens
FFRKEARVVMIGLDNAGKTT

SEQ ID NO: 2936189 - protein, 18 aa, Entamoeba invadens
FFRVDKRALYSVLVLNKF

SEQ ID NO: 2936190 - protein, 21 aa, Entamoeba invadens
FFSCTVNKFSLVFGDTDENVS

SEQ ID NO: 2936191 - protein, 19 aa, Entamoeba invadens
FFSDCPVEKVLQKVAKKGE

SEQ ID NO: 2936192 - protein, 17 aa, Entamoeba invadens
FFSDILKIIPLNDSNSL

SEQ ID NO: 2936193 - protein, 17 aa, Entamoeba invadens
FFSFESINRALTPKKSS

SEQ ID NO: 2936194 - protein, 25 aa, Entamoeba invadens
FFSKECIEKCLFLSPVVDFNYVIEG

SEQ ID NO: 2936195 - protein, 19 aa, Entamoeba invadens
FFSKELLLFDEAKRAGAPP

SEQ ID NO: 2936196 - protein, 20 aa, Entamoeba invadens
FFSKFESMLLKAYQTTFKLF

SEQ ID NO: 2936197 - protein, 18 aa, Entamoeba invadens
FFSKIFWYQVDYQTYKIF

SEQ ID NO: 2936198 - protein, 18 aa, Entamoeba invadens
FFSTFQFYTTPTVVLSKL

SEQ ID NO: 2936199 - protein, 25 aa, Entamoeba invadens
FFSVCNVPSFKVFVFYSQDMNAPLT

SEQ ID NO: 2936200 - protein, 17 aa, Entamoeba invadens
FFTAEKVKEFFTVTFNM

SEQ ID NO: 2936201 - protein, 18 aa, Entamoeba invadens
FFTGSPTFEISKLIIVQW

SEQ ID NO: 2936202 - protein, 19 aa, Entamoeba invadens
FFTGTDFSKPTFDFGNIFN

SEQ ID NO: 2936203 - protein, 18 aa, Entamoeba invadens
FFTHLVVEACSKTVRGGS

SEQ ID NO: 2936204 - protein, 18 aa, Entamoeba invadens
FFTKTAQVGYNFKSQTEK

SEQ ID NO: 2936205 - protein, 24 aa, Entamoeba invadens
FFTTFFYSFCKTFFNEFYSQVIEF

SEQ ID NO: 2936206 - protein, 25 aa, Entamoeba invadens
FFTYQRYKFGVLYGSPGQTKEMDFF

SEQ ID NO: 2936207 - protein, 17 aa, Entamoeba invadens
FFVCLEKDVLSFCFQSK

SEQ ID NO: 2936208 - protein, 26 aa, Entamoeba invadens
FFVKITLRIPKYVPMLRHLLNDTTRV

SEQ ID NO: 2936209 - protein, 19 aa, Entamoeba invadens
FFVLCDYLFNKYETMEKLR

SEQ ID NO: 2936210 - protein, 19 aa, Entamoeba invadens
FFVRDEKCCIFSLKREGIV

SEQ ID NO: 2936211 - protein, 19 aa, Entamoeba invadens
FFVWKRYTLPNNKIVSSQT

SEQ ID NO: 2936212 - protein, 17 aa, Entamoeba invadens
FFWCCALKTFEISELEN

SEQ ID NO: 2936213 - protein, 19 aa, Entamoeba invadens
FFWVNRKFLPLIAGEQSVK

SEQ ID NO: 2936214 - protein, 19 aa, Entamoeba invadens
FFYGEGRVGIISGGIQTLA

SEQ ID NO: 2936215 - protein, 19 aa, Entamoeba invadens
FFYLRNVTNGFILPETICP

SEQ ID NO: 2936216 - protein, 17 aa, Entamoeba invadens
FFYPVSYDKFLEEKKHF

SEQ ID NO: 2936217 - protein, 17 aa, Entamoeba invadens
FGAANIFGKDEGEQKKV

SEQ ID NO: 2936218 - protein, 24 aa, Entamoeba invadens
FGADVLDWNVSFDEFVPLSKPELQ

SEQ ID NO: 2936219 - protein, 18 aa, Entamoeba invadens
FGAFCGAKNLVKVSLPLN

SEQ ID NO: 2936220 - protein, 21 aa, Entamoeba invadens
FGAFSKFILKTAYNVDTFHDR

SEQ ID NO: 2936221 - protein, 22 aa, Entamoeba invadens
FGAGQIEYVVHFSIFKKSGQLL

SEQ ID NO: 2936222 - protein, 19 aa, Entamoeba invadens
FGAKEHFINAILCQMCNDD

SEQ ID NO: 2936223 - protein, 26 aa, Entamoeba invadens
FGAKKGLSFCFIKFSMREDMGIVINR

SEQ ID NO: 2936224 - protein, 24 aa, Entamoeba invadens
FGAPEKRALPFGFQPTTFKPLSQT

SEQ ID NO: 2936225 - protein, 19 aa, Entamoeba invadens
FGATNIYECLREVGQKISQ

SEQ ID NO: 2936226 - protein, 17 aa, Entamoeba invadens
FGAYNYKFRCEDVNGKD

SEQ ID NO: 2936227 - protein, 18 aa, Entamoeba invadens
FGCEVLFYLLALKLTYPE

SEQ ID NO: 2936228 - protein, 21 aa, Entamoeba invadens
FGCGPALHYCNVLCERKKATV

SEQ ID NO: 2936229 - protein, 26 aa, Entamoeba invadens
FGCIAAELILGIPIFPGSSEYNQLER

SEQ ID NO: 2936230 - protein, 26 aa, Entamoeba invadens
FGCIIAEMMIGIPIFPGESEYNQLVK

SEQ ID NO: 2936231 - protein, 26 aa, Entamoeba invadens
FGCIVAELLLGIPIFPGENEFNQIYK

SEQ ID NO: 2936232 - protein, 25 aa, Entamoeba invadens
FGCVAAELFLGIPLFPGENEYNQLA

SEQ ID NO: 2936233 - protein, 25 aa, Entamoeba invadens
FGCVAAELFLGIPLFPGENEYNQLL

SEQ ID NO: 2936234 - protein, 17 aa, Entamoeba invadens
FGDAKWLECSALDGTGI

SEQ ID NO: 2936235 - protein, 17 aa, Entamoeba invadens
FGDCFEVAMNREKYPEK

SEQ ID NO: 2936236 - protein, 26 aa, Entamoeba invadens
FGDEKSKMCPFGFCNISLEKFEKLVS

SEQ ID NO: 2936237 - protein, 17 aa, Entamoeba invadens
FGDFLAVHVDPNVIEGL

SEQ ID NO: 2936238 - protein, 20 aa, Entamoeba invadens
FGDGCFKCCSSLNSILIPSS

SEQ ID NO: 2936239 - protein, 24 aa, Entamoeba invadens
FGDVDAFANFFRKTMYDIIELNKT

SEQ ID NO: 2936240 - protein, 22 aa, Entamoeba invadens
FGEAILKELFLSMNNDIGGEYL

SEQ ID NO: 2936241 - protein, 19 aa, Entamoeba invadens
FGEALLRIDSTVEIETITP

SEQ ID NO: 2936242 - protein, 19 aa, Entamoeba invadens
FGEAVYRANKQPIYFTIED

SEQ ID NO: 2936243 - protein, 26 aa, Entamoeba invadens
FGECVLKIGSIYGFLLFSCDKERVFE

SEQ ID NO: 2936244 - protein, 17 aa, Entamoeba invadens
FGEEEWAFHGSSQDAIQ

SEQ ID NO: 2936245 - protein, 31 aa, Entamoeba invadens
FGEEFELAIKIFKTSILIFKDRERYVEGDYR

SEQ ID NO: 2936246 - protein, 19 aa, Entamoeba invadens
FGEEFYKFRRSLAGVCGKE

SEQ ID NO: 2936247 - protein, 17 aa, Entamoeba invadens
FGEFEFFHFLVQNLVAL

SEQ ID NO: 2936248 - protein, 18 aa, Entamoeba invadens
FGEFKGRINMSVKQDTVE

SEQ ID NO: 2936249 - protein, 18 aa, Entamoeba invadens
FGEFKIFHFLVQNLVALV

SEQ ID NO: 2936250 - protein, 18 aa, Entamoeba invadens
FGELCAFTTQDTVGVVNY

SEQ ID NO: 2936251 - protein, 23 aa, Entamoeba invadens
FGENMTVLCVMNGVIDNTPYDFG

SEQ ID NO: 2936252 - protein, 18 aa, Entamoeba invadens
FGEPEETFEFDISSFPIG

SEQ ID NO: 2936253 - protein, 18 aa, Entamoeba invadens
FGETLVPDQMGNWIEVSN

SEQ ID NO: 2936254 - protein, 17 aa, Entamoeba invadens
FGFCCDIVIPDNVTTLG

SEQ ID NO: 2936255 - protein, 25 aa, Entamoeba invadens
FGFEHNFKPFLALMTQLQKKTFPCV

SEQ ID NO: 2936256 - protein, 23 aa, Entamoeba invadens
FGFFNCGFLSFKKIKGEKKVDCI

SEQ ID NO: 2936257 - protein, 19 aa, Entamoeba invadens
FGFGQTRPMFFQNQHTQLF

SEQ ID NO: 2936258 - protein, 26 aa, Entamoeba invadens
FGFLIYRYAMEKHIKLTFVQPKQIGT

SEQ ID NO: 2936259 - protein, 19 aa, Entamoeba invadens
FGFPEHQPLALTVFGASKY

SEQ ID NO: 2936260 - protein, 19 aa, Entamoeba invadens
FGGFCTAAPGLHDDNHTSV

SEQ ID NO: 2936261 - protein, 20 aa, Entamoeba invadens
FGGFCTAAPGLHDDNQTSVG

SEQ ID NO: 2936262 - protein, 36 aa, Entamoeba invadens
FGGGMRMKKCCAAPMAPRMAAPMMMCDSESLEQSRA

SEQ ID NO: 2936263 - protein, 26 aa, Entamoeba invadens
FGGIKKRITIFMARLTFLIKAVEYSV

SEQ ID NO: 2936264 - protein, 17 aa, Entamoeba invadens
FGGIPLHSIGNQIINPY

SEQ ID NO: 2936265 - protein, 20 aa, Entamoeba invadens
FGGKNKLFIDDKFKVSRIKV

SEQ ID NO: 2936266 - protein, 23 aa, Entamoeba invadens
FGGMKVTPPAGFKISTTANAPQI

SEQ ID NO: 2936267 - protein, 25 aa, Entamoeba invadens
FGHFLGNVIKLGFYKKESAPFVLTV

SEQ ID NO: 2936268 - protein, 20 aa, Entamoeba invadens
FGHRFKFRSGLGAKFDIDVG

SEQ ID NO: 2936269 - protein, 20 aa, Entamoeba invadens
FGIDILKFQKVHSIDEGAFF

SEQ ID NO: 2936270 - protein, 18 aa, Entamoeba invadens
FGIDVCMPEETYVKSLAI

SEQ ID NO: 2936271 - protein, 22 aa, Entamoeba invadens
FGIGIFKNARVELVELPNSLSE

SEQ ID NO: 2936272 - protein, 17 aa, Entamoeba invadens
FGIGRIVSALTVNFTQT

SEQ ID NO: 2936273 - protein, 18 aa, Entamoeba invadens
FGILDYGLRWRQLIHGGV

SEQ ID NO: 2936274 - protein, 19 aa, Entamoeba invadens
FGIRDCFRGIDIVLQMIDK

SEQ ID NO: 2936275 - protein, 17 aa, Entamoeba invadens
FGITFLEIMKWEDAFPK

SEQ ID NO: 2936276 - protein, 23 aa, Entamoeba invadens
FGITMYEVFGWCEAYIIENFKFQ

SEQ ID NO: 2936277 - protein, 29 aa, Entamoeba invadens
FGITMYEVFGWCEAYPFTTFKFPWKIAEF

SEQ ID NO: 2936278 - protein, 26 aa, Entamoeba invadens
FGIVEEMSHLFAVFLCPRYNADTNKV

SEQ ID NO: 2936279 - protein, 26 aa, Entamoeba invadens
FGIYSKCFFELKIAGAVVTQDSKWPK

SEQ ID NO: 2936280 - protein, 24 aa, Entamoeba invadens
FGKAEPLMSSFYLGYNMLLNLMKL

SEQ ID NO: 2936281 - protein, 19 aa, Entamoeba invadens
FGKAFRWEEIRCENEITEE

SEQ ID NO: 2936282 - protein, 19 aa, Entamoeba invadens
FGKDIKEAYSYFERYESVA

SEQ ID NO: 2936283 - protein, 17 aa, Entamoeba invadens
FGKEHFEEIAQKFKENA

SEQ ID NO: 2936284 - protein, 17 aa, Entamoeba invadens
FGKEIVKSVLVSLSEKF

SEQ ID NO: 2936285 - protein, 19 aa, Entamoeba invadens
FGKGVFKNAGVQLVKLPNS

SEQ ID NO: 2936286 - protein, 19 aa, Entamoeba invadens
FGKKIGGLFDKTSKVIKSV

SEQ ID NO: 2936287 - protein, 18 aa, Entamoeba invadens
FGKKPKKGRSFSVPDETD

SEQ ID NO: 2936288 - protein, 21 aa, Entamoeba invadens
FGKNNWRSVEEVVMTRTRKQC

SEQ ID NO: 2936289 - protein, 18 aa, Entamoeba invadens
FGKRCFANCYSLESVFCE

SEQ ID NO: 2936290 - protein, 17 aa, Entamoeba invadens
FGLFPIIFIGKGYGLYR

SEQ ID NO: 2936291 - protein, 22 aa, Entamoeba invadens
FGLKGVCAYISHAYLLGEKNTD

SEQ ID NO: 2936292 - protein, 24 aa, Entamoeba invadens
FGLKGVCAYISHAYLLGEKNTEIN

SEQ ID NO: 2936293 - protein, 24 aa, Entamoeba invadens
FGLKGVCTYISHAYLLGEKNTEIN

SEQ ID NO: 2936294 - protein, 19 aa, Entamoeba invadens
FGLLNVKNVTIWNCTHINY

SEQ ID NO: 2936295 - protein, 20 aa, Entamoeba invadens
FGLSCLLCDAVNVESVTDLF

SEQ ID NO: 2936296 - protein, 20 aa, Entamoeba invadens
FGLSFARTSMGTNFTKTDVP

SEQ ID NO: 2936297 - protein, 21 aa, Entamoeba invadens
FGLVYKALWLGTTEVAMKGIS

SEQ ID NO: 2936298 - protein, 17 aa, Entamoeba invadens
FGMNDFWDVVANVVDES

SEQ ID NO: 2936299 - protein, 18 aa, Entamoeba invadens
FGMVLWDTVFETIAMEYP

SEQ ID NO: 2936300 - protein, 24 aa, Entamoeba invadens
FGNASERWYIFNLPSQVDDLIDKL

SEQ ID NO: 2936301 - protein, 20 aa, Entamoeba invadens
FGNCHPIKIIVSNYKGKKIN

SEQ ID NO: 2936302 - protein, 32 aa, Entamoeba invadens
FGNDFMAKFNGAMCNLPLLEHLTFIDSPGILS

SEQ ID NO: 2936303 - protein, 31 aa, Entamoeba invadens; identical to SEQ ID NO: 2481329

SEQ ID NO: 2936304 - protein, 19 aa, Entamoeba invadens
FGNDLKISLTYSNKTSSLS

SEQ ID NO: 2936305 - protein, 25 aa, Entamoeba invadens
FGNEPFLGFVRLRIDYNKEETTQSP

SEQ ID NO: 2936306 - protein, 18 aa, Entamoeba invadens
FGNGFLIKFNKNHVYNGM

SEQ ID NO: 2936307 - protein, 17 aa, Entamoeba invadens
FGNIGMPTLNFGTLNIG

SEQ ID NO: 2936308 - protein, 17 aa, Entamoeba invadens
FGNLKKINITAGNIKTV

SEQ ID NO: 2936309 - protein, 18 aa, Entamoeba invadens
FGNLRAGDRQFLLHEGSG

SEQ ID NO: 2936310 - protein, 23 aa, Entamoeba invadens
FGNNVICTIDLSSNFTIKSADIP

SEQ ID NO: 2936311 - protein, 21 aa, Entamoeba invadens
FGNRFPFCVIFNEDSENKKQN

SEQ ID NO: 2936312 - protein, 27 aa, Entamoeba invadens
FGNRSLMGWQNVRACVFMAKVLIKRTR

SEQ ID NO: 2936313 - protein, 17 aa, Entamoeba invadens
FGNSALCGVGITHINFN

SEQ ID NO: 2936314 - protein, 19 aa, Entamoeba invadens
FGNSCFFDSLLNQKTLKIP

SEQ ID NO: 2936315 - protein, 19 aa, Entamoeba invadens
FGNSSCRVLGQGPTLAQFG

SEQ ID NO: 2936316 - protein, 25 aa, Entamoeba invadens
FGNVFGGFAKRPIVNLADTTRYTEN

SEQ ID NO: 2936317 - protein, 18 aa, Entamoeba invadens
FGNYCFCRCNSLSAITLG

SEQ ID NO: 2936318 - protein, 24 aa, Entamoeba invadens
FGPKTLIAMKHFIDEFYAIFDSRA

SEQ ID NO: 2936319 - protein, 18 aa, Entamoeba invadens
FGQIEFQENTVFFMEYFM

SEQ ID NO: 2936320 - protein, 17 aa, Entamoeba invadens
FGQLYFIEADQAVKERA

SEQ ID NO: 2936321 - protein, 17 aa, Entamoeba invadens
FGQYSPIFFQFLDCVHI

SEQ ID NO: 2936322 - protein, 24 aa, Entamoeba invadens
FGRDLCYFELLFEVCFTVELKTDY

SEQ ID NO: 2936323 - protein, 17 aa, Entamoeba invadens
FGRDLDFTVGRSLARNN

SEQ ID NO: 2936324 - protein, 27 aa, Entamoeba invadens
FGRHKIKFSAAFSFKIQKMMSDLQVSQ

SEQ ID NO: 2936325 - protein, 17 aa, Entamoeba invadens
FGRLANVGISFVGECHG

SEQ ID NO: 2936326 - protein, 24 aa, Entamoeba invadens
FGRVQPKCFSLVYEKPQIRAKPMH

SEQ ID NO: 2936327 - protein, 25 aa, Entamoeba invadens
FGSACMDEVPVHVGMEEDDTKKEEK

SEQ ID NO: 2936328 - protein, 17 aa, Entamoeba invadens
FGSAKGRDQQLLDQLMK

SEQ ID NO: 2936329 - protein, 17 aa, Entamoeba invadens
FGSAVAITPGIQGTFSS

SEQ ID NO: 2936330 - protein, 17 aa, Entamoeba invadens
FGSFNTKRMPAHMTEGF

SEQ ID NO: 2936331 - protein, 26 aa, Entamoeba invadens
FGSGCTRTKFNSFISVLFDQLTKFGE

SEQ ID NO: 2936332 - protein, 22 aa, Entamoeba invadens
FGSHNWPTWGNKNIVEYYEKQR

SEQ ID NO: 2936333 - protein, 26 aa, Entamoeba invadens
FGSHNWPVWGNKEIVEFWEKQRDLYK

SEQ ID NO: 2936334 - protein, 19 aa, Entamoeba invadens
FGSNIETWFYLKGGDDGNS

SEQ ID NO: 2936335 - protein, 18 aa, Entamoeba invadens
FGSPLFLSNVCFNLSSQH

SEQ ID NO: 2936336 - protein, 17 aa, Entamoeba invadens
FGSQAVRRGTEKQYLSP

SEQ ID NO: 2936337 - protein, 18 aa, Entamoeba invadens
FGSQDMKVVEKIHAGRRE

SEQ ID NO: 2936338 - protein, 17 aa, Entamoeba invadens
FGSQWGLAIESFLDGLT

SEQ ID NO: 2936339 - protein, 21 aa, Entamoeba invadens
FGSSISLKAVVSGECVDYMEI

SEQ ID NO: 2936340 - protein, 25 aa, Entamoeba invadens
FGSSNFLACGSYDGYLSVVGGDEME

SEQ ID NO: 2936341 - protein, 17 aa, Entamoeba invadens
FGSTEAEFVRFMKEKKE

SEQ ID NO: 2936342 - protein, 25 aa, Entamoeba invadens
FGTFPRQGFNPVIPYTSLIKNYIEK

SEQ ID NO: 2936343 - protein, 20 aa, Entamoeba invadens
FGTKATIVMPEFAPTAKVMA

SEQ ID NO: 2936344 - protein, 25 aa, Entamoeba invadens
FGTNERWDGIFLAIYLTRRKELMRV

SEQ ID NO: 2936345 - protein, 19 aa, Entamoeba invadens
FGTPEDKTSFCDLACLALI

SEQ ID NO: 2936346 - protein, 17 aa, Entamoeba invadens
FGTQCFYKNTSLQEIHL

SEQ ID NO: 2936347 - protein, 18 aa, Entamoeba invadens
FGTQCFYKNTSLQEIYLD

SEQ ID NO: 2936348 - protein, 24 aa, Entamoeba invadens
FGTTNGCVCCFELDGPTKVMFKMA

SEQ ID NO: 2936349 - protein, 18 aa, Entamoeba invadens
FGTVRRVRHNKSGVYGAM

SEQ ID NO: 2936350 - protein, 24 aa, Entamoeba invadens
FGTYCVDPPLLINGQVLFASKFTV

SEQ ID NO: 2936351 - protein, 17 aa, Entamoeba invadens
FGVDKLKAIVLPDTISA

SEQ ID NO: 2936352 - protein, 17 aa, Entamoeba invadens
FGVDLEAILPIPKVKTY

SEQ ID NO: 2936353 - protein, 24 aa, Entamoeba invadens
FGVFCIADGCGMGKNPAASAHVAC

SEQ ID NO: 2936354 - protein, 17 aa, Entamoeba invadens
FGVGPSFDLNLISDDSV

SEQ ID NO: 2936355 - protein, 17 aa, Entamoeba invadens
FGVGVIGIIRALPKTHY

SEQ ID NO: 2936356 - protein, 19 aa, Entamoeba invadens
FGVGVIGIIRALPKTHYAR

SEQ ID NO: 2936357 - protein, 17 aa, Entamoeba invadens
FGVGVIGIIRTLPKTHY

SEQ ID NO: 2936358 - protein, 23 aa, Entamoeba invadens
FGVHIPRSLSIALIGASCFEKNY

SEQ ID NO: 2936359 - protein, 22 aa, Entamoeba invadens
FGVILYRMITGVVPRVDENCVI

SEQ ID NO: 2936360 - protein, 17 aa, Entamoeba invadens
FGVKMAQFEIHIVAFLE

SEQ ID NO: 2936361 - protein, 17 aa, Entamoeba invadens
FGVLCFKGCSSLTSLHC

SEQ ID NO: 2936362 - protein, 35 aa, Entamoeba invadens
FGVPPNSLIFRDMIYIVLSCCGRYKGKALTGPPII

SEQ ID NO: 2936363 - protein, 18 aa, Entamoeba invadens
FGVPSLYLNDMVIQCVIK

SEQ ID NO: 2936364 - protein, 18 aa, Entamoeba invadens
FGVSCFDECINLKNINIP

SEQ ID NO: 2936365 - protein, 18 aa, Entamoeba invadens
FGVSFIKNPKSVDAESLQ

SEQ ID NO: 2936366 - protein, 25 aa, Entamoeba invadens
FGVTLYEVFGWSEAYQNDIFKFPWK

SEQ ID NO: 2936367 - protein, 39 aa, Entamoeba invadens
FGVTMYEVFGWTNAYPLDAFKFPWKIAEFVMSGKQLQRK

SEQ ID NO: 2936368 - protein, 22 aa, Entamoeba invadens
FGVTTFEVFGWFQAYPLDIFKF

SEQ ID NO: 2936369 - protein, 17 aa, Entamoeba invadens
FGWKEAYPKDIFKYPWR

SEQ ID NO: 2936370 - protein, 19 aa, Entamoeba invadens
FGYELWVDQYIKARQPTEL

SEQ ID NO: 2936371 - protein, 18 aa, Entamoeba invadens
FGYYCFDGCLSLSNILIP

SEQ ID NO: 2936372 - protein, 25 aa, Entamoeba invadens
FHANGSFFCSFKIKIDPSDTVKSMG

SEQ ID NO: 2936373 - protein, 25 aa, Entamoeba invadens
FHASVCAALNKYPRVKAIDEFEKKL

SEQ ID NO: 2936374 - protein, 22 aa, Entamoeba invadens
FHCTGMPIKACADKLKNEIEKY

SEQ ID NO: 2936375 - protein, 18 aa, Entamoeba invadens
FHCYKCKAILNVPSLKPE

SEQ ID NO: 2936376 - protein, 24 aa, Entamoeba invadens
FHDFPKLGTFVLRDNGNIAAYGGV

SEQ ID NO: 2936377 - protein, 19 aa, Entamoeba invadens
FHDLLMCRSVSKKWRDSVS

SEQ ID NO: 2936378 - protein, 18 aa, Entamoeba invadens
FHEEALPNASYEGSQQIV

SEQ ID NO: 2936379 - protein, 27 aa, Entamoeba invadens
FHEIFGVCKTTFFESFLEHFVGVKKYN

SEQ ID NO: 2936380 - protein, 17 aa, Entamoeba invadens
FHEQPCFSIKRTFNSDV

SEQ ID NO: 2936381 - protein, 19 aa, Entamoeba invadens
FHETCFVCSVCGDKLNDKY

SEQ ID NO: 2936382 - protein, 17 aa, Entamoeba invadens
FHFLGFYVVDNLFNTPD

SEQ ID NO: 2936383 - protein, 20 aa, Entamoeba invadens
FHFVCYLKGKGSKQFVNGEV

SEQ ID NO: 2936384 - protein, 19 aa, Entamoeba invadens
FHFVSTFILKSRKEQTYKD

SEQ ID NO: 2936385 - protein, 17 aa, Entamoeba invadens
FHGRCLHFAIGDIDKES

SEQ ID NO: 2936386 - protein, 17 aa, Entamoeba invadens
FHGVVPYFFLVERKAVL

SEQ ID NO: 2936387 - protein, 18 aa, Entamoeba invadens
FHHFLLYRFVLLRRSHMN

SEQ ID NO: 2936388 - protein, 19 aa, Entamoeba invadens
FHHHICIVTELLSINLYEL

SEQ ID NO: 2936389 - protein, 17 aa, Entamoeba invadens
FHILCSYSKETQIKLEI

SEQ ID NO: 2936390 - protein, 23 aa, Entamoeba invadens
FHKEWDPLVIEWNVVDTKPENIK

SEQ ID NO: 2936391 - protein, 22 aa, Entamoeba invadens
FHKFKCTNLFSVCVSPSGTVGA

SEQ ID NO: 2936392 - protein, 18 aa, Entamoeba invadens
FHKKYNIFSGKYVVPQGL

SEQ ID NO: 2936393 - protein, 17 aa, Entamoeba invadens
FHKTNICFYNISNYTIN

SEQ ID NO: 2936394 - protein, 24 aa, Entamoeba invadens
FHLCREILKMMKLVVDAFCQYRLG

SEQ ID NO: 2936395 - protein, 21 aa, Entamoeba invadens
FHLKSLNVMRLNLVDCCIDTA

SEQ ID NO: 2936396 - protein, 23 aa, Entamoeba invadens
FHLVEVLLSYVFPVFADNAHYVY

SEQ ID NO: 2936397 - protein, 17 aa, Entamoeba invadens
FHMANLQKKSCLETAKI

SEQ ID NO: 2936398 - protein, 18 aa, Entamoeba invadens
FHMYPREFARHLARYSTP

SEQ ID NO: 2936399 - protein, 26 aa, Entamoeba invadens
FHNGVGLSFQIAHPSYLLGKFETQVM

SEQ ID NO: 2936400 - protein, 20 aa, Entamoeba invadens
FHPACFVCSNCGCSLLDEEY

SEQ ID NO: 2936401 - protein, 18 aa, Entamoeba invadens
FHPILPWIYSVGADGTMQ

SEQ ID NO: 2936402 - protein, 24 aa, Entamoeba invadens
FHPLEFAEDLYVFIKESMKCDGNF

SEQ ID NO: 2936403 - protein, 24 aa, Entamoeba invadens
FHPNSRPTQVAAFDGGVFNIYTEE

SEQ ID NO: 2936404 - protein, 18 aa, Entamoeba invadens
FHPNVFKDGRICLDILQD

SEQ ID NO: 2936405 - protein, 17 aa, Entamoeba invadens
FHPSVYPTFSIVDPVYT

SEQ ID NO: 2936406 - protein, 17 aa, Entamoeba invadens
FHPVDFIVTTKRRISEC

SEQ ID NO: 2936407 - protein, 26 aa, Entamoeba invadens
FHRKRKEKIVRCDFINDKNKKFNEAA

SEQ ID NO: 2936408 - protein, 26 aa, Entamoeba invadens
FHRTGRSFLNYKFKDIHCDVSIKIVE

SEQ ID NO: 2936409 - protein, 19 aa, Entamoeba invadens
FHRVIPKFMMQGGDPSGTG

SEQ ID NO: 2936410 - protein, 20 aa, Entamoeba invadens
FHSECYRKYGNDHVYKMIVD

SEQ ID NO: 2936411 - protein, 28 aa, Entamoeba invadens
FHSFKCSTCIACVSLDGAFVTPAIVLPN

SEQ ID NO: 2936412 - protein, 19 aa, Entamoeba invadens
FHSIFCFNGDIFILKLLPG

SEQ ID NO: 2936413 - protein, 22 aa, Entamoeba invadens
FHSLEVLCLVYALKLRYPKQYF

SEQ ID NO: 2936414 - protein, 18 aa, Entamoeba invadens
FHSRKISNFVLFPKQTIT

SEQ ID NO: 2936415 - protein, 25 aa, Entamoeba invadens
FHTFFFKTKFVHFMLGVLPDKGEDI

SEQ ID NO: 2936416 - protein, 25 aa, Entamoeba invadens
FHVIDCGVPLLAMHSIREIGGVFDI

SEQ ID NO: 2936417 - protein, 19 aa, Entamoeba invadens
FHVPVYFKITAADKIRKEA

SEQ ID NO: 2936418 - protein, 17 aa, Entamoeba invadens
FHVSARALAGQALSIFG

SEQ ID NO: 2936419 - protein, 29 aa, Entamoeba invadens
FHVSFKSLRLEGIPEMSASIIGVHSIYYQ

SEQ ID NO: 2936420 - protein, 21 aa, Entamoeba invadens
FHYCIFCGKMFNRRKYMKHSM

SEQ ID NO: 2936421 - protein, 22 aa, Entamoeba invadens
FIADPFLDRGVAYVVRKVDGTT

SEQ ID NO: 2936422 - protein, 18 aa, Entamoeba invadens
FIAESWDGIIGVYDLHGE

SEQ ID NO: 2936423 - protein, 25 aa, Entamoeba invadens
FIAGYRFKCKIGEVIEFILVSKDKH

SEQ ID NO: 2936424 - protein, 24 aa, Entamoeba invadens
FIAHFRPADFIMMKPMKHSGEFSW

SEQ ID NO: 2936425 - protein, 20 aa, Entamoeba invadens
FIAIYQKLLIKRIVEGTSKS

SEQ ID NO: 2936426 - protein, 17 aa, Entamoeba invadens
FIAKLKAKYETELEEIE

SEQ ID NO: 2936427 - protein, 18 aa, Entamoeba invadens
FIAKSPVDLFEKNEIVDI

SEQ ID NO: 2936428 - protein, 19 aa, Entamoeba invadens
FIANVHRLLGFDVISMNWL

SEQ ID NO: 2936429 - protein, 19 aa, Entamoeba invadens
FIAPTVDAIVCYKILTMLF

SEQ ID NO: 2936430 - protein, 27 aa, Entamoeba invadens
FICDEKCLFPDAAGWVIERIQDILKRA

SEQ ID NO: 2936431 - protein, 24 aa, Entamoeba invadens
FICFHHLYHCISLKNIEAVDTKVV

SEQ ID NO: 2936432 - protein, 22 aa, Entamoeba invadens
FICQTKTDLGCMDIPIEDRKTF

SEQ ID NO: 2936433 - protein, 19 aa, Entamoeba invadens
FIDDFSFHKCIKLQCVKFS

SEQ ID NO: 2936434 - protein, 25 aa, Entamoeba invadens
FIDDGEKLFLHGLKLYYKKLDDKQK

SEQ ID NO: 2936435 - protein, 33 aa, Entamoeba invadens
FIDEASLLKKCCHPNVLLFLGVSFLASKQVVLV

SEQ ID NO: 2936436 - protein, 19 aa, Entamoeba invadens
FIDEFKAKLPVNLTEQHHF

SEQ ID NO: 2936437 - protein, 28 aa, Entamoeba invadens
FIDHIAVIGLRAHFFSAIQALYLANTKR

SEQ ID NO: 2936438 - protein, 33 aa, Entamoeba invadens
FIDKKGRCISLLCYDRLLWVIPLGSNRSSYRVD

SEQ ID NO: 2936439 - protein, 27 aa, Entamoeba invadens
FIDKPDGYFSWEIRKFVHHHFCKNGYD

SEQ ID NO: 2936440 - protein, 24 aa, Entamoeba invadens
FIDNFDRLSSVWGVDSKQFETQDF

SEQ ID NO: 2936441 - protein, 24 aa, Entamoeba invadens
FIDRKRDCDLTDSLTTKKRVSQEL

SEQ ID NO: 2936442 - protein, 18 aa, Entamoeba invadens
FIDSNAFENCKLKEIVFP

SEQ ID NO: 2936443 - protein, 27 aa, Entamoeba invadens
FIDSPLIYNGCSWGWVNDKLLPGFLWI

SEQ ID NO: 2936444 - protein, 18 aa, Entamoeba invadens
FIDSRAFSFCMIKTITIH

SEQ ID NO: 2936445 - protein, 26 aa, Entamoeba invadens
FIDTYPFKCFIDFSITESHSAAREWI

SEQ ID NO: 2936446 - protein, 25 aa, Entamoeba invadens
FIDVFPPLLTIRVWDCYLYEGKDVL

SEQ ID NO: 2936447 - protein, 17 aa, Entamoeba invadens
FIDWEFLEHHSRYNIEK

SEQ ID NO: 2936448 - protein, 17 aa, Entamoeba invadens
FIEAGVCAVHYVHYIYK

SEQ ID NO: 2936449 - protein, 30 aa, Entamoeba invadens
FIECFDCRKKFCKKCFKKFHENKYHSIHLE

SEQ ID NO: 2936450 - protein, 18 aa, Entamoeba invadens
FIEDHWKLLSKLKLFKSP

SEQ ID NO: 2936451 - protein, 24 aa, Entamoeba invadens
FIEEIGWDGTEEIFVKRRKGTSSD

SEQ ID NO: 2936452 - protein, 18 aa, Entamoeba invadens
FIEELYLLGCNCDMLGVS

SEQ ID NO: 2936453 - protein, 18 aa, Entamoeba invadens
FIEKRSPTVILPKESECV

SEQ ID NO: 2936454 - protein, 19 aa, Entamoeba invadens
FIEKTEVFVFVYSVDNYFS

SEQ ID NO: 2936455 - protein, 17 aa, Entamoeba invadens
FIELACVMRPKEVNCDG

SEQ ID NO: 2936456 - protein, 23 aa, Entamoeba invadens
FIENTRPLLFVALLQNDVSLTEK

SEQ ID NO: 2936457 - protein, 24 aa, Entamoeba invadens
FIEQKLNEHIAIIVIQDTIHTWYQ

SEQ ID NO: 2936458 - protein, 26 aa, Entamoeba invadens
FIERCASCDIAVPFWMANLINKSGCF

SEQ ID NO: 2936459 - protein, 22 aa, Entamoeba invadens
FIERRLKERKIFDIQNGIDEKT

SEQ ID NO: 2936460 - protein, 24 aa, Entamoeba invadens
FIESGCLSELVGLTIKNDREDIVL

SEQ ID NO: 2936461 - protein, 26 aa, Entamoeba invadens
FIESLHSPSLYLIGIVRKYLSEAIGI

SEQ ID NO: 2936462 - protein, 27 aa, Entamoeba invadens
FIESPFWQAEFVKAFTLIPEVTILEIP

SEQ ID NO: 2936463 - protein, 18 aa, Entamoeba invadens
FIETFKDYFEIMKTVWGT

SEQ ID NO: 2936464 - protein, 17 aa, Entamoeba invadens
FIEYCPNRTILVGNNTG

SEQ ID NO: 2936465 - protein, 19 aa, Entamoeba invadens
FIFDTCLELGYFFDSKLSK

SEQ ID NO: 2936466 - protein, 34 aa, Entamoeba invadens
FIFGDGWLLWICPQVNAMFWERYIVFYVNSTLWN

SEQ ID NO: 2936467 - protein, 17 aa, Entamoeba invadens
FIFKDGILRNDVKKTVF

SEQ ID NO: 2936468 - protein, 20 aa, Entamoeba invadens
FIFKDHKGLVVGILGDSNGR

SEQ ID NO: 2936469 - protein, 22 aa, Entamoeba invadens
FIFPDDCYGLYGANGEYDHTLH

SEQ ID NO: 2936470 - protein, 23 aa, Entamoeba invadens
FIFSCDSAFWLSDGKIYIHQCLK

SEQ ID NO: 2936471 - protein, 23 aa, Entamoeba invadens
FIFSYKFVRYNTTFSAIIILETY

SEQ ID NO: 2936472 - protein, 17 aa, Entamoeba invadens
FIFTLVINAVCASNVSG

SEQ ID NO: 2936473 - protein, 25 aa, Entamoeba invadens
FIFYKSCFYPFNFIHFRVLNTNPFI

SEQ ID NO: 2936474 - protein, 23 aa, Entamoeba invadens
FIGDGLDLWKSVIPNQLMVLQDF

SEQ ID NO: 2936475 - protein, 24 aa, Entamoeba invadens
FIGELCFNGCLALIKVNFESNTCR

SEQ ID NO: 2936476 - protein, 31 aa, Entamoeba invadens
FIGHLNLRGFFPSHFIVKIIRQLLDDYVDQS

SEQ ID NO: 2936477 - protein, 17 aa, Entamoeba invadens
FIGKGCFESCSSLCEIS

SEQ ID NO: 2936478 - protein, 21 aa, Entamoeba invadens
FIGKTCFKNCIGLSSVDINNA

SEQ ID NO: 2936479 - protein, 19 aa, Entamoeba invadens
FIGLGGYGLIGWAVKPRIA

SEQ ID NO: 2936480 - protein, 18 aa, Entamoeba invadens
FIGMQKFCVNSCDDDSIE

SEQ ID NO: 2936481 - protein, 21 aa, Entamoeba invadens
FIGNNCFNGAALEKIEIPESV

SEQ ID NO: 2936482 - protein, 18 aa, Entamoeba invadens
FIGPYCFEDNSTLTELTI

SEQ ID NO: 2936483 - protein, 20 aa, Entamoeba invadens
FIGSAAKFLVERNGQLKKVA

SEQ ID NO: 2936484 - protein, 28 aa, Entamoeba invadens
FIGSLTRLVHVLDFYKSKGYDLNNMMDR

SEQ ID NO: 2936485 - protein, 24 aa, Entamoeba invadens
FIHFPDKLPTIFLSREFDVPLKID

SEQ ID NO: 2936486 - protein, 18 aa, Entamoeba invadens
FIIDRLVEELKVPKYKQY

SEQ ID NO: 2936487 - protein, 21 aa, Entamoeba invadens
FIIFDRYLKHIKSFEIDVTYK

SEQ ID NO: 2936488 - protein, 17 aa, Entamoeba invadens
FIIGIPIEGYVPSIRRF

SEQ ID NO: 2936489 - protein, 22 aa, Entamoeba invadens
FIIKNAHLFTSLKSLRGDLKSL

SEQ ID NO: 2936490 - protein, 17 aa, Entamoeba invadens
FIILREELTGMKILINQ

SEQ ID NO: 2936491 - protein, 26 aa, Entamoeba invadens
FIINFYGAVFIKTKFCMVAEFAEYGS

SEQ ID NO: 2936492 - protein, 27 aa, Entamoeba invadens
FIIPENITSLGYKCFFTSEFITSVVIP

SEQ ID NO: 2936493 - protein, 17 aa, Entamoeba invadens
FIISRGIALHKMIRLVT

SEQ ID NO: 2936494 - protein, 24 aa, Entamoeba invadens
FIKECVLRGLPYSVVSHRPVCPLY

SEQ ID NO: 2936495 - protein, 18 aa, Entamoeba invadens
FIKEIAIVYGKGSEDFDV

SEQ ID NO: 2936496 - protein, 25 aa, Entamoeba invadens
FIKEKRVNEVLFWTVPGPEEENEIF

SEQ ID NO: 2936497 - protein, 25 aa, Entamoeba invadens
FIKFVPRLAPLFGGLEISPIVVDSE

SEQ ID NO: 2936498 - protein, 17 aa, Entamoeba invadens
FIKKIGKSWNDVINTMK

SEQ ID NO: 2936499 - protein, 18 aa, Entamoeba invadens
FIKQRGKDVYQFLDILEL

SEQ ID NO: 2936500 - protein, 25 aa, Entamoeba invadens
FIKRKTECTKAFTVHGDESSTLLTC

SEQ ID NO: 2936501 - protein, 17 aa, Entamoeba invadens
FIKSHWDVLNKFKQFKQ

SEQ ID NO: 2936502 - protein, 23 aa, Entamoeba invadens
FIKSKPGRYGIKFRMSADSETGM

SEQ ID NO: 2936503 - protein, 31 aa, Entamoeba invadens
FIKSKPGRYGIKFWMCADCETGMTLNFQMYC

SEQ ID NO: 2936504 - protein, 30 aa, Entamoeba invadens
FIKSKPGRYGIKFWTGMALNLQMYCGKCGG

SEQ ID NO: 2936505 - protein, 20 aa, Entamoeba invadens
FILEQHFRYFFMHWCSYVRD

SEQ ID NO: 2936506 - protein, 17 aa, Entamoeba invadens
FILIPSILSAVLRLPDF

SEQ ID NO: 2936507 - protein, 17 aa, Entamoeba invadens
FILKKYSIHLLVKLGDA

SEQ ID NO: 2936508 - protein, 34 aa, Entamoeba invadens
FILKKYSIRLLVKLSEAMILRFEIPSRKMTKEDL

SEQ ID NO: 2936509 - protein, 24 aa, Entamoeba invadens
FILLLCQYCKIELGQPSKKSVLTK

SEQ ID NO: 2936510 - protein, 26 aa, Entamoeba invadens
FILPENVRYIGFHAFLNCVLLSNIVI

SEQ ID NO: 2936511 - protein, 22 aa, Entamoeba invadens
FILRYNEKVVRDFFMKNKKAPE

SEQ ID NO: 2936512 - protein, 22 aa, Entamoeba invadens
FILTTRVGGLGINLTGADRVVL

SEQ ID NO: 2936513 - protein, 17 aa, Entamoeba invadens
FILVNGMKCHPFHYQCA

SEQ ID NO: 2936514 - protein, 20 aa, Entamoeba invadens
FIMCDKCSFFHKRDNKLDKE

SEQ ID NO: 2936515 - protein, 20 aa, Entamoeba invadens
FIMDRSCKVKQDLRAKRNVL

SEQ ID NO: 2936516 - protein, 25 aa, Entamoeba invadens
FIMKLVAKCYMEWQHHNISNEQIYA

SEQ ID NO: 2936517 - protein, 17 aa, Entamoeba invadens
FIMMPFNPLFKAEQLAH

SEQ ID NO: 2936518 - protein, 17 aa, Entamoeba invadens
FIMMPLNPLYKVEQLLN

SEQ ID NO: 2936519 - protein, 21 aa, Entamoeba invadens
FIMNVCKLDGFEKLLGKSTQD

SEQ ID NO: 2936520 - protein, 18 aa, Entamoeba invadens
FINCKLNRRHIKGSPFKQ

SEQ ID NO: 2936521 - protein, 19 aa, Entamoeba invadens
FINECISFIDEGRKCGGVL

SEQ ID NO: 2936522 - protein, 21 aa, Entamoeba invadens
FINIPSYRWFFTHFTPDTLDC

SEQ ID NO: 2936523 - protein, 27 aa, Entamoeba invadens
FINIRLQIYFKVFHDWVSKNAIDKLEN

SEQ ID NO: 2936524 - protein, 17 aa, Entamoeba invadens
FINKFALFCDCIVQFVP

SEQ ID NO: 2936525 - protein, 23 aa, Entamoeba invadens
FINNRYVEFPALKKIFERSYEEN

SEQ ID NO: 2936526 - protein, 27 aa, Entamoeba invadens
FINSILMCKKFSFILDRFRYNPIQVDS

SEQ ID NO: 2936527 - protein, 18 aa, Entamoeba invadens
FINSVLICKKFSCVLDRF

SEQ ID NO: 2936528 - protein, 22 aa, Entamoeba invadens
FINTASYEWASLRSYFTTERIK

SEQ ID NO: 2936529 - protein, 21 aa, Entamoeba invadens
FINVVIGNRCMFGYETLSSVE

SEQ ID NO: 2936530 - protein, 19 aa, Entamoeba invadens
FIPAKAKSFQCLNCSEGRS

SEQ ID NO: 2936531 - protein, 24 aa, Entamoeba invadens
FIPCGGRPRTLRVDNVKDFFIEDV

SEQ ID NO: 2936532 - protein, 22 aa, Entamoeba invadens
FIPDDCKIYQYDVLNQKDEIVN

SEQ ID NO: 2936533 - protein, 21 aa, Entamoeba invadens
FIPDKVTALCLVQINKEWLYS

SEQ ID NO: 2936534 - protein, 22 aa, Entamoeba invadens
FIPEGARVILLYGGGSIKKNGV

SEQ ID NO: 2936535 - protein, 24 aa, Entamoeba invadens
FIPFKYRDGYLMAILQKVGAQSAI

SEQ ID NO: 2936536 - protein, 24 aa, Entamoeba invadens
FIPGRPLGFSVDAFFMKNDAFSQF

SEQ ID NO: 2936537 - protein, 26 aa, Entamoeba invadens
FIPKKICLVTEFAKYGSLHDLMKKSQ

SEQ ID NO: 2936538 - protein, 18 aa, Entamoeba invadens
FIPNEPIATFPPQEKKFY

SEQ ID NO: 2936539 - protein, 22 aa, Entamoeba invadens
FIPNHICMVTEFALYGSLQDLM

SEQ ID NO: 2936540 - protein, 19 aa, Entamoeba invadens
FIPPVDLFFTQDMCSPTLF

SEQ ID NO: 2936541 - protein, 23 aa, Entamoeba invadens
FIPTYCDTMYPALGFSTCYSVSV

SEQ ID NO: 2936542 - protein, 17 aa, Entamoeba invadens
FIQGAIYGGRCMTRDNK

SEQ ID NO: 2936543 - protein, 17 aa, Entamoeba invadens
FIQGAVYGGRNMCRDNT

SEQ ID NO: 2936544 - protein, 17 aa, Entamoeba invadens
FIQIITMLSPLVRPIGV

SEQ ID NO: 2936545 - protein, 19 aa, Entamoeba invadens
FIQLIGNIIPLKGHKGYKA

SEQ ID NO: 2936546 - protein, 19 aa, Entamoeba invadens
FIQQLGMFVNPNFDANQPK

SEQ ID NO: 2936547 - protein, 19 aa, Entamoeba invadens
FIQYPACLFYLDKLQNPDF

SEQ ID NO: 2936548 - protein, 22 aa, Entamoeba invadens
FIRAKTCGRVYIQHTGYITVYT

SEQ ID NO: 2936549 - protein, 19 aa, Entamoeba invadens
FIRALKCGYVLNTVYPNPF

SEQ ID NO: 2936550 - protein, 18 aa, Entamoeba invadens
FIRDLVEFMYMVLCNSTI

SEQ ID NO: 2936551 - protein, 17 aa, Entamoeba invadens
FIREFRVPVNAFVTCKV

SEQ ID NO: 2936552 - protein, 28 aa, Entamoeba invadens
FIREISDGLVPSCFYQNCVEAGGEENIE

SEQ ID NO: 2936553 - protein, 23 aa, Entamoeba invadens
FIREISTEITFVLRKPYGKNNYV

SEQ ID NO: 2936554 - protein, 25 aa, Entamoeba invadens
FIRFKPKSIEFFKIPNYKVVMEREL

SEQ ID NO: 2936555 - protein, 19 aa, Entamoeba invadens
FIRFRKAIDYYDLYRSFSL

SEQ ID NO: 2936556 - protein, 18 aa, Entamoeba invadens
FIRFSRFLGNCITKSQKI

SEQ ID NO: 2936557 - protein, 27 aa, Entamoeba invadens
FIRHVWPSSRFYIVEIITLLCDPNSSQ

SEQ ID NO: 2936558 - protein, 19 aa, Entamoeba invadens
FIRKAFGRKNYQNYKRSSC

SEQ ID NO: 2936559 - protein, 19 aa, Entamoeba invadens
FIRKKRSGAINVLQSRFIQ

SEQ ID NO: 2936560 - protein, 21 aa, Entamoeba invadens
FIRLFIDRFDRVVFNHLMSQR

SEQ ID NO: 2936561 - protein, 25 aa, Entamoeba invadens
FIRNFVFDSCLEFGYFFNSKLSKNS

SEQ ID NO: 2936562 - protein, 26 aa, Entamoeba invadens
FIRPLDVYICLSHYKIIQKLMRKAIL

SEQ ID NO: 2936563 - protein, 24 aa, Entamoeba invadens
FIRRRNNNWTDLYWRDVMNDEALV

SEQ ID NO: 2936564 - protein, 19 aa, Entamoeba invadens
FIRTIGYNWFIPLASSTYN

SEQ ID NO: 2936565 - protein, 20 aa, Entamoeba invadens
FISATMRTTLLASIEKAIQA

SEQ ID NO: 2936566 - protein, 17 aa, Entamoeba invadens
FISDADIVLNIRTNLNA

SEQ ID NO: 2936567 - protein, 17 aa, Entamoeba invadens
FISDFGVRGEVEVYQIG

SEQ ID NO: 2936568 - protein, 19 aa, Entamoeba invadens
FISFNEVFGNFSFDPEALI

SEQ ID NO: 2936569 - protein, 22 aa, Entamoeba invadens
FISHLFMVYKHFCVVMNVSCTL

SEQ ID NO: 2936570 - protein, 18 aa, Entamoeba invadens
FISKCFKNLETAEVVQKA

SEQ ID NO: 2936571 - protein, 18 aa, Entamoeba invadens
FISKKLPAALEFYDRKIK

SEQ ID NO: 2936572 - protein, 17 aa, Entamoeba invadens
FISKSAFYNCTSLTEIT

SEQ ID NO: 2936573 - protein, 17 aa, Entamoeba invadens
FISLIAMFVRPEDLFNF

SEQ ID NO: 2936574 - protein, 26 aa, Entamoeba invadens
FISNDLKRVIGLVSLSVVWRIGFCKS

SEQ ID NO: 2936575 - protein, 17 aa, Entamoeba invadens
FISPELITTHFSIPEQF

SEQ ID NO: 2936576 - protein, 17 aa, Entamoeba invadens
FISSGFDSRVLQWDTRC

SEQ ID NO: 2936577 - protein, 18 aa, Entamoeba invadens
FISSLILSPRKGQKVQQK

SEQ ID NO: 2936578 - protein, 17 aa, Entamoeba invadens
FISVSLGCTNCISGYYL

SEQ ID NO: 2936579 - protein, 19 aa, Entamoeba invadens
FITILKFNVDYFRRLHVDF

SEQ ID NO: 2936580 - protein, 20 aa, Entamoeba invadens
FITKHPIVFDDKGSIVCATS

SEQ ID NO: 2936581 - protein, 21 aa, Entamoeba invadens
FITLCLRRVLPDSSYQLRKAC

SEQ ID NO: 2936582 - protein, 18 aa, Entamoeba invadens
FITPRGSSIPLRHRIFYS

SEQ ID NO: 2936583 - protein, 21 aa, Entamoeba invadens
FITTFRIIFCPFDEVQVNKFV

SEQ ID NO: 2936584 - protein, 17 aa, Entamoeba invadens
FIVGLVVSIKFETIMMV

SEQ ID NO: 2936585 - protein, 23 aa, Entamoeba invadens
FIVHKGKNFIMRNFLMCQIEEPS

SEQ ID NO: 2936586 - protein, 17 aa, Entamoeba invadens
FIVKVGCRVVDRTITRK

SEQ ID NO: 2936587 - protein, 18 aa, Entamoeba invadens
FIVNRKVIASDWDHSDFC

SEQ ID NO: 2936588 - protein, 24 aa, Entamoeba invadens
FIVQCGHSALPKSVHAERIIQNIN

SEQ ID NO: 2936589 - protein, 27 aa, Entamoeba invadens
FIVRYLYPRHEHITKLLAFTAQSIHSL

SEQ ID NO: 2936590 - protein, 28 aa, Entamoeba invadens
FIVSIKSVLLKFAMAYLSLVSSTAKFVE

SEQ ID NO: 2936591 - protein, 25 aa, Entamoeba invadens
FIVSLKEVFEFGTKLKSHEMGVSFN

SEQ ID NO: 2936592 - protein, 20 aa, Entamoeba invadens
FIVTQIRFKVGDVIYSLPLQ

SEQ ID NO: 2936593 - protein, 19 aa, Entamoeba invadens
FIWGEAFPREMFRYPWEVV

SEQ ID NO: 2936594 - protein, 19 aa, Entamoeba invadens
FIYILPPAELYKGVRIDAE

SEQ ID NO: 2936595 - protein, 20 aa, Entamoeba invadens
FIYKSLVICENCYYNEMIKE

SEQ ID NO: 2936596 - protein, 21 aa, Entamoeba invadens
FIYLFRLMLATGIPELQKEKD

SEQ ID NO: 2936597 - protein, 22 aa, Entamoeba invadens
FIYQNPFCFVEQVSTRNPVEYM

SEQ ID NO: 2936598 - protein, 19 aa, Entamoeba invadens
FKAAKTLMDKKWRFSNKFG

SEQ ID NO: 2936599 - protein, 19 aa, Entamoeba invadens
FKADHIFADGTYRITPNTV

SEQ ID NO: 2936600 - protein, 21 aa, Entamoeba invadens
FKAFFRELPESLVTAENTDLF

SEQ ID NO: 2936601 - protein, 18 aa, Entamoeba invadens
FKAGEAMAEVIGTSHFGE

SEQ ID NO: 2936602 - protein, 17 aa, Entamoeba invadens
FKAIKPENDMLCIDGTK

SEQ ID NO: 2936603 - protein, 17 aa, Entamoeba invadens
FKAKLPVNLTEQHHFFF

SEQ ID NO: 2936604 - protein, 24 aa, Entamoeba invadens
FKALREMYVLFSGNVLIGSEFCDD

SEQ ID NO: 2936605 - protein, 19 aa, Entamoeba invadens
FKAPMPPSGSQKVERKSSQ

SEQ ID NO: 2936606 - protein, 21 aa, Entamoeba invadens
FKAQHKRISKDVCNYFPVNSI

SEQ ID NO: 2936607 - protein, 19 aa, Entamoeba invadens
FKATIGEKLAKIDKKKILS

SEQ ID NO: 2936608 - protein, 19 aa, Entamoeba invadens
FKAVFKMERSEFNMLPRWR

SEQ ID NO: 2936609 - protein, 19 aa, Entamoeba invadens
FKAVGEVYEDLGVPEEFGS

SEQ ID NO: 2936610 - protein, 18 aa, Entamoeba invadens
FKCFCDSSISSIEIPLQV

SEQ ID NO: 2936611 - protein, 22 aa, Entamoeba invadens
FKCGHYVCSECMSLKSEDQIEC

SEQ ID NO: 2936612 - protein, 27 aa, Entamoeba invadens
FKCKCGAEGKCEYCCCCKEGKCQCKTF

SEQ ID NO: 2936613 - protein, 17 aa, Entamoeba invadens
FKCKIVVSDNDSERRFM

SEQ ID NO: 2936614 - protein, 24 aa, Entamoeba invadens
FKCLETRWTIYRALYAKLQENSIG

SEQ ID NO: 2936615 - protein, 25 aa, Entamoeba invadens
FKCSSSPRFFSFSPTRLSNASSQAQ

SEQ ID NO: 2936616 - protein, 18 aa, Entamoeba invadens
FKDALKLCRILQDDEHDL

SEQ ID NO: 2936617 - protein, 18 aa, Entamoeba invadens
FKDCKEVTLWKEDSSKKF

SEQ ID NO: 2936618 - protein, 22 aa, Entamoeba invadens
FKDCVSLVYVDLGFNSLIEIPY

SEQ ID NO: 2936619 - protein, 22 aa, Entamoeba invadens
FKDDIYCLIQPKATQAVHPSGV

SEQ ID NO: 2936620 - protein, 19 aa, Entamoeba invadens
FKDELKDVPSIFLTCENLK

SEQ ID NO: 2936621 - protein, 24 aa, Entamoeba invadens
FKDFCFDNCKKLATIDFESIEFLG

SEQ ID NO: 2936622 - protein, 17 aa, Entamoeba invadens
FKDFDALNDIAFVDKTR

SEQ ID NO: 2936623 - protein, 17 aa, Entamoeba invadens
FKDGITYVEFRFAPIQC

SEQ ID NO: 2936624 - protein, 21 aa, Entamoeba invadens
FKDGLRLSIIHQIVQESLKAK

SEQ ID NO: 2936625 - protein, 20 aa, Entamoeba invadens
FKDGRICLDILQDKWSSVYT

SEQ ID NO: 2936626 - protein, 23 aa, Entamoeba invadens
FKDGVIAVSGFRNVEVLLWTQEE

SEQ ID NO: 2936627 - protein, 19 aa, Entamoeba invadens
FKDGYTLVVSPLISLMQDQ

SEQ ID NO: 2936628 - protein, 18 aa, Entamoeba invadens
FKDIHCDVSIKIVEFDGP

SEQ ID NO: 2936629 - protein, 26 aa, Entamoeba invadens
FKDKGKRTSLVTFLPERNDFVARRII

SEQ ID NO: 2936630 - protein, 19 aa, Entamoeba invadens
FKDKKCFTMMLEVMHSDWW

SEQ ID NO: 2936631 - protein, 17 aa, Entamoeba invadens
FKDLRKTLHLLLDQLKE

SEQ ID NO: 2936632 - protein, 22 aa, Entamoeba invadens
FKDLYSIVGPAPYHRVIGHKTV

SEQ ID NO: 2936633 - protein, 24 aa, Entamoeba invadens
FKDNQLFILLPNRVMYRVIENNLI

SEQ ID NO: 2936634 - protein, 18 aa, Entamoeba invadens
FKDPDVAQICFDKINNQI

SEQ ID NO: 2936635 - protein, 21 aa, Entamoeba invadens
FKDQCKAFIKKIVDERQFCVY

SEQ ID NO: 2936636 - protein, 18 aa, Entamoeba invadens
FKDRCRHLVSTQSMNEYS

SEQ ID NO: 2936637 - protein, 22 aa, Entamoeba invadens
FKDRYTRLAVSNVIYLGGKAKI

SEQ ID NO: 2936638 - protein, 21 aa, Entamoeba invadens
FKDSFFPPDPSVVYFHNSSPQ

SEQ ID NO: 2936639 - protein, 19 aa, Entamoeba invadens
FKDVFINTITLYFPTHTIL

SEQ ID NO: 2936640 - protein, 18 aa, Entamoeba invadens
FKDVLLQFHINPIPINKK

SEQ ID NO: 2936641 - protein, 18 aa, Entamoeba invadens
FKEALGALFEVDYKDENI

SEQ ID NO: 2936642 - protein, 20 aa, Entamoeba invadens
FKEAMSYYRAIMARDELSDR

SEQ ID NO: 2936643 - protein, 20 aa, Entamoeba invadens
FKECCFKLGEFANEIPSTAA

SEQ ID NO: 2936644 - protein, 20 aa, Entamoeba invadens
FKECSSLYVLSGISDITEFG

SEQ ID NO: 2936645 - protein, 21 aa, Entamoeba invadens
FKEDLMLGILKGEDIAKIVRP

SEQ ID NO: 2936646 - protein, 26 aa, Entamoeba invadens
FKEEDKIRVGMLYALKYEEKCSEVIQ

SEQ ID NO: 2936647 - protein, 20 aa, Entamoeba invadens
FKEEFMYPFVEYVTTQYSSI

SEQ ID NO: 2936648 - protein, 28 aa, Entamoeba invadens
FKEEKTLIFLNCHLIYIATQPALLLETI

SEQ ID NO: 2936649 - protein, 18 aa, Entamoeba invadens
FKEFKLSHKWRYIIFKMN

SEQ ID NO: 2936650 - protein, 18 aa, Entamoeba invadens
FKEFSGGLLKGTKSAVKG

SEQ ID NO: 2936651 - protein, 19 aa, Entamoeba invadens
FKEGVDLYESALCGTFKKI

SEQ ID NO: 2936652 - protein, 20 aa, Entamoeba invadens
FKEIERLSVQDVKRYVSENC

SEQ ID NO: 2936653 - protein, 25 aa, Entamoeba invadens
FKEKCWKNNKAMVMVESVIEKKLEE

SEQ ID NO: 2936654 - protein, 21 aa, Entamoeba invadens
FKEKFFRVVNWYQVTFEECMA

SEQ ID NO: 2936655 - protein, 20 aa, Entamoeba invadens
FKEKHFVRRRNDIWEKFKEQ

SEQ ID NO: 2936656 - protein, 19 aa, Entamoeba invadens
FKEKKCPFEPLFNKHLTFT

SEQ ID NO: 2936657 - protein, 17 aa, Entamoeba invadens
FKEKQYVLYRMHLHGKK

SEQ ID NO: 2936658 - protein, 23 aa, Entamoeba invadens
FKEKWIVKLKEMMVYTQGLADIK

SEQ ID NO: 2936659 - protein, 28 aa, Entamoeba invadens
FKEKYMIPMHFWLYYVINVEKHKVLYTH

SEQ ID NO: 2936660 - protein, 24 aa, Entamoeba invadens
FKELCFKTWIDLEMHTDKFVKNCY

SEQ ID NO: 2936661 - protein, 21 aa, Entamoeba invadens
FKELCSSALLSLRKQGSLFIY

SEQ ID NO: 2936662 - protein, 25 aa, Entamoeba invadens
FKELGRLDGTSCLREFDVIVKAEQA

SEQ ID NO: 2936663 - protein, 20 aa, Entamoeba invadens
FKELRRMKVQDLVLREKNIL

SEQ ID NO: 2936664 - protein, 18 aa, Entamoeba invadens
FKEMCFDETIIAGDAMTR

SEQ ID NO: 2936665 - protein, 23 aa, Entamoeba invadens
FKEMDIKGGSIVVYLIKNDITKE

SEQ ID NO: 2936666 - protein, 18 aa, Entamoeba invadens
FKENIRMINSASYDRAKK

SEQ ID NO: 2936667 - protein, 26 aa, Entamoeba invadens
FKENVARFYLAEVVCALEYLHMEDIV

SEQ ID NO: 2936668 - protein, 30 aa, Entamoeba invadens
FKEPLCGWYHSHPSYKCWLSAIDVKTEQLH

SEQ ID NO: 2936669 - protein, 18 aa, Entamoeba invadens
FKEPPLIKKTKIKKNKKD

SEQ ID NO: 2936670 - protein, 19 aa, Entamoeba invadens
FKEQLPKVPKCFLEATSLK

SEQ ID NO: 2936671 - protein, 17 aa, Entamoeba invadens
FKERLAKEMNIIDSKLM

SEQ ID NO: 2936672 - protein, 22 aa, Entamoeba invadens
FKETFTELFGLGITNATTAIED

SEQ ID NO: 2936673 - protein, 21 aa, Entamoeba invadens
FKETFYWTNGIWKERDFVKST

SEQ ID NO: 2936674 - protein, 23 aa, Entamoeba invadens
FKETRKLFYELALRDSTISTKPT

SEQ ID NO: 2936675 - protein, 21 aa, Entamoeba invadens
FKEVVVFHQRIYKELNKTSDE

SEQ ID NO: 2936676 - protein, 25 aa, Entamoeba invadens
FKFDMKAYCVFYCNQYVRILKQGHS

SEQ ID NO: 2936677 - protein, 25 aa, Entamoeba invadens
FKFEKSIFGRKFVKMETVEVQFNKS

SEQ ID NO: 2936678 - protein, 17 aa, Entamoeba invadens
FKFELDDPIITKMFPNE

SEQ ID NO: 2936679 - protein, 37 aa, Entamoeba invadens
FKFEPTEQNWPFKFTRIQIPVVPAFAMTINKAQGQSF

SEQ ID NO: 2936680 - protein, 21 aa, Entamoeba invadens
FKFGKTKIFFKDKEIEALKKK

SEQ ID NO: 2936681 - protein, 24 aa, Entamoeba invadens
FKFHYEIVPRILVLAKECVGKRDS

SEQ ID NO: 2936682 - protein, 24 aa, Entamoeba invadens
FKFIKAHWHILSFIKPFTSQKWRK

SEQ ID NO: 2936683 - protein, 17 aa, Entamoeba invadens
FKFIWWTKIALILSKNR

SEQ ID NO: 2936684 - protein, 17 aa, Entamoeba invadens
FKFLMNGINFILNDKEG

SEQ ID NO: 2936685 - protein, 26 aa, Entamoeba invadens
FKFLREAFELVKEAKTGELVKFDSAL

SEQ ID NO: 2936686 - protein, 22 aa, Entamoeba invadens
FKFLSEPVAALLSMKTKMSDIK

SEQ ID NO: 2936687 - protein, 18 aa, Entamoeba invadens
FKFPRKLMNLKVDTKTLQ

SEQ ID NO: 2936688 - protein, 22 aa, Entamoeba invadens
FKFSREEFPKTITFIDYDDVNP

SEQ ID NO: 2936689 - protein, 17 aa, Entamoeba invadens
FKGCTSLKKFEFNQDAV

SEQ ID NO: 2936690 - protein, 22 aa, Entamoeba invadens
FKGECKKELCEIIKQMKGEIAQ

SEQ ID NO: 2936691 - protein, 25 aa, Entamoeba invadens
FKGEHLHCVLPLWLKNKLPSNVKVD

SEQ ID NO: 2936692 - protein, 17 aa, Entamoeba invadens
FKGEIEVMKTLGKHAHM

SEQ ID NO: 2936693 - protein, 19 aa, Entamoeba invadens
FKGEINMFCSGNFRKKTSL

SEQ ID NO: 2936694 - protein, 18 aa, Entamoeba invadens
FKGIDAFQSANLHSFAIS

SEQ ID NO: 2936695 - protein, 18 aa, Entamoeba invadens
FKGKEVFNLQQIVTEGGI

SEQ ID NO: 2936696 - protein, 20 aa, Entamoeba invadens
FKGKFIVLLFYPLDWTFVCP

SEQ ID NO: 2936697 - protein, 21 aa, Entamoeba invadens
FKGKIHPYASMPDTRMVEALE

SEQ ID NO: 2936698 - protein, 19 aa, Entamoeba invadens
FKGKSIIEIRYEDYKANNF

SEQ ID NO: 2936699 - protein, 17 aa, Entamoeba invadens
FKGLLLVLQNEVLYTLI

SEQ ID NO: 2936700 - protein, 21 aa, Entamoeba invadens
FKGQTDPLYALSFLLDSRSLQ

SEQ ID NO: 2936701 - protein, 19 aa, Entamoeba invadens
FKGSIDYTIYKALKNKYSF

SEQ ID NO: 2936702 - protein, 20 aa, Entamoeba invadens
FKGTKKLFTRGIPQNLKKIG

SEQ ID NO: 2936703 - protein, 26 aa, Entamoeba invadens
FKGTRSARKTIKMYRVKKITTPTQVV

SEQ ID NO: 2936704 - protein, 30 aa, Entamoeba invadens
FKHGSCCVMCDGCGWSHAAYLAALDANENA

SEQ ID NO: 2936705 - protein, 23 aa, Entamoeba invadens
FKHIEKEALCIVYNGDVLTDDVV

SEQ ID NO: 2936706 - protein, 22 aa, Entamoeba invadens
FKHKEKLFQMFFENFEVPSIAI

SEQ ID NO: 2936707 - protein, 18 aa, Entamoeba invadens
FKHNGVIYEGKFVANFSK

SEQ ID NO: 2936708 - protein, 18 aa, Entamoeba invadens
FKHNNLEYLVRMRIEITP

SEQ ID NO: 2936709 - protein, 25 aa, Entamoeba invadens
FKHRNCYRTFVSFVRELVAGNHILR

SEQ ID NO: 2936710 - protein, 18 aa, Entamoeba invadens
FKHSNICSFVRQLNIYGF

SEQ ID NO: 2936711 - protein, 24 aa, Entamoeba invadens
FKHSNICSFVRQLNIYGFKKLETP

SEQ ID NO: 2936712 - protein, 21 aa, Entamoeba invadens
FKHTFSCNGSLEKKETGTEMK

SEQ ID NO: 2936713 - protein, 20 aa, Entamoeba invadens
FKIACPVIDYISSDFEMYPV

SEQ ID NO: 2936714 - protein, 17 aa, Entamoeba invadens
FKIAMNFQSKEITTAED

SEQ ID NO: 2936715 - protein, 23 aa, Entamoeba invadens
FKICWGDVGIGMFFIEPDKLKNL

SEQ ID NO: 2936716 - protein, 20 aa, Entamoeba invadens
FKIEGFGWFDENHKRGDLCV

SEQ ID NO: 2936717 - protein, 17 aa, Entamoeba invadens
FKIETLPAPKKREGELI

SEQ ID NO: 2936718 - protein, 20 aa, Entamoeba invadens
FKIIGCGNHDMWWPYSTSQK

SEQ ID NO: 2936719 - protein, 26 aa, Entamoeba invadens
FKIIKLFPKNVNIFFTFLSNETADCV

SEQ ID NO: 2936720 - protein, 24 aa, Entamoeba invadens
FKIKEEHKGIAFLWYFLDNDQEGL

SEQ ID NO: 2936721 - protein, 21 aa, Entamoeba invadens
FKIKFDEKLCRVNIEDDSDQS

SEQ ID NO: 2936722 - protein, 22 aa, Entamoeba invadens
FKIKITNDFINTVIMRLPKDQQ

SEQ ID NO: 2936723 - protein, 23 aa, Entamoeba invadens
FKILEAHTNYAFGCYKDDHPRLF

SEQ ID NO: 2936724 - protein, 17 aa, Entamoeba invadens
FKILEFSILLGKDKMVE

SEQ ID NO: 2936725 - protein, 34 aa, Entamoeba invadens
FKILELLGYSWAKNCYHISFGMVMGMSTRRGTAV

SEQ ID NO: 2936726 - protein, 17 aa, Entamoeba invadens
FKILQALVFEQNEPVIV

SEQ ID NO: 2936727 - protein, 20 aa, Entamoeba invadens
FKINGTFNGCYSLKKIAIPE

SEQ ID NO: 2936728 - protein, 23 aa, Entamoeba invadens
FKINPLRVVVRNVPRAVTNDELR

SEQ ID NO: 2936729 - protein, 32 aa, Entamoeba invadens
FKINVKVLNKWCFRNCKALKEITLPKTLKFVD

SEQ ID NO: 2936730 - protein, 19 aa, Entamoeba invadens
FKIPCAQCYEDVMESYKID

SEQ ID NO: 2936731 - protein, 19 aa, Entamoeba invadens
FKIPCKQILHGVGPIGEEP

SEQ ID NO: 2936732 - protein, 19 aa, Entamoeba invadens
FKIPEPFPSNYMNTKLVFG

SEQ ID NO: 2936733 - protein, 22 aa, Entamoeba invadens
FKIPFLKSKIEKYEMCIDKLLQ

SEQ ID NO: 2936734 - protein, 19 aa, Entamoeba invadens
FKISNCYELTSVTFLNQKV

SEQ ID NO: 2936735 - protein, 34 aa, Entamoeba invadens
FKISRINVLFIVYWKKIHGIPKINSGTFRGIAYK

SEQ ID NO: 2936736 - protein, 20 aa, Entamoeba invadens
FKITARNRINEPLKKGGLVF

SEQ ID NO: 2936737 - protein, 17 aa, Entamoeba invadens
FKITNSFTHLTNLKELV

SEQ ID NO: 2936738 - protein, 18 aa, Entamoeba invadens
FKITTANAPMFFSETGGI

SEQ ID NO: 2936739 - protein, 27 aa, Entamoeba invadens
FKIVAGMLHMGNVCYVDGKDLAEISNL

SEQ ID NO: 2936740 - protein, 17 aa, Entamoeba invadens
FKIVLLGSGSVGKSAIA

SEQ ID NO: 2936741 - protein, 21 aa, Entamoeba invadens
FKKAFVLSLYQYVPFEQSDLS

SEQ ID NO: 2936742 - protein, 25 aa, Entamoeba invadens
FKKDEFGVYRYKWENWNVYDETTEG

SEQ ID NO: 2936743 - protein, 27 aa, Entamoeba invadens
FKKDEFIKCYGCNKICASTHPVYVYSC

SEQ ID NO: 2936744 - protein, 21 aa, Entamoeba invadens
FKKDGVLYLRVGLKNISKSCI

SEQ ID NO: 2936745 - protein, 20 aa, Entamoeba invadens
FKKEAEDFLKSCPAKKLTLN

SEQ ID NO: 2936746 - protein, 23 aa, Entamoeba invadens
FKKEDIRHSPAYGADFVKQEQRR

SEQ ID NO: 2936747 - protein, 24 aa, Entamoeba invadens
FKKEDVLRIWDFLISYIEDKMYLF

SEQ ID NO: 2936748 - protein, 17 aa, Entamoeba invadens
FKKELIESLKEYQTELK

SEQ ID NO: 2936749 - protein, 23 aa, Entamoeba invadens
FKKELPATLLFSKFVVSETVPFN

SEQ ID NO: 2936750 - protein, 17 aa, Entamoeba invadens
FKKELTSILDYLPKKRQ

SEQ ID NO: 2936751 - protein, 19 aa, Entamoeba invadens
FKKEVAMLDKFRSDYIVHF

SEQ ID NO: 2936752 - protein, 18 aa, Entamoeba invadens
FKKFAVVISKDLPNSDET

SEQ ID NO: 2936753 - protein, 31 aa, Entamoeba invadens
FKKFCSLELKFPQNLVGRFAELWAMMEQETK

SEQ ID NO: 2936754 - protein, 23 aa, Entamoeba invadens
FKKFNITFDRFFVGEKIEINSAK

SEQ ID NO: 2936755 - protein, 23 aa, Entamoeba invadens
FKKFNITFDRFFVGETIEINSAK

SEQ ID NO: 2936756 - protein, 25 aa, Entamoeba invadens
FKKFYELLKLYGYKMPLFDKLKSWN

SEQ ID NO: 2936757 - protein, 20 aa, Entamoeba invadens
FKKGEAVIVVGQPENGWVPI

SEQ ID NO: 2936758 - protein, 17 aa, Entamoeba invadens
FKKIIRLTTRDVKEMVT

SEQ ID NO: 2936759 - protein, 20 aa, Entamoeba invadens
FKKILRLLFTMPEIKDPNLF

SEQ ID NO: 2936760 - protein, 33 aa, Entamoeba invadens
FKKISMINFLIFHFGYDWKEVVEAPQGGNLEGI

SEQ ID NO: 2936761 - protein, 35 aa, Entamoeba invadens
FKKISMINFLIFHFGYDWKEVVNAPQGGNIEGIEK

SEQ ID NO: 2936762 - protein, 20 aa, Entamoeba invadens
FKKKIVCDKVGRMYNKDAIL

SEQ ID NO: 2936763 - protein, 17 aa, Entamoeba invadens
FKKKRFYGTHKVSPPTI

SEQ ID NO: 2936764 - protein, 22 aa, Entamoeba invadens
FKKKRSFYDFRGEFERQGISSE

SEQ ID NO: 2936765 - protein, 19 aa, Entamoeba invadens
FKKKVVIPFFQWKEIPNDI

SEQ ID NO: 2936766 - protein, 21 aa, Entamoeba invadens
FKKKYVPCHCILFSDICVFAE

SEQ ID NO: 2936767 - protein, 18 aa, Entamoeba invadens
FKKLEVWHFVGITGSAGF

SEQ ID NO: 2936768 - protein, 28 aa, Entamoeba invadens
FKKLFFKTVAVSYAFYLQMKAFGYTFYN

SEQ ID NO: 2936769 - protein, 17 aa, Entamoeba invadens
FKKLGIDVSNMMKKEEV

SEQ ID NO: 2936770 - protein, 19 aa, Entamoeba invadens
FKKMLTTLLEFLKMSEKIG

SEQ ID NO: 2936771 - protein, 20 aa, Entamoeba invadens
FKKNEFRGIGIVWGSKQSSA

SEQ ID NO: 2936772 - protein, 25 aa, Entamoeba invadens
FKKNLPFELYMKFYLENKTNKIPIF

SEQ ID NO: 2936773 - protein, 28 aa, Entamoeba invadens
FKKNLSFKGGFGLLKYGPSVDTSRLYNA

SEQ ID NO: 2936774 - protein, 19 aa, Entamoeba invadens
FKKNSKWSLIKPVPQLGDD

SEQ ID NO: 2936775 - protein, 20 aa, Entamoeba invadens
FKKRIFSLEVVIIGESGVGK

SEQ ID NO: 2936776 - protein, 17 aa, Entamoeba invadens
FKKRSGIDIKLVEDPRK

SEQ ID NO: 2936777 - protein, 20 aa, Entamoeba invadens
FKKSEVEFMIITERSHFFNR

SEQ ID NO: 2936778 - protein, 17 aa, Entamoeba invadens
FKKSFLQAFYTAFSDTL

SEQ ID NO: 2936779 - protein, 20 aa, Entamoeba invadens
FKKSISYEVEKAFWDEFENT

SEQ ID NO: 2936780 - protein, 21 aa, Entamoeba invadens
FKKSRKLLHFGALKVVEEKED

SEQ ID NO: 2936781 - protein, 24 aa, Entamoeba invadens
FKKTLKLMSSFFVISIELAYNDIF

SEQ ID NO: 2936782 - protein, 18 aa, Entamoeba invadens
FKKVFPKNIFVYFDTNNK

SEQ ID NO: 2936783 - protein, 26 aa, Entamoeba invadens
FKKVWVAFAEFCVRNHFISLARKAFG

SEQ ID NO: 2936784 - protein, 34 aa, Entamoeba invadens
FKKYKCLFQRNKNYLNFIILIKIKYTYNNRDKLF

SEQ ID NO: 2936785 - protein, 19 aa, Entamoeba invadens
FKKYKVEKSFEEFDPSIKT

SEQ ID NO: 2936786 - protein, 26 aa, Entamoeba invadens
FKKYTAEVFLEYQLRESRFKSIIAEF

SEQ ID NO: 2936787 - protein, 26 aa, Entamoeba invadens
FKLAPEDVKVLFGIFKFVYTEYIDRL

SEQ ID NO: 2936788 - protein, 21 aa, Entamoeba invadens
FKLCLYEAKMGLHMTNTSMRE

SEQ ID NO: 2936789 - protein, 19 aa, Entamoeba invadens
FKLDARVARLIKMIFDKGM

SEQ ID NO: 2936790 - protein, 27 aa, Entamoeba invadens
FKLDELKHYLCFIFLDEFTVWAPKSSD

SEQ ID NO: 2936791 - protein, 19 aa, Entamoeba invadens
FKLFKDLYVTFANKLKLLD

SEQ ID NO: 2936792 - protein, 26 aa, Entamoeba invadens
FKLFLRELPNPVIPSKFYDNFVNEDV

SEQ ID NO: 2936793 - protein, 18 aa, Entamoeba invadens
FKLFPRVMTYLNQTKETE

SEQ ID NO: 2936794 - protein, 26 aa, Entamoeba invadens
FKLKKPTGEWVTLLLLHVPRGNLKSD

SEQ ID NO: 2936795 - protein, 24 aa, Entamoeba invadens
FKLKLHPKVVFLKLERSCVDGLQN

SEQ ID NO: 2936796 - protein, 21 aa, Entamoeba invadens
FKLKNRRVVSIITSEYETEFT

SEQ ID NO: 2936797 - protein, 20 aa, Entamoeba invadens
FKLKVTCFGKNYRIPEQVKI

SEQ ID NO: 2936798 - protein, 21 aa, Entamoeba invadens
FKLLHFKRVEIVTEDFSLLAS

SEQ ID NO: 2936799 - protein, 20 aa, Entamoeba invadens
FKLLKYRRVSHISMIIVLIN

SEQ ID NO: 2936800 - protein, 22 aa, Entamoeba invadens
FKLNKTKIFSKVGVLVEIEEIR

SEQ ID NO: 2936801 - protein, 24 aa, Entamoeba invadens
FKLNPDWKKTLFIYGDDQSTDVLG

SEQ ID NO: 2936802 - protein, 20 aa, Entamoeba invadens
FKLPDTFYKTLLPYYKVSRI

SEQ ID NO: 2936803 - protein, 20 aa, Entamoeba invadens
FKLPHDVVIISFLYKRLNSV

SEQ ID NO: 2936804 - protein, 17 aa, Entamoeba invadens
FKLPYLNNLKKLHIKTC

SEQ ID NO: 2936805 - protein, 22 aa, Entamoeba invadens
FKLQCKSGCEPTKWSLKKGKER

SEQ ID NO: 2936806 - protein, 18 aa, Entamoeba invadens
FKLRGVTVSTDLKSLGED

SEQ ID NO: 2936807 - protein, 19 aa, Entamoeba invadens
FKLSHKWRYILFKLNDKMT

SEQ ID NO: 2936808 - protein, 21 aa, Entamoeba invadens
FKLTFIIENGFVYRIYYHIGK

SEQ ID NO: 2936809 - protein, 19 aa, Entamoeba invadens
FKLTHFGHFEQLYERNDFV

SEQ ID NO: 2936810 - protein, 20 aa, Entamoeba invadens
FKLYSPLFHQLICCVIPNYQ

SEQ ID NO: 2936811 - protein, 20 aa, Entamoeba invadens
FKMAHPVVAVGFNGNAVIAI

SEQ ID NO: 2936812 - protein, 22 aa, Entamoeba invadens
FKMAKLTIENNINFVGGSNDCD

SEQ ID NO: 2936813 - protein, 20 aa, Entamoeba invadens
FKMFFDLHMNAATFFRRRER

SEQ ID NO: 2936814 - protein, 19 aa, Entamoeba invadens
FKMFGDERMRLIAESVNLL

SEQ ID NO: 2936815 - protein, 17 aa, Entamoeba invadens
FKMFKNIIVDFYKNDQH

SEQ ID NO: 2936816 - protein, 20 aa, Entamoeba invadens
FKMFTKFVGSLTPPIQLKND

SEQ ID NO: 2936817 - protein, 17 aa, Entamoeba invadens
FKMKMDVVNCLKENIGV

SEQ ID NO: 2936818 - protein, 23 aa, Entamoeba invadens
FKMPKLNFSLSVGKVNIDLISEF

SEQ ID NO: 2936819 - protein, 25 aa, Entamoeba invadens
FKMPNSIFTLGFDCFFGCSNLMEIK

SEQ ID NO: 2936820 - protein, 20 aa, Entamoeba invadens
FKMPQEFLQELLLDAEPIND

SEQ ID NO: 2936821 - protein, 20 aa, Entamoeba invadens
FKMTDFSHWIYSLVKDEKEC

SEQ ID NO: 2936822 - protein, 18 aa, Entamoeba invadens
FKMTRIIRGEVVKCVQVE

SEQ ID NO: 2936823 - protein, 23 aa, Entamoeba invadens
FKMYARDASGFICTIIADNYFGY

SEQ ID NO: 2936824 - protein, 21 aa, Entamoeba invadens
FKNAMKISWKCKAKYPILAAL

SEQ ID NO: 2936825 - protein, 28 aa, Entamoeba invadens
FKNAMKYNPPRNMVHVFAKTLLKYFDDK

SEQ ID NO: 2936826 - protein, 21 aa, Entamoeba invadens
FKNATCLVVCDGCGWNKDSAR

SEQ ID NO: 2936827 - protein, 37 aa, Entamoeba invadens
FKNAYDMLKDLGLESCFKELLKEAALLSTSDSSSITL

SEQ ID NO: 2936828 - protein, 18 aa, Entamoeba invadens
FKNCCSLRHLTFPKTLNN

SEQ ID NO: 2936829 - protein, 17 aa, Entamoeba invadens
FKNCEQLVGLNFNENVV

SEQ ID NO: 2936830 - protein, 17 aa, Entamoeba invadens
FKNCNFTLLKLDVRSQS

SEQ ID NO: 2936831 - protein, 19 aa, Entamoeba invadens
FKNCNFTLLKLDVRSQSQF

SEQ ID NO: 2936832 - protein, 19 aa, Entamoeba invadens
FKNCYKLRTIKILGNTSSY

SEQ ID NO: 2936833 - protein, 21 aa, Entamoeba invadens
FKNDFCYEQAILIFLVNQFGA

SEQ ID NO: 2936834 - protein, 21 aa, Entamoeba invadens
FKNDFCYEQAILVLLVNKEYG

SEQ ID NO: 2936835 - protein, 25 aa, Entamoeba invadens
FKNEAKELLTEVGINKYALEHDDLV

SEQ ID NO: 2936836 - protein, 22 aa, Entamoeba invadens
FKNFLQLALKCLEIRNFNSFNS

SEQ ID NO: 2936837 - protein, 24 aa, Entamoeba invadens
FKNGEYQWAITLLNNVVFKNPRNE

SEQ ID NO: 2936838 - protein, 37 aa, Entamoeba invadens
FKNGIPINLTEIGDWAFSGCGIKELIVPKLELNNKVF

SEQ ID NO: 2936839 - protein, 22 aa, Entamoeba invadens
FKNGVCKGFGFVDVIDKENANR

SEQ ID NO: 2936840 - protein, 27 aa, Entamoeba invadens
FKNIGIKPPRGVLMYGPPGCGKTMIAR

SEQ ID NO: 2936841 - protein, 27 aa, Entamoeba invadens
FKNIPTHFVIVMSRLFKTVSKALGKRY

SEQ ID NO: 2936842 - protein, 21 aa, Entamoeba invadens
FKNIYCKIANAVCNHFWRAEG

SEQ ID NO: 2936843 - protein, 20 aa, Entamoeba invadens
FKNKVFKTCIIDAVVTGNYK

SEQ ID NO: 2936844 - protein, 20 aa, Entamoeba invadens
FKNLAVCFSPVLLTFYKDEK

SEQ ID NO: 2936845 - protein, 20 aa, Entamoeba invadens
FKNLEVLDSNVIIKALSVLN

SEQ ID NO: 2936846 - protein, 25 aa, Entamoeba invadens
FKNLMKFLYDKNCFVVAKEVEGKVC

SEQ ID NO: 2936847 - protein, 21 aa, Entamoeba invadens
FKNPKMWSSQLVDFVGKCLTF

SEQ ID NO: 2936848 - protein, 20 aa, Entamoeba invadens
FKNPKTHFRSCDDSFLEIEN

SEQ ID NO: 2936849 - protein, 20 aa, Entamoeba invadens
FKNRKGFLVFSIRVHRGNRK

SEQ ID NO: 2936850 - protein, 19 aa, Entamoeba invadens
FKNRVAMFQKMIDIALELE

SEQ ID NO: 2936851 - protein, 18 aa, Entamoeba invadens
FKNSFRLVEYSDKDIGFF

SEQ ID NO: 2936852 - protein, 26 aa, Entamoeba invadens
FKNSVLYFKDLCEYLKTINVDQNETK

SEQ ID NO: 2936853 - protein, 24 aa, Entamoeba invadens
FKNTACTIGKVLSLLSARTTTVEM

SEQ ID NO: 2936854 - protein, 23 aa, Entamoeba invadens
FKNVTLKSAMNIFYIDKTKMTLE

SEQ ID NO: 2936855 - protein, 17 aa, Entamoeba invadens
FKNVVNWYQETQRYSNL

SEQ ID NO: 2936856 - protein, 26 aa, Entamoeba invadens
FKNWKQGRCVVIKAPLLKIPNECFTN

SEQ ID NO: 2936857 - protein, 25 aa, Entamoeba invadens
FKNYLLDIFEPIIFGLSSGGDYSEE

SEQ ID NO: 2936858 - protein, 17 aa, Entamoeba invadens
FKNYNFLEEIVLSDDVK

SEQ ID NO: 2936859 - protein, 23 aa, Entamoeba invadens
FKPAEAYVSIKLDFETIKQLQLE

SEQ ID NO: 2936860 - protein, 19 aa, Entamoeba invadens
FKPAFPDLTKGVFSKVVDV

SEQ ID NO: 2936861 - protein, 17 aa, Entamoeba invadens
FKPATRIRAGEAAPKED

SEQ ID NO: 2936862 - protein, 24 aa, Entamoeba invadens
FKPFSKFVDLTWVFEMLKTRQFIA

SEQ ID NO: 2936863 - protein, 21 aa, Entamoeba invadens
FKPGMHPRIRLDILHECEQRI

SEQ ID NO: 2936864 - protein, 17 aa, Entamoeba invadens
FKPNFQFTPTIKPSVVE

SEQ ID NO: 2936865 - protein, 17 aa, Entamoeba invadens
FKPNTFIVQQKKPQKPL

SEQ ID NO: 2936866 - protein, 23 aa, Entamoeba invadens
FKPPRYRYQMDYRIWSAEQTTDF

SEQ ID NO: 2936867 - protein, 17 aa, Entamoeba invadens
FKPSPTLQKSAQSEYIT

SEQ ID NO: 2936868 - protein, 18 aa, Entamoeba invadens
FKPSSPVINFLKGVNQKI

SEQ ID NO: 2936869 - protein, 27 aa, Entamoeba invadens
FKQGDIYYCMICEFRGKKTTAYNHSNT

SEQ ID NO: 2936870 - protein, 19 aa, Entamoeba invadens
FKQGDTILVVEMDQSGWCL

SEQ ID NO: 2936871 - protein, 23 aa, Entamoeba invadens
FKQHPTAFARYVTQLIINAQDEE

SEQ ID NO: 2936872 - protein, 19 aa, Entamoeba invadens
FKQIMKGIEYIHSKNIIHG

SEQ ID NO: 2936873 - protein, 24 aa, Entamoeba invadens
FKQITRLRVPRVLYYSNKSYSTKD

SEQ ID NO: 2936874 - protein, 21 aa, Entamoeba invadens
FKQKEVPVWADGVEYYEVYRN

SEQ ID NO: 2936875 - protein, 21 aa, Entamoeba invadens
FKQLECAQRCTFHQTIDPKFH

SEQ ID NO: 2936876 - protein, 20 aa, Entamoeba invadens
FKQLIKSSGKLVLLDKLLPK

SEQ ID NO: 2936877 - protein, 21 aa, Entamoeba invadens
FKQREKFVARRVENEANNVET

SEQ ID NO: 2936878 - protein, 22 aa, Entamoeba invadens
FKQRVSFEERKAFAIQLRQKKP

SEQ ID NO: 2936879 - protein, 19 aa, Entamoeba invadens
FKRDARFASVKHRGGNKMD

SEQ ID NO: 2936880 - protein, 27 aa, Entamoeba invadens
FKRDEVFKEWLLCKAINGERSSIESPQ

SEQ ID NO: 2936881 - protein, 17 aa, Entamoeba invadens
FKREVLKKWVNETLIEQ

SEQ ID NO: 2936882 - protein, 19 aa, Entamoeba invadens
FKRKVIKGPGVLTFESDVV

SEQ ID NO: 2936883 - protein, 21 aa, Entamoeba invadens
FKRLESTSIHFPSTLLPKIAN

SEQ ID NO: 2936884 - protein, 19 aa, Entamoeba invadens
FKRLVYRAPEVFSKFLQNP

SEQ ID NO: 2936885 - protein, 22 aa, Entamoeba invadens
FKRMPYFLKELVELNNCLICII

SEQ ID NO: 2936886 - protein, 19 aa, Entamoeba invadens
FKRSESFTEIHVDHSTSEI

SEQ ID NO: 2936887 - protein, 20 aa, Entamoeba invadens
FKRSKIQAFIDLLKKLFPNL

SEQ ID NO: 2936888 - protein, 19 aa, Entamoeba invadens
FKRSSCGIASTKSSDIPFE

SEQ ID NO: 2936889 - protein, 28 aa, Entamoeba invadens
FKRTIPRLRGVYNFVKWLEEADRSHKMP

SEQ ID NO: 2936890 - protein, 19 aa, Entamoeba invadens
FKRVLKFSQLIAETTQALI

SEQ ID NO: 2936891 - protein, 24 aa, Entamoeba invadens
FKRVLKHLLLKHGFECIRSVSEAD

SEQ ID NO: 2936892 - protein, 21 aa, Entamoeba invadens
FKSCKKLKGVVISQNVQTIES

SEQ ID NO: 2936893 - protein, 17 aa, Entamoeba invadens
FKSDIVAVHPVKNVVYF

SEQ ID NO: 2936894 - protein, 20 aa, Entamoeba invadens
FKSGFFFGRTDKFVLENWDK

SEQ ID NO: 2936895 - protein, 17 aa, Entamoeba invadens
FKSGIFVHYKSVGIGNV

SEQ ID NO: 2936896 - protein, 20 aa, Entamoeba invadens
FKSGRGRVSSGRWGCGVFNN

SEQ ID NO: 2936897 - protein, 19 aa, Entamoeba invadens
FKSGVSLAEPIVRGQVKNW

SEQ ID NO: 2936898 - protein, 20 aa, Entamoeba invadens
FKSHFNNIFMVIKKIPTGMV

SEQ ID NO: 2936899 - protein, 22 aa, Entamoeba invadens
FKSKELRYNVSFNQKELFYFEV

SEQ ID NO: 2936900 - protein, 18 aa, Entamoeba invadens
FKSKIVIPQTLKYLVINN

SEQ ID NO: 2936901 - protein, 18 aa, Entamoeba invadens
FKSKKGFIQKGVDDLVML

SEQ ID NO: 2936902 - protein, 21 aa, Entamoeba invadens
FKSKLPITLVLELDDINKNKL

SEQ ID NO: 2936903 - protein, 26 aa, Entamoeba invadens
FKSLDTWKKEFLNGANVTNPKDFPFV

SEQ ID NO: 2936904 - protein, 18 aa, Entamoeba invadens
FKSLEFLEEVILPEHLIV

SEQ ID NO: 2936905 - protein, 17 aa, Entamoeba invadens
FKSLINMNLPGEENSVF

SEQ ID NO: 2936906 - protein, 25 aa, Entamoeba invadens
FKSLWRKVQTGGFIKVQLDDDNFTS

SEQ ID NO: 2936907 - protein, 17 aa, Entamoeba invadens
FKSPIMFEIQNTKTKRR

SEQ ID NO: 2936908 - protein, 24 aa, Entamoeba invadens
FKSPSGSLLLRFGTVRECSVSNGV

SEQ ID NO: 2936909 - protein, 17 aa, Entamoeba invadens
FKSPTLITSKDFLITLN

SEQ ID NO: 2936910 - protein, 20 aa, Entamoeba invadens
FKSSEIAASIIKEYLRELPN

SEQ ID NO: 2936911 - protein, 17 aa, Entamoeba invadens
FKSSLNLKEKSEEPKRM

SEQ ID NO: 2936912 - protein, 19 aa, Entamoeba invadens
FKSTSALFLSRPENPSPEE

SEQ ID NO: 2936913 - protein, 18 aa, Entamoeba invadens
FKSVEALIYVFDVTSETF

SEQ ID NO: 2936914 - protein, 34 aa, Entamoeba invadens
FKSYEELRLIILTDFFKHAFDGSGADNFYDAGSC

SEQ ID NO: 2936915 - protein, 19 aa, Entamoeba invadens
FKTAFLYIKQKRPIVFPNP

SEQ ID NO: 2936916 - protein, 20 aa, Entamoeba invadens
FKTAIFFKTIASIGLTLAGR

SEQ ID NO: 2936917 - protein, 32 aa, Entamoeba invadens
FKTATIGAMGLRFPGKVSNDFKVFLSSCFMFD

SEQ ID NO: 2936918 - protein, 20 aa, Entamoeba invadens
FKTATIGAMGLRNPTKVSKE

SEQ ID NO: 2936919 - protein, 17 aa, Entamoeba invadens
FKTEGPIDKKEEDIERK

SEQ ID NO: 2936920 - protein, 23 aa, Entamoeba invadens
FKTFTEMYFRYRRLCDKSQPVSF

SEQ ID NO: 2936921 - protein, 20 aa, Entamoeba invadens
FKTGELNGQVIFTAAFFTLD

SEQ ID NO: 2936922 - protein, 22 aa, Entamoeba invadens
FKTHDFLAVLDMKWDRQRKEEI

SEQ ID NO: 2936923 - protein, 19 aa, Entamoeba invadens
FKTIFVIVMEMGWTANEFQ

SEQ ID NO: 2936924 - protein, 25 aa, Entamoeba invadens
FKTIKRHYVEVLKYTSFDLFVSQHK

SEQ ID NO: 2936925 - protein, 21 aa, Entamoeba invadens
FKTIRDFIRLEFVCKKYYCNM

SEQ ID NO: 2936926 - protein, 20 aa, Entamoeba invadens
FKTLCESLETRLGAAEDVLD

SEQ ID NO: 2936927 - protein, 25 aa, Entamoeba invadens
FKTLRELIMRIPLQVSNNLRDEINN

SEQ ID NO: 2936928 - protein, 20 aa, Entamoeba invadens
FKTLSRCHGSVMQLYQDIKN

SEQ ID NO: 2936929 - protein, 18 aa, Entamoeba invadens
FKTLTLKISTIFKSCGFK

SEQ ID NO: 2936930 - protein, 26 aa, Entamoeba invadens
FKTMREWKGRPDVFVPLLKTYVIKCS

SEQ ID NO: 2936931 - protein, 23 aa, Entamoeba invadens
FKTPEHLTTLKVCENSKNIELFV

SEQ ID NO: 2936932 - protein, 20 aa, Entamoeba invadens
FKTPEHLTTLNVCDNSENIE

SEQ ID NO: 2936933 - protein, 17 aa, Entamoeba invadens
FKTPRCVVTKISNDALG

SEQ ID NO: 2936934 - protein, 19 aa, Entamoeba invadens
FKTQEGFLLAYSVIISVKK

SEQ ID NO: 2936935 - protein, 25 aa, Entamoeba invadens
FKTRRMICPRVFFSYTNKHDILSFK

SEQ ID NO: 2936936 - protein, 20 aa, Entamoeba invadens
FKTRSEYNFKEIPQNKQYPF

SEQ ID NO: 2936937 - protein, 27 aa, Entamoeba invadens
FKTSIFWKLCCVYDHIVVHTLIRYCST

SEQ ID NO: 2936938 - protein, 28 aa, Entamoeba invadens
FKTSYFVSLLRKMFELYPKTRDDFTFII

SEQ ID NO: 2936939 - protein, 19 aa, Entamoeba invadens
FKTTCEEMSEEYEKRNISH

SEQ ID NO: 2936940 - protein, 23 aa, Entamoeba invadens
FKTTHFDRIIARDIKEHMCYFAS

SEQ ID NO: 2936941 - protein, 26 aa, Entamoeba invadens
FKVAEKEGKKKAAVRMTGNEDAEFDP

SEQ ID NO: 2936942 - protein, 19 aa, Entamoeba invadens
FKVDKEFVNEWVLALNYCS

SEQ ID NO: 2936943 - protein, 20 aa, Entamoeba invadens
FKVECLPDFIKNISQPFVFN

SEQ ID NO: 2936944 - protein, 19 aa, Entamoeba invadens
FKVEIENVVTAKPETNTSE

SEQ ID NO: 2936945 - protein, 20 aa, Entamoeba invadens
FKVFINTGGIPKLCEKSNPN

SEQ ID NO: 2936946 - protein, 22 aa, Entamoeba invadens
FKVFLSSCFMFDPKMRPKCEDL

SEQ ID NO: 2936947 - protein, 18 aa, Entamoeba invadens
FKVLYGQGMSDLCSLVMN

SEQ ID NO: 2936948 - protein, 17 aa, Entamoeba invadens
FKVNVLYDMVMQAQTIG

SEQ ID NO: 2936949 - protein, 25 aa, Entamoeba invadens
FKVPDLRKIYKMECIPPQINTNYNE

SEQ ID NO: 2936950 - protein, 22 aa, Entamoeba invadens
FKVPKLKKAKVEKMEEESESQK

SEQ ID NO: 2936951 - protein, 21 aa, Entamoeba invadens
FKVSCKTMKESPPNIIYKEIC

SEQ ID NO: 2936952 - protein, 20 aa, Entamoeba invadens
FKVTHLPTMLAGYVEVEVVF

SEQ ID NO: 2936953 - protein, 21 aa, Entamoeba invadens
FKWVDLRSWISSTLVSTINEK

SEQ ID NO: 2936954 - protein, 20 aa, Entamoeba invadens
FKYAKGNLFNFVLQDKEGGE

SEQ ID NO: 2936955 - protein, 18 aa, Entamoeba invadens
FKYFSRLNDASVMCLVGN

SEQ ID NO: 2936956 - protein, 19 aa, Entamoeba invadens
FKYGKIKIFSKDKEIEALK

SEQ ID NO: 2936957 - protein, 20 aa, Entamoeba invadens
FKYIEACARAGQFQELARIV

SEQ ID NO: 2936958 - protein, 17 aa, Entamoeba invadens
FKYIGVVDFDLIDGVLA

SEQ ID NO: 2936959 - protein, 28 aa, Entamoeba invadens
FKYLKYLLSNTCKFCSKEFETIEKLNFH

SEQ ID NO: 2936960 - protein, 18 aa, Entamoeba invadens
FKYPLDFGSVTSLTRSKE

SEQ ID NO: 2936961 - protein, 19 aa, Entamoeba invadens
FKYPLDFGSVTSLTRSKED

SEQ ID NO: 2936962 - protein, 20 aa, Entamoeba invadens
FKYPWKIAEFVMSGKRLERK

SEQ ID NO: 2936963 - protein, 20 aa, Entamoeba invadens
FKYQQELPKTIAVRQQQSVS

SEQ ID NO: 2936964 - protein, 19 aa, Entamoeba invadens
FKYRCITNGHPLDVNIENG

SEQ ID NO: 2936965 - protein, 20 aa, Entamoeba invadens
FKYSIFLVKEFRYFQIECPS

SEQ ID NO: 2936966 - protein, 22 aa, Entamoeba invadens
FKYSTLRKSRFLTLKQRAVRYG

SEQ ID NO: 2936967 - protein, 25 aa, Entamoeba invadens
FLAANCPKFVCPAMNSTMYLNPITQ

SEQ ID NO: 2936968 - protein, 35 aa, Entamoeba invadens
FLADHRRLNVALTRARKGLVMVGDAYTLRHNCIFV

SEQ ID NO: 2936969 - protein, 17 aa, Entamoeba invadens
FLAELYQHFRDVKTKHT

SEQ ID NO: 2936970 - protein, 19 aa, Entamoeba invadens
FLAEQLILFDLKEFQKVHA

SEQ ID NO: 2936971 - protein, 28 aa, Entamoeba invadens
FLAHPEMFWKMSTELRVATSNKQPTKAH

SEQ ID NO: 2936972 - protein, 24 aa, Entamoeba invadens
FLAKDMWRVVFGYQVNYGKVRDKA

SEQ ID NO: 2936973 - protein, 17 aa, Entamoeba invadens
FLAKYGVNRCIKKGGKI

SEQ ID NO: 2936974 - protein, 17 aa, Entamoeba invadens
FLAKYGVNRCIKKSGKI

SEQ ID NO: 2936975 - protein, 18 aa, Entamoeba invadens
FLALLGYETDKWIPLASY

SEQ ID NO: 2936976 - protein, 19 aa, Entamoeba invadens
FLAPELFFNPEIFSSDFTT

SEQ ID NO: 2936977 - protein, 17 aa, Entamoeba invadens
FLASVGVDFKFKEVTYN

SEQ ID NO: 2936978 - protein, 19 aa, Entamoeba invadens
FLASVLIERGFTLNLTLIT

SEQ ID NO: 2936979 - protein, 18 aa, Entamoeba invadens
FLAVAGFGNCPGEVDVYE

SEQ ID NO: 2936980 - protein, 20 aa, Entamoeba invadens
FLCCDCGLEKVMIDGNKEVL

SEQ ID NO: 2936981 - protein, 24 aa, Entamoeba invadens
FLCDKRSTMSVPVPKLLQKISKVD

SEQ ID NO: 2936982 - protein, 23 aa, Entamoeba invadens
FLCDLPHNAVCYFHNLKYDGSSL

SEQ ID NO: 2936983 - protein, 23 aa, Entamoeba invadens
FLCDLPHNDVCYFHNLKYDGSFL

SEQ ID NO: 2936984 - protein, 19 aa, Entamoeba invadens
FLCEECLQLVLQRMDEFMD

SEQ ID NO: 2936985 - protein, 18 aa, Entamoeba invadens
FLCEKGADANHQANNETF

SEQ ID NO: 2936986 - protein, 18 aa, Entamoeba invadens
FLCGLTCCEDMKVLYNSR

SEQ ID NO: 2936987 - protein, 17 aa, Entamoeba invadens
FLCNCLLGDGMCVCTPL

SEQ ID NO: 2936988 - protein, 26 aa, Entamoeba invadens
FLCQKYRKTFKMNFEMKHVEIPEEVE

SEQ ID NO: 2936989 - protein, 27 aa, Entamoeba invadens
FLCSLILRHPLPVLVAVYNSHQFQVSI

SEQ ID NO: 2936990 - protein, 25 aa, Entamoeba invadens
FLCVCDCLLSYGFRKIGEELKAKLD

SEQ ID NO: 2936991 - protein, 26 aa, Entamoeba invadens
FLCVFPTSYCILKGLDIKEITFNNSG

SEQ ID NO: 2936992 - protein, 17 aa, Entamoeba invadens
FLCVGDVSGVITILSVK

SEQ ID NO: 2936993 - protein, 22 aa, Entamoeba invadens
FLDCWDAILEHVIRMPQHKLIP

SEQ ID NO: 2936994 - protein, 19 aa, Entamoeba invadens
FLDEIKAKLPVVLTPQHHM

SEQ ID NO: 2936995 - protein, 20 aa, Entamoeba invadens
FLDGKRSCQFCGKLLCKSCC

SEQ ID NO: 2936996 - protein, 34 aa, Entamoeba invadens
FLDKPDGYFSWEIGKFIHRHFCKNGYDFDDIFKF

SEQ ID NO: 2936997 - protein, 21 aa, Entamoeba invadens
FLDKTEELFLKKCTDHINEAL

SEQ ID NO: 2936998 - protein, 18 aa, Entamoeba invadens
FLDNCLKDLELENLKNQL

SEQ ID NO: 2936999 - protein, 20 aa, Entamoeba invadens
FLDNLRYVGDVAVTNVKGID

SEQ ID NO: 2937000 - protein, 17 aa, Entamoeba invadens
FLDNMRHAFATSPDFRE

SEQ ID NO: 2937001 - protein, 21 aa, Entamoeba invadens
FLDVSISFKFKGVFHTAQGQN

SEQ ID NO: 2937002 - protein, 22 aa, Entamoeba invadens
FLECASCFPVIVNHDHKNLIIK

SEQ ID NO: 2937003 - protein, 18 aa, Entamoeba invadens
FLECFCIVTDKPFESLYS

SEQ ID NO: 2937004 - protein, 27 aa, Entamoeba invadens
FLEDADFPFLFILKVIYALTREEDNNS

SEQ ID NO: 2937005 - protein, 19 aa, Entamoeba invadens
FLEELTKLYKLSKTKKSGS

SEQ ID NO: 2937006 - protein, 17 aa, Entamoeba invadens
FLEERDALIQRALVVGN

SEQ ID NO: 2937007 - protein, 17 aa, Entamoeba invadens
FLEETCLTFVNTLLAKK

SEQ ID NO: 2937008 - protein, 27 aa, Entamoeba invadens
FLEFIPNLLNAIALFSLKSRYEQIFER

SEQ ID NO: 2937009 - protein, 18 aa, Entamoeba invadens
FLEGCANSFTSYDLAFCI

SEQ ID NO: 2937010 - protein, 21 aa, Entamoeba invadens
FLEHSKNIFGGEVITYKQHFL

SEQ ID NO: 2937011 - protein, 17 aa, Entamoeba invadens
FLEKITLLENLYDTKEK

SEQ ID NO: 2937012 - protein, 17 aa, Entamoeba invadens
FLEKVCQQVKIVVLKFE

SEQ ID NO: 2937013 - protein, 17 aa, Entamoeba invadens
FLENPKIMVANTAMDND

SEQ ID NO: 2937014 - protein, 30 aa, Entamoeba invadens
FLEPNAPKYEVLFNCCGLFDLYQLKKIVWD

SEQ ID NO: 2937015 - protein, 24 aa, Entamoeba invadens
FLEQKARLRWNNMVNKRRPNYNEL

SEQ ID NO: 2937016 - protein, 29 aa, Entamoeba invadens
FLERCCSLVLQLYASIAYHYYLDDESATK

SEQ ID NO: 2937017 - protein, 23 aa, Entamoeba invadens
FLETLGTFLIEFRRKTLSSTDNC

SEQ ID NO: 2937018 - protein, 19 aa, Entamoeba invadens
FLEVEGFSTVSLLKYVNAA

SEQ ID NO: 2937019 - protein, 17 aa, Entamoeba invadens
FLEYALDVARIAKAKGL

SEQ ID NO: 2937020 - protein, 21 aa, Entamoeba invadens
FLFCHLEELTIWSVTGLSLPK

SEQ ID NO: 2937021 - protein, 21 aa, Entamoeba invadens
FLFDLVFCSTFGGSYKISGES

SEQ ID NO: 2937022 - protein, 24 aa, Entamoeba invadens
FLFFLDDCLSFFSDFQVRKDALDF

SEQ ID NO: 2937023 - protein, 25 aa, Entamoeba invadens
FLFGGRIVVVGGDFRQILPVIPNGT

SEQ ID NO: 2937024 - protein, 24 aa, Entamoeba invadens
FLFHAMCSIVPFPTIQSIFDKSYG

SEQ ID NO: 2937025 - protein, 20 aa, Entamoeba invadens
FLFIKELRFDGYVVDVSEFI

SEQ ID NO: 2937026 - protein, 29 aa, Entamoeba invadens
FLFQKPKKFTVHTSLPFINIEKCFDQTNN

SEQ ID NO: 2937027 - protein, 18 aa, Entamoeba invadens
FLFRLRKSIMTKQVSLPP

SEQ ID NO: 2937028 - protein, 18 aa, Entamoeba invadens
FLFSRSFQDFAFSVAKTS

SEQ ID NO: 2937029 - protein, 18 aa, Entamoeba invadens
FLFSSFKHFAMCLTDELK

SEQ ID NO: 2937030 - protein, 19 aa, Entamoeba invadens
FLFTMIMRDSERFSVQRGL

SEQ ID NO: 2937031 - protein, 26 aa, Entamoeba invadens
FLGEGWRPLYQRTFTTFAKLWKLQQT

SEQ ID NO: 2937032 - protein, 17 aa, Entamoeba invadens
FLGEKCFARSTGLKSIT

SEQ ID NO: 2937033 - protein, 21 aa, Entamoeba invadens
FLGEKYMRFDPVLPEQYDLDC

SEQ ID NO: 2937034 - protein, 32 aa, Entamoeba invadens
FLGEQYRKIWLDWYVYYCGKLGSVPNDKIMFG

SEQ ID NO: 2937035 - protein, 17 aa, Entamoeba invadens
FLGGDSIHIQIVPGDMK

SEQ ID NO: 2937036 - protein, 21 aa, Entamoeba invadens
FLGNKLKVAGVINREPAPFVL

SEQ ID NO: 2937037 - protein, 19 aa, Entamoeba invadens
FLGNYASRNGHEIDLIVDA

SEQ ID NO: 2937038 - protein, 17 aa, Entamoeba invadens
FLGPSGVGKTELAKALA

SEQ ID NO: 2937039 - protein, 18 aa, Entamoeba invadens
FLGPSGVGKTELAKALAE

SEQ ID NO: 2937040 - protein, 24 aa, Entamoeba invadens
FLGSKRNSILFAFGKGDLVVYKKD

SEQ ID NO: 2937041 - protein, 19 aa, Entamoeba invadens
FLGSVFECPSSRYFVGTTD

SEQ ID NO: 2937042 - protein, 24 aa, Entamoeba invadens
FLGTLPYLRVYRMFVGNNTTGLQA

SEQ ID NO: 2937043 - protein, 17 aa, Entamoeba invadens
FLHEDLFNYFLDKMENK

SEQ ID NO: 2937044 - protein, 18 aa, Entamoeba invadens
FLHESPWERLRLLREKIP

SEQ ID NO: 2937045 - protein, 26 aa, Entamoeba invadens
FLHFRETSTFYLVRKCVDTIGSTSSV

SEQ ID NO: 2937046 - protein, 18 aa, Entamoeba invadens
FLHIPKNVSMLIKYIKEK

SEQ ID NO: 2937047 - protein, 17 aa, Entamoeba invadens
FLHIVFNNIEFIFCPED

SEQ ID NO: 2937048 - protein, 17 aa, Entamoeba invadens
FLHPKVECLFTTDEEPG

SEQ ID NO: 2937049 - protein, 27 aa, Entamoeba invadens
FLIDKSKLFLSGEVIRVIGDIEQTMQT

SEQ ID NO: 2937050 - protein, 18 aa, Entamoeba invadens
FLIDNGVEPRYCRSETFT

SEQ ID NO: 2937051 - protein, 23 aa, Entamoeba invadens
FLIEAKTALSFITFVCDRKAAPS

SEQ ID NO: 2937052 - protein, 17 aa, Entamoeba invadens
FLIEKAKLFMVGKQIHI

SEQ ID NO: 2937053 - protein, 25 aa, Entamoeba invadens
FLIGRGSKTLHCFEVTDEDPYVFPL

SEQ ID NO: 2937054 - protein, 19 aa, Entamoeba invadens
FLIICNALEWVIERTQHLT

SEQ ID NO: 2937055 - protein, 18 aa, Entamoeba invadens
FLIKKEKQDFAFLAGAER

SEQ ID NO: 2937056 - protein, 27 aa, Entamoeba invadens
FLILPVQRLPRYILLLETLIKHTPEVA

SEQ ID NO: 2937057 - protein, 17 aa, Entamoeba invadens
FLISKTMTYHGESLDVG

SEQ ID NO: 2937058 - protein, 17 aa, Entamoeba invadens
FLKCSSLVRLKMPKERI

SEQ ID NO: 2937059 - protein, 24 aa, Entamoeba invadens
FLKCVSTIHPRCVYTSGKASSAAG

SEQ ID NO: 2937060 - protein, 27 aa, Entamoeba invadens
FLKEDFSFYGCNCISFYLVPKVLKGLK

SEQ ID NO: 2937061 - protein, 21 aa, Entamoeba invadens
FLKGNDVCIGFVFYPQQSRNY

SEQ ID NO: 2937062 - protein, 19 aa, Entamoeba invadens
FLKGYGMSAIKAYTYSLTK

SEQ ID NO: 2937063 - protein, 27 aa, Entamoeba invadens
FLKHAFDYKTLYDIFDYRKRSNISEEK

SEQ ID NO: 2937064 - protein, 23 aa, Entamoeba invadens
FLKHKPQILEIVLKKIFEFCEDP

SEQ ID NO: 2937065 - protein, 20 aa, Entamoeba invadens
FLKHREAYEMMISYYNAFCE

SEQ ID NO: 2937066 - protein, 22 aa, Entamoeba invadens
FLKIFKRTSLLRNFVDRIVNDF

SEQ ID NO: 2937067 - protein, 20 aa, Entamoeba invadens
FLKLRQFPVLEMSEFMQLFV

SEQ ID NO: 2937068 - protein, 23 aa, Entamoeba invadens
FLKNGPVTWKWSKDSIKQLNKFF

SEQ ID NO: 2937069 - protein, 22 aa, Entamoeba invadens
FLKQQCVKQWFFLQDTIFTSVK

SEQ ID NO: 2937070 - protein, 18 aa, Entamoeba invadens
FLKQRCSILLKCLVLRKL

SEQ ID NO: 2937071 - protein, 30 aa, Entamoeba invadens
FLKRGVELTKRIPLIFSTALSTWIDDSSIT

SEQ ID NO: 2937072 - protein, 21 aa, Entamoeba invadens
FLKTDFGKLYYADSEKDMEKK

SEQ ID NO: 2937073 - protein, 18 aa, Entamoeba invadens
FLKTEKWMSQFIEADGVG

SEQ ID NO: 2937074 - protein, 17 aa, Entamoeba invadens
FLKVMLSQMRDGLPKVL

SEQ ID NO: 2937075 - protein, 18 aa, Entamoeba invadens
FLKWAPRTLDLFQYSRRD

SEQ ID NO: 2937076 - protein, 19 aa, Entamoeba invadens
FLKYLAIAAPVKGLTAEVY

SEQ ID NO: 2937077 - protein, 18 aa, Entamoeba invadens
FLLDKYLVIYKIVSDLII

SEQ ID NO: 2937078 - protein, 19 aa, Entamoeba invadens
FLLEFKEFDPLYAGDGAGI

SEQ ID NO: 2937079 - protein, 17 aa, Entamoeba invadens
FLLEIYKNGELLKKVDF

SEQ ID NO: 2937080 - protein, 22 aa, Entamoeba invadens
FLLEKILDFAMYVIYNEGNNFT

SEQ ID NO: 2937081 - protein, 17 aa, Entamoeba invadens
FLLFLPLDGCIKSSRAI

SEQ ID NO: 2937082 - protein, 17 aa, Entamoeba invadens
FLLGMLVKCGYNVYVNK

SEQ ID NO: 2937083 - protein, 19 aa, Entamoeba invadens
FLLGYKEGSDFYLGTIDAK

SEQ ID NO: 2937084 - protein, 20 aa, Entamoeba invadens
FLLINFSNLEQITWTDFLIS

SEQ ID NO: 2937085 - protein, 26 aa, Entamoeba invadens
FLLKKKLSTVSGWKRRWVVLCRGFLF

SEQ ID NO: 2937086 - protein, 19 aa, Entamoeba invadens
FLLKMVAAAREFMGSTSID

SEQ ID NO: 2937087 - protein, 26 aa, Entamoeba invadens
FLLLQRLCGIYKSFCNTCTQYQQKQN

SEQ ID NO: 2937088 - protein, 17 aa, Entamoeba invadens
FLLLRNVCENVLFERKR

SEQ ID NO: 2937089 - protein, 23 aa, Entamoeba invadens
FLLNCGVLTKVVRLFTMSNTLQT

SEQ ID NO: 2937090 - protein, 18 aa, Entamoeba invadens
FLLQCFQKNPLARASSTS

SEQ ID NO: 2937091 - protein, 18 aa, Entamoeba invadens
FLLQRLNTLTTLQLSDNP

SEQ ID NO: 2937092 - protein, 22 aa, Entamoeba invadens
FLLRVVLEFTMKEELINFMCIN

SEQ ID NO: 2937093 - protein, 18 aa, Entamoeba invadens
FLLSGCLIHLPTLKMPKP

SEQ ID NO: 2937094 - protein, 18 aa, Entamoeba invadens
FLLSPYISPPHPNHSTNS

SEQ ID NO: 2937095 - protein, 22 aa, Entamoeba invadens
FLLSTRSGGLGINLQSADTVIL

SEQ ID NO: 2937096 - protein, 17 aa, Entamoeba invadens
FLLVFEIQGGKTLFITF

SEQ ID NO: 2937097 - protein, 29 aa, Entamoeba invadens
FLLYDVPSNYGWLFLSARNGMLSESVSKI

SEQ ID NO: 2937098 - protein, 17 aa, Entamoeba invadens
FLMDFAFEGELTVKGKS

SEQ ID NO: 2937099 - protein, 23 aa, Entamoeba invadens
FLMFVHQQLKVMIFALNKEQNKL

SEQ ID NO: 2937100 - protein, 23 aa, Entamoeba invadens
FLMKVALNFFSRQTLYSFIQVSK

SEQ ID NO: 2937101 - protein, 23 aa, Entamoeba invadens
FLMLRNLCYGKYHAADVVDQSNT

SEQ ID NO: 2937102 - protein, 18 aa, Entamoeba invadens
FLMPCATLNPLLMNMNDK

SEQ ID NO: 2937103 - protein, 20 aa, Entamoeba invadens
FLMTFKRGVKEGEIVQIYNT

SEQ ID NO: 2937104 - protein, 24 aa, Entamoeba invadens
FLNCVDLLLQQHFVNFEFTDTLIA

SEQ ID NO: 2937105 - protein, 26 aa, Entamoeba invadens
FLNDICDYKNWFVCDFEELKNPQANL

SEQ ID NO: 2937106 - protein, 19 aa, Entamoeba invadens
FLNIYFEKLELGIVVNLEI

SEQ ID NO: 2937107 - protein, 25 aa, Entamoeba invadens
FLNKEFPFGVVVNVEKKDVAEQAML

SEQ ID NO: 2937108 - protein, 18 aa, Entamoeba invadens
FLNKGCVGQNVPHLLNLM

SEQ ID NO: 2937109 - protein, 20 aa, Entamoeba invadens
FLNLIWKYKHGNIIDILGVY

SEQ ID NO: 2937110 - protein, 24 aa, Entamoeba invadens
FLNLKCPLERGLIKDFDCMKQLWD

SEQ ID NO: 2937111 - protein, 19 aa, Entamoeba invadens
FLNLKSLTKSAVFVNKNAA

SEQ ID NO: 2937112 - protein, 18 aa, Entamoeba invadens
FLNQHDFSSLSLDKVPSL

SEQ ID NO: 2937113 - protein, 22 aa, Entamoeba invadens
FLNRFADLLKFRSVPTTLSTAQ

SEQ ID NO: 2937114 - protein, 17 aa, Entamoeba invadens
FLNRFADSLKFRPVPTR

SEQ ID NO: 2937115 - protein, 20 aa, Entamoeba invadens
FLNRIWKYKHGNIIDILGVY

SEQ ID NO: 2937116 - protein, 17 aa, Entamoeba invadens
FLNSTGFASSRKEANKL

SEQ ID NO: 2937117 - protein, 33 aa, Entamoeba invadens
FLPFISRLGNYAIRPRTLMKFLALLNTKNCSQD

SEQ ID NO: 2937118 - protein, 19 aa, Entamoeba invadens
FLPGGRFVAIGTLGGSIEI

SEQ ID NO: 2937119 - protein, 17 aa, Entamoeba invadens
FLPKMKYEILPLAQEGF

SEQ ID NO: 2937120 - protein, 23 aa, Entamoeba invadens
FLPKQRRTGVFSATIPDELNKLV

SEQ ID NO: 2937121 - protein, 21 aa, Entamoeba invadens
FLPLDTFVLCYSAIYDWNVTL

SEQ ID NO: 2937122 - protein, 17 aa, Entamoeba invadens
FLPQLPAALQIVLGPNL

SEQ ID NO: 2937123 - protein, 19 aa, Entamoeba invadens
FLPQMIEIINYCMSLKATN

SEQ ID NO: 2937124 - protein, 25 aa, Entamoeba invadens
FLPSLEMYYVLCLMDHIVKRENNFR

SEQ ID NO: 2937125 - protein, 19 aa, Entamoeba invadens
FLPSTWDFVVRRVICITFK

SEQ ID NO: 2937126 - protein, 18 aa, Entamoeba invadens
FLPSYTFSYCEKLKVVFG

SEQ ID NO: 2937127 - protein, 17 aa, Entamoeba invadens
FLQCIRLTEIVKNERLY

SEQ ID NO: 2937128 - protein, 18 aa, Entamoeba invadens
FLQFPPDVIFPIISDALT

SEQ ID NO: 2937129 - protein, 21 aa, Entamoeba invadens
FLQGRVKSGDGVELVENERIV

SEQ ID NO: 2937130 - protein, 26 aa, Entamoeba invadens
FLQLPRRILQMYPLNVPFHLNYVVMV

SEQ ID NO: 2937131 - protein, 27 aa, Entamoeba invadens
FLQRRIKLLDLFCCVGGDSIQHATQNF

SEQ ID NO: 2937132 - protein, 20 aa, Entamoeba invadens
FLRCRSCGKETSVYVPPCCG

SEQ ID NO: 2937133 - protein, 21 aa, Entamoeba invadens
FLRDNIHIINNWTELRCKEIL

SEQ ID NO: 2937134 - protein, 27 aa, Entamoeba invadens
FLRENMMANLFFNYDCDPYCTDLFQFF

SEQ ID NO: 2937135 - protein, 24 aa, Entamoeba invadens
FLRGCDLDSFLLVNCTYPENQFGL

SEQ ID NO: 2937136 - protein, 17 aa, Entamoeba invadens
FLRHRVVLYECLFSGND

SEQ ID NO: 2937137 - protein, 27 aa, Entamoeba invadens
FLRNFLFDACFEFGFFFESKMSKNSMK

SEQ ID NO: 2937138 - protein, 28 aa, Entamoeba invadens
FLRNLCLSNCPTFRHLSIPFSVTSLTLK

SEQ ID NO: 2937139 - protein, 20 aa, Entamoeba invadens
FLRQYYIDSIRAMSGNLICG

SEQ ID NO: 2937140 - protein, 20 aa, Entamoeba invadens
FLRREVSKQILMTFNVQKTN

SEQ ID NO: 2937141 - protein, 24 aa, Entamoeba invadens
FLRTLRKGKKYVMRENNDANVIYH

SEQ ID NO: 2937142 - protein, 22 aa, Entamoeba invadens
FLRVSKKCRRVLSLFEYNPVTL

SEQ ID NO: 2937143 - protein, 21 aa, Entamoeba invadens
FLRVVHCPNLMDFPIPQSVRL

SEQ ID NO: 2937144 - protein, 21 aa, Entamoeba invadens
FLRVYQKFKYQEVGLNKLYQL

SEQ ID NO: 2937145 - protein, 18 aa, Entamoeba invadens
FLRWCLNAGCVSDTLCEC

SEQ ID NO: 2937146 - protein, 22 aa, Entamoeba invadens
FLRYKKSHFVFKSVLYTSTDCQ

SEQ ID NO: 2937147 - protein, 32 aa, Entamoeba invadens
FLSDHRRLNVALTRAKRGLVIVGDAHTLISNQ

SEQ ID NO: 2937148 - protein, 17 aa, Entamoeba invadens
FLSDLLNEFGVISISTQ

SEQ ID NO: 2937149 - protein, 24 aa, Entamoeba invadens
FLSDPFGRLSFYGMKAVVSPNGQY

SEQ ID NO: 2937150 - protein, 25 aa, Entamoeba invadens
FLSEEVYSLVALLWERGVFDVKNAN

SEQ ID NO: 2937151 - protein, 20 aa, Entamoeba invadens
FLSFCGKSVDFDCLKGVVSR

SEQ ID NO: 2937152 - protein, 18 aa, Entamoeba invadens
FLSFSDFVALEMVCKKFR

SEQ ID NO: 2937153 - protein, 18 aa, Entamoeba invadens
FLSHLKCKIVTLRDNSFD

SEQ ID NO: 2937154 - protein, 19 aa, Entamoeba invadens
FLSISSLHVNLSFANEKSL

SEQ ID NO: 2937155 - protein, 19 aa, Entamoeba invadens
FLSKCSISNFAQHLLETFE

SEQ ID NO: 2937156 - protein, 19 aa, Entamoeba invadens
FLSKSLLCLESNVVAITSP

SEQ ID NO: 2937157 - protein, 24 aa, Entamoeba invadens
FLSLPRGDFLIHCGDFSNSKEYSI

SEQ ID NO: 2937158 - protein, 18 aa, Entamoeba invadens
FLSLPRKVVIYDKFEEKD

SEQ ID NO: 2937159 - protein, 20 aa, Entamoeba invadens
FLSLSPCVIGKQLIFYHREL

SEQ ID NO: 2937160 - protein, 30 aa, Entamoeba invadens
FLSNFSVFKCFPERCVPSLDTMTEYLLSYS

SEQ ID NO: 2937161 - protein, 20 aa, Entamoeba invadens
FLSNLVLHPFVINRGIFQCD

SEQ ID NO: 2937162 - protein, 25 aa, Entamoeba invadens
FLSNSICIGYRCGTIKYYVEDLVQP

SEQ ID NO: 2937163 - protein, 18 aa, Entamoeba invadens
FLSQDGWKSYMLNTKDAI

SEQ ID NO: 2937164 - protein, 18 aa, Entamoeba invadens
FLSSTSWVAELNEPINKE

SEQ ID NO: 2937165 - protein, 17 aa, Entamoeba invadens
FLSSVMVMQRMVVGYVM

SEQ ID NO: 2937166 - protein, 18 aa, Entamoeba invadens
FLTELGIPGEHIRFRQHL

SEQ ID NO: 2937167 - protein, 17 aa, Entamoeba invadens
FLTENWKKQKYFKKKRG

SEQ ID NO: 2937168 - protein, 21 aa, Entamoeba invadens
FLTEQVRFLLPIIEKSMSISQ

SEQ ID NO: 2937169 - protein, 23 aa, Entamoeba invadens
FLTGFPLFGMNGFWKLINKDDPW

SEQ ID NO: 2937170 - protein, 23 aa, Entamoeba invadens
FLTHEVCTVMGETILKNYKFPVT

SEQ ID NO: 2937171 - protein, 35 aa, Entamoeba invadens
FLTHLYWSFSTEKCFYFVMDYCAGGNFYRALRKTP

SEQ ID NO: 2937172 - protein, 26 aa, Entamoeba invadens
FLTTDWKSLMDFEWNIYKLNLLRNPI

SEQ ID NO: 2937173 - protein, 23 aa, Entamoeba invadens
FLTVRSDPFKDFNFVALTMSEFV

SEQ ID NO: 2937174 - protein, 20 aa, Entamoeba invadens
FLTVVRRIFTDFIKHSSFIS

SEQ ID NO: 2937175 - protein, 27 aa, Entamoeba invadens
FLTYLPKRENFAACWQTANLLKVDFLR

SEQ ID NO: 2937176 - protein, 17 aa, Entamoeba invadens
FLVAEWYQLCLTYNKMK

SEQ ID NO: 2937177 - protein, 19 aa, Entamoeba invadens
FLVCADFKGSQDIEEVINF

SEQ ID NO: 2937178 - protein, 17 aa, Entamoeba invadens
FLVEKMGLESENDKMNF

SEQ ID NO: 2937179 - protein, 17 aa, Entamoeba invadens
FLVIRSLSDVPSANAEN

SEQ ID NO: 2937180 - protein, 20 aa, Entamoeba invadens
FLVLPCLIASVVDTRKKDIL

SEQ ID NO: 2937181 - protein, 18 aa, Entamoeba invadens
FLVQVMSQALNTYRPFQA

SEQ ID NO: 2937182 - protein, 18 aa, Entamoeba invadens
FLVRTGFNTFLWCGSKTS

SEQ ID NO: 2937183 - protein, 17 aa, Entamoeba invadens
FLVVDDVTSKIMWFVNK

SEQ ID NO: 2937184 - protein, 19 aa, Entamoeba invadens
FLVVLDFMSTVGIKDAQPM

SEQ ID NO: 2937185 - protein, 23 aa, Entamoeba invadens
FLVVTDRGSIFGFYQNDLVDKMK

SEQ ID NO: 2937186 - protein, 18 aa, Entamoeba invadens
FLVYKFDDEMSFRHVYNW

SEQ ID NO: 2937187 - protein, 17 aa, Entamoeba invadens
FLWSNAYPKTIYMYPWT

SEQ ID NO: 2937188 - protein, 18 aa, Entamoeba invadens
FLWTFVLNNENEFDEAKC

SEQ ID NO: 2937189 - protein, 22 aa, Entamoeba invadens
FLYASQAFLEFFTYCGAGEIRR

SEQ ID NO: 2937190 - protein, 24 aa, Entamoeba invadens
FLYDIQVGCIIYQLVFAENPEHYT

SEQ ID NO: 2937191 - protein, 17 aa, Entamoeba invadens
FLYEKDTCKEELDKIII

SEQ ID NO: 2937192 - protein, 17 aa, Entamoeba invadens
FLYEKDTCKEELDKITI

SEQ ID NO: 2937193 - protein, 17 aa, Entamoeba invadens
FLYEQEIDKENLEKVEI

SEQ ID NO: 2937194 - protein, 19 aa, Entamoeba invadens
FLYEYKGDPCYRLKDSISM

SEQ ID NO: 2937195 - protein, 18 aa, Entamoeba invadens
FLYFQPCKSYAIYMGDQD

SEQ ID NO: 2937196 - protein, 20 aa, Entamoeba invadens
FLYILKKFLIKMDCKKDEEK

SEQ ID NO: 2937197 - protein, 17 aa, Entamoeba invadens
FLYLKYNIKTIVSKKTH

SEQ ID NO: 2937198 - protein, 28 aa, Entamoeba invadens
FLYMKYQLKSSIMAYCITHESYCSDLNK

SEQ ID NO: 2937199 - protein, 17 aa, Entamoeba invadens
FMAALPVIPCLNSNNTY

SEQ ID NO: 2937200 - protein, 19 aa, Entamoeba invadens
FMAQCGCGEHVYCEEHKVN

SEQ ID NO: 2937201 - protein, 22 aa, Entamoeba invadens
FMDKAKELYPNFEKQQDDFDTM

SEQ ID NO: 2937202 - protein, 17 aa, Entamoeba invadens
FMDREKLGVYDNERKKY

SEQ ID NO: 2937203 - protein, 17 aa, Entamoeba invadens
FMECFYLSKIELCEGIT

SEQ ID NO: 2937204 - protein, 17 aa, Entamoeba invadens
FMEIIGLFDGHNGSETA

SEQ ID NO: 2937205 - protein, 18 aa, Entamoeba invadens
FMEQAVKSFLALRDYYQS

SEQ ID NO: 2937206 - protein, 18 aa, Entamoeba invadens
FMESLKKTFGLSYVTSGF

SEQ ID NO: 2937207 - protein, 22 aa, Entamoeba invadens
FMESNCQIILFNTGIEEAKIKF

SEQ ID NO: 2937208 - protein, 19 aa, Entamoeba invadens
FMEVVRWFAERVDMIVLVF

SEQ ID NO: 2937209 - protein, 20 aa, Entamoeba invadens
FMFKNCKSLSFIDIPTSIQK

SEQ ID NO: 2937210 - protein, 20 aa, Entamoeba invadens
FMFKNCQKLSQIEVCNSVIK

SEQ ID NO: 2937211 - protein, 17 aa, Entamoeba invadens
FMFKNCVRLESVKMHEG

SEQ ID NO: 2937212 - protein, 17 aa, Entamoeba invadens
FMFKNCVSLLNIQIPSS

SEQ ID NO: 2937213 - protein, 23 aa, Entamoeba invadens
FMFNNCINLKCIKNMNNIKHVGK

SEQ ID NO: 2937214 - protein, 18 aa, Entamoeba invadens
FMFPFSFQKCEFDCNIAF

SEQ ID NO: 2937215 - protein, 17 aa, Entamoeba invadens
FMGCNLLKICVPKTVES

SEQ ID NO: 2937216 - protein, 18 aa, Entamoeba invadens
FMGIDPNEVLKCRTDYSK

SEQ ID NO: 2937217 - protein, 18 aa, Entamoeba invadens
FMGRKLRIDIARPPRERH

SEQ ID NO: 2937218 - protein, 19 aa, Entamoeba invadens
FMIDPHNLPSILFEIYDWD

SEQ ID NO: 2937219 - protein, 25 aa, Entamoeba invadens
FMIEFKGQEGLKCGNEYITPLVVQF

SEQ ID NO: 2937220 - protein, 22 aa, Entamoeba invadens
FMKGRLEECGFVFYSKKTKKAK

SEQ ID NO: 2937221 - protein, 18 aa, Entamoeba invadens
FMKKIYLYVRPNTRFPAL

SEQ ID NO: 2937222 - protein, 23 aa, Entamoeba invadens
FMKQIKFKLVIGNVLSPDVDKSV

SEQ ID NO: 2937223 - protein, 18 aa, Entamoeba invadens
FMLCKSVKEQILFFLCNY

SEQ ID NO: 2937224 - protein, 24 aa, Entamoeba invadens
FMLEVLLPLCMRHCSSETITSLVS

SEQ ID NO: 2937225 - protein, 17 aa, Entamoeba invadens
FMLPILLEITKKYAHDE

SEQ ID NO: 2937226 - protein, 20 aa, Entamoeba invadens
FMMKKSCDFAEFLLETTVEY

SEQ ID NO: 2937227 - protein, 18 aa, Entamoeba invadens
FMNCKRLEEVTLYEGCEC

SEQ ID NO: 2937228 - protein, 17 aa, Entamoeba invadens
FMNCSKLKCINLNNNKT

SEQ ID NO: 2937229 - protein, 17 aa, Entamoeba invadens
FMNLGMFTFFVLNTSTQ

SEQ ID NO: 2937230 - protein, 18 aa, Entamoeba invadens
FMNNPAMRPMLNMVAQSM

SEQ ID NO: 2937231 - protein, 54 aa, Entamoeba invadens
FMNRKQFCIHCGLCVCNGCYKGRFVFNGVNKRGCDRCMKKALTMNKIVVDDEVC

SEQ ID NO: 2937232 - protein, 18 aa, Entamoeba invadens
FMNVFPYMKSVVGPNGVG

SEQ ID NO: 2937233 - protein, 17 aa, Entamoeba invadens
FMNVGGYHPLEIFTKLK

SEQ ID NO: 2937234 - protein, 17 aa, Entamoeba invadens
FMNYKIKTFFPSKNQSE

SEQ ID NO: 2937235 - protein, 18 aa, Entamoeba invadens
FMNYKPILIRNIPNHITK

SEQ ID NO: 2937236 - protein, 17 aa, Entamoeba invadens
FMPIYPCNYSICQQYQQ

SEQ ID NO: 2937237 - protein, 24 aa, Entamoeba invadens
FMPSKPGKYGMKFFCWQTLQPTLF

SEQ ID NO: 2937238 - protein, 26 aa, Entamoeba invadens
FMRLDGFRSEGVFRLAGQSFLMKEMK

SEQ ID NO: 2937239 - protein, 43 aa, Entamoeba invadens
FMRPQMVDWLFRTCDYFKFSAKIEFQALCYVDLYSSRRVVNSD

SEQ ID NO: 2937240 - protein, 20 aa, Entamoeba invadens
FMRVKEIVFEKDTLNILDYV

SEQ ID NO: 2937241 - protein, 31 aa, Entamoeba invadens
FMSEILLRLNYTLTYRKTRGTSIILKMNRIN

SEQ ID NO: 2937242 - protein, 20 aa, Entamoeba invadens
FMSELCVYVDVKGINEKALV

SEQ ID NO: 2937243 - protein, 22 aa, Entamoeba invadens
FMSIEKCRFAGYQFEKHGTCAL

SEQ ID NO: 2937244 - protein, 28 aa, Entamoeba invadens
FMSKPPFKFNRRASLIINDEMTPKVFSF

SEQ ID NO: 2937245 - protein, 26 aa, Entamoeba invadens
FMSQDTICVGYKCGTIKYINSDNQKT

SEQ ID NO: 2937246 - protein, 19 aa, Entamoeba invadens
FMTDCKGSEPVRVADWSFP

SEQ ID NO: 2937247 - protein, 17 aa, Entamoeba invadens
FMVPFYLHDSLWRGQQL

SEQ ID NO: 2937248 - protein, 22 aa, Entamoeba invadens
FMVRSSVFADISFKEKLSSLHK

SEQ ID NO: 2937249 - protein, 19 aa, Entamoeba invadens
FMVSGAVEGKGKFESEHAE

SEQ ID NO: 2937250 - protein, 25 aa, Entamoeba invadens
FMVYDRLRKLPLFEENEYKIIQLIN

SEQ ID NO: 2937251 - protein, 18 aa, Entamoeba invadens
FNAEQCLLHEFFGTKHPS

SEQ ID NO: 2937252 - protein, 20 aa, Entamoeba invadens
FNAGQIRMAYIAAVKHGLDD

SEQ ID NO: 2937253 - protein, 25 aa, Entamoeba invadens
FNAIKTFVVCLPLVTPNVIQTRIKP

SEQ ID NO: 2937254 - protein, 27 aa, Entamoeba invadens
FNAKEVFRILLTLVFFYCKKMTVFCLN

SEQ ID NO: 2937255 - protein, 21 aa, Entamoeba invadens
FNAKEVFRILLTLVSLLQDDD

SEQ ID NO: 2937256 - protein, 19 aa, Entamoeba invadens
FNAKGFGEEEWAFHGSSQD

SEQ ID NO: 2937257 - protein, 37 aa, Entamoeba invadens
FNAPLDFYKCFETIKMYDVFESIYFVFVVSHPITIPS

SEQ ID NO: 2937258 - protein, 19 aa, Entamoeba invadens
FNASWLRVLLVCMGESVVY

SEQ ID NO: 2937259 - protein, 19 aa, Entamoeba invadens
FNCDGKWNIQFNIKVFART

SEQ ID NO: 2937260 - protein, 20 aa, Entamoeba invadens
FNCEQIKSFYFCESVTQLKK

SEQ ID NO: 2937261 - protein, 26 aa, Entamoeba invadens
FNCSTAEILPEIKFDSFSYVQKQSPM

SEQ ID NO: 2937262 - protein, 19 aa, Entamoeba invadens
FNCTCLDNIILNGAIKEFG

SEQ ID NO: 2937263 - protein, 18 aa, Entamoeba invadens
FNCTTASFEKNELIPFTY

SEQ ID NO: 2937264 - protein, 20 aa, Entamoeba invadens
FNCVRSNLNPSIGFSEGNAM

SEQ ID NO: 2937265 - protein, 28 aa, Entamoeba invadens
FNCYAAECPICGEHSIDLIKFPYTSAQN

SEQ ID NO: 2937266 - protein, 17 aa, Entamoeba invadens
FNDAFSNLGFDHLSCIC

SEQ ID NO: 2937267 - protein, 30 aa, Entamoeba invadens
FNDELRLATAKNLLNWAIKQQPGMALKKAI

SEQ ID NO: 2937268 - protein, 22 aa, Entamoeba invadens
FNDFKLSHKFRYVIFTMNDKMT

SEQ ID NO: 2937269 - protein, 19 aa, Entamoeba invadens
FNDGLLICQIVDKIKPGSV

SEQ ID NO: 2937270 - protein, 17 aa, Entamoeba invadens
FNDGVRWVVLYFGEKGV

SEQ ID NO: 2937271 - protein, 20 aa, Entamoeba invadens
FNDIKGIFIVFSLDSMETLN

SEQ ID NO: 2937272 - protein, 21 aa, Entamoeba invadens
FNDKICDLPNLVFFIETAEKD

SEQ ID NO: 2937273 - protein, 23 aa, Entamoeba invadens
FNDRNIFRLASWALCIAADAGSN

SEQ ID NO: 2937274 - protein, 18 aa, Entamoeba invadens
FNDTFILQKSEFIKNSQD

SEQ ID NO: 2937275 - protein, 18 aa, Entamoeba invadens
FNDYAFFINLYKRLMNDY

SEQ ID NO: 2937276 - protein, 18 aa, Entamoeba invadens
FNECTSLCAVTLSASTLR

SEQ ID NO: 2937277 - protein, 18 aa, Entamoeba invadens
FNEDFLIELNDAIFCSEF

SEQ ID NO: 2937278 - protein, 19 aa, Entamoeba invadens
FNEECFKIAVLPTDEKTSN

SEQ ID NO: 2937279 - protein, 19 aa, Entamoeba invadens
FNEEKFFKKVVLYPVNYED

SEQ ID NO: 2937280 - protein, 24 aa, Entamoeba invadens
FNEFLKRRCVEHYTFDITNNTPMK

SEQ ID NO: 2937281 - protein, 18 aa, Entamoeba invadens
FNEFLLKIGDIEKAVCDE

SEQ ID NO: 2937282 - protein, 17 aa, Entamoeba invadens
FNEICEIEEGVFSGCTS

SEQ ID NO: 2937283 - protein, 20 aa, Entamoeba invadens
FNEIFLKRKSEREVDEDIYR

SEQ ID NO: 2937284 - protein, 20 aa, Entamoeba invadens
FNEIPLMFHFNPIRWEKNMG

SEQ ID NO: 2937285 - protein, 26 aa, Entamoeba invadens
FNENVKVCGRRSCLSNIFISCNGIGD

SEQ ID NO: 2937286 - protein, 18 aa, Entamoeba invadens
FNEPCIFGSADLGRPLWV

SEQ ID NO: 2937287 - protein, 24 aa, Entamoeba invadens
FNEPLDFLSISPFNFAHELTKIQS

SEQ ID NO: 2937288 - protein, 20 aa, Entamoeba invadens
FNESCLTFAIGDIDKESICD

SEQ ID NO: 2937289 - protein, 23 aa, Entamoeba invadens
FNEVKMVIEFNGTLEFLMGSVGM

SEQ ID NO: 2937290 - protein, 17 aa, Entamoeba invadens
FNEWRDINSPQELSSHL

SEQ ID NO: 2937291 - protein, 22 aa, Entamoeba invadens
FNEYLEAYAFRDIAKQPPQPPE

SEQ ID NO: 2937292 - protein, 43 aa, Entamoeba invadens
FNFADLKFKLDSSFKALCEITEKLFLWDKVRVEGGTYGVYALY

SEQ ID NO: 2937293 - protein, 18 aa, Entamoeba invadens
FNFCFGENFEAKLEENDK

SEQ ID NO: 2937294 - protein, 23 aa, Entamoeba invadens
FNFDAVVCIVTLFNSAAIHRLKN

SEQ ID NO: 2937295 - protein, 19 aa, Entamoeba invadens
FNFETARLFEQISHHCGQA

SEQ ID NO: 2937296 - protein, 22 aa, Entamoeba invadens
FNFKESKKIVSTVVITHSLFST

SEQ ID NO: 2937297 - protein, 32 aa, Entamoeba invadens
FNFLKNKKIVFKIVFCDRCISQMKAIKIVFPF

SEQ ID NO: 2937298 - protein, 23 aa, Entamoeba invadens
FNFPLFCLVSQPVLSLLSTGKST

SEQ ID NO: 2937299 - protein, 18 aa, Entamoeba invadens
FNFPLVVGNFSDQWNNTH

SEQ ID NO: 2937300 - protein, 20 aa, Entamoeba invadens
FNFSTTCFDCLELQVMNGKH

SEQ ID NO: 2937301 - protein, 18 aa, Entamoeba invadens
FNGCEKLSAIEIPESVTK

SEQ ID NO: 2937302 - protein, 19 aa, Entamoeba invadens
FNGCQQWSGYVTYREFLIL

SEQ ID NO: 2937303 - protein, 22 aa, Entamoeba invadens
FNGEKFPILIVLKDSTSIGNLG

SEQ ID NO: 2937304 - protein, 20 aa, Entamoeba invadens
FNGFESWCQICTTTIKDIQV

SEQ ID NO: 2937305 - protein, 18 aa, Entamoeba invadens
FNGIIPSNFYKLKIICHN

SEQ ID NO: 2937306 - protein, 17 aa, Entamoeba invadens
FNGIIPSNFYKLKIICR

SEQ ID NO: 2937307 - protein, 24 aa, Entamoeba invadens
FNGKPLYPFMCRTAGLSYLGALHI

SEQ ID NO: 2937308 - protein, 17 aa, Entamoeba invadens
FNGLKQWFMETMQSTKS

SEQ ID NO: 2937309 - protein, 19 aa, Entamoeba invadens
FNGVCFDSQVDGWGLNDSV

SEQ ID NO: 2937310 - protein, 20 aa, Entamoeba invadens
FNGVIKRFGVRHLPRKTHRG

SEQ ID NO: 2937311 - protein, 18 aa, Entamoeba invadens
FNGVNSFSSLTISVFEET

SEQ ID NO: 2937312 - protein, 25 aa, Entamoeba invadens
FNHPKRKPLYFSFASQDFTQFFDTT

SEQ ID NO: 2937313 - protein, 20 aa, Entamoeba invadens
FNIDEFGELCAFTTQDTVGV

SEQ ID NO: 2937314 - protein, 21 aa, Entamoeba invadens
FNIEGLMYMFYKPDEIINKLL

SEQ ID NO: 2937315 - protein, 23 aa, Entamoeba invadens
FNIFVCTSCSGIHREFNHRVKSV

SEQ ID NO: 2937316 - protein, 19 aa, Entamoeba invadens
FNIIRGYYWTGCKSNMFSN

SEQ ID NO: 2937317 - protein, 19 aa, Entamoeba invadens
FNIIRGYYWTGCKSNVFSN

SEQ ID NO: 2937318 - protein, 19 aa, Entamoeba invadens
FNIIRGYYWTGNPLQNNYK

SEQ ID NO: 2937319 - protein, 35 aa, Entamoeba invadens
FNIIRIYYWTGCKSSVFSNEIEKIYNLRSQLKKEG

SEQ ID NO: 2937320 - protein, 18 aa, Entamoeba invadens
FNILFWRYLTQVQPFSSR

SEQ ID NO: 2937321 - protein, 22 aa, Entamoeba invadens
FNIPQGVVLIGQFCFLNTKFTR

SEQ ID NO: 2937322 - protein, 25 aa, Entamoeba invadens
FNIQMYRCLTSFLIDLKGFKPPMPS

SEQ ID NO: 2937323 - protein, 25 aa, Entamoeba invadens
FNISPELLDGTLFVVNGRKFRMKVV

SEQ ID NO: 2937324 - protein, 21 aa, Entamoeba invadens
FNIVMKRYNLVAGDFPPIDVY

SEQ ID NO: 2937325 - protein, 21 aa, Entamoeba invadens
FNKAEEWYRNVVVPEVSAPVT

SEQ ID NO: 2937326 - protein, 17 aa, Entamoeba invadens
FNKCFEGNAADFVGQSC

SEQ ID NO: 2937327 - protein, 25 aa, Entamoeba invadens
FNKEGIEASAWYFGPVILALKDPDF

SEQ ID NO: 2937328 - protein, 18 aa, Entamoeba invadens
FNKEIDFMYVVDRSFDLL

SEQ ID NO: 2937329 - protein, 17 aa, Entamoeba invadens
FNKEWLLRDITEHHGSH

SEQ ID NO: 2937330 - protein, 22 aa, Entamoeba invadens
FNKEYIEGINFFVRHSYCKDNK

SEQ ID NO: 2937331 - protein, 18 aa, Entamoeba invadens
FNKFCGRIVLIKNNTTPY

SEQ ID NO: 2937332 - protein, 20 aa, Entamoeba invadens
FNKFFCLIDIGLKKIQSTEE

SEQ ID NO: 2937333 - protein, 25 aa, Entamoeba invadens
FNKFNRWSSVFYSRMSEESPLSSLY

SEQ ID NO: 2937334 - protein, 19 aa, Entamoeba invadens
FNKIKFVFLSLDYCFGDIE

SEQ ID NO: 2937335 - protein, 25 aa, Entamoeba invadens
FNKKIFECVLLLFSDTVLICKRKKR

SEQ ID NO: 2937336 - protein, 33 aa, Entamoeba invadens
FNKKVVGVIVYWKLLNSFFYIEHFAVFSEFRGE

SEQ ID NO: 2937337 - protein, 21 aa, Entamoeba invadens
FNKLKAISPFVNFQKFNIEEI

SEQ ID NO: 2937338 - protein, 17 aa, Entamoeba invadens
FNKNCFENIVSVKIMKN

SEQ ID NO: 2937339 - protein, 26 aa, Entamoeba invadens
FNKNGCVSCAVGYYLLNAECNLCSEN

SEQ ID NO: 2937340 - protein, 24 aa, Entamoeba invadens
FNKPIGKCVALFPFTARCANELTL

SEQ ID NO: 2937341 - protein, 17 aa, Entamoeba invadens
FNKQFFKTHGYIERLKL

SEQ ID NO: 2937342 - protein, 18 aa, Entamoeba invadens
FNKRLLATMEDIQKANIY

SEQ ID NO: 2937343 - protein, 19 aa, Entamoeba invadens
FNKTAICYKQIFKEMNGNH

SEQ ID NO: 2937344 - protein, 25 aa, Entamoeba invadens
FNKTNFLFHWGYKQEFLHTENTYED

SEQ ID NO: 2937345 - protein, 25 aa, Entamoeba invadens
FNKVICFSTKVLKRMKEVSYDELYE

SEQ ID NO: 2937346 - protein, 20 aa, Entamoeba invadens
FNLCMGMCTEFNDLIKLWDE

SEQ ID NO: 2937347 - protein, 19 aa, Entamoeba invadens
FNLCTCMISEGFYVKCKPN

SEQ ID NO: 2937348 - protein, 25 aa, Entamoeba invadens
FNLELFKRRCEALKKAYNKKPKKLV

SEQ ID NO: 2937349 - protein, 27 aa, Entamoeba invadens
FNLESWKRLYCNSEITESIPWFFEHFD

SEQ ID NO: 2937350 - protein, 18 aa, Entamoeba invadens
FNLFYGCYSCDYKQNSTV

SEQ ID NO: 2937351 - protein, 17 aa, Entamoeba invadens
FNLFYKCFSLKEIAIPP

SEQ ID NO: 2937352 - protein, 17 aa, Entamoeba invadens
FNLIFYNLEHHLNLLKI

SEQ ID NO: 2937353 - protein, 18 aa, Entamoeba invadens
FNLIIARMKNVSKRKAKM

SEQ ID NO: 2937354 - protein, 27 aa, Entamoeba invadens
FNLLELRPSFEFDKQFNIKTREHFTKN

SEQ ID NO: 2937355 - protein, 27 aa, Entamoeba invadens
FNLLELRPSFEFDKQFNIKTREHFTRN

SEQ ID NO: 2937356 - protein, 24 aa, Entamoeba invadens
FNLLQLRASFEFTKDFKNKSRSQF

SEQ ID NO: 2937357 - protein, 27 aa, Entamoeba invadens
FNLMSNRMLAFIIKNNFAIFPSAKKCF

SEQ ID NO: 2937358 - protein, 22 aa, Entamoeba invadens
FNLPKHTICLSKSNESETCEFS

SEQ ID NO: 2937359 - protein, 17 aa, Entamoeba invadens
FNLSGSVQLPGCVNGID

SEQ ID NO: 2937360 - protein, 31 aa, Entamoeba invadens
FNLTNMRLRPRFLLKYLDAEGDWVTLCDDDD

SEQ ID NO: 2937361 - protein, 25 aa, Entamoeba invadens
FNMFFKVEFFERVWSKTTPEDDVSE

SEQ ID NO: 2937362 - protein, 17 aa, Entamoeba invadens
FNMKTTVSLLHYSEGAE

SEQ ID NO: 2937363 - protein, 17 aa, Entamoeba invadens
FNMRKAEEIKREIVKQG

SEQ ID NO: 2937364 - protein, 17 aa, Entamoeba invadens
FNMRPFIPCSLGIGIEK

SEQ ID NO: 2937365 - protein, 24 aa, Entamoeba invadens
FNNIFFKCKIGFSGNSKGVYRYHT

SEQ ID NO: 2937366 - protein, 23 aa, Entamoeba invadens
FNNIRYIPISGLSGENLTSPCNQ

SEQ ID NO: 2937367 - protein, 25 aa, Entamoeba invadens
FNNKEFCATLVRLPCVVETHKSYDD

SEQ ID NO: 2937368 - protein, 19 aa, Entamoeba invadens
FNNLLKIVSDIVSFLKSDT

SEQ ID NO: 2937369 - protein, 20 aa, Entamoeba invadens
FNNTEVVLLMFALDNKNSFI

SEQ ID NO: 2937370 - protein, 25 aa, Entamoeba invadens
FNPIDPRFAPPIQISQVSPIQNQSF

SEQ ID NO: 2937371 - protein, 20 aa, Entamoeba invadens
FNPISWKPKIKIYFENVETL

SEQ ID NO: 2937372 - protein, 19 aa, Entamoeba invadens
FNPLEWWKEHSCDYPLISR

SEQ ID NO: 2937373 - protein, 34 aa, Entamoeba invadens
FNPPEVWKGVVPFLKLLPMKIRIIQLVKSIHQLS

SEQ ID NO: 2937374 - protein, 19 aa, Entamoeba invadens
FNPSAKFSLGNTLDGTVTL

SEQ ID NO: 2937375 - protein, 24 aa, Entamoeba invadens
FNPSRHLSEVFTIFSAPNYCDYYK

SEQ ID NO: 2937376 - protein, 24 aa, Entamoeba invadens
FNPYLLKRFRAHINVECCSGVESI

SEQ ID NO: 2937377 - protein, 17 aa, Entamoeba invadens
FNQCPLTSIVISKNMTS

SEQ ID NO: 2937378 - protein, 21 aa, Entamoeba invadens
FNQNLKVIGGFAFYNCTGLTA

SEQ ID NO: 2937379 - protein, 23 aa, Entamoeba invadens
FNQRYKHMFRIVTSIGSVVEKNS

SEQ ID NO: 2937380 - protein, 28 aa, Entamoeba invadens
FNRCCNLTSFEFPKFVNHIGRSCFEGCS

SEQ ID NO: 2937381 - protein, 17 aa, Entamoeba invadens
FNRCIKLKNVIIPSSVR

SEQ ID NO: 2937382 - protein, 17 aa, Entamoeba invadens
FNRCLNVKSVVVRRGDC

SEQ ID NO: 2937383 - protein, 19 aa, Entamoeba invadens
FNRIIPVLKTRTYTDADIK

SEQ ID NO: 2937384 - protein, 20 aa, Entamoeba invadens
FNRKKIKGIQNIIFYELPNS

SEQ ID NO: 2937385 - protein, 17 aa, Entamoeba invadens
FNRKYVVCNSGYYIVNG

SEQ ID NO: 2937386 - protein, 18 aa, Entamoeba invadens
FNRRELRNLFLTTNNLDG

SEQ ID NO: 2937387 - protein, 17 aa, Entamoeba invadens
FNRREMRNLFLTTNNVE

SEQ ID NO: 2937388 - protein, 23 aa, Entamoeba invadens
FNRRKYRVVYVAPELLDMSSNFI

SEQ ID NO: 2937389 - protein, 20 aa, Entamoeba invadens
FNSAISFASFGAHVKEQGHM

SEQ ID NO: 2937390 - protein, 17 aa, Entamoeba invadens
FNSEPLPNMALYDGNSA

SEQ ID NO: 2937391 - protein, 19 aa, Entamoeba invadens
FNSEVLIPGKWVENDDKFS

SEQ ID NO: 2937392 - protein, 18 aa, Entamoeba invadens
FNSFMNLNISPRVDGKRS

SEQ ID NO: 2937393 - protein, 26 aa, Entamoeba invadens
FNSFYRVVHHFNRKISFDYYPFIGPF

SEQ ID NO: 2937394 - protein, 21 aa, Entamoeba invadens
FNSIKCEFVHLNIWYEVSYSR

SEQ ID NO: 2937395 - protein, 28 aa, Entamoeba invadens
FNSIQFKMRFARDCFGLFEVLCGDVNKE

SEQ ID NO: 2937396 - protein, 24 aa, Entamoeba invadens
FNSKVALCKSVFIIVTTREGHVLG

SEQ ID NO: 2937397 - protein, 23 aa, Entamoeba invadens
FNSRPNFDANLFAVPVSIRKQLG

SEQ ID NO: 2937398 - protein, 19 aa, Entamoeba invadens
FNSVETFLLLIALKVKYTD

SEQ ID NO: 2937399 - protein, 22 aa, Entamoeba invadens
FNSVVFKSWLYESVLKSIFMKR

SEQ ID NO: 2937400 - protein, 20 aa, Entamoeba invadens
FNTCFNCVSITKLVLPTLKG

SEQ ID NO: 2937401 - protein, 20 aa, Entamoeba invadens
FNTIRYIAMNSFEKDIVVPS

SEQ ID NO: 2937402 - protein, 24 aa, Entamoeba invadens
FNTKVSFPFGYGLSYTTFEYNNLH

SEQ ID NO: 2937403 - protein, 18 aa, Entamoeba invadens
FNTLNWYFEVTLIGKDEK

SEQ ID NO: 2937404 - protein, 18 aa, Entamoeba invadens
FNTMSFKTFTEMYFRYRR

SEQ ID NO: 2937405 - protein, 17 aa, Entamoeba invadens
FNTPGELYACFLTTFVF

SEQ ID NO: 2937406 - protein, 24 aa, Entamoeba invadens
FNTRITLKLPKCLSRMFINNMESI

SEQ ID NO: 2937407 - protein, 19 aa, Entamoeba invadens
FNVDMKFLMEKYQIHYWIY

SEQ ID NO: 2937408 - protein, 17 aa, Entamoeba invadens
FNVESFDSFNSLEKLVK

SEQ ID NO: 2937409 - protein, 23 aa, Entamoeba invadens
FNVLHEFLNFYVILMKFVCFKLY

SEQ ID NO: 2937410 - protein, 17 aa, Entamoeba invadens
FNVLKRQNSAIVPINEF

SEQ ID NO: 2937411 - protein, 19 aa, Entamoeba invadens
FNVLNELKFNSAPHSNTEI

SEQ ID NO: 2937412 - protein, 20 aa, Entamoeba invadens
FNVMFPDIFYEVLKKPITIE

SEQ ID NO: 2937413 - protein, 18 aa, Entamoeba invadens
FNVMKKVVFFTRNGKIVN

SEQ ID NO: 2937414 - protein, 17 aa, Entamoeba invadens
FNVNITPHFLISLFSLS

SEQ ID NO: 2937415 - protein, 17 aa, Entamoeba invadens
FNVPDSFVVICSGTPDV

SEQ ID NO: 2937416 - protein, 20 aa, Entamoeba invadens
FNVPVYVAAECFKFSDIYPI

SEQ ID NO: 2937417 - protein, 26 aa, Entamoeba invadens
FNVRAYLPVCESFGFTADLRSHTSGQ

SEQ ID NO: 2937418 - protein, 25 aa, Entamoeba invadens
FNYCNFKSIEICNGITEIEDCAFCE

SEQ ID NO: 2937419 - protein, 17 aa, Entamoeba invadens
FNYFLSCIVGERSGEYK

SEQ ID NO: 2937420 - protein, 17 aa, Entamoeba invadens
FNYIKGMVYTTPGFSSS

SEQ ID NO: 2937421 - protein, 21 aa, Entamoeba invadens
FNYKSMRGVTRVNYKWLEDVS

SEQ ID NO: 2937422 - protein, 23 aa, Entamoeba invadens
FNYQLCSEFCKVLLSHKNLLNQS

SEQ ID NO: 2937423 - protein, 17 aa, Entamoeba invadens
FNYRKSDFIVISEKDKD

SEQ ID NO: 2937424 - protein, 17 aa, Entamoeba invadens
FNYSLPSLMESLVLVLS

SEQ ID NO: 2937425 - protein, 17 aa, Entamoeba invadens
FNYSYRSLLKCLSYSMG

SEQ ID NO: 2937426 - protein, 24 aa, Entamoeba invadens
FNYTDICVFELFSKFFMNYLKIDT

SEQ ID NO: 2937427 - protein, 32 aa, Entamoeba invadens
FNYVHGIFHLKLWRLLTVVLFAIQDALLLSTC

SEQ ID NO: 2937428 - protein, 18 aa, Entamoeba invadens
FNYVLDVCLEKLKTSQDK

SEQ ID NO: 2937429 - protein, 25 aa, Entamoeba invadens
FNYVLQFKTACQIRQMSEEEYTNSY

SEQ ID NO: 2937430 - protein, 21 aa, Entamoeba invadens
FPACLRRIGSAAFKRCGLTEI

SEQ ID NO: 2937431 - protein, 20 aa, Entamoeba invadens
FPADIEAIFVKSLVALKGLD

SEQ ID NO: 2937432 - protein, 17 aa, Entamoeba invadens
FPAFLTVVDLLKYYYIR

SEQ ID NO: 2937433 - protein, 23 aa, Entamoeba invadens
FPAKLCSLQLRFLDVSFNKLSSL

SEQ ID NO: 2937434 - protein, 17 aa, Entamoeba invadens
FPALVAFIHEDPITDVF

SEQ ID NO: 2937435 - protein, 20 aa, Entamoeba invadens
FPCKEIIVVKLVFKKDLGKS

SEQ ID NO: 2937436 - protein, 22 aa, Entamoeba invadens
FPDFLDCFNYSLPSLMESLVLV

SEQ ID NO: 2937437 - protein, 21 aa, Entamoeba invadens
FPDIREAYFMFNIYTDPIPFI

SEQ ID NO: 2937438 - protein, 18 aa, Entamoeba invadens
FPDKAKWEKDRKRVFTHI

SEQ ID NO: 2937439 - protein, 23 aa, Entamoeba invadens
FPDLLSCRLVCKKWRDILTETQS

SEQ ID NO: 2937440 - protein, 27 aa, Entamoeba invadens
FPDSLKSVGDWCFAKCVSLISIVLPSS

SEQ ID NO: 2937441 - protein, 17 aa, Entamoeba invadens
FPDVCTKIGSTAFYSCP

SEQ ID NO: 2937442 - protein, 20 aa, Entamoeba invadens
FPDVICDLTKVTILMMQQNN

SEQ ID NO: 2937443 - protein, 20 aa, Entamoeba invadens
FPDVLELFRVGGRTPETNYI

SEQ ID NO: 2937444 - protein, 25 aa, Entamoeba invadens
FPEDMARFYIAELFVALDSIHKLSY

SEQ ID NO: 2937445 - protein, 18 aa, Entamoeba invadens
FPEECNPLLVGVKQPLPL

SEQ ID NO: 2937446 - protein, 17 aa, Entamoeba invadens
FPEEIHFVNCLDNKLIV

SEQ ID NO: 2937447 - protein, 17 aa, Entamoeba invadens
FPEGIKIHTFGVENAPM

SEQ ID NO: 2937448 - protein, 17 aa, Entamoeba invadens
FPEHLGVPLSQRKFVSE

SEQ ID NO: 2937449 - protein, 22 aa, Entamoeba invadens
FPEIKYPRKIYNLNYKMYTVKD

SEQ ID NO: 2937450 - protein, 22 aa, Entamoeba invadens
FPEKMKKIGQNAFYGCYDLIEM

SEQ ID NO: 2937451 - protein, 22 aa, Entamoeba invadens
FPEKTCKSCRMIYGCELCVNLL

SEQ ID NO: 2937452 - protein, 23 aa, Entamoeba invadens
FPEKYVLASECIKLPNGEKPFEG

SEQ ID NO: 2937453 - protein, 19 aa, Entamoeba invadens
FPELQALYVELQCKVKKTK

SEQ ID NO: 2937454 - protein, 20 aa, Entamoeba invadens
FPELQAQDFVQVKPSHGDNN

SEQ ID NO: 2937455 - protein, 28 aa, Entamoeba invadens
FPESDLKFWDCSCDLAMLDQIKKFGFGV

SEQ ID NO: 2937456 - protein, 24 aa, Entamoeba invadens
FPESLQVIGSFCFTQNNKITEIEF

SEQ ID NO: 2937457 - protein, 22 aa, Entamoeba invadens
FPESTKLCGIDTLTNCTKLSAL

SEQ ID NO: 2937458 - protein, 19 aa, Entamoeba invadens
FPESVAKTIFPFVDVIEKF

SEQ ID NO: 2937459 - protein, 22 aa, Entamoeba invadens
FPETLFKWINETVIKEKKTPSH

SEQ ID NO: 2937460 - protein, 25 aa, Entamoeba invadens
FPEVKSEAYITFSIYSSEKGSPVVE

SEQ ID NO: 2937461 - protein, 22 aa, Entamoeba invadens
FPFGESEEIFWKNMKEQKPLSF

SEQ ID NO: 2937462 - protein, 21 aa, Entamoeba invadens
FPFLKEQNGGVTIEINVKPNS

SEQ ID NO: 2937463 - protein, 21 aa, Entamoeba invadens
FPFLKRKGIIEEIIPKNPTFS

SEQ ID NO: 2937464 - protein, 24 aa, Entamoeba invadens
FPFLPRFNNGLKFGSVPITCAGAQ

SEQ ID NO: 2937465 - protein, 17 aa, Entamoeba invadens
FPFLSERVAEMKKQRIY

SEQ ID NO: 2937466 - protein, 17 aa, Entamoeba invadens
FPFQCLRENSCEPTNFL

SEQ ID NO: 2937467 - protein, 23 aa, Entamoeba invadens
FPFQKIPFTLAITGTSQLSTSGD

SEQ ID NO: 2937468 - protein, 17 aa, Entamoeba invadens
FPFSIDLNAPIDSYSSS

SEQ ID NO: 2937469 - protein, 17 aa, Entamoeba invadens
FPGCNRAFHLQCHDPPL

SEQ ID NO: 2937470 - protein, 26 aa, Entamoeba invadens
FPGELEVFSGLPLFSVFDRDAYVKWD

SEQ ID NO: 2937471 - protein, 18 aa, Entamoeba invadens
FPGIKVHGPKECLEVFES

SEQ ID NO: 2937472 - protein, 21 aa, Entamoeba invadens
FPGILKGALIVRAKKITDNMA

SEQ ID NO: 2937473 - protein, 22 aa, Entamoeba invadens
FPGILKGALIVRARKITDNMAI

SEQ ID NO: 2937474 - protein, 23 aa, Entamoeba invadens
FPGLKGTEAILQFMAEKGEIQFT

SEQ ID NO: 2937475 - protein, 24 aa, Entamoeba invadens
FPGLKGTEAILQFMAEKGEIQFTT

SEQ ID NO: 2937476 - protein, 19 aa, Entamoeba invadens
FPGLKNLFCECVEKCTNVI

SEQ ID NO: 2937477 - protein, 17 aa, Entamoeba invadens
FPGVKKFIGLEMLVMKK

SEQ ID NO: 2937478 - protein, 17 aa, Entamoeba invadens
FPGYPFYITQLLKNVNE

SEQ ID NO: 2937479 - protein, 21 aa, Entamoeba invadens
FPHGIKPMFFPIGTSITIRNL

SEQ ID NO: 2937480 - protein, 24 aa, Entamoeba invadens
FPHIMIRMHFDVIVKALTLCVKSK

SEQ ID NO: 2937481 - protein, 19 aa, Entamoeba invadens
FPHIRYSQHDMKKYGSSTL

SEQ ID NO: 2937482 - protein, 19 aa, Entamoeba invadens
FPHVLNPLLQNPRTICNGQ

SEQ ID NO: 2937483 - protein, 20 aa, Entamoeba invadens
FPIATFDWHKKAITSVEWCP

SEQ ID NO: 2937484 - protein, 24 aa, Entamoeba invadens
FPICENEVPWNWKVKPVQMTSPPS

SEQ ID NO: 2937485 - protein, 20 aa, Entamoeba invadens
FPIENQIFIRRLLLLCKNVT

SEQ ID NO: 2937486 - protein, 21 aa, Entamoeba invadens
FPIEVCACPLQTLSLNGNSIR

SEQ ID NO: 2937487 - protein, 22 aa, Entamoeba invadens
FPIGEGLAGVVYKASLKGLNVA

SEQ ID NO: 2937488 - protein, 21 aa, Entamoeba invadens
FPIIQLVAPFVSFRVVKDFNE

SEQ ID NO: 2937489 - protein, 19 aa, Entamoeba invadens
FPINFKPDIQAIVFNNKIS

SEQ ID NO: 2937490 - protein, 20 aa, Entamoeba invadens
FPINLPDGFYDVKILRMEGL

SEQ ID NO: 2937491 - protein, 18 aa, Entamoeba invadens
FPINSTITKSRWTVPNIV

SEQ ID NO: 2937492 - protein, 18 aa, Entamoeba invadens
FPISGRVLIGPNSSVVNT

SEQ ID NO: 2937493 - protein, 20 aa, Entamoeba invadens
FPIVVSKLIDMYNRKSGNVM

SEQ ID NO: 2937494 - protein, 18 aa, Entamoeba invadens
FPKEICQLPHLRSLNLSS

SEQ ID NO: 2937495 - protein, 26 aa, Entamoeba invadens
FPKEKFKMAWDIADFVAAGSVLPKPI

SEQ ID NO: 2937496 - protein, 22 aa, Entamoeba invadens
FPKEMPMQLIYLVGSMLQINPN

SEQ ID NO: 2937497 - protein, 22 aa, Entamoeba invadens
FPKIETLHLWDVIDENFGNDFL

SEQ ID NO: 2937498 - protein, 22 aa, Entamoeba invadens
FPKIETLHLWNAKNENFGNGFL

SEQ ID NO: 2937499 - protein, 22 aa, Entamoeba invadens
FPKIETLHLWNVMDENFGNGFI

SEQ ID NO: 2937500 - protein, 20 aa, Entamoeba invadens
FPKIRVNLTVFQKLKQLQKE

SEQ ID NO: 2937501 - protein, 17 aa, Entamoeba invadens
FPKLEFGPFKKAVLKEL

SEQ ID NO: 2937502 - protein, 19 aa, Entamoeba invadens
FPKLENFKSPIEYKEENYG

SEQ ID NO: 2937503 - protein, 20 aa, Entamoeba invadens
FPKLETLYIPYTIYENLSFL

SEQ ID NO: 2937504 - protein, 18 aa, Entamoeba invadens
FPKLHALAAADNMLQFLH

SEQ ID NO: 2937505 - protein, 22 aa, Entamoeba invadens
FPKLSSFEIKSALSPSFMELIH

SEQ ID NO: 2937506 - protein, 17 aa, Entamoeba invadens
FPKMCRDQVGCRFLQQQ

SEQ ID NO: 2937507 - protein, 19 aa, Entamoeba invadens
FPKNLKVTFWQQNVTQKNS

SEQ ID NO: 2937508 - protein, 25 aa, Entamoeba invadens
FPKNPNLYFCKYCSSSFDSKTLLRT

SEQ ID NO: 2937509 - protein, 18 aa, Entamoeba invadens
FPKQKCIKRLTITVDSAS

SEQ ID NO: 2937510 - protein, 20 aa, Entamoeba invadens
FPKRVASYFFTTNIIGVPII

SEQ ID NO: 2937511 - protein, 20 aa, Entamoeba invadens
FPKRVRKLRIFEEEVHTFAD

SEQ ID NO: 2937512 - protein, 20 aa, Entamoeba invadens
FPKSLTKLRAEWIKAKLNNG

SEQ ID NO: 2937513 - protein, 25 aa, Entamoeba invadens
FPKTDFLTRYLIVLHILFGALQNRE

SEQ ID NO: 2937514 - protein, 19 aa, Entamoeba invadens
FPKVMGGFDRVLVDAPCTG

SEQ ID NO: 2937515 - protein, 21 aa, Entamoeba invadens
FPKVVSLSLLYPVYEKDDPCN

SEQ ID NO: 2937516 - protein, 25 aa, Entamoeba invadens
FPKYPCVIPHPKIPFYKLAAKIKRE

SEQ ID NO: 2937517 - protein, 17 aa, Entamoeba invadens
FPLIPRESVIYMQDLLQ

SEQ ID NO: 2937518 - protein, 23 aa, Entamoeba invadens
FPLKCGYEATYLTAIKNGRENVV

SEQ ID NO: 2937519 - protein, 17 aa, Entamoeba invadens
FPLKKTHHLLFSIFDVS

SEQ ID NO: 2937520 - protein, 17 aa, Entamoeba invadens
FPLKLNEIMNLQNCDLS

SEQ ID NO: 2937521 - protein, 20 aa, Entamoeba invadens
FPLPGESVVASKSLKVSNPY

SEQ ID NO: 2937522 - protein, 23 aa, Entamoeba invadens
FPLQDILSLRLKYIEGRDPKLEQ

SEQ ID NO: 2937523 - protein, 21 aa, Entamoeba invadens
FPLQFKFDLKGSLYGRKADEN

SEQ ID NO: 2937524 - protein, 26 aa, Entamoeba invadens
FPMHHFLKKIHVEVGNDGFLFPHSTI

SEQ ID NO: 2937525 - protein, 25 aa, Entamoeba invadens
FPMSKRLLHDRIIKFHMAENYVTSN

SEQ ID NO: 2937526 - protein, 19 aa, Entamoeba invadens
FPNAFKNRNFRNRSVVSAQ

SEQ ID NO: 2937527 - protein, 20 aa, Entamoeba invadens
FPNELYHFADFKQIWINSGF

SEQ ID NO: 2937528 - protein, 26 aa, Entamoeba invadens
FPNGCPCGIEFFDVIRRCQKSGLVIY

SEQ ID NO: 2937529 - protein, 33 aa, Entamoeba invadens
FPNGCPCNIEFFDVIRRCQKNGLVIYSVAAEPL

SEQ ID NO: 2937530 - protein, 19 aa, Entamoeba invadens
FPNGFCYLKELNLGSNEIS

SEQ ID NO: 2937531 - protein, 21 aa, Entamoeba invadens
FPNHPPKVMCLTPIYHPNIDL

SEQ ID NO: 2937532 - protein, 19 aa, Entamoeba invadens
FPNIETLHLWDVEDENFGN

SEQ ID NO: 2937533 - protein, 18 aa, Entamoeba invadens
FPNIETLHLWDVKDGNFV

SEQ ID NO: 2937534 - protein, 19 aa, Entamoeba invadens
FPNIETLHLWDVTDENFGN

SEQ ID NO: 2937535 - protein, 17 aa, Entamoeba invadens
FPNIETLHLWKKHNENF

SEQ ID NO: 2937536 - protein, 17 aa, Entamoeba invadens
FPNIETLHLWNVKDENF

SEQ ID NO: 2937537 - protein, 22 aa, Entamoeba invadens
FPNIETLHLWSTRDENFGNGFV

SEQ ID NO: 2937538 - protein, 18 aa, Entamoeba invadens
FPNIETLYLWNKNDENFG

SEQ ID NO: 2937539 - protein, 23 aa, Entamoeba invadens
FPNIKTLHLWSTRDENFGNGFVI

SEQ ID NO: 2937540 - protein, 20 aa, Entamoeba invadens
FPNIVSAFASYCFADCSNLK

SEQ ID NO: 2937541 - protein, 19 aa, Entamoeba invadens
FPNLKFCEIDVTENYNDFL

SEQ ID NO: 2937542 - protein, 17 aa, Entamoeba invadens
FPNRDITNIFAVSNCYQ

SEQ ID NO: 2937543 - protein, 23 aa, Entamoeba invadens
FPNRVQVGVGLTIYKLMNFLNTS

SEQ ID NO: 2937544 - protein, 25 aa, Entamoeba invadens
FPNSLQFIGSFAFSNAKLVDVTIPE

SEQ ID NO: 2937545 - protein, 31 aa, Entamoeba invadens
FPNTQFPLQFKFDLKGSLYGRKADENERGKK

SEQ ID NO: 2937546 - protein, 24 aa, Entamoeba invadens
FPNVERVVIKKGILNEFDFSQLKS

SEQ ID NO: 2937547 - protein, 17 aa, Entamoeba invadens
FPNVERVVIKKGNSNEF

SEQ ID NO: 2937548 - protein, 24 aa, Entamoeba invadens
FPNVKNYICLKAMMKSLRVFEEVI

SEQ ID NO: 2937549 - protein, 26 aa, Entamoeba invadens
FPNVKVSACGKPISRGILKVDVKVEL

SEQ ID NO: 2937550 - protein, 23 aa, Entamoeba invadens
FPNVPCLLVGTKLDLKYDIYTIN

SEQ ID NO: 2937551 - protein, 21 aa, Entamoeba invadens
FPPELTYTFTRVRQAVKAKYG

SEQ ID NO: 2937552 - protein, 17 aa, Entamoeba invadens
FPPELYDKMGEIAGHIS

SEQ ID NO: 2937553 - protein, 35 aa, Entamoeba invadens
FPPFIKDGWMKKNIIAYDFLLKKMINGERVTMHNT

SEQ ID NO: 2937554 - protein, 18 aa, Entamoeba invadens
FPPLGALPQKGEKVEKKD

SEQ ID NO: 2937555 - protein, 18 aa, Entamoeba invadens
FPPLTLYLHYLFMIHGLH

SEQ ID NO: 2937556 - protein, 25 aa, Entamoeba invadens
FPPNFKRMKCAVLNASCSSTELLML

SEQ ID NO: 2937557 - protein, 20 aa, Entamoeba invadens
FPPNLIELSISYASNIADLD

SEQ ID NO: 2937558 - protein, 20 aa, Entamoeba invadens
FPPPPFGRFGGWERGRRHYP

SEQ ID NO: 2937559 - protein, 20 aa, Entamoeba invadens
FPPQFEMIDILYLLLNTPSE

SEQ ID NO: 2937560 - protein, 17 aa, Entamoeba invadens
FPPSLIVPNKPFKSTYS

SEQ ID NO: 2937561 - protein, 20 aa, Entamoeba invadens
FPPTLYKAIFLFFRDIVSVN

SEQ ID NO: 2937562 - protein, 18 aa, Entamoeba invadens
FPQKRISCETNRRKIAVP

SEQ ID NO: 2937563 - protein, 25 aa, Entamoeba invadens
FPQNRFGIPPDYKWDGIDRGNGYEK

SEQ ID NO: 2937564 - protein, 20 aa, Entamoeba invadens
FPQQWSRITNFFPDRVDTQV

SEQ ID NO: 2937565 - protein, 17 aa, Entamoeba invadens
FPQRTGINLQRKEYVPR

SEQ ID NO: 2937566 - protein, 22 aa, Entamoeba invadens
FPRKRPSCDVFSSNFNNVSVTQ

SEQ ID NO: 2937567 - protein, 20 aa, Entamoeba invadens
FPRNHFAMMSYSPIVTAEKA

SEQ ID NO: 2937568 - protein, 19 aa, Entamoeba invadens
FPRSVRVFGKRCFENSRRL

SEQ ID NO: 2937569 - protein, 17 aa, Entamoeba invadens
FPSADVIIFGPGLMGCM

SEQ ID NO: 2937570 - protein, 25 aa, Entamoeba invadens
FPSCLSSIGADCFYYTPLRQVDLSR

SEQ ID NO: 2937571 - protein, 17 aa, Entamoeba invadens
FPSDEAFPWCFDAATSI

SEQ ID NO: 2937572 - protein, 25 aa, Entamoeba invadens
FPSDIKNLFVFFPLFLEKIKGILSL

SEQ ID NO: 2937573 - protein, 19 aa, Entamoeba invadens
FPSFCAGALSIEKKILKQL

SEQ ID NO: 2937574 - protein, 18 aa, Entamoeba invadens
FPSFEAWKKETIKKAREV

SEQ ID NO: 2937575 - protein, 28 aa, Entamoeba invadens
FPSHIKSVGYYSCFSCVNLKEVVLPEGI

SEQ ID NO: 2937576 - protein, 28 aa, Entamoeba invadens
FPSHVTSIGYYCCYACTNLKEVILPNTI

SEQ ID NO: 2937577 - protein, 20 aa, Entamoeba invadens
FPSIKIFVSIELVCKKYNGN

SEQ ID NO: 2937578 - protein, 25 aa, Entamoeba invadens
FPSKLMHLGKFCFEQCCSLKEIEVP

SEQ ID NO: 2937579 - protein, 20 aa, Entamoeba invadens
FPSLEPTSIIGEMGSYNYFL

SEQ ID NO: 2937580 - protein, 19 aa, Entamoeba invadens
FPSLEQFRLQSLTLNSFDL

SEQ ID NO: 2937581 - protein, 17 aa, Entamoeba invadens
FPSLHDAVFQWVVGDEE

SEQ ID NO: 2937582 - protein, 24 aa, Entamoeba invadens
FPSPLLKTYCEVFVKPEGCNYFYV

SEQ ID NO: 2937583 - protein, 17 aa, Entamoeba invadens
FPSQIVSVGEFCFDLCL

SEQ ID NO: 2937584 - protein, 18 aa, Entamoeba invadens
FPSSLRFLIARNSFKVLP

SEQ ID NO: 2937585 - protein, 20 aa, Entamoeba invadens
FPSSVCRIPSLTSLEMNSNN

SEQ ID NO: 2937586 - protein, 19 aa, Entamoeba invadens
FPSTHPYLVLIIDVNSSVI

SEQ ID NO: 2937587 - protein, 20 aa, Entamoeba invadens
FPSVECIDLSTFFDLLKKKF

SEQ ID NO: 2937588 - protein, 19 aa, Entamoeba invadens
FPTEDVTGFNYLNDAKQLG

SEQ ID NO: 2937589 - protein, 20 aa, Entamoeba invadens
FPTEMANLFIEQKNETISRK

SEQ ID NO: 2937590 - protein, 20 aa, Entamoeba invadens
FPTFHLCPQSTSFETKYDEC

SEQ ID NO: 2937591 - protein, 17 aa, Entamoeba invadens
FPTIFEIPSAFHLVNMR

SEQ ID NO: 2937592 - protein, 17 aa, Entamoeba invadens
FPTKALYDYTAETDDEL

SEQ ID NO: 2937593 - protein, 18 aa, Entamoeba invadens
FPTKWPTMVTLILQTFAN

SEQ ID NO: 2937594 - protein, 21 aa, Entamoeba invadens
FPTPQRSYFTQSLNTFNFSSA

SEQ ID NO: 2937595 - protein, 22 aa, Entamoeba invadens
FPTQHVDAFIDYYCLVLENYNN

SEQ ID NO: 2937596 - protein, 18 aa, Entamoeba invadens
FPTTGILQIFMFPNYCYG

SEQ ID NO: 2937597 - protein, 18 aa, Entamoeba invadens
FPTTLKCFDKNILVEPSS

SEQ ID NO: 2937598 - protein, 33 aa, Entamoeba invadens
FPTTLKTIGKFAFKNCYSLESLTFPKSLENVED

SEQ ID NO: 2937599 - protein, 21 aa, Entamoeba invadens
FPTTYRKICYSRYNHDDIMTI

SEQ ID NO: 2937600 - protein, 24 aa, Entamoeba invadens
FPTYKRNFFQVNIWFEVAFTDYLN

SEQ ID NO: 2937601 - protein, 24 aa, Entamoeba invadens
FPTYKRNFFQVNIWFEVTFTDYLN

SEQ ID NO: 2937602 - protein, 20 aa, Entamoeba invadens
FPVCLPRVQDILDIVVTTSY

SEQ ID NO: 2937603 - protein, 25 aa, Entamoeba invadens
FPVEIKETFEPILVLTKQIVSDLDL

SEQ ID NO: 2937604 - protein, 20 aa, Entamoeba invadens
FPVELVEILKKCKLPSNAKV

SEQ ID NO: 2937605 - protein, 19 aa, Entamoeba invadens
FPVFGPRSTNSAPFNMSVP

SEQ ID NO: 2937606 - protein, 24 aa, Entamoeba invadens
FPVKNNYVALSFNFADLKFKLDSS

SEQ ID NO: 2937607 - protein, 23 aa, Entamoeba invadens
FPVKSLHGHSHFVSDLVLSADAK

SEQ ID NO: 2937608 - protein, 18 aa, Entamoeba invadens
FPVLKRLLPFMKKTSEEY

SEQ ID NO: 2937609 - protein, 20 aa, Entamoeba invadens
FPVLPDPFLVYSSAQEHVRD

SEQ ID NO: 2937610 - protein, 21 aa, Entamoeba invadens
FPVQLKIPLALSLSLVLNIKN

SEQ ID NO: 2937611 - protein, 25 aa, Entamoeba invadens
FPVTKAGVFQFRIKKITGEVLKTVY

SEQ ID NO: 2937612 - protein, 20 aa, Entamoeba invadens
FPWTNNSKFMYLRQNHNSVL

SEQ ID NO: 2937613 - protein, 21 aa, Entamoeba invadens
FPYAGSFIQRQGELFPEHTCP

SEQ ID NO: 2937614 - protein, 22 aa, Entamoeba invadens
FPYEHIPIVLCGNKIDLNTQRK

SEQ ID NO: 2937615 - protein, 18 aa, Entamoeba invadens
FPYILGLLASFRADAADI

SEQ ID NO: 2937616 - protein, 22 aa, Entamoeba invadens
FPYPRVGAIEFRPLSRNDYTKG

SEQ ID NO: 2937617 - protein, 25 aa, Entamoeba invadens
FPYSWDITNLISRGERPAIELEDGE

SEQ ID NO: 2937618 - protein, 18 aa, Entamoeba invadens
FPYTIEVLSEPKMSQFTE

SEQ ID NO: 2937619 - protein, 30 aa, Entamoeba invadens
FPYTVELFGVQSFYCCLILESIELPKKHKE

SEQ ID NO: 2937620 - protein, 17 aa, Entamoeba invadens
FQACEKLKTAVLQKKVK

SEQ ID NO: 2937621 - protein, 19 aa, Entamoeba invadens
FQADCTPFLNSILLCGDVP

SEQ ID NO: 2937622 - protein, 20 aa, Entamoeba invadens
FQAFEGLECLSIRKNHLHFT

SEQ ID NO: 2937623 - protein, 20 aa, Entamoeba invadens
FQAIECIQLLSQIQIIQPFL

SEQ ID NO: 2937624 - protein, 23 aa, Entamoeba invadens
FQAPPTRQSIRRSLVPTKKHLNN

SEQ ID NO: 2937625 - protein, 17 aa, Entamoeba invadens
FQATNTFMFIVSKTGEV

SEQ ID NO: 2937626 - protein, 24 aa, Entamoeba invadens
FQAVNVMGYPECDVVLSECVLYLS

SEQ ID NO: 2937627 - protein, 28 aa, Entamoeba invadens
FQCDGLEHCFWLAFFFKYATVGEGEEVK

SEQ ID NO: 2937628 - protein, 18 aa, Entamoeba invadens
FQDAEEFVTALIQIGLKM

SEQ ID NO: 2937629 - protein, 19 aa, Entamoeba invadens
FQDEFKKYAKVYIVEPNGY

SEQ ID NO: 2937630 - protein, 17 aa, Entamoeba invadens
FQDILIHVCEYGTVCLR

SEQ ID NO: 2937631 - protein, 26 aa, Entamoeba invadens
FQDKMCLLDVNKSCCYKSEKQNILDK

SEQ ID NO: 2937632 - protein, 23 aa, Entamoeba invadens
FQDQAVWMLNAMWFKEKDARAEE

SEQ ID NO: 2937633 - protein, 20 aa, Entamoeba invadens
FQDQAVWMLNAMWPKEQDKR

SEQ ID NO: 2937634 - protein, 23 aa, Entamoeba invadens
FQDRQLRCEISFSFENDYNESLG

SEQ ID NO: 2937635 - protein, 19 aa, Entamoeba invadens
FQEFPELTMDVQIIIQSAT

SEQ ID NO: 2937636 - protein, 17 aa, Entamoeba invadens
FQEMLSIIVKRNLHLNE

SEQ ID NO: 2937637 - protein, 26 aa, Entamoeba invadens
FQENTVFFMEYFMRHALFNKDVNIIV

SEQ ID NO: 2937638 - protein, 17 aa, Entamoeba invadens
FQESCFEFQTSQNDEQK

SEQ ID NO: 2937639 - protein, 19 aa, Entamoeba invadens
FQFLEPHSAPFVLPNEVCL

SEQ ID NO: 2937640 - protein, 25 aa, Entamoeba invadens
FQFQAEINQLLSLIINAFYSNKDIF

SEQ ID NO: 2937641 - protein, 17 aa, Entamoeba invadens
FQGHVMVIVPGIAACLE

SEQ ID NO: 2937642 - protein, 25 aa, Entamoeba invadens
FQGMKDIHFLVAITYCLKTIDIDSI

SEQ ID NO: 2937643 - protein, 26 aa, Entamoeba invadens
FQGNLRYLFLESLLDLGSFERKASYL

SEQ ID NO: 2937644 - protein, 24 aa, Entamoeba invadens
FQHFNMTKCLFVGGDVIYSEEHPV

SEQ ID NO: 2937645 - protein, 24 aa, Entamoeba invadens
FQHIMRYKIQINRIIETLQNNDKL

SEQ ID NO: 2937646 - protein, 19 aa, Entamoeba invadens
FQHIMRYRIQVERIVETLP

SEQ ID NO: 2937647 - protein, 18 aa, Entamoeba invadens
FQHRGLAQQLMRHFIKNA

SEQ ID NO: 2937648 - protein, 18 aa, Entamoeba invadens
FQIDPVVNFLNLHAITIS

SEQ ID NO: 2937649 - protein, 18 aa, Entamoeba invadens
FQIFVWFKVNYRTVVKNK

SEQ ID NO: 2937650 - protein, 17 aa, Entamoeba invadens
FQIKQRFIEMGMVDVCE

SEQ ID NO: 2937651 - protein, 17 aa, Entamoeba invadens
FQILRPNWKLHMRSNLV

SEQ ID NO: 2937652 - protein, 20 aa, Entamoeba invadens
FQIPEYSKKVFVYFRDGIVA

SEQ ID NO: 2937653 - protein, 17 aa, Entamoeba invadens
FQIRKFYESNGLNFSDE

SEQ ID NO: 2937654 - protein, 20 aa, Entamoeba invadens
FQITSLPTFVFFQDQKVVKK

SEQ ID NO: 2937655 - protein, 17 aa, Entamoeba invadens
FQKAVQFDKDHNISDTI

SEQ ID NO: 2937656 - protein, 18 aa, Entamoeba invadens
FQKCEFDCNIAFSNLKRV

SEQ ID NO: 2937657 - protein, 27 aa, Entamoeba invadens
FQKDVLRFKFAWDIADFTSAGKRLIIP

SEQ ID NO: 2937658 - protein, 21 aa, Entamoeba invadens
FQKLPGPFLIVTPLSTLEHWR

SEQ ID NO: 2937659 - protein, 22 aa, Entamoeba invadens
FQKMLCVAVWMGVRTNCDTSCI

SEQ ID NO: 2937660 - protein, 18 aa, Entamoeba invadens
FQKSIKFFGKYYNSQFVT

SEQ ID NO: 2937661 - protein, 19 aa, Entamoeba invadens
FQKSSVVSIEVNCKVIQEI

SEQ ID NO: 2937662 - protein, 18 aa, Entamoeba invadens
FQKVHAHDFYLSRKDSTL

SEQ ID NO: 2937663 - protein, 22 aa, Entamoeba invadens
FQKVVKKRCEIIEHIMLKQNVK

SEQ ID NO: 2937664 - protein, 27 aa, Entamoeba invadens
FQKWIKQLVYFIGEFELNKLTTLNHKE

SEQ ID NO: 2937665 - protein, 19 aa, Entamoeba invadens
FQLAISFSLANGARRTRVI

SEQ ID NO: 2937666 - protein, 23 aa, Entamoeba invadens
FQLERLDAIFYNGNFVMGATKIG

SEQ ID NO: 2937667 - protein, 18 aa, Entamoeba invadens
FQLFKSGFKLIPKQIEIG

SEQ ID NO: 2937668 - protein, 22 aa, Entamoeba invadens
FQLISICIERLLELAVPSPEDL

SEQ ID NO: 2937669 - protein, 31 aa, Entamoeba invadens
FQLLLEHFIQFEMPKTWELFQDGILIEQKLL

SEQ ID NO: 2937670 - protein, 23 aa, Entamoeba invadens
FQLPEFGDGISYSLPYLLEHCVR

SEQ ID NO: 2937671 - protein, 21 aa, Entamoeba invadens
FQLQLNKQCREYFVQQYMVRM

SEQ ID NO: 2937672 - protein, 20 aa, Entamoeba invadens
FQLQPMKFVLTFKLGSASLE

SEQ ID NO: 2937673 - protein, 32 aa, Entamoeba invadens
FQLSDLWLSTLRLGGVGEERYIRFAFSEKTRI

SEQ ID NO: 2937674 - protein, 21 aa, Entamoeba invadens
FQMSCITSFNLLNTMEDYALD

SEQ ID NO: 2937675 - protein, 28 aa, Entamoeba invadens
FQMVCRKAFEWNSVKNFWEYCIKVAEDS

SEQ ID NO: 2937676 - protein, 18 aa, Entamoeba invadens
FQNDFSDFDFFVASTQFF

SEQ ID NO: 2937677 - protein, 17 aa, Entamoeba invadens
FQNEVIALKQENETVER

SEQ ID NO: 2937678 - protein, 21 aa, Entamoeba invadens
FQNIEMLHLWDVKDENFGNRI

SEQ ID NO: 2937679 - protein, 35 aa, Entamoeba invadens
FQNLELMYIKFSFNISIMCTFNITKLKALNLIKSS

SEQ ID NO: 2937680 - protein, 23 aa, Entamoeba invadens
FQNSVLHFIDFEFANQYSAIPET

SEQ ID NO: 2937681 - protein, 18 aa, Entamoeba invadens
FQNVSCWENCFSDVGQKL

SEQ ID NO: 2937682 - protein, 18 aa, Entamoeba invadens
FQPFYKYLDSVIVTGLQN

SEQ ID NO: 2937683 - protein, 18 aa, Entamoeba invadens
FQPPPPLQSPFVICQQPF

SEQ ID NO: 2937684 - protein, 21 aa, Entamoeba invadens
FQPQLCSLGGYPNFAQDDPRS

SEQ ID NO: 2937685 - protein, 23 aa, Entamoeba invadens
FQRCNYLKFEILNNANGANYITL

SEQ ID NO: 2937686 - protein, 26 aa, Entamoeba invadens
FQRGILKFFLNLCEEFDKKLKSDLLS

SEQ ID NO: 2937687 - protein, 20 aa, Entamoeba invadens
FQRLEPFFDGILVTMKSFSL

SEQ ID NO: 2937688 - protein, 24 aa, Entamoeba invadens
FQRLRRIKQLGAMDFVVSSATHTR

SEQ ID NO: 2937689 - protein, 17 aa, Entamoeba invadens
FQRTKCLFGGQRFFFYT

SEQ ID NO: 2937690 - protein, 18 aa, Entamoeba invadens
FQRVIWYPVPYFVFSEHP

SEQ ID NO: 2937691 - protein, 21 aa, Entamoeba invadens
FQSESIVPVLLDIMRSTKSLL

SEQ ID NO: 2937692 - protein, 17 aa, Entamoeba invadens
FQSLKKSGSLVVYSQYL

SEQ ID NO: 2937693 - protein, 23 aa, Entamoeba invadens
FQSMCRKYAIKVCKAEYEEFTLR

SEQ ID NO: 2937694 - protein, 17 aa, Entamoeba invadens
FQSNAQWCDLCIDNDIT

SEQ ID NO: 2937695 - protein, 17 aa, Entamoeba invadens
FQSRVVGGYNIIGFFEL

SEQ ID NO: 2937696 - protein, 22 aa, Entamoeba invadens
FQSSGVFAPIPSAGTMQPQKAT

SEQ ID NO: 2937697 - protein, 22 aa, Entamoeba invadens
FQSVDIILGMIVCKAKNFTVFL

SEQ ID NO: 2937698 - protein, 23 aa, Entamoeba invadens
FQTIPSLFYRGSIGAIVVYDLTN

SEQ ID NO: 2937699 - protein, 22 aa, Entamoeba invadens
FQTKWAEYEWENKIVVETEINN

SEQ ID NO: 2937700 - protein, 23 aa, Entamoeba invadens
FQTLQQCLCICLLSEMADITIKQ

SEQ ID NO: 2937701 - protein, 18 aa, Entamoeba invadens
FQTMPLLCDKEIMKSERE

SEQ ID NO: 2937702 - protein, 17 aa, Entamoeba invadens
FQTMSCAQGNYVVDKIG

SEQ ID NO: 2937703 - protein, 17 aa, Entamoeba invadens
FQTSVVLHALKFKNVKK

SEQ ID NO: 2937704 - protein, 20 aa, Entamoeba invadens
FQTVCPSKKNVLKWEDTINS

SEQ ID NO: 2937705 - protein, 21 aa, Entamoeba invadens
FQVETLRSWENFLPSLKEKVI

SEQ ID NO: 2937706 - protein, 22 aa, Entamoeba invadens
FQVIDRSSFRLILPSEQPVDFP

SEQ ID NO: 2937707 - protein, 17 aa, Entamoeba invadens
FQVKLLIPIKRSVLTLQ

SEQ ID NO: 2937708 - protein, 20 aa, Entamoeba invadens
FQVSYFPVGFQPVYEHSNLY

SEQ ID NO: 2937709 - protein, 17 aa, Entamoeba invadens
FQVTITIPEFVKKYASL

SEQ ID NO: 2937710 - protein, 17 aa, Entamoeba invadens
FQVVVFLENEKVIFKTG

SEQ ID NO: 2937711 - protein, 21 aa, Entamoeba invadens
FQWAIPIESIFPNKSQRLDFV

SEQ ID NO: 2937712 - protein, 19 aa, Entamoeba invadens
FQYGDVWYNAFDVFGVGEE

SEQ ID NO: 2937713 - protein, 17 aa, Entamoeba invadens
FQYQPMMFPQQFPPFHQ

SEQ ID NO: 2937714 - protein, 18 aa, Entamoeba invadens
FRADIEVTCYAKAGVSAV

SEQ ID NO: 2937715 - protein, 17 aa, Entamoeba invadens
FRAGAYEQLQMNAKRAG

SEQ ID NO: 2937716 - protein, 21 aa, Entamoeba invadens
FRAISLLLRCGVPRKNMSNDT

SEQ ID NO: 2937717 - protein, 17 aa, Entamoeba invadens
FRDCDGAIVVFDLSNRE

SEQ ID NO: 2937718 - protein, 18 aa, Entamoeba invadens
FRDCLHAWEAVDFYGNAR

SEQ ID NO: 2937719 - protein, 18 aa, Entamoeba invadens
FRDGHVFVELAALITKTS

SEQ ID NO: 2937720 - protein, 18 aa, Entamoeba invadens
FRDGLRCVIPNYKVLQTD

SEQ ID NO: 2937721 - protein, 18 aa, Entamoeba invadens
FRDSHMLYTCYVFQQISS

SEQ ID NO: 2937722 - protein, 22 aa, Entamoeba invadens
FRDSQFLYQCFIFEQVSSTHVK

SEQ ID NO: 2937723 - protein, 21 aa, Entamoeba invadens
FRDVLFFADFFRTFGANEVNW

SEQ ID NO: 2937724 - protein, 25 aa, Entamoeba invadens
FRDVPWKRIQIENVNKGTYVADKLI

SEQ ID NO: 2937725 - protein, 23 aa, Entamoeba invadens
FREFKNKMRFLAELSNLTMVSKA

SEQ ID NO: 2937726 - protein, 19 aa, Entamoeba invadens
FRERVGVGADGVDRGKLTI

SEQ ID NO: 2937727 - protein, 20 aa, Entamoeba invadens
FRFAEFDSLIHLFNVRCVYD

SEQ ID NO: 2937728 - protein, 19 aa, Entamoeba invadens
FRFFCSVMPLEGVSQDTAK

SEQ ID NO: 2937729 - protein, 21 aa, Entamoeba invadens
FRFFDIEKRSLIKIEGSTNTN

SEQ ID NO: 2937730 - protein, 27 aa, Entamoeba invadens
FRFGGWPHAGCGIGLERITMLYLGIPN

SEQ ID NO: 2937731 - protein, 17 aa, Entamoeba invadens
FRFIAFRNYITKHINEI

SEQ ID NO: 2937732 - protein, 21 aa, Entamoeba invadens
FRFKLDGTVVIRMEKINSAFS

SEQ ID NO: 2937733 - protein, 20 aa, Entamoeba invadens
FRFYFIPVVRGSFTEQEFQE

SEQ ID NO: 2937734 - protein, 27 aa, Entamoeba invadens
FRGDRAIEISKAFTLPNEQFKYFDRIE

SEQ ID NO: 2937735 - protein, 18 aa, Entamoeba invadens
FRGLMKYSRVVPKVDIQT

SEQ ID NO: 2937736 - protein, 19 aa, Entamoeba invadens
FRGLSCQFDEAGLLDATTV

SEQ ID NO: 2937737 - protein, 20 aa, Entamoeba invadens
FRGNSPFTRVFGEYLKMFCG

SEQ ID NO: 2937738 - protein, 17 aa, Entamoeba invadens
FRGNSPFTRVYSAYLKK

SEQ ID NO: 2937739 - protein, 21 aa, Entamoeba invadens
FRGNTVFTRVFFYYLNHYCSD

SEQ ID NO: 2937740 - protein, 21 aa, Entamoeba invadens
FRGTLFRWMENLRYLNLSACI

SEQ ID NO: 2937741 - protein, 18 aa, Entamoeba invadens
FRHCGLRALYFSGTHNNN

SEQ ID NO: 2937742 - protein, 17 aa, Entamoeba invadens
FRHRGPLFVKRMNENGR

SEQ ID NO: 2937743 - protein, 21 aa, Entamoeba invadens
FRIATLPPFITAKSCILVVVN

SEQ ID NO: 2937744 - protein, 18 aa, Entamoeba invadens
FRIKCPVLNNKSFINFDH

SEQ ID NO: 2937745 - protein, 25 aa, Entamoeba invadens
FRINCVGGLDVGWVAYVIGITSDYR

SEQ ID NO: 2937746 - protein, 19 aa, Entamoeba invadens
FRIPEGCFIIELLEKIVCV

SEQ ID NO: 2937747 - protein, 27 aa, Entamoeba invadens
FRIQVSSMDCTGCGVCVTACPAKCLAM

SEQ ID NO: 2937748 - protein, 28 aa, Entamoeba invadens
FRIQVSSMDCTGCSVCVTACPAKCLSMT

SEQ ID NO: 2937749 - protein, 24 aa, Entamoeba invadens
FRIRYKKIWSFIQENFTVFPKQTG

SEQ ID NO: 2937750 - protein, 17 aa, Entamoeba invadens
FRKACQYNLVNDGAIDL

SEQ ID NO: 2937751 - protein, 27 aa, Entamoeba invadens
FRKEVCYYYGCPTCKISVEKTAHKCNH

SEQ ID NO: 2937752 - protein, 19 aa, Entamoeba invadens
FRKEVICGNQSIYKSEKSY

SEQ ID NO: 2937753 - protein, 17 aa, Entamoeba invadens
FRKLIYKCLDAWSQTFN

SEQ ID NO: 2937754 - protein, 19 aa, Entamoeba invadens
FRLAKKMGALEVRREEEFS

SEQ ID NO: 2937755 - protein, 20 aa, Entamoeba invadens
FRLALQKARGVVTIAQEHGL

SEQ ID NO: 2937756 - protein, 19 aa, Entamoeba invadens
FRLEEMLLNAVLFNDIRQL

SEQ ID NO: 2937757 - protein, 19 aa, Entamoeba invadens
FRLGKKCFCGCQNLKKVVI

SEQ ID NO: 2937758 - protein, 20 aa, Entamoeba invadens
FRLKSVLEMGKYEAIGYKFG

SEQ ID NO: 2937759 - protein, 28 aa, Entamoeba invadens
FRLLPSLCQSLLLRLVFLSSTIDLPTVE

SEQ ID NO: 2937760 - protein, 20 aa, Entamoeba invadens
FRLMGIYGHCNITPRDMSPV

SEQ ID NO: 2937761 - protein, 18 aa, Entamoeba invadens
FRLNYVIYLFSIVESSMK

SEQ ID NO: 2937762 - protein, 19 aa, Entamoeba invadens
FRLQMLQPLSTIVLEKVFP

SEQ ID NO: 2937763 - protein, 17 aa, Entamoeba invadens
FRMNLCDTTPYNADFDG

SEQ ID NO: 2937764 - protein, 21 aa, Entamoeba invadens
FRMNNKLYWTTFVESYSSIVS

SEQ ID NO: 2937765 - protein, 18 aa, Entamoeba invadens
FRNCKISQIVLPKHLKSI

SEQ ID NO: 2937766 - protein, 17 aa, Entamoeba invadens
FRNFLVLMKDLQVLEIE

SEQ ID NO: 2937767 - protein, 22 aa, Entamoeba invadens
FRNKRLLPSNIIVDQLYMEHPT

SEQ ID NO: 2937768 - protein, 19 aa, Entamoeba invadens
FRNLKCLKGQLETFQTIKD

SEQ ID NO: 2937769 - protein, 21 aa, Entamoeba invadens
FRNLMKYIYDRGNFVHVIKNE

SEQ ID NO: 2937770 - protein, 18 aa, Entamoeba invadens
FRNSSQFVAILKRVVNFF

SEQ ID NO: 2937771 - protein, 18 aa, Entamoeba invadens
FRNTQRFLKMYQDCATQC

SEQ ID NO: 2937772 - protein, 28 aa, Entamoeba invadens
FRNVFECYYCVFRGLFDVEEITLRNDIF

SEQ ID NO: 2937773 - protein, 18 aa, Entamoeba invadens
FRPFGNVYYVERSYERMY

SEQ ID NO: 2937774 - protein, 26 aa, Entamoeba invadens
FRPKPILEQIERVFKIDYKFSDNIGA

SEQ ID NO: 2937775 - protein, 21 aa, Entamoeba invadens
FRPLMMWYSEHLYRETYIQSH

SEQ ID NO: 2937776 - protein, 17 aa, Entamoeba invadens
FRPPVPLVKRTIESLIE

SEQ ID NO: 2937777 - protein, 18 aa, Entamoeba invadens
FRPTIVCDGMGEIEVNWG

SEQ ID NO: 2937778 - protein, 30 aa, Entamoeba invadens
FRPVKKGDHFLCHGGMRTVEFKIVDVDPAP

SEQ ID NO: 2937779 - protein, 17 aa, Entamoeba invadens
FRQELPPHIFALAEETY

SEQ ID NO: 2937780 - protein, 20 aa, Entamoeba invadens
FRQESNFHYLFGVKEAGFLG

SEQ ID NO: 2937781 - protein, 26 aa, Entamoeba invadens
FRQKKICGPNSLFYGTVKDALESYLN

SEQ ID NO: 2937782 - protein, 17 aa, Entamoeba invadens
FRQMPILQPIIVQSQMQ

SEQ ID NO: 2937783 - protein, 19 aa, Entamoeba invadens
FRQSGCVDLSTKYEGIDND

SEQ ID NO: 2937784 - protein, 19 aa, Entamoeba invadens
FRRIREISNKFKANYIDKN

SEQ ID NO: 2937785 - protein, 24 aa, Entamoeba invadens
FRRIRLSERLMYWLRQISEESNGY

SEQ ID NO: 2937786 - protein, 18 aa, Entamoeba invadens
FRRSEALLQLSSLGMEAS

SEQ ID NO: 2937787 - protein, 23 aa, Entamoeba invadens
FRSEDLPTFIVQIILDDGVVTVP

SEQ ID NO: 2937788 - protein, 17 aa, Entamoeba invadens
FRSEFIVHFYGAVFIPN

SEQ ID NO: 2937789 - protein, 22 aa, Entamoeba invadens
FRSEYIVHFFGAVLIPNKICMV

SEQ ID NO: 2937790 - protein, 17 aa, Entamoeba invadens
FRSEYIVHFYGAVFIPN

SEQ ID NO: 2937791 - protein, 26 aa, Entamoeba invadens
FRSKGRIPAISWRGEKNQTISRSAQP

SEQ ID NO: 2937792 - protein, 18 aa, Entamoeba invadens
FRSKIPFEQVFEELMVSF

SEQ ID NO: 2937793 - protein, 19 aa, Entamoeba invadens
FRSMIDLYFRKAAGAVVVY

SEQ ID NO: 2937794 - protein, 19 aa, Entamoeba invadens
FRSNDTFNTFAPFNQFNQY

SEQ ID NO: 2937795 - protein, 28 aa, Entamoeba invadens
FRSNLFRWLENLKYLNIAACVQFSNEFI

SEQ ID NO: 2937796 - protein, 20 aa, Entamoeba invadens
FRSNPYFFLFKLEKNTVKPR

SEQ ID NO: 2937797 - protein, 23 aa, Entamoeba invadens
FRSVFKCEIKICLFHLNQAVYRM

SEQ ID NO: 2937798 - protein, 24 aa, Entamoeba invadens
FRSVFKCEIKICLFHLNQAVYRML

SEQ ID NO: 2937799 - protein, 23 aa, Entamoeba invadens
FRSVGKMCFLGCSQLTSVTLSSH

SEQ ID NO: 2937800 - protein, 19 aa, Entamoeba invadens
FRSVMPVYFRGATSAIIVY

SEQ ID NO: 2937801 - protein, 17 aa, Entamoeba invadens
FRSVPLIDSIHFLPLIL

SEQ ID NO: 2937802 - protein, 25 aa, Entamoeba invadens
FRTAGKRIYTVLCNRQDFVRDKVLL

SEQ ID NO: 2937803 - protein, 17 aa, Entamoeba invadens
FRTFKNVFFFGEKISLE

SEQ ID NO: 2937804 - protein, 21 aa, Entamoeba invadens
FRTIFKIIYSEVLRQCKPEDH

SEQ ID NO: 2937805 - protein, 20 aa, Entamoeba invadens
FRTMIPQLFSAMMRMAQSSM

SEQ ID NO: 2937806 - protein, 20 aa, Entamoeba invadens
FRTNFPLFTPREVQLYMKHL

SEQ ID NO: 2937807 - protein, 18 aa, Entamoeba invadens
FRTQVCELSFLTLLQQVG

SEQ ID NO: 2937808 - protein, 17 aa, Entamoeba invadens
FRTSDEDNIIFAVADCF

SEQ ID NO: 2937809 - protein, 24 aa, Entamoeba invadens
FRTTYSDTRWCYIYKNLDDITNNY

SEQ ID NO: 2937810 - protein, 17 aa, Entamoeba invadens
FRVFFYKIFHNYFDFFI

SEQ ID NO: 2937811 - protein, 17 aa, Entamoeba invadens
FRVGSYLLVKGVSYRIE

SEQ ID NO: 2937812 - protein, 17 aa, Entamoeba invadens
FRVLTAIEMGMRNHELV

SEQ ID NO: 2937813 - protein, 17 aa, Entamoeba invadens
FRVMGSFEQHVEPCDNA

SEQ ID NO: 2937814 - protein, 22 aa, Entamoeba invadens
FRVPIFRECLLLDFETHIQYKS

SEQ ID NO: 2937815 - protein, 19 aa, Entamoeba invadens
FRVQLDMDRRLYAFNNNKK

SEQ ID NO: 2937816 - protein, 19 aa, Entamoeba invadens
FRVRIKLVQNKNVTATLLS

SEQ ID NO: 2937817 - protein, 21 aa, Entamoeba invadens
FRVTTMWDFNGSKVYDEHYMD

SEQ ID NO: 2937818 - protein, 18 aa, Entamoeba invadens
FRVYWKNISAGIAVADVG

SEQ ID NO: 2937819 - protein, 21 aa, Entamoeba invadens
FRYCVSLKWFEIRGDVDEIGD

SEQ ID NO: 2937820 - protein, 19 aa, Entamoeba invadens
FRYELKCHCKSIASTSVTI

SEQ ID NO: 2937821 - protein, 21 aa, Entamoeba invadens
FRYRRLCDKSQPVSFTSTQFM

SEQ ID NO: 2937822 - protein, 17 aa, Entamoeba invadens
FRYSATRGPQVQSRIKM

SEQ ID NO: 2937823 - protein, 20 aa, Entamoeba invadens
FSAEEFNRCVGSNKKVLVIV

SEQ ID NO: 2937824 - protein, 17 aa, Entamoeba invadens
FSAFAKVNKIVMIGDIQ

SEQ ID NO: 2937825 - protein, 20 aa, Entamoeba invadens
FSAKESLCQYLENFPNLQKL

SEQ ID NO: 2937826 - protein, 21 aa, Entamoeba invadens
FSAKLFRFKSAIESQERQLEL

SEQ ID NO: 2937827 - protein, 25 aa, Entamoeba invadens
FSAKVPFRIAQLLLKNNVKCLDIVF

SEQ ID NO: 2937828 - protein, 17 aa, Entamoeba invadens
FSALPSLFGRSLTLKEL

SEQ ID NO: 2937829 - protein, 20 aa, Entamoeba invadens
FSALTCLTKFTLKGGKCSVK

SEQ ID NO: 2937830 - protein, 17 aa, Entamoeba invadens
FSALYIFKKEQHPDVHS

SEQ ID NO: 2937831 - protein, 25 aa, Entamoeba invadens
FSAPPPSPRLCVFKKLETDTHFQII

SEQ ID NO: 2937832 - protein, 17 aa, Entamoeba invadens
FSAPYSFIKLENTLCNG

SEQ ID NO: 2937833 - protein, 17 aa, Entamoeba invadens
FSAVFVFSTAFPTQQES

SEQ ID NO: 2937834 - protein, 19 aa, Entamoeba invadens
FSAVRRFLVKNDMVCIVRG

SEQ ID NO: 2937835 - protein, 18 aa, Entamoeba invadens
FSAYRLMIEYNMQFPKLV

SEQ ID NO: 2937836 - protein, 17 aa, Entamoeba invadens
FSCGGHNIECCRCGDTN

SEQ ID NO: 2937837 - protein, 28 aa, Entamoeba invadens
FSCKLDKLKTLFVFKGYQITFKKIDNLK

SEQ ID NO: 2937838 - protein, 30 aa, Entamoeba invadens
FSCLAFGGGSGRPALMFDEMLMASSEASQT

SEQ ID NO: 2937839 - protein, 17 aa, Entamoeba invadens
FSCLLKRKMKKENHFYN

SEQ ID NO: 2937840 - protein, 21 aa, Entamoeba invadens
FSCNRFELNKCMDVDIYLKNT

SEQ ID NO: 2937841 - protein, 27 aa, Entamoeba invadens
FSCRQYFKVTVFLSRSCDDVVPKAVAL

SEQ ID NO: 2937842 - protein, 26 aa, Entamoeba invadens
FSCSGDGTIKGWELPFPTAMSKTISP

SEQ ID NO: 2937843 - protein, 17 aa, Entamoeba invadens
FSCSLCNKKFARATDLK

SEQ ID NO: 2937844 - protein, 17 aa, Entamoeba invadens
FSDALCKKLLQKGIPTW

SEQ ID NO: 2937845 - protein, 29 aa, Entamoeba invadens
FSDDITVGFCCSVCSLPIIGSADTCKCCK

SEQ ID NO: 2937846 - protein, 19 aa, Entamoeba invadens
FSDFKPIRIEKEICDTQIE

SEQ ID NO: 2937847 - protein, 23 aa, Entamoeba invadens
FSDGEVFLALAHFISNKSFDFEE

SEQ ID NO: 2937848 - protein, 24 aa, Entamoeba invadens
FSDICKRLHRLPEDVKLFVLEELQ

SEQ ID NO: 2937849 - protein, 23 aa, Entamoeba invadens
FSDIPAYEFKEGVDLYESALCGT

SEQ ID NO: 2937850 - protein, 23 aa, Entamoeba invadens
FSDKIGVLWFHYLVGLESTIAKF

SEQ ID NO: 2937851 - protein, 26 aa, Entamoeba invadens
FSDKKMMYAFNDFKMYLPLGPEKMEE

SEQ ID NO: 2937852 - protein, 24 aa, Entamoeba invadens
FSDNVYLFGKLVKFNRSNQVRRGA

SEQ ID NO: 2937853 - protein, 18 aa, Entamoeba invadens
FSDQISHEVINYMKRFGS

SEQ ID NO: 2937854 - protein, 22 aa, Entamoeba invadens
FSECDRLTSVVIPHFINCSNTN

SEQ ID NO: 2937855 - protein, 23 aa, Entamoeba invadens
FSEIKLLDFESSGPFNVDNLVFP

SEQ ID NO: 2937856 - protein, 34 aa, Entamoeba invadens
FSEKTRILIALSNLCHLHGWKLDSKYSTPTQIVL

SEQ ID NO: 2937857 - protein, 17 aa, Entamoeba invadens
FSENGPLIDPVRCLDVF

SEQ ID NO: 2937858 - protein, 24 aa, Entamoeba invadens
FSENSRKMWYVKYVVWKLTKNNRL

SEQ ID NO: 2937859 - protein, 18 aa, Entamoeba invadens
FSEPSGEFGSKWKSLVGE

SEQ ID NO: 2937860 - protein, 24 aa, Entamoeba invadens
FSESCGDAISVDWTDQPLSQDKTA

SEQ ID NO: 2937861 - protein, 19 aa, Entamoeba invadens
FSESVFQPIFTTIKDPRQI

SEQ ID NO: 2937862 - protein, 17 aa, Entamoeba invadens
FSETCCSILKQSLVISS

SEQ ID NO: 2937863 - protein, 20 aa, Entamoeba invadens
FSETILVEYCFPDVVKKTKV

SEQ ID NO: 2937864 - protein, 23 aa, Entamoeba invadens
FSEYLRTNFRWIYNGKDKYGLGN

SEQ ID NO: 2937865 - protein, 30 aa, Entamoeba invadens
FSFAITMYECFKWGEAYPINEFKFPWKIAE

SEQ ID NO: 2937866 - protein, 20 aa, Entamoeba invadens
FSFDDTCCINNTKTLANTGT

SEQ ID NO: 2937867 - protein, 20 aa, Entamoeba invadens
FSFDEIILLLGAESATYYSE

SEQ ID NO: 2937868 - protein, 22 aa, Entamoeba invadens
FSFEFRRPERYALKTVQYLIIN

SEQ ID NO: 2937869 - protein, 24 aa, Entamoeba invadens
FSFGITLFEVFGWEDAYKNSKFKF

SEQ ID NO: 2937870 - protein, 19 aa, Entamoeba invadens
FSFHKCIKLQCVKFSKSVL

SEQ ID NO: 2937871 - protein, 26 aa, Entamoeba invadens
FSFKTKSRMMKGFVNHLSRPAFRRQL

SEQ ID NO: 2937872 - protein, 18 aa, Entamoeba invadens
FSFNTIFENCEILEVSFC

SEQ ID NO: 2937873 - protein, 17 aa, Entamoeba invadens
FSFPSLFDATGVKIFKF

SEQ ID NO: 2937874 - protein, 20 aa, Entamoeba invadens
FSFYGCVSLTSILCNTNVIL

SEQ ID NO: 2937875 - protein, 17 aa, Entamoeba invadens
FSFYLPQNFPTSYVTQC

SEQ ID NO: 2937876 - protein, 17 aa, Entamoeba invadens
FSGAISILKHSENNFSI

SEQ ID NO: 2937877 - protein, 26 aa, Entamoeba invadens
FSGCNARPSVCPCWSVEPKLGTNPLV

SEQ ID NO: 2937878 - protein, 17 aa, Entamoeba invadens
FSGEFHTGEAPKASTKS

SEQ ID NO: 2937879 - protein, 24 aa, Entamoeba invadens
FSGELINLYSAWNLNGKHTYFDMV

SEQ ID NO: 2937880 - protein, 17 aa, Entamoeba invadens
FSGFGYPTDLVTINWMK

SEQ ID NO: 2937881 - protein, 17 aa, Entamoeba invadens
FSGGGRKDLSVQRWNVI

SEQ ID NO: 2937882 - protein, 26 aa, Entamoeba invadens
FSGGWRMRISIAKAIYMKPDLLLLDE

SEQ ID NO: 2937883 - protein, 22 aa, Entamoeba invadens
FSGIGGILRYKLDMEQLDENFN

SEQ ID NO: 2937884 - protein, 17 aa, Entamoeba invadens
FSGLKALVVDSVTTSIV

SEQ ID NO: 2937885 - protein, 20 aa, Entamoeba invadens
FSGNDIRAVSFLPINITEKA

SEQ ID NO: 2937886 - protein, 17 aa, Entamoeba invadens
FSGSIGFFEFLALYNFV

SEQ ID NO: 2937887 - protein, 18 aa, Entamoeba invadens
FSGSRTGENVNILTSTDL

SEQ ID NO: 2937888 - protein, 18 aa, Entamoeba invadens
FSGTIARLRDDMVDYSNT

SEQ ID NO: 2937889 - protein, 20 aa, Entamoeba invadens
FSGTTAFPVFGPRSTNSAPF

SEQ ID NO: 2937890 - protein, 22 aa, Entamoeba invadens
FSHFCLISQPVLSFLSTGKSTG

SEQ ID NO: 2937891 - protein, 20 aa, Entamoeba invadens
FSHFCLISQPVLSLLSTGKS

SEQ ID NO: 2937892 - protein, 21 aa, Entamoeba invadens
FSHFHVYVCVSLIEKYKAKLM

SEQ ID NO: 2937893 - protein, 22 aa, Entamoeba invadens
FSHPFKYVVCDECHLLKNQTTK

SEQ ID NO: 2937894 - protein, 19 aa, Entamoeba invadens
FSHPYPFIRTREFLWQEGH

SEQ ID NO: 2937895 - protein, 18 aa, Entamoeba invadens
FSHSKHFFVYTIAGKPAF

SEQ ID NO: 2937896 - protein, 22 aa, Entamoeba invadens
FSHTEIVLYAAFYVMNYSTHSL

SEQ ID NO: 2937897 - protein, 22 aa, Entamoeba invadens
FSHYCMKEYHKAMSEYENALKI

SEQ ID NO: 2937898 - protein, 24 aa, Entamoeba invadens
FSIAYRRIIDLIIFLIDFKTQIND

SEQ ID NO: 2937899 - protein, 25 aa, Entamoeba invadens
FSIAYRRIIDLIIFLIDFKTQINDS

SEQ ID NO: 2937900 - protein, 20 aa, Entamoeba invadens
FSIERTRFYAAELLIGLKYL

SEQ ID NO: 2937901 - protein, 30 aa, Entamoeba invadens
FSIKASLFAASPRALITMLFFPQQPEPDFP

SEQ ID NO: 2937902 - protein, 17 aa, Entamoeba invadens
FSIKGEVNMFYKHLHVS

SEQ ID NO: 2937903 - protein, 27 aa, Entamoeba invadens
FSILHSHVKYPFAISLMLELFLNEEDF

SEQ ID NO: 2937904 - protein, 17 aa, Entamoeba invadens
FSIPIGVKSVANGCFEG

SEQ ID NO: 2937905 - protein, 17 aa, Entamoeba invadens
FSIPNEVLVEIRAVVKD

SEQ ID NO: 2937906 - protein, 23 aa, Entamoeba invadens
FSIPSRGKSPIGFDDSSLPVSNS

SEQ ID NO: 2937907 - protein, 19 aa, Entamoeba invadens
FSIQGGEKNKATWGEATQA

SEQ ID NO: 2937908 - protein, 24 aa, Entamoeba invadens
FSIQNWTKFLQIFNLMLTKEKIGR

SEQ ID NO: 2937909 - protein, 24 aa, Entamoeba invadens
FSKAFERMLLFGFKKNEKIPYLEV

SEQ ID NO: 2937910 - protein, 26 aa, Entamoeba invadens
FSKCLGCSMCTTKCCYGVLEKQGPKI

SEQ ID NO: 2937911 - protein, 23 aa, Entamoeba invadens
FSKDKIIQLCFGCYTHKDSQPTF

SEQ ID NO: 2937912 - protein, 22 aa, Entamoeba invadens
FSKEACLLVADFLSDVFPSLSF

SEQ ID NO: 2937913 - protein, 25 aa, Entamoeba invadens
FSKEFFRLEIPRLLLNPLSSAQETD

SEQ ID NO: 2937914 - protein, 19 aa, Entamoeba invadens
FSKESFYNAVCGLSNIMTL

SEQ ID NO: 2937915 - protein, 22 aa, Entamoeba invadens
FSKEVFEKIIAVLKITSNVLPI

SEQ ID NO: 2937916 - protein, 26 aa, Entamoeba invadens
FSKFEPPLRLDFHSLPILPLLDLTPS

SEQ ID NO: 2937917 - protein, 17 aa, Entamoeba invadens
FSKFKRTKTVPVMTVTE

SEQ ID NO: 2937918 - protein, 19 aa, Entamoeba invadens
FSKGGLTCKNCKRVYFCDK

SEQ ID NO: 2937919 - protein, 22 aa, Entamoeba invadens
FSKHPPPILFFVTRNNQLVSVT

SEQ ID NO: 2937920 - protein, 18 aa, Entamoeba invadens
FSKIFKTDFVVVYINEAL

SEQ ID NO: 2937921 - protein, 22 aa, Entamoeba invadens
FSKIGICVAPSFFSRELTYITT

SEQ ID NO: 2937922 - protein, 22 aa, Entamoeba invadens
FSKINFDIEVIGCFARVTATHF

SEQ ID NO: 2937923 - protein, 22 aa, Entamoeba invadens
FSKLAVDAMLRVKRIVNGKAKY

SEQ ID NO: 2937924 - protein, 30 aa, Entamoeba invadens
FSKLREVMKIAVSPCIPFLGSTMGDLVFTD

SEQ ID NO: 2937925 - protein, 19 aa, Entamoeba invadens
FSKMFYISKSCVFNTVKNV

SEQ ID NO: 2937926 - protein, 25 aa, Entamoeba invadens
FSKNCPKLKALPIYAALPTDQQKQI

SEQ ID NO: 2937927 - protein, 21 aa, Entamoeba invadens
FSKNEIDERMLLNLQKKKWTD

SEQ ID NO: 2937928 - protein, 18 aa, Entamoeba invadens
FSKNKTIFIQNFLFDVLL

SEQ ID NO: 2937929 - protein, 22 aa, Entamoeba invadens
FSKQRVEGLGSFLDDLHKTMSK

SEQ ID NO: 2937930 - protein, 18 aa, Entamoeba invadens
FSKQSFARLVAKTVPEMI

SEQ ID NO: 2937931 - protein, 23 aa, Entamoeba invadens
FSKTEIHDGMTFGVEVGVVEVTG

SEQ ID NO: 2937932 - protein, 20 aa, Entamoeba invadens
FSKTFFSICEVFLQTETNPL

SEQ ID NO: 2937933 - protein, 17 aa, Entamoeba invadens
FSKVGVLAEIEEIRENR

SEQ ID NO: 2937934 - protein, 19 aa, Entamoeba invadens
FSLANGARRTRVINLEIDT

SEQ ID NO: 2937935 - protein, 18 aa, Entamoeba invadens
FSLAVVKTVIVRYGANQI

SEQ ID NO: 2937936 - protein, 29 aa, Entamoeba invadens
FSLEEVKQFLKWVDNFPSLQYVCFTIGED

SEQ ID NO: 2937937 - protein, 17 aa, Entamoeba invadens
FSLEKEGELEMVRFGVP

SEQ ID NO: 2937938 - protein, 25 aa, Entamoeba invadens
FSLFSNGRIEGMEKFEIGQKYNCCF

SEQ ID NO: 2937939 - protein, 20 aa, Entamoeba invadens
FSLFVRFVFSDGSFEEKRVK

SEQ ID NO: 2937940 - protein, 29 aa, Entamoeba invadens
FSLGEKQLICIARALLKGSKILIMDEATA

SEQ ID NO: 2937941 - protein, 19 aa, Entamoeba invadens
FSLGKYRIFGETIDIAVGN

SEQ ID NO: 2937942 - protein, 26 aa, Entamoeba invadens
FSLGQRQLLCLARALLNGSKLLIMDE

SEQ ID NO: 2937943 - protein, 27 aa, Entamoeba invadens
FSLIPEELKFLGIHRVVAPTLVYPEEY

SEQ ID NO: 2937944 - protein, 17 aa, Entamoeba invadens
FSLKKVVFPSFFYKLNK

SEQ ID NO: 2937945 - protein, 23 aa, Entamoeba invadens
FSLKSCQLLTLLEIDHCDAMETL

SEQ ID NO: 2937946 - protein, 37 aa, Entamoeba invadens
FSLKSPYLLKPTKYTKLRSFADLCHFSLYFSDNEEDV

SEQ ID NO: 2937947 - protein, 24 aa, Entamoeba invadens
FSLKYLNLSGCFNLNGEKILETYH

SEQ ID NO: 2937948 - protein, 35 aa, Entamoeba invadens
FSLLNRKHHCALCNKIFCDNCAKKKVISRNGKNYT

SEQ ID NO: 2937949 - protein, 18 aa, Entamoeba invadens
FSLLPAFLKERESSIFKE

SEQ ID NO: 2937950 - protein, 19 aa, Entamoeba invadens
FSLMPYSSLTQIVKTTNRN

SEQ ID NO: 2937951 - protein, 24 aa, Entamoeba invadens
FSLPRKTPNYALQFLPESLRSLDA

SEQ ID NO: 2937952 - protein, 23 aa, Entamoeba invadens
FSLPTDCFRNCFSLSSVKLPESV

SEQ ID NO: 2937953 - protein, 20 aa, Entamoeba invadens
FSLRFKIRLLAEMLQMPAYC

SEQ ID NO: 2937954 - protein, 25 aa, Entamoeba invadens
FSLRMPGCTRLIVPMISMLQQLRVV

SEQ ID NO: 2937955 - protein, 26 aa, Entamoeba invadens
FSLSTKKCFLRLFEKSRFVVNEKLKD

SEQ ID NO: 2937956 - protein, 20 aa, Entamoeba invadens
FSLVNRLGEPFLVEKKTNSS

SEQ ID NO: 2937957 - protein, 18 aa, Entamoeba invadens
FSLYKFSIAQNVGKDDEP

SEQ ID NO: 2937958 - protein, 19 aa, Entamoeba invadens
FSMIPRTLPQINLTKTQQE

SEQ ID NO: 2937959 - protein, 25 aa, Entamoeba invadens
FSMKDACFFSCYYLESIHLPKTLTF

SEQ ID NO: 2937960 - protein, 20 aa, Entamoeba invadens
FSMNLLLVYIYEKRINIDVM

SEQ ID NO: 2937961 - protein, 17 aa, Entamoeba invadens
FSMRLTRESVLDTILSL

SEQ ID NO: 2937962 - protein, 17 aa, Entamoeba invadens
FSMTEFEFLYGTKSIKS

SEQ ID NO: 2937963 - protein, 17 aa, Entamoeba invadens
FSMYKRMMSIISGLGRD

SEQ ID NO: 2937964 - protein, 17 aa, Entamoeba invadens
FSMYLTPLCTFVGVTEK

SEQ ID NO: 2937965 - protein, 23 aa, Entamoeba invadens
FSNCCIFRIELKNAKLLKSVAFV

SEQ ID NO: 2937966 - protein, 23 aa, Entamoeba invadens
FSNCGFEKMEIPSSVVYIEDSAF

SEQ ID NO: 2937967 - protein, 25 aa, Entamoeba invadens
FSNCGIERITLPSSIYFIKNSAFAD

SEQ ID NO: 2937968 - protein, 24 aa, Entamoeba invadens
FSNCGIERVTLPTSIYFIKNSAFA

SEQ ID NO: 2937969 - protein, 18 aa, Entamoeba invadens
FSNCHKLTKVVLPTTLVL

SEQ ID NO: 2937970 - protein, 17 aa, Entamoeba invadens
FSNCLSINTVVLPKTTK

SEQ ID NO: 2937971 - protein, 17 aa, Entamoeba invadens
FSNCNKLSEFEVPQKVR

SEQ ID NO: 2937972 - protein, 18 aa, Entamoeba invadens
FSNDFEYFQMNGVTIGNH

SEQ ID NO: 2937973 - protein, 22 aa, Entamoeba invadens
FSNDLLFVFSNVVNKVFGSEDS

SEQ ID NO: 2937974 - protein, 21 aa, Entamoeba invadens
FSNEFFYRGKLNDGVTANERS

SEQ ID NO: 2937975 - protein, 20 aa, Entamoeba invadens
FSNGGSIKFLITKNTYIRLQ

SEQ ID NO: 2937976 - protein, 17 aa, Entamoeba invadens
FSNIGLRSIILQKYYQF

SEQ ID NO: 2937977 - protein, 18 aa, Entamoeba invadens
FSNIKKFKINFGKTTNRL

SEQ ID NO: 2937978 - protein, 20 aa, Entamoeba invadens
FSNKFMKKWMEYSYGIKETA

SEQ ID NO: 2937979 - protein, 21 aa, Entamoeba invadens
FSNLEQITWTDFLISSFMFFD

SEQ ID NO: 2937980 - protein, 26 aa, Entamoeba invadens
FSNLKVCGSAIFLKLCEISVGFLVIP

SEQ ID NO: 2937981 - protein, 29 aa, Entamoeba invadens
FSNNEMNLFCLRVMTGCIILNDRISELTS

SEQ ID NO: 2937982 - protein, 28 aa, Entamoeba invadens
FSNPNYSAAMDLFFRLGADIEATNKNME

SEQ ID NO: 2937983 - protein, 21 aa, Entamoeba invadens
FSNSCFRVCSSLTSIKLPNNL

SEQ ID NO: 2937984 - protein, 21 aa, Entamoeba invadens
FSNSKIRLVLMNYQISSVMHR

SEQ ID NO: 2937985 - protein, 26 aa, Entamoeba invadens
FSNTESDCSPAFWNFLNLIGAKIELS

SEQ ID NO: 2937986 - protein, 17 aa, Entamoeba invadens
FSNVLGLFRLIDLKAID

SEQ ID NO: 2937987 - protein, 26 aa, Entamoeba invadens
FSPATSLRLLIKMTQIITQVHSVGLI

SEQ ID NO: 2937988 - protein, 24 aa, Entamoeba invadens
FSPDSRYIASMGCDKSIKLWDGFK

SEQ ID NO: 2937989 - protein, 17 aa, Entamoeba invadens
FSPIELSKCHFKNCKWL

SEQ ID NO: 2937990 - protein, 20 aa, Entamoeba invadens
FSPKKGDKVILVIEMKQDGT

SEQ ID NO: 2937991 - protein, 18 aa, Entamoeba invadens
FSPLNPFRIMIAGAGRGP

SEQ ID NO: 2937992 - protein, 17 aa, Entamoeba invadens
FSPNVCRVMDVTGSELF

SEQ ID NO: 2937993 - protein, 22 aa, Entamoeba invadens
FSPPMFLLNRFEEIVKGYFEKG

SEQ ID NO: 2937994 - protein, 19 aa, Entamoeba invadens
FSPQLFKALMNKIKAFKTL

SEQ ID NO: 2937995 - protein, 18 aa, Entamoeba invadens
FSPWLSERSLELFRKGGY

SEQ ID NO: 2937996 - protein, 17 aa, Entamoeba invadens
FSPYRIKGIQSDTLCYF

SEQ ID NO: 2937997 - protein, 19 aa, Entamoeba invadens
FSQACLKQMLDNQLEYIVL

SEQ ID NO: 2937998 - protein, 17 aa, Entamoeba invadens
FSQCGIESLKIPDSVSF

SEQ ID NO: 2937999 - protein, 29 aa, Entamoeba invadens
FSQDELVLFCSKCLLLSDTITSLVWNKRD

SEQ ID NO: 2938000 - protein, 18 aa, Entamoeba invadens
FSQFKDFVFYSRCYSKET

SEQ ID NO: 2938001 - protein, 22 aa, Entamoeba invadens
FSQKFPALLYGFLKTTDVRTAF

SEQ ID NO: 2938002 - protein, 31 aa, Entamoeba invadens
FSQLKSLKSFEANGCKQCEFILPHINGENCG

SEQ ID NO: 2938003 - protein, 17 aa, Entamoeba invadens
FSQMSFLSLVSEVEKSK

SEQ ID NO: 2938004 - protein, 17 aa, Entamoeba invadens
FSQSESYTALPEDESES

SEQ ID NO: 2938005 - protein, 17 aa, Entamoeba invadens
FSQSGLRAFKSLQQITF

SEQ ID NO: 2938006 - protein, 25 aa, Entamoeba invadens
FSQSIRPSLLMARSQLEQRQKEKEM

SEQ ID NO: 2938007 - protein, 33 aa, Entamoeba invadens
FSQTLKTKWFPPKVRKMRILWNEIDSVAKNKDN

SEQ ID NO: 2938008 - protein, 18 aa, Entamoeba invadens
FSQYFGEKNFDEYWDVFT

SEQ ID NO: 2938009 - protein, 25 aa, Entamoeba invadens
FSRAYSWMPIIFGVSYEEFFASLIH

SEQ ID NO: 2938010 - protein, 23 aa, Entamoeba invadens
FSRIAFEIKDGLVINIVKVESDI

SEQ ID NO: 2938011 - protein, 22 aa, Entamoeba invadens
FSRIAFKIKDGLVINIVKVESD

SEQ ID NO: 2938012 - protein, 20 aa, Entamoeba invadens
FSRILPQNVEVFPIITKAIE

SEQ ID NO: 2938013 - protein, 21 aa, Entamoeba invadens
FSRKCKVCANGFYPDDASGKC

SEQ ID NO: 2938014 - protein, 18 aa, Entamoeba invadens
FSRKCLTCRGGKYPKDGV

SEQ ID NO: 2938015 - protein, 19 aa, Entamoeba invadens
FSRLTKFLFSNATSPPLVI

SEQ ID NO: 2938016 - protein, 24 aa, Entamoeba invadens
FSRLWPCSLQPPTLPTPPIQKSDF

SEQ ID NO: 2938017 - protein, 20 aa, Entamoeba invadens
FSRQNCSIIDGGTYGAVFNV

SEQ ID NO: 2938018 - protein, 26 aa, Entamoeba invadens
FSRSVARKFFKDTFSGYIQKVVTTPQ

SEQ ID NO: 2938019 - protein, 31 aa, Entamoeba invadens
FSSCGHFLCKNCLKSQLLVAISSGKFMLCPY

SEQ ID NO: 2938020 - protein, 27 aa, Entamoeba invadens
FSSDWSSGEAFVALTGAVSFGEIDVNE

SEQ ID NO: 2938021 - protein, 17 aa, Entamoeba invadens
FSSFKLPQPSLIFKDNK

SEQ ID NO: 2938022 - protein, 31 aa, Entamoeba invadens
FSSFTDCEGFIACLMKLYNDTEIDSLLCKLQ

SEQ ID NO: 2938023 - protein, 17 aa, Entamoeba invadens
FSSGFEFPNLTEGIFQN

SEQ ID NO: 2938024 - protein, 17 aa, Entamoeba invadens
FSSGKLCIVSRSGKVLM

SEQ ID NO: 2938025 - protein, 20 aa, Entamoeba invadens
FSSIDLALFLGEPTETALNK

SEQ ID NO: 2938026 - protein, 18 aa, Entamoeba invadens
FSSIKLIYIESIDVMEMQ

SEQ ID NO: 2938027 - protein, 27 aa, Entamoeba invadens
FSSLEICDDVKPIFKLAGDAPFDMSMV

SEQ ID NO: 2938028 - protein, 18 aa, Entamoeba invadens
FSSLTAIYTLVLKTMKKY

SEQ ID NO: 2938029 - protein, 17 aa, Entamoeba invadens
FSSMTALEFQNATVTQD

SEQ ID NO: 2938030 - protein, 22 aa, Entamoeba invadens
FSSNCTLILLSLPYDVKNSDII

SEQ ID NO: 2938031 - protein, 24 aa, Entamoeba invadens
FSSPWKDKYPTLALLPKTNSELMQ

SEQ ID NO: 2938032 - protein, 19 aa, Entamoeba invadens
FSSQKKVDFMQFYTQPQQQ

SEQ ID NO: 2938033 - protein, 23 aa, Entamoeba invadens
FSSQWFCRVMKCLNKMETNDELC

SEQ ID NO: 2938034 - protein, 17 aa, Entamoeba invadens
FSSSGLVFGSFLRNPII

SEQ ID NO: 2938035 - protein, 17 aa, Entamoeba invadens
FSSVVIAKQLGWIDSEV

SEQ ID NO: 2938036 - protein, 25 aa, Entamoeba invadens
FSTAFRPEILNGFVKGDMPSGEEKL

SEQ ID NO: 2938037 - protein, 23 aa, Entamoeba invadens
FSTAWCHPCKTMDPVYKKISTEH

SEQ ID NO: 2938038 - protein, 17 aa, Entamoeba invadens
FSTCQSGYEINEKTSKC

SEQ ID NO: 2938039 - protein, 24 aa, Entamoeba invadens
FSTFLKGKILFIAAVDTKKKSGIT

SEQ ID NO: 2938040 - protein, 21 aa, Entamoeba invadens
FSTFRRSNLDVTRQNPFVEVS

SEQ ID NO: 2938041 - protein, 17 aa, Entamoeba invadens
FSTHGDSLVALKNTLIQ

SEQ ID NO: 2938042 - protein, 29 aa, Entamoeba invadens
FSTLEHIDCPYLFPYRNWKYTPPEVDFQG

SEQ ID NO: 2938043 - protein, 25 aa, Entamoeba invadens
FSTLFPRFADPTLAFANGSKSIAEK

SEQ ID NO: 2938044 - protein, 19 aa, Entamoeba invadens
FSTLSKFMADWKRVGDDNQ

SEQ ID NO: 2938045 - protein, 19 aa, Entamoeba invadens
FSTNCLKTNLTIKTKSKDE

SEQ ID NO: 2938046 - protein, 29 aa, Entamoeba invadens
FSTNEAFMRCLFASLQVPALFSTGVNVLQ

SEQ ID NO: 2938047 - protein, 40 aa, Entamoeba invadens
FSTNIKNLLGLTDFLARPARLPFLSLLLDLPPDVNDGTQQ

SEQ ID NO: 2938048 - protein, 18 aa, Entamoeba invadens
FSTPKLVFLFQGDALIDV

SEQ ID NO: 2938049 - protein, 25 aa, Entamoeba invadens
FSTPYVNEGFFLHGLWPQNDAHKNL

SEQ ID NO: 2938050 - protein, 18 aa, Entamoeba invadens
FSTQYGFSLTTFTIAASS

SEQ ID NO: 2938051 - protein, 24 aa, Entamoeba invadens
FSTRARSAPIISLDTDEHMEEINE

SEQ ID NO: 2938052 - protein, 17 aa, Entamoeba invadens
FSTVFKLMCVSKKCQDV

SEQ ID NO: 2938053 - protein, 27 aa, Entamoeba invadens
FSTVQIPYSFQVVRPVFQSSFSQVTCA

SEQ ID NO: 2938054 - protein, 24 aa, Entamoeba invadens
FSVECSYAGTAFRGNARTFLQETQ

SEQ ID NO: 2938055 - protein, 18 aa, Entamoeba invadens
FSVFTKEDRIAFGGKIPN

SEQ ID NO: 2938056 - protein, 19 aa, Entamoeba invadens
FSVGECLFSLEASFKFSER

SEQ ID NO: 2938057 - protein, 18 aa, Entamoeba invadens
FSVISLWQYQDQKFSYEL

SEQ ID NO: 2938058 - protein, 18 aa, Entamoeba invadens
FSVLLLMKMDHMKSAQEN

SEQ ID NO: 2938059 - protein, 22 aa, Entamoeba invadens
FSVNDTISWWVLECSDSVKEVA

SEQ ID NO: 2938060 - protein, 20 aa, Entamoeba invadens
FSVQSFEMFVWTDKMVDKLR

SEQ ID NO: 2938061 - protein, 17 aa, Entamoeba invadens
FSVSGKMLYNFIEDGVK

SEQ ID NO: 2938062 - protein, 25 aa, Entamoeba invadens
FSVSPEFYFDVSLHYRSEKNVIDAI

SEQ ID NO: 2938063 - protein, 24 aa, Entamoeba invadens
FSVYPELMRDLAMNISEKHFDYEA

SEQ ID NO: 2938064 - protein, 24 aa, Entamoeba invadens
FSYCEKLKVVFGLENVLKIDQRAF

SEQ ID NO: 2938065 - protein, 17 aa, Entamoeba invadens
FSYCKSLTSISLPDNLT

SEQ ID NO: 2938066 - protein, 21 aa, Entamoeba invadens
FSYDEFETFMTEIRKYRDMQR

SEQ ID NO: 2938067 - protein, 17 aa, Entamoeba invadens
FSYDTTHNFVFPTSITK

SEQ ID NO: 2938068 - protein, 17 aa, Entamoeba invadens
FSYEKTMYWDEVAQYEE

SEQ ID NO: 2938069 - protein, 20 aa, Entamoeba invadens
FSYHLLQEFCFPNGVNRMKF

SEQ ID NO: 2938070 - protein, 23 aa, Entamoeba invadens
FSYKNGRTGLFLFNNVTQKNLEK

SEQ ID NO: 2938071 - protein, 18 aa, Entamoeba invadens
FSYLPKKYFDNFHKLYVF

SEQ ID NO: 2938072 - protein, 26 aa, Entamoeba invadens
FSYQNQCLKEMGFLNEEENLRALTQT

SEQ ID NO: 2938073 - protein, 17 aa, Entamoeba invadens
FSYTGLPSFEVLENFTV

SEQ ID NO: 2938074 - protein, 17 aa, Entamoeba invadens
FTACCFGFLSLLHPLSW

SEQ ID NO: 2938075 - protein, 23 aa, Entamoeba invadens
FTADLNSTIALRFNKASLSQEDV

SEQ ID NO: 2938076 - protein, 24 aa, Entamoeba invadens
FTADTCYYEPFWVALFQVKNLKAV

SEQ ID NO: 2938077 - protein, 18 aa, Entamoeba invadens
FTAKILGANVKEYVRGMF

SEQ ID NO: 2938078 - protein, 20 aa, Entamoeba invadens
FTAPTLPKLIKAIMDANVVT

SEQ ID NO: 2938079 - protein, 18 aa, Entamoeba invadens
FTAQRPGIPEALKIYESH

SEQ ID NO: 2938080 - protein, 17 aa, Entamoeba invadens
FTAVFVSCILKNYTVEE

SEQ ID NO: 2938081 - protein, 30 aa, Entamoeba invadens
FTCGNCHNMCFPRTDPCIIVVVKHPTERKC

SEQ ID NO: 2938082 - protein, 25 aa, Entamoeba invadens
FTCIPRVATSIALNCFSGCLTLLSI

SEQ ID NO: 2938083 - protein, 20 aa, Entamoeba invadens
FTCNGAFWITSENLVYFHPA

SEQ ID NO: 2938084 - protein, 23 aa, Entamoeba invadens
FTCPKQYALVYSFDPLFGLGLDY

SEQ ID NO: 2938085 - protein, 18 aa, Entamoeba invadens
FTDLKIETMLKYFCDPMG

SEQ ID NO: 2938086 - protein, 19 aa, Entamoeba invadens
FTDYFKVFFSDEMKDIIIE

SEQ ID NO: 2938087 - protein, 22 aa, Entamoeba invadens
FTDYPKLGTFVIRDSNKTVAVG

SEQ ID NO: 2938088 - protein, 19 aa, Entamoeba invadens
FTEAYKYNVVPVLSKKLFP

SEQ ID NO: 2938089 - protein, 19 aa, Entamoeba invadens
FTECPKLSSLILPNTPILF

SEQ ID NO: 2938090 - protein, 18 aa, Entamoeba invadens
FTEDLEKCFGVYGHQRAI

SEQ ID NO: 2938091 - protein, 25 aa, Entamoeba invadens
FTEFPRPILRLEGLKHLDLSHNKLT

SEQ ID NO: 2938092 - protein, 19 aa, Entamoeba invadens
FTEKCVKPLKNIVTDLYKE

SEQ ID NO: 2938093 - protein, 23 aa, Entamoeba invadens
FTEKPFALNFGRVQPKCFSLVYE

SEQ ID NO: 2938094 - protein, 17 aa, Entamoeba invadens
FTEKTCDLEKYFKNMFA

SEQ ID NO: 2938095 - protein, 20 aa, Entamoeba invadens
FTEKYIEAIGLKDTAGQTAF

SEQ ID NO: 2938096 - protein, 24 aa, Entamoeba invadens
FTELNFKVILFYTANYTTADPQFA

SEQ ID NO: 2938097 - protein, 23 aa, Entamoeba invadens
FTELSRYYPLVLQYYRCDFEPVL

SEQ ID NO: 2938098 - protein, 17 aa, Entamoeba invadens
FTENWFIERDAASYNVT

SEQ ID NO: 2938099 - protein, 18 aa, Entamoeba invadens
FTEPSVMSLHEMYKTISA

SEQ ID NO: 2938100 - protein, 18 aa, Entamoeba invadens
FTESMYFERFVQQFDKYE

SEQ ID NO: 2938101 - protein, 19 aa, Entamoeba invadens
FTEVLYGMFTGCYNLAEIV

SEQ ID NO: 2938102 - protein, 23 aa, Entamoeba invadens
FTEYNIPAANDFAIFNLLSTGKR

SEQ ID NO: 2938103 - protein, 21 aa, Entamoeba invadens
FTFEDKAAFFVSETGFNDFSI

SEQ ID NO: 2938104 - protein, 17 aa, Entamoeba invadens
FTFEKVITWFQDVMEHN

SEQ ID NO: 2938105 - protein, 27 aa, Entamoeba invadens
FTFFGIKIGFCYQDGFVVGFMINVKGM

SEQ ID NO: 2938106 - protein, 18 aa, Entamoeba invadens
FTFIAVRFTMAGLIEDEE

SEQ ID NO: 2938107 - protein, 19 aa, Entamoeba invadens
FTFIYQWLLLLFKREFDSK

SEQ ID NO: 2938108 - protein, 22 aa, Entamoeba invadens
FTFKGVHVAAGVLKEYLRTLDE

SEQ ID NO: 2938109 - protein, 27 aa, Entamoeba invadens
FTFKKGPFSYCKKWVPNRGEACGIKLN

SEQ ID NO: 2938110 - protein, 30 aa, Entamoeba invadens
FTFLKPSIIFNIRFYFEYAVPTQSEHLIGY

SEQ ID NO: 2938111 - protein, 26 aa, Entamoeba invadens
FTFRVKRSMKTNSFFTVKDKKFRLKI

SEQ ID NO: 2938112 - protein, 17 aa, Entamoeba invadens
FTFTLRPDFIGKVLDGI

SEQ ID NO: 2938113 - protein, 24 aa, Entamoeba invadens
FTGKSEVIKIMFDVITDLVSLEEN

SEQ ID NO: 2938114 - protein, 19 aa, Entamoeba invadens
FTGKSQYALLYKYSEGKAN

SEQ ID NO: 2938115 - protein, 20 aa, Entamoeba invadens
FTGNVKITFPDGRVMTEKNI

SEQ ID NO: 2938116 - protein, 17 aa, Entamoeba invadens
FTGVFGYPLQSITTKKK

SEQ ID NO: 2938117 - protein, 17 aa, Entamoeba invadens
FTHFVVYSIKVELTLHM

SEQ ID NO: 2938118 - protein, 19 aa, Entamoeba invadens
FTHHKFLECFCIVTDKPFE

SEQ ID NO: 2938119 - protein, 18 aa, Entamoeba invadens
FTHKFPVSSFESFYNTYL

SEQ ID NO: 2938120 - protein, 18 aa, Entamoeba invadens
FTHLRVSNIFINTDGKVK

SEQ ID NO: 2938121 - protein, 23 aa, Entamoeba invadens
FTHTRSVLLFNIENFIFPNTFKN

SEQ ID NO: 2938122 - protein, 18 aa, Entamoeba invadens
FTHVIPLLQYTIHYNYSL

SEQ ID NO: 2938123 - protein, 21 aa, Entamoeba invadens
FTIKCSGVYPVTYNGFVSVID

SEQ ID NO: 2938124 - protein, 24 aa, Entamoeba invadens
FTINKIKVTFIFNQFNICAIKHFT

SEQ ID NO: 2938125 - protein, 18 aa, Entamoeba invadens
FTIPSKIVHFGFFYLSEC

SEQ ID NO: 2938126 - protein, 27 aa, Entamoeba invadens
FTIQYALSIATVWLFCYEMELNDIPPY

SEQ ID NO: 2938127 - protein, 19 aa, Entamoeba invadens
FTITLNLLVDLLSEFRYVL

SEQ ID NO: 2938128 - protein, 25 aa, Entamoeba invadens
FTKEMCFRVVFKLVDTDCKGVLTKD

SEQ ID NO: 2938129 - protein, 17 aa, Entamoeba invadens
FTKENFPHLKILDLQDN

SEQ ID NO: 2938130 - protein, 22 aa, Entamoeba invadens
FTKFGSEFELTITRDILGKCCL

SEQ ID NO: 2938131 - protein, 22 aa, Entamoeba invadens
FTKIKEVLFDLDITKTKVQPSL

SEQ ID NO: 2938132 - protein, 17 aa, Entamoeba invadens
FTKKDFEIFKYRKTVII

SEQ ID NO: 2938133 - protein, 19 aa, Entamoeba invadens
FTKKNGIVMNNCFDEMPSV

SEQ ID NO: 2938134 - protein, 24 aa, Entamoeba invadens
FTKKRKGLNLFAFKETGRLINQLQ

SEQ ID NO: 2938135 - protein, 25 aa, Entamoeba invadens
FTKLARFLRILIRYQSFKRTEGLVE

SEQ ID NO: 2938136 - protein, 23 aa, Entamoeba invadens
FTKMELTGNFALNLKVLVIYLTL

SEQ ID NO: 2938137 - protein, 19 aa, Entamoeba invadens
FTKMPKWVHNGIINNNKYV

SEQ ID NO: 2938138 - protein, 17 aa, Entamoeba invadens
FTKQFSLDPNVKKMYGE

SEQ ID NO: 2938139 - protein, 19 aa, Entamoeba invadens
FTKRKDVLKEIKIAATSKL

SEQ ID NO: 2938140 - protein, 25 aa, Entamoeba invadens
FTKSFNMKREIVFNVIQNDEMREMM

SEQ ID NO: 2938141 - protein, 18 aa, Entamoeba invadens
FTKTCPLIITGSSELIHQ

SEQ ID NO: 2938142 - protein, 20 aa, Entamoeba invadens
FTKVNAEVLISFITPFVTPQ

SEQ ID NO: 2938143 - protein, 18 aa, Entamoeba invadens
FTKYAETVFSVFTDMSTP

SEQ ID NO: 2938144 - protein, 18 aa, Entamoeba invadens
FTLCFGKKRVFLLIIEKE

SEQ ID NO: 2938145 - protein, 25 aa, Entamoeba invadens
FTLDLRKATTLEVISITRFGGKLSI

SEQ ID NO: 2938146 - protein, 17 aa, Entamoeba invadens
FTLKRNVLLNVVVVALT

SEQ ID NO: 2938147 - protein, 27 aa, Entamoeba invadens
FTLNGEIYGRCAIDFKTYGAVVTVSEI

SEQ ID NO: 2938148 - protein, 21 aa, Entamoeba invadens
FTLNTGFCIGYGCEKGVVIDD

SEQ ID NO: 2938149 - protein, 25 aa, Entamoeba invadens
FTLPCGEAICEECIDSLALGGEQFD

SEQ ID NO: 2938150 - protein, 25 aa, Entamoeba invadens
FTLPCTAPFTGKECSFVMGSGLIFQ

SEQ ID NO: 2938151 - protein, 28 aa, Entamoeba invadens
FTLPCVLPEFGERLIVGLLCVEKKSTFV

SEQ ID NO: 2938152 - protein, 18 aa, Entamoeba invadens
FTLPKIYPMDVHKNDPHN

SEQ ID NO: 2938153 - protein, 20 aa, Entamoeba invadens
FTLPPSFPPSLIVPNKPFKS

SEQ ID NO: 2938154 - protein, 17 aa, Entamoeba invadens
FTLREVRVLKMLNHPNI

SEQ ID NO: 2938155 - protein, 24 aa, Entamoeba invadens
FTLRFAEAYLKSGNKDLARKRALM

SEQ ID NO: 2938156 - protein, 23 aa, Entamoeba invadens
FTLRNSFNIQPTRFFQNSTNENQ

SEQ ID NO: 2938157 - protein, 26 aa, Entamoeba invadens
FTLVDGHKWYMGCGFEGLENDLKGRD

SEQ ID NO: 2938158 - protein, 29 aa, Entamoeba invadens
FTMDMFIDLCILLGCDYCETIKGIGPVTA

SEQ ID NO: 2938159 - protein, 17 aa, Entamoeba invadens
FTMDMKFGNRIGRISVS

SEQ ID NO: 2938160 - protein, 24 aa, Entamoeba invadens
FTMGKWILNFSILEFIVSHQEELQ

SEQ ID NO: 2938161 - protein, 23 aa, Entamoeba invadens
FTMKEVVNPIGYLLEGVCYHPIT

SEQ ID NO: 2938162 - protein, 18 aa, Entamoeba invadens
FTMMLEVMHSDWWFPFYS

SEQ ID NO: 2938163 - protein, 23 aa, Entamoeba invadens
FTMSAAPRFGFVTIRTSHGKFLS

SEQ ID NO: 2938164 - protein, 26 aa, Entamoeba invadens
FTNCIKLSALTLPNFNGKLTFAISKY

SEQ ID NO: 2938165 - protein, 20 aa, Entamoeba invadens
FTNIFLKFKVEKLMRIVLMI

SEQ ID NO: 2938166 - protein, 17 aa, Entamoeba invadens
FTNKIFYSSQVQVPPIH

SEQ ID NO: 2938167 - protein, 20 aa, Entamoeba invadens
FTNKRCCGGNSGIAIEGQPT

SEQ ID NO: 2938168 - protein, 19 aa, Entamoeba invadens
FTNMMKFSFKSNSFQPVTS

SEQ ID NO: 2938169 - protein, 24 aa, Entamoeba invadens
FTPAGKPVFCRYGNVLLQSSTTAT

SEQ ID NO: 2938170 - protein, 29 aa, Entamoeba invadens
FTPCQHKYCKSCVLSLCKERVNSLQEIFC

SEQ ID NO: 2938171 - protein, 19 aa, Entamoeba invadens
FTPDFQWYCSSVCRILLLN

SEQ ID NO: 2938172 - protein, 23 aa, Entamoeba invadens
FTPEELKAAFSDFVKIIDASIQH

SEQ ID NO: 2938173 - protein, 21 aa, Entamoeba invadens
FTPFFKVYFLYISHYNSTVEI

SEQ ID NO: 2938174 - protein, 18 aa, Entamoeba invadens
FTPFTAFLTENWKKQKYF

SEQ ID NO: 2938175 - protein, 25 aa, Entamoeba invadens
FTPHFAHVMGGKGSKMFKKFEELCI

SEQ ID NO: 2938176 - protein, 23 aa, Entamoeba invadens
FTPKRIYPYIFYIIITDCLFNIS

SEQ ID NO: 2938177 - protein, 17 aa, Entamoeba invadens
FTPPIYHDIFYNKRESI

SEQ ID NO: 2938178 - protein, 19 aa, Entamoeba invadens
FTPPKVRIHKTVQFNSEKI

SEQ ID NO: 2938179 - protein, 18 aa, Entamoeba invadens
FTPQCILCSRGFYPTTSG

SEQ ID NO: 2938180 - protein, 19 aa, Entamoeba invadens
FTPSRRRAGFYVYTQGIYW

SEQ ID NO: 2938181 - protein, 18 aa, Entamoeba invadens
FTPTHTFFMRAHPTVTAD

SEQ ID NO: 2938182 - protein, 24 aa, Entamoeba invadens
FTQHFKGEFLFVFIEKCNTAKFDS

SEQ ID NO: 2938183 - protein, 22 aa, Entamoeba invadens
FTQKALACLVQLAKVSDDKSIE

SEQ ID NO: 2938184 - protein, 21 aa, Entamoeba invadens
FTQLKSVFIDFTFNEDYSSYL

SEQ ID NO: 2938185 - protein, 28 aa, Entamoeba invadens
FTQNLLIDICMEFGYFFESCLSRKSKKT

SEQ ID NO: 2938186 - protein, 17 aa, Entamoeba invadens
FTQSDSFVFGKIFREGI

SEQ ID NO: 2938187 - protein, 26 aa, Entamoeba invadens
FTQSFNRKNLRYCVKPKTKNVIDDIE

SEQ ID NO: 2938188 - protein, 17 aa, Entamoeba invadens
FTQTLIFNSFIDNYIDN

SEQ ID NO: 2938189 - protein, 18 aa, Entamoeba invadens
FTQVEFISLIPPSPQSND

SEQ ID NO: 2938190 - protein, 25 aa, Entamoeba invadens
FTRELPGMMFCNSLARDMLSVYKKS

SEQ ID NO: 2938191 - protein, 21 aa, Entamoeba invadens
FTRKCPVVYLTLANVLNLMDK

SEQ ID NO: 2938192 - protein, 23 aa, Entamoeba invadens
FTRKDVKKHLAIVFENGKKVGKI

SEQ ID NO: 2938193 - protein, 17 aa, Entamoeba invadens
FTRLSTSLLRTQFSTLF

SEQ ID NO: 2938194 - protein, 29 aa, Entamoeba invadens
FTRLYGEYSHLCLLPYLRAVTKDIIQVLM

SEQ ID NO: 2938195 - protein, 21 aa, Entamoeba invadens
FTRSVALMSMVGYILGLGDRH

SEQ ID NO: 2938196 - protein, 22 aa, Entamoeba invadens
FTRSVALMSMVGYILGLGDRHP

SEQ ID NO: 2938197 - protein, 18 aa, Entamoeba invadens
FTSFAYKDYQMFHSLCFT

SEQ ID NO: 2938198 - protein, 24 aa, Entamoeba invadens
FTSIVKCWKMISKVAFNNKKYTNE

SEQ ID NO: 2938199 - protein, 18 aa, Entamoeba invadens
FTSLQPFLEYLFAVANKT

SEQ ID NO: 2938200 - protein, 25 aa, Entamoeba invadens
FTSMLPNRFAVMDFMCLFSTKTDGF

SEQ ID NO: 2938201 - protein, 18 aa, Entamoeba invadens
FTSNKLKPLIGIPLEPKF

SEQ ID NO: 2938202 - protein, 32 aa, Entamoeba invadens
FTSNKLKPLIGIPLEPKFNVLQSEKFVGVTDF

SEQ ID NO: 2938203 - protein, 22 aa, Entamoeba invadens
FTSRFPFLKKLFFRQVNTSIQA

SEQ ID NO: 2938204 - protein, 18 aa, Entamoeba invadens
FTSVICFLTKLMKQKKDM

SEQ ID NO: 2938205 - protein, 30 aa, Entamoeba invadens
FTSYLCNELLCLLTRGGFKVKELILEVVVK

SEQ ID NO: 2938206 - protein, 23 aa, Entamoeba invadens
FTTAIRPTSCPELQDMQTIASVI

SEQ ID NO: 2938207 - protein, 27 aa, Entamoeba invadens
FTTKLWVSFFRYFMAKLAETYKQDQKQ

SEQ ID NO: 2938208 - protein, 18 aa, Entamoeba invadens
FTTLIKQKVNGVGLGVDL

SEQ ID NO: 2938209 - protein, 17 aa, Entamoeba invadens
FTTLPVVNEITPFYDIL

SEQ ID NO: 2938210 - protein, 18 aa, Entamoeba invadens
FTTLYRGECYLTHNYANT

SEQ ID NO: 2938211 - protein, 23 aa, Entamoeba invadens
FTTPDRFVAYHAGTKGAAIGNNK

SEQ ID NO: 2938212 - protein, 23 aa, Entamoeba invadens
FTTPECFLAYLLPQSNNKESFET

SEQ ID NO: 2938213 - protein, 18 aa, Entamoeba invadens
FTTQFCVQVYEIKTVPTK

SEQ ID NO: 2938214 - protein, 23 aa, Entamoeba invadens
FTTSEMIEMIFGKDNMTNPICTT

SEQ ID NO: 2938215 - protein, 24 aa, Entamoeba invadens
FTTSPDVLFIFCSNEFKKKRSFYD

SEQ ID NO: 2938216 - protein, 25 aa, Entamoeba invadens
FTVEIIKATGLPILGWGFPDPYACV

SEQ ID NO: 2938217 - protein, 23 aa, Entamoeba invadens
FTVELPPHRKAIIENVFSLQSFN

SEQ ID NO: 2938218 - protein, 17 aa, Entamoeba invadens
FTVGSMPSEYESFWANR

SEQ ID NO: 2938219 - protein, 19 aa, Entamoeba invadens
FTVKICDFGFAEVLTDDVR

SEQ ID NO: 2938220 - protein, 23 aa, Entamoeba invadens
FTVLKRVRMVSEFQMTDDNLLSL

SEQ ID NO: 2938221 - protein, 18 aa, Entamoeba invadens
FTVLSGLGVYKSQRGYTH

SEQ ID NO: 2938222 - protein, 20 aa, Entamoeba invadens
FTVNLCRTDVLKTWTCFDEI

SEQ ID NO: 2938223 - protein, 17 aa, Entamoeba invadens
FTVSIGEEMNGWDAFVK

SEQ ID NO: 2938224 - protein, 20 aa, Entamoeba invadens
FTYFYCIHNKLLTNIYNHLS

SEQ ID NO: 2938225 - protein, 18 aa, Entamoeba invadens
FTYLIQWMDEVLKDVVDK

SEQ ID NO: 2938226 - protein, 17 aa, Entamoeba invadens
FTYLYPRLDINVSTKLN

SEQ ID NO: 2938227 - protein, 18 aa, Entamoeba invadens
FTYMEAFIFYQIRPSEFF

SEQ ID NO: 2938228 - protein, 19 aa, Entamoeba invadens
FTYMPQWMMDYLKFNPGDR

SEQ ID NO: 2938229 - protein, 19 aa, Entamoeba invadens
FTYNHFNFMPTQFEYVPRS

SEQ ID NO: 2938230 - protein, 25 aa, Entamoeba invadens
FTYPNRSPLHYSFDLKSPVSDKIPP

SEQ ID NO: 2938231 - protein, 21 aa, Entamoeba invadens
FTYQLCRGLCYLHSMNICHRD

SEQ ID NO: 2938232 - protein, 34 aa, Entamoeba invadens
FVAFKKEGGILFAFGYDSFFPKTDLAIMKQIDAS

SEQ ID NO: 2938233 - protein, 23 aa, Entamoeba invadens
FVANCKYLKTVFVSNNRGITNTV

SEQ ID NO: 2938234 - protein, 18 aa, Entamoeba invadens
FVAQMFYDYSTVVEGTEA

SEQ ID NO: 2938235 - protein, 21 aa, Entamoeba invadens
FVAQPMFKNGRNYLDKRSKAI

SEQ ID NO: 2938236 - protein, 18 aa, Entamoeba invadens
FVCALQWLDYLINKNGGI

SEQ ID NO: 2938237 - protein, 21 aa, Entamoeba invadens
FVCATKLERVVLPLSITGTPS

SEQ ID NO: 2938238 - protein, 17 aa, Entamoeba invadens
FVCCGRQSPYTFDKAPL

SEQ ID NO: 2938239 - protein, 19 aa, Entamoeba invadens
FVCLNICLCECIQRIDNNL

SEQ ID NO: 2938240 - protein, 24 aa, Entamoeba invadens
FVCNLKPSKLRGVPSEGMILAATS

SEQ ID NO: 2938241 - protein, 20 aa, Entamoeba invadens
FVCPCCHKESTIFPPTNGGA

SEQ ID NO: 2938242 - protein, 19 aa, Entamoeba invadens
FVCQTCSGIHREFGHRVKS

SEQ ID NO: 2938243 - protein, 17 aa, Entamoeba invadens
FVCSLFETKDKTLMKFL

SEQ ID NO: 2938244 - protein, 25 aa, Entamoeba invadens
FVDAALSTIEWDYMDYAWLRLNKYY

SEQ ID NO: 2938245 - protein, 23 aa, Entamoeba invadens
FVDAEKYGKCVLDALRTKKPILD

SEQ ID NO: 2938246 - protein, 17 aa, Entamoeba invadens
FVDEGCQKFYDFFNSGQ

SEQ ID NO: 2938247 - protein, 17 aa, Entamoeba invadens
FVDFCFANFSEIEGVMV

SEQ ID NO: 2938248 - protein, 23 aa, Entamoeba invadens
FVDGWKCDHCGQMCQAKLSTSLH

SEQ ID NO: 2938249 - protein, 19 aa, Entamoeba invadens
FVDHMRMCYTKIMCGEVWC

SEQ ID NO: 2938250 - protein, 24 aa, Entamoeba invadens
FVDILNRYICLFKYGQTDLKKYIV

SEQ ID NO: 2938251 - protein, 27 aa, Entamoeba invadens
FVDISVKAGECFALLKMMEKKSPELQE

SEQ ID NO: 2938252 - protein, 34 aa, Entamoeba invadens
FVDKPDGYFSWEIGKFVHRHFCKNGYDFEQIFRF

SEQ ID NO: 2938253 - protein, 21 aa, Entamoeba invadens
FVDLILVLFVKWERSPDDWIM

SEQ ID NO: 2938254 - protein, 17 aa, Entamoeba invadens
FVDNRFEGMTIVGHIKD

SEQ ID NO: 2938255 - protein, 19 aa, Entamoeba invadens
FVDVIEKFIAKPSEEEMRL

SEQ ID NO: 2938256 - protein, 22 aa, Entamoeba invadens
FVEAIKKFKGLSKFEMRDTIAW

SEQ ID NO: 2938257 - protein, 24 aa, Entamoeba invadens
FVEARLNFLPTFKINQNGEYNDKR

SEQ ID NO: 2938258 - protein, 17 aa, Entamoeba invadens
FVECQNLNFKNLISTLN

SEQ ID NO: 2938259 - protein, 46 aa, Entamoeba invadens
FVEDERRLNVAITRAKRALCVVGNIKTLRQVKVWEDYINWLTKNRL

SEQ ID NO: 2938260 - protein, 26 aa, Entamoeba invadens
FVEGDTFKLGVKMLMATAYLPEDVIV

SEQ ID NO: 2938261 - protein, 20 aa, Entamoeba invadens
FVEGSSFYKTVMENVPQEIV

SEQ ID NO: 2938262 - protein, 18 aa, Entamoeba invadens
FVEGYRGTIGVEFYPYTL

SEQ ID NO: 2938263 - protein, 17 aa, Entamoeba invadens
FVEKFKLLHWFDMDHII

SEQ ID NO: 2938264 - protein, 17 aa, Entamoeba invadens
FVEKGNETFKIVIQIGR

SEQ ID NO: 2938265 - protein, 22 aa, Entamoeba invadens
FVEKKNALTLKWMCKKEDVSYV

SEQ ID NO: 2938266 - protein, 24 aa, Entamoeba invadens
FVEKLFRDRFAFIVVTESTTNAAI

SEQ ID NO: 2938267 - protein, 24 aa, Entamoeba invadens
FVEKVKEFCLGFFVKQESLDMKTL

SEQ ID NO: 2938268 - protein, 18 aa, Entamoeba invadens
FVELLQLLLVRGASVLVS

SEQ ID NO: 2938269 - protein, 23 aa, Entamoeba invadens
FVENIACDFLKVMLSQMRDGLPK

SEQ ID NO: 2938270 - protein, 26 aa, Entamoeba invadens
FVERVFKLVKTYLLKNGKLVKSAPAQ

SEQ ID NO: 2938271 - protein, 21 aa, Entamoeba invadens
FVETNMKFNIILPSENKIEKE

SEQ ID NO: 2938272 - protein, 17 aa, Entamoeba invadens
FVEWEGDALRLSVTKGG

SEQ ID NO: 2938273 - protein, 22 aa, Entamoeba invadens
FVEYPPQYGARMVRCSQILTYL

SEQ ID NO: 2938274 - protein, 26 aa, Entamoeba invadens
FVFDRYDIKDGYYLIVYKASSSLNKD

SEQ ID NO: 2938275 - protein, 21 aa, Entamoeba invadens
FVFDTCLEMGFFFNSKLSKKS

SEQ ID NO: 2938276 - protein, 17 aa, Entamoeba invadens
FVFEKRIRREWFEEDVS

SEQ ID NO: 2938277 - protein, 18 aa, Entamoeba invadens
FVFKEGRHTNTYFIKKET

SEQ ID NO: 2938278 - protein, 29 aa, Entamoeba invadens
FVFLFKHFPLLLSFSFRLSQIDTIPFTLV

SEQ ID NO: 2938279 - protein, 28 aa, Entamoeba invadens
FVFLLCTRAGGFGINLSEADTVIIYDSD

SEQ ID NO: 2938280 - protein, 17 aa, Entamoeba invadens
FVFLSFKKFAVVISKDL

SEQ ID NO: 2938281 - protein, 23 aa, Entamoeba invadens
FVFMPVCLQSLVYTLESLLNIAH

SEQ ID NO: 2938282 - protein, 20 aa, Entamoeba invadens
FVFNGVQTIVTWERKPSEEA

SEQ ID NO: 2938283 - protein, 19 aa, Entamoeba invadens
FVFPGNFFMIGKRCFQNCE

SEQ ID NO: 2938284 - protein, 19 aa, Entamoeba invadens
FVFSLCVNDILAGATAEET

SEQ ID NO: 2938285 - protein, 17 aa, Entamoeba invadens
FVFYSVMELYKCSVLDV

SEQ ID NO: 2938286 - protein, 19 aa, Entamoeba invadens
FVGCLSVAMIIEIRKGLLS

SEQ ID NO: 2938287 - protein, 21 aa, Entamoeba invadens
FVGDHRRLNVSLTRAKYGLVI

SEQ ID NO: 2938288 - protein, 19 aa, Entamoeba invadens
FVGERCFENCYSLKRAWVP

SEQ ID NO: 2938289 - protein, 23 aa, Entamoeba invadens
FVGESCFQGCIALTKLVIPASVK

SEQ ID NO: 2938290 - protein, 18 aa, Entamoeba invadens
FVGGGPLSMTFDYASALM

SEQ ID NO: 2938291 - protein, 24 aa, Entamoeba invadens
FVGKRGPLLVVLFLNDVELRNLEK

SEQ ID NO: 2938292 - protein, 25 aa, Entamoeba invadens
FVGKSCFSGCIWIKSVVLNRKVSLV

SEQ ID NO: 2938293 - protein, 19 aa, Entamoeba invadens
FVGMHFLTFLSLSNCVMLS

SEQ ID NO: 2938294 - protein, 17 aa, Entamoeba invadens
FVGNDVVVVVFKEMNDK

SEQ ID NO: 2938295 - protein, 18 aa, Entamoeba invadens
FVGNSAFIKCQNLRKVIL

SEQ ID NO: 2938296 - protein, 25 aa, Entamoeba invadens
FVGQTKIRLGFIVLSLLLSNYSVIY

SEQ ID NO: 2938297 - protein, 19 aa, Entamoeba invadens
FVGRRLCANTGKSTMVSVS

SEQ ID NO: 2938298 - protein, 17 aa, Entamoeba invadens
FVGTYGYPLRLAILKSG

SEQ ID NO: 2938299 - protein, 23 aa, Entamoeba invadens
FVGVCGKFVFLKSLAQQRIAIAI

SEQ ID NO: 2938300 - protein, 35 aa, Entamoeba invadens
FVGYQLDCPRVFPSENYFGASIPKCQYTAFIAKGY

SEQ ID NO: 2938301 - protein, 34 aa, Entamoeba invadens
FVGYVVSFATNFCERRRGTVFVGYTADDVKNYEK

SEQ ID NO: 2938302 - protein, 18 aa, Entamoeba invadens
FVHCKLSSFHVFVNSLDF

SEQ ID NO: 2938303 - protein, 18 aa, Entamoeba invadens
FVHYIRPFLVEGLSFKTD

SEQ ID NO: 2938304 - protein, 24 aa, Entamoeba invadens
FVHYLPSFWHFHVHFCSIYSPLFK

SEQ ID NO: 2938305 - protein, 18 aa, Entamoeba invadens
FVIFISFKESQVIYRINY

SEQ ID NO: 2938306 - protein, 27 aa, Entamoeba invadens
FVIKKGEPCSVVIQLLFHHHATMGLTG

SEQ ID NO: 2938307 - protein, 24 aa, Entamoeba invadens
FVIKNCKKLNILCEKMWYLELDTN

SEQ ID NO: 2938308 - protein, 19 aa, Entamoeba invadens
FVILISAIEQCMRGKVIEE

SEQ ID NO: 2938309 - protein, 21 aa, Entamoeba invadens
FVINLRPKFDANRFAIPTIIR

SEQ ID NO: 2938310 - protein, 17 aa, Entamoeba invadens
FVIRNWVSVNLADSTDT

SEQ ID NO: 2938311 - protein, 18 aa, Entamoeba invadens
FVISRPIHYNVWSTRGMT

SEQ ID NO: 2938312 - protein, 18 aa, Entamoeba invadens
FVISSGKEGCNWRQMGER

SEQ ID NO: 2938313 - protein, 18 aa, Entamoeba invadens
FVIVYAINSRTSFIEANN

SEQ ID NO: 2938314 - protein, 19 aa, Entamoeba invadens
FVKDCIDINHILETYAQKY

SEQ ID NO: 2938315 - protein, 25 aa, Entamoeba invadens
FVKDVCIPEDIVGRYLPKLNGKVRD

SEQ ID NO: 2938316 - protein, 23 aa, Entamoeba invadens
FVKEGFMLNGFWPQIRVNAKLRC

SEQ ID NO: 2938317 - protein, 22 aa, Entamoeba invadens
FVKELGKLFGISKIWYFIGKVI

SEQ ID NO: 2938318 - protein, 18 aa, Entamoeba invadens
FVKFDGINRLVYLAEHSE

SEQ ID NO: 2938319 - protein, 21 aa, Entamoeba invadens
FVKGMNWPKVDTSSWCNPFCV

SEQ ID NO: 2938320 - protein, 18 aa, Entamoeba invadens
FVKGRHQLVELLKRIKAE

SEQ ID NO: 2938321 - protein, 19 aa, Entamoeba invadens
FVKKFIFGRLKAMTESVQF

SEQ ID NO: 2938322 - protein, 24 aa, Entamoeba invadens
FVKQGACIAMGMVYLQTSLKENGK

SEQ ID NO: 2938323 - protein, 17 aa, Entamoeba invadens
FVKRPKHSVPLKSLLFS

SEQ ID NO: 2938324 - protein, 17 aa, Entamoeba invadens
FVKRSCISKEIIYKEQF

SEQ ID NO: 2938325 - protein, 20 aa, Entamoeba invadens
FVKSIYLDEVIEYLKVHEPK

SEQ ID NO: 2938326 - protein, 19 aa, Entamoeba invadens
FVKYDAEVFGKIKGVTDRD

SEQ ID NO: 2938327 - protein, 22 aa, Entamoeba invadens
FVKYNCVRHILDLLKASNKSPP

SEQ ID NO: 2938328 - protein, 25 aa, Entamoeba invadens
FVLADFLTEYSFEFTTKVVNGKKKT

SEQ ID NO: 2938329 - protein, 18 aa, Entamoeba invadens
FVLCESEIHLFGVMGKFT

SEQ ID NO: 2938330 - protein, 24 aa, Entamoeba invadens
FVLFPEHIVKIIAMQFVNTLEALS

SEQ ID NO: 2938331 - protein, 17 aa, Entamoeba invadens
FVLICWAGEGIKKPKLR

SEQ ID NO: 2938332 - protein, 18 aa, Entamoeba invadens
FVLKSVSLQPSYLLCATQ

SEQ ID NO: 2938333 - protein, 24 aa, Entamoeba invadens
FVLLRRSHMNWAKYDKVESSLIKK

SEQ ID NO: 2938334 - protein, 20 aa, Entamoeba invadens
FVLNCPWTGAELEKQLPGSM

SEQ ID NO: 2938335 - protein, 27 aa, Entamoeba invadens
FVLPPLKKKRSVLVSSDLLEIDVEKNL

SEQ ID NO: 2938336 - protein, 17 aa, Entamoeba invadens
FVLPSTVTREMIFESSQ

SEQ ID NO: 2938337 - protein, 17 aa, Entamoeba invadens
FVLRNCVCSPTKSICLI

SEQ ID NO: 2938338 - protein, 21 aa, Entamoeba invadens
FVLSLGDIFLVKRVVEELTTI

SEQ ID NO: 2938339 - protein, 20 aa, Entamoeba invadens
FVLTFKLGSASLELLPYNAM

SEQ ID NO: 2938340 - protein, 19 aa, Entamoeba invadens
FVMKDLYAFYSGMANPLIY

SEQ ID NO: 2938341 - protein, 21 aa, Entamoeba invadens
FVMLKYRKWQMTGRKAQNLNH

SEQ ID NO: 2938342 - protein, 20 aa, Entamoeba invadens
FVMNLLKEFSEKTGEVQTSL

SEQ ID NO: 2938343 - protein, 23 aa, Entamoeba invadens
FVNCKSLKSLAFPNLCKNAPGTF

SEQ ID NO: 2938344 - protein, 23 aa, Entamoeba invadens
FVNDRSFHMFQFYSNGIHVLRGW

SEQ ID NO: 2938345 - protein, 18 aa, Entamoeba invadens
FVNEWVLALNYCSVLKKK

SEQ ID NO: 2938346 - protein, 25 aa, Entamoeba invadens
FVNHLSRPAFRRQLLSDEEQLLKAL

SEQ ID NO: 2938347 - protein, 19 aa, Entamoeba invadens
FVNKKCFDTLLMVHINPLF

SEQ ID NO: 2938348 - protein, 26 aa, Entamoeba invadens
FVNKKCKTAIEMLRINPGLASEGIKK

SEQ ID NO: 2938349 - protein, 18 aa, Entamoeba invadens
FVNLLRYAKTYDIDTEQY

SEQ ID NO: 2938350 - protein, 17 aa, Entamoeba invadens
FVNPKIICLNIELELKK

SEQ ID NO: 2938351 - protein, 18 aa, Entamoeba invadens
FVNRTDIAIVLITQSIAD

SEQ ID NO: 2938352 - protein, 18 aa, Entamoeba invadens
FVNTGLSCIVDAFNIIFK

SEQ ID NO: 2938353 - protein, 17 aa, Entamoeba invadens
FVNVVLVCRKFENTLNK

SEQ ID NO: 2938354 - protein, 18 aa, Entamoeba invadens
FVPAFSIGIVGNYMKHNY

SEQ ID NO: 2938355 - protein, 18 aa, Entamoeba invadens
FVPDAPKSEQWVVAPTHR

SEQ ID NO: 2938356 - protein, 18 aa, Entamoeba invadens
FVPENVIRKTDNCKFSPT

SEQ ID NO: 2938357 - protein, 17 aa, Entamoeba invadens
FVPGNMVSCLDFVESVF

SEQ ID NO: 2938358 - protein, 19 aa, Entamoeba invadens
FVPKDCPIKEYNLLDEAQK

SEQ ID NO: 2938359 - protein, 20 aa, Entamoeba invadens
FVPMKGAWFIDKYLAKFCEL

SEQ ID NO: 2938360 - protein, 22 aa, Entamoeba invadens
FVPPCFFNVLLPLLLPPNPPAV

SEQ ID NO: 2938361 - protein, 19 aa, Entamoeba invadens
FVPQQFYAPFTMPQFSPLR

SEQ ID NO: 2938362 - protein, 26 aa, Entamoeba invadens
FVPSVCVECGVAGVKGLIIITAGFAE

SEQ ID NO: 2938363 - protein, 28 aa, Entamoeba invadens
FVQCVDCNQKLCKKCFENTHANLWHSIR

SEQ ID NO: 2938364 - protein, 17 aa, Entamoeba invadens
FVQELLEKFLYVANDDF

SEQ ID NO: 2938365 - protein, 25 aa, Entamoeba invadens
FVQLKYPVCEIINAVLSYLNGTNYT

SEQ ID NO: 2938366 - protein, 25 aa, Entamoeba invadens
FVRELPGMLFCNSLAKDMLTTYRSR

SEQ ID NO: 2938367 - protein, 25 aa, Entamoeba invadens
FVRFNEYSFQFGHCGSVSCDKNSCR

SEQ ID NO: 2938368 - protein, 40 aa, Entamoeba invadens
FVRKLPYMAEWSVVCDFTLLKILATCGIDLKLIMENKVIG

SEQ ID NO: 2938369 - protein, 21 aa, Entamoeba invadens
FVRNEVRGVSYFFDDNVLDVF

SEQ ID NO: 2938370 - protein, 18 aa, Entamoeba invadens
FVRVQAMLYYTNMAGGQA

SEQ ID NO: 2938371 - protein, 17 aa, Entamoeba invadens
FVSCSRGPSMLKVQTFL

SEQ ID NO: 2938372 - protein, 32 aa, Entamoeba invadens
FVSDYRRLNVSLTRARLGMYIVGNVETLAHNR

SEQ ID NO: 2938373 - protein, 27 aa, Entamoeba invadens
FVSEQRFQIRLSREVEFQRGKKFTVAK

SEQ ID NO: 2938374 - protein, 24 aa, Entamoeba invadens
FVSFRYNNVYSRFVVVPEDEFNCN

SEQ ID NO: 2938375 - protein, 23 aa, Entamoeba invadens
FVSGCSLLTSLVCENGTSFDLKN

SEQ ID NO: 2938376 - protein, 25 aa, Entamoeba invadens
FVSGCSVLTSLVCENGTSFDLKKIT

SEQ ID NO: 2938377 - protein, 21 aa, Entamoeba invadens
FVSGKFPMYYNISMENSVNIF

SEQ ID NO: 2938378 - protein, 17 aa, Entamoeba invadens
FVSKLCKKTFDTKETTI

SEQ ID NO: 2938379 - protein, 17 aa, Entamoeba invadens
FVSKRFHMMITKTKEVM

SEQ ID NO: 2938380 - protein, 24 aa, Entamoeba invadens
FVSKRVAKLYSHLPPGETYTVRFK

SEQ ID NO: 2938381 - protein, 19 aa, Entamoeba invadens
FVSLYPHKVAFYTFFPYVD

SEQ ID NO: 2938382 - protein, 24 aa, Entamoeba invadens
FVSMPRVSQIGVMDLSLKRIKSFP

SEQ ID NO: 2938383 - protein, 18 aa, Entamoeba invadens
FVSNCLGIKALGQYKGSL

SEQ ID NO: 2938384 - protein, 17 aa, Entamoeba invadens
FVSQAALKKEEDELNGF

SEQ ID NO: 2938385 - protein, 17 aa, Entamoeba invadens
FVSRGASYFPFKGVSLA

SEQ ID NO: 2938386 - protein, 17 aa, Entamoeba invadens
FVSRVCFISHKGTYLSV

SEQ ID NO: 2938387 - protein, 19 aa, Entamoeba invadens
FVSSEICGVVCSVEKKTIG

SEQ ID NO: 2938388 - protein, 24 aa, Entamoeba invadens
FVSSIDFSYCKKLKEMVIEKMPQN

SEQ ID NO: 2938389 - protein, 20 aa, Entamoeba invadens
FVSTLVRFLNGARCWENSIY

SEQ ID NO: 2938390 - protein, 27 aa, Entamoeba invadens
FVSTYFKVERMLLGFTIAEPNFCALEL

SEQ ID NO: 2938391 - protein, 27 aa, Entamoeba invadens
FVSTYFKVERMLLGFTVAEPNFCALEL

SEQ ID NO: 2938392 - protein, 18 aa, Entamoeba invadens
FVTEKFKGNVIVETIADM

SEQ ID NO: 2938393 - protein, 18 aa, Entamoeba invadens
FVTGELLDNVLKLFREEI

SEQ ID NO: 2938394 - protein, 17 aa, Entamoeba invadens
FVTGWKFFMSVEDVSRK

SEQ ID NO: 2938395 - protein, 20 aa, Entamoeba invadens
FVTIKGRVRVRWLTSNEDEQ

SEQ ID NO: 2938396 - protein, 18 aa, Entamoeba invadens
FVTLIPINCFKDCKTLKE

SEQ ID NO: 2938397 - protein, 20 aa, Entamoeba invadens
FVTLPTWFVVKCKPNDKIIF

SEQ ID NO: 2938398 - protein, 19 aa, Entamoeba invadens
FVTLVGRFYRNPNFSREDK

SEQ ID NO: 2938399 - protein, 20 aa, Entamoeba invadens
FVTSCFIRRESIEFKVSNSN

SEQ ID NO: 2938400 - protein, 25 aa, Entamoeba invadens
FVVAVCAKGRIILFDYVSEKLELVD

SEQ ID NO: 2938401 - protein, 27 aa, Entamoeba invadens
FVVDLLGELGFRFKAKVSSGRNNTMKV

SEQ ID NO: 2938402 - protein, 24 aa, Entamoeba invadens
FVVEIQLRPTRIVYNKVMVEELMN

SEQ ID NO: 2938403 - protein, 19 aa, Entamoeba invadens
FVVKGHVLIIWRKNPPLSD

SEQ ID NO: 2938404 - protein, 26 aa, Entamoeba invadens
FVVLPSLLLEIGNYCFEECSKLKDIA

SEQ ID NO: 2938405 - protein, 20 aa, Entamoeba invadens
FVVMSSVLKRFFRNLPQKIF

SEQ ID NO: 2938406 - protein, 19 aa, Entamoeba invadens
FVVVGEVAVGKSCLLLQFQ

SEQ ID NO: 2938407 - protein, 26 aa, Entamoeba invadens
FVVYNFFKIRIEKSFTEKCVKPLKNI

SEQ ID NO: 2938408 - protein, 23 aa, Entamoeba invadens
FVYGDGGYVFGIYLQEPVVVLDK

SEQ ID NO: 2938409 - protein, 19 aa, Entamoeba invadens
FVYLCSFAQKMVELGEEVG

SEQ ID NO: 2938410 - protein, 20 aa, Entamoeba invadens
FVYNVACKFFPSEMKRAEKK

SEQ ID NO: 2938411 - protein, 18 aa, Entamoeba invadens
FVYSFPLLTELTVRKILK

SEQ ID NO: 2938412 - protein, 17 aa, Entamoeba invadens
FWFVQNRPMMFVATAGK

SEQ ID NO: 2938413 - protein, 18 aa, Entamoeba invadens
FWGDKSVHIHIALICALV

SEQ ID NO: 2938414 - protein, 25 aa, Entamoeba invadens
FWIEKSGVINFNFVMKDLYAFYSGM

SEQ ID NO: 2938415 - protein, 26 aa, Entamoeba invadens
FWKCEKCSKSFCETCNIFIHDVLFNC

SEQ ID NO: 2938416 - protein, 18 aa, Entamoeba invadens
FWKECFVDGEVPLFQVAY

SEQ ID NO: 2938417 - protein, 27 aa, Entamoeba invadens
FWLSDGKIYIHQCLKTAYNVSPECRNP

SEQ ID NO: 2938418 - protein, 17 aa, Entamoeba invadens
FWNELIVTASQDSLSCF

SEQ ID NO: 2938419 - protein, 18 aa, Entamoeba invadens
FWNGYGCGQVPDKVILYY

SEQ ID NO: 2938420 - protein, 26 aa, Entamoeba invadens
FWPSLLKIKNFLVEFITPIVKVKKGK

SEQ ID NO: 2938421 - protein, 29 aa, Entamoeba invadens
FWQKTNELYQRFVTSFGVDHVFLVSFGTG

SEQ ID NO: 2938422 - protein, 20 aa, Entamoeba invadens
FWRTKFSIPLKDVVNETKDI

SEQ ID NO: 2938423 - protein, 25 aa, Entamoeba invadens
FWRVRLQIASSFGRVVKCVGESVDV

SEQ ID NO: 2938424 - protein, 20 aa, Entamoeba invadens
FWVPKEIYRLTDYIIKNYQM

SEQ ID NO: 2938425 - protein, 22 aa, Entamoeba invadens
FWYIYKKCGNYSMFDIQYIAHK

SEQ ID NO: 2938426 - protein, 20 aa, Entamoeba invadens
FYAGHALGAVCFEILFDGKT

SEQ ID NO: 2938427 - protein, 19 aa, Entamoeba invadens
FYATGSLIYNFCISLATLA

SEQ ID NO: 2938428 - protein, 18 aa, Entamoeba invadens
FYCEPESKELMTYLVKRV

SEQ ID NO: 2938429 - protein, 19 aa, Entamoeba invadens
FYDAFSIKYVKNLGTKNLN

SEQ ID NO: 2938430 - protein, 21 aa, Entamoeba invadens
FYDCPKLESIIDIKMFTIEDI

SEQ ID NO: 2938431 - protein, 17 aa, Entamoeba invadens
FYDDLLVLHVGETYILK

SEQ ID NO: 2938432 - protein, 18 aa, Entamoeba invadens
FYDELLVVTIMKIYMVKG

SEQ ID NO: 2938433 - protein, 18 aa, Entamoeba invadens
FYDIFRVFHDGELPLKYC

SEQ ID NO: 2938434 - protein, 32 aa, Entamoeba invadens
FYDKELRLGFVLISFYDLRVSKKMFKAVQMHF

SEQ ID NO: 2938435 - protein, 22 aa, Entamoeba invadens
FYDTCVKFGLFPTFEMVNREIA

SEQ ID NO: 2938436 - protein, 18 aa, Entamoeba invadens
FYDVFSIEHVSAFSSQSV

SEQ ID NO: 2938437 - protein, 32 aa, Entamoeba invadens
FYEAKAKFIVYFCKLLKLNKLPQFLRAHNRFA

SEQ ID NO: 2938438 - protein, 25 aa, Entamoeba invadens
FYECKHLKYLFTFEEYKNCGFKDFI

SEQ ID NO: 2938439 - protein, 19 aa, Entamoeba invadens
FYEHTFKTISFATVLSNVK

SEQ ID NO: 2938440 - protein, 23 aa, Entamoeba invadens
FYEKCNLKGFNLLIQKIINDAPN

SEQ ID NO: 2938441 - protein, 21 aa, Entamoeba invadens
FYEMMRFVVEICRCQKITNTK

SEQ ID NO: 2938442 - protein, 26 aa, Entamoeba invadens
FYEMSALKRDGVFYVIDDVTKRSLLK

SEQ ID NO: 2938443 - protein, 24 aa, Entamoeba invadens
FYENWKYFCSKLEFYDKLPNNIAD

SEQ ID NO: 2938444 - protein, 18 aa, Entamoeba invadens
FYERCIKKPLETFDTDNK

SEQ ID NO: 2938445 - protein, 28 aa, Entamoeba invadens
FYERSMCGTSPFLLACAYGQLEMAKVVF

SEQ ID NO: 2938446 - protein, 17 aa, Entamoeba invadens
FYFCKLTKIDLPKSLQC

SEQ ID NO: 2938447 - protein, 26 aa, Entamoeba invadens
FYFDMSYRAVPMSTKFIVLPENEKDD

SEQ ID NO: 2938448 - protein, 18 aa, Entamoeba invadens
FYFEFIPNIETVQCSHSM

SEQ ID NO: 2938449 - protein, 24 aa, Entamoeba invadens
FYFKCTNCKNVFTIKTDPKNADYA

SEQ ID NO: 2938450 - protein, 25 aa, Entamoeba invadens
FYFPNIETLHLWKLNHEHFGNDITI

SEQ ID NO: 2938451 - protein, 27 aa, Entamoeba invadens
FYGASFIPNRICMVTELAKYGSLQDLM

SEQ ID NO: 2938452 - protein, 17 aa, Entamoeba invadens
FYGCQIVTQKMCGCTHP

SEQ ID NO: 2938453 - protein, 17 aa, Entamoeba invadens
FYGDKIVSLKMTLLKLS

SEQ ID NO: 2938454 - protein, 22 aa, Entamoeba invadens
FYGKPGCGKSFTARKEAEDKWG

SEQ ID NO: 2938455 - protein, 17 aa, Entamoeba invadens
FYGKTIFEIAEEHKFTR

SEQ ID NO: 2938456 - protein, 17 aa, Entamoeba invadens
FYHCDMLSNIVFTDPPT

SEQ ID NO: 2938457 - protein, 18 aa, Entamoeba invadens
FYHCFKLKSLELPICVSY

SEQ ID NO: 2938458 - protein, 28 aa, Entamoeba invadens
FYHKRFLISDVFLGCVEFDLTHLKFGRN

SEQ ID NO: 2938459 - protein, 30 aa, Entamoeba invadens
FYHKRFLISDVFLGCVEFDLTHLKFGRNIE

SEQ ID NO: 2938460 - protein, 29 aa, Entamoeba invadens
FYHKRFLISDVFLGCVEFDLTHLKFGSNI

SEQ ID NO: 2938461 - protein, 26 aa, Entamoeba invadens
FYHTGLPLSCWIRFLYSHPAMVEKIK

SEQ ID NO: 2938462 - protein, 20 aa, Entamoeba invadens
FYIIDYCSGGEFYFYLQKNR

SEQ ID NO: 2938463 - protein, 25 aa, Entamoeba invadens
FYILFKRKSSITFKTNMSGRFKCEQ

SEQ ID NO: 2938464 - protein, 17 aa, Entamoeba invadens
FYIPEFKAFCQAEEVNH

SEQ ID NO: 2938465 - protein, 30 aa, Entamoeba invadens
FYIQVEIMRLMLWGEESFFWLEKKSMSLVF

SEQ ID NO: 2938466 - protein, 25 aa, Entamoeba invadens
FYIYFCPLTSQYLSLFVDPVTNGLV

SEQ ID NO: 2938467 - protein, 18 aa, Entamoeba invadens
FYKCKGLRSVTIPSSLTI

SEQ ID NO: 2938468 - protein, 25 aa, Entamoeba invadens
FYKCSRLTKMRVYKDFEVVDHYGVL

SEQ ID NO: 2938469 - protein, 17 aa, Entamoeba invadens
FYKDCRAANPIVRGLAV

SEQ ID NO: 2938470 - protein, 19 aa, Entamoeba invadens
FYKDVKLTFNNAKVFNHPD

SEQ ID NO: 2938471 - protein, 18 aa, Entamoeba invadens
FYKEKKFVVLNTDSHENV

SEQ ID NO: 2938472 - protein, 22 aa, Entamoeba invadens
FYKHTWKVNTVIFIVADNEDYK

SEQ ID NO: 2938473 - protein, 17 aa, Entamoeba invadens
FYKLLTILNHMPDKSET

SEQ ID NO: 2938474 - protein, 23 aa, Entamoeba invadens
FYKNHSFVIKKLIPKYYSFSETP

SEQ ID NO: 2938475 - protein, 30 aa, Entamoeba invadens
FYKNKTAKCPFHWMDVYKCIDDVDLALLVN

SEQ ID NO: 2938476 - protein, 17 aa, Entamoeba invadens
FYKNLLLSFPTLSRTIE

SEQ ID NO: 2938477 - protein, 19 aa, Entamoeba invadens
FYKQFFYKNLKVHHYLSKE

SEQ ID NO: 2938478 - protein, 21 aa, Entamoeba invadens
FYKTELFESFLTLVQHNQFFA

SEQ ID NO: 2938479 - protein, 27 aa, Entamoeba invadens
FYKVKGKSIKICWKLSKEEISNEEFNY

SEQ ID NO: 2938480 - protein, 22 aa, Entamoeba invadens
FYKVQWEYNFPLRLLNKDTKEE

SEQ ID NO: 2938481 - protein, 24 aa, Entamoeba invadens
FYLAEKIILLGIQREEEFAAVKYG

SEQ ID NO: 2938482 - protein, 18 aa, Entamoeba invadens
FYLEDGVCQKCDTTLSDC

SEQ ID NO: 2938483 - protein, 19 aa, Entamoeba invadens
FYLKKGKSKKLVWLNHLGK

SEQ ID NO: 2938484 - protein, 21 aa, Entamoeba invadens
FYLKKMSCFGFLLFPLPKIDI

SEQ ID NO: 2938485 - protein, 18 aa, Entamoeba invadens
FYLKSISIERNWSDDFRA

SEQ ID NO: 2938486 - protein, 17 aa, Entamoeba invadens
FYLLALKLTYPEKFHLL

SEQ ID NO: 2938487 - protein, 19 aa, Entamoeba invadens
FYLLRLMMRHSTSTVPEFW

SEQ ID NO: 2938488 - protein, 18 aa, Entamoeba invadens
FYLLYAVGHLEHFCKDEP

SEQ ID NO: 2938489 - protein, 19 aa, Entamoeba invadens
FYLNNGMCQQCNTTLSDCV

SEQ ID NO: 2938490 - protein, 19 aa, Entamoeba invadens
FYLNNGMCQQCNTTLSNCV

SEQ ID NO: 2938491 - protein, 24 aa, Entamoeba invadens
FYMNHSCTILRQTIKMTFLTVVNG

SEQ ID NO: 2938492 - protein, 22 aa, Entamoeba invadens
FYMRRPFEEYFHLFSDDLNTFT

SEQ ID NO: 2938493 - protein, 18 aa, Entamoeba invadens
FYNCDFQKVVFGEKIEYI

SEQ ID NO: 2938494 - protein, 17 aa, Entamoeba invadens
FYNCKQLTKVVCKNKNI

SEQ ID NO: 2938495 - protein, 17 aa, Entamoeba invadens
FYNCRSLSSISLPEKLV

SEQ ID NO: 2938496 - protein, 17 aa, Entamoeba invadens
FYNGALLFQTDEIRNFG

SEQ ID NO: 2938497 - protein, 17 aa, Entamoeba invadens
FYNIKRFLGKTFEELQD

SEQ ID NO: 2938498 - protein, 17 aa, Entamoeba invadens
FYNIMKSLIPYLSDADS

SEQ ID NO: 2938499 - protein, 18 aa, Entamoeba invadens
FYNKGLKNLRLPTTLKIL

SEQ ID NO: 2938500 - protein, 18 aa, Entamoeba invadens
FYNQFVHYHFKNYLLDIF

SEQ ID NO: 2938501 - protein, 25 aa, Entamoeba invadens
FYNQKYRIGQCLFGVLAGDQHTVNN

SEQ ID NO: 2938502 - protein, 17 aa, Entamoeba invadens
FYNSVGKENVIFEDKNA

SEQ ID NO: 2938503 - protein, 40 aa, Entamoeba invadens
FYNTIVLCGGSSLFPGMKRRFAKELKRIAPANINVNISAG

SEQ ID NO: 2938504 - protein, 26 aa, Entamoeba invadens
FYNVYQCFKLAPPLHAHNSTLSQDFK

SEQ ID NO: 2938505 - protein, 19 aa, Entamoeba invadens
FYNYCPKYFLVGRPITSMA

SEQ ID NO: 2938506 - protein, 29 aa, Entamoeba invadens
FYPKENCTFMLTSYWPSYVLDRLSLSSKP

SEQ ID NO: 2938507 - protein, 18 aa, Entamoeba invadens
FYPKPHVVKTPFDKLQNL

SEQ ID NO: 2938508 - protein, 21 aa, Entamoeba invadens
FYPLEVHGAIADIDFSKITSL

SEQ ID NO: 2938509 - protein, 22 aa, Entamoeba invadens
FYPNEMNEYAVLYKKYCSLHVI

SEQ ID NO: 2938510 - protein, 17 aa, Entamoeba invadens
FYPSAIKSSVSFSTPGT

SEQ ID NO: 2938511 - protein, 18 aa, Entamoeba invadens
FYQDADFVELEVKRILSK

SEQ ID NO: 2938512 - protein, 19 aa, Entamoeba invadens
FYQEGWRWEKNEQGELTVN

SEQ ID NO: 2938513 - protein, 18 aa, Entamoeba invadens
FYQIVVWFHVYYPTVDQY

SEQ ID NO: 2938514 - protein, 26 aa, Entamoeba invadens
FYQKILRLLRCLLREGPFKENQLLMD

SEQ ID NO: 2938515 - protein, 18 aa, Entamoeba invadens
FYQMKVIESRPFIKENTD

SEQ ID NO: 2938516 - protein, 17 aa, Entamoeba invadens
FYQRIETMIEKKLDEYK

SEQ ID NO: 2938517 - protein, 17 aa, Entamoeba invadens
FYQSFDYKELLEVKEGV

SEQ ID NO: 2938518 - protein, 19 aa, Entamoeba invadens
FYRAQPFREYLASFKDSIT

SEQ ID NO: 2938519 - protein, 19 aa, Entamoeba invadens
FYRDFRLTDTLKYKIFQDV

SEQ ID NO: 2938520 - protein, 17 aa, Entamoeba invadens
FYRFPRSVSNIGDQCFS

SEQ ID NO: 2938521 - protein, 26 aa, Entamoeba invadens
FYRHRKCDKYNIAGLLKLMNEPLRVA

SEQ ID NO: 2938522 - protein, 21 aa, Entamoeba invadens
FYRRVYWRPVSYRIYLQPHDN

SEQ ID NO: 2938523 - protein, 21 aa, Entamoeba invadens
FYRYKSHTLIKHLITKVYKMW

SEQ ID NO: 2938524 - protein, 17 aa, Entamoeba invadens
FYSDYALFYSEQRKSNQ

SEQ ID NO: 2938525 - protein, 23 aa, Entamoeba invadens
FYSGKYKRYCIIIEVVVNSVTGT

SEQ ID NO: 2938526 - protein, 26 aa, Entamoeba invadens
FYSHEFCPGISQVFFECEIPLTFPLM

SEQ ID NO: 2938527 - protein, 24 aa, Entamoeba invadens
FYSIDRRLARAVSISSPTTRINEV

SEQ ID NO: 2938528 - protein, 34 aa, Entamoeba invadens
FYSLCKIECPEFICLVCELFARLSSVRSQTAAAV

SEQ ID NO: 2938529 - protein, 19 aa, Entamoeba invadens
FYSPTIVLIPKFINHTLEA

SEQ ID NO: 2938530 - protein, 19 aa, Entamoeba invadens
FYSRRPAIRKVFFSCIERQ

SEQ ID NO: 2938531 - protein, 17 aa, Entamoeba invadens
FYSTNGFVLCNSKPIIL

SEQ ID NO: 2938532 - protein, 20 aa, Entamoeba invadens
FYTCKCSTLTLNLFTESALR

SEQ ID NO: 2938533 - protein, 27 aa, Entamoeba invadens
FYTDKGTLCYSQCKFFAPTSSISELVN

SEQ ID NO: 2938534 - protein, 18 aa, Entamoeba invadens
FYTIDAIKIGQEVKLGRR

SEQ ID NO: 2938535 - protein, 24 aa, Entamoeba invadens
FYTKEGEDIFSLVAGYMEIITMKA

SEQ ID NO: 2938536 - protein, 18 aa, Entamoeba invadens
FYTLTVLGLLFKILQDNN

SEQ ID NO: 2938537 - protein, 24 aa, Entamoeba invadens
FYTRTTAMEAFRFFATTETAKGVY

SEQ ID NO: 2938538 - protein, 18 aa, Entamoeba invadens
FYTSEAFTELVIKKKSLI

SEQ ID NO: 2938539 - protein, 25 aa, Entamoeba invadens
FYVEMRTLIVFPTYFYYVKFIGSAF

SEQ ID NO: 2938540 - protein, 17 aa, Entamoeba invadens
FYVFKCGHYVCSECMSL

SEQ ID NO: 2938541 - protein, 17 aa, Entamoeba invadens
FYVFRTIDFTKMIQQAS

SEQ ID NO: 2938542 - protein, 24 aa, Entamoeba invadens
FYVNRIGILFGEFAKNNNVRVEAI

SEQ ID NO: 2938543 - protein, 17 aa, Entamoeba invadens
FYVPNLIGVQILSMSKR

SEQ ID NO: 2938544 - protein, 31 aa, Entamoeba invadens
FYVYDQIGSFLFEMFTSFALQYNGQVAKIAV

SEQ ID NO: 2938545 - protein, 18 aa, Entamoeba invadens
FYWYKLNDKWLIDNVDIY

SEQ ID NO: 2938546 - protein, 18 aa, Entamoeba invadens
FYYCKTLNINTNWKNIEI

SEQ ID NO: 2938547 - protein, 19 aa, Entamoeba invadens
FYYCPSLLLKLQRSYNNTV

SEQ ID NO: 2938548 - protein, 17 aa, Entamoeba invadens
FYYGDYRKLNACGNNGI

SEQ ID NO: 2938549 - protein, 26 aa, Entamoeba invadens
FYYRDRSLKGGIVFCDCTSPETCELQ

SEQ ID NO: 2938550 - protein, 19 aa, Entamoeba invadens
FYYSRVVPAQSEIDKMKAE

SEQ ID NO: 2938551 - protein, 27 aa, Entamoeba invadens
FYYYLSDAYSYLSLNNLLGFFTKTNGK

SEQ ID NO: 2938552 - protein, 25 aa, Entamoeba invadens
GAAFRLPYGRCVAMLLKSETTAEGV

SEQ ID NO: 2938553 - protein, 25 aa, Entamoeba invadens
GAAFTTKWFYVDRMFVKAQFWDTAG

SEQ ID NO: 2938554 - protein, 19 aa, Entamoeba invadens
GAAIKRSASSHVLLTQQER

SEQ ID NO: 2938555 - protein, 23 aa, Entamoeba invadens
GAALYNFKMCSGIDNDVMLDVLP

SEQ ID NO: 2938556 - protein, 17 aa, Entamoeba invadens
GAAPQYGMPAQFPYSPF

SEQ ID NO: 2938557 - protein, 19 aa, Entamoeba invadens
GAASTFLRLFGLIDDEDGE

SEQ ID NO: 2938558 - protein, 17 aa, Entamoeba invadens
GACGDGYYGEAGNCQKC

SEQ ID NO: 2938559 - protein, 17 aa, Entamoeba invadens
GACKLQEKFDVIGRGAP

SEQ ID NO: 2938560 - protein, 18 aa, Entamoeba invadens
GACLYARDMASQTVKNHI

SEQ ID NO: 2938561 - protein, 19 aa, Entamoeba invadens
GACPFVIKDQFHTFKDQGN

SEQ ID NO: 2938562 - protein, 23 aa, Entamoeba invadens
GACPPLKALLYIMANGSYNGMTI

SEQ ID NO: 2938563 - protein, 24 aa, Entamoeba invadens
GACPPLKALLYIMATGSYNGMTIE

SEQ ID NO: 2938564 - protein, 17 aa, Entamoeba invadens
GACSFRKCVALKKIEIP

SEQ ID NO: 2938565 - protein, 17 aa, Entamoeba invadens
GACTLDISCIQKNVYGY

SEQ ID NO: 2938566 - protein, 19 aa, Entamoeba invadens
GACVPFIQKYLKKFVDINK

SEQ ID NO: 2938567 - protein, 23 aa, Entamoeba invadens
GADAYVLCCGFKNSGKTYTLEGK

SEQ ID NO: 2938568 - protein, 30 aa, Entamoeba invadens
GADDFGFGFGFGHFGSFGRFTSFGPTSYMS

SEQ ID NO: 2938569 - protein, 30 aa, Entamoeba invadens
GADFHTWKKRWFVMKEQYIWYFPKNTGSAQ

SEQ ID NO: 2938570 - protein, 18 aa, Entamoeba invadens
GADIRQSLFMNLVITGGS

SEQ ID NO: 2938571 - protein, 26 aa, Entamoeba invadens
GADLQDWRFLLKYRDECQRTSAVCTL

SEQ ID NO: 2938572 - protein, 26 aa, Entamoeba invadens
GADSRYPITCPLVLLDNVIPTFNLQS

SEQ ID NO: 2938573 - protein, 18 aa, Entamoeba invadens
GAEDVLDILGFHFNEYLA

SEQ ID NO: 2938574 - protein, 24 aa, Entamoeba invadens
GAEKELHDMYGFYIGLNAPQVKYF

SEQ ID NO: 2938575 - protein, 24 aa, Entamoeba invadens
GAEKELHDMYGFYVQLNCREVKYF

SEQ ID NO: 2938576 - protein, 20 aa, Entamoeba invadens
GAEKMSVAFQCDGSTTVNQF

SEQ ID NO: 2938577 - protein, 21 aa, Entamoeba invadens
GAEKRALKWADFIMKKTRQNT

SEQ ID NO: 2938578 - protein, 34 aa, Entamoeba invadens
GAEKRKTEEIIWTLSVCIPVLGVSLFGRNAQELL

SEQ ID NO: 2938579 - protein, 23 aa, Entamoeba invadens
GAERKCSVCKAGYYPKTSGDYKC

SEQ ID NO: 2938580 - protein, 24 aa, Entamoeba invadens
GAFDSCVKLSKIVLPQTVTQITEK

SEQ ID NO: 2938581 - protein, 17 aa, Entamoeba invadens
GAFFECKKLTMLSFPDG

SEQ ID NO: 2938582 - protein, 28 aa, Entamoeba invadens
GAFKNWKLGRCVVIKAPLLKIPNECFTN

SEQ ID NO: 2938583 - protein, 20 aa, Entamoeba invadens
GAFSQCRYLTQIVLNETLKC

SEQ ID NO: 2938584 - protein, 19 aa, Entamoeba invadens
GAFTCKFADCISLDAEFEF

SEQ ID NO: 2938585 - protein, 22 aa, Entamoeba invadens
GAFYSNISLCYMKLGQPQEALK

SEQ ID NO: 2938586 - protein, 20 aa, Entamoeba invadens
GAGCEPTLFLAYKNRKDLPI

SEQ ID NO: 2938587 - protein, 20 aa, Entamoeba invadens
GAGLGRLAYEIAKLGVQCEG

SEQ ID NO: 2938588 - protein, 17 aa, Entamoeba invadens
GAGNDFCNFKSFIDFAS

SEQ ID NO: 2938589 - protein, 28 aa, Entamoeba invadens
GAHICPKEKLDIIFSHFDDVLSFNTALF

SEQ ID NO: 2938590 - protein, 18 aa, Entamoeba invadens
GAIIKLAVALAEQRNKEL

SEQ ID NO: 2938591 - protein, 17 aa, Entamoeba invadens
GAILGAMDERYCIDNGT

SEQ ID NO: 2938592 - protein, 18 aa, Entamoeba invadens
GAIVRCDITLLSEYAEFT

SEQ ID NO: 2938593 - protein, 23 aa, Entamoeba invadens
GAKGVFYYSYYDLVYMDDKGDPF

SEQ ID NO: 2938594 - protein, 28 aa, Entamoeba invadens
GAKLMIPGLLRYAKDITMNEIVVLMTTK

SEQ ID NO: 2938595 - protein, 23 aa, Entamoeba invadens
GAKMTWTPSNNWRIELEVTNLPF

SEQ ID NO: 2938596 - protein, 22 aa, Entamoeba invadens
GAKRLASIYQWVVKREEFNWSE

SEQ ID NO: 2938597 - protein, 19 aa, Entamoeba invadens
GAKTIRGATKMATVTTTNK

SEQ ID NO: 2938598 - protein, 20 aa, Entamoeba invadens
GAKVRSGKIWSKALDDAIVS

SEQ ID NO: 2938599 - protein, 33 aa, Entamoeba invadens
GALCAIKGESAGECWKATKKEVPKIDADQKAGM

SEQ ID NO: 2938600 - protein, 28 aa, Entamoeba invadens
GALKIARGLELMKMRYTVIHKYYEEKLT

SEQ ID NO: 2938601 - protein, 20 aa, Entamoeba invadens
GALKNLRLLTKVKLPNKLKE

SEQ ID NO: 2938602 - protein, 18 aa, Entamoeba invadens
GALKRKTQTPIAMELCYR

SEQ ID NO: 2938603 - protein, 17 aa, Entamoeba invadens
GALNWPVIEQYPILMCS

SEQ ID NO: 2938604 - protein, 20 aa, Entamoeba invadens
GALRVYCYFFPSLFSSSFHT

SEQ ID NO: 2938605 - protein, 23 aa, Entamoeba invadens
GALSFRDKGVFWRKFSTKGDIGV

SEQ ID NO: 2938606 - protein, 21 aa, Entamoeba invadens
GAMDRKCKALTNFFSFSMMTR

SEQ ID NO: 2938607 - protein, 19 aa, Entamoeba invadens
GAMHWKVIADMIPGRSRKQ

SEQ ID NO: 2938608 - protein, 18 aa, Entamoeba invadens
GANGFLGIHLLQELQRAG

SEQ ID NO: 2938609 - protein, 19 aa, Entamoeba invadens
GANIKRFTGVANFTVEGQV

SEQ ID NO: 2938610 - protein, 18 aa, Entamoeba invadens
GANSFCPTIRVLPTAILL

SEQ ID NO: 2938611 - protein, 19 aa, Entamoeba invadens
GAPNFKLFEDLCLRAFACI

SEQ ID NO: 2938612 - protein, 22 aa, Entamoeba invadens
GAPRKVCDACILDQYRKQQETL

SEQ ID NO: 2938613 - protein, 29 aa, Entamoeba invadens
GAQFWEVFISMMWRFYRNKSISYNTKRKV

SEQ ID NO: 2938614 - protein, 22 aa, Entamoeba invadens
GAQKPAALFRKNVPLLTGVAKF

SEQ ID NO: 2938615 - protein, 25 aa, Entamoeba invadens
GAQLKAVCVEAGMFALRREALEIRH

SEQ ID NO: 2938616 - protein, 25 aa, Entamoeba invadens
GAQLLWRYITSWEIYTKKTTEKVGA

SEQ ID NO: 2938617 - protein, 20 aa, Entamoeba invadens
GAQRAVVIVHLFDAFSAFQC

SEQ ID NO: 2938618 - protein, 18 aa, Entamoeba invadens
GAQREKRDDRREGGDRNG

SEQ ID NO: 2938619 - protein, 27 aa, Entamoeba invadens
GARKFLCSGPLFIVEKVMEPPKKWMYF

SEQ ID NO: 2938620 - protein, 23 aa, Entamoeba invadens
GARPFKACACRKLQNDSSASFVS

SEQ ID NO: 2938621 - protein, 17 aa, Entamoeba invadens
GASLRLGMSPSDTMHIA

SEQ ID NO: 2938622 - protein, 27 aa, Entamoeba invadens
GASVIREANLCFAEFIRDASLLWRKDE

SEQ ID NO: 2938623 - protein, 28 aa, Entamoeba invadens
GASVSCIKCRICKIYMHKTCATELQMGC

SEQ ID NO: 2938624 - protein, 18 aa, Entamoeba invadens
GASYYRFNLNQNITKLKI

SEQ ID NO: 2938625 - protein, 25 aa, Entamoeba invadens
GATEGLKLQRLVVMVTSTSEAVISR

SEQ ID NO: 2938626 - protein, 19 aa, Entamoeba invadens
GATEGLQFLSFDKEMNLAV

SEQ ID NO: 2938627 - protein, 23 aa, Entamoeba invadens
GATREIISILVALYKQSDINEKV

SEQ ID NO: 2938628 - protein, 23 aa, Entamoeba invadens
GAVDAWYGALSLILNIKMYRPKN

SEQ ID NO: 2938629 - protein, 17 aa, Entamoeba invadens
GAVFIPKKICLVTEFAK

SEQ ID NO: 2938630 - protein, 19 aa, Entamoeba invadens
GAVGKTCILMSYTSHVFPE

SEQ ID NO: 2938631 - protein, 22 aa, Entamoeba invadens
GAVGKTCLLISFTSNVFPNEYI

SEQ ID NO: 2938632 - protein, 24 aa, Entamoeba invadens
GAVGKTCLLISYSIKKFPEDYIPT

SEQ ID NO: 2938633 - protein, 20 aa, Entamoeba invadens
GAVGKTCLLISYTTNAFPNE

SEQ ID NO: 2938634 - protein, 19 aa, Entamoeba invadens
GAVGKTCMLMSYTSNDFPS

SEQ ID NO: 2938635 - protein, 18 aa, Entamoeba invadens
GAVIFRISNSSTFEGGKY

SEQ ID NO: 2938636 - protein, 30 aa, Entamoeba invadens
GAVKTWKKRWFVLKENRLWYFASKTATSAK

SEQ ID NO: 2938637 - protein, 31 aa, Entamoeba invadens
GAVKTWKKRWFVLKENRLWYFASKTATSAKG

SEQ ID NO: 2938638 - protein, 23 aa, Entamoeba invadens
GAVLKRFALGTAVEDQQLGVVFT

SEQ ID NO: 2938639 - protein, 18 aa, Entamoeba invadens
GAYEFVPPTQSSRYKPER

SEQ ID NO: 2938640 - protein, 28 aa, Entamoeba invadens
GAYKGDMRLKFIIQMCACALNGRDMIYN

SEQ ID NO: 2938641 - protein, 18 aa, Entamoeba invadens
GCAICKDKYYKRETDCIA

SEQ ID NO: 2938642 - protein, 19 aa, Entamoeba invadens
GCALLKEIVLYTPQFVPLG

SEQ ID NO: 2938643 - protein, 17 aa, Entamoeba invadens
GCANAFITPDGERTFGT

SEQ ID NO: 2938644 - protein, 24 aa, Entamoeba invadens
GCAPNAFLSMVLFVAQLCAIKKEK

SEQ ID NO: 2938645 - protein, 25 aa, Entamoeba invadens
GCARNRVRPSIGYSEGDFICISKSA

SEQ ID NO: 2938646 - protein, 23 aa, Entamoeba invadens
GCAYKNANIFLGKAVKDTNAKLT

SEQ ID NO: 2938647 - protein, 24 aa, Entamoeba invadens
GCCDIYCVCCIPMPCPPGCCDGCP

SEQ ID NO: 2938648 - protein, 18 aa, Entamoeba invadens
GCDALRLKLISNETKELK

SEQ ID NO: 2938649 - protein, 21 aa, Entamoeba invadens
GCDFDMVWLSYNFGLYVVNNF

SEQ ID NO: 2938650 - protein, 26 aa, Entamoeba invadens
GCDKLKELIDLCVEMDYFLKVNDKTK

SEQ ID NO: 2938651 - protein, 25 aa, Entamoeba invadens
GCDMKRLDLSHVMFFGSQYDMTFLT

SEQ ID NO: 2938652 - protein, 22 aa, Entamoeba invadens
GCDMPLSACSLTSKNDYYEQKK

SEQ ID NO: 2938653 - protein, 17 aa, Entamoeba invadens
GCDTPAHLEVLNFITKE

SEQ ID NO: 2938654 - protein, 31 aa, Entamoeba invadens
GCEFELLREFPFTFGNCVFKPINETNEVKHV

SEQ ID NO: 2938655 - protein, 18 aa, Entamoeba invadens
GCEPTKWSLKKGKERYVL

SEQ ID NO: 2938656 - protein, 25 aa, Entamoeba invadens
GCERIIRRRFGGVKFEQKVVIRPSV

SEQ ID NO: 2938657 - protein, 20 aa, Entamoeba invadens
GCESCANYYLTVEIGTKCSP

SEQ ID NO: 2938658 - protein, 17 aa, Entamoeba invadens
GCESCPIGEYKFSETTC

SEQ ID NO: 2938659 - protein, 26 aa, Entamoeba invadens
GCESLKLDFSFIMEKFSPIELSKCHF

SEQ ID NO: 2938660 - protein, 20 aa, Entamoeba invadens
GCEVLKSLAMVGFRDITVID

SEQ ID NO: 2938661 - protein, 20 aa, Entamoeba invadens
GCFCGCKSLAGITIPSSVTS

SEQ ID NO: 2938662 - protein, 19 aa, Entamoeba invadens
GCFGECYALTTVNIFSLDV

SEQ ID NO: 2938663 - protein, 19 aa, Entamoeba invadens
GCFGNCRNLTSVTIPSSVR

SEQ ID NO: 2938664 - protein, 17 aa, Entamoeba invadens
GCFKGCSSLTSVELPLL

SEQ ID NO: 2938665 - protein, 18 aa, Entamoeba invadens
GCFNGCGSLSKLVIQPGI

SEQ ID NO: 2938666 - protein, 29 aa, Entamoeba invadens
GCFPPNGVCSICNGNGPLTEKECDEKYRD

SEQ ID NO: 2938667 - protein, 20 aa, Entamoeba invadens
GCFQMLPVIEEFILPTNLKE

SEQ ID NO: 2938668 - protein, 18 aa, Entamoeba invadens
GCFSFCKSLSTFESENLK

SEQ ID NO: 2938669 - protein, 19 aa, Entamoeba invadens
GCFSQCSRLSSIVIPSRVS

SEQ ID NO: 2938670 - protein, 17 aa, Entamoeba invadens
GCFYGCNNLSRITIQSN

SEQ ID NO: 2938671 - protein, 20 aa, Entamoeba invadens
GCFYRCRNLKSVVIPSSVTA

SEQ ID NO: 2938672 - protein, 24 aa, Entamoeba invadens
GCGDGSVRLWGDWDYKPKLITSWR

SEQ ID NO: 2938673 - protein, 21 aa, Entamoeba invadens
GCGDGSVRLWNNWDYKPKLIT

SEQ ID NO: 2938674 - protein, 20 aa, Entamoeba invadens
GCGEFLDIIKLVDWCKKTGI

SEQ ID NO: 2938675 - protein, 30 aa, Entamoeba invadens
GCGFTYKTQKIFFTRNGKFLGLMNFVSGLV

SEQ ID NO: 2938676 - protein, 26 aa, Entamoeba invadens
GCGHTCGGCKAGGCGCNNTNSYTQPN

SEQ ID NO: 2938677 - protein, 25 aa, Entamoeba invadens
GCGKTTFVKGMFSFLSLMGRTPLIV

SEQ ID NO: 2938678 - protein, 23 aa, Entamoeba invadens
GCGLKWPKLWRGLYGSKLHSVAG

SEQ ID NO: 2938679 - protein, 19 aa, Entamoeba invadens
GCHMCKCALNTQQSTQTNR

SEQ ID NO: 2938680 - protein, 25 aa, Entamoeba invadens
GCICAELVLGIPLFPGSSEFNQLFK

SEQ ID NO: 2938681 - protein, 25 aa, Entamoeba invadens
GCICAEMVLGIPLFPGNSEYDQLYK

SEQ ID NO: 2938682 - protein, 25 aa, Entamoeba invadens
GCIIAEMFLGVPLFPASSEYDLIAR

SEQ ID NO: 2938683 - protein, 17 aa, Entamoeba invadens
GCIYEYTHDLTLKYRYE

SEQ ID NO: 2938684 - protein, 22 aa, Entamoeba invadens
GCKIREIPVGVFSLKLYPKLQM

SEQ ID NO: 2938685 - protein, 26 aa, Entamoeba invadens
GCKNLECVNIPLGVTKIKNFSFNGCS

SEQ ID NO: 2938686 - protein, 17 aa, Entamoeba invadens
GCKRCFIKNDVTKEMSG

SEQ ID NO: 2938687 - protein, 23 aa, Entamoeba invadens
GCKSLQLQVSCFVDLDNRKTLSN

SEQ ID NO: 2938688 - protein, 22 aa, Entamoeba invadens
GCKSNMFSNEIEKIYNLRYQLK

SEQ ID NO: 2938689 - protein, 22 aa, Entamoeba invadens
GCKSNVFSNEIEKIYNLRSQLK

SEQ ID NO: 2938690 - protein, 20 aa, Entamoeba invadens
GCKTCDTAKFVVHALKSNGA

SEQ ID NO: 2938691 - protein, 21 aa, Entamoeba invadens
GCKTFWVFLNKAVSVMRDFHD

SEQ ID NO: 2938692 - protein, 19 aa, Entamoeba invadens
GCKVIALKDDFALITLMKP

SEQ ID NO: 2938693 - protein, 28 aa, Entamoeba invadens
GCLAFCFMFKKELPCFSPTCKNPNKVNS

SEQ ID NO: 2938694 - protein, 17 aa, Entamoeba invadens
GCLSRCINLSAITLPKG

SEQ ID NO: 2938695 - protein, 19 aa, Entamoeba invadens
GCLSVFIVNNRIFYIYDDG

SEQ ID NO: 2938696 - protein, 17 aa, Entamoeba invadens
GCLTCTGPSNGLCSTCA

SEQ ID NO: 2938697 - protein, 25 aa, Entamoeba invadens
GCMKRGSRCVFQLYPESHFDLEMIT

SEQ ID NO: 2938698 - protein, 25 aa, Entamoeba invadens
GCMTAELFLGYPLFGATSEYNLLYK

SEQ ID NO: 2938699 - protein, 25 aa, Entamoeba invadens
GCMVAEMFFGIPLFVASSELGLLRK

SEQ ID NO: 2938700 - protein, 20 aa, Entamoeba invadens
GCMVYEFVVGIPPFHDETPD

SEQ ID NO: 2938701 - protein, 18 aa, Entamoeba invadens
GCNCFRASRIPSLSLPKT

SEQ ID NO: 2938702 - protein, 17 aa, Entamoeba invadens
GCNKITCICGAYFCYLC

SEQ ID NO: 2938703 - protein, 25 aa, Entamoeba invadens
GCNVSRVLMGWGVQYITFVDNGTIS

SEQ ID NO: 2938704 - protein, 20 aa, Entamoeba invadens
GCPCGIDFQKVVLKAVQKDI

SEQ ID NO: 2938705 - protein, 22 aa, Entamoeba invadens
GCPCGKDFIEVLRECMKKDIVI

SEQ ID NO: 2938706 - protein, 27 aa, Entamoeba invadens
GCPDCKKKKGLGVSLCVNCKKMTSSIY

SEQ ID NO: 2938707 - protein, 22 aa, Entamoeba invadens
GCPFDLEKHSGWQLKVELRAYL

SEQ ID NO: 2938708 - protein, 20 aa, Entamoeba invadens
GCPQNAFVYILAVEDLPKVL

SEQ ID NO: 2938709 - protein, 18 aa, Entamoeba invadens
GCQKCKIGYFPEEKRCSP

SEQ ID NO: 2938710 - protein, 19 aa, Entamoeba invadens
GCQNLKVVTYEGGTITPQM

SEQ ID NO: 2938711 - protein, 21 aa, Entamoeba invadens
GCQYMPNTICDKIDAKHIENA

SEQ ID NO: 2938712 - protein, 21 aa, Entamoeba invadens
GCRLGGLVGYTIRFDDVTSDR

SEQ ID NO: 2938713 - protein, 17 aa, Entamoeba invadens
GCSCLKQVMFDDSIEYF

SEQ ID NO: 2938714 - protein, 18 aa, Entamoeba invadens
GCSIERVLEVDPKGSVVS

SEQ ID NO: 2938715 - protein, 21 aa, Entamoeba invadens
GCSKFKDLLFLIVKSSEHHPE

SEQ ID NO: 2938716 - protein, 19 aa, Entamoeba invadens
GCSLCKNQFYLNGKARLAC

SEQ ID NO: 2938717 - protein, 21 aa, Entamoeba invadens
GCSNLKSIVFEDGHNVDINKE

SEQ ID NO: 2938718 - protein, 18 aa, Entamoeba invadens
GCSNLRHISIPSGITSLN

SEQ ID NO: 2938719 - protein, 25 aa, Entamoeba invadens
GCSRLKKKVDILAYWVSQSLYESIN

SEQ ID NO: 2938720 - protein, 26 aa, Entamoeba invadens
GCSSLKEIYCTSSLHFPVSSLYGVDA

SEQ ID NO: 2938721 - protein, 20 aa, Entamoeba invadens
GCSVGSILVSFLAVGYAPET

SEQ ID NO: 2938722 - protein, 25 aa, Entamoeba invadens
GCSYIYGVEAMKDFLKNNELNLLIR

SEQ ID NO: 2938723 - protein, 21 aa, Entamoeba invadens
GCSYSYGFSAVRRFLVKNDMV

SEQ ID NO: 2938724 - protein, 21 aa, Entamoeba invadens
GCTNLKYVVFENGRHFDIKEE

SEQ ID NO: 2938725 - protein, 17 aa, Entamoeba invadens
GCTNLPYFELPDQLEEI

SEQ ID NO: 2938726 - protein, 19 aa, Entamoeba invadens
GCTNNCLTHNTFSCENPVV

SEQ ID NO: 2938727 - protein, 21 aa, Entamoeba invadens
GCTRLKTIVVENGLKSLNLDV

SEQ ID NO: 2938728 - protein, 19 aa, Entamoeba invadens
GCTVLELITGNPPYYDLPP

SEQ ID NO: 2938729 - protein, 18 aa, Entamoeba invadens
GCVFGCYNESDGLPRVVK

SEQ ID NO: 2938730 - protein, 18 aa, Entamoeba invadens
GCVNLRSMILPPIIKSIS

SEQ ID NO: 2938731 - protein, 25 aa, Entamoeba invadens
GCVRSRVKPSIGFSEGEYMCNFDGT

SEQ ID NO: 2938732 - protein, 29 aa, Entamoeba invadens
GCVSGSPLSRLKMPPPPLTSMRQNTPQKS

SEQ ID NO: 2938733 - protein, 27 aa, Entamoeba invadens
GCVYSACLQLPIKLTLPVVSFAFNVLL

SEQ ID NO: 2938734 - protein, 18 aa, Entamoeba invadens
GCWGCLYSESKACSDIYL

SEQ ID NO: 2938735 - protein, 20 aa, Entamoeba invadens
GCYFHFAHSILRKIESRIVA

SEQ ID NO: 2938736 - protein, 31 aa, Entamoeba invadens
GCYRYVKRPRVCCVSESKKLLTTIIYGYKEE

SEQ ID NO: 2938737 - protein, 26 aa, Entamoeba invadens
GCYSNCSFDVFLLCFSVVQRSSFKNI

SEQ ID NO: 2938738 - protein, 20 aa, Entamoeba invadens
GDAAIYCFGVQEKRVFFLDP

SEQ ID NO: 2938739 - protein, 26 aa, Entamoeba invadens
GDADIFKYKFIFLPLHTSSHFSLIVL

SEQ ID NO: 2938740 - protein, 21 aa, Entamoeba invadens
GDAFYSFNLPIKINKGEVGEV

SEQ ID NO: 2938741 - protein, 19 aa, Entamoeba invadens
GDAKYVFISLLAKVKDQMQ

SEQ ID NO: 2938742 - protein, 27 aa, Entamoeba invadens
GDAMKQKQCLSGLCDTEKLGIKINRDE

SEQ ID NO: 2938743 - protein, 21 aa, Entamoeba invadens
GDAPMPFIIGCQRKIYPLLQE

SEQ ID NO: 2938744 - protein, 22 aa, Entamoeba invadens
GDAQFWGGRVVEMLIGDSVSGR

SEQ ID NO: 2938745 - protein, 19 aa, Entamoeba invadens
GDASFDIVDSILYQNDNKE

SEQ ID NO: 2938746 - protein, 25 aa, Entamoeba invadens
GDASPYFRPCLTGNISNVDKACEIS

SEQ ID NO: 2938747 - protein, 24 aa, Entamoeba invadens
GDATKRFSAYILFYQKVIPIVEKV

SEQ ID NO: 2938748 - protein, 28 aa, Entamoeba invadens
GDATSDLPCMSRIFLPGITDLVVVNHKV

SEQ ID NO: 2938749 - protein, 23 aa, Entamoeba invadens
GDAVCPLPTFDKALETPIINNTN

SEQ ID NO: 2938750 - protein, 24 aa, Entamoeba invadens
GDAYTLRHNCIFVNFMKMVYDEKN

SEQ ID NO: 2938751 - protein, 20 aa, Entamoeba invadens
GDCCFYECSNLSSIIIPPSV

SEQ ID NO: 2938752 - protein, 18 aa, Entamoeba invadens
GDCDGCIMNTLKFSKDDV

SEQ ID NO: 2938753 - protein, 19 aa, Entamoeba invadens
GDCDLKYSNSEDVIMTFGN

SEQ ID NO: 2938754 - protein, 19 aa, Entamoeba invadens
GDCSSLVVIFALSPFLRMV

SEQ ID NO: 2938755 - protein, 18 aa, Entamoeba invadens
GDCVAKFCCINKIDMIAR

SEQ ID NO: 2938756 - protein, 17 aa, Entamoeba invadens
GDDCFFMCFNLDNVIIP

SEQ ID NO: 2938757 - protein, 17 aa, Entamoeba invadens
GDDCFSYLCSLRSVTIP

SEQ ID NO: 2938758 - protein, 23 aa, Entamoeba invadens
GDDCPRSVFPTVVGVPKTLIKMI

SEQ ID NO: 2938759 - protein, 27 aa, Entamoeba invadens
GDDDGMILAVRWAFYIREKSGSISPSF

SEQ ID NO: 2938760 - protein, 25 aa, Entamoeba invadens
GDDFKELYLELKIKDVSRFKLQATR

SEQ ID NO: 2938761 - protein, 30 aa, Entamoeba invadens
GDDFLLSRMILFFKHCFKSECVDILVCTMG

SEQ ID NO: 2938762 - protein, 18 aa, Entamoeba invadens
GDDIPDYDSFIFIMEQNG

SEQ ID NO: 2938763 - protein, 22 aa, Entamoeba invadens
GDDLRIGYKNGVIKHTNILNGT

SEQ ID NO: 2938764 - protein, 18 aa, Entamoeba invadens
GDDPLKLIQFKNLQKAKI

SEQ ID NO: 2938765 - protein, 21 aa, Entamoeba invadens
GDDVILPFIQSWVAVFRNEYQ

SEQ ID NO: 2938766 - protein, 24 aa, Entamoeba invadens
GDEDILRNELKNFIKKQADKGNTL

SEQ ID NO: 2938767 - protein, 22 aa, Entamoeba invadens
GDEFKISPEFRLHHVEQFRVEK

SEQ ID NO: 2938768 - protein, 21 aa, Entamoeba invadens
GDEIFKQLIEFYKMRADFPQE

SEQ ID NO: 2938769 - protein, 17 aa, Entamoeba invadens
GDEIKLAPFMGTLTALS

SEQ ID NO: 2938770 - protein, 28 aa, Entamoeba invadens
GDEKGYESFPWFIKRAHSPSRGLYSVHI

SEQ ID NO: 2938771 - protein, 18 aa, Entamoeba invadens
GDEKRQLIKYGSFNTLQF

SEQ ID NO: 2938772 - protein, 18 aa, Entamoeba invadens
GDELVGVFRLSAGAQEMK

SEQ ID NO: 2938773 - protein, 24 aa, Entamoeba invadens
GDEYRYVVMNNLFPNTQFPLQFKF

SEQ ID NO: 2938774 - protein, 17 aa, Entamoeba invadens
GDFCFFTCVALSEFNFP

SEQ ID NO: 2938775 - protein, 19 aa, Entamoeba invadens
GDFCFGRCYNLDSIDISSS

SEQ ID NO: 2938776 - protein, 20 aa, Entamoeba invadens
GDFCFYKCINLTNVTIPSNV

SEQ ID NO: 2938777 - protein, 17 aa, Entamoeba invadens
GDFDEVFSLLKGKTDVL

SEQ ID NO: 2938778 - protein, 17 aa, Entamoeba invadens
GDFDIVFAAVKSKREDS

SEQ ID NO: 2938779 - protein, 28 aa, Entamoeba invadens
GDFDLLQAFEFCDFILKTSSPLYDAVLK

SEQ ID NO: 2938780 - protein, 28 aa, Entamoeba invadens
GDFELKFGVPASDTWNVISFSSKPVEVC

SEQ ID NO: 2938781 - protein, 27 aa, Entamoeba invadens
GDFGIEVICLLYALKIRSPKQIFLLRG

SEQ ID NO: 2938782 - protein, 20 aa, Entamoeba invadens
GDFIPRLFVLDSGFYGIYTH

SEQ ID NO: 2938783 - protein, 22 aa, Entamoeba invadens
GDFLITCQHKLPKEERSDGSGG

SEQ ID NO: 2938784 - protein, 28 aa, Entamoeba invadens
GDFLKELYKLYADYVLKDPFIILEMPIR

SEQ ID NO: 2938785 - protein, 17 aa, Entamoeba invadens
GDFLTHLIKVEGKTIKV

SEQ ID NO: 2938786 - protein, 20 aa, Entamoeba invadens
GDFNVFFSFFAPPYERQQKV

SEQ ID NO: 2938787 - protein, 19 aa, Entamoeba invadens
GDFPSRLGINPLAVYSHVP

SEQ ID NO: 2938788 - protein, 20 aa, Entamoeba invadens
GDFRFCGCNNLCSVTIPTSV

SEQ ID NO: 2938789 - protein, 26 aa, Entamoeba invadens
GDGAIDLAGCVKFNILPEQLAVNYAI

SEQ ID NO: 2938790 - protein, 20 aa, Entamoeba invadens
GDGCFCECCSLSSVTIPLGV

SEQ ID NO: 2938791 - protein, 20 aa, Entamoeba invadens
GDGDVEVGKMLIRKNVGVWN

SEQ ID NO: 2938792 - protein, 21 aa, Entamoeba invadens
GDGEMKSFASILCTKNVKERG

SEQ ID NO: 2938793 - protein, 21 aa, Entamoeba invadens
GDGEYSLPIYNGQPFEGYMSS

SEQ ID NO: 2938794 - protein, 27 aa, Entamoeba invadens
GDGHYDCIADFFLSRGISVIELTAIHR

SEQ ID NO: 2938795 - protein, 20 aa, Entamoeba invadens
GDGMYLTFDLLETIVTIENI

SEQ ID NO: 2938796 - protein, 26 aa, Entamoeba invadens
GDGRTCKKCHISNCLQCSEKEIMDPN

SEQ ID NO: 2938797 - protein, 30 aa, Entamoeba invadens
GDGRWWAKKRMLQFLRRRWESSPPTIEAID

SEQ ID NO: 2938798 - protein, 20 aa, Entamoeba invadens
GDGRYSVYVRKDCFEVMYKV

SEQ ID NO: 2938799 - protein, 18 aa, Entamoeba invadens
GDGSLRMFDLRALDHSTI

SEQ ID NO: 2938800 - protein, 18 aa, Entamoeba invadens
GDGSVYWLNTGDLKVNRK

SEQ ID NO: 2938801 - protein, 18 aa, Entamoeba invadens
GDGTFRLSSFGGKNKLFI

SEQ ID NO: 2938802 - protein, 19 aa, Entamoeba invadens
GDGTITWVLDEFLRHELHP

SEQ ID NO: 2938803 - protein, 24 aa, Entamoeba invadens
GDHCFLDCHSLIFVSFPKSVTHYG

SEQ ID NO: 2938804 - protein, 24 aa, Entamoeba invadens
GDHITIKVTLLFHQYATMGLTGQV

SEQ ID NO: 2938805 - protein, 20 aa, Entamoeba invadens
GDHSGARLLLNFPPNLQSGA

SEQ ID NO: 2938806 - protein, 26 aa, Entamoeba invadens
GDHYLSLYARFVYKDCTFEEKRLSIC

SEQ ID NO: 2938807 - protein, 24 aa, Entamoeba invadens
GDICDCHAYPAPKMRVVDERIRVV

SEQ ID NO: 2938808 - protein, 25 aa, Entamoeba invadens
GDIFDYQSAIAFFANTFLLKRMRNN

SEQ ID NO: 2938809 - protein, 20 aa, Entamoeba invadens
GDIFYEMNILDKSFQWAKEV

SEQ ID NO: 2938810 - protein, 25 aa, Entamoeba invadens
GDIHLKFIIQPFLHWPDTMMTVIEE

SEQ ID NO: 2938811 - protein, 25 aa, Entamoeba invadens
GDIIEMGNAILPIFERKGITMQLGD

SEQ ID NO: 2938812 - protein, 24 aa, Entamoeba invadens
GDIIKFSCVVGSIKNEDYFLGCVD

SEQ ID NO: 2938813 - protein, 17 aa, Entamoeba invadens
GDIKIHLKFEVRDDDVY

SEQ ID NO: 2938814 - protein, 20 aa, Entamoeba invadens
GDIKNIPIANQWKMVQEFDK

SEQ ID NO: 2938815 - protein, 21 aa, Entamoeba invadens
GDILKLFTLCEADVFAQRIFA

SEQ ID NO: 2938816 - protein, 19 aa, Entamoeba invadens
GDINVCLPSSLKRFEGYVP

SEQ ID NO: 2938817 - protein, 27 aa, Entamoeba invadens
GDITRGVIFIWNFLKQFQTEIGTDDAS

SEQ ID NO: 2938818 - protein, 18 aa, Entamoeba invadens
GDITRYVLRDVQKGYHTK

SEQ ID NO: 2938819 - protein, 20 aa, Entamoeba invadens
GDIVTLGIFPPSLWKLSLCD

SEQ ID NO: 2938820 - protein, 18 aa, Entamoeba invadens
GDIYIAEACAFMKRNCGV

SEQ ID NO: 2938821 - protein, 18 aa, Entamoeba invadens
GDIYRYGRNFLIPADRYS

SEQ ID NO: 2938822 - protein, 30 aa, Entamoeba invadens
GDKAEIIYKWCFRNCKSLKEITLPKNLCYI

SEQ ID NO: 2938823 - protein, 17 aa, Entamoeba invadens
GDKCFRGCNKLVSVTIP

SEQ ID NO: 2938824 - protein, 23 aa, Entamoeba invadens
GDKETVILIHLFLDPPVIIQNKA

SEQ ID NO: 2938825 - protein, 26 aa, Entamoeba invadens
GDKIEVCSGLEGFKHFPTAALNELCM

SEQ ID NO: 2938826 - protein, 26 aa, Entamoeba invadens
GDKIMNLFLFSFRFWDDEKVVLEWCE

SEQ ID NO: 2938827 - protein, 18 aa, Entamoeba invadens
GDKLLHLFLKPTPINMDK

SEQ ID NO: 2938828 - protein, 18 aa, Entamoeba invadens
GDKYFARPAIDQKGCGLK

SEQ ID NO: 2938829 - protein, 19 aa, Entamoeba invadens
GDLAWLEKNCMVYPQVDFE

SEQ ID NO: 2938830 - protein, 22 aa, Entamoeba invadens
GDLCFNRCCRLGSVLIPSSVTS

SEQ ID NO: 2938831 - protein, 20 aa, Entamoeba invadens
GDLFNIFTHPFISSEEETQK

SEQ ID NO: 2938832 - protein, 25 aa, Entamoeba invadens
GDLISFGGSDFIFWVGQAKPPKDIF

SEQ ID NO: 2938833 - protein, 21 aa, Entamoeba invadens
GDLIVDCPICGKHLPQKEIEK

SEQ ID NO: 2938834 - protein, 21 aa, Entamoeba invadens
GDLKAIVEFEGKKVLETRQKI

SEQ ID NO: 2938835 - protein, 20 aa, Entamoeba invadens
GDLKSKFVYLVHSEHPIIKR

SEQ ID NO: 2938836 - protein, 19 aa, Entamoeba invadens
GDLLSGSQMWGCENLNRRI

SEQ ID NO: 2938837 - protein, 22 aa, Entamoeba invadens
GDLPKSLLISSLKCLIKDDKHK

SEQ ID NO: 2938838 - protein, 21 aa, Entamoeba invadens
GDLPPKCPSTPSGVPPENKEE

SEQ ID NO: 2938839 - protein, 18 aa, Entamoeba invadens
GDLQRYVAIDALQADTHE

SEQ ID NO: 2938840 - protein, 36 aa, Entamoeba invadens
GDLQSQLCELLDFFFKRTVQVCVVKYEGFLEGIIED

SEQ ID NO: 2938841 - protein, 17 aa, Entamoeba invadens
GDLSNLVIPEFVKDLSV

SEQ ID NO: 2938842 - protein, 27 aa, Entamoeba invadens
GDLTENCFICGKFGHLKDDCPEADKAV

SEQ ID NO: 2938843 - protein, 18 aa, Entamoeba invadens
GDLTSWIKSVDMLRRLIL

SEQ ID NO: 2938844 - protein, 17 aa, Entamoeba invadens
GDLVQRGKTIIVVQSGE

SEQ ID NO: 2938845 - protein, 21 aa, Entamoeba invadens
GDLWLNLSVQGKLHINLDTLK

SEQ ID NO: 2938846 - protein, 17 aa, Entamoeba invadens
GDLWRRVYSALLDYDDQ

SEQ ID NO: 2938847 - protein, 17 aa, Entamoeba invadens
GDMQGNVRIWDTTQKEH

SEQ ID NO: 2938848 - protein, 17 aa, Entamoeba invadens
GDNCFEFCYSLQDIVIP

SEQ ID NO: 2938849 - protein, 26 aa, Entamoeba invadens
GDNGRWWKCNDKIVVEYNERRIKEDS

SEQ ID NO: 2938850 - protein, 23 aa, Entamoeba invadens
GDNLPGPYIKYFVQSIGAEGLFK

SEQ ID NO: 2938851 - protein, 26 aa, Entamoeba invadens
GDNMFPFGVTVSIVLDIFANRLSKIQ

SEQ ID NO: 2938852 - protein, 25 aa, Entamoeba invadens
GDNSRGVGMVHFLKTHVCNQSCIKL

SEQ ID NO: 2938853 - protein, 25 aa, Entamoeba invadens
GDPFRMMAGRVFRGHYCGAWSCRPS

SEQ ID NO: 2938854 - protein, 21 aa, Entamoeba invadens
GDPRVTEALMALMGIDTSNFE

SEQ ID NO: 2938855 - protein, 23 aa, Entamoeba invadens
GDPSCYKKLYSVDEVNALYRTMQ

SEQ ID NO: 2938856 - protein, 24 aa, Entamoeba invadens
GDQVPQHRSVLVFDEMKRFDITSD

SEQ ID NO: 2938857 - protein, 24 aa, Entamoeba invadens
GDQYRLPLYLTQIIIPNGVSQINS

SEQ ID NO: 2938858 - protein, 19 aa, Entamoeba invadens
GDRAIAIKTWVPLGKSVTF

SEQ ID NO: 2938859 - protein, 20 aa, Entamoeba invadens
GDRIVVCGMQGPIVTSIRAL

SEQ ID NO: 2938860 - protein, 20 aa, Entamoeba invadens
GDRKFILFVETEMYLHEFVK

SEQ ID NO: 2938861 - protein, 23 aa, Entamoeba invadens
GDRRVVDMIYLIFSNCAAGNLAC

SEQ ID NO: 2938862 - protein, 21 aa, Entamoeba invadens
GDSCFQGCCCLSSITIPSSVI

SEQ ID NO: 2938863 - protein, 19 aa, Entamoeba invadens
GDSCFQYCGSLSSITIPSS

SEQ ID NO: 2938864 - protein, 21 aa, Entamoeba invadens
GDSCFRQCHKLSSVTMPTDIS

SEQ ID NO: 2938865 - protein, 17 aa, Entamoeba invadens
GDSDMMMLFALKDLIGV

SEQ ID NO: 2938866 - protein, 22 aa, Entamoeba invadens
GDSGVGKTCLCQRYVNNGFTGG

SEQ ID NO: 2938867 - protein, 18 aa, Entamoeba invadens
GDSIFTLIDKFRLHSNMI

SEQ ID NO: 2938868 - protein, 23 aa, Entamoeba invadens
GDSIKGLTQYSVKKFAEAFQMVP

SEQ ID NO: 2938869 - protein, 20 aa, Entamoeba invadens
GDSIKKIQNGCIGRKTEENV

SEQ ID NO: 2938870 - protein, 24 aa, Entamoeba invadens
GDSKVCVINTLLIHSEGGTLCVDD

SEQ ID NO: 2938871 - protein, 19 aa, Entamoeba invadens
GDSKWVYVRHQFNGWGYIP

SEQ ID NO: 2938872 - protein, 18 aa, Entamoeba invadens
GDSLFNPQFKQIVRDFFA

SEQ ID NO: 2938873 - protein, 18 aa, Entamoeba invadens
GDSLPDYLPEGILKKLTK

SEQ ID NO: 2938874 - protein, 19 aa, Entamoeba invadens
GDSTFKATLKTIAEMKSHL

SEQ ID NO: 2938875 - protein, 20 aa, Entamoeba invadens
GDSVRWKGVLKVIEKKKGKD

SEQ ID NO: 2938876 - protein, 20 aa, Entamoeba invadens
GDTFVPILIYALLKANLPHL

SEQ ID NO: 2938877 - protein, 25 aa, Entamoeba invadens
GDTHLYSRFGFVQSIDYDVHSFFEC

SEQ ID NO: 2938878 - protein, 18 aa, Entamoeba invadens
GDTIFAAGGDGCMSTWSL

SEQ ID NO: 2938879 - protein, 20 aa, Entamoeba invadens
GDTKIALYGMSYKKGEEMNK

SEQ ID NO: 2938880 - protein, 23 aa, Entamoeba invadens
GDTLKMLLPHVAPYLNFTTDYQI

SEQ ID NO: 2938881 - protein, 21 aa, Entamoeba invadens
GDTLLHMLIILGYTNLVEMVI

SEQ ID NO: 2938882 - protein, 22 aa, Entamoeba invadens
GDTLLNRTIRFGPYHKDQNKYL

SEQ ID NO: 2938883 - protein, 20 aa, Entamoeba invadens
GDTPLLYAVRLQKNNFVIAL

SEQ ID NO: 2938884 - protein, 17 aa, Entamoeba invadens
GDVFGSFHSVVANGIGI

SEQ ID NO: 2938885 - protein, 24 aa, Entamoeba invadens
GDVFPMTTSVLFKTKRFAFCVATT

SEQ ID NO: 2938886 - protein, 23 aa, Entamoeba invadens
GDVGNKFLIPNLFINCGGLSIIS

SEQ ID NO: 2938887 - protein, 20 aa, Entamoeba invadens
GDVKKLLKIMARPIIHLNAI

SEQ ID NO: 2938888 - protein, 27 aa, Entamoeba invadens
GDVKKVYVCGGLLKVLQIGKCDEIKVS

SEQ ID NO: 2938889 - protein, 20 aa, Entamoeba invadens
GDVKLADFGFALKAQTCRGM

SEQ ID NO: 2938890 - protein, 19 aa, Entamoeba invadens
GDVKLSHMGCTIVENKIVF

SEQ ID NO: 2938891 - protein, 19 aa, Entamoeba invadens
GDVLLKFHLTTFVIPENFK

SEQ ID NO: 2938892 - protein, 20 aa, Entamoeba invadens
GDVLSMVIGMIAPRNAGEIA

SEQ ID NO: 2938893 - protein, 19 aa, Entamoeba invadens
GDVRRLRAMPQNRDVVVTS

SEQ ID NO: 2938894 - protein, 17 aa, Entamoeba invadens
GDVSGVITILSVKTSAL

SEQ ID NO: 2938895 - protein, 20 aa, Entamoeba invadens
GDVSVCRFFLGYIDDTDLHN

SEQ ID NO: 2938896 - protein, 18 aa, Entamoeba invadens
GDVVLYCIDMNSIDCNGV

SEQ ID NO: 2938897 - protein, 24 aa, Entamoeba invadens
GDVYYYRSCYKLSSITLPLSLQKI

SEQ ID NO: 2938898 - protein, 25 aa, Entamoeba invadens
GDWDYKPKLITSWRGIPKPVVSQAV

SEQ ID NO: 2938899 - protein, 27 aa, Entamoeba invadens
GDYAGNIILWDYFVNVPLITFTNTHNS

SEQ ID NO: 2938900 - protein, 17 aa, Entamoeba invadens
GDYANSFISSFQGDQSL

SEQ ID NO: 2938901 - protein, 19 aa, Entamoeba invadens
GDYCFSRCSSLSSVIISSN

SEQ ID NO: 2938902 - protein, 20 aa, Entamoeba invadens
GDYCFYKCKSLSSINISPIV

SEQ ID NO: 2938903 - protein, 23 aa, Entamoeba invadens
GDYCFYNCYGMKNVIIPSSVVSF

SEQ ID NO: 2938904 - protein, 21 aa, Entamoeba invadens
GDYCYMKELNLPSITIPNNVY

SEQ ID NO: 2938905 - protein, 17 aa, Entamoeba invadens
GDYHLPDPCSLVNTCGQ

SEQ ID NO: 2938906 - protein, 28 aa, Entamoeba invadens
GDYLLLQSFKTFFAYKRVNGKYVIHFTH

SEQ ID NO: 2938907 - protein, 24 aa, Entamoeba invadens
GDYRYKELFEFLNIEIISPDNYEN

SEQ ID NO: 2938908 - protein, 18 aa, Entamoeba invadens
GDYYRYYAEFTVDEKRQE

SEQ ID NO: 2938909 - protein, 17 aa, Entamoeba invadens
GEAKKQLEEKIKALEKE

SEQ ID NO: 2938910 - protein, 22 aa, Entamoeba invadens
GEALKGISLLPKRAVHVNQCEI

SEQ ID NO: 2938911 - protein, 18 aa, Entamoeba invadens
GEALSCMTYLAKVTITTR

SEQ ID NO: 2938912 - protein, 17 aa, Entamoeba invadens
GEAQFLLSVYQDAEKEF

SEQ ID NO: 2938913 - protein, 22 aa, Entamoeba invadens
GEASMTSHCNLLGKFGLQQEKK

SEQ ID NO: 2938914 - protein, 23 aa, Entamoeba invadens
GEASVLPPEYAIFLSQSQSLANL

SEQ ID NO: 2938915 - protein, 18 aa, Entamoeba invadens
GEAVCVRLMKRLKRCNER

SEQ ID NO: 2938916 - protein, 20 aa, Entamoeba invadens
GEAVGGYTIVCRIGQGTFGS

SEQ ID NO: 2938917 - protein, 22 aa, Entamoeba invadens
GEAVVFPFGFHCTGMPIKACAD

SEQ ID NO: 2938918 - protein, 19 aa, Entamoeba invadens
GECDCRVRCPLCDYEKRDR

SEQ ID NO: 2938919 - protein, 24 aa, Entamoeba invadens
GECEKRLEDIGKIYDIIDENELDL

SEQ ID NO: 2938920 - protein, 21 aa, Entamoeba invadens
GECLMIPLLNLERCWAYANDL

SEQ ID NO: 2938921 - protein, 22 aa, Entamoeba invadens
GECNKLTKISFCNRLNKSDNSN

SEQ ID NO: 2938922 - protein, 17 aa, Entamoeba invadens
GEDADLLLLSLTLHTDN

SEQ ID NO: 2938923 - protein, 26 aa, Entamoeba invadens
GEDCFKNCKKLSAITFGEELSAVGHN

SEQ ID NO: 2938924 - protein, 22 aa, Entamoeba invadens
GEDLITCSFYDKKIVMWKKQEE

SEQ ID NO: 2938925 - protein, 23 aa, Entamoeba invadens
GEDNVVWMLLGCKCDDQIKVDEE

SEQ ID NO: 2938926 - protein, 22 aa, Entamoeba invadens
GEDRVHFLSGYVDPQGGVVYEI

SEQ ID NO: 2938927 - protein, 22 aa, Entamoeba invadens
GEEAKAAGAVCLVNTYVTDVEN

SEQ ID NO: 2938928 - protein, 27 aa, Entamoeba invadens
GEEDKIKIVGFEALNHIDEMEITEIYC

SEQ ID NO: 2938929 - protein, 17 aa, Entamoeba invadens
GEEDLMFTLMVEVKEEK

SEQ ID NO: 2938930 - protein, 23 aa, Entamoeba invadens
GEEKEALCGKVIPNYFALQRLVI

SEQ ID NO: 2938931 - protein, 19 aa, Entamoeba invadens
GEELHAISHFTFIIIYDKK

SEQ ID NO: 2938932 - protein, 23 aa, Entamoeba invadens
GEEMKFGIPVLFIGTHADIAQKE

SEQ ID NO: 2938933 - protein, 17 aa, Entamoeba invadens
GEERTKQLLSFGKDKPK

SEQ ID NO: 2938934 - protein, 23 aa, Entamoeba invadens
GEERTPIFLKLEEVVFGSFCSMK

SEQ ID NO: 2938935 - protein, 17 aa, Entamoeba invadens
GEETPTFVAKRMVTQAS

SEQ ID NO: 2938936 - protein, 28 aa, Entamoeba invadens
GEEYFRFLWELRLLFNKEMTQLQDLQMG

SEQ ID NO: 2938937 - protein, 23 aa, Entamoeba invadens
GEEYTLVCAVYFALKYCGKRGAV

SEQ ID NO: 2938938 - protein, 25 aa, Entamoeba invadens
GEFDVICATIAFGMGINKPDVRFVI

SEQ ID NO: 2938939 - protein, 24 aa, Entamoeba invadens
GEFEKRYIPTMGVDVHPMLFQTNC

SEQ ID NO: 2938940 - protein, 17 aa, Entamoeba invadens
GEFNSIYIGDCQTITLR

SEQ ID NO: 2938941 - protein, 19 aa, Entamoeba invadens
GEFPDFGLVIEKAIDNLME

SEQ ID NO: 2938942 - protein, 17 aa, Entamoeba invadens
GEFRHRGPLFVKRMNEN

SEQ ID NO: 2938943 - protein, 23 aa, Entamoeba invadens
GEFSGGRVCIGASFPFPTTGAAK

SEQ ID NO: 2938944 - protein, 25 aa, Entamoeba invadens
GEGDAKSWVEWILRSLNHVKLSVQQ

SEQ ID NO: 2938945 - protein, 17 aa, Entamoeba invadens
GEGDIFIGVPMPKIREI

SEQ ID NO: 2938946 - protein, 26 aa, Entamoeba invadens
GEGFLALRYAMEYNDVLSFVEYPSKM

SEQ ID NO: 2938947 - protein, 19 aa, Entamoeba invadens
GEGIFYYYTYNAFGGWVPS

SEQ ID NO: 2938948 - protein, 28 aa, Entamoeba invadens
GEGIKKPKLRAAMSILKGEVKDTLFKNF

SEQ ID NO: 2938949 - protein, 24 aa, Entamoeba invadens
GEGKRSGVYGAFLLACYNEDDDCY

SEQ ID NO: 2938950 - protein, 21 aa, Entamoeba invadens
GEGMKRGWESFSSKMFNDGIG

SEQ ID NO: 2938951 - protein, 21 aa, Entamoeba invadens
GEGMSGVVYHCYDSMNKKEVA

SEQ ID NO: 2938952 - protein, 20 aa, Entamoeba invadens
GEGQIEFKMKGSKLGVFGEY

SEQ ID NO: 2938953 - protein, 18 aa, Entamoeba invadens
GEGQIVLAYKRAWETKAP

SEQ ID NO: 2938954 - protein, 25 aa, Entamoeba invadens
GEGSFGIVFKGMFKGNSVAIKKMKI

SEQ ID NO: 2938955 - protein, 26 aa, Entamoeba invadens
GEGSFGIVFKGMFRNNVVAIKKMKIG

SEQ ID NO: 2938956 - protein, 23 aa, Entamoeba invadens
GEGSFGIVFLGEFRGNKVAIKKM

SEQ ID NO: 2938957 - protein, 25 aa, Entamoeba invadens
GEGSVGKSSLCLMFVKGEFNIEYNP

SEQ ID NO: 2938958 - protein, 23 aa, Entamoeba invadens
GEHLGEIVTFIFEALKDQAVDVL

SEQ ID NO: 2938959 - protein, 27 aa, Entamoeba invadens
GEIAEMRSRLAVLFVIYKMGLSETNKA

SEQ ID NO: 2938960 - protein, 17 aa, Entamoeba invadens
GEIAFSCLTKLDRMNLI

SEQ ID NO: 2938961 - protein, 26 aa, Entamoeba invadens
GEIAKVCGAVCRHIYLSDKIALKNGY

SEQ ID NO: 2938962 - protein, 17 aa, Entamoeba invadens
GEIFGFYQNDLVCPQSN

SEQ ID NO: 2938963 - protein, 22 aa, Entamoeba invadens
GEIKSFCFSNCVALRTIDIPEG

SEQ ID NO: 2938964 - protein, 17 aa, Entamoeba invadens
GEIKVKILLNNEKVAKS

SEQ ID NO: 2938965 - protein, 27 aa, Entamoeba invadens
GEIMRILGLCSICFAFKDITYVFKNKT

SEQ ID NO: 2938966 - protein, 22 aa, Entamoeba invadens
GEINDICWELPHIAIATNEGAL

SEQ ID NO: 2938967 - protein, 20 aa, Entamoeba invadens
GEINGNLVILTRRNPKTHKV

SEQ ID NO: 2938968 - protein, 17 aa, Entamoeba invadens
GEITFSCLTKIERMYLI

SEQ ID NO: 2938969 - protein, 20 aa, Entamoeba invadens
GEITLFVDLHVENCKADLSH

SEQ ID NO: 2938970 - protein, 19 aa, Entamoeba invadens
GEIVKARLSAEQIRALKRC

SEQ ID NO: 2938971 - protein, 19 aa, Entamoeba invadens
GEIVKLAISDVLPWICDNQ

SEQ ID NO: 2938972 - protein, 17 aa, Entamoeba invadens
GEIYLKTTAGFKRYYKE

SEQ ID NO: 2938973 - protein, 18 aa, Entamoeba invadens
GEIYSIRIKYFNKSPTDV

SEQ ID NO: 2938974 - protein, 17 aa, Entamoeba invadens
GEKCFKNCFKLKEVILP

SEQ ID NO: 2938975 - protein, 19 aa, Entamoeba invadens
GEKCFNWCSYLSNITIPLS

SEQ ID NO: 2938976 - protein, 17 aa, Entamoeba invadens
GEKCFYFNTTLINLTVP

SEQ ID NO: 2938977 - protein, 18 aa, Entamoeba invadens
GEKCKKCEEKLLVDTVKD

SEQ ID NO: 2938978 - protein, 19 aa, Entamoeba invadens
GEKCLKTSFFQWSPDNTAA

SEQ ID NO: 2938979 - protein, 22 aa, Entamoeba invadens
GEKDVKILLATLSEQIPQHSLE

SEQ ID NO: 2938980 - protein, 31 aa, Entamoeba invadens
GEKEEFCITAEPCARVKLEVECMSGVYHNVP

SEQ ID NO: 2938981 - protein, 23 aa, Entamoeba invadens
GEKEKHISLNLGDLSDELIKEIN

SEQ ID NO: 2938982 - protein, 24 aa, Entamoeba invadens
GEKEKTRLGMLFIMNNYAFIMNVC

SEQ ID NO: 2938983 - protein, 26 aa, Entamoeba invadens
GEKIKPCFICGSLTHKTLTCPQHKAQ

SEQ ID NO: 2938984 - protein, 22 aa, Entamoeba invadens
GEKKDILNFIEKVQIEKWSSCK

SEQ ID NO: 2938985 - protein, 22 aa, Entamoeba invadens
GEKLWNIIAMCFETDPEKRPTF

SEQ ID NO: 2938986 - protein, 21 aa, Entamoeba invadens
GEKLWNIIAMCFETNPEKRPT

SEQ ID NO: 2938987 - protein, 24 aa, Entamoeba invadens
GEKPFKFDLNMMKEQLVNCIDGTQ

SEQ ID NO: 2938988 - protein, 22 aa, Entamoeba invadens
GEKPFKFDLNMMKEQLVNCVDG

SEQ ID NO: 2938989 - protein, 18 aa, Entamoeba invadens
GEKQRIGRNYDFMEVVRW

SEQ ID NO: 2938990 - protein, 23 aa, Entamoeba invadens
GEKRAYDMLCEFLLEKSTQPTLT

SEQ ID NO: 2938991 - protein, 21 aa, Entamoeba invadens
GEKRIKLQIWDTAGQERFMNI

SEQ ID NO: 2938992 - protein, 29 aa, Entamoeba invadens
GEKRKWLIWKDYAETLARMELRDLSVKAY

SEQ ID NO: 2938993 - protein, 22 aa, Entamoeba invadens
GEKSEALTLVFDKSRLQKTKKK

SEQ ID NO: 2938994 - protein, 18 aa, Entamoeba invadens
GEKSFKLASEKVAQFEAD

SEQ ID NO: 2938995 - protein, 25 aa, Entamoeba invadens
GEKTLSSLALIFALHHYRPTPIYVM

SEQ ID NO: 2938996 - protein, 19 aa, Entamoeba invadens
GEKVFKIPKNVEVIEIGAF

SEQ ID NO: 2938997 - protein, 31 aa, Entamoeba invadens
GEKVYFAKTLRPGRCDGCDKVAEVISKIVTS

SEQ ID NO: 2938998 - protein, 22 aa, Entamoeba invadens
GELCGGNKNFPGSQPGESPDVP

SEQ ID NO: 2938999 - protein, 17 aa, Entamoeba invadens
GELCGNVMVGVRNIEIA

SEQ ID NO: 2939000 - protein, 21 aa, Entamoeba invadens
GELDVSLKFEGMELTEVYPKT

SEQ ID NO: 2939001 - protein, 21 aa, Entamoeba invadens
GELDVSLKFEGMEVTEVYPKT

SEQ ID NO: 2939002 - protein, 21 aa, Entamoeba invadens
GELEGSFGYHVPSGIVLKEGH

SEQ ID NO: 2939003 - protein, 17 aa, Entamoeba invadens
GELEMVRFGVPNQPHTV

SEQ ID NO: 2939004 - protein, 20 aa, Entamoeba invadens
GELFHKLEIETSLKEDTAKF

SEQ ID NO: 2939005 - protein, 24 aa, Entamoeba invadens
GELHKLFVQFPCDLTIELKNEEKR

SEQ ID NO: 2939006 - protein, 17 aa, Entamoeba invadens
GELKRYGPDKGNIPKAL

SEQ ID NO: 2939007 - protein, 17 aa, Entamoeba invadens
GELKVWDFRTFDFPIAT

SEQ ID NO: 2939008 - protein, 23 aa, Entamoeba invadens
GELKWNCLCGWVGKESVKLSISK

SEQ ID NO: 2939009 - protein, 27 aa, Entamoeba invadens
GELLETGHDIIFFWVARMVMMSLELTD

SEQ ID NO: 2939010 - protein, 21 aa, Entamoeba invadens
GELLFALAGCCLKNIEKDPKE

SEQ ID NO: 2939011 - protein, 18 aa, Entamoeba invadens
GELLITCDDKGYLFNVYR

SEQ ID NO: 2939012 - protein, 18 aa, Entamoeba invadens
GELMGNTISVIFKSATNA

SEQ ID NO: 2939013 - protein, 19 aa, Entamoeba invadens
GELMMKYKKDGVLLNLEVD

SEQ ID NO: 2939014 - protein, 32 aa, Entamoeba invadens
GELPLHEGLVFTCLSCESFCCNKLGYDKDGKM

SEQ ID NO: 2939015 - protein, 18 aa, Entamoeba invadens
GELPPVYFQVLKALIEFL

SEQ ID NO: 2939016 - protein, 20 aa, Entamoeba invadens
GELREHICVSIARHTKKVLG

SEQ ID NO: 2939017 - protein, 22 aa, Entamoeba invadens
GELRSMKDFTVPRLREDLKTIT

SEQ ID NO: 2939018 - protein, 26 aa, Entamoeba invadens
GELYACFLTTFVFDIGWLLREVPILK

SEQ ID NO: 2939019 - protein, 17 aa, Entamoeba invadens
GEMKESLDALINESAAF

SEQ ID NO: 2939020 - protein, 25 aa, Entamoeba invadens
GEMLTIPLWTGYYLKYSHPDIARLR

SEQ ID NO: 2939021 - protein, 19 aa, Entamoeba invadens
GEMVFKEKATLLFVGEEDD

SEQ ID NO: 2939022 - protein, 19 aa, Entamoeba invadens
GENCFEMCSSLTFDGLTHL

SEQ ID NO: 2939023 - protein, 25 aa, Entamoeba invadens
GENCFRECPHLSSITLSSNVQTIGH

SEQ ID NO: 2939024 - protein, 30 aa, Entamoeba invadens
GENDPNRCCKACFFNNFIPGYDCKIADACL

SEQ ID NO: 2939025 - protein, 24 aa, Entamoeba invadens
GENENLPGWGEWSNQATVTKKVNQ

SEQ ID NO: 2939026 - protein, 21 aa, Entamoeba invadens
GENILMVAIKLGFNDICEEIM

SEQ ID NO: 2939027 - protein, 17 aa, Entamoeba invadens
GENLAYFPKGFIENMFF

SEQ ID NO: 2939028 - protein, 24 aa, Entamoeba invadens
GENLNIKMGQIWKELSEDEKKVYT

SEQ ID NO: 2939029 - protein, 20 aa, Entamoeba invadens
GENVTFLPPFHCDYGKYITV

SEQ ID NO: 2939030 - protein, 18 aa, Entamoeba invadens
GENWKWENQDGGIGGRGV

SEQ ID NO: 2939031 - protein, 23 aa, Entamoeba invadens
GENYKGIGTVEHFFGINKDEHVK

SEQ ID NO: 2939032 - protein, 18 aa, Entamoeba invadens
GEPDAASCLLRRYINRKE

SEQ ID NO: 2939033 - protein, 26 aa, Entamoeba invadens
GEPIEGYITLCFDDPIFVTSIAVELS

SEQ ID NO: 2939034 - protein, 24 aa, Entamoeba invadens
GEPKICVYSHFAMVNPFLTMDMSY

SEQ ID NO: 2939035 - protein, 21 aa, Entamoeba invadens
GEPKTTFVIVLTFLKMSLQNE

SEQ ID NO: 2939036 - protein, 23 aa, Entamoeba invadens
GEPLLRPDIIYEVMDMIPHAEFI

SEQ ID NO: 2939037 - protein, 25 aa, Entamoeba invadens
GEPRMCLGVNCGFGDPVDVTVTKEF

SEQ ID NO: 2939038 - protein, 21 aa, Entamoeba invadens
GEPSFGNQNMEGMKALKDLED

SEQ ID NO: 2939039 - protein, 17 aa, Entamoeba invadens
GEQEIHVDLGIIEVKTC

SEQ ID NO: 2939040 - protein, 24 aa, Entamoeba invadens
GEQFDCPLCSKIHTLDEVYNPQTQ

SEQ ID NO: 2939041 - protein, 25 aa, Entamoeba invadens
GEQFVKELVKDFGDEINDIRLEAAK

SEQ ID NO: 2939042 - protein, 18 aa, Entamoeba invadens
GEQIDLMISKKCTGETIL

SEQ ID NO: 2939043 - protein, 17 aa, Entamoeba invadens
GERAEEGTFDWVQENTS

SEQ ID NO: 2939044 - protein, 17 aa, Entamoeba invadens
GERANLSLIRRLKKKQL

SEQ ID NO: 2939045 - protein, 24 aa, Entamoeba invadens
GERKWKLKMFNFKKNFGYLKEGAE

SEQ ID NO: 2939046 - protein, 18 aa, Entamoeba invadens
GERLVTCICDVLKAYHSA

SEQ ID NO: 2939047 - protein, 19 aa, Entamoeba invadens
GERRVLGVFANEFLGDIVN

SEQ ID NO: 2939048 - protein, 23 aa, Entamoeba invadens
GERSAMYDVEFIRGFIGNAKNIN

SEQ ID NO: 2939049 - protein, 23 aa, Entamoeba invadens
GERYRELWLDYFVLLCGQNNDSS

SEQ ID NO: 2939050 - protein, 20 aa, Entamoeba invadens
GESAFMYMVRLNTFPFPKKV

SEQ ID NO: 2939051 - protein, 22 aa, Entamoeba invadens
GESCFSGCIKLSKVELPESLTT

SEQ ID NO: 2939052 - protein, 26 aa, Entamoeba invadens
GESERGKCLSCLLAQTKKSSKNRRNK

SEQ ID NO: 2939053 - protein, 20 aa, Entamoeba invadens
GESEVRWLNIIKKISVDNEE

SEQ ID NO: 2939054 - protein, 17 aa, Entamoeba invadens
GESFLYYTLSNLVLHNF

SEQ ID NO: 2939055 - protein, 19 aa, Entamoeba invadens
GESIYRLAEEISKKHPEYN

SEQ ID NO: 2939056 - protein, 24 aa, Entamoeba invadens
GESLSCPFCKSGGILVDKEVFTHP

SEQ ID NO: 2939057 - protein, 19 aa, Entamoeba invadens
GESNGFGYVKYRTLEATQA

SEQ ID NO: 2939058 - protein, 29 aa, Entamoeba invadens
GESRICKVYDSPCLPESEAAFSITDGGIG

SEQ ID NO: 2939059 - protein, 20 aa, Entamoeba invadens
GESTFKLLSIANRLRSKGFI

SEQ ID NO: 2939060 - protein, 24 aa, Entamoeba invadens
GESTFRLEFMYDGFSYQNSTFHNS

SEQ ID NO: 2939061 - protein, 23 aa, Entamoeba invadens
GETCGKYVIGPVRTWMEQNKTAL

SEQ ID NO: 2939062 - protein, 20 aa, Entamoeba invadens
GETLYFCPKCQQRYTESEAI

SEQ ID NO: 2939063 - protein, 32 aa, Entamoeba invadens
GETPLHLACLCGYKGIIESLTFALSMTDVTVS

SEQ ID NO: 2939064 - protein, 20 aa, Entamoeba invadens
GETPLILALKRNHISCAEVL

SEQ ID NO: 2939065 - protein, 26 aa, Entamoeba invadens
GETVAECLRCLSLMCRSKNAIPAIAS

SEQ ID NO: 2939066 - protein, 23 aa, Entamoeba invadens
GEVDFPMNLVCHVVPIGEFGKMN

SEQ ID NO: 2939067 - protein, 27 aa, Entamoeba invadens
GEVEKVWPWGCSHMMSGLQGWNNNTKT

SEQ ID NO: 2939068 - protein, 30 aa, Entamoeba invadens
GEVGEGCGFKGIKNGIAYQFFVGTNSDNEF

SEQ ID NO: 2939069 - protein, 33 aa, Entamoeba invadens
GEVGSLPLVFPIPVRRDLHYFVAYQVGDVKGKE

SEQ ID NO: 2939070 - protein, 20 aa, Entamoeba invadens
GEVIAVPSFFIIYSNQDSYI

SEQ ID NO: 2939071 - protein, 35 aa, Entamoeba invadens
GEVIVAWKKKWKYRIDWSLILEFSHPQLLNEGERT

SEQ ID NO: 2939072 - protein, 19 aa, Entamoeba invadens
GEVKELFSSITRLEYQQII

SEQ ID NO: 2939073 - protein, 17 aa, Entamoeba invadens
GEVKYSEVCFEETKQKI

SEQ ID NO: 2939074 - protein, 17 aa, Entamoeba invadens
GEVNRAKESYWCSSGKG

SEQ ID NO: 2939075 - protein, 22 aa, Entamoeba invadens
GEWTCHFCSTKNTVSGILPEEI

SEQ ID NO: 2939076 - protein, 27 aa, Entamoeba invadens
GEYCFFNCSKMCFPVEFTHTTYIGKFA

SEQ ID NO: 2939077 - protein, 21 aa, Entamoeba invadens
GEYLVTGSFMIRGKKNYLPPA

SEQ ID NO: 2939078 - protein, 18 aa, Entamoeba invadens
GEYMYLLAQINFSEMPAL

SEQ ID NO: 2939079 - protein, 17 aa, Entamoeba invadens
GEYPLHFAARSGDFETT

SEQ ID NO: 2939080 - protein, 23 aa, Entamoeba invadens
GEYRPEIEKMYSLKYLVIDERKK

SEQ ID NO: 2939081 - protein, 18 aa, Entamoeba invadens
GEYSFGIVYKETFRGNCV

SEQ ID NO: 2939082 - protein, 17 aa, Entamoeba invadens
GEYTLNFHIQPFLHWPD

SEQ ID NO: 2939083 - protein, 17 aa, Entamoeba invadens
GEYTPVIYQEHRDEMVK

SEQ ID NO: 2939084 - protein, 22 aa, Entamoeba invadens
GEYTRMAPLRICSFDIECVSAK

SEQ ID NO: 2939085 - protein, 19 aa, Entamoeba invadens
GEYYFKREVLKKWVNETLI

SEQ ID NO: 2939086 - protein, 19 aa, Entamoeba invadens
GFAAFGPTDCRGIISWQHI

SEQ ID NO: 2939087 - protein, 18 aa, Entamoeba invadens
GFAKEVLTLIAQFLQQNE

SEQ ID NO: 2939088 - protein, 17 aa, Entamoeba invadens
GFALPRALQGHVESIIK

SEQ ID NO: 2939089 - protein, 17 aa, Entamoeba invadens
GFALRNGKCLKIENREY

SEQ ID NO: 2939090 - protein, 24 aa, Entamoeba invadens
GFCDRKEYIGWNIPDPLCLMCYLF

SEQ ID NO: 2939091 - protein, 17 aa, Entamoeba invadens
GFCKLCTKLETVVSPNG

SEQ ID NO: 2939092 - protein, 18 aa, Entamoeba invadens
GFCLDCYEEVTNTDNYVQ

SEQ ID NO: 2939093 - protein, 17 aa, Entamoeba invadens
GFCSQCLVNYTVTSPIS

SEQ ID NO: 2939094 - protein, 23 aa, Entamoeba invadens
GFCSSCIDGAILINNSCSVCYEG

SEQ ID NO: 2939095 - protein, 19 aa, Entamoeba invadens
GFDDCLNSLVLKIWEVYVG

SEQ ID NO: 2939096 - protein, 21 aa, Entamoeba invadens
GFDERVCSIVDILLKQKDTAC

SEQ ID NO: 2939097 - protein, 20 aa, Entamoeba invadens
GFDLEMISTIYSKRFGMKTD

SEQ ID NO: 2939098 - protein, 18 aa, Entamoeba invadens
GFDQVFFMKNLKEFGFGV

SEQ ID NO: 2939099 - protein, 19 aa, Entamoeba invadens
GFDRRMYGNYIFSIKNQRI

SEQ ID NO: 2939100 - protein, 23 aa, Entamoeba invadens
GFDVKMGMARFEFVVENKNKKAK

SEQ ID NO: 2939101 - protein, 24 aa, Entamoeba invadens
GFDVKRKEVFFTLNGKVLPSIKVT

SEQ ID NO: 2939102 - protein, 28 aa, Entamoeba invadens
GFEEGLKLTVDWYLSHKKNWERTDEALV

SEQ ID NO: 2939103 - protein, 20 aa, Entamoeba invadens
GFEGDCCFYNKLENVVDNSF

SEQ ID NO: 2939104 - protein, 18 aa, Entamoeba invadens
GFEHPKGMFVIPLKNPIS

SEQ ID NO: 2939105 - protein, 19 aa, Entamoeba invadens
GFEIECIQAHLVVDVTPGK

SEQ ID NO: 2939106 - protein, 22 aa, Entamoeba invadens
GFETRTGIMVARQFNSLFSQKP

SEQ ID NO: 2939107 - protein, 19 aa, Entamoeba invadens
GFEVDVCLGLTYNKNNYIF

SEQ ID NO: 2939108 - protein, 22 aa, Entamoeba invadens
GFFPESRQIAVSQLEVISNGQE

SEQ ID NO: 2939109 - protein, 17 aa, Entamoeba invadens
GFFSGLYQMIFHPIDFF

SEQ ID NO: 2939110 - protein, 25 aa, Entamoeba invadens
GFGCECFGRGCGIESIVVTPNICVS

SEQ ID NO: 2939111 - protein, 23 aa, Entamoeba invadens
GFGETRKGILQDIGIITGATVIS

SEQ ID NO: 2939112 - protein, 26 aa, Entamoeba invadens
GFGLNGCTNLRCLTFAGDNNIFNNKL

SEQ ID NO: 2939113 - protein, 19 aa, Entamoeba invadens
GFGNNRNSFGFIGQPERRN

SEQ ID NO: 2939114 - protein, 30 aa, Entamoeba invadens
GFGRIGRLVARVILSRPEFELVALNDPFMD

SEQ ID NO: 2939115 - protein, 25 aa, Entamoeba invadens
GFGRIGRLVARVILTRPEFDLVALN

SEQ ID NO: 2939116 - protein, 26 aa, Entamoeba invadens
GFGRIGRLVARVILTRPEFELVALND

SEQ ID NO: 2939117 - protein, 27 aa, Entamoeba invadens
GFGRIGRLVARVILTRPEFELVALNDP

SEQ ID NO: 2939118 - protein, 18 aa, Entamoeba invadens
GFHLRNAFEKEYKIIQEY

SEQ ID NO: 2939119 - protein, 18 aa, Entamoeba invadens
GFIECRRVYVKVTVFSGV

SEQ ID NO: 2939120 - protein, 17 aa, Entamoeba invadens
GFIEMIHMHLLASFAYR

SEQ ID NO: 2939121 - protein, 26 aa, Entamoeba invadens
GFIKGEFQASPSFAYDGEKTFEAPTT

SEQ ID NO: 2939122 - protein, 25 aa, Entamoeba invadens
GFIPIKEMFYTLSLAGDLFDNAAPF

SEQ ID NO: 2939123 - protein, 20 aa, Entamoeba invadens
GFLEACCRGLKAGLLTESEY

SEQ ID NO: 2939124 - protein, 19 aa, Entamoeba invadens
GFLFLRFINPALVSPQRFG

SEQ ID NO: 2939125 - protein, 27 aa, Entamoeba invadens
GFLHKKEMYYTLCLTDYLVKQAKDFRP

SEQ ID NO: 2939126 - protein, 18 aa, Entamoeba invadens
GFLISVLALNGFEVKMNK

SEQ ID NO: 2939127 - protein, 24 aa, Entamoeba invadens
GFLIYRFAMEKHMMINFVQPEKWG

SEQ ID NO: 2939128 - protein, 24 aa, Entamoeba invadens
GFLNEMSRLLFVKKSVVDDLVNNV

SEQ ID NO: 2939129 - protein, 24 aa, Entamoeba invadens
GFLSDWRFKKVLNETLKNILMNNE

SEQ ID NO: 2939130 - protein, 24 aa, Entamoeba invadens
GFLSEKSLRAFLTHKFTRGIEWKQ

SEQ ID NO: 2939131 - protein, 22 aa, Entamoeba invadens
GFLYHCLTPLFNEILEKKIKLK

SEQ ID NO: 2939132 - protein, 29 aa, Entamoeba invadens
GFLYPMTDCFIFLYKRIKIAPFKEINSVD

SEQ ID NO: 2939133 - protein, 18 aa, Entamoeba invadens
GFMAFLRCELLKKIKSQQ

SEQ ID NO: 2939134 - protein, 29 aa, Entamoeba invadens
GFMLSELSYKCKAFRDIVQLILRSVSPCL

SEQ ID NO: 2939135 - protein, 34 aa, Entamoeba invadens
GFMLSELSYKCKAFRDIVQLILRSVSPCLNSVYV

SEQ ID NO: 2939136 - protein, 18 aa, Entamoeba invadens
GFNCSKRSIDILIKLNSA

SEQ ID NO: 2939137 - protein, 21 aa, Entamoeba invadens
GFNEVELFLFNEGILKQENGV

SEQ ID NO: 2939138 - protein, 22 aa, Entamoeba invadens
GFNTVRMYLHYLMFESDLSPYQ

SEQ ID NO: 2939139 - protein, 24 aa, Entamoeba invadens
GFNTVRMYLHYLMFESDTLPYQYK

SEQ ID NO: 2939140 - protein, 17 aa, Entamoeba invadens
GFPTDFTCDALKSIFSV

SEQ ID NO: 2939141 - protein, 19 aa, Entamoeba invadens
GFQCFFRCFSLQSILIPDG

SEQ ID NO: 2939142 - protein, 21 aa, Entamoeba invadens
GFQTRSKRISLINNRVTRLVT

SEQ ID NO: 2939143 - protein, 26 aa, Entamoeba invadens
GFRKIREIMLTKKLTSIIADENVFLV

SEQ ID NO: 2939144 - protein, 18 aa, Entamoeba invadens
GFRPTHDLAITTSHKHGG

SEQ ID NO: 2939145 - protein, 24 aa, Entamoeba invadens
GFSAGELTSLFIPSSLVLSDTVSV

SEQ ID NO: 2939146 - protein, 21 aa, Entamoeba invadens
GFSDLCGFLILVMQKEEDVYW

SEQ ID NO: 2939147 - protein, 17 aa, Entamoeba invadens
GFSGDTYLVQNVRGKRI

SEQ ID NO: 2939148 - protein, 21 aa, Entamoeba invadens
GFSMWCQNVYYPYLNQQRQLI

SEQ ID NO: 2939149 - protein, 23 aa, Entamoeba invadens
GFSPRLFNKWNYDEVHVPDMSLV

SEQ ID NO: 2939150 - protein, 18 aa, Entamoeba invadens
GFSTYFKCRAFKTSINGD

SEQ ID NO: 2939151 - protein, 19 aa, Entamoeba invadens
GFSVLLKRDINNIGKEMAR

SEQ ID NO: 2939152 - protein, 26 aa, Entamoeba invadens
GFTFYQRFYAKWGWDMSTVPQHVDDN

SEQ ID NO: 2939153 - protein, 18 aa, Entamoeba invadens
GFTIKKENVVKCTYCQPT

SEQ ID NO: 2939154 - protein, 22 aa, Entamoeba invadens
GFTKELLKGFPTVVSEMSEQRL

SEQ ID NO: 2939155 - protein, 20 aa, Entamoeba invadens
GFTKVGILFSGYKGYHKFFN

SEQ ID NO: 2939156 - protein, 18 aa, Entamoeba invadens
GFTPDDIIGIEWGEYSIR

SEQ ID NO: 2939157 - protein, 18 aa, Entamoeba invadens
GFTTEAITYVLRKVSLVM

SEQ ID NO: 2939158 - protein, 24 aa, Entamoeba invadens
GFTTGCVNLALQYVSFVDSVADNG

SEQ ID NO: 2939159 - protein, 27 aa, Entamoeba invadens
GFVALKLTKRFVGGYIIGLRDRHLENM

SEQ ID NO: 2939160 - protein, 17 aa, Entamoeba invadens
GFVDGKCSQKFAEKGDG

SEQ ID NO: 2939161 - protein, 21 aa, Entamoeba invadens
GFVERFKSEFTKFTPESAKIS

SEQ ID NO: 2939162 - protein, 17 aa, Entamoeba invadens
GFVKFGVIIPTPTVYAV

SEQ ID NO: 2939163 - protein, 18 aa, Entamoeba invadens
GFVKISVLVPSPKQDLIL

SEQ ID NO: 2939164 - protein, 25 aa, Entamoeba invadens
GFVKSVYRMNYCKTLLSSLKSDDNV

SEQ ID NO: 2939165 - protein, 25 aa, Entamoeba invadens
GFVRAWSYKSGYYMKTTDKGTMFYY

SEQ ID NO: 2939166 - protein, 25 aa, Entamoeba invadens
GFVTQCLRISSFLMKSFPRLETLVC

SEQ ID NO: 2939167 - protein, 18 aa, Entamoeba invadens
GFYEEKLVEFILETKEKK

SEQ ID NO: 2939168 - protein, 30 aa, Entamoeba invadens
GFYSECLRDFSSLYPWNAFVSTFNVMPFAA

SEQ ID NO: 2939169 - protein, 19 aa, Entamoeba invadens
GGAFIKFIPFLKSYTQFAS

SEQ ID NO: 2939170 - protein, 33 aa, Entamoeba invadens
GGAVKTWKKRWFVLKENRLWYFASKTATSAKGF

SEQ ID NO: 2939171 - protein, 18 aa, Entamoeba invadens
GGAVVRRNGKIMSQSGIN

SEQ ID NO: 2939172 - protein, 18 aa, Entamoeba invadens
GGAVVRRNGNIMSQSGIN

SEQ ID NO: 2939173 - protein, 19 aa, Entamoeba invadens
GGAYSSVYLVRKRVTNDVY

SEQ ID NO: 2939174 - protein, 17 aa, Entamoeba invadens
GGCAICNSGYYREGISC

SEQ ID NO: 2939175 - protein, 19 aa, Entamoeba invadens
GGCAICRDGYFKVLKDCIV

SEQ ID NO: 2939176 - protein, 25 aa, Entamoeba invadens
GGCCRVCGSIHHLERDCPKKKEMRS

SEQ ID NO: 2939177 - protein, 19 aa, Entamoeba invadens
GGCESCPIGEYKFSETTCI

SEQ ID NO: 2939178 - protein, 20 aa, Entamoeba invadens
GGCFWCMVKPFDTYPGVKSV

SEQ ID NO: 2939179 - protein, 20 aa, Entamoeba invadens
GGCIGGYLARQAKNVTLIAR

SEQ ID NO: 2939180 - protein, 20 aa, Entamoeba invadens
GGCNIKGEFCSHVIMGEDLF

SEQ ID NO: 2939181 - protein, 17 aa, Entamoeba invadens
GGDFWRLLNRQPGKCFK

SEQ ID NO: 2939182 - protein, 33 aa, Entamoeba invadens
GGDGSMGFWDVFKFKAIGMLPPIANFASITAGC

SEQ ID NO: 2939183 - protein, 19 aa, Entamoeba invadens
GGDIFWWLRKLDFDNNVIN

SEQ ID NO: 2939184 - protein, 26 aa, Entamoeba invadens
GGDVILKFLLQSVVCCYCKRKMTFTT

SEQ ID NO: 2939185 - protein, 20 aa, Entamoeba invadens
GGEAIPYTRIETVKVGSTKD

SEQ ID NO: 2939186 - protein, 19 aa, Entamoeba invadens
GGEEKWWGSSGMEEISGQM

SEQ ID NO: 2939187 - protein, 24 aa, Entamoeba invadens
GGEKREVIPFGYAYPDDGKCTKQR

SEQ ID NO: 2939188 - protein, 25 aa, Entamoeba invadens
GGEKTIAALALLFAIQSFYPSPFFI

SEQ ID NO: 2939189 - protein, 22 aa, Entamoeba invadens
GGELRATAFNDMCDALYDTIQV

SEQ ID NO: 2939190 - protein, 22 aa, Entamoeba invadens
GGELSLDAGALVLADGGVCCID

SEQ ID NO: 2939191 - protein, 17 aa, Entamoeba invadens
GGESSFKLFKFGDGDVE

SEQ ID NO: 2939192 - protein, 26 aa, Entamoeba invadens
GGETCLRVKFFPERPKLMMTFLGEPV

SEQ ID NO: 2939193 - protein, 24 aa, Entamoeba invadens
GGFDEKLCLYVFWELLRKSDDKTL

SEQ ID NO: 2939194 - protein, 17 aa, Entamoeba invadens
GGFGGGMRMKKCCAAPM

SEQ ID NO: 2939195 - protein, 18 aa, Entamoeba invadens
GGFKCIYEQIPFICEGCY

SEQ ID NO: 2939196 - protein, 25 aa, Entamoeba invadens
GGFKDIIHIVSMLKATRSVLLRDRL

SEQ ID NO: 2939197 - protein, 21 aa, Entamoeba invadens
GGFKGKLFPINGRKPELFGMK

SEQ ID NO: 2939198 - protein, 20 aa, Entamoeba invadens
GGFKTDFFKNTSFKTTPAII

SEQ ID NO: 2939199 - protein, 24 aa, Entamoeba invadens
GGFLILRLICPAIVQPHKTGFCLE

SEQ ID NO: 2939200 - protein, 17 aa, Entamoeba invadens
GGFTFIYQWLLLLFKRE

SEQ ID NO: 2939201 - protein, 21 aa, Entamoeba invadens
GGGALCPSCGMAAERISGCNW

SEQ ID NO: 2939202 - protein, 23 aa, Entamoeba invadens
GGGASGESICYCNATTNNKCFCE

SEQ ID NO: 2939203 - protein, 20 aa, Entamoeba invadens
GGGCAICKDHYYKQKTDCIS

SEQ ID NO: 2939204 - protein, 20 aa, Entamoeba invadens
GGGCFQGCCSLSSVTIASYV

SEQ ID NO: 2939205 - protein, 18 aa, Entamoeba invadens
GGGIRNGMEIVKCLSYGS

SEQ ID NO: 2939206 - protein, 18 aa, Entamoeba invadens
GGGKMADGRCAACQVTNC

SEQ ID NO: 2939207 - protein, 20 aa, Entamoeba invadens
GGGKQMCGFGKSNSTINEVK

SEQ ID NO: 2939208 - protein, 22 aa, Entamoeba invadens
GGGTFWGLCCLLTNFKSFEEML

SEQ ID NO: 2939209 - protein, 20 aa, Entamoeba invadens
GGGYCPPSVPLQEQKNYPSL

SEQ ID NO: 2939210 - protein, 19 aa, Entamoeba invadens
GGHFCMVFELLSFNLYDLL

SEQ ID NO: 2939211 - protein, 25 aa, Entamoeba invadens
GGHNVWPIEICEVLNKHPKVQESAV

SEQ ID NO: 2939212 - protein, 18 aa, Entamoeba invadens
GGHSVFAFLYGNKMEMAN

SEQ ID NO: 2939213 - protein, 19 aa, Entamoeba invadens
GGIEINELSMKVLLDLDSY

SEQ ID NO: 2939214 - protein, 17 aa, Entamoeba invadens
GGIESNGNLKGIRPHDA

SEQ ID NO: 2939215 - protein, 25 aa, Entamoeba invadens
GGIFTFKNLVEFVNPMFIEEEEPYY

SEQ ID NO: 2939216 - protein, 18 aa, Entamoeba invadens
GGIGQCQKHLEGVVQEMG

SEQ ID NO: 2939217 - protein, 20 aa, Entamoeba invadens
GGIIGVTCIVDLKKVTSAVV

SEQ ID NO: 2939218 - protein, 20 aa, Entamoeba invadens
GGIKEIGNFCFKNHSDQYLT

SEQ ID NO: 2939219 - protein, 25 aa, Entamoeba invadens
GGIKKCPRCRAPVLKSYGCNKITCI

SEQ ID NO: 2939220 - protein, 18 aa, Entamoeba invadens
GGIKRLEKCIKLREQAKL

SEQ ID NO: 2939221 - protein, 30 aa, Entamoeba invadens
GGIQYRTIPQMMPGMTMGNMQPFQFVQQLP

SEQ ID NO: 2939222 - protein, 23 aa, Entamoeba invadens
GGIRLAPKTALRMMRIFDTDHNG

SEQ ID NO: 2939223 - protein, 17 aa, Entamoeba invadens
GGIYLSALCNNYFGFDY

SEQ ID NO: 2939224 - protein, 23 aa, Entamoeba invadens
GGKKAGTELCVWNTGNQQNQKFA

SEQ ID NO: 2939225 - protein, 22 aa, Entamoeba invadens
GGKKPGSELCLWHNKKQLNQQF

SEQ ID NO: 2939226 - protein, 20 aa, Entamoeba invadens
GGKKYIGFIDIDLCETPFNT

SEQ ID NO: 2939227 - protein, 26 aa, Entamoeba invadens
GGKPYMFDDYHMFRSLLDSINVFNED

SEQ ID NO: 2939228 - protein, 17 aa, Entamoeba invadens
GGKRGWAPAEFITKVAP

SEQ ID NO: 2939229 - protein, 22 aa, Entamoeba invadens
GGKRVFECIVELQNFELELYDG

SEQ ID NO: 2939230 - protein, 27 aa, Entamoeba invadens
GGKSLCYQLPMLFKDGYTLVVSPLISL

SEQ ID NO: 2939231 - protein, 17 aa, Entamoeba invadens
GGKTLFITFKIVLKKTC

SEQ ID NO: 2939232 - protein, 20 aa, Entamoeba invadens
GGLCGIEIAVAMKRKHKDVG

SEQ ID NO: 2939233 - protein, 21 aa, Entamoeba invadens
GGLEPLFTFLGLNPLVFLMIR

SEQ ID NO: 2939234 - protein, 20 aa, Entamoeba invadens
GGLFNLSFDTLKMAYLNDSS

SEQ ID NO: 2939235 - protein, 23 aa, Entamoeba invadens
GGLFPSIDYYAVFDGHNGDQASA

SEQ ID NO: 2939236 - protein, 17 aa, Entamoeba invadens
GGLGFYLLPLDYFNARR

SEQ ID NO: 2939237 - protein, 20 aa, Entamoeba invadens
GGLHVCVKAISQRKLIEQKR

SEQ ID NO: 2939238 - protein, 17 aa, Entamoeba invadens
GGLISFVTCTIRSIIQR

SEQ ID NO: 2939239 - protein, 24 aa, Entamoeba invadens
GGLKVMLEVIILRRIIEHNPKFIE

SEQ ID NO: 2939240 - protein, 18 aa, Entamoeba invadens
GGLMVIYRSKLTDIKKII

SEQ ID NO: 2939241 - protein, 19 aa, Entamoeba invadens
GGLRYCINSASLRFIPKDK

SEQ ID NO: 2939242 - protein, 25 aa, Entamoeba invadens
GGLSDFKQALLVAKLALANRVEKIY

SEQ ID NO: 2939243 - protein, 24 aa, Entamoeba invadens
GGMGALEIWEYICSDIQTKFIPMK

SEQ ID NO: 2939244 - protein, 25 aa, Entamoeba invadens
GGNCFNLGESCFMGCISLVSIQLPD

SEQ ID NO: 2939245 - protein, 24 aa, Entamoeba invadens
GGNDINCIVFGFPNEVQSYNIEKD

SEQ ID NO: 2939246 - protein, 27 aa, Entamoeba invadens
GGNEFLKRRYLLLCYIKTFDIDDFTQI

SEQ ID NO: 2939247 - protein, 22 aa, Entamoeba invadens
GGNEGVDLWEFERDQPTQHFNI

SEQ ID NO: 2939248 - protein, 20 aa, Entamoeba invadens
GGNITLCFFYANSFRIQKDF

SEQ ID NO: 2939249 - protein, 22 aa, Entamoeba invadens
GGNRVVLFFLSYKYYITNKPYL

SEQ ID NO: 2939250 - protein, 23 aa, Entamoeba invadens
GGNSLKSGDSFIFSPGSRQDSYK

SEQ ID NO: 2939251 - protein, 23 aa, Entamoeba invadens
GGNYEVGNGFSIVGSHTDSPSLK

SEQ ID NO: 2939252 - protein, 24 aa, Entamoeba invadens
GGQEKKISIEFCVNQRISTQDKED

SEQ ID NO: 2939253 - protein, 21 aa, Entamoeba invadens
GGQGSRLGFEHPKGMFVIPLK

SEQ ID NO: 2939254 - protein, 26 aa, Entamoeba invadens
GGQIWKFCLAYGYRIVTTILPTKSTE

SEQ ID NO: 2939255 - protein, 19 aa, Entamoeba invadens
GGQQLRFAPVQMNGGINPP

SEQ ID NO: 2939256 - protein, 23 aa, Entamoeba invadens
GGREIISVIEFLSGVKHKQTRVR

SEQ ID NO: 2939257 - protein, 19 aa, Entamoeba invadens
GGRFYVWKLNEFLKTNTGI

SEQ ID NO: 2939258 - protein, 24 aa, Entamoeba invadens
GGRIKRGIYGFSIGSVEGLYMSKG

SEQ ID NO: 2939259 - protein, 24 aa, Entamoeba invadens
GGRILPRLVAQTIFSNVEQVMSAA

SEQ ID NO: 2939260 - protein, 23 aa, Entamoeba invadens
GGRTFKLTKRSGYSVEVGDLSKF

SEQ ID NO: 2939261 - protein, 17 aa, Entamoeba invadens
GGRVCRPLIVVENAKSK

SEQ ID NO: 2939262 - protein, 24 aa, Entamoeba invadens
GGRVSDGFISRSLPHFPLHSRTPQ

SEQ ID NO: 2939263 - protein, 22 aa, Entamoeba invadens
GGSCKCPAVKKLLVDYFGMSKV

SEQ ID NO: 2939264 - protein, 20 aa, Entamoeba invadens
GGSDAFVFKIDYTPKLTETL

SEQ ID NO: 2939265 - protein, 26 aa, Entamoeba invadens
GGSGRKGKSSFSFGGMPGGFSFGGMP

SEQ ID NO: 2939266 - protein, 19 aa, Entamoeba invadens
GGSIYRVLQSGAIVPGEMC

SEQ ID NO: 2939267 - protein, 17 aa, Entamoeba invadens
GGSMSFDIGEDAFDISA

SEQ ID NO: 2939268 - protein, 24 aa, Entamoeba invadens
GGSQRFVQVASWIGKKNCVKLAKF

SEQ ID NO: 2939269 - protein, 22 aa, Entamoeba invadens
GGSRPFGISTLIGGFDPDGTPR

SEQ ID NO: 2939270 - protein, 32 aa, Entamoeba invadens
GGSVKSWKKRFFVLKNKNLWYFESETSSSEVG

SEQ ID NO: 2939271 - protein, 33 aa, Entamoeba invadens
GGSVKSWKKRWFVLKPNKLWYFTSKSATTATGY

SEQ ID NO: 2939272 - protein, 21 aa, Entamoeba invadens
GGTFNEFIKEIAIVYGKGSED

SEQ ID NO: 2939273 - protein, 27 aa, Entamoeba invadens
GGTGRAPYVVNIIKHVVGQEVKFLNSI

SEQ ID NO: 2939274 - protein, 22 aa, Entamoeba invadens
GGTLDVAFCRIINGKIDVFNCG

SEQ ID NO: 2939275 - protein, 31 aa, Entamoeba invadens
GGTNILKPLCWAMKRKCQVILLTDGQISETE

SEQ ID NO: 2939276 - protein, 20 aa, Entamoeba invadens
GGTSCSRCVHNSNVLVNQKN

SEQ ID NO: 2939277 - protein, 25 aa, Entamoeba invadens
GGVGPLMVCTQVAGTIHLRDVIKGT

SEQ ID NO: 2939278 - protein, 17 aa, Entamoeba invadens
GGVIYEYINGIISASTV

SEQ ID NO: 2939279 - protein, 19 aa, Entamoeba invadens
GGVKCIYQTILLRKIVTEI

SEQ ID NO: 2939280 - protein, 20 aa, Entamoeba invadens
GGVKEAMYPAALYLLQIETD

SEQ ID NO: 2939281 - protein, 18 aa, Entamoeba invadens
GGVKKRRFKVEGKNNTKQ

SEQ ID NO: 2939282 - protein, 20 aa, Entamoeba invadens
GGVLKNLKFEGVSVEDQITL

SEQ ID NO: 2939283 - protein, 26 aa, Entamoeba invadens
GGVLLQCIHSGFGLGRYGEELSGPEY

SEQ ID NO: 2939284 - protein, 18 aa, Entamoeba invadens
GGVLNNLVYIVLSLVLSG

SEQ ID NO: 2939285 - protein, 19 aa, Entamoeba invadens
GGVPWSVEMPVDMVDVMVV

SEQ ID NO: 2939286 - protein, 25 aa, Entamoeba invadens
GGVTPRGKIVLMLREVQKDLVSQGG

SEQ ID NO: 2939287 - protein, 24 aa, Entamoeba invadens
GGVYTCALAYCGTASEKAINKLLH

SEQ ID NO: 2939288 - protein, 23 aa, Entamoeba invadens
GGWRMRIALATALYLQPDLLILD

SEQ ID NO: 2939289 - protein, 22 aa, Entamoeba invadens
GGYAGCCKCVYPITTSSKKKTY

SEQ ID NO: 2939290 - protein, 19 aa, Entamoeba invadens
GGYCFYRCNSLSCVTIQSN

SEQ ID NO: 2939291 - protein, 33 aa, Entamoeba invadens
GGYHPLEIFTKLKLSQFFKEVEIALLFQQIQNC

SEQ ID NO: 2939292 - protein, 20 aa, Entamoeba invadens
GGYSLQIWIHPGVYLGLPFP

SEQ ID NO: 2939293 - protein, 21 aa, Entamoeba invadens
GHAAIALGMIYEGSMDGEIAD

SEQ ID NO: 2939294 - protein, 19 aa, Entamoeba invadens
GHAKFAVKITHESGTEIPQ

SEQ ID NO: 2939295 - protein, 27 aa, Entamoeba invadens
GHAKIGEYGWKGILPRKTDKHLITIEL

SEQ ID NO: 2939296 - protein, 22 aa, Entamoeba invadens
GHAKVTYFGYDIFTGKRLDDAC

SEQ ID NO: 2939297 - protein, 25 aa, Entamoeba invadens
GHCECMKRVKAFGLPMILVGGGGYT

SEQ ID NO: 2939298 - protein, 18 aa, Entamoeba invadens
GHCRQFINQFAFSKTLKI

SEQ ID NO: 2939299 - protein, 26 aa, Entamoeba invadens
GHCYMVGGVWRVEGVVALSRSIGDRA

SEQ ID NO: 2939300 - protein, 25 aa, Entamoeba invadens
GHDAFRKCGFKDFTIDKNVFIKKSI

SEQ ID NO: 2939301 - protein, 24 aa, Entamoeba invadens
GHDELMFLIPEINFMPIFDPTQIS

SEQ ID NO: 2939302 - protein, 20 aa, Entamoeba invadens
GHDRPSPSLIELSAADKTIN

SEQ ID NO: 2939303 - protein, 17 aa, Entamoeba invadens
GHDSGLIVFKLSNQRVP

SEQ ID NO: 2939304 - protein, 25 aa, Entamoeba invadens
GHECYVSTCALDLVIADLRNSKNPI

SEQ ID NO: 2939305 - protein, 23 aa, Entamoeba invadens
GHEFRTTYSATRWCYIYKNLKDI

SEQ ID NO: 2939306 - protein, 25 aa, Entamoeba invadens
GHENIKKGILLLLFGGVHKTTKEGI

SEQ ID NO: 2939307 - protein, 18 aa, Entamoeba invadens
GHFGEINLALPVFHIGFF

SEQ ID NO: 2939308 - protein, 25 aa, Entamoeba invadens
GHFKILKLHLNFVVDSVIRKSGENI

SEQ ID NO: 2939309 - protein, 23 aa, Entamoeba invadens
GHFLLKCVSHFMTPAPFFNIMND

SEQ ID NO: 2939310 - protein, 19 aa, Entamoeba invadens
GHFYPIMFYPIVLETPSSL

SEQ ID NO: 2939311 - protein, 17 aa, Entamoeba invadens
GHGGAILRSDGQLLGQD

SEQ ID NO: 2939312 - protein, 18 aa, Entamoeba invadens
GHGGAILRSDGQLLGQDG

SEQ ID NO: 2939313 - protein, 20 aa, Entamoeba invadens
GHGGDLCSKAAVKVISKNIS

SEQ ID NO: 2939314 - protein, 17 aa, Entamoeba invadens
GHGSFGQVLKCLDMNTG

SEQ ID NO: 2939315 - protein, 25 aa, Entamoeba invadens
GHGTFGQVFKCWDIKNEKFVAVKIL

SEQ ID NO: 2939316 - protein, 26 aa, Entamoeba invadens
GHKIFFKLPLIRRIELEGQLIQRPWF

SEQ ID NO: 2939317 - protein, 22 aa, Entamoeba invadens
GHKRKVGTCNFNPCASNVLATS

SEQ ID NO: 2939318 - protein, 26 aa, Entamoeba invadens
GHKVKSWKKRWFVFRKSGALDYYADK

SEQ ID NO: 2939319 - protein, 21 aa, Entamoeba invadens
GHLIHIDFGFMFDRSPGGDLG

SEQ ID NO: 2939320 - protein, 18 aa, Entamoeba invadens
GHNVWPKEICEVLNKHPR

SEQ ID NO: 2939321 - protein, 27 aa, Entamoeba invadens
GHNWMVYNWCKGRGCILADEMGLGKTV

SEQ ID NO: 2939322 - protein, 27 aa, Entamoeba invadens
GHNYLRVTRIFNSLRAFGFAQYAKSFW

SEQ ID NO: 2939323 - protein, 26 aa, Entamoeba invadens
GHPKFRKPRVASTAGHFEFDIIHYAG

SEQ ID NO: 2939324 - protein, 18 aa, Entamoeba invadens
GHQCFPEGIKIHTFGVEN

SEQ ID NO: 2939325 - protein, 25 aa, Entamoeba invadens
GHRARVLPFSTFRMNLCDTTPYNAD

SEQ ID NO: 2939326 - protein, 17 aa, Entamoeba invadens
GHRCFFLCINLAKVVLP

SEQ ID NO: 2939327 - protein, 22 aa, Entamoeba invadens
GHRFVHGGSYFKTSAVIEGPVL

SEQ ID NO: 2939328 - protein, 17 aa, Entamoeba invadens
GHRRKVDVIAHNYGAPV

SEQ ID NO: 2939329 - protein, 33 aa, Entamoeba invadens
GHSASVDWWTLGVLMYEFLYGCNPFVASSKQET

SEQ ID NO: 2939330 - protein, 25 aa, Entamoeba invadens
GHSGSVDWWTFGIFMYEVLYGRTPF

SEQ ID NO: 2939331 - protein, 28 aa, Entamoeba invadens
GHSLQEIGAFCFKNCSKLEQLDFPKSLT

SEQ ID NO: 2939332 - protein, 20 aa, Entamoeba invadens
GHTFKNCLFSSKKFPEMETR

SEQ ID NO: 2939333 - protein, 17 aa, Entamoeba invadens
GHTLIYSSCLPRLEQYR

SEQ ID NO: 2939334 - protein, 18 aa, Entamoeba invadens
GHVLGCFQNGFLQVPSVF

SEQ ID NO: 2939335 - protein, 18 aa, Entamoeba invadens
GHVLIIWRKNPPLSDAPG

SEQ ID NO: 2939336 - protein, 17 aa, Entamoeba invadens
GHVTYFWNGNKTGYFDD

SEQ ID NO: 2939337 - protein, 21 aa, Entamoeba invadens
GHYKFPSPYWDNISTEIKNCI

SEQ ID NO: 2939338 - protein, 24 aa, Entamoeba invadens
GIAACLECQVSLFPPAKTFPMCTI

SEQ ID NO: 2939339 - protein, 21 aa, Entamoeba invadens
GIAAPLMICAVVARTLSLLWH

SEQ ID NO: 2939340 - protein, 26 aa, Entamoeba invadens
GIAFDWKMRLKIATDVAKGLGVIHKM

SEQ ID NO: 2939341 - protein, 17 aa, Entamoeba invadens
GIAFITYYDIRAAEKAH

SEQ ID NO: 2939342 - protein, 17 aa, Entamoeba invadens
GIAKCVPSITSVHKFLN

SEQ ID NO: 2939343 - protein, 17 aa, Entamoeba invadens
GIAPFTGDIEWWDAPFI

SEQ ID NO: 2939344 - protein, 20 aa, Entamoeba invadens
GIAPMLQNHFGVFPTIVSKA

SEQ ID NO: 2939345 - protein, 28 aa, Entamoeba invadens
GIAPRIICAAVYKFTGKKMEFLWTGDMK

SEQ ID NO: 2939346 - protein, 17 aa, Entamoeba invadens
GIATTAITPLRNDITQA

SEQ ID NO: 2939347 - protein, 30 aa, Entamoeba invadens
GICCFKRCYHLKYVILYGVKYLEKESFSYC

SEQ ID NO: 2939348 - protein, 20 aa, Entamoeba invadens
GICCGEEGVTLFPRNVSLTM

SEQ ID NO: 2939349 - protein, 18 aa, Entamoeba invadens
GICLFEMTTKMTFPTYQF

SEQ ID NO: 2939350 - protein, 23 aa, Entamoeba invadens
GICTIGRGCFSYCESLNNVKIPE

SEQ ID NO: 2939351 - protein, 24 aa, Entamoeba invadens
GICVFKSLFGIRMVETVVEKGTKL

SEQ ID NO: 2939352 - protein, 23 aa, Entamoeba invadens
GIDGVVIVGPFAFQKCEKLSSII

SEQ ID NO: 2939353 - protein, 24 aa, Entamoeba invadens
GIDGYKMQNGFLVATASWDKTCKA

SEQ ID NO: 2939354 - protein, 24 aa, Entamoeba invadens
GIDIGTTKCCICVVDQNRKLRVLE

SEQ ID NO: 2939355 - protein, 26 aa, Entamoeba invadens
GIDKIPVFRIQAVTLSGVKCTKGGDE

SEQ ID NO: 2939356 - protein, 26 aa, Entamoeba invadens
GIDLIKFKGACDILFSDSSKDEKVTT

SEQ ID NO: 2939357 - protein, 19 aa, Entamoeba invadens
GIDLPQIVVVGAQSAGKSS

SEQ ID NO: 2939358 - protein, 27 aa, Entamoeba invadens
GIDNLCIVVAPTFFWKKGEMQRQNGFE

SEQ ID NO: 2939359 - protein, 17 aa, Entamoeba invadens
GIDSFFFRKDVEPKTTE

SEQ ID NO: 2939360 - protein, 22 aa, Entamoeba invadens
GIDYKFGLLYCGPKQTSEAEMY

SEQ ID NO: 2939361 - protein, 18 aa, Entamoeba invadens
GIECFSRCSSLSGIKLPS

SEQ ID NO: 2939362 - protein, 25 aa, Entamoeba invadens
GIEIFLQFLCNGWKNPTPQIPNLRW

SEQ ID NO: 2939363 - protein, 17 aa, Entamoeba invadens
GIEKLVWDELVKIGTSL

SEQ ID NO: 2939364 - protein, 25 aa, Entamoeba invadens
GIELIRRLHISIVRKLVKSTPETFV

SEQ ID NO: 2939365 - protein, 18 aa, Entamoeba invadens
GIELYKIFPSFKNVKKLD

SEQ ID NO: 2939366 - protein, 26 aa, Entamoeba invadens
GIEQFSFDNVRLFIGYIQMLQYSPVT

SEQ ID NO: 2939367 - protein, 26 aa, Entamoeba invadens
GIERIKKYITWHITCAAVINKMDECK

SEQ ID NO: 2939368 - protein, 18 aa, Entamoeba invadens
GIESLKSALQLFLRQLPT

SEQ ID NO: 2939369 - protein, 34 aa, Entamoeba invadens
GIETEFLWDRNRLFDRIACLILYEDALDKVKQAK

SEQ ID NO: 2939370 - protein, 18 aa, Entamoeba invadens
GIEVRGGGNPIVVDSDVS

SEQ ID NO: 2939371 - protein, 27 aa, Entamoeba invadens
GIEVVTFLLCEYSHLFPTEVDENVMRL

SEQ ID NO: 2939372 - protein, 18 aa, Entamoeba invadens
GIFFLRLINPAVVTPQRF

SEQ ID NO: 2939373 - protein, 19 aa, Entamoeba invadens
GIFKMMRFISNSFALEIVD

SEQ ID NO: 2939374 - protein, 20 aa, Entamoeba invadens
GIFQENQIYFGFVRETDQID

SEQ ID NO: 2939375 - protein, 17 aa, Entamoeba invadens
GIFRHTCLREFDKQSDN

SEQ ID NO: 2939376 - protein, 33 aa, Entamoeba invadens
GIFSGGHWEYRGMIIKYNYLHHALGFSYSNSGL

SEQ ID NO: 2939377 - protein, 17 aa, Entamoeba invadens
GIGCTICGVCSKEAVVA

SEQ ID NO: 2939378 - protein, 19 aa, Entamoeba invadens
GIGMLKYPLVSDISKTIST

SEQ ID NO: 2939379 - protein, 17 aa, Entamoeba invadens
GIHKAYCVAYYKRNSSQ

SEQ ID NO: 2939380 - protein, 18 aa, Entamoeba invadens
GIHKAYCVCYSKRDSNII

SEQ ID NO: 2939381 - protein, 24 aa, Entamoeba invadens
GIHVFPFEIEFDIMEQFLTGGRVF

SEQ ID NO: 2939382 - protein, 17 aa, Entamoeba invadens
GIIDCGDDIFDGCSSLK

SEQ ID NO: 2939383 - protein, 26 aa, Entamoeba invadens
GIIDNIPCGLAWPYLTGEKGIGIDPK

SEQ ID NO: 2939384 - protein, 29 aa, Entamoeba invadens
GIIELKRMYSDGLLSVEAYVTLRDNYLTS

SEQ ID NO: 2939385 - protein, 23 aa, Entamoeba invadens
GIIELRESCFMRREDIKRIEFPE

SEQ ID NO: 2939386 - protein, 20 aa, Entamoeba invadens
GIIFRLPLFPNPLVKTLVEM

SEQ ID NO: 2939387 - protein, 17 aa, Entamoeba invadens
GIIPLNIKNLRTIISDA

SEQ ID NO: 2939388 - protein, 23 aa, Entamoeba invadens
GIIREPGKIFVFDINRYDDTLLK

SEQ ID NO: 2939389 - protein, 18 aa, Entamoeba invadens
GIISFNPCVKDFYDIKSP

SEQ ID NO: 2939390 - protein, 26 aa, Entamoeba invadens
GIIVAMLRAFKSCYNEGVYDFTVELP

SEQ ID NO: 2939391 - protein, 20 aa, Entamoeba invadens
GIKCFSDCFYLSHISTSLEE

SEQ ID NO: 2939392 - protein, 23 aa, Entamoeba invadens
GIKCIMQAIIIGRLMDKYPTLLD

SEQ ID NO: 2939393 - protein, 27 aa, Entamoeba invadens
GIKDPKLAECLMVLMGVDPSMFMKKSE

SEQ ID NO: 2939394 - protein, 24 aa, Entamoeba invadens
GIKECKLDSFACFTCPQLTELDLV

SEQ ID NO: 2939395 - protein, 24 aa, Entamoeba invadens
GIKESRFNLSCFEYGDKTEDLLKM

SEQ ID NO: 2939396 - protein, 22 aa, Entamoeba invadens
GIKKCAFVSMKVMKKYHSKIFY

SEQ ID NO: 2939397 - protein, 19 aa, Entamoeba invadens
GIKNYRPKASIFQIDTTKE

SEQ ID NO: 2939398 - protein, 25 aa, Entamoeba invadens
GIKQEEFHSILGFANRSETLKQTET

SEQ ID NO: 2939399 - protein, 24 aa, Entamoeba invadens
GIKSDCTKNVFCVDGKNKIGLFSI

SEQ ID NO: 2939400 - protein, 22 aa, Entamoeba invadens
GIKSVYFKVCGYNNPDMEMLEP

SEQ ID NO: 2939401 - protein, 26 aa, Entamoeba invadens
GIKTMEWFFRVEKLCEMMTHTAAKRN

SEQ ID NO: 2939402 - protein, 34 aa, Entamoeba invadens
GIKVLMSVIILRRLCVEFPDLLTKCNLFCGVSAS

SEQ ID NO: 2939403 - protein, 22 aa, Entamoeba invadens
GILDERRKDIATEYSDDEDDWS

SEQ ID NO: 2939404 - protein, 22 aa, Entamoeba invadens
GILKKKGLRYFEIEVTGRSDVC

SEQ ID NO: 2939405 - protein, 19 aa, Entamoeba invadens
GILKLCQRGVIIGSGEKVI

SEQ ID NO: 2939406 - protein, 19 aa, Entamoeba invadens
GILKVPNELPKRLTTPEEN

SEQ ID NO: 2939407 - protein, 19 aa, Entamoeba invadens
GILPEILENLLAARKQAKK

SEQ ID NO: 2939408 - protein, 25 aa, Entamoeba invadens
GILPSRPVLFEMIKIISEFLVVRYW

SEQ ID NO: 2939409 - protein, 19 aa, Entamoeba invadens
GILSIPNFFEFVILLFEID

SEQ ID NO: 2939410 - protein, 17 aa, Entamoeba invadens
GILSPFAKQFFVPNILD

SEQ ID NO: 2939411 - protein, 18 aa, Entamoeba invadens
GILTLKYPIEHGIVNNWD

SEQ ID NO: 2939412 - protein, 17 aa, Entamoeba invadens
GIMKRAPQPWEHLVGLK

SEQ ID NO: 2939413 - protein, 24 aa, Entamoeba invadens
GIMPRLVKEDFVWVSKGITTYYIS

SEQ ID NO: 2939414 - protein, 23 aa, Entamoeba invadens
GIMSGRPFYIFNLLEELDEEGEY

SEQ ID NO: 2939415 - protein, 23 aa, Entamoeba invadens
GIMTHNRYEWFIAQHAMQRQGIV

SEQ ID NO: 2939416 - protein, 23 aa, Entamoeba invadens
GINGVVIVGPFAFQKCEKLSSII

SEQ ID NO: 2939417 - protein, 24 aa, Entamoeba invadens
GININTRYGYVISIKDKTASSIIN

SEQ ID NO: 2939418 - protein, 18 aa, Entamoeba invadens
GINKCIKKDGKTMKINLI

SEQ ID NO: 2939419 - protein, 19 aa, Entamoeba invadens
GINLRVCVWDTAGQERFRS

SEQ ID NO: 2939420 - protein, 18 aa, Entamoeba invadens
GINSLIWKIDELNSPTSF

SEQ ID NO: 2939421 - protein, 21 aa, Entamoeba invadens
GINVKEAFTSLVQDIRAHLPN

SEQ ID NO: 2939422 - protein, 20 aa, Entamoeba invadens
GINVLVCVVVAYVSVMANEC

SEQ ID NO: 2939423 - protein, 18 aa, Entamoeba invadens
GINYEMFQVCLKKLKEDS

SEQ ID NO: 2939424 - protein, 18 aa, Entamoeba invadens
GINYKLNKYFEFPLALNW

SEQ ID NO: 2939425 - protein, 23 aa, Entamoeba invadens
GIPDFRSSNGLWKKYDPATYGSY

SEQ ID NO: 2939426 - protein, 19 aa, Entamoeba invadens
GIPEALKIYESHVGICTPD

SEQ ID NO: 2939427 - protein, 30 aa, Entamoeba invadens
GIPESSPICPICKSNGRPNATLFTESLPSE

SEQ ID NO: 2939428 - protein, 20 aa, Entamoeba invadens
GIPPNSIPLLGQRHCTSKLQ

SEQ ID NO: 2939429 - protein, 25 aa, Entamoeba invadens
GIQSFNFILEWEFNVSFKGSHAQED

SEQ ID NO: 2939430 - protein, 23 aa, Entamoeba invadens
GIREFIKTIFVNKTYYSEETTKQ

SEQ ID NO: 2939431 - protein, 25 aa, Entamoeba invadens
GIRILYEVCCLFIRAETKMCEQFNL

SEQ ID NO: 2939432 - protein, 25 aa, Entamoeba invadens
GIRQGKTGKCYADFEDQETWLKVKA

SEQ ID NO: 2939433 - protein, 18 aa, Entamoeba invadens
GIRRVLCSLMDRIMTHLK

SEQ ID NO: 2939434 - protein, 20 aa, Entamoeba invadens
GIRTGFKAVYSLESPDKGAL

SEQ ID NO: 2939435 - protein, 17 aa, Entamoeba invadens
GIRTPNICLTKADVDLV

SEQ ID NO: 2939436 - protein, 24 aa, Entamoeba invadens
GISAKSGFKRIFYDKASDTSVVEC

SEQ ID NO: 2939437 - protein, 19 aa, Entamoeba invadens
GISKFDLKSKVVLKKEEQI

SEQ ID NO: 2939438 - protein, 23 aa, Entamoeba invadens
GISMKRLNSAIINGRHFDLKQIN

SEQ ID NO: 2939439 - protein, 20 aa, Entamoeba invadens
GISVFFPPAAPYVLVGAGVM

SEQ ID NO: 2939440 - protein, 21 aa, Entamoeba invadens
GITALKVALQLFLRQLPENST

SEQ ID NO: 2939441 - protein, 26 aa, Entamoeba invadens
GITEFGPACFFGCLHMSDILLPKSLC

SEQ ID NO: 2939442 - protein, 24 aa, Entamoeba invadens
GITFFEAFAWKDAFGDVKYFFEIP

SEQ ID NO: 2939443 - protein, 25 aa, Entamoeba invadens
GITKIPDCTFFKCFSLSVISIPKSV

SEQ ID NO: 2939444 - protein, 18 aa, Entamoeba invadens
GITLLNGFACEFEILITP

SEQ ID NO: 2939445 - protein, 22 aa, Entamoeba invadens
GITMWELFYMKFPFFEHPEIVT

SEQ ID NO: 2939446 - protein, 39 aa, Entamoeba invadens
GITMYETFAWKEAYPTNKFKFPWKIAEFVMSGKRVEKIE

SEQ ID NO: 2939447 - protein, 17 aa, Entamoeba invadens
GITREMNDYIITTLSAN

SEQ ID NO: 2939448 - protein, 23 aa, Entamoeba invadens
GITRIPFGMFLSCSNLSEIKNLE

SEQ ID NO: 2939449 - protein, 17 aa, Entamoeba invadens
GITSLRLKKLTLCECSI

SEQ ID NO: 2939450 - protein, 31 aa, Entamoeba invadens
GITVPIVLCGGDFFFGMFVRQLLEMNAKEKM

SEQ ID NO: 2939451 - protein, 25 aa, Entamoeba invadens
GITYGMWRNKECVFDHINKKTFWVD

SEQ ID NO: 2939452 - protein, 18 aa, Entamoeba invadens
GITYRFIINDIKNSTNKK

SEQ ID NO: 2939453 - protein, 17 aa, Entamoeba invadens
GIVATWSIKKGEMVMRE

SEQ ID NO: 2939454 - protein, 24 aa, Entamoeba invadens
GIVEMWDVRYPRMCVNNTVVGGMT

SEQ ID NO: 2939455 - protein, 20 aa, Entamoeba invadens
GIVKGMFKTVIYGAQGLRDV

SEQ ID NO: 2939456 - protein, 18 aa, Entamoeba invadens
GIVKSVRPFNFFDRISYI

SEQ ID NO: 2939457 - protein, 27 aa, Entamoeba invadens
GIVKSWTDMELLWKYVFEEKLHVDTHG

SEQ ID NO: 2939458 - protein, 18 aa, Entamoeba invadens
GIVKYRYVVCKSDDKSII

SEQ ID NO: 2939459 - protein, 18 aa, Entamoeba invadens
GIVMSKRGNIRCLIPNEI

SEQ ID NO: 2939460 - protein, 23 aa, Entamoeba invadens
GIVSCKYCGIVLNEEVLENVPVN

SEQ ID NO: 2939461 - protein, 27 aa, Entamoeba invadens
GIVSFKFEGLYGVKMLFDIGMKSDDYL

SEQ ID NO: 2939462 - protein, 24 aa, Entamoeba invadens
GIVVFRPPKQLFWDGNGYQDDPYK

SEQ ID NO: 2939463 - protein, 26 aa, Entamoeba invadens
GIVVKCMKRGYWLLMENVNFCNPTVL

SEQ ID NO: 2939464 - protein, 18 aa, Entamoeba invadens
GIVYWKFQFQNQRVPQSM

SEQ ID NO: 2939465 - protein, 31 aa, Entamoeba invadens
GIYFHVADILLLELTVAFYKINFYSSALANS

SEQ ID NO: 2939466 - protein, 18 aa, Entamoeba invadens
GIYGYVYSYLNGISIEIL

SEQ ID NO: 2939467 - protein, 26 aa, Entamoeba invadens
GIYIAKRLKLGTAIESNCELMIQLAK

SEQ ID NO: 2939468 - protein, 23 aa, Entamoeba invadens
GIYQLRMLLNYLVVKGGVELYRF

SEQ ID NO: 2939469 - protein, 24 aa, Entamoeba invadens
GIYRTNLDYRIFKFLIKNYKIEGE

SEQ ID NO: 2939470 - protein, 25 aa, Entamoeba invadens
GIYRTNLDYRIFKFLIKNYKIEGEV

SEQ ID NO: 2939471 - protein, 20 aa, Entamoeba invadens
GIYTGIKFILHIKGRLNYYA

SEQ ID NO: 2939472 - protein, 26 aa, Entamoeba invadens
GKAACWMKEMIDKAVLDVDEYYLSKE

SEQ ID NO: 2939473 - protein, 18 aa, Entamoeba invadens
GKAALQLDCKEIKSDLEE

SEQ ID NO: 2939474 - protein, 18 aa, Entamoeba invadens
GKAFKCFKKAAELGNVKG

SEQ ID NO: 2939475 - protein, 22 aa, Entamoeba invadens
GKAFLRKSECEIHMRIHTGVKP

SEQ ID NO: 2939476 - protein, 18 aa, Entamoeba invadens
GKAIPFNIVIASMDSTML

SEQ ID NO: 2939477 - protein, 20 aa, Entamoeba invadens
GKAIVHCIGLGNGVDSDLIK

SEQ ID NO: 2939478 - protein, 20 aa, Entamoeba invadens
GKAIVHCIGLGNGVDSDLIR

SEQ ID NO: 2939479 - protein, 24 aa, Entamoeba invadens
GKAKECLGGMWGIKIEKISEYKTD

SEQ ID NO: 2939480 - protein, 23 aa, Entamoeba invadens
GKAKSTVCLKDYQIGKTGIFPDW

SEQ ID NO: 2939481 - protein, 20 aa, Entamoeba invadens
GKAMPRNVFQLINVNIETYD

SEQ ID NO: 2939482 - protein, 25 aa, Entamoeba invadens
GKANCTACIYPHVFNGTKCELCQPN

SEQ ID NO: 2939483 - protein, 17 aa, Entamoeba invadens
GKAPCLDVSPPEEYSPR

SEQ ID NO: 2939484 - protein, 26 aa, Entamoeba invadens
GKAQVCSWCPTNIGMLATGCFSEDEN

SEQ ID NO: 2939485 - protein, 23 aa, Entamoeba invadens
GKAYETSNPFAIMNQEPRYELQY

SEQ ID NO: 2939486 - protein, 18 aa, Entamoeba invadens
GKAYFIYNNLMFMRTDYN

SEQ ID NO: 2939487 - protein, 22 aa, Entamoeba invadens
GKCEKCGIVGCSLCNSTGSDCL

SEQ ID NO: 2939488 - protein, 26 aa, Entamoeba invadens
GKCEKEVYCVIPFIRPLDVYICLSHY

SEQ ID NO: 2939489 - protein, 17 aa, Entamoeba invadens
GKCKLISYFNEKKKLVL

SEQ ID NO: 2939490 - protein, 20 aa, Entamoeba invadens
GKCLDCQFCYSCHTQTGCSQ

SEQ ID NO: 2939491 - protein, 19 aa, Entamoeba invadens
GKCNVCGDTLLASSLTSLR

SEQ ID NO: 2939492 - protein, 31 aa, Entamoeba invadens
GKCQIEVSFFKGLEMRSTFQTNRQEELVKEV

SEQ ID NO: 2939493 - protein, 21 aa, Entamoeba invadens
GKCQSGLTCQWYKSHTTEDFK

SEQ ID NO: 2939494 - protein, 21 aa, Entamoeba invadens
GKCSSELFEAFQQISKLTAQQ

SEQ ID NO: 2939495 - protein, 17 aa, Entamoeba invadens
GKCVACLTNSLTCDGTS

SEQ ID NO: 2939496 - protein, 17 aa, Entamoeba invadens
GKCVVCQAGTFQSGNNC

SEQ ID NO: 2939497 - protein, 29 aa, Entamoeba invadens
GKCYKYEDGYFYWVYKNYVVFKTLNKQKF

SEQ ID NO: 2939498 - protein, 24 aa, Entamoeba invadens
GKDADFPPYAFVKFTDEKSANLAL

SEQ ID NO: 2939499 - protein, 22 aa, Entamoeba invadens
GKDDKCFKCITRDTVQYYLQLW

SEQ ID NO: 2939500 - protein, 23 aa, Entamoeba invadens
GKDLCKNKAFGVKYLLKTNKKHP

SEQ ID NO: 2939501 - protein, 17 aa, Entamoeba invadens
GKDLFAQQRFEHFSIPP

SEQ ID NO: 2939502 - protein, 19 aa, Entamoeba invadens
GKDNVVWMVDPLMMRKVKS

SEQ ID NO: 2939503 - protein, 23 aa, Entamoeba invadens
GKDPRYKVIKKRVPKKGKTPSHA

SEQ ID NO: 2939504 - protein, 19 aa, Entamoeba invadens
GKDRFCVEIGNGADKRNVS

SEQ ID NO: 2939505 - protein, 24 aa, Entamoeba invadens
GKDRMKRLVCVKVFNNGGMIDDLK

SEQ ID NO: 2939506 - protein, 17 aa, Entamoeba invadens
GKDTMLFVLRKNTRKDL

SEQ ID NO: 2939507 - protein, 19 aa, Entamoeba invadens
GKDTMNWSTMITLIASILK

SEQ ID NO: 2939508 - protein, 25 aa, Entamoeba invadens
GKDYDCVVDVWSLGIMCREMMEGYP

SEQ ID NO: 2939509 - protein, 23 aa, Entamoeba invadens
GKEAFAECFKLSKITLPSSVQKI

SEQ ID NO: 2939510 - protein, 22 aa, Entamoeba invadens
GKEARHGVAQVLNRITFTSALA

SEQ ID NO: 2939511 - protein, 35 aa, Entamoeba invadens
GKECDYWSVGCILFEMVCGFPPFLSDDAVQTCLKI

SEQ ID NO: 2939512 - protein, 22 aa, Entamoeba invadens
GKECFLCCSSLSAVDFSEKLVT

SEQ ID NO: 2939513 - protein, 24 aa, Entamoeba invadens
GKEDLSKLTTEYKILEADNQKLQD

SEQ ID NO: 2939514 - protein, 18 aa, Entamoeba invadens
GKEDLSKLTTEYKKFEAD

SEQ ID NO: 2939515 - protein, 18 aa, Entamoeba invadens
GKEDLSKLTTEYKKLEAD

SEQ ID NO: 2939516 - protein, 20 aa, Entamoeba invadens
GKEEILVCFTERYFVERDSH

SEQ ID NO: 2939517 - protein, 20 aa, Entamoeba invadens
GKEGCGLDEVNMHRVFEKLN

SEQ ID NO: 2939518 - protein, 25 aa, Entamoeba invadens
GKELIGELEHNFFLTRTELTRRIQV

SEQ ID NO: 2939519 - protein, 17 aa, Entamoeba invadens
GKELKGEKLHIVGKNKN

SEQ ID NO: 2939520 - protein, 21 aa, Entamoeba invadens
GKELVSYSVFIEKFYRIQKIG

SEQ ID NO: 2939521 - protein, 19 aa, Entamoeba invadens
GKEMLKFCVENNVEGQAEL

SEQ ID NO: 2939522 - protein, 22 aa, Entamoeba invadens
GKEMRVKSIGFKTKNGAGDFVI

SEQ ID NO: 2939523 - protein, 24 aa, Entamoeba invadens
GKESNEFWFEFGKPTGNIRSSEEG

SEQ ID NO: 2939524 - protein, 18 aa, Entamoeba invadens
GKEVCLFENVAFLSPKGH

SEQ ID NO: 2939525 - protein, 17 aa, Entamoeba invadens
GKEVLSVLSEMWKKLGP

SEQ ID NO: 2939526 - protein, 18 aa, Entamoeba invadens
GKEVLTILSEMWKKLDPL

SEQ ID NO: 2939527 - protein, 24 aa, Entamoeba invadens
GKEWEVLRGICAVVLSYGKLAGEA

SEQ ID NO: 2939528 - protein, 36 aa, Entamoeba invadens
GKFDCPEIFKKALLKRFNQKFTRKQFTHFLYFMMRT

SEQ ID NO: 2939529 - protein, 19 aa, Entamoeba invadens
GKFDWKLPGHLEKLKTDRA

SEQ ID NO: 2939530 - protein, 19 aa, Entamoeba invadens
GKFFLPSFNLRSFLTPEQE

SEQ ID NO: 2939531 - protein, 27 aa, Entamoeba invadens
GKFFRTRELLLRDGFAFISKQEIIDLV

SEQ ID NO: 2939532 - protein, 21 aa, Entamoeba invadens
GKFHLFSSFILYKFDNNSKTE

SEQ ID NO: 2939533 - protein, 30 aa, Entamoeba invadens
GKFLSGFEPLEMCPLAFFPFQITMEQTNNA

SEQ ID NO: 2939534 - protein, 37 aa, Entamoeba invadens
GKFPDFSSNAFGRVEMKNCNFVTVFVFGIVNSALNVV

SEQ ID NO: 2939535 - protein, 18 aa, Entamoeba invadens
GKFSLFNYRVRGTLQAPI

SEQ ID NO: 2939536 - protein, 18 aa, Entamoeba invadens
GKFSPFRITGARTEVTNV

SEQ ID NO: 2939537 - protein, 19 aa, Entamoeba invadens
GKFSVDVHGTVIEFDMPSF

SEQ ID NO: 2939538 - protein, 17 aa, Entamoeba invadens
GKFTVLRWGECKRHNSG

SEQ ID NO: 2939539 - protein, 19 aa, Entamoeba invadens
GKFTVNFSTNFSVVPKIMV

SEQ ID NO: 2939540 - protein, 24 aa, Entamoeba invadens
GKFYCIDCAKLIKSSTLFEMSRTA

SEQ ID NO: 2939541 - protein, 20 aa, Entamoeba invadens
GKGFMCAWCGRKERVFTVGF

SEQ ID NO: 2939542 - protein, 18 aa, Entamoeba invadens
GKGGCGCGHTCGGCKAGG

SEQ ID NO: 2939543 - protein, 21 aa, Entamoeba invadens
GKGHVGLGVKCAKEVASAIKG

SEQ ID NO: 2939544 - protein, 24 aa, Entamoeba invadens
GKGIFKNARVELVELPNSLSEFGD

SEQ ID NO: 2939545 - protein, 26 aa, Entamoeba invadens
GKGKRLRPLSILAFYKAAGGRMEQDN

SEQ ID NO: 2939546 - protein, 20 aa, Entamoeba invadens
GKGKRTLIHIHYTGWPDFGV

SEQ ID NO: 2939547 - protein, 23 aa, Entamoeba invadens
GKGKTGSTLFCYINDAIHTVYVK

SEQ ID NO: 2939548 - protein, 23 aa, Entamoeba invadens
GKGRTGLMCACLLIYFRDCLHAW

SEQ ID NO: 2939549 - protein, 21 aa, Entamoeba invadens
GKGSADAFVSSEICGVVCSVE

SEQ ID NO: 2939550 - protein, 19 aa, Entamoeba invadens
GKHGRFRGNLLGKRVDFSG

SEQ ID NO: 2939551 - protein, 18 aa, Entamoeba invadens
GKHQLHFFFQPLKMKMEG

SEQ ID NO: 2939552 - protein, 21 aa, Entamoeba invadens
GKHRLDFSFYLPQNFPTSYVT

SEQ ID NO: 2939553 - protein, 21 aa, Entamoeba invadens
GKIALDLMKKFSLLTPDNVET

SEQ ID NO: 2939554 - protein, 27 aa, Entamoeba invadens
GKICSCCGHKLCARCIFEVKLKPKTVV

SEQ ID NO: 2939555 - protein, 20 aa, Entamoeba invadens
GKIEEWEKMRAEIEDQLKKL

SEQ ID NO: 2939556 - protein, 24 aa, Entamoeba invadens
GKIFLNFSPYFAVYQNFLINHENA

SEQ ID NO: 2939557 - protein, 28 aa, Entamoeba invadens
GKIFMWDWKKGKVLKCYTKAHNGTVADV

SEQ ID NO: 2939558 - protein, 27 aa, Entamoeba invadens
GKIFPKRWRVGEELVLEFVSSTKVAFE

SEQ ID NO: 2939559 - protein, 17 aa, Entamoeba invadens
GKIKTFVVFPVRDNLLS

SEQ ID NO: 2939560 - protein, 23 aa, Entamoeba invadens
GKILNCKFSEEFSDLRINIKNWV

SEQ ID NO: 2939561 - protein, 17 aa, Entamoeba invadens
GKINAGQSYASFSKSIS

SEQ ID NO: 2939562 - protein, 23 aa, Entamoeba invadens
GKINCVGCGVYLNKEGANVLFFT

SEQ ID NO: 2939563 - protein, 18 aa, Entamoeba invadens
GKINPLFHPITPRTELTE

SEQ ID NO: 2939564 - protein, 19 aa, Entamoeba invadens
GKIQREEFVIGMRNLTNTT

SEQ ID NO: 2939565 - protein, 20 aa, Entamoeba invadens
GKIREVLEAFIYNLVNNKYF

SEQ ID NO: 2939566 - protein, 18 aa, Entamoeba invadens
GKISKKVIEKVNEESDVQ

SEQ ID NO: 2939567 - protein, 24 aa, Entamoeba invadens
GKISYDEFCGIILKNSENIGEKLT

SEQ ID NO: 2939568 - protein, 19 aa, Entamoeba invadens
GKITGGIRIRAKSQGVAVS

SEQ ID NO: 2939569 - protein, 19 aa, Entamoeba invadens
GKIVALYCGRLEWIDVGSY

SEQ ID NO: 2939570 - protein, 17 aa, Entamoeba invadens
GKIVKTILCEKCEKVFR

SEQ ID NO: 2939571 - protein, 23 aa, Entamoeba invadens
GKIVKTILCEKCEKVFRKKCEEI

SEQ ID NO: 2939572 - protein, 24 aa, Entamoeba invadens
GKIVSKKEAFGYSDDEMSEDEEPY

SEQ ID NO: 2939573 - protein, 25 aa, Entamoeba invadens
GKIYGEGIGKSFEKLSHFLKTYCSY

SEQ ID NO: 2939574 - protein, 23 aa, Entamoeba invadens
GKKAFFKCFQLSKVEFNKGITAI

SEQ ID NO: 2939575 - protein, 20 aa, Entamoeba invadens
GKKCFKRCESLQCVTLHAPL

SEQ ID NO: 2939576 - protein, 20 aa, Entamoeba invadens
GKKCIECLGLGIPDTHYVNM

SEQ ID NO: 2939577 - protein, 23 aa, Entamoeba invadens
GKKDGIVYLGTFFPINAIFKSAL

SEQ ID NO: 2939578 - protein, 24 aa, Entamoeba invadens
GKKEILDRFKLFRFNKYTFEDQPF

SEQ ID NO: 2939579 - protein, 24 aa, Entamoeba invadens
GKKELLDFGNLLIENGFFQMAMMI

SEQ ID NO: 2939580 - protein, 21 aa, Entamoeba invadens
GKKGGMLKPPMPTPLDTEKTK

SEQ ID NO: 2939581 - protein, 28 aa, Entamoeba invadens
GKKIGKQGGKLWKWYKKNGKEKDKKDLK

SEQ ID NO: 2939582 - protein, 23 aa, Entamoeba invadens
GKKIGRLIFRVILYDKNGKIINV

SEQ ID NO: 2939583 - protein, 23 aa, Entamoeba invadens
GKKKCPQCRQVLLTPLTCACGKT

SEQ ID NO: 2939584 - protein, 20 aa, Entamoeba invadens
GKKKIEYFRVYDGKKSQAVS

SEQ ID NO: 2939585 - protein, 25 aa, Entamoeba invadens
GKKKIKASLILRQKINKNFKVNLSA

SEQ ID NO: 2939586 - protein, 23 aa, Entamoeba invadens
GKKKKEEIVGIGYIDLATYVACV

SEQ ID NO: 2939587 - protein, 23 aa, Entamoeba invadens
GKKLICKKCNEETNVFNLRYRTG

SEQ ID NO: 2939588 - protein, 20 aa, Entamoeba invadens
GKKLKIVVRAGAGYDNVDLP

SEQ ID NO: 2939589 - protein, 26 aa, Entamoeba invadens
GKKLKLLSLLDCHAITSPSPRVRSSS

SEQ ID NO: 2939590 - protein, 19 aa, Entamoeba invadens
GKKQFLLRSKKVIASMLEQ

SEQ ID NO: 2939591 - protein, 26 aa, Entamoeba invadens
GKKQKSRGFAIIEFAAKVSVLKALEL

SEQ ID NO: 2939592 - protein, 17 aa, Entamoeba invadens
GKKQWPYSSIAIAMEVI

SEQ ID NO: 2939593 - protein, 17 aa, Entamoeba invadens
GKKRMMCITGEVSKVVR

SEQ ID NO: 2939594 - protein, 23 aa, Entamoeba invadens
GKKSFDIFCAINYIVYNKQDCTV

SEQ ID NO: 2939595 - protein, 24 aa, Entamoeba invadens
GKKSKACGFVKFRRVADAMKCVSD

SEQ ID NO: 2939596 - protein, 20 aa, Entamoeba invadens
GKKSPCYKDIDFLDQKAVIK

SEQ ID NO: 2939597 - protein, 34 aa, Entamoeba invadens
GKKVSFLICCGDFQSLRTEADFDFFKSNVSHRDL

SEQ ID NO: 2939598 - protein, 20 aa, Entamoeba invadens
GKKVTRVWEKVKFLGSGGFG

SEQ ID NO: 2939599 - protein, 26 aa, Entamoeba invadens
GKKYIRDIICGIKFLHEQGIVHMDIK

SEQ ID NO: 2939600 - protein, 28 aa, Entamoeba invadens
GKLALYLNLAICFIKVSKFNKALDNADS

SEQ ID NO: 2939601 - protein, 22 aa, Entamoeba invadens
GKLEKYAAVKLIRQAAEIFKKE

SEQ ID NO: 2939602 - protein, 27 aa, Entamoeba invadens
GKLETLGRCVVLYPFRAEHSDELNLRR

SEQ ID NO: 2939603 - protein, 18 aa, Entamoeba invadens
GKLFTRISFFQMPPNSER

SEQ ID NO: 2939604 - protein, 18 aa, Entamoeba invadens
GKLGKQVCCETVQETELH

SEQ ID NO: 2939605 - protein, 24 aa, Entamoeba invadens
GKLIKRLVSDGVRYRHVKVCHGSP

SEQ ID NO: 2939606 - protein, 17 aa, Entamoeba invadens
GKLILKYINNMGLELDF

SEQ ID NO: 2939607 - protein, 31 aa, Entamoeba invadens
GKLKADEIFDRMKLEWDKLTFSENVQGNYNT

SEQ ID NO: 2939608 - protein, 18 aa, Entamoeba invadens
GKLKEMDTPLNLIKEKDT

SEQ ID NO: 2939609 - protein, 18 aa, Entamoeba invadens
GKLKHVWMNSEAVNAIAF

SEQ ID NO: 2939610 - protein, 20 aa, Entamoeba invadens
GKLKLLEVLPYVKQAFQPQY

SEQ ID NO: 2939611 - protein, 17 aa, Entamoeba invadens
GKLKNTEGEIVQLKSEL

SEQ ID NO: 2939612 - protein, 30 aa, Entamoeba invadens
GKLLKGGEPDLHIVAKLILYDFQRGRLPYF

SEQ ID NO: 2939613 - protein, 18 aa, Entamoeba invadens
GKLNEVFEKFVLPMVQKD

SEQ ID NO: 2939614 - protein, 19 aa, Entamoeba invadens
GKLPDEFQKRGGAAERPVE

SEQ ID NO: 2939615 - protein, 18 aa, Entamoeba invadens
GKLQLDDVVEGMKELKSE

SEQ ID NO: 2939616 - protein, 24 aa, Entamoeba invadens
GKLRKVLGALGFVVFEAHLKSDIV

SEQ ID NO: 2939617 - protein, 21 aa, Entamoeba invadens
GKLRLTQKVIEKLRLKPEEYV

SEQ ID NO: 2939618 - protein, 17 aa, Entamoeba invadens
GKLYNAVLDFIKTNTDN

SEQ ID NO: 2939619 - protein, 26 aa, Entamoeba invadens
GKMASRLTVVLGYILCILYHLKRYGD

SEQ ID NO: 2939620 - protein, 21 aa, Entamoeba invadens
GKMGHFFKPDSFICGHSGAGN

SEQ ID NO: 2939621 - protein, 19 aa, Entamoeba invadens
GKMIREFDDKISAVLGSGE

SEQ ID NO: 2939622 - protein, 19 aa, Entamoeba invadens
GKMLIRKNVGVWNCILGQS

SEQ ID NO: 2939623 - protein, 18 aa, Entamoeba invadens
GKMLITIEHNVFVVQISD

SEQ ID NO: 2939624 - protein, 19 aa, Entamoeba invadens
GKMSHSYVVLDLGYKNYVT

SEQ ID NO: 2939625 - protein, 18 aa, Entamoeba invadens
GKMTISFYGSDNCSGNTN

SEQ ID NO: 2939626 - protein, 23 aa, Entamoeba invadens
GKMVKGDVSFFMKMLPKLETLEA

SEQ ID NO: 2939627 - protein, 17 aa, Entamoeba invadens
GKMVRPSLKNMKSDLVW

SEQ ID NO: 2939628 - protein, 17 aa, Entamoeba invadens
GKNAFKGVTKIVSLTAN

SEQ ID NO: 2939629 - protein, 21 aa, Entamoeba invadens
GKNCWKAVSQVVPGRTRKQCR

SEQ ID NO: 2939630 - protein, 17 aa, Entamoeba invadens
GKNFTLKKGEYILVPCS

SEQ ID NO: 2939631 - protein, 31 aa, Entamoeba invadens
GKNIFLEKDFPVFFVKLLEVYLFPILVVKDG

SEQ ID NO: 2939632 - protein, 23 aa, Entamoeba invadens
GKNKARTTFHISMYTGKININTP

SEQ ID NO: 2939633 - protein, 19 aa, Entamoeba invadens
GKNLEEVKKWMTVESTPNT

SEQ ID NO: 2939634 - protein, 22 aa, Entamoeba invadens
GKNLPRKIVLEKVSVCIQYGVL

SEQ ID NO: 2939635 - protein, 23 aa, Entamoeba invadens
GKNRYLLKQPFEFEMENGVELEP

SEQ ID NO: 2939636 - protein, 21 aa, Entamoeba invadens
GKNSFKWCTLFSSIKVRKYNY

SEQ ID NO: 2939637 - protein, 24 aa, Entamoeba invadens
GKNTKFGDNFSCQMLVNFISNPKS

SEQ ID NO: 2939638 - protein, 21 aa, Entamoeba invadens
GKPAENSAIFVFGNDADGAKK

SEQ ID NO: 2939639 - protein, 25 aa, Entamoeba invadens
GKPDLFRWECLVPGAKDTIWEGGYY

SEQ ID NO: 2939640 - protein, 19 aa, Entamoeba invadens
GKPEKRTTLMFSATMPANL

SEQ ID NO: 2939641 - protein, 23 aa, Entamoeba invadens
GKPERIVNFLTFFTQNVGEISTS

SEQ ID NO: 2939642 - protein, 23 aa, Entamoeba invadens
GKPGFSCPFAGKYGITKCQPIEL

SEQ ID NO: 2939643 - protein, 27 aa, Entamoeba invadens
GKPILNYDLFPLFSIILSSEIGKVGTE

SEQ ID NO: 2939644 - protein, 31 aa, Entamoeba invadens
GKPKISTEVLQRWILELGASIKKTYKDADTI

SEQ ID NO: 2939645 - protein, 19 aa, Entamoeba invadens
GKPKSCALINLDSDEAVNR

SEQ ID NO: 2939646 - protein, 25 aa, Entamoeba invadens
GKPLGGVRISFGFLSTFEEGYSLVQ

SEQ ID NO: 2939647 - protein, 24 aa, Entamoeba invadens
GKPLMEWLEASAFPAERKCKEESL

SEQ ID NO: 2939648 - protein, 18 aa, Entamoeba invadens
GKPMRILKAEGFKMKCFI

SEQ ID NO: 2939649 - protein, 25 aa, Entamoeba invadens
GKPPPRYRVIMLFEADSLSYEAQQS

SEQ ID NO: 2939650 - protein, 18 aa, Entamoeba invadens
GKPTGRMTPMMDSIENVL

SEQ ID NO: 2939651 - protein, 24 aa, Entamoeba invadens
GKPVEFKPKFNLFDRQEEERKGKS

SEQ ID NO: 2939652 - protein, 18 aa, Entamoeba invadens
GKPVMKIAEENGQFNVLF

SEQ ID NO: 2939653 - protein, 24 aa, Entamoeba invadens
GKQLKEALRRFGVKLEGDENKMNN

SEQ ID NO: 2939654 - protein, 18 aa, Entamoeba invadens
GKQLLKYGYNYYGSEPMY

SEQ ID NO: 2939655 - protein, 20 aa, Entamoeba invadens
GKQYIGLILFSAVLEGGCSL

SEQ ID NO: 2939656 - protein, 17 aa, Entamoeba invadens
GKRFVLKALITNDNIAF

SEQ ID NO: 2939657 - protein, 19 aa, Entamoeba invadens
GKRGFKGMMSDGKTSLQRT

SEQ ID NO: 2939658 - protein, 23 aa, Entamoeba invadens
GKRGGRGRPAAPVRQKVESFFDL

SEQ ID NO: 2939659 - protein, 22 aa, Entamoeba invadens
GKRGICLQCSFDYYNAPVVLCG

SEQ ID NO: 2939660 - protein, 19 aa, Entamoeba invadens
GKRIGLYLSTNETTKFRMN

SEQ ID NO: 2939661 - protein, 18 aa, Entamoeba invadens
GKRLKIDGLMPAKYQELM

SEQ ID NO: 2939662 - protein, 21 aa, Entamoeba invadens
GKRNFWCLVCNEKISHNEATR

SEQ ID NO: 2939663 - protein, 21 aa, Entamoeba invadens
GKRRKETVCLVEVLDEYDDHR

SEQ ID NO: 2939664 - protein, 20 aa, Entamoeba invadens
GKRVILLVRIKQASGEIGPL

SEQ ID NO: 2939665 - protein, 20 aa, Entamoeba invadens
GKRWEDHFEKVIQMPNLSPL

SEQ ID NO: 2939666 - protein, 19 aa, Entamoeba invadens
GKRYICSNCLVTHPKFNAN

SEQ ID NO: 2939667 - protein, 21 aa, Entamoeba invadens
GKSAILVALALCLGAKANFTN

SEQ ID NO: 2939668 - protein, 21 aa, Entamoeba invadens
GKSCFRGCNSLSSITIPLSVK

SEQ ID NO: 2939669 - protein, 19 aa, Entamoeba invadens
GKSCLISQVLEGGYKESVH

SEQ ID NO: 2939670 - protein, 17 aa, Entamoeba invadens
GKSDIIKTALSRNLSVE

SEQ ID NO: 2939671 - protein, 24 aa, Entamoeba invadens
GKSELRFNPLEFKHFGPKKEKFEK

SEQ ID NO: 2939672 - protein, 18 aa, Entamoeba invadens
GKSFKMFTKFVGSLTPPI

SEQ ID NO: 2939673 - protein, 19 aa, Entamoeba invadens
GKSGSLFMFTKDSKYILKV

SEQ ID NO: 2939674 - protein, 18 aa, Entamoeba invadens
GKSIFERCNCLKEVLIDA

SEQ ID NO: 2939675 - protein, 18 aa, Entamoeba invadens
GKSIIWEIVKQLRPGMSL

SEQ ID NO: 2939676 - protein, 18 aa, Entamoeba invadens
GKSIVHCIGLGSDVDGNL

SEQ ID NO: 2939677 - protein, 23 aa, Entamoeba invadens
GKSKEVFCCLCQKEVSVPFSDLD

SEQ ID NO: 2939678 - protein, 17 aa, Entamoeba invadens
GKSKIHMILVPADANME

SEQ ID NO: 2939679 - protein, 21 aa, Entamoeba invadens
GKSKKLVWLNHLGKAMVLVRV

SEQ ID NO: 2939680 - protein, 19 aa, Entamoeba invadens
GKSLLRSKMDSVWLSEQTS

SEQ ID NO: 2939681 - protein, 29 aa, Entamoeba invadens
GKSNFYDAIRFVLCDEKFGNLRAGDRQFL

SEQ ID NO: 2939682 - protein, 23 aa, Entamoeba invadens
GKSNLLLRFTRNEFDPEKRSTIG

SEQ ID NO: 2939683 - protein, 19 aa, Entamoeba invadens
GKSNLLLRFTRNEYEPEKK

SEQ ID NO: 2939684 - protein, 20 aa, Entamoeba invadens
GKSNTVWYIYMDKCTTNNKD

SEQ ID NO: 2939685 - protein, 17 aa, Entamoeba invadens
GKSPRNFFGKLKKQIGG

SEQ ID NO: 2939686 - protein, 20 aa, Entamoeba invadens
GKSQIAFTVFDQSGHLFGVF

SEQ ID NO: 2939687 - protein, 25 aa, Entamoeba invadens
GKSSFGYTSLRILKLNPLAEYSTNV

SEQ ID NO: 2939688 - protein, 21 aa, Entamoeba invadens
GKSTFLGHLFVDLKQVDQRTI

SEQ ID NO: 2939689 - protein, 28 aa, Entamoeba invadens
GKSTLLRTVCLAVIMAQMGMRCTAEELT

SEQ ID NO: 2939690 - protein, 27 aa, Entamoeba invadens
GKSTLVRMVLRIHRIFKLDELKHYLCF

SEQ ID NO: 2939691 - protein, 25 aa, Entamoeba invadens
GKSVEELRKTFGIVNDFTKEEEEEI

SEQ ID NO: 2939692 - protein, 20 aa, Entamoeba invadens
GKSVFLWLCDLEDQKLGGPG

SEQ ID NO: 2939693 - protein, 19 aa, Entamoeba invadens
GKSVLELLEQLDLGDERPG

SEQ ID NO: 2939694 - protein, 18 aa, Entamoeba invadens
GKSVLSKRGKNIGGSTPM

SEQ ID NO: 2939695 - protein, 18 aa, Entamoeba invadens
GKSVYECLIMELSTTEEI

SEQ ID NO: 2939696 - protein, 20 aa, Entamoeba invadens
GKTAAFSIGVLQQIDISSNV

SEQ ID NO: 2939697 - protein, 19 aa, Entamoeba invadens
GKTAMIRRLLDDEFSEEKG

SEQ ID NO: 2939698 - protein, 17 aa, Entamoeba invadens
GKTAVGIYTNFSKEVPQ

SEQ ID NO: 2939699 - protein, 20 aa, Entamoeba invadens
GKTCIPRKTCYKCQHLKEVV

SEQ ID NO: 2939700 - protein, 19 aa, Entamoeba invadens
GKTCIPRMTCYDCKHLKEV

SEQ ID NO: 2939701 - protein, 19 aa, Entamoeba invadens
GKTDALVNCSISYSTAEFV

SEQ ID NO: 2939702 - protein, 29 aa, Entamoeba invadens
GKTDYFAKYFIAKSVRVIDDMVVDMNGAP

SEQ ID NO: 2939703 - protein, 21 aa, Entamoeba invadens
GKTEFASFVLDAEDSSATVYS

SEQ ID NO: 2939704 - protein, 25 aa, Entamoeba invadens
GKTELDLTVIDWLRLQDYRIRPQKG

SEQ ID NO: 2939705 - protein, 18 aa, Entamoeba invadens
GKTFFECCKVDTHIHANW

SEQ ID NO: 2939706 - protein, 18 aa, Entamoeba invadens
GKTFKLKVTCFGKNYRIP

SEQ ID NO: 2939707 - protein, 20 aa, Entamoeba invadens
GKTFKLTKRTGYAVEVGDLS

SEQ ID NO: 2939708 - protein, 19 aa, Entamoeba invadens
GKTGWDYICQGCGKTCDCF

SEQ ID NO: 2939709 - protein, 19 aa, Entamoeba invadens
GKTHIKGMNTITVTMYENK

SEQ ID NO: 2939710 - protein, 18 aa, Entamoeba invadens
GKTICLVTVPSFYKEKKF

SEQ ID NO: 2939711 - protein, 26 aa, Entamoeba invadens
GKTIELRIAFNLKTKLFANVVTITQK

SEQ ID NO: 2939712 - protein, 34 aa, Entamoeba invadens
GKTKEFGEALTLILRSPIALKRLDLGNIGLTEEV

SEQ ID NO: 2939713 - protein, 19 aa, Entamoeba invadens
GKTKGFAFVMYVVPQDAVK

SEQ ID NO: 2939714 - protein, 20 aa, Entamoeba invadens
GKTKIFFRLVFLLKLKKLER

SEQ ID NO: 2939715 - protein, 18 aa, Entamoeba invadens
GKTLHAFSILFYVNTTTC

SEQ ID NO: 2939716 - protein, 21 aa, Entamoeba invadens
GKTLKFTKCETLSDIYVNTKM

SEQ ID NO: 2939717 - protein, 18 aa, Entamoeba invadens
GKTLLHYVVEHGFVDMAM

SEQ ID NO: 2939718 - protein, 21 aa, Entamoeba invadens
GKTLSFLIPLVQRFIEKGTFD

SEQ ID NO: 2939719 - protein, 18 aa, Entamoeba invadens
GKTLYEFVCSTKKSDKVI

SEQ ID NO: 2939720 - protein, 17 aa, Entamoeba invadens
GKTMIARAIANETGAFF

SEQ ID NO: 2939721 - protein, 24 aa, Entamoeba invadens
GKTMTLCGIIGVILYGNSSSVFSK

SEQ ID NO: 2939722 - protein, 19 aa, Entamoeba invadens
GKTPHFPHAEFFGQRLVEN

SEQ ID NO: 2939723 - protein, 25 aa, Entamoeba invadens
GKTQIKLRFCQGIFVENYNPTMEDQ

SEQ ID NO: 2939724 - protein, 18 aa, Entamoeba invadens
GKTRLILSYNTERYPPHE

SEQ ID NO: 2939725 - protein, 18 aa, Entamoeba invadens
GKTSFLISFIENRFDEAY

SEQ ID NO: 2939726 - protein, 21 aa, Entamoeba invadens
GKTSFVRRMLDDTFSEEPQPY

SEQ ID NO: 2939727 - protein, 27 aa, Entamoeba invadens
GKTSILYKLRLGEIVTTIPTIGFNAET

SEQ ID NO: 2939728 - protein, 19 aa, Entamoeba invadens
GKTSLIRRFVHGAQIIEHT

SEQ ID NO: 2939729 - protein, 18 aa, Entamoeba invadens
GKTSVLMMVGLQGAGKTT

SEQ ID NO: 2939730 - protein, 20 aa, Entamoeba invadens
GKTTKCVLRKSNIDTASAVS

SEQ ID NO: 2939731 - protein, 18 aa, Entamoeba invadens
GKTYFVKWVGLQYGECSW

SEQ ID NO: 2939732 - protein, 22 aa, Entamoeba invadens
GKVCPTHAFVSATIALERRANV

SEQ ID NO: 2939733 - protein, 26 aa, Entamoeba invadens
GKVEKLRFGFDRAFGPSSTQEIIFEE

SEQ ID NO: 2939734 - protein, 23 aa, Entamoeba invadens
GKVGKVIKKKVIIEEKQYENDSP

SEQ ID NO: 2939735 - protein, 18 aa, Entamoeba invadens
GKVIAGGISGLLLEGKTR

SEQ ID NO: 2939736 - protein, 19 aa, Entamoeba invadens
GKVIVVGSEMCWKSNQRFV

SEQ ID NO: 2939737 - protein, 26 aa, Entamoeba invadens
GKVKKVRGGEILKICDLEGRDEAQGK

SEQ ID NO: 2939738 - protein, 25 aa, Entamoeba invadens
GKVKRYNIKNELLIDIFEYRFPITS

SEQ ID NO: 2939739 - protein, 23 aa, Entamoeba invadens
GKVLCVKNSIFAKDVDMEDFEDE

SEQ ID NO: 2939740 - protein, 25 aa, Entamoeba invadens
GKVMFKPNCFFISFDKKGSIFGGYL

SEQ ID NO: 2939741 - protein, 25 aa, Entamoeba invadens
GKVNLKFDSYIFWSLTIPNKTKLVK

SEQ ID NO: 2939742 - protein, 17 aa, Entamoeba invadens
GKVPFGLESLRNKMVKQ

SEQ ID NO: 2939743 - protein, 17 aa, Entamoeba invadens
GKVPVKLVKAISVLFKN

SEQ ID NO: 2939744 - protein, 19 aa, Entamoeba invadens
GKVSDFTSVIIINRDNVQK

SEQ ID NO: 2939745 - protein, 19 aa, Entamoeba invadens
GKWGNKMYFEYINVHGERS

SEQ ID NO: 2939746 - protein, 23 aa, Entamoeba invadens
GKWSELKEVLKKEVDEEICYTDD

SEQ ID NO: 2939747 - protein, 18 aa, Entamoeba invadens
GKWVNGTKFCTHCGTKVP

SEQ ID NO: 2939748 - protein, 26 aa, Entamoeba invadens
GKYARLTVPILKSFLMASHVVVTNKD

SEQ ID NO: 2939749 - protein, 25 aa, Entamoeba invadens
GKYCFDGCSSLHGITIPSSVTSIGI

SEQ ID NO: 2939750 - protein, 23 aa, Entamoeba invadens
GKYEKDIAEITVRAVTLEKNVQM

SEQ ID NO: 2939751 - protein, 23 aa, Entamoeba invadens
GKYEKDIAKIIVRAETLEKNVQM

SEQ ID NO: 2939752 - protein, 19 aa, Entamoeba invadens
GKYFYIKDLTTVCAFAVGG

SEQ ID NO: 2939753 - protein, 24 aa, Entamoeba invadens
GKYKKDIAEITVRAETLEKNMGTN

SEQ ID NO: 2939754 - protein, 24 aa, Entamoeba invadens
GKYKVIVLHCAKVVESLILRVFGK

SEQ ID NO: 2939755 - protein, 21 aa, Entamoeba invadens
GKYQDYEWLNGINVMELVDAV

SEQ ID NO: 2939756 - protein, 20 aa, Entamoeba invadens
GKYWKCDKCFTVFGKDKFTL

SEQ ID NO: 2939757 - protein, 18 aa, Entamoeba invadens
GLADEFLNDFYMDDGNAQ

SEQ ID NO: 2939758 - protein, 23 aa, Entamoeba invadens
GLAEKRKARCSGIRGKNERRYAF

SEQ ID NO: 2939759 - protein, 25 aa, Entamoeba invadens
GLCECQRNALPQVYQLLFEHIEELK

SEQ ID NO: 2939760 - protein, 18 aa, Entamoeba invadens
GLCELCDPIFSSLISISG

SEQ ID NO: 2939761 - protein, 22 aa, Entamoeba invadens
GLCERLSFDFFPLSLVDPLIHL

SEQ ID NO: 2939762 - protein, 23 aa, Entamoeba invadens
GLCKPCDLTCGGSCDSTNGTCIT

SEQ ID NO: 2939763 - protein, 36 aa, Entamoeba invadens
GLCVCVRSKECGLFGLKISSTMWDGSFPKMNKVGTG

SEQ ID NO: 2939764 - protein, 24 aa, Entamoeba invadens
GLDEFSRRAFLQSISKTKLPPLFC

SEQ ID NO: 2939765 - protein, 19 aa, Entamoeba invadens
GLDGVPIFINKEAMARCYA

SEQ ID NO: 2939766 - protein, 17 aa, Entamoeba invadens
GLDIFASYVEKLGDVVV

SEQ ID NO: 2939767 - protein, 20 aa, Entamoeba invadens
GLDIPEVDWIIQMDLPDGPT

SEQ ID NO: 2939768 - protein, 17 aa, Entamoeba invadens
GLDKLAGIVLINPQVEK

SEQ ID NO: 2939769 - protein, 17 aa, Entamoeba invadens
GLDQRKVNMLAREYAAT

SEQ ID NO: 2939770 - protein, 17 aa, Entamoeba invadens
GLEELKSMFPDVDPQVI

SEQ ID NO: 2939771 - protein, 18 aa, Entamoeba invadens
GLEETVRVLPLIDYQNFQ

SEQ ID NO: 2939772 - protein, 23 aa, Entamoeba invadens
GLEETVRVLPLIDYQNFQMNISV

SEQ ID NO: 2939773 - protein, 22 aa, Entamoeba invadens
GLELRSVSLFSDIDQHFDIWLR

SEQ ID NO: 2939774 - protein, 35 aa, Entamoeba invadens
GLERLMKILKLVGFKVAILSGGFTYFGNYLKDKYG

SEQ ID NO: 2939775 - protein, 26 aa, Entamoeba invadens
GLERRRVVFDFPDFVDSPLMQKFPEN

SEQ ID NO: 2939776 - protein, 25 aa, Entamoeba invadens
GLETIPHCAFFRCYKLSEIKVPNSV

SEQ ID NO: 2939777 - protein, 26 aa, Entamoeba invadens
GLFASRFSAAVLWAGFSSSLPIMTSA

SEQ ID NO: 2939778 - protein, 18 aa, Entamoeba invadens
GLFGIVYKVTYRGNVVAI

SEQ ID NO: 2939779 - protein, 24 aa, Entamoeba invadens
GLFGLKLNLCVNFTFDGASTMIFD

SEQ ID NO: 2939780 - protein, 25 aa, Entamoeba invadens
GLFGLKLNLCVNFTFDGASTMISDE

SEQ ID NO: 2939781 - protein, 19 aa, Entamoeba invadens
GLFKNFFAKHQGVKIEKEK

SEQ ID NO: 2939782 - protein, 19 aa, Entamoeba invadens
GLFKRALQIFDQFDDIRRV

SEQ ID NO: 2939783 - protein, 24 aa, Entamoeba invadens
GLFKSKKLRFVNVAFNDLEELKIK

SEQ ID NO: 2939784 - protein, 19 aa, Entamoeba invadens
GLFKVIRNVFQIEMKECSE

SEQ ID NO: 2939785 - protein, 24 aa, Entamoeba invadens
GLFPEYEPSLLFQDHVPSNCIIEI

SEQ ID NO: 2939786 - protein, 17 aa, Entamoeba invadens
GLFRGICHKNEFNEFDN

SEQ ID NO: 2939787 - protein, 24 aa, Entamoeba invadens
GLFSYCHRLRRVVLPHTLKKISEN

SEQ ID NO: 2939788 - protein, 22 aa, Entamoeba invadens
GLGDMKGRVSLYKYGDLTVPEM

SEQ ID NO: 2939789 - protein, 27 aa, Entamoeba invadens
GLGFSTLNMFCCLSLLERYKATLLTKS

SEQ ID NO: 2939790 - protein, 20 aa, Entamoeba invadens
GLGGMGGLPGMGMPAMGGMP

SEQ ID NO: 2939791 - protein, 21 aa, Entamoeba invadens
GLGLCSGCTNLPYFELPDQLE

SEQ ID NO: 2939792 - protein, 22 aa, Entamoeba invadens
GLGQALTGLSFVVKQLDGRELL

SEQ ID NO: 2939793 - protein, 19 aa, Entamoeba invadens
GLGSTGAWDNTAMSVVNAV

SEQ ID NO: 2939794 - protein, 18 aa, Entamoeba invadens
GLHFKISPLTFFQTNSLG

SEQ ID NO: 2939795 - protein, 17 aa, Entamoeba invadens
GLIDKKRAEGMLTGKVD

SEQ ID NO: 2939796 - protein, 26 aa, Entamoeba invadens
GLIKTVPSLIGIVGMICVFHMFANSQ

SEQ ID NO: 2939797 - protein, 24 aa, Entamoeba invadens
GLIPKYCIAVGCADLIGQAISISK

SEQ ID NO: 2939798 - protein, 20 aa, Entamoeba invadens
GLIRHAALNYSRPVYLAPTT

SEQ ID NO: 2939799 - protein, 24 aa, Entamoeba invadens
GLIRNLCRDYLLIVKKSMKDLVPK

SEQ ID NO: 2939800 - protein, 19 aa, Entamoeba invadens
GLISGMMGWVGKKENVAEY

SEQ ID NO: 2939801 - protein, 20 aa, Entamoeba invadens
GLIVMGLWLNIYTYDIVQAP

SEQ ID NO: 2939802 - protein, 23 aa, Entamoeba invadens
GLKEFPIHTSPHFPRIIQECCRR

SEQ ID NO: 2939803 - protein, 22 aa, Entamoeba invadens
GLKEVFYTAVELCMVDKKQNQV

SEQ ID NO: 2939804 - protein, 26 aa, Entamoeba invadens
GLKFKHLDCNQAYQVRKGVKFTTYQG

SEQ ID NO: 2939805 - protein, 28 aa, Entamoeba invadens
GLKKMDIRSSDPYCIVTVGIEQRKSRTV

SEQ ID NO: 2939806 - protein, 20 aa, Entamoeba invadens
GLKNALCGRQHPGTFQPTRI

SEQ ID NO: 2939807 - protein, 20 aa, Entamoeba invadens
GLKPYDPVVLSFLGQNNSTI

SEQ ID NO: 2939808 - protein, 25 aa, Entamoeba invadens
GLKQFTDLFISYGYCEIEYILEMTS

SEQ ID NO: 2939809 - protein, 19 aa, Entamoeba invadens
GLKRAVGFQQKMYLTNEQQ

SEQ ID NO: 2939810 - protein, 24 aa, Entamoeba invadens
GLKSDELRKLFHLVGGSYKDSDTR

SEQ ID NO: 2939811 - protein, 25 aa, Entamoeba invadens
GLKSPKAECPFFHLSQLLLDPHESP

SEQ ID NO: 2939812 - protein, 23 aa, Entamoeba invadens
GLKTLKIAGALALNKTIRTFDCS

SEQ ID NO: 2939813 - protein, 26 aa, Entamoeba invadens
GLKTLRPVHRLDRMTSGILILAKSAD

SEQ ID NO: 2939814 - protein, 24 aa, Entamoeba invadens
GLKVFKLFGERPMYFVSGKNVYYQ

SEQ ID NO: 2939815 - protein, 21 aa, Entamoeba invadens
GLKVSQYVIGFMRFKNKTVEQ

SEQ ID NO: 2939816 - protein, 20 aa, Entamoeba invadens
GLKYKQGISTWKVFDKNYTE

SEQ ID NO: 2939817 - protein, 18 aa, Entamoeba invadens
GLLEFIPEVKVLIEQLND

SEQ ID NO: 2939818 - protein, 24 aa, Entamoeba invadens
GLLEKESFILLLVVIACLDSGKLA

SEQ ID NO: 2939819 - protein, 24 aa, Entamoeba invadens
GLLERPKRELRWFDKTKCLKSGEE

SEQ ID NO: 2939820 - protein, 20 aa, Entamoeba invadens
GLLHGLAFSSFVIQYYGLVL

SEQ ID NO: 2939821 - protein, 20 aa, Entamoeba invadens
GLLHLWRPQEIEQFTTFTQS

SEQ ID NO: 2939822 - protein, 18 aa, Entamoeba invadens
GLLIKLKLFQSVQYKKSL

SEQ ID NO: 2939823 - protein, 19 aa, Entamoeba invadens
GLLNFCLTHGFVGGDNKPR

SEQ ID NO: 2939824 - protein, 23 aa, Entamoeba invadens
GLLNTRCSFTLKKQRKQTTISET

SEQ ID NO: 2939825 - protein, 20 aa, Entamoeba invadens
GLLRKCFISTKGFFYTASVC

SEQ ID NO: 2939826 - protein, 23 aa, Entamoeba invadens
GLLSELTGMMGMVKNVPGIDEAI

SEQ ID NO: 2939827 - protein, 18 aa, Entamoeba invadens
GLMAVDVVTPFPPNFKRM

SEQ ID NO: 2939828 - protein, 19 aa, Entamoeba invadens
GLMCNLAFSVDHFSVDTWI

SEQ ID NO: 2939829 - protein, 18 aa, Entamoeba invadens
GLMVFKDKFGSFPKSHCE

SEQ ID NO: 2939830 - protein, 20 aa, Entamoeba invadens
GLNCNCSLIVGPPGTGKSTV

SEQ ID NO: 2939831 - protein, 19 aa, Entamoeba invadens
GLNCYECLLNCSTCNTKEK

SEQ ID NO: 2939832 - protein, 26 aa, Entamoeba invadens
GLNEQCVELFLTFIEMFPKKCKPVKD

SEQ ID NO: 2939833 - protein, 18 aa, Entamoeba invadens
GLNLKRKGIDTAISLEEV

SEQ ID NO: 2939834 - protein, 19 aa, Entamoeba invadens
GLNLPFSCDANFSKMAKGK

SEQ ID NO: 2939835 - protein, 19 aa, Entamoeba invadens
GLNPVMLEIIRILNYDKPT

SEQ ID NO: 2939836 - protein, 24 aa, Entamoeba invadens
GLNQLFWKKIFVLKTIPYSPQCNA

SEQ ID NO: 2939837 - protein, 22 aa, Entamoeba invadens
GLNRGFGFPVFYTVIEANMIEK

SEQ ID NO: 2939838 - protein, 18 aa, Entamoeba invadens
GLNYMCQIGRDMGATPPR

SEQ ID NO: 2939839 - protein, 18 aa, Entamoeba invadens
GLPAEIDFTLNGVRTTFH

SEQ ID NO: 2939840 - protein, 19 aa, Entamoeba invadens
GLPAIKYFGLEGEFRVLVM

SEQ ID NO: 2939841 - protein, 18 aa, Entamoeba invadens
GLPDVKFKPAYNPYTEPS

SEQ ID NO: 2939842 - protein, 19 aa, Entamoeba invadens
GLPERLEKELKRLCTENKM

SEQ ID NO: 2939843 - protein, 22 aa, Entamoeba invadens
GLPERYDMELILKHFKHTFSCN

SEQ ID NO: 2939844 - protein, 23 aa, Entamoeba invadens
GLPKDLWKGNVEEVVEVIEDKNL

SEQ ID NO: 2939845 - protein, 23 aa, Entamoeba invadens
GLPNLPIHGIIDWVVEKGGNEFL

SEQ ID NO: 2939846 - protein, 20 aa, Entamoeba invadens
GLPRLKKLIDNFLVDQNTDP

SEQ ID NO: 2939847 - protein, 20 aa, Entamoeba invadens
GLPRVVKRETPIIANKAFVF

SEQ ID NO: 2939848 - protein, 26 aa, Entamoeba invadens
GLQNDREWHSFCAHVLQQPALAQDAR

SEQ ID NO: 2939849 - protein, 27 aa, Entamoeba invadens
GLQSYTIPDHIWKLGQMAFKRCTNITE

SEQ ID NO: 2939850 - protein, 26 aa, Entamoeba invadens
GLQWIKEFVVLMKKWYGVQKAFNIDK

SEQ ID NO: 2939851 - protein, 20 aa, Entamoeba invadens
GLRKRRFILVNSKEYETDEV

SEQ ID NO: 2939852 - protein, 17 aa, Entamoeba invadens
GLRNGFEVLSIYSIQWN

SEQ ID NO: 2939853 - protein, 23 aa, Entamoeba invadens
GLRRHITMINRFFKTLTDLPTNL

SEQ ID NO: 2939854 - protein, 19 aa, Entamoeba invadens
GLRYLCKVINEGSVQANPS

SEQ ID NO: 2939855 - protein, 19 aa, Entamoeba invadens
GLSDLMVICVGKNMNIFGW

SEQ ID NO: 2939856 - protein, 18 aa, Entamoeba invadens
GLSHIKITCNLHYVDATY

SEQ ID NO: 2939857 - protein, 26 aa, Entamoeba invadens
GLSKGCCYGAALKLAVDLLNNRGGTV

SEQ ID NO: 2939858 - protein, 19 aa, Entamoeba invadens
GLSLDIPKWSEIVCDVNKM

SEQ ID NO: 2939859 - protein, 18 aa, Entamoeba invadens
GLSLEIIQQFTIDINNAL

SEQ ID NO: 2939860 - protein, 19 aa, Entamoeba invadens
GLSPEMFHLMVSLLSAKQL

SEQ ID NO: 2939861 - protein, 29 aa, Entamoeba invadens
GLSPRGFVEFIKRYCEVIQDELNHERLPQ

SEQ ID NO: 2939862 - protein, 24 aa, Entamoeba invadens
GLSRKLGGVKFFFCSAKNGEGVQE

SEQ ID NO: 2939863 - protein, 23 aa, Entamoeba invadens
GLSRSACVIVAYLMMTYQINIKT

SEQ ID NO: 2939864 - protein, 24 aa, Entamoeba invadens
GLSRSACVIVAYLMMTYQINIKTA

SEQ ID NO: 2939865 - protein, 17 aa, Entamoeba invadens
GLSSCFLGTLPYLRVYR

SEQ ID NO: 2939866 - protein, 23 aa, Entamoeba invadens
GLSSMACARGHIVTGMKNGSVFV

SEQ ID NO: 2939867 - protein, 20 aa, Entamoeba invadens
GLSVSGVFETFVPREVVLPV

SEQ ID NO: 2939868 - protein, 17 aa, Entamoeba invadens
GLSYVIGIYLDDNLSKQ

SEQ ID NO: 2939869 - protein, 21 aa, Entamoeba invadens
GLTCKNCKRVYFCDKCSNNVD

SEQ ID NO: 2939870 - protein, 18 aa, Entamoeba invadens
GLTKKYWLAIYRDSEAPY

SEQ ID NO: 2939871 - protein, 24 aa, Entamoeba invadens
GLTRPKVVFFSNIMDRADISDFNN

SEQ ID NO: 2939872 - protein, 25 aa, Entamoeba invadens
GLTVELRHVLKWHESDVMSMMNQCE

SEQ ID NO: 2939873 - protein, 25 aa, Entamoeba invadens
GLVAGCFTNNLAFRNWYAKFIGESF

SEQ ID NO: 2939874 - protein, 17 aa, Entamoeba invadens
GLVHSWASIRVEILQLI

SEQ ID NO: 2939875 - protein, 24 aa, Entamoeba invadens
GLVIEMIRMYGIRPCELGPFGFEW

SEQ ID NO: 2939876 - protein, 18 aa, Entamoeba invadens
GLVKQCRKALKERYMYLF

SEQ ID NO: 2939877 - protein, 31 aa, Entamoeba invadens
GLVLKPIRLWGIWTERWMVLTRDKLYYFDSS

SEQ ID NO: 2939878 - protein, 22 aa, Entamoeba invadens
GLVMPSSLPFFVDHVTTCIQMT

SEQ ID NO: 2939879 - protein, 17 aa, Entamoeba invadens
GLVNNALFLLDKILRTV

SEQ ID NO: 2939880 - protein, 17 aa, Entamoeba invadens
GLVSVASCRAELKKKQI

SEQ ID NO: 2939881 - protein, 18 aa, Entamoeba invadens
GLVTRLINLTSLKCGKIN

SEQ ID NO: 2939882 - protein, 25 aa, Entamoeba invadens
GLVVPRRTSVALSINKSGNAAVMRR

SEQ ID NO: 2939883 - protein, 24 aa, Entamoeba invadens
GLVYKVRLPLFTQYLYVQNNTLRS

SEQ ID NO: 2939884 - protein, 19 aa, Entamoeba invadens
GLYIIKMDLCIDDGNHRMV

SEQ ID NO: 2939885 - protein, 20 aa, Entamoeba invadens
GLYIKCYSKYFLNKEYPPKC

SEQ ID NO: 2939886 - protein, 24 aa, Entamoeba invadens
GLYLCSGCTNLPYFELPDQLEEIP

SEQ ID NO: 2939887 - protein, 18 aa, Entamoeba invadens
GLYLPLNLLMSIFKQIAV

SEQ ID NO: 2939888 - protein, 24 aa, Entamoeba invadens
GLYQMIFHPIDFFTPEEKKVGTVT

SEQ ID NO: 2939889 - protein, 19 aa, Entamoeba invadens
GLYYRGVGVVTPIFSLRTR

SEQ ID NO: 2939890 - protein, 24 aa, Entamoeba invadens
  misc_feature (18)..(19): Xaa can be any naturally occurring amino acid
GMACFKNCKIERICIQTXXECINL

SEQ ID NO: 2939891 - protein, 20 aa, Entamoeba invadens
GMAFQCLRLVLTERTDFSFL

SEQ ID NO: 2939892 - protein, 24 aa, Entamoeba invadens
GMAPGMCPGMAPGMAPGMYPPPMG

SEQ ID NO: 2939893 - protein, 20 aa, Entamoeba invadens
GMCCFSRCYSLQSISVPSSL

SEQ ID NO: 2939894 - protein, 17 aa, Entamoeba invadens
GMCQKWNDKIVCNSGVV

SEQ ID NO: 2939895 - protein, 22 aa, Entamoeba invadens
GMCSCQNSVFGIIEMTESYKNS

SEQ ID NO: 2939896 - protein, 17 aa, Entamoeba invadens
GMCTPKCQDYEERINGV

SEQ ID NO: 2939897 - protein, 18 aa, Entamoeba invadens
GMDANSMFADLAKDPELM

SEQ ID NO: 2939898 - protein, 17 aa, Entamoeba invadens
GMDEMKQAVLLAKKPNV

SEQ ID NO: 2939899 - protein, 18 aa, Entamoeba invadens
GMDGGWFFKGELSCDIIR

SEQ ID NO: 2939900 - protein, 26 aa, Entamoeba invadens
GMDPQRFSKFLSCIANTIIAVQTTSG

SEQ ID NO: 2939901 - protein, 21 aa, Entamoeba invadens
GMEGVIRFYDFGGMDARFSSF

SEQ ID NO: 2939902 - protein, 17 aa, Entamoeba invadens
GMELVTFQNKDGTTHEA

SEQ ID NO: 2939903 - protein, 31 aa, Entamoeba invadens
GMEVFGAKRPVSWIMICRVILYSLMEIHKGT

SEQ ID NO: 2939904 - protein, 21 aa, Entamoeba invadens
GMEYWMKHAVFDSDKGVCRIS

SEQ ID NO: 2939905 - protein, 19 aa, Entamoeba invadens
GMFKDCIELDELVNIQNIK

SEQ ID NO: 2939906 - protein, 18 aa, Entamoeba invadens
GMFLEMRYGEYAMVQRVN

SEQ ID NO: 2939907 - protein, 19 aa, Entamoeba invadens
GMGCTAVVALIIDNKIYCG

SEQ ID NO: 2939908 - protein, 30 aa, Entamoeba invadens
GMGIDRSDVRFVVHWNIPKNIEGFIQEAGR

SEQ ID NO: 2939909 - protein, 27 aa, Entamoeba invadens
GMGINKPDVRFVIHHSLPKTLEGYYQE

SEQ ID NO: 2939910 - protein, 26 aa, Entamoeba invadens
GMGMMGRPGLKIKLTLDKIKVPDQKF

SEQ ID NO: 2939911 - protein, 18 aa, Entamoeba invadens
GMIEYSLMELFLKKFDLT

SEQ ID NO: 2939912 - protein, 23 aa, Entamoeba invadens
GMIISKRGIIRCLIPEEVNSLKQ

SEQ ID NO: 2939913 - protein, 28 aa, Entamoeba invadens
GMIKKEEELMMWKGQTVGQYLRSTFGKA

SEQ ID NO: 2939914 - protein, 39 aa, Entamoeba invadens
GMINYNRVRIFFKFILSVLKLKSFPSLFAVFELTEKQLV

SEQ ID NO: 2939915 - protein, 24 aa, Entamoeba invadens
GMIPEIVSAFNFHIGNLGRSGIGN

SEQ ID NO: 2939916 - protein, 27 aa, Entamoeba invadens
GMIRGWDLYTGKCVQCYTQHKKGVRCL

SEQ ID NO: 2939917 - protein, 18 aa, Entamoeba invadens
GMKFSIARFDSVMRYDPK

SEQ ID NO: 2939918 - protein, 23 aa, Entamoeba invadens
GMKMIYRDVSTFDITTIDTINAS

SEQ ID NO: 2939919 - protein, 17 aa, Entamoeba invadens
GMLDRCGLIIGKHLKRK

SEQ ID NO: 2939920 - protein, 41 aa, Entamoeba invadens
GMLIAKWKKPGFGHLCCLKCLRPKQGSNSVCICRVPEDERD

SEQ ID NO: 2939921 - protein, 29 aa, Entamoeba invadens
GMLIRINKAVITKMFPGVPLVCASNSVTQ

SEQ ID NO: 2939922 - protein, 17 aa, Entamoeba invadens
GMLLMFDLSNLKSLDNL

SEQ ID NO: 2939923 - protein, 19 aa, Entamoeba invadens
GMLSLVRFSTEESVRLLTQ

SEQ ID NO: 2939924 - protein, 20 aa, Entamoeba invadens
GMMFPMKNQPLLIQVISGVY

SEQ ID NO: 2939925 - protein, 22 aa, Entamoeba invadens
GMMIRSALQISQILITHNFPSK

SEQ ID NO: 2939926 - protein, 23 aa, Entamoeba invadens
GMMLAKRIGAFAFYEVSRNGFFN

SEQ ID NO: 2939927 - protein, 17 aa, Entamoeba invadens
GMMLMDFYRELAMQQLV

SEQ ID NO: 2939928 - protein, 23 aa, Entamoeba invadens
GMMPPPGMGMPGMGMMGRPGLKI

SEQ ID NO: 2939929 - protein, 28 aa, Entamoeba invadens
GMMPPPGMGMPGMMGGFGAPQVLNGLVD

SEQ ID NO: 2939930 - protein, 39 aa, Entamoeba invadens
GMMSTEEFVYCGFHLKYFEACLVEFTWAGVYSPSYSVNL

SEQ ID NO: 2939931 - protein, 29 aa, Entamoeba invadens
GMNCAFGRWPVKSCNFILKLIKSAVDNAK

SEQ ID NO: 2939932 - protein, 18 aa, Entamoeba invadens
GMNRSVLVTKIEFENNME

SEQ ID NO: 2939933 - protein, 23 aa, Entamoeba invadens
GMNVWLMLFARLVLKTKNTKNFG

SEQ ID NO: 2939934 - protein, 29 aa, Entamoeba invadens
GMPYTVGKYDWWSLTPAVMLSRFKLKTLT

SEQ ID NO: 2939935 - protein, 17 aa, Entamoeba invadens
GMQLRKSFCAFEEASPR

SEQ ID NO: 2939936 - protein, 17 aa, Entamoeba invadens
GMRNLRVLYDKSMPEVD

SEQ ID NO: 2939937 - protein, 29 aa, Entamoeba invadens
GMSALNFNSKVCGKENIMIIVITTEGYSF

SEQ ID NO: 2939938 - protein, 27 aa, Entamoeba invadens
GMSASLRSPLMFSMPKQAEWGLVGNHD

SEQ ID NO: 2939939 - protein, 24 aa, Entamoeba invadens
GMSDIYVALLMKWMKKGEKESESK

SEQ ID NO: 2939940 - protein, 25 aa, Entamoeba invadens
GMSEECQRMAFLIGLLNANGVGFSI

SEQ ID NO: 2939941 - protein, 22 aa, Entamoeba invadens
GMSLHSFFDGLKLGKYINKLAV

SEQ ID NO: 2939942 - protein, 22 aa, Entamoeba invadens
GMSLVYPLLFWVQKYRDNTNVT

SEQ ID NO: 2939943 - protein, 18 aa, Entamoeba invadens
GMSTRRGTAVFLQDILDD

SEQ ID NO: 2939944 - protein, 17 aa, Entamoeba invadens
GMTAPRVIFECRNLKNL

SEQ ID NO: 2939945 - protein, 27 aa, Entamoeba invadens
GMTSLGYYGFRGCDNLSQIVFTNRVKM

SEQ ID NO: 2939946 - protein, 21 aa, Entamoeba invadens
GMVQAALYAPFDLIFKTLMKV

SEQ ID NO: 2939947 - protein, 27 aa, Entamoeba invadens
GMVYKRPCGYMRYALNVIGKFDNGNDT

SEQ ID NO: 2939948 - protein, 24 aa, Entamoeba invadens
GMWRLKEMLENRVLSLYDYSIDTK

SEQ ID NO: 2939949 - protein, 25 aa, Entamoeba invadens
GMYFSTRLKVFIKENESTFCDLSLQ

SEQ ID NO: 2939950 - protein, 27 aa, Entamoeba invadens
GMYTTEILDCIKMPNAVKEEQRIEEHV

SEQ ID NO: 2939951 - protein, 25 aa, Entamoeba invadens
GMYVVYCYYSTYLLSCNASVLIKAY

SEQ ID NO: 2939952 - protein, 23 aa, Entamoeba invadens
GNADAMYNLGLCYYKGKGSFKQC

SEQ ID NO: 2939953 - protein, 17 aa, Entamoeba invadens
GNAIVYPTGTLKQEVGK

SEQ ID NO: 2939954 - protein, 20 aa, Entamoeba invadens
GNAKYAELVRMILHVTVNGG

SEQ ID NO: 2939955 - protein, 22 aa, Entamoeba invadens
GNATVADILLENGIGIDHTDVT

SEQ ID NO: 2939956 - protein, 17 aa, Entamoeba invadens
GNCKDRVLIPYDLLDRY

SEQ ID NO: 2939957 - protein, 22 aa, Entamoeba invadens
GNCKECAEGLSLIEKASDTSAV

SEQ ID NO: 2939958 - protein, 25 aa, Entamoeba invadens
GNCQKCSVNGCKRCSDGETCDMCSE

SEQ ID NO: 2939959 - protein, 25 aa, Entamoeba invadens
GNCQKCSVSGCKRCSDGETCDMCSG

SEQ ID NO: 2939960 - protein, 19 aa, Entamoeba invadens
GNCQQRQCMCYALEAAGKG

SEQ ID NO: 2939961 - protein, 21 aa, Entamoeba invadens
GNCSTECRLFTPDGLPFGDVL

SEQ ID NO: 2939962 - protein, 24 aa, Entamoeba invadens
GNCTCSMCKKLFVVPITLNCGHTF

SEQ ID NO: 2939963 - protein, 21 aa, Entamoeba invadens
GNCVFGIANFFSVFKTRQGYI

SEQ ID NO: 2939964 - protein, 25 aa, Entamoeba invadens
GNDDLEFPLCFTVFGATKYSLNNEG

SEQ ID NO: 2939965 - protein, 18 aa, Entamoeba invadens
GNDFIKKLSIGKHTLYTS

SEQ ID NO: 2939966 - protein, 29 aa, Entamoeba invadens
GNDFMAKFNGSFCNLPLLEHLSFIDSPGV

SEQ ID NO: 2939967 - protein, 23 aa, Entamoeba invadens
GNDKCFICKKFTSVVDIGSGKFY

SEQ ID NO: 2939968 - protein, 20 aa, Entamoeba invadens
GNDKLICIWGKDGKLEKKIE

SEQ ID NO: 2939969 - protein, 19 aa, Entamoeba invadens
GNDLEFCEFNLDLRFLPDD

SEQ ID NO: 2939970 - protein, 25 aa, Entamoeba invadens
GNDLEFVDYLFLAMVIYIREPILKS

SEQ ID NO: 2939971 - protein, 20 aa, Entamoeba invadens
GNDLVVQWLLNKGASCETEN

SEQ ID NO: 2939972 - protein, 17 aa, Entamoeba invadens
GNDSFDFGGSPKKSPQL

SEQ ID NO: 2939973 - protein, 21 aa, Entamoeba invadens
GNDVDFCRCGDFMFDGGRVCP

SEQ ID NO: 2939974 - protein, 20 aa, Entamoeba invadens
GNECFKDCKSLKEVDLSNVT

SEQ ID NO: 2939975 - protein, 22 aa, Entamoeba invadens
GNECFKMCRNLSLITLPANLKD

SEQ ID NO: 2939976 - protein, 21 aa, Entamoeba invadens
GNECFKMCRNLSSITLPANLK

SEQ ID NO: 2939977 - protein, 18 aa, Entamoeba invadens
GNECLACNDGYFNIPSEG

SEQ ID NO: 2939978 - protein, 17 aa, Entamoeba invadens
GNEGPGLTKVFYTGVQD

SEQ ID NO: 2939979 - protein, 19 aa, Entamoeba invadens
GNEIGFYFQEPYIFRFYYY

SEQ ID NO: 2939980 - protein, 24 aa, Entamoeba invadens
GNEKKLCYVLDGISLKEIGVDSTL

SEQ ID NO: 2939981 - protein, 18 aa, Entamoeba invadens
GNEKLIFLFVSKTGEIFG

SEQ ID NO: 2939982 - protein, 19 aa, Entamoeba invadens
GNEKPKAAKPCVLPKENVE

SEQ ID NO: 2939983 - protein, 17 aa, Entamoeba invadens
GNEMPRLYRDLVEECWR

SEQ ID NO: 2939984 - protein, 19 aa, Entamoeba invadens
GNEPKCLDKVLASSKGLDA

SEQ ID NO: 2939985 - protein, 21 aa, Entamoeba invadens
GNERCEICNIGLYSRSGVCFS

SEQ ID NO: 2939986 - protein, 25 aa, Entamoeba invadens
GNERRIREFMKLKYQDKRWFDQNAF

SEQ ID NO: 2939987 - protein, 17 aa, Entamoeba invadens
GNESLEFTSKQIDIRNP

SEQ ID NO: 2939988 - protein, 27 aa, Entamoeba invadens
GNEVPSRLEILVKVLTRFILLFRNFPV

SEQ ID NO: 2939989 - protein, 25 aa, Entamoeba invadens
GNFAQICGVFMKIYADYMRKADDVW

SEQ ID NO: 2939990 - protein, 17 aa, Entamoeba invadens
GNFASVFYNEEFYKKKS

SEQ ID NO: 2939991 - protein, 19 aa, Entamoeba invadens
GNFCFCECRSLSSITIPLS

SEQ ID NO: 2939992 - protein, 23 aa, Entamoeba invadens
GNFCFCKCSNLSNIVIPPSVSFI

SEQ ID NO: 2939993 - protein, 19 aa, Entamoeba invadens
GNFCFCQCNALKTLSIPST

SEQ ID NO: 2939994 - protein, 17 aa, Entamoeba invadens
GNFCFNECTSLCAVTLS

SEQ ID NO: 2939995 - protein, 21 aa, Entamoeba invadens
GNFCFNLCGGLASVTLPKTLK

SEQ ID NO: 2939996 - protein, 21 aa, Entamoeba invadens
GNFCFYKCGALKSITLPSSVT

SEQ ID NO: 2939997 - protein, 18 aa, Entamoeba invadens
GNFEFLDLTNLYSVESLV

SEQ ID NO: 2939998 - protein, 19 aa, Entamoeba invadens
GNFFEIFWDIVNGRDEERR

SEQ ID NO: 2939999 - protein, 17 aa, Entamoeba invadens
GNFFMIGKRCFQNCEKL

SEQ ID NO: 2940000 - protein, 30 aa, Entamoeba invadens
GNFFPWNTKCPIEIEVLLYYFNYVTFSSDK

SEQ ID NO: 2940001 - protein, 18 aa, Entamoeba invadens
GNFLKIIDFKKVQFDAKS

SEQ ID NO: 2940002 - protein, 19 aa, Entamoeba invadens
GNFSFSRCSDLQKCIFVGE

SEQ ID NO: 2940003 - protein, 20 aa, Entamoeba invadens
GNGCFRECTSLRTITLPLCL

SEQ ID NO: 2940004 - protein, 24 aa, Entamoeba invadens
GNGFLGERYFRFDPVLFENLDLDC

SEQ ID NO: 2940005 - protein, 27 aa, Entamoeba invadens
GNGGFSFGGSDAFDIFNMMFGGGSGRK

SEQ ID NO: 2940006 - protein, 20 aa, Entamoeba invadens
GNGGVMLPDVHIGRDAMVAT

SEQ ID NO: 2940007 - protein, 19 aa, Entamoeba invadens
GNGKPKLFSVEPLEGHKKC

SEQ ID NO: 2940008 - protein, 23 aa, Entamoeba invadens
GNGKVHGIHLLWEVAIANKNLYL

SEQ ID NO: 2940009 - protein, 23 aa, Entamoeba invadens
GNGRSEISPSFIVTMEKSRFLFN

SEQ ID NO: 2940010 - protein, 18 aa, Entamoeba invadens
GNGSCVVLLIGGLMHNLF

SEQ ID NO: 2940011 - protein, 26 aa, Entamoeba invadens
GNGWTRSSSAFIFSLIRKGILKPKKF

SEQ ID NO: 2940012 - protein, 20 aa, Entamoeba invadens
GNHDGRLSIATPGYNGSYNR

SEQ ID NO: 2940013 - protein, 26 aa, Entamoeba invadens
GNHECLRTSTVYGFMRECSWKYSESL

SEQ ID NO: 2940014 - protein, 17 aa, Entamoeba invadens
GNHFKFEKSIFGRKFVK

SEQ ID NO: 2940015 - protein, 23 aa, Entamoeba invadens
GNHRFPFTFVIPMTNCPMLVIPQ

SEQ ID NO: 2940016 - protein, 17 aa, Entamoeba invadens
GNIDFRSFVPVLKVVLP

SEQ ID NO: 2940017 - protein, 24 aa, Entamoeba invadens
GNIDKLDMRECANCQKLRLLSTAK

SEQ ID NO: 2940018 - protein, 24 aa, Entamoeba invadens
GNIEMKECKPIKFSIVNYTGNQLI

SEQ ID NO: 2940019 - protein, 22 aa, Entamoeba invadens
GNIENYCRLNLFFETVREKDGL

SEQ ID NO: 2940020 - protein, 20 aa, Entamoeba invadens
GNIFKLVVWFKVNYLSTLAF

SEQ ID NO: 2940021 - protein, 19 aa, Entamoeba invadens
GNIGHDFCSDFYLSSIPSF

SEQ ID NO: 2940022 - protein, 19 aa, Entamoeba invadens
GNIICPFCNAITHISSPKD

SEQ ID NO: 2940023 - protein, 17 aa, Entamoeba invadens
GNIICPFCNSITHISSP

SEQ ID NO: 2940024 - protein, 26 aa, Entamoeba invadens
GNIKSCKLMISRGYSKGFGFVEYETE

SEQ ID NO: 2940025 - protein, 21 aa, Entamoeba invadens
GNILYSIALRVCQEVSSDVLV

SEQ ID NO: 2940026 - protein, 20 aa, Entamoeba invadens
GNIPHDFLPFISRLGNYAIR

SEQ ID NO: 2940027 - protein, 17 aa, Entamoeba invadens
GNIPLATIKTAIKEKDL

SEQ ID NO: 2940028 - protein, 22 aa, Entamoeba invadens
GNIPLKIKRYVLYQMCQNSIGG

SEQ ID NO: 2940029 - protein, 17 aa, Entamoeba invadens
GNIPLSFHTLAQLEQSK

SEQ ID NO: 2940030 - protein, 18 aa, Entamoeba invadens
GNISRPTFVSLFQHADMI

SEQ ID NO: 2940031 - protein, 23 aa, Entamoeba invadens
GNITCPFCNAITRISSPKDSYIS

SEQ ID NO: 2940032 - protein, 18 aa, Entamoeba invadens
GNIVFKGDVTTTVHDLIA

SEQ ID NO: 2940033 - protein, 18 aa, Entamoeba invadens
GNKCDLELNRDITTEEGK

SEQ ID NO: 2940034 - protein, 19 aa, Entamoeba invadens
GNKCKRCSNDYLMVKENQC

SEQ ID NO: 2940035 - protein, 24 aa, Entamoeba invadens
GNKFAELVQNGFRGHKTLNLDRLF

SEQ ID NO: 2940036 - protein, 18 aa, Entamoeba invadens
GNKFGFYISKKVDKMDKT

SEQ ID NO: 2940037 - protein, 18 aa, Entamoeba invadens
GNKGAFALANLLKITKTL

SEQ ID NO: 2940038 - protein, 18 aa, Entamoeba invadens
GNKPLNIFQRRTNCTVLI

SEQ ID NO: 2940039 - protein, 23 aa, Entamoeba invadens
GNKVCISPALALMLNGMAQPEFG

SEQ ID NO: 2940040 - protein, 24 aa, Entamoeba invadens
GNKWTKISACLKGRSPNSVKNRFC

SEQ ID NO: 2940041 - protein, 24 aa, Entamoeba invadens
GNLEIKGWKCKNLNSIESIDAKKV

SEQ ID NO: 2940042 - protein, 17 aa, Entamoeba invadens
GNLEVIHPRGVVLDIVI

SEQ ID NO: 2940043 - protein, 26 aa, Entamoeba invadens
GNLFCMLGPVFKIYSEYTMSYNYIND

SEQ ID NO: 2940044 - protein, 19 aa, Entamoeba invadens
GNLIAGFRVYWKNISAGIA

SEQ ID NO: 2940045 - protein, 17 aa, Entamoeba invadens
GNLIARIDNELHGSVLS

SEQ ID NO: 2940046 - protein, 28 aa, Entamoeba invadens
GNLLPGMASELIGIFSAYGEVLNTVQPK

SEQ ID NO: 2940047 - protein, 23 aa, Entamoeba invadens
GNLNGFVLRSVRRNIFGEVVTEQ

SEQ ID NO: 2940048 - protein, 20 aa, Entamoeba invadens
GNLNGTFGLFHVSLATFADP

SEQ ID NO: 2940049 - protein, 21 aa, Entamoeba invadens
GNLPRGATVQSIFKHFEGYKV

SEQ ID NO: 2940050 - protein, 25 aa, Entamoeba invadens
GNLRKVCRKKIKPRHFILFNDIFLY

SEQ ID NO: 2940051 - protein, 28 aa, Entamoeba invadens
GNNAREAMAPCFMELASALAVYDKKEIS

SEQ ID NO: 2940052 - protein, 21 aa, Entamoeba invadens
GNNCFMWLDRLQKVVKNKTEK

SEQ ID NO: 2940053 - protein, 19 aa, Entamoeba invadens
GNNFLKFTFDTLATEKKIT

SEQ ID NO: 2940054 - protein, 18 aa, Entamoeba invadens
GNNGIKAIYGYDDIFQFG

SEQ ID NO: 2940055 - protein, 19 aa, Entamoeba invadens
GNNIPFGITTIYKRCFYEC

SEQ ID NO: 2940056 - protein, 18 aa, Entamoeba invadens
GNNIPGLIGHIVKDKNNK

SEQ ID NO: 2940057 - protein, 19 aa, Entamoeba invadens
GNNSALDVFVKWAEQHGIN

SEQ ID NO: 2940058 - protein, 19 aa, Entamoeba invadens
GNNSFVWKTTEWMDEEKDE

SEQ ID NO: 2940059 - protein, 19 aa, Entamoeba invadens
GNPKICVYENMGFTANIYG

SEQ ID NO: 2940060 - protein, 23 aa, Entamoeba invadens
GNQTRRSFCAFEEKNDPTGDSDM

SEQ ID NO: 2940061 - protein, 26 aa, Entamoeba invadens
GNRIPSWCDRVLWKIENRHNVECVKY

SEQ ID NO: 2940062 - protein, 24 aa, Entamoeba invadens
GNRKLVKLLLHQGAVYTKKHDMII

SEQ ID NO: 2940063 - protein, 23 aa, Entamoeba invadens
GNRWTKLFITHDIMAEGAKIEFV

SEQ ID NO: 2940064 - protein, 20 aa, Entamoeba invadens
GNSAFKGCVSIKNISISGNG

SEQ ID NO: 2940065 - protein, 22 aa, Entamoeba invadens
GNSCAFLPDTQYRVISLLGKGV

SEQ ID NO: 2940066 - protein, 20 aa, Entamoeba invadens
GNSCLYYCNISCITLPPNIT

SEQ ID NO: 2940067 - protein, 18 aa, Entamoeba invadens
GNSIPVYFTNNTVTDLCD

SEQ ID NO: 2940068 - protein, 22 aa, Entamoeba invadens
GNSKAKDLLSFFVKNSDVTTQK

SEQ ID NO: 2940069 - protein, 17 aa, Entamoeba invadens
GNSLSSVTLCDYIETIP

SEQ ID NO: 2940070 - protein, 17 aa, Entamoeba invadens
GNSPFTRVYSAYLKKYC

SEQ ID NO: 2940071 - protein, 25 aa, Entamoeba invadens
GNSQFPIPVLYTLDSFGGVKIVSLS

SEQ ID NO: 2940072 - protein, 17 aa, Entamoeba invadens
GNSQKIIISDFVDTTIL

SEQ ID NO: 2940073 - protein, 25 aa, Entamoeba invadens
GNSQSAFLFTAFSAFWMSPDLTLNF

SEQ ID NO: 2940074 - protein, 18 aa, Entamoeba invadens
GNSSFDFAVLSLYNDESF

SEQ ID NO: 2940075 - protein, 30 aa, Entamoeba invadens
GNSVAFKGWEVLTSYVPQLLQLCASFLASG

SEQ ID NO: 2940076 - protein, 19 aa, Entamoeba invadens
GNSWKFTKTGFQVERNKFH

SEQ ID NO: 2940077 - protein, 20 aa, Entamoeba invadens
GNTDKLSWRVYGPQGALIQN

SEQ ID NO: 2940078 - protein, 21 aa, Entamoeba invadens
GNTDKLSWRVYGPQGALIQNM

SEQ ID NO: 2940079 - protein, 20 aa, Entamoeba invadens
GNTDKLSWRVYGPQGALIQS

SEQ ID NO: 2940080 - protein, 17 aa, Entamoeba invadens
GNTFTRVNLILKDVLSD

SEQ ID NO: 2940081 - protein, 30 aa, Entamoeba invadens
GNTIPEWVLQFLLSFFIPGLLDFFGGNEYN

SEQ ID NO: 2940082 - protein, 18 aa, Entamoeba invadens
GNTLFKGYVERLKKELQL

SEQ ID NO: 2940083 - protein, 18 aa, Entamoeba invadens
GNTLKLVLRDLLVQTQRN

SEQ ID NO: 2940084 - protein, 24 aa, Entamoeba invadens
GNTLRMVDHFVFYNHICIVTELLS

SEQ ID NO: 2940085 - protein, 20 aa, Entamoeba invadens
GNTMMPGFVERFKSEFTKFT

SEQ ID NO: 2940086 - protein, 18 aa, Entamoeba invadens
GNTMMPGFVERFKTQFTK

SEQ ID NO: 2940087 - protein, 18 aa, Entamoeba invadens
GNTSFTRIFTQYLNRYCS

SEQ ID NO: 2940088 - protein, 19 aa, Entamoeba invadens
GNTYLKFVRINQIVIVLSG

SEQ ID NO: 2940089 - protein, 17 aa, Entamoeba invadens
GNVFGVFVPMKIGYTND

SEQ ID NO: 2940090 - protein, 26 aa, Entamoeba invadens
GNVFTSEMIEYFTVPEVDRFLVTIQM

SEQ ID NO: 2940091 - protein, 19 aa, Entamoeba invadens
GNVGKTCMLMVYTSNEFPT

SEQ ID NO: 2940092 - protein, 25 aa, Entamoeba invadens
GNVHRLGGFEAPPAVISVFLGDGLQ

SEQ ID NO: 2940093 - protein, 17 aa, Entamoeba invadens
GNVKFILMSSAKTDETK

SEQ ID NO: 2940094 - protein, 25 aa, Entamoeba invadens
GNVKRAVEVFKLFDRSPEKTGDAGD

SEQ ID NO: 2940095 - protein, 31 aa, Entamoeba invadens
GNVKSIISETDFLKGKVFYFGMNDEMMKKYE

SEQ ID NO: 2940096 - protein, 18 aa, Entamoeba invadens
GNVLLSEYFPSTFPIAKV

SEQ ID NO: 2940097 - protein, 25 aa, Entamoeba invadens
GNVNVPTPFEFLRIVEKGKKKENMV

SEQ ID NO: 2940098 - protein, 19 aa, Entamoeba invadens
GNVPREYVDPVLSRLDQLL

SEQ ID NO: 2940099 - protein, 18 aa, Entamoeba invadens
GNVPRTKDVILLGDLIDK

SEQ ID NO: 2940100 - protein, 17 aa, Entamoeba invadens
GNVPSWLASVVKKNDAD

SEQ ID NO: 2940101 - protein, 18 aa, Entamoeba invadens
GNVSLRYTNLDGETTTHV

SEQ ID NO: 2940102 - protein, 18 aa, Entamoeba invadens
GNVTLFPVVFSSPVIEKV

SEQ ID NO: 2940103 - protein, 23 aa, Entamoeba invadens
GNWNRIAMGPVMMEKVINSYLYL

SEQ ID NO: 2940104 - protein, 22 aa, Entamoeba invadens
GNWQILFAWKNIDLHNFLYRVA

SEQ ID NO: 2940105 - protein, 25 aa, Entamoeba invadens
GNWTEWYDRCSLLERRLISLAKNIT

SEQ ID NO: 2940106 - protein, 17 aa, Entamoeba invadens
GNYCFCGCSNLRHISIP

SEQ ID NO: 2940107 - protein, 18 aa, Entamoeba invadens
GNYCFSRCGSLRSVVIPS

SEQ ID NO: 2940108 - protein, 17 aa, Entamoeba invadens
GNYCFYECISLKSVNIP

SEQ ID NO: 2940109 - protein, 23 aa, Entamoeba invadens
GNYDFECLEALRLDDLNDTLKKL

SEQ ID NO: 2940110 - protein, 27 aa, Entamoeba invadens
GNYEVVWLISNFCMFDNPIPFTSLQPF

SEQ ID NO: 2940111 - protein, 18 aa, Entamoeba invadens
GNYKEVLKALATDLEGEN

SEQ ID NO: 2940112 - protein, 18 aa, Entamoeba invadens
GNYNELVQEMFLYSVLLN

SEQ ID NO: 2940113 - protein, 17 aa, Entamoeba invadens
GNYVIQHLLEFGSQPIR

SEQ ID NO: 2940114 - protein, 18 aa, Entamoeba invadens
GPAWADSVVYSFNYMKGM

SEQ ID NO: 2940115 - protein, 29 aa, Entamoeba invadens
GPAWADSVVYSFNYMKGMYFVEQGFGSSE

SEQ ID NO: 2940116 - protein, 29 aa, Entamoeba invadens
GPAWADSVVYSFNYMKGMYFVEQGFSSSE

SEQ ID NO: 2940117 - protein, 21 aa, Entamoeba invadens
GPCRMRKRLVRDTDFTSRYST

SEQ ID NO: 2940118 - protein, 23 aa, Entamoeba invadens
GPCWADSIGKNFNYIKGMVYSNE

SEQ ID NO: 2940119 - protein, 17 aa, Entamoeba invadens
GPDRVFLSRNNAVLFET

SEQ ID NO: 2940120 - protein, 18 aa, Entamoeba invadens
GPDTKWKFDSILETIVIA

SEQ ID NO: 2940121 - protein, 24 aa, Entamoeba invadens
GPEICLECRYLPYLIYLEQITEVQ

SEQ ID NO: 2940122 - protein, 26 aa, Entamoeba invadens
GPEIKFLLRILKGVFRIGFSERSLPN

SEQ ID NO: 2940123 - protein, 20 aa, Entamoeba invadens
GPESVACALKCASELGYRTY

SEQ ID NO: 2940124 - protein, 18 aa, Entamoeba invadens
GPFVFSVDTYTLVVYLKE

SEQ ID NO: 2940125 - protein, 17 aa, Entamoeba invadens
GPFYSAPFVLQAREKRT

SEQ ID NO: 2940126 - protein, 23 aa, Entamoeba invadens
GPGRVKFLLKLNEMRIQKEKESF

SEQ ID NO: 2940127 - protein, 18 aa, Entamoeba invadens
GPHYKISHDISLLIPEIW

SEQ ID NO: 2940128 - protein, 19 aa, Entamoeba invadens
GPIDFLIEFKKNVGKMKEV

SEQ ID NO: 2940129 - protein, 29 aa, Entamoeba invadens
GPIELLEICEPFLAYKIGGYVRVVSCTVG

SEQ ID NO: 2940130 - protein, 22 aa, Entamoeba invadens
GPIFKKDVMKTLIMKEKNPDYA

SEQ ID NO: 2940131 - protein, 27 aa, Entamoeba invadens
GPIIYDVFKDLSVRGSNGLIKKISKCD

SEQ ID NO: 2940132 - protein, 19 aa, Entamoeba invadens
GPIKESANIIFVGHVDAGK

SEQ ID NO: 2940133 - protein, 19 aa, Entamoeba invadens
GPIPPRSGIYTDAFGYLAS

SEQ ID NO: 2940134 - protein, 17 aa, Entamoeba invadens
GPITISSYNKLLLDMKT

SEQ ID NO: 2940135 - protein, 18 aa, Entamoeba invadens
GPKLRLHYINGLEGEKKC

SEQ ID NO: 2940136 - protein, 28 aa, Entamoeba invadens
GPKVVEAFAFANCIYLKSAAVMGVTSLP

SEQ ID NO: 2940137 - protein, 18 aa, Entamoeba invadens
GPKVVSIQQSVEVKEIQE

SEQ ID NO: 2940138 - protein, 24 aa, Entamoeba invadens
GPLILLKLRVNPFFIEVQGIIHTM

SEQ ID NO: 2940139 - protein, 20 aa, Entamoeba invadens
GPLLPEEVNAAYRRMRDRGD

SEQ ID NO: 2940140 - protein, 18 aa, Entamoeba invadens
GPLQFPGSMEVELRTQHL

SEQ ID NO: 2940141 - protein, 19 aa, Entamoeba invadens
GPLWPVGEVCYMKREGDGK

SEQ ID NO: 2940142 - protein, 21 aa, Entamoeba invadens
GPMHKRLFIGGIDRSITQQQL

SEQ ID NO: 2940143 - protein, 23 aa, Entamoeba invadens
GPPGCGKTLLAKAVASQCQANFI

SEQ ID NO: 2940144 - protein, 23 aa, Entamoeba invadens
GPPGCGKTLMARQIGKMVSSVEP

SEQ ID NO: 2940145 - protein, 18 aa, Entamoeba invadens
GPPGVPTMPGMYGTAPGY

SEQ ID NO: 2940146 - protein, 20 aa, Entamoeba invadens
GPPPRPHIKRIDPMQHADPS

SEQ ID NO: 2940147 - protein, 17 aa, Entamoeba invadens
GPQRTETFMKFGPVVLQ

SEQ ID NO: 2940148 - protein, 22 aa, Entamoeba invadens
GPRPVLKVVEDFAALSKKFICT

SEQ ID NO: 2940149 - protein, 22 aa, Entamoeba invadens
GPSAKCTKCSCVFHKSCCQHVF

SEQ ID NO: 2940150 - protein, 30 aa, Entamoeba invadens
GPSGKDWRAGRCAACNIIPASTGAAKAVGK

SEQ ID NO: 2940151 - protein, 29 aa, Entamoeba invadens
GPSGKDWRAGRCAACNIIPATTGAAKAVG

SEQ ID NO: 2940152 - protein, 26 aa, Entamoeba invadens
GPSGKDWRAGRCAAHNIIPATTGAAK

SEQ ID NO: 2940153 - protein, 30 aa, Entamoeba invadens
GPSGKDWRAGRCAGCNIIPATTGIGGKLAP

SEQ ID NO: 2940154 - protein, 18 aa, Entamoeba invadens
GPSLVSITYKFPNSRHLY

SEQ ID NO: 2940155 - protein, 26 aa, Entamoeba invadens
GPSNMKLTYLESWRVVELSNALFGFD

SEQ ID NO: 2940156 - protein, 19 aa, Entamoeba invadens
GPTHRWKIGQIPIELFTQL

SEQ ID NO: 2940157 - protein, 24 aa, Entamoeba invadens
GPTQIPLCIRIRDYFKGFDVEQII

SEQ ID NO: 2940158 - protein, 24 aa, Entamoeba invadens
GPTQIPLCIRIRDYFKGIDVEQII

SEQ ID NO: 2940159 - protein, 20 aa, Entamoeba invadens
GPYGRTVQIVAPMGMGQQQN

SEQ ID NO: 2940160 - protein, 17 aa, Entamoeba invadens
GPYLKLDIYEFADCVSL

SEQ ID NO: 2940161 - protein, 21 aa, Entamoeba invadens
GQAHGDFGLKLNMSNGGPAPI

SEQ ID NO: 2940162 - protein, 22 aa, Entamoeba invadens
GQAKLIRKIMGAIITKQAINKD

SEQ ID NO: 2940163 - protein, 18 aa, Entamoeba invadens
GQALLSFIELPYRNSSGL

SEQ ID NO: 2940164 - protein, 17 aa, Entamoeba invadens
GQARSVSILTLLQNAIK

SEQ ID NO: 2940165 - protein, 18 aa, Entamoeba invadens
GQAVECFEKAQFTNRTTD

SEQ ID NO: 2940166 - protein, 23 aa, Entamoeba invadens
GQCYHLRLVGKIGNISDYNNDRF

SEQ ID NO: 2940167 - protein, 28 aa, Entamoeba invadens
GQDAKPVLRRLLLAYSIYNYNIGYVQGE

SEQ ID NO: 2940168 - protein, 21 aa, Entamoeba invadens
GQDELPKFCPECGAKNSGTKF

SEQ ID NO: 2940169 - protein, 18 aa, Entamoeba invadens
GQDISCLFPENGEKSGGK

SEQ ID NO: 2940170 - protein, 24 aa, Entamoeba invadens
GQDKLRPLWSYYYAGSNAIIYVLD

SEQ ID NO: 2940171 - protein, 28 aa, Entamoeba invadens
GQEFKRNMRWGESLIFFSKENPKFAEAI

SEQ ID NO: 2940172 - protein, 18 aa, Entamoeba invadens
GQEIKLALWDTAGQEKYK

SEQ ID NO: 2940173 - protein, 26 aa, Entamoeba invadens
GQESLRPYWRCYYSNTNAIIFVVDSC

SEQ ID NO: 2940174 - protein, 23 aa, Entamoeba invadens
GQFGVGFYSSYLVAEKVTVITKN

SEQ ID NO: 2940175 - protein, 17 aa, Entamoeba invadens
GQFLKKFIVSSDENRNI

SEQ ID NO: 2940176 - protein, 23 aa, Entamoeba invadens
GQFSHEFLSVFTITFLEENTPFT

SEQ ID NO: 2940177 - protein, 19 aa, Entamoeba invadens
GQFTRRQLKVLRIERKLDK

SEQ ID NO: 2940178 - protein, 19 aa, Entamoeba invadens
GQGSRLGFEHPKGMFVIPL

SEQ ID NO: 2940179 - protein, 19 aa, Entamoeba invadens
GQGTMWWMQRELTEKKKYM

SEQ ID NO: 2940180 - protein, 18 aa, Entamoeba invadens
GQGTRLGFDHPKGCYDIG

SEQ ID NO: 2940181 - protein, 18 aa, Entamoeba invadens
GQGTYAWNAGIFLWSSSG

SEQ ID NO: 2940182 - protein, 18 aa, Entamoeba invadens
GQHPFVFDIASFVEDQKV

SEQ ID NO: 2940183 - protein, 17 aa, Entamoeba invadens
GQIEIPENLKIDVKSVE

SEQ ID NO: 2940184 - protein, 25 aa, Entamoeba invadens
GQIELPSNFLIEMFFTIYSKASKRN

SEQ ID NO: 2940185 - protein, 26 aa, Entamoeba invadens
GQIELYSHLPVMSRFVDYMKEQNYNV

SEQ ID NO: 2940186 - protein, 27 aa, Entamoeba invadens
GQIGYNLTFLIAHGLMFGPSQTVVLHL

SEQ ID NO: 2940187 - protein, 18 aa, Entamoeba invadens
GQIKFNKWLLSIGNGELV

SEQ ID NO: 2940188 - protein, 29 aa, Entamoeba invadens
GQIQKRVYSALLWCCFVPTKICIVTEYAD

SEQ ID NO: 2940189 - protein, 18 aa, Entamoeba invadens
GQISFTLKGSELGLYGDY

SEQ ID NO: 2940190 - protein, 22 aa, Entamoeba invadens
GQIYCVYCGRVIDKVLDEGQEW

SEQ ID NO: 2940191 - protein, 24 aa, Entamoeba invadens
GQKCSNCLCPHGGAAEVKRKCNHP

SEQ ID NO: 2940192 - protein, 23 aa, Entamoeba invadens
GQKDWKDMIAKTVVPVVPAAGAK

SEQ ID NO: 2940193 - protein, 17 aa, Entamoeba invadens
GQKELFVSFPNFVGTPK

SEQ ID NO: 2940194 - protein, 21 aa, Entamoeba invadens
GQKPLVVPVVLQKGMVPRTFV

SEQ ID NO: 2940195 - protein, 23 aa, Entamoeba invadens
GQKRKAMIYRMLCTGTIEEKIYQ

SEQ ID NO: 2940196 - protein, 31 aa, Entamoeba invadens; identical to SEQ ID NO: 2483986

SEQ ID NO: 2940197 - protein, 21 aa, Entamoeba invadens
GQKVCVFASPYRDEHDADLLN

SEQ ID NO: 2940198 - protein, 25 aa, Entamoeba invadens
GQLFDEKYGRCTLNADNIPDDIIVC

SEQ ID NO: 2940199 - protein, 17 aa, Entamoeba invadens
GQLFFNASIHDITHKNN

SEQ ID NO: 2940200 - protein, 19 aa, Entamoeba invadens
GQLFFSQKIESQWKSGGSV

SEQ ID NO: 2940201 - protein, 20 aa, Entamoeba invadens
GQLGCAFSFVVDSTAKSAQI

SEQ ID NO: 2940202 - protein, 17 aa, Entamoeba invadens
GQLKLKLFTTKNVTKCR

SEQ ID NO: 2940203 - protein, 22 aa, Entamoeba invadens
GQLKPELILAINGLLQDLNHPN

SEQ ID NO: 2940204 - protein, 21 aa, Entamoeba invadens
GQMKYALVWGTSVARSPQRVG

SEQ ID NO: 2940205 - protein, 18 aa, Entamoeba invadens
GQMLFLLDSERVYTDEGV

SEQ ID NO: 2940206 - protein, 23 aa, Entamoeba invadens
GQNILYVCSSLIIISNFVNDGGK

SEQ ID NO: 2940207 - protein, 23 aa, Entamoeba invadens
GQNVEVPKQWTLFKSKNKNKDEE

SEQ ID NO: 2940208 - protein, 20 aa, Entamoeba invadens
GQPLMVGCSVVDGKKNNVQA

SEQ ID NO: 2940209 - protein, 25 aa, Entamoeba invadens
GQPQAKLLFLSLISRVYKREPIILH

SEQ ID NO: 2940210 - protein, 17 aa, Entamoeba invadens
GQPQMQVPYPYRQYAPM

SEQ ID NO: 2940211 - protein, 26 aa, Entamoeba invadens
GQPSDLRKAALLCFGRTINQIEDIKV

SEQ ID NO: 2940212 - protein, 19 aa, Entamoeba invadens
GQPSLQVFIDKVLTKQYYL

SEQ ID NO: 2940213 - protein, 17 aa, Entamoeba invadens
GQQMCDFLAAGVTIQNN

SEQ ID NO: 2940214 - protein, 23 aa, Entamoeba invadens
GQQPQMGLGMGFGQQQQPQMGGG

SEQ ID NO: 2940215 - protein, 20 aa, Entamoeba invadens
GQRCFQECRYLESIDIPSNV

SEQ ID NO: 2940216 - protein, 24 aa, Entamoeba invadens
GQRLKDNFLCYTVLPFYIKIFESE

SEQ ID NO: 2940217 - protein, 25 aa, Entamoeba invadens
GQSFPINFSDTISFRGKDEKKDKIL

SEQ ID NO: 2940218 - protein, 18 aa, Entamoeba invadens
GQSGIPIVDFMKLEYVNF

SEQ ID NO: 2940219 - protein, 25 aa, Entamoeba invadens
GQSKSGIDIALFRLNYVIYLFSIVE

SEQ ID NO: 2940220 - protein, 25 aa, Entamoeba invadens
GQSLASFLYCLNINPVVRAITKQPN

SEQ ID NO: 2940221 - protein, 17 aa, Entamoeba invadens
GQSYASFSKSISLPSHS

SEQ ID NO: 2940222 - protein, 24 aa, Entamoeba invadens
GQTMFSCSLWYLVETVLDKMKNVD

SEQ ID NO: 2940223 - protein, 26 aa, Entamoeba invadens
GQVNELLETIPLLGYVTKKSVKSNEK

SEQ ID NO: 2940224 - protein, 22 aa, Entamoeba invadens
GQVRDYFVSLFVGDSVTKQNTY

SEQ ID NO: 2940225 - protein, 20 aa, Entamoeba invadens
GQVRRAISIIVVLNANGEVV

SEQ ID NO: 2940226 - protein, 19 aa, Entamoeba invadens
GQVTLFLPFNLISEMGGFI

SEQ ID NO: 2940227 - protein, 19 aa, Entamoeba invadens
GQVYFKTVRLPLASMELQI

SEQ ID NO: 2940228 - protein, 20 aa, Entamoeba invadens
GQVYPFRYLLQSFPRNQHIA

SEQ ID NO: 2940229 - protein, 21 aa, Entamoeba invadens
GQWCFCGCGNLKSVTIPSSVT

SEQ ID NO: 2940230 - protein, 21 aa, Entamoeba invadens
GQWGCIAVPIAQGSFKMRKPF

SEQ ID NO: 2940231 - protein, 23 aa, Entamoeba invadens
GQWLKNDTSFIFSIVRNGELNPK

SEQ ID NO: 2940232 - protein, 28 aa, Entamoeba invadens
GRAGRTRPGKCFRLYTEKGFEESLGKQT

SEQ ID NO: 2940233 - protein, 22 aa, Entamoeba invadens
GRAKYALDFFHYVNCLEKNELS

SEQ ID NO: 2940234 - protein, 19 aa, Entamoeba invadens
GRAPNSVKNRFCSHILRVI

SEQ ID NO: 2940235 - protein, 21 aa, Entamoeba invadens
GRAPTLIAIALIELGMDNSDA

SEQ ID NO: 2940236 - protein, 18 aa, Entamoeba invadens
GRCAECLLYEVMSNVLGK

SEQ ID NO: 2940237 - protein, 19 aa, Entamoeba invadens
GRCKPCGDVVIGCETSFKN

SEQ ID NO: 2940238 - protein, 18 aa, Entamoeba invadens
GRCKPCGDVVIGCKTSTK

SEQ ID NO: 2940239 - protein, 21 aa, Entamoeba invadens
GRCSGKTSIIHRYVNGEFIRE

SEQ ID NO: 2940240 - protein, 22 aa, Entamoeba invadens
GRDDLAIVFALFSVDPENFKIP

SEQ ID NO: 2940241 - protein, 19 aa, Entamoeba invadens
GRDFTYFPSDCNVYMATND

SEQ ID NO: 2940242 - protein, 35 aa, Entamoeba invadens
GRDGEPADCILFYSYRDKFVYERFLMEDQKKNNSD

SEQ ID NO: 2940243 - protein, 26 aa, Entamoeba invadens
GRDRAPALIAAYFVLKNKINFLQVSE

SEQ ID NO: 2940244 - protein, 20 aa, Entamoeba invadens
GRDSIKIPLTVCITEEIAWM

SEQ ID NO: 2940245 - protein, 24 aa, Entamoeba invadens
GREAFMKCKHLRSIVFENGNDIVF

SEQ ID NO: 2940246 - protein, 20 aa, Entamoeba invadens
GREGNGCKFQENHDKIEVLL

SEQ ID NO: 2940247 - protein, 22 aa, Entamoeba invadens
GRELAEKLGIPFLETSAANSDN

SEQ ID NO: 2940248 - protein, 24 aa, Entamoeba invadens
GRESVMRKKVQLIYSLNELKDYYF

SEQ ID NO: 2940249 - protein, 21 aa, Entamoeba invadens
GREVSTFCFLTEVFGTSNEDV

SEQ ID NO: 2940250 - protein, 27 aa, Entamoeba invadens
GRFCIKAPHLKTIFIENSMEVIFDKMC

SEQ ID NO: 2940251 - protein, 17 aa, Entamoeba invadens
GRFEMQYMRCWIEHVTL

SEQ ID NO: 2940252 - protein, 19 aa, Entamoeba invadens
GRFERSIVGGFLYPSCVRI

SEQ ID NO: 2940253 - protein, 20 aa, Entamoeba invadens
GRFIGMMNINKSLIVHDREF

SEQ ID NO: 2940254 - protein, 25 aa, Entamoeba invadens
GRFKKLKKLYVENCANFDDFKMLEN

SEQ ID NO: 2940255 - protein, 21 aa, Entamoeba invadens
GRFKKPTLCNVEHKKRKITQC

SEQ ID NO: 2940256 - protein, 25 aa, Entamoeba invadens
GRFKMLRKKGRWMVQIQYECKKRQF

SEQ ID NO: 2940257 - protein, 19 aa, Entamoeba invadens
GRFSYGSFYNWVLRVPADN

SEQ ID NO: 2940258 - protein, 17 aa, Entamoeba invadens
GRFVIGGPMGDAGLTGR

SEQ ID NO: 2940259 - protein, 20 aa, Entamoeba invadens
GRGADINELIVKRLEALSKS

SEQ ID NO: 2940260 - protein, 23 aa, Entamoeba invadens
GRGCKNPESDLCIASVNSLERII

SEQ ID NO: 2940261 - protein, 31 aa, Entamoeba invadens
GRGEKSLSMSCSDKILKWNLIGLQGSILSKY

SEQ ID NO: 2940262 - protein, 18 aa, Entamoeba invadens
GRGGTRYVGRKGAKGAKA

SEQ ID NO: 2940263 - protein, 24 aa, Entamoeba invadens
GRGILFLKKWKILMSDEGALNIIN

SEQ ID NO: 2940264 - protein, 17 aa, Entamoeba invadens
GRGLIALEDIKKGEMVF

SEQ ID NO: 2940265 - protein, 18 aa, Entamoeba invadens
GRGPFVFITVGPKDETFA

SEQ ID NO: 2940266 - protein, 26 aa, Entamoeba invadens
GRGTFGQVLKCIDLKDGKYVAIKVLK

SEQ ID NO: 2940267 - protein, 19 aa, Entamoeba invadens
GRGWMEFVEVGNPVLNKKE

SEQ ID NO: 2940268 - protein, 25 aa, Entamoeba invadens
GRHDFKARVFQFYRSEDNELLCNEL

SEQ ID NO: 2940269 - protein, 18 aa, Entamoeba invadens
GRHFCNGKVSNMSDCQIL

SEQ ID NO: 2940270 - protein, 25 aa, Entamoeba invadens
GRHLAEVLVALAFHKFKCTNLFSVC

SEQ ID NO: 2940271 - protein, 20 aa, Entamoeba invadens
GRHYTISSTFTRFLSRSRDS

SEQ ID NO: 2940272 - protein, 17 aa, Entamoeba invadens
GRIAIVTEGVFRADLSL

SEQ ID NO: 2940273 - protein, 24 aa, Entamoeba invadens
GRIEASRIGLYLLKLKEYPDSFCV

SEQ ID NO: 2940274 - protein, 21 aa, Entamoeba invadens
GRIGFVIMRLLLSMQHPPQSV

SEQ ID NO: 2940275 - protein, 17 aa, Entamoeba invadens
GRIGPFVDKNFPDLRNA

SEQ ID NO: 2940276 - protein, 18 aa, Entamoeba invadens
GRIICKFCYEEIQRDENV

SEQ ID NO: 2940277 - protein, 17 aa, Entamoeba invadens
GRIIGLYVSSKVKQADQ

SEQ ID NO: 2940278 - protein, 24 aa, Entamoeba invadens
GRILVFKNKCNWRDFLEDLETEEA

SEQ ID NO: 2940279 - protein, 19 aa, Entamoeba invadens
GRILWIHREIIPELKSLIP

SEQ ID NO: 2940280 - protein, 20 aa, Entamoeba invadens
GRILWIHREIIPELKSLIPG

SEQ ID NO: 2940281 - protein, 24 aa, Entamoeba invadens
GRIRDLLRQMYLVLGQCYYCVLDE

SEQ ID NO: 2940282 - protein, 21 aa, Entamoeba invadens
GRISYKNVCLHKDERKGCGNK

SEQ ID NO: 2940283 - protein, 21 aa, Entamoeba invadens
GRITPFSIKTVCNIYIEGIDG

SEQ ID NO: 2940284 - protein, 25 aa, Entamoeba invadens
GRKCFERCSWLKEINFPSSVDKLHR

SEQ ID NO: 2940285 - protein, 18 aa, Entamoeba invadens
GRKDIQIEETKKEEKSQE

SEQ ID NO: 2940286 - protein, 23 aa, Entamoeba invadens
GRKEWKYKKYAIVAFVTVPYLHQ

SEQ ID NO: 2940287 - protein, 18 aa, Entamoeba invadens
GRKGFVVTFDSTSAAAEF

SEQ ID NO: 2940288 - protein, 23 aa, Entamoeba invadens
GRKHLSCCLEIELPNYNLTKYLK

SEQ ID NO: 2940289 - protein, 29 aa, Entamoeba invadens
GRKILRICPLKLNYDIGCILEQKDMGIFS

SEQ ID NO: 2940290 - protein, 20 aa, Entamoeba invadens
GRKKLDVWWMKQAFLDVLKG

SEQ ID NO: 2940291 - protein, 22 aa, Entamoeba invadens
GRKPFPNVFYLNDFVGTFVEVK

SEQ ID NO: 2940292 - protein, 22 aa, Entamoeba invadens
GRKPRLPFETRLKQMDSDLTKY

SEQ ID NO: 2940293 - protein, 17 aa, Entamoeba invadens
GRLAACFLDSLATMNFP

SEQ ID NO: 2940294 - protein, 17 aa, Entamoeba invadens
GRLACDIFLCDRKYSYL

SEQ ID NO: 2940295 - protein, 19 aa, Entamoeba invadens
GRLAMTGAIRKFLAENPTK

SEQ ID NO: 2940296 - protein, 21 aa, Entamoeba invadens
GRLDIYADYFALYHKNCKKLE

SEQ ID NO: 2940297 - protein, 17 aa, Entamoeba invadens
GRLEGMCRFPIFEGEKG

SEQ ID NO: 2940298 - protein, 18 aa, Entamoeba invadens
GRLGDLGKIDDRYDVAIT

SEQ ID NO: 2940299 - protein, 19 aa, Entamoeba invadens
GRLIKESFISRSMLEIPND

SEQ ID NO: 2940300 - protein, 22 aa, Entamoeba invadens
GRLKFLERTDCVSTLDFIKRMK

SEQ ID NO: 2940301 - protein, 20 aa, Entamoeba invadens
GRLKSGLTPPTNRIISKFKK

SEQ ID NO: 2940302 - protein, 22 aa, Entamoeba invadens
GRLTFVMLPSFSFPQNKMNMEI

SEQ ID NO: 2940303 - protein, 19 aa, Entamoeba invadens
GRLVPFHVNYIKSVTTREG

SEQ ID NO: 2940304 - protein, 17 aa, Entamoeba invadens
GRMAKDMSDRFEGKSIV

SEQ ID NO: 2940305 - protein, 19 aa, Entamoeba invadens
GRMHSFIDFCLKTANMKKE

SEQ ID NO: 2940306 - protein, 19 aa, Entamoeba invadens
GRMLLNFNGLLFNNQRTRV

SEQ ID NO: 2940307 - protein, 18 aa, Entamoeba invadens
GRMRACCATFTRLKKENK

SEQ ID NO: 2940308 - protein, 22 aa, Entamoeba invadens
GRNCVEKFSLIEAIFEGKKANT

SEQ ID NO: 2940309 - protein, 19 aa, Entamoeba invadens
GRNDIEWINKYVLKINEII

SEQ ID NO: 2940310 - protein, 23 aa, Entamoeba invadens
GRNGCGKTTFLKLLINSLSPVEG

SEQ ID NO: 2940311 - protein, 21 aa, Entamoeba invadens
GRNYGLRASFRLKEKKINESV

SEQ ID NO: 2940312 - protein, 17 aa, Entamoeba invadens
GRPEKYCVIDLPSDEEL

SEQ ID NO: 2940313 - protein, 17 aa, Entamoeba invadens
GRPFEYQNKFPVMYTPH

SEQ ID NO: 2940314 - protein, 21 aa, Entamoeba invadens
GRPITSMALVLYWPGEKCKRT

SEQ ID NO: 2940315 - protein, 17 aa, Entamoeba invadens
GRPNNVGGTDLFVLPPL

SEQ ID NO: 2940316 - protein, 17 aa, Entamoeba invadens
GRPNVDWCEDHKEETIR

SEQ ID NO: 2940317 - protein, 21 aa, Entamoeba invadens
GRPYPTCQVMLKCVPEMGFCT

SEQ ID NO: 2940318 - protein, 25 aa, Entamoeba invadens
GRQVFFYKRAQIVVGDISGMCDNIK

SEQ ID NO: 2940319 - protein, 19 aa, Entamoeba invadens
GRRAFIHHYAEFGMEENEF

SEQ ID NO: 2940320 - protein, 26 aa, Entamoeba invadens
GRREAFDYVITCFFIDTAHNIIEYFR

SEQ ID NO: 2940321 - protein, 18 aa, Entamoeba invadens
GRRFKIANPHLLRTTYQE

SEQ ID NO: 2940322 - protein, 22 aa, Entamoeba invadens
GRRGYPGYMYTDLASIYERAGR

SEQ ID NO: 2940323 - protein, 19 aa, Entamoeba invadens
GRRKYTLEDVFVFPKNKVV

SEQ ID NO: 2940324 - protein, 17 aa, Entamoeba invadens
GRRMSRVGAMKTVTSNE

SEQ ID NO: 2940325 - protein, 19 aa, Entamoeba invadens
GRSCFEKCYSLFSIVLPET

SEQ ID NO: 2940326 - protein, 19 aa, Entamoeba invadens
GRSECYEFDIADVENVIQK

SEQ ID NO: 2940327 - protein, 21 aa, Entamoeba invadens
GRSFFESCSSLLSLDLPATLT

SEQ ID NO: 2940328 - protein, 24 aa, Entamoeba invadens
GRSKKFLERWEVFYDLVESLWPFV

SEQ ID NO: 2940329 - protein, 18 aa, Entamoeba invadens
GRSPNAVKNRFFGHLNKL

SEQ ID NO: 2940330 - protein, 22 aa, Entamoeba invadens
GRSPNSIKNRFFSYLAKSKKKT

SEQ ID NO: 2940331 - protein, 20 aa, Entamoeba invadens
GRSPSTVRCFLKCYGNDHQL

SEQ ID NO: 2940332 - protein, 19 aa, Entamoeba invadens
GRSRKQCRERYCYHLDPKI

SEQ ID NO: 2940333 - protein, 18 aa, Entamoeba invadens
GRSRLYFIASKSVTSETV

SEQ ID NO: 2940334 - protein, 21 aa, Entamoeba invadens
GRSSFKFNAVQFLFKKTLMGI

SEQ ID NO: 2940335 - protein, 18 aa, Entamoeba invadens
GRSTPLCTRMKVIPPNAK

SEQ ID NO: 2940336 - protein, 24 aa, Entamoeba invadens
GRTCNLYDPNTYFFTAMMEGNWWK

SEQ ID NO: 2940337 - protein, 31 aa, Entamoeba invadens
GRTDCFYEKFLCVWDYAAASLIVEEAGGVCK

SEQ ID NO: 2940338 - protein, 24 aa, Entamoeba invadens
GRTDEGVLCLLKLTVEDIYKQEIN

SEQ ID NO: 2940339 - protein, 22 aa, Entamoeba invadens
GRTEVVVGIKCELEEPQATSSN

SEQ ID NO: 2940340 - protein, 20 aa, Entamoeba invadens
GRTHGSEVFVSMNHVMKKDE

SEQ ID NO: 2940341 - protein, 24 aa, Entamoeba invadens
GRTITFGCPYYFKNMSRGFVKIKG

SEQ ID NO: 2940342 - protein, 25 aa, Entamoeba invadens
GRTIVDSMVTFKCTPLFAAPELLKR

SEQ ID NO: 2940343 - protein, 20 aa, Entamoeba invadens
GRTKCIAFLVTVNSIREGIV

SEQ ID NO: 2940344 - protein, 23 aa, Entamoeba invadens
GRTKQQKVCLVKTLHRPVPLQHY

SEQ ID NO: 2940345 - protein, 18 aa, Entamoeba invadens
GRTVSINCCDVIEPLLVP

SEQ ID NO: 2940346 - protein, 23 aa, Entamoeba invadens
GRVDLLEKFYEKWQEGASQRDVY

SEQ ID NO: 2940347 - protein, 19 aa, Entamoeba invadens
GRVISMLQWDYTFTTEELM

SEQ ID NO: 2940348 - protein, 21 aa, Entamoeba invadens
GRVKMELFRTVCPKTVENFRQ

SEQ ID NO: 2940349 - protein, 17 aa, Entamoeba invadens
GRVKMKIGYDTKAHTQL

SEQ ID NO: 2940350 - protein, 20 aa, Entamoeba invadens
GRVKYILKQQFEYELDNDVQ

SEQ ID NO: 2940351 - protein, 22 aa, Entamoeba invadens
GRVLDMLDRGAINPNTVKILIL

SEQ ID NO: 2940352 - protein, 18 aa, Entamoeba invadens
GRVSLATDFKHRRLLIVS

SEQ ID NO: 2940353 - protein, 17 aa, Entamoeba invadens
GRWSDKQFDEYRTNFTQ

SEQ ID NO: 2940354 - protein, 30 aa, Entamoeba invadens
GRYECRIFGEGAVEGVIFRSYHSCCDVVFT

SEQ ID NO: 2940355 - protein, 21 aa, Entamoeba invadens
GRYFLRKSHNVYNCDPTSTTV

SEQ ID NO: 2940356 - protein, 26 aa, Entamoeba invadens
GRYFTFKHHCSGLKTEVYVNCDGMAV

SEQ ID NO: 2940357 - protein, 18 aa, Entamoeba invadens
GRYLVFWQLIPLQYVQGE

SEQ ID NO: 2940358 - protein, 17 aa, Entamoeba invadens
GRYMPPRDQRIPFGKDM

SEQ ID NO: 2940359 - protein, 19 aa, Entamoeba invadens
GRYSEPIRWFKKTEVESGI

SEQ ID NO: 2940360 - protein, 20 aa, Entamoeba invadens
GRYSIPNGISPQRMYQRFPL

SEQ ID NO: 2940361 - protein, 25 aa, Entamoeba invadens
GRYSTLYLRFLPKLQNVYANGGIKA

SEQ ID NO: 2940362 - protein, 17 aa, Entamoeba invadens
GRYVYPIYIISDSTTSS

SEQ ID NO: 2940363 - protein, 17 aa, Entamoeba invadens
GRYYLNNGFSIPYDIFS

SEQ ID NO: 2940364 - protein, 24 aa, Entamoeba invadens
GSAFKNCGLRGLTIPKNVQSIGKL

SEQ ID NO: 2940365 - protein, 20 aa, Entamoeba invadens
GSAKKVWGIKVSEGRIVTTL

SEQ ID NO: 2940366 - protein, 25 aa, Entamoeba invadens
GSAVERCYICGTLGHSKKNCPEKDP

SEQ ID NO: 2940367 - protein, 17 aa, Entamoeba invadens
GSAWSSAKIEVERMQVK

SEQ ID NO: 2940368 - protein, 21 aa, Entamoeba invadens
GSAYFALLCAPLYASLSEKSD

SEQ ID NO: 2940369 - protein, 17 aa, Entamoeba invadens
GSCDKEIYEVFKRIYSV

SEQ ID NO: 2940370 - protein, 20 aa, Entamoeba invadens
GSCFCKCSSLSSITIPSSIR

SEQ ID NO: 2940371 - protein, 31 aa, Entamoeba invadens
GSCIDGRLTSAWNWCSMIEKYIYYPIFLLAD

SEQ ID NO: 2940372 - protein, 25 aa, Entamoeba invadens
GSCIDGRLTSAWNWCSSLDKKEYYP

SEQ ID NO: 2940373 - protein, 17 aa, Entamoeba invadens
GSCISCIIGYYYSGGLC

SEQ ID NO: 2940374 - protein, 20 aa, Entamoeba invadens
GSCKSCGQTIEQGELKYGKE

SEQ ID NO: 2940375 - protein, 21 aa, Entamoeba invadens
GSCLPLCFGAIDVLSNVFYWS

SEQ ID NO: 2940376 - protein, 22 aa, Entamoeba invadens
GSCNVSMSFPYTVVPQIIPAQV

SEQ ID NO: 2940377 - protein, 19 aa, Entamoeba invadens
GSCQFQILTALKKVSNHPW

SEQ ID NO: 2940378 - protein, 24 aa, Entamoeba invadens
GSDANKSFLGFSFWKKKEDKKSLA

SEQ ID NO: 2940379 - protein, 18 aa, Entamoeba invadens
GSDAVLYFYSAINHQTFD

SEQ ID NO: 2940380 - protein, 17 aa, Entamoeba invadens
GSDCLRCDKTHFSTTLP

SEQ ID NO: 2940381 - protein, 27 aa, Entamoeba invadens
GSDDFLGNCFWYVPQMRTSEKRKEILK

SEQ ID NO: 2940382 - protein, 19 aa, Entamoeba invadens
GSDFKELFGKLEVYGEKSF

SEQ ID NO: 2940383 - protein, 18 aa, Entamoeba invadens
GSDGGSCIDGRLTSAWNW

SEQ ID NO: 2940384 - protein, 17 aa, Entamoeba invadens
GSDGGSCIDGRLTSSWN

SEQ ID NO: 2940385 - protein, 19 aa, Entamoeba invadens
GSDMSRQLVCCLLGCMHDV

SEQ ID NO: 2940386 - protein, 18 aa, Entamoeba invadens
GSEAITCGCCCQDGKCCC

SEQ ID NO: 2940387 - protein, 27 aa, Entamoeba invadens
GSEDCLMAYLCCILQGYFIISDLYLEH

SEQ ID NO: 2940388 - protein, 17 aa, Entamoeba invadens
GSEEVFNVYCECSKDYE

SEQ ID NO: 2940389 - protein, 27 aa, Entamoeba invadens
GSEFFYNLYLFPYLVFIGFTRCQLPVS

SEQ ID NO: 2940390 - protein, 23 aa, Entamoeba invadens
GSEGCVRLAINRRTGEKKAIKIF

SEQ ID NO: 2940391 - protein, 20 aa, Entamoeba invadens
GSEHRLRIRGNFEGTLKNNV

SEQ ID NO: 2940392 - protein, 20 aa, Entamoeba invadens
GSEHRLRIRGNFEGTLKNSV

SEQ ID NO: 2940393 - protein, 20 aa, Entamoeba invadens
GSEIEFKYATPLDEDTNTKT

SEQ ID NO: 2940394 - protein, 18 aa, Entamoeba invadens
GSELFKERIQSMPQPMTN

SEQ ID NO: 2940395 - protein, 22 aa, Entamoeba invadens
GSELLKVMGVAGVIGESTTCNH

SEQ ID NO: 2940396 - protein, 25 aa, Entamoeba invadens
GSENLRLIGQYAFSGCLSLKSFYFN

SEQ ID NO: 2940397 - protein, 26 aa, Entamoeba invadens
GSEQWEWLFWVGFRDIFVWKKGSEYE

SEQ ID NO: 2940398 - protein, 25 aa, Entamoeba invadens
GSERFCSLGPVFFRGAECCVLVCDM

SEQ ID NO: 2940399 - protein, 25 aa, Entamoeba invadens
GSEVCIKLRIKIMLDAANKISYLHS

SEQ ID NO: 2940400 - protein, 17 aa, Entamoeba invadens
GSEVVIVSHAVLKRCLS

SEQ ID NO: 2940401 - protein, 24 aa, Entamoeba invadens
GSFCGSCPKAGGKYCKKYYLEDIL

SEQ ID NO: 2940402 - protein, 22 aa, Entamoeba invadens
GSFCGSCQRAGAGEYSRKYYLE

SEQ ID NO: 2940403 - protein, 19 aa, Entamoeba invadens
GSFFEIIKEAKFAAQYSGN

SEQ ID NO: 2940404 - protein, 28 aa, Entamoeba invadens
GSFFPYRYKEEFSIFGNILLKHKYSVHY

SEQ ID NO: 2940405 - protein, 28 aa, Entamoeba invadens
GSFGCEKILCLWDIRMLKLPTITFDNRV

SEQ ID NO: 2940406 - protein, 19 aa, Entamoeba invadens
GSFGIQWLLKMKISREQDD

SEQ ID NO: 2940407 - protein, 18 aa, Entamoeba invadens
GSFGIVFKGSYRGNVVAI

SEQ ID NO: 2940408 - protein, 17 aa, Entamoeba invadens
GSFGIVYKGKYQGNIVA

SEQ ID NO: 2940409 - protein, 19 aa, Entamoeba invadens
GSFGIVYKGQYRGVCVAIK

SEQ ID NO: 2940410 - protein, 23 aa, Entamoeba invadens
GSFGIVYKGSFRKNCVAIKKMKE

SEQ ID NO: 2940411 - protein, 17 aa, Entamoeba invadens
GSFGIVYKGTFRGNIVA

SEQ ID NO: 2940412 - protein, 18 aa, Entamoeba invadens
GSFGIVYKGTFRKQDVAI

SEQ ID NO: 2940413 - protein, 18 aa, Entamoeba invadens
GSFGIVYLGSYRGNTVAI

SEQ ID NO: 2940414 - protein, 17 aa, Entamoeba invadens
GSFGLVYQGTFRNNLVA

SEQ ID NO: 2940415 - protein, 28 aa, Entamoeba invadens
GSFGQVLKCLDMNTGLFVALKVLRNRSA

SEQ ID NO: 2940416 - protein, 19 aa, Entamoeba invadens
GSFGVVYKGTFRGNVVAIK

SEQ ID NO: 2940417 - protein, 30 aa, Entamoeba invadens
GSFHLKCFKCDVCGAQLGGKFGLKGTKKLC

SEQ ID NO: 2940418 - protein, 23 aa, Entamoeba invadens
GSFKDIVHIISMLRTTRSLLLRD

SEQ ID NO: 2940419 - protein, 17 aa, Entamoeba invadens
GSFKEIFAIDDTLSGKV

SEQ ID NO: 2940420 - protein, 27 aa, Entamoeba invadens
GSFLARYGVNRCIKKSGKIMQMTLKFQ

SEQ ID NO: 2940421 - protein, 23 aa, Entamoeba invadens
GSFLRKLGKSLCEEHIASKFETL

SEQ ID NO: 2940422 - protein, 29 aa, Entamoeba invadens
GSFLVKWKRRYCVLAPNVIALFNCAKDLL

SEQ ID NO: 2940423 - protein, 20 aa, Entamoeba invadens
GSFNKCLKKLEDARVKKGLP

SEQ ID NO: 2940424 - protein, 17 aa, Entamoeba invadens
GSFRNCSSLSKLDIPTT

SEQ ID NO: 2940425 - protein, 21 aa, Entamoeba invadens
GSFVRRYMDDNGFVSVVILSK

SEQ ID NO: 2940426 - protein, 26 aa, Entamoeba invadens
GSFYFWMAYCPMIPKSEKLTQIVEKL

SEQ ID NO: 2940427 - protein, 26 aa, Entamoeba invadens
GSGKRLRPLGLLSFYIGGGGQLTDPE

SEQ ID NO: 2940428 - protein, 17 aa, Entamoeba invadens
GSGQCYCDQYSFDYKGM

SEQ ID NO: 2940429 - protein, 21 aa, Entamoeba invadens
GSGRYTRAMLFLQNIYGKGVY

SEQ ID NO: 2940430 - protein, 22 aa, Entamoeba invadens
GSGRYTRVLLFLREIYGNDVLN

SEQ ID NO: 2940431 - protein, 18 aa, Entamoeba invadens
GSGWCWLVLTNGKLEIVD

SEQ ID NO: 2940432 - protein, 22 aa, Entamoeba invadens
GSGYLKYYLYNWACPKVNPDKL

SEQ ID NO: 2940433 - protein, 21 aa, Entamoeba invadens
GSHFFPFSITIPIVSHPSIHF

SEQ ID NO: 2940434 - protein, 17 aa, Entamoeba invadens
GSHGCFLVYDITNVDSF

SEQ ID NO: 2940435 - protein, 25 aa, Entamoeba invadens
GSHIPEIVTRLGVKCFEGCTNEVIE

SEQ ID NO: 2940436 - protein, 24 aa, Entamoeba invadens
GSHLICSLCLVNGFFVSNNFEQLC

SEQ ID NO: 2940437 - protein, 25 aa, Entamoeba invadens
GSHSCCLKVVKGDGVYSIFGGFGKK

SEQ ID NO: 2940438 - protein, 19 aa, Entamoeba invadens
GSICVCFDGTTLAQGINCR

SEQ ID NO: 2940439 - protein, 23 aa, Entamoeba invadens
GSIGDMLFFFGYRHEGFVLDIAQ

SEQ ID NO: 2940440 - protein, 19 aa, Entamoeba invadens
GSIGFFEFLALYNFVKLCL

SEQ ID NO: 2940441 - protein, 20 aa, Entamoeba invadens
GSIIEMFKAKSKVLVLTAKK

SEQ ID NO: 2940442 - protein, 19 aa, Entamoeba invadens
GSIKKDRTVKDKKKIADLE

SEQ ID NO: 2940443 - protein, 19 aa, Entamoeba invadens
GSIKRCAFFNCNFKTIEVP

SEQ ID NO: 2940444 - protein, 25 aa, Entamoeba invadens
GSIKTWKKRLFILKDNRLWYFEGKN

SEQ ID NO: 2940445 - protein, 33 aa, Entamoeba invadens
GSIKTWKKRYFVLKDKMIWYYASRHDLIAKGCV

SEQ ID NO: 2940446 - protein, 23 aa, Entamoeba invadens
GSINSIVSVLAEWVPFTKTPKIV

SEQ ID NO: 2940447 - protein, 18 aa, Entamoeba invadens
GSIPSWLINSQAKGVLPK

SEQ ID NO: 2940448 - protein, 25 aa, Entamoeba invadens
GSIRDFIKPFMLRRLKSDVQKELPP

SEQ ID NO: 2940449 - protein, 22 aa, Entamoeba invadens
GSISHFLSLVFFIAKKTDTRVE

SEQ ID NO: 2940450 - protein, 19 aa, Entamoeba invadens
GSISYCGFTSLTLSTHLEV

SEQ ID NO: 2940451 - protein, 17 aa, Entamoeba invadens
GSIWEGGIFKLTMTFTD

SEQ ID NO: 2940452 - protein, 19 aa, Entamoeba invadens
GSKCFSKCYSLLPFQIPTS

SEQ ID NO: 2940453 - protein, 20 aa, Entamoeba invadens
GSKELRGFRRRGCVGECTDP

SEQ ID NO: 2940454 - protein, 26 aa, Entamoeba invadens
GSKEVMMACYFNPMTKLMIYPNYKEL

SEQ ID NO: 2940455 - protein, 25 aa, Entamoeba invadens
GSKHIPTNLCFDIACVGSLINVTVI

SEQ ID NO: 2940456 - protein, 21 aa, Entamoeba invadens
GSKIGRLVRETAICLDKASIL

SEQ ID NO: 2940457 - protein, 23 aa, Entamoeba invadens
GSKKYIVIVPFLFNKEKKMFDKM

SEQ ID NO: 2940458 - protein, 22 aa, Entamoeba invadens
GSKLIRQYVEMGGKYLGICAGA

SEQ ID NO: 2940459 - protein, 24 aa, Entamoeba invadens
GSKMQMGVSCLELAGQDVSESIEK

SEQ ID NO: 2940460 - protein, 23 aa, Entamoeba invadens
GSKVDVWSAGVILFVMVCGYPPF

SEQ ID NO: 2940461 - protein, 26 aa, Entamoeba invadens
GSLERLRKDILLVRPTFFGATPSFWN

SEQ ID NO: 2940462 - protein, 23 aa, Entamoeba invadens
GSLFKNGCADVVFTGEMGHHEVL

SEQ ID NO: 2940463 - protein, 18 aa, Entamoeba invadens
GSLFQSLPIGNFPRFKSS

SEQ ID NO: 2940464 - protein, 34 aa, Entamoeba invadens
GSLIQSGCICGKYFCVGTVFGALRTSYPPTSKSV

SEQ ID NO: 2940465 - protein, 23 aa, Entamoeba invadens
GSLKGVCGDEWIEQVKVQREKYQ

SEQ ID NO: 2940466 - protein, 17 aa, Entamoeba invadens
GSLKWKHSIDDCIFVNN

SEQ ID NO: 2940467 - protein, 31 aa, Entamoeba invadens
GSLLHSGHKFKVWKAEMERVVLGEKGDERHE

SEQ ID NO: 2940468 - protein, 21 aa, Entamoeba invadens
GSLLVRARIISAIKYWIENVW

SEQ ID NO: 2940469 - protein, 17 aa, Entamoeba invadens
GSLLYKDERIKLINLAK

SEQ ID NO: 2940470 - protein, 28 aa, Entamoeba invadens
GSLMSPMDAFLCVRGMKTLPLRMKVHHE

SEQ ID NO: 2940471 - protein, 29 aa, Entamoeba invadens
GSLMSPMDAFLCVRGMKTLPLRMQVHHEN

SEQ ID NO: 2940472 - protein, 23 aa, Entamoeba invadens
GSLRFLKHGNVLNHYGAIPQTWE

SEQ ID NO: 2940473 - protein, 24 aa, Entamoeba invadens
GSLRTVCDACLLAMYTKQQEALSK

SEQ ID NO: 2940474 - protein, 23 aa, Entamoeba invadens
GSLSNLRSVVCGTYELVNYINPT

SEQ ID NO: 2940475 - protein, 18 aa, Entamoeba invadens
GSLSPPVEIDFRSKIPFE

SEQ ID NO: 2940476 - protein, 20 aa, Entamoeba invadens
GSLSRSYCNPSLQSSSYTAK

SEQ ID NO: 2940477 - protein, 23 aa, Entamoeba invadens
GSLSVAIPPVFGKLSGDPVGLEL

SEQ ID NO: 2940478 - protein, 23 aa, Entamoeba invadens
GSLTKRSKGILFFGPPGTGKTML

SEQ ID NO: 2940479 - protein, 27 aa, Entamoeba invadens
GSLYMKIKCVKSVYKYSDLKQIPQDDD

SEQ ID NO: 2940480 - protein, 21 aa, Entamoeba invadens
GSMILMKIMDFLGGLFTGIAV

SEQ ID NO: 2940481 - protein, 22 aa, Entamoeba invadens
GSNCFMDCISLRSVTLPVSLTQ

SEQ ID NO: 2940482 - protein, 20 aa, Entamoeba invadens
GSNIKRVFMLAVDVIMKNMA

SEQ ID NO: 2940483 - protein, 20 aa, Entamoeba invadens
GSNKHLAMAYYTLFVKPVFE

SEQ ID NO: 2940484 - protein, 21 aa, Entamoeba invadens
GSNTFPMKWGIGNYCDVVRRQ

SEQ ID NO: 2940485 - protein, 18 aa, Entamoeba invadens
GSNTFVFEKPVFDQKTKG

SEQ ID NO: 2940486 - protein, 19 aa, Entamoeba invadens
GSPAIKGQIQATVDDETAL

SEQ ID NO: 2940487 - protein, 18 aa, Entamoeba invadens
GSQCPLRQLHGVPSDLCK

SEQ ID NO: 2940488 - protein, 24 aa, Entamoeba invadens
GSQDGLCCTLNFKNRNEGIIDTVN

SEQ ID NO: 2940489 - protein, 24 aa, Entamoeba invadens
GSQGFVCCNLIKLLEKLVVEKHIL

SEQ ID NO: 2940490 - protein, 22 aa, Entamoeba invadens
GSQIRMPLPLIRDNPITFSMSQ

SEQ ID NO: 2940491 - protein, 17 aa, Entamoeba invadens
GSQPCKASDVFSFGLIV

SEQ ID NO: 2940492 - protein, 22 aa, Entamoeba invadens
GSQPKWKCGIELLRDKCGSSST

SEQ ID NO: 2940493 - protein, 18 aa, Entamoeba invadens
GSRDKTLLVWNVDTTSEA

SEQ ID NO: 2940494 - protein, 24 aa, Entamoeba invadens
GSRGVECLFGVLSLFLEHPTRVYI

SEQ ID NO: 2940495 - protein, 29 aa, Entamoeba invadens
GSRIALTDFRCCMCGMVVHGSCIHSAPPI

SEQ ID NO: 2940496 - protein, 26 aa, Entamoeba invadens
GSRISARLKRIFVPAKFSKIFRDYFA

SEQ ID NO: 2940497 - protein, 20 aa, Entamoeba invadens
GSSADICRLVLQKNKMGPIV

SEQ ID NO: 2940498 - protein, 21 aa, Entamoeba invadens
GSSAQEIADWLFSESNLLISN

SEQ ID NO: 2940499 - protein, 18 aa, Entamoeba invadens
GSSCCAILNGKSYDTSMG

SEQ ID NO: 2940500 - protein, 20 aa, Entamoeba invadens
GSSCFKGCHNLSKITIPLNV

SEQ ID NO: 2940501 - protein, 21 aa, Entamoeba invadens
GSSCFWGCGLMTLVVERGVKY

SEQ ID NO: 2940502 - protein, 17 aa, Entamoeba invadens
GSSFFKKTSTPRMASFE

SEQ ID NO: 2940503 - protein, 17 aa, Entamoeba invadens
GSSGESALEIIIANKQS

SEQ ID NO: 2940504 - protein, 22 aa, Entamoeba invadens
GSSGTDPECKFGTKSDHDKFYD

SEQ ID NO: 2940505 - protein, 18 aa, Entamoeba invadens
GSSIAWRNNMRIENVDLE

SEQ ID NO: 2940506 - protein, 22 aa, Entamoeba invadens
GSSIPLRHRIFYSKKDRATYYS

SEQ ID NO: 2940507 - protein, 21 aa, Entamoeba invadens
GSSITPAWLRFISDTRNSPTM

SEQ ID NO: 2940508 - protein, 25 aa, Entamoeba invadens
GSSLSVRFGLPFVFVATRKDLVKPQ

SEQ ID NO: 2940509 - protein, 23 aa, Entamoeba invadens
GSSRQHIRFSSTYHDTTFKGERL

SEQ ID NO: 2940510 - protein, 23 aa, Entamoeba invadens
GSSVFQVRFTPLVGFENSAPLKE

SEQ ID NO: 2940511 - protein, 24 aa, Entamoeba invadens
GSTALPFLKVMNILIFVFATNSID

SEQ ID NO: 2940512 - protein, 18 aa, Entamoeba invadens
GSTGDDKGLGAAGTTGST

SEQ ID NO: 2940513 - protein, 20 aa, Entamoeba invadens
GSTKTVSWLLAKGANPTAEN

SEQ ID NO: 2940514 - protein, 21 aa, Entamoeba invadens
GSTPMKRKRLFASSSSATEHK

SEQ ID NO: 2940515 - protein, 20 aa, Entamoeba invadens
GSTSKQRFFVLCDYLFNKYE

SEQ ID NO: 2940516 - protein, 35 aa, Entamoeba invadens
GSTVCPLCANRSMFCYSCKMLTPIELEKHTKKSHK

SEQ ID NO: 2940517 - protein, 28 aa, Entamoeba invadens
GSVDILRFKFLISIFGKFYLNKNQFLKM

SEQ ID NO: 2940518 - protein, 23 aa, Entamoeba invadens
GSVDRLKHSNFFIVDNKTQHDKL

SEQ ID NO: 2940519 - protein, 69 aa, Entamoeba invadens
GSVGGQAGVSVDAVIQGEADLAFVRAKMTPLEDAVEEWKNEMSADMKTFSEISGKIRGQNEAIMKAESE

SEQ ID NO: 2940520 - protein, 27 aa, Entamoeba invadens
GSVGKSAICLLYVKGEFNVEYNPTIED

SEQ ID NO: 2940521 - protein, 19 aa, Entamoeba invadens
GSVHFEHFLTLIGQKTKLY

SEQ ID NO: 2940522 - protein, 21 aa, Entamoeba invadens
GSVKCSPSIFLCAVQNQGIFF

SEQ ID NO: 2940523 - protein, 22 aa, Entamoeba invadens
GSVLCCNWLIRYGARVDIENEM

SEQ ID NO: 2940524 - protein, 25 aa, Entamoeba invadens
GSVLVAELGRFVGRYIGMFLEMRYG

SEQ ID NO: 2940525 - protein, 18 aa, Entamoeba invadens
GSVNGRSVTHACHHSRSL

SEQ ID NO: 2940526 - protein, 17 aa, Entamoeba invadens
GSVNWNLIAKPRGNKPL

SEQ ID NO: 2940527 - protein, 23 aa, Entamoeba invadens
GSVTKEVLIRVLFGIRKEIPVSV

SEQ ID NO: 2940528 - protein, 31 aa, Entamoeba invadens
GSVYCKKTWKCQVCSHVGQLAQMGLVKRRGD

SEQ ID NO: 2940529 - protein, 18 aa, Entamoeba invadens
GSYHVMGVLGRYSQKVSV

SEQ ID NO: 2940530 - protein, 18 aa, Entamoeba invadens
GSYLMGLKMEGMSGKDHY

SEQ ID NO: 2940531 - protein, 26 aa, Entamoeba invadens
GSYLSHGTCAWVFGEKHFYYNVNNDI

SEQ ID NO: 2940532 - protein, 21 aa, Entamoeba invadens
GSYTFKSLVLVLSDKTKQPLV

SEQ ID NO: 2940533 - protein, 22 aa, Entamoeba invadens
GTALKEPTFCVGNKANGSDEDR

SEQ ID NO: 2940534 - protein, 19 aa, Entamoeba invadens
GTANSWRWCTEVFDYLNIA

SEQ ID NO: 2940535 - protein, 18 aa, Entamoeba invadens
GTARAKCHGFKFNTLGKL

SEQ ID NO: 2940536 - protein, 19 aa, Entamoeba invadens
GTASVGNARCNECYPPYTL

SEQ ID NO: 2940537 - protein, 20 aa, Entamoeba invadens
GTCFDIKLECMRSVYNHVET

SEQ ID NO: 2940538 - protein, 26 aa, Entamoeba invadens
GTDIPKEIKYIFARLRTAVEKKFAGS

SEQ ID NO: 2940539 - protein, 22 aa, Entamoeba invadens
GTDKEKIVCMGIYSEGQYGIPK

SEQ ID NO: 2940540 - protein, 17 aa, Entamoeba invadens
GTDKLRGLTSYIFYLID

SEQ ID NO: 2940541 - protein, 21 aa, Entamoeba invadens
GTDNWVFRELVNYIMALLHGL

SEQ ID NO: 2940542 - protein, 22 aa, Entamoeba invadens
GTEICKHLFLGSAMAASNIEWL

SEQ ID NO: 2940543 - protein, 18 aa, Entamoeba invadens
GTEIGVEVAMQWNDSYAE

SEQ ID NO: 2940544 - protein, 24 aa, Entamoeba invadens
GTEVKPEWLRLLIPKNQIPVKGAV

SEQ ID NO: 2940545 - protein, 19 aa, Entamoeba invadens
GTEYIKVAKIKNGVWSQCY

SEQ ID NO: 2940546 - protein, 17 aa, Entamoeba invadens
GTFERLSWLYAPSSVIL

SEQ ID NO: 2940547 - protein, 25 aa, Entamoeba invadens
GTFFKLERFRKIVILKKELSCDNLV

SEQ ID NO: 2940548 - protein, 18 aa, Entamoeba invadens
GTFGQVFKCRNCKDNTLV

SEQ ID NO: 2940549 - protein, 22 aa, Entamoeba invadens
GTFHQKCFVCEICGEPLVGSYT

SEQ ID NO: 2940550 - protein, 26 aa, Entamoeba invadens
GTFLFPKEPWWKVHFGSDEGKVSKWI

SEQ ID NO: 2940551 - protein, 18 aa, Entamoeba invadens
GTFMGCSMLNNALRTQKV

SEQ ID NO: 2940552 - protein, 25 aa, Entamoeba invadens
GTFNMKAVAGLVLFNQYWYWYPFTL

SEQ ID NO: 2940553 - protein, 24 aa, Entamoeba invadens
GTFWLDIGNHLGRICVTTPGTNQS

SEQ ID NO: 2940554 - protein, 18 aa, Entamoeba invadens
GTGEQACRFLRTLRKGKK

SEQ ID NO: 2940555 - protein, 23 aa, Entamoeba invadens
GTGKTCMLIRLSQNFFDTQHNAT

SEQ ID NO: 2940556 - protein, 18 aa, Entamoeba invadens
GTGLLILSICGMYLSNAH

SEQ ID NO: 2940557 - protein, 28 aa, Entamoeba invadens
GTGPRIIPRQSRLFAASFEDLHDFVRPP

SEQ ID NO: 2940558 - protein, 17 aa, Entamoeba invadens
GTGSAWSSAKIEVERMQ

SEQ ID NO: 2940559 - protein, 21 aa, Entamoeba invadens
GTGSGFTAALCEKIAEQYPKR

SEQ ID NO: 2940560 - protein, 22 aa, Entamoeba invadens
GTGSGFTAALCEKLADKYRKKT

SEQ ID NO: 2940561 - protein, 20 aa, Entamoeba invadens
GTGSTCSVYRGIYKKDGGIG

SEQ ID NO: 2940562 - protein, 18 aa, Entamoeba invadens
GTHKFAFRISAGEFTHGV

SEQ ID NO: 2940563 - protein, 23 aa, Entamoeba invadens
GTHRKCTRCVLKALEQLEKEGQE

SEQ ID NO: 2940564 - protein, 18 aa, Entamoeba invadens
GTIARPSYDLGESCNAEK

SEQ ID NO: 2940565 - protein, 19 aa, Entamoeba invadens
GTIEKAEFVKILTDVPKRQ

SEQ ID NO: 2940566 - protein, 25 aa, Entamoeba invadens
GTIGGLRIIGRLAVGNRKGLLLPHT

SEQ ID NO: 2940567 - protein, 17 aa, Entamoeba invadens
GTIKAGLYNTAQHEEGS

SEQ ID NO: 2940568 - protein, 18 aa, Entamoeba invadens
GTIMKAKRLLLLAFSEGK

SEQ ID NO: 2940569 - protein, 26 aa, Entamoeba invadens
GTIPLPNAIEPIPIESNSSMITLKFI

SEQ ID NO: 2940570 - protein, 18 aa, Entamoeba invadens
GTIQIGFISLRNNDLDHF

SEQ ID NO: 2940571 - protein, 23 aa, Entamoeba invadens
GTIRAASMMLEFLGYSEESVLIE

SEQ ID NO: 2940572 - protein, 30 aa, Entamoeba invadens
GTIRLVGELLIKFNPTFKVNLMDVFGTYYL

SEQ ID NO: 2940573 - protein, 20 aa, Entamoeba invadens
GTISFNPCVRDFYDVQNQTF

SEQ ID NO: 2940574 - protein, 29 aa, Entamoeba invadens
GTITPVWQIECAKTLKGVVKMVDGEVVIP

SEQ ID NO: 2940575 - protein, 21 aa, Entamoeba invadens
GTITYRLFLNYLKTKKYSEAL

SEQ ID NO: 2940576 - protein, 20 aa, Entamoeba invadens
GTIYSECFFFNVSTGNTQPI

SEQ ID NO: 2940577 - protein, 28 aa, Entamoeba invadens
GTKAFKDTDWLSAIRMYSAALGHLEAMF

SEQ ID NO: 2940578 - protein, 23 aa, Entamoeba invadens
GTKEIAMWRSIFVLYAITIFGIR

SEQ ID NO: 2940579 - protein, 31 aa, Entamoeba invadens
GTKEYDWKRMPAWCDRVLFRIHNLYQLSLHV

SEQ ID NO: 2940580 - protein, 26 aa, Entamoeba invadens
GTKFEKKDCGDTIVWNSIGSGVFVDC

SEQ ID NO: 2940581 - protein, 26 aa, Entamoeba invadens
GTKIPFRNTFPVFPIRNDVIVELYEN

SEQ ID NO: 2940582 - protein, 26 aa, Entamoeba invadens
GTKIPFSNTFPVFPIRNDVIVELYEN

SEQ ID NO: 2940583 - protein, 17 aa, Entamoeba invadens
GTKPCIFFMQNGYCKKG

SEQ ID NO: 2940584 - protein, 21 aa, Entamoeba invadens
GTKRRIFVIPYLMYSTMERAV

SEQ ID NO: 2940585 - protein, 21 aa, Entamoeba invadens
GTKRRVFVIPYLMYSTMERAV

SEQ ID NO: 2940586 - protein, 21 aa, Entamoeba invadens
GTLCSVEIPPSVSIINDKNRN

SEQ ID NO: 2940587 - protein, 20 aa, Entamoeba invadens
GTLEFSGWMIVDGVFSIQAD

SEQ ID NO: 2940588 - protein, 19 aa, Entamoeba invadens
GTLFIGRKRVGMMKGSRTF

SEQ ID NO: 2940589 - protein, 18 aa, Entamoeba invadens
GTLFYTYASNLLKKSEEK

SEQ ID NO: 2940590 - protein, 21 aa, Entamoeba invadens
GTLKLLRSGVGVNILGEVEYR

SEQ ID NO: 2940591 - protein, 27 aa, Entamoeba invadens
GTLKMGCPISLPSRNNLDIGRVIGIEN

SEQ ID NO: 2940592 - protein, 17 aa, Entamoeba invadens
GTLLPKLFPPMTERYKP

SEQ ID NO: 2940593 - protein, 17 aa, Entamoeba invadens
GTLMPLDIRQKFDDFIK

SEQ ID NO: 2940594 - protein, 28 aa, Entamoeba invadens
GTLPNKFFKRGFEFVRDYVVKNCTKASG

SEQ ID NO: 2940595 - protein, 19 aa, Entamoeba invadens
GTLPPLYDRFHKVSLSNSF

SEQ ID NO: 2940596 - protein, 19 aa, Entamoeba invadens
GTLRKCIDAKIKFDIYDAY

SEQ ID NO: 2940597 - protein, 19 aa, Entamoeba invadens
GTLSIFDFIGLGGYGLIGW

SEQ ID NO: 2940598 - protein, 34 aa, Entamoeba invadens
GTLVVEVKGVRLMSSVYKAMFNQMGGAPMQGMPG

SEQ ID NO: 2940599 - protein, 27 aa, Entamoeba invadens
GTLYHQACFKCKTCHRALSVSNYKLLK

SEQ ID NO: 2940600 - protein, 18 aa, Entamoeba invadens
GTMLELEMGLLVMLMGIH

SEQ ID NO: 2940601 - protein, 23 aa, Entamoeba invadens
GTNFKHLMVFAVQDGISIPKSLT

SEQ ID NO: 2940602 - protein, 19 aa, Entamoeba invadens
GTNLAMWKMKFRALYNSVP

SEQ ID NO: 2940603 - protein, 19 aa, Entamoeba invadens
GTNMDNWGNSGLTPQQIAT

SEQ ID NO: 2940604 - protein, 17 aa, Entamoeba invadens
GTNTILFVDEIHSLNKL

SEQ ID NO: 2940605 - protein, 20 aa, Entamoeba invadens
GTPFVKEGFFLHGYWPQSTG

SEQ ID NO: 2940606 - protein, 25 aa, Entamoeba invadens
GTPKCIKCFTSYYIENGKCVLAYSK

SEQ ID NO: 2940607 - protein, 28 aa, Entamoeba invadens
GTPKVMRVAELMFTEFTFCAKLEIFQIF

SEQ ID NO: 2940608 - protein, 17 aa, Entamoeba invadens
GTPKYMAPEIMNKKHYK

SEQ ID NO: 2940609 - protein, 20 aa, Entamoeba invadens
GTPNPSWASVPYGIFICIQC

SEQ ID NO: 2940610 - protein, 21 aa, Entamoeba invadens
GTPRSVFDWINTAAKVDPQPE

SEQ ID NO: 2940611 - protein, 19 aa, Entamoeba invadens
GTPYFRAILSLKKPRRVTL

SEQ ID NO: 2940612 - protein, 23 aa, Entamoeba invadens
GTQCQLEMAVLLINNAQNIRKLL

SEQ ID NO: 2940613 - protein, 30 aa, Entamoeba invadens
GTQKKSRWGSAIRQTLRWFTEPTKDEVKDD

SEQ ID NO: 2940614 - protein, 19 aa, Entamoeba invadens
GTQRMYSLLDRFSKSLEFK

SEQ ID NO: 2940615 - protein, 17 aa, Entamoeba invadens
GTRRGVDIIGVLINTLK

SEQ ID NO: 2940616 - protein, 24 aa, Entamoeba invadens
GTSCAKKAVWWVIFIGKIDIPDVV

SEQ ID NO: 2940617 - protein, 17 aa, Entamoeba invadens
GTSCFQECISLKDITYL

SEQ ID NO: 2940618 - protein, 19 aa, Entamoeba invadens
GTSDYMASCSVKVVDEKSK

SEQ ID NO: 2940619 - protein, 20 aa, Entamoeba invadens
GTSEAPCSWISITPSSQDTC

SEQ ID NO: 2940620 - protein, 22 aa, Entamoeba invadens
GTSEGLVFGWVKKGKSFELVFT

SEQ ID NO: 2940621 - protein, 17 aa, Entamoeba invadens
GTSETLQFLAYVKETPV

SEQ ID NO: 2940622 - protein, 29 aa, Entamoeba invadens
GTSIGKYAFKKCPLTSIVVSKNVHSLPGF

SEQ ID NO: 2940623 - protein, 22 aa, Entamoeba invadens
GTSTFDGFGIAWGISEYLINEI

SEQ ID NO: 2940624 - protein, 23 aa, Entamoeba invadens
GTSYCDGLFCSIDESGAYFFSNV

SEQ ID NO: 2940625 - protein, 24 aa, Entamoeba invadens
GTTCLKVNLLDGGNLLDLMVQKDK

SEQ ID NO: 2940626 - protein, 25 aa, Entamoeba invadens
GTTDIPQCLFFKCNSLMKISIPNSV

SEQ ID NO: 2940627 - protein, 18 aa, Entamoeba invadens
GTTECRAGFAGFDTPKLV

SEQ ID NO: 2940628 - protein, 35 aa, Entamoeba invadens
GTTGSTGSLGLQFPSLSGSTLGSLNNGMSGTTLGG

SEQ ID NO: 2940629 - protein, 31 aa, Entamoeba invadens
GTTIKADIWALGCTVIELITGNAPYSDLNPT

SEQ ID NO: 2940630 - protein, 27 aa, Entamoeba invadens
GTTLEYLHNCAPFVAKLYSLINSPETN

SEQ ID NO: 2940631 - protein, 19 aa, Entamoeba invadens
GTTLHSFAGIGLGDLSGDQ

SEQ ID NO: 2940632 - protein, 19 aa, Entamoeba invadens
GTTQRKNIRSLLKTLQDIL

SEQ ID NO: 2940633 - protein, 23 aa, Entamoeba invadens
GTTSDWHPILSFVTVSEKNMTFR

SEQ ID NO: 2940634 - protein, 24 aa, Entamoeba invadens
GTTSDWHPILSFVTVSERNMAFRK

SEQ ID NO: 2940635 - protein, 19 aa, Entamoeba invadens
GTTTECYKCRNGYIRNNNN

SEQ ID NO: 2940636 - protein, 19 aa, Entamoeba invadens
GTTYSCVGIWQNDRVEIIA

SEQ ID NO: 2940637 - protein, 20 aa, Entamoeba invadens
GTVECKYCKLEMKKKELRDH

SEQ ID NO: 2940638 - protein, 19 aa, Entamoeba invadens
GTVFPIRFTVEKLVAVQWF

SEQ ID NO: 2940639 - protein, 25 aa, Entamoeba invadens
GTVILRTGTSFAVLYADVGDCRGLL

SEQ ID NO: 2940640 - protein, 19 aa, Entamoeba invadens
GTVKCAFTQGVVSCYDGEL

SEQ ID NO: 2940641 - protein, 19 aa, Entamoeba invadens
GTVLPQFARLIPFHITNII

SEQ ID NO: 2940642 - protein, 19 aa, Entamoeba invadens
GTVPCVQYPLEIVSVKKMK

SEQ ID NO: 2940643 - protein, 18 aa, Entamoeba invadens
GTVSIYINASGINVVPNT

SEQ ID NO: 2940644 - protein, 25 aa, Entamoeba invadens
GTVSYELLICIMLRKIKEMTNTVFA

SEQ ID NO: 2940645 - protein, 24 aa, Entamoeba invadens
GTWIKCALVGILEFPDRMYHQLGV

SEQ ID NO: 2940646 - protein, 17 aa, Entamoeba invadens
GTYCFHECLDLKGIQIP

SEQ ID NO: 2940647 - protein, 17 aa, Entamoeba invadens
GTYFPKKVLLHVDSMGS

SEQ ID NO: 2940648 - protein, 24 aa, Entamoeba invadens
GTYFYRCKHGPLIVASEKSKADIF

SEQ ID NO: 2940649 - protein, 19 aa, Entamoeba invadens
GTYKPKLITVRVVSAKSKQ

SEQ ID NO: 2940650 - protein, 19 aa, Entamoeba invadens
GTYKRIITQPVNYTEIVSE

SEQ ID NO: 2940651 - protein, 20 aa, Entamoeba invadens
GVAACCKLSKTTNETNQVIE

SEQ ID NO: 2940652 - protein, 26 aa, Entamoeba invadens
GVACETYGGGIWNTWFDRDLGVSGRV

SEQ ID NO: 2940653 - protein, 18 aa, Entamoeba invadens
GVAFPRLSIIDTPINNSL

SEQ ID NO: 2940654 - protein, 19 aa, Entamoeba invadens
GVAGIKMIGNAAMDISYVA

SEQ ID NO: 2940655 - protein, 27 aa, Entamoeba invadens
GVAHACTKLGIKFLVIRSLSDVPSANA

SEQ ID NO: 2940656 - protein, 21 aa, Entamoeba invadens
GVAKCQICRKDGPNKGKPFYT

SEQ ID NO: 2940657 - protein, 24 aa, Entamoeba invadens
GVAKERLMNVLAFCGLEQANQTAF

SEQ ID NO: 2940658 - protein, 24 aa, Entamoeba invadens
GVAMERRAVYMFGHNLERNEKGWV

SEQ ID NO: 2940659 - protein, 18 aa, Entamoeba invadens
GVARRMSMCTPKESKVLV

SEQ ID NO: 2940660 - protein, 20 aa, Entamoeba invadens
GVASGEWFYAEMFEEKKVKK

SEQ ID NO: 2940661 - protein, 17 aa, Entamoeba invadens
GVCDSVNTCKTCGKNVD

SEQ ID NO: 2940662 - protein, 20 aa, Entamoeba invadens
GVCDTVCKIIHGVKYKDAEM

SEQ ID NO: 2940663 - protein, 26 aa, Entamoeba invadens
GVCESEFFKQWLTSILSTRLISIKRP

SEQ ID NO: 2940664 - protein, 22 aa, Entamoeba invadens
GVCPKCHREMRWGDVIKDFKAR

SEQ ID NO: 2940665 - protein, 25 aa, Entamoeba invadens
GVCPKDKRIGWNWIKCSTTKGSHLI

SEQ ID NO: 2940666 - protein, 17 aa, Entamoeba invadens
GVCVKKCTKSEERINGM

SEQ ID NO: 2940667 - protein, 26 aa, Entamoeba invadens
GVDAFFKMVSRFILGSTFKPTEIPEF

SEQ ID NO: 2940668 - protein, 19 aa, Entamoeba invadens
GVDGLGAFADKTAMRKHKE

SEQ ID NO: 2940669 - protein, 20 aa, Entamoeba invadens
GVDKKFLKYLAIAAPVKGLT

SEQ ID NO: 2940670 - protein, 19 aa, Entamoeba invadens
GVDKYYWPSSWREDFRKEV

SEQ ID NO: 2940671 - protein, 27 aa, Entamoeba invadens
GVDSTCCINCSALSLVIEDFANTFLFR

SEQ ID NO: 2940672 - protein, 18 aa, Entamoeba invadens
GVDVFGRRVTDYIISQNK

SEQ ID NO: 2940673 - protein, 29 aa, Entamoeba invadens
GVEAVKFIRDYAMKYFLLKNENGAVTQLK

SEQ ID NO: 2940674 - protein, 28 aa, Entamoeba invadens
GVEFTIFFCMWWDMFYIKSLDESYDKIQ

SEQ ID NO: 2940675 - protein, 36 aa, Entamoeba invadens
GVEGKVITKIMNWMLKCLICHEEIFDLSKKFCPKCG

SEQ ID NO: 2940676 - protein, 24 aa, Entamoeba invadens
GVEKKVKICFSGFDDEEIKAYQKR

SEQ ID NO: 2940677 - protein, 24 aa, Entamoeba invadens
GVENKGKWYRGEVVKVAQSANVVK

SEQ ID NO: 2940678 - protein, 27 aa, Entamoeba invadens
GVESTCCINCSALSLVIEDFANTISFT

SEQ ID NO: 2940679 - protein, 32 aa, Entamoeba invadens
GVETYCVLDSPKIDDCPAFVISTSDYGCVQMY

SEQ ID NO: 2940680 - protein, 25 aa, Entamoeba invadens
GVEYFSLFVRFVFSDGSFEEKRVKI

SEQ ID NO: 2940681 - protein, 25 aa, Entamoeba invadens
GVEYFSLFVRFVFSDGSFEERRVKI

SEQ ID NO: 2940682 - protein, 24 aa, Entamoeba invadens
GVEYFSLFVRFVFSDGSFVEKRVK

SEQ ID NO: 2940683 - protein, 25 aa, Entamoeba invadens
GVEYFSLFVRFVFSDGSFVEKRVKI

SEQ ID NO: 2940684 - protein, 27 aa, Entamoeba invadens
GVFDFRCVYCGMCLHPECIPKAPHICS

SEQ ID NO: 2940685 - protein, 28 aa, Entamoeba invadens
GVFEPTYRATIGVDFAVKFVTIGGKELQ

SEQ ID NO: 2940686 - protein, 17 aa, Entamoeba invadens
GVFMSRLKTFKFLSKNK

SEQ ID NO: 2940687 - protein, 17 aa, Entamoeba invadens
GVFRADFSLAPLAELSK

SEQ ID NO: 2940688 - protein, 25 aa, Entamoeba invadens
GVFSGCTSLTCLVVPKINGIIKNTI

SEQ ID NO: 2940689 - protein, 19 aa, Entamoeba invadens
GVFSVDYFISVVIIDTDER

SEQ ID NO: 2940690 - protein, 17 aa, Entamoeba invadens
GVFVSRVVVSSDGRSGV

SEQ ID NO: 2940691 - protein, 18 aa, Entamoeba invadens
GVFYRINYDKYLYPYIPP

SEQ ID NO: 2940692 - protein, 26 aa, Entamoeba invadens
GVGCTYCRTNYRLVDRFCFPCTTIEG

SEQ ID NO: 2940693 - protein, 19 aa, Entamoeba invadens
GVGERCRALAWLVFMKILP

SEQ ID NO: 2940694 - protein, 19 aa, Entamoeba invadens
GVGGMSIQIVRSICKDAGG

SEQ ID NO: 2940695 - protein, 20 aa, Entamoeba invadens
GVGHWKSILSAYEFDGRSCV

SEQ ID NO: 2940696 - protein, 24 aa, Entamoeba invadens
GVGKDIFVSLGMSGIHNCVGKKGL

SEQ ID NO: 2940697 - protein, 24 aa, Entamoeba invadens
GVGKSCLLLRFADDVFSKTYITTI

SEQ ID NO: 2940698 - protein, 24 aa, Entamoeba invadens
GVGKTCILSRFVNGVFDNKIVATT

SEQ ID NO: 2940699 - protein, 18 aa, Entamoeba invadens
GVGKTCLLTRFADKTFTE

SEQ ID NO: 2940700 - protein, 23 aa, Entamoeba invadens
GVGKTSIIVNFVFGKFVEQKDST

SEQ ID NO: 2940701 - protein, 19 aa, Entamoeba invadens
GVGNSYLFDIGVCKYGLQA

SEQ ID NO: 2940702 - protein, 25 aa, Entamoeba invadens
GVGRISLSLASKVFAEYRRCGENVI

SEQ ID NO: 2940703 - protein, 18 aa, Entamoeba invadens
GVGTPSFMAPEILNGQKY

SEQ ID NO: 2940704 - protein, 27 aa, Entamoeba invadens
GVGYYSLCHQCPPLIGMAQPLKEGMVT

SEQ ID NO: 2940705 - protein, 17 aa, Entamoeba invadens
GVIDARFSGCTEYVIAV

SEQ ID NO: 2940706 - protein, 27 aa, Entamoeba invadens
GVIDNIPCGLAWPLLIGEKGIGIHMED

SEQ ID NO: 2940707 - protein, 25 aa, Entamoeba invadens
GVIKCLSVLCYFNSSFDLVARWYGL

SEQ ID NO: 2940708 - protein, 19 aa, Entamoeba invadens
GVIPCCLVDGDVYGIEIFL

SEQ ID NO: 2940709 - protein, 19 aa, Entamoeba invadens
GVIRLDIKRLRSVINKDEE

SEQ ID NO: 2940710 - protein, 24 aa, Entamoeba invadens
GVITKERYALIVSFFKDNNCVVPT

SEQ ID NO: 2940711 - protein, 19 aa, Entamoeba invadens
GVIVNCCFDEIKSHISAEQ

SEQ ID NO: 2940712 - protein, 25 aa, Entamoeba invadens
GVIVPVYVKYCWNVLYQTMMKIERH

SEQ ID NO: 2940713 - protein, 20 aa, Entamoeba invadens
GVKCAICGELSHATIDCPLK

SEQ ID NO: 2940714 - protein, 24 aa, Entamoeba invadens
GVKCSTKFFDVGCGDINVVYNNTN

SEQ ID NO: 2940715 - protein, 23 aa, Entamoeba invadens
GVKCTKCNFGSYIENGRCVEVKA

SEQ ID NO: 2940716 - protein, 21 aa, Entamoeba invadens
GVKCVYQCAVLKKISEKFPNF

SEQ ID NO: 2940717 - protein, 18 aa, Entamoeba invadens
GVKDGTTCLCVLATELNV

SEQ ID NO: 2940718 - protein, 23 aa, Entamoeba invadens
GVKEINIRAVLCCPVSFNDAQKE

SEQ ID NO: 2940719 - protein, 23 aa, Entamoeba invadens
GVKELMFDKFLQYKDVERLLQGS

SEQ ID NO: 2940720 - protein, 21 aa, Entamoeba invadens
GVKEVIPWSITSKETIMKYCA

SEQ ID NO: 2940721 - protein, 21 aa, Entamoeba invadens
GVKGKDCIIFGIEKKSIAKLQ

SEQ ID NO: 2940722 - protein, 27 aa, Entamoeba invadens
GVKICPNEVPTFCDGRMELPPQYPTTI

SEQ ID NO: 2940723 - protein, 18 aa, Entamoeba invadens
GVKIPILSFRALNSETDK

SEQ ID NO: 2940724 - protein, 21 aa, Entamoeba invadens
GVKIRTWKRRYFVIKNNFIFY

SEQ ID NO: 2940725 - protein, 28 aa, Entamoeba invadens
GVKKINVSEWFYLKHVYIEPDQRYQNAF

SEQ ID NO: 2940726 - protein, 22 aa, Entamoeba invadens
GVKLPISSFRAFDATKDAKQYS

SEQ ID NO: 2940727 - protein, 22 aa, Entamoeba invadens
GVKSLGDYCFYRSKATEVIIPT

SEQ ID NO: 2940728 - protein, 23 aa, Entamoeba invadens
GVKTPYWEWEDTFLQKVFPTVTS

SEQ ID NO: 2940729 - protein, 20 aa, Entamoeba invadens
GVKVILQLLILKRIVEKFPH

SEQ ID NO: 2940730 - protein, 35 aa, Entamoeba invadens
GVKVLPRVLLKDFAELGFPFFGYEEIVKSLREKHD

SEQ ID NO: 2940731 - protein, 22 aa, Entamoeba invadens
GVKVNSYPQCFIRGNNKVCYIS

SEQ ID NO: 2940732 - protein, 26 aa, Entamoeba invadens
GVKYCLVKWGGGLSYTEATWEKESDV

SEQ ID NO: 2940733 - protein, 19 aa, Entamoeba invadens
GVLEHCFWLREGDENRSVL

SEQ ID NO: 2940734 - protein, 30 aa, Entamoeba invadens
GVLFSCRADYKVTIFLSRSCEEEVMKKLIE

SEQ ID NO: 2940735 - protein, 17 aa, Entamoeba invadens
GVLGRYSQKVSVSINTT

SEQ ID NO: 2940736 - protein, 25 aa, Entamoeba invadens
GVLHPHHFYELQQCYLNSLHLAFSL

SEQ ID NO: 2940737 - protein, 27 aa, Entamoeba invadens
GVLKKVFFWHQGLGFTFVHNGEELKNT

SEQ ID NO: 2940738 - protein, 17 aa, Entamoeba invadens
GVLKRVEELEIIKDNYI

SEQ ID NO: 2940739 - protein, 19 aa, Entamoeba invadens
GVLKSCFKLTKVQLPVEVT

SEQ ID NO: 2940740 - protein, 25 aa, Entamoeba invadens
GVLLRLLIMRGYRVVVKKPKIAKKS

SEQ ID NO: 2940741 - protein, 18 aa, Entamoeba invadens
GVLLVSKKKVYWVDFEKS

SEQ ID NO: 2940742 - protein, 17 aa, Entamoeba invadens
GVLLYHLVLKFYPEYPI

SEQ ID NO: 2940743 - protein, 27 aa, Entamoeba invadens
GVLRKLRGEVVIPLYFSAIMQNFVKTD

SEQ ID NO: 2940744 - protein, 18 aa, Entamoeba invadens
GVLTLKYPIEHGVVTNWD

SEQ ID NO: 2940745 - protein, 19 aa, Entamoeba invadens
GVLTPLLFCQEIIGTLEEL

SEQ ID NO: 2940746 - protein, 25 aa, Entamoeba invadens
GVMAEALYPLFPLNFLSKSVLEMAT

SEQ ID NO: 2940747 - protein, 24 aa, Entamoeba invadens
GVMFTRYEPEIGLSVTESGLEEVS

SEQ ID NO: 2940748 - protein, 18 aa, Entamoeba invadens
GVMLNKTSLDFFVDFDTI

SEQ ID NO: 2940749 - protein, 27 aa, Entamoeba invadens
GVMNIKCSFCGAFHFKAEKSKNGSFRQ

SEQ ID NO: 2940750 - protein, 24 aa, Entamoeba invadens
GVMPQRIVDCLSEVKKSMWELGIP

SEQ ID NO: 2940751 - protein, 21 aa, Entamoeba invadens
GVMTCVFGLLKPGVDPRIGCC

SEQ ID NO: 2940752 - protein, 24 aa, Entamoeba invadens
GVPEGFAICGPDRVFLSRNNAVLF

SEQ ID NO: 2940753 - protein, 26 aa, Entamoeba invadens
GVPKELKVLVCTWNINQGVFSQDVVN

SEQ ID NO: 2940754 - protein, 23 aa, Entamoeba invadens
GVPKSVVCVGEFAFMNCNTLNEL

SEQ ID NO: 2940755 - protein, 18 aa, Entamoeba invadens
GVPQVEVTFDIDANGILN

SEQ ID NO: 2940756 - protein, 27 aa, Entamoeba invadens
GVPVLADDMFYFWIASCPILPSSEKIS

SEQ ID NO: 2940757 - protein, 25 aa, Entamoeba invadens
GVPWTGVGKIALWPADKPGKMTNPI

SEQ ID NO: 2940758 - protein, 26 aa, Entamoeba invadens
GVREWFRCGLRGWDLDGGLEDGEGCT

SEQ ID NO: 2940759 - protein, 19 aa, Entamoeba invadens
GVRHYYRKFGYILDGPYMA

SEQ ID NO: 2940760 - protein, 21 aa, Entamoeba invadens
GVRIGRRSLKQSIISPNQPTA

SEQ ID NO: 2940761 - protein, 20 aa, Entamoeba invadens
GVRLDESWETVGLNDFNILK

SEQ ID NO: 2940762 - protein, 18 aa, Entamoeba invadens
GVRSMPTFVLFKGGDVVK

SEQ ID NO: 2940763 - protein, 24 aa, Entamoeba invadens
GVSACAICDGAVPIFRNKVLMVVG

SEQ ID NO: 2940764 - protein, 19 aa, Entamoeba invadens
GVSCFEFCNSLSTIELPNS

SEQ ID NO: 2940765 - protein, 20 aa, Entamoeba invadens
GVSCFRGCEALREVVLPNSL

SEQ ID NO: 2940766 - protein, 19 aa, Entamoeba invadens
GVSGIELLKSMLVYNPNNR

SEQ ID NO: 2940767 - protein, 28 aa, Entamoeba invadens
GVSGMCSLGKCYFCGEGVKEDKSKGVKW

SEQ ID NO: 2940768 - protein, 18 aa, Entamoeba invadens
GVSHLSKQCLRRYHGYDI

SEQ ID NO: 2940769 - protein, 18 aa, Entamoeba invadens
GVSKEYHTSFVIDSIKGG

SEQ ID NO: 2940770 - protein, 19 aa, Entamoeba invadens
GVSKFQFPSLFMKEPTFFA

SEQ ID NO: 2940771 - protein, 17 aa, Entamoeba invadens
GVSLGDSNATSWWQKNF

SEQ ID NO: 2940772 - protein, 31 aa, Entamoeba invadens
GVSQLFKTKWFPPKIRKMRIIAQEMEMVYTN

SEQ ID NO: 2940773 - protein, 25 aa, Entamoeba invadens
GVSRNWYKTPSLWVGEEVDSTGTIE

SEQ ID NO: 2940774 - protein, 24 aa, Entamoeba invadens
GVSSSIGCIRCKKGYYTDKSNKCS

SEQ ID NO: 2940775 - protein, 24 aa, Entamoeba invadens
GVSTELFKNVAVAAVMGVFSDYNV

SEQ ID NO: 2940776 - protein, 35 aa, Entamoeba invadens
GVSTIKCIRYSDAFFTGGVDGVVKFWSYKDRIAYL

SEQ ID NO: 2940777 - protein, 25 aa, Entamoeba invadens
GVSYKTLTCSFVYNGVANPLFWNWK

SEQ ID NO: 2940778 - protein, 31 aa, Entamoeba invadens
GVTATMFCKLHEWCGASSYHLYFDSRIGPIE

SEQ ID NO: 2940779 - protein, 24 aa, Entamoeba invadens
GVTCVRWSGRENILYTSSRDRTIN

SEQ ID NO: 2940780 - protein, 18 aa, Entamoeba invadens
GVTDIGFDSFLMSEIQTL

SEQ ID NO: 2940781 - protein, 17 aa, Entamoeba invadens
GVTGYIIEKRRRITAQE

SEQ ID NO: 2940782 - protein, 19 aa, Entamoeba invadens
GVTLFPRNVSLTMIKCTVT

SEQ ID NO: 2940783 - protein, 20 aa, Entamoeba invadens
GVTLYYLIRCEPFSHFGIEL

SEQ ID NO: 2940784 - protein, 17 aa, Entamoeba invadens
GVTSIGDQCFKACKSLI

SEQ ID NO: 2940785 - protein, 17 aa, Entamoeba invadens
GVVALGANCYRDTANLV

SEQ ID NO: 2940786 - protein, 21 aa, Entamoeba invadens
GVVCTCRDGALLVYLLVRSDL

SEQ ID NO: 2940787 - protein, 31 aa, Entamoeba invadens
GVVELEFKCFFMCGSLVKVRIPKTVSKIGKL

SEQ ID NO: 2940788 - protein, 19 aa, Entamoeba invadens
GVVFNAISGVDEWNTDPRA

SEQ ID NO: 2940789 - protein, 18 aa, Entamoeba invadens
GVVHSSNCNMFFSSYFDC

SEQ ID NO: 2940790 - protein, 22 aa, Entamoeba invadens
GVVKAVEYVPAYKNLMNAHASD

SEQ ID NO: 2940791 - protein, 23 aa, Entamoeba invadens
GVVSRPTLFLLLEKCKTLFRSEK

SEQ ID NO: 2940792 - protein, 18 aa, Entamoeba invadens
GVVVLKRIPTNKMSIIRV

SEQ ID NO: 2940793 - protein, 18 aa, Entamoeba invadens
GVYCFSRCSSLSGITIPS

SEQ ID NO: 2940794 - protein, 19 aa, Entamoeba invadens
GVYFIPFLLESGLKDEKVK

SEQ ID NO: 2940795 - protein, 24 aa, Entamoeba invadens
GVYFPKYPCIIPHQKVPFSKITSI

SEQ ID NO: 2940796 - protein, 23 aa, Entamoeba invadens
GVYKMECWKDIPFDCIGVGKQDC

SEQ ID NO: 2940797 - protein, 23 aa, Entamoeba invadens
GVYKSRLLCDVCRNENVRFEPFV

SEQ ID NO: 2940798 - protein, 17 aa, Entamoeba invadens
GVYNGRINYDFCKLVKQ

SEQ ID NO: 2940799 - protein, 21 aa, Entamoeba invadens
GVYSIPIQRGFLERSSNVLSF

SEQ ID NO: 2940800 - protein, 29 aa, Entamoeba invadens
GVYTREHLELFVLPFRPTYLVKSEEESLP

SEQ ID NO: 2940801 - protein, 26 aa, Entamoeba invadens
GVYTREHLELFVLPPRPTYLVKSEEE

SEQ ID NO: 2940802 - protein, 27 aa, Entamoeba invadens
GVYYYRLTGMTMDRLFKNCVSYLSQCE

SEQ ID NO: 2940803 - protein, 26 aa, Entamoeba invadens
GWDAEPLFFPIRVLRKVQSKVEPVES

SEQ ID NO: 2940804 - protein, 23 aa, Entamoeba invadens
GWDTSKVCGFDFGGGEVVSKWEH

SEQ ID NO: 2940805 - protein, 24 aa, Entamoeba invadens
GWEKSPRGAGFIFGKDASDQFNQI

SEQ ID NO: 2940806 - protein, 20 aa, Entamoeba invadens
GWIFGGDPFFDFVGDKSSKV

SEQ ID NO: 2940807 - protein, 23 aa, Entamoeba invadens
GWIPFLRCLFEIERLRQIASGWG

SEQ ID NO: 2940808 - protein, 21 aa, Entamoeba invadens
GWKYVYRIMSSVLKYNASTIL

SEQ ID NO: 2940809 - protein, 19 aa, Entamoeba invadens
GWMFSGDFDVTVIKKFVDG

SEQ ID NO: 2940810 - protein, 27 aa, Entamoeba invadens
GWNIPDPLCLMCYLFPEIVKKTITVQT

SEQ ID NO: 2940811 - protein, 17 aa, Entamoeba invadens
GWPSYLQKLYVSKADGF

SEQ ID NO: 2940812 - protein, 21 aa, Entamoeba invadens
GWSSIDLKLFKVVGQNGIIGV

SEQ ID NO: 2940813 - protein, 20 aa, Entamoeba invadens
GWTVARAGQMGFFKRTEVNK

SEQ ID NO: 2940814 - protein, 18 aa, Entamoeba invadens
GWVEYRVSTQKKFSKMYM

SEQ ID NO: 2940815 - protein, 17 aa, Entamoeba invadens
GWVGCGLGTESGAGQIS

SEQ ID NO: 2940816 - protein, 29 aa, Entamoeba invadens
GWVKEIRRYCEITTSIIIVEFGDTTEKTR

SEQ ID NO: 2940817 - protein, 17 aa, Entamoeba invadens
GWVKGSIGYFSDEGKIF

SEQ ID NO: 2940818 - protein, 19 aa, Entamoeba invadens
GWVKSSIGLTFEKLNEKVK

SEQ ID NO: 2940819 - protein, 18 aa, Entamoeba invadens
GWVPIEFGGKRGWAPAEF

SEQ ID NO: 2940820 - protein, 18 aa, Entamoeba invadens
GWVPSWVMNSLISSQGLS

SEQ ID NO: 2940821 - protein, 24 aa, Entamoeba invadens
GWYHSHPGFGCWLSSIDISTQQSF

SEQ ID NO: 2940822 - protein, 25 aa, Entamoeba invadens
GWYQLCGVVLFTFVKKSIKSLITKT

SEQ ID NO: 2940823 - protein, 17 aa, Entamoeba invadens
GYCFESCSSLKTKNLDT

SEQ ID NO: 2940824 - protein, 17 aa, Entamoeba invadens
GYCKSAVIIGMDGNENA

SEQ ID NO: 2940825 - protein, 19 aa, Entamoeba invadens
GYCKSCINGYVFNIANPKV

SEQ ID NO: 2940826 - protein, 17 aa, Entamoeba invadens
GYCNGTITYRLFLNYLK

SEQ ID NO: 2940827 - protein, 18 aa, Entamoeba invadens
GYCSEFPIVDDVAKGVFG

SEQ ID NO: 2940828 - protein, 18 aa, Entamoeba invadens
GYCTGCLSNYVFVSSTSM

SEQ ID NO: 2940829 - protein, 22 aa, Entamoeba invadens
GYCTSCKLGYVLKLDKQSLICE

SEQ ID NO: 2940830 - protein, 20 aa, Entamoeba invadens
GYDCSGGVFKCVTAPYQEHK

SEQ ID NO: 2940831 - protein, 17 aa, Entamoeba invadens
GYDCTECSSGYSLVRRS

SEQ ID NO: 2940832 - protein, 27 aa, Entamoeba invadens
GYDDVINCWDISTGVPLRRITFEQTMN

SEQ ID NO: 2940833 - protein, 20 aa, Entamoeba invadens
GYDISFKKKRFYGTHKVSPP

SEQ ID NO: 2940834 - protein, 22 aa, Entamoeba invadens
GYDKNPRYPPARQFDDYYEQSR

SEQ ID NO: 2940835 - protein, 24 aa, Entamoeba invadens
GYDVLKRRLEAIAQSKEFQDAKQV

SEQ ID NO: 2940836 - protein, 18 aa, Entamoeba invadens
GYECFSGYASLEEITIPK

SEQ ID NO: 2940837 - protein, 24 aa, Entamoeba invadens
GYEGRCAFPTNFDATYCYALGYTS

SEQ ID NO: 2940838 - protein, 24 aa, Entamoeba invadens
GYEGTYITRHVCFVSFENFGTTSY

SEQ ID NO: 2940839 - protein, 23 aa, Entamoeba invadens
GYEIESIGKFLVVRKGEQTAKVF

SEQ ID NO: 2940840 - protein, 18 aa, Entamoeba invadens
GYEKYDFKMNNNTLSFGN

SEQ ID NO: 2940841 - protein, 27 aa, Entamoeba invadens
GYETDIAMRVMKLWITNKDRPMHMFSV

SEQ ID NO: 2940842 - protein, 19 aa, Entamoeba invadens
GYEVVKIAEIFVRNKIYVT

SEQ ID NO: 2940843 - protein, 25 aa, Entamoeba invadens
GYFESLKGIMPPVVGGEEWPTRNQE

SEQ ID NO: 2940844 - protein, 26 aa, Entamoeba invadens
GYFESLKGIMPPVVGGEEWPTRNQEG

SEQ ID NO: 2940845 - protein, 23 aa, Entamoeba invadens
GYFMPAIGLGTWLAKPGEVGAAV

SEQ ID NO: 2940846 - protein, 20 aa, Entamoeba invadens
GYFMYYRFVGHYITSNETGQ

SEQ ID NO: 2940847 - protein, 20 aa, Entamoeba invadens
GYFPKELLSKIFAMSESTSE

SEQ ID NO: 2940848 - protein, 18 aa, Entamoeba invadens
GYFQECFVLAYRLVTTPE

SEQ ID NO: 2940849 - protein, 21 aa, Entamoeba invadens
GYGEGYLYPPMFDHVLQQSYL

SEQ ID NO: 2940850 - protein, 18 aa, Entamoeba invadens
GYGKRTAALGYMFHAFKK

SEQ ID NO: 2940851 - protein, 19 aa, Entamoeba invadens
GYHALLPIITACWIGTNYQ

SEQ ID NO: 2940852 - protein, 22 aa, Entamoeba invadens
GYHCGTIRYINWIDSRHSHVFD

SEQ ID NO: 2940853 - protein, 18 aa, Entamoeba invadens
GYHDLRRISYYVLSDGKI

SEQ ID NO: 2940854 - protein, 24 aa, Entamoeba invadens
GYHPYRVILCRVLLGRDGRDYEFK

SEQ ID NO: 2940855 - protein, 17 aa, Entamoeba invadens
GYIFKDQFNMIFQVVQD

SEQ ID NO: 2940856 - protein, 25 aa, Entamoeba invadens
GYIHAKIDVIGAWVDDQNAFVFSLF

SEQ ID NO: 2940857 - protein, 24 aa, Entamoeba invadens
GYIMYGIKVSEAFDEVDGKIEEKK

SEQ ID NO: 2940858 - protein, 19 aa, Entamoeba invadens
GYISGRMVVDMGKDEENAG

SEQ ID NO: 2940859 - protein, 17 aa, Entamoeba invadens
GYIYYNISNFFEGNLKS

SEQ ID NO: 2940860 - protein, 22 aa, Entamoeba invadens
GYKLQKVCCVDMFPNTYHVETV

SEQ ID NO: 2940861 - protein, 17 aa, Entamoeba invadens
GYLAKYEIDEIIPKNNI

SEQ ID NO: 2940862 - protein, 28 aa, Entamoeba invadens
GYLDTPRLYLKWIEKISEEHSVRQHYLE

SEQ ID NO: 2940863 - protein, 23 aa, Entamoeba invadens
GYLKAKRTVKEYIPRRKDALQQR

SEQ ID NO: 2940864 - protein, 18 aa, Entamoeba invadens
GYLKDVFNTTGLEHYVHG

SEQ ID NO: 2940865 - protein, 19 aa, Entamoeba invadens
GYLKLPFEHSRNADNLRNF

SEQ ID NO: 2940866 - protein, 18 aa, Entamoeba invadens
GYLPYFKLKKSLDVVVEN

SEQ ID NO: 2940867 - protein, 18 aa, Entamoeba invadens
GYLSEDWMYYCCSNEISL

SEQ ID NO: 2940868 - protein, 21 aa, Entamoeba invadens
GYLVLKDSILGLFTSVEDAFK

SEQ ID NO: 2940869 - protein, 19 aa, Entamoeba invadens
GYLYKGLDTDPDFNWKYLF

SEQ ID NO: 2940870 - protein, 20 aa, Entamoeba invadens
GYLYLCLCALYANPHDPIQN

SEQ ID NO: 2940871 - protein, 17 aa, Entamoeba invadens
GYNCFSYCKTLKKVVIP

SEQ ID NO: 2940872 - protein, 25 aa, Entamoeba invadens
GYNNKKCWPKDCRMRLMKHDVNLGR

SEQ ID NO: 2940873 - protein, 18 aa, Entamoeba invadens
GYNSWVYGIEKGFWIHAQ

SEQ ID NO: 2940874 - protein, 20 aa, Entamoeba invadens
GYPGLMPIQVMINSKKTIAK

SEQ ID NO: 2940875 - protein, 20 aa, Entamoeba invadens
GYPLRLSLLNIYNILESLNL

SEQ ID NO: 2940876 - protein, 23 aa, Entamoeba invadens
GYPTGLGALIVKNSVLDLMQKSF

SEQ ID NO: 2940877 - protein, 23 aa, Entamoeba invadens
GYQNGALVFCVRLVTDQKDLSPD

SEQ ID NO: 2940878 - protein, 20 aa, Entamoeba invadens
GYRGLRSLRQTEWDCDEDLP

SEQ ID NO: 2940879 - protein, 23 aa, Entamoeba invadens
GYRNVEGPLRMVINESTRQGNGS

SEQ ID NO: 2940880 - protein, 19 aa, Entamoeba invadens
GYSALLAYVYSYSFQKNKH

SEQ ID NO: 2940881 - protein, 26 aa, Entamoeba invadens
GYSCLLHQCCWRVLKESTTLKDYTKN

SEQ ID NO: 2940882 - protein, 18 aa, Entamoeba invadens
GYSKLLIVIYRIFTEDDS

SEQ ID NO: 2940883 - protein, 38 aa, Entamoeba invadens
GYSKLPLDCYSKVDLFYQCCLGIQWLHNKLNIIHRDIK

SEQ ID NO: 2940884 - protein, 19 aa, Entamoeba invadens
GYSQKTREWYAPKEQCFPA

SEQ ID NO: 2940885 - protein, 19 aa, Entamoeba invadens
GYSTILTDVIFFINRGLNI

SEQ ID NO: 2940886 - protein, 18 aa, Entamoeba invadens
GYTNDWVIDGFHFVLSLE

SEQ ID NO: 2940887 - protein, 18 aa, Entamoeba invadens
GYTPGMKVCTRFPPEPSG

SEQ ID NO: 2940888 - protein, 17 aa, Entamoeba invadens
GYVHCLEADTFSRTKYN

SEQ ID NO: 2940889 - protein, 18 aa, Entamoeba invadens
GYVIGSRTNGNLAISRSL

SEQ ID NO: 2940890 - protein, 19 aa, Entamoeba invadens
GYVKRCALMALGKICCEKL

SEQ ID NO: 2940891 - protein, 21 aa, Entamoeba invadens
GYVKVWTCMCGSGETPKDYFV

SEQ ID NO: 2940892 - protein, 19 aa, Entamoeba invadens
GYVQWATCVTELFRTAGIA

SEQ ID NO: 2940893 - protein, 17 aa, Entamoeba invadens
GYYCFYRCSSLSSITIP

SEQ ID NO: 2940894 - protein, 18 aa, Entamoeba invadens
GYYEIRWHCPKQVSQPKI

SEQ ID NO: 2940895 - protein, 20 aa, Entamoeba invadens
GYYGDARGPYRYHYEKGATY

SEQ ID NO: 2940896 - protein, 24 aa, Entamoeba invadens
GYYIPRKEVLCGNETTFKSEKSVD

SEQ ID NO: 2940897 - protein, 25 aa, Entamoeba invadens
GYYQLCGVVLYVFFHERMENHIEEV

SEQ ID NO: 2940898 - protein, 24 aa, Entamoeba invadens
GYYSCPLCSESIQPIDLVIDLQME

SEQ ID NO: 2940899 - protein, 17 aa, Entamoeba invadens
GYYSKQLITGKKEFETK

SEQ ID NO: 2940900 - protein, 31 aa, Entamoeba invadens
GYYWTGCKSNVFSNEIEKIYNLRSQFKKEGN

SEQ ID NO: 2940901 - protein, 21 aa, Entamoeba invadens
HAAAIPPELIIEAFRKLAPEE

SEQ ID NO: 2940902 - protein, 22 aa, Entamoeba invadens
HAAEISRVISLFTLSKLFSDNA

SEQ ID NO: 2940903 - protein, 24 aa, Entamoeba invadens
HAASAEPKCSLFLQNEKVKFEKID

SEQ ID NO: 2940904 - protein, 20 aa, Entamoeba invadens
HAAVVARGMGKPCVSGAEGI

SEQ ID NO: 2940905 - protein, 18 aa, Entamoeba invadens
HADIHGAASCLIKGVKGK

SEQ ID NO: 2940906 - protein, 28 aa, Entamoeba invadens
HAEKLYTKYKVECEYCRRMSSRYDAKLL

SEQ ID NO: 2940907 - protein, 22 aa, Entamoeba invadens
HAELQLVLGEKVVELNVNIDKI

SEQ ID NO: 2940908 - protein, 28 aa, Entamoeba invadens
HAFPKEKFKHAWDVANFITTDKRPDIDN

SEQ ID NO: 2940909 - protein, 25 aa, Entamoeba invadens
HAFQPYCLTEAITPEAALQYLEEKQ

SEQ ID NO: 2940910 - protein, 17 aa, Entamoeba invadens
HAFSGCTNLHINFPTTL

SEQ ID NO: 2940911 - protein, 23 aa, Entamoeba invadens
HAGHLRSTIIGNFIANVHRLLGF

SEQ ID NO: 2940912 - protein, 23 aa, Entamoeba invadens
HAHKYKLPTVFFNGVMVANEPEE

SEQ ID NO: 2940913 - protein, 18 aa, Entamoeba invadens
HAHLLLNERVTLFGIEIF

SEQ ID NO: 2940914 - protein, 19 aa, Entamoeba invadens
HAIDLCFTGFSIQNPSKMY

SEQ ID NO: 2940915 - protein, 19 aa, Entamoeba invadens
HAIVDLSLYDKTREMMCQC

SEQ ID NO: 2940916 - protein, 19 aa, Entamoeba invadens
HAKSMFLNFGYAEKTGGKC

SEQ ID NO: 2940917 - protein, 18 aa, Entamoeba invadens
HALLRFITTKAPSITSSF

SEQ ID NO: 2940918 - protein, 26 aa, Entamoeba invadens
HAMEVTHCELLRCFVKYLKRLRDANE

SEQ ID NO: 2940919 - protein, 18 aa, Entamoeba invadens
HAMLKLADCTLMVDNESI

SEQ ID NO: 2940920 - protein, 32 aa, Entamoeba invadens
HAMPELSVRVKLCLDIAKGLNFIHKNNVIHRD

SEQ ID NO: 2940921 - protein, 21 aa, Entamoeba invadens
HAPKFLNVFFEFLMLNEDAFI

SEQ ID NO: 2940922 - protein, 23 aa, Entamoeba invadens
HAPKKFPHVIPFNRNEKTCVDFI

SEQ ID NO: 2940923 - protein, 21 aa, Entamoeba invadens
HAPMMSVEMTNQWLITIESAL

SEQ ID NO: 2940924 - protein, 20 aa, Entamoeba invadens
HAQFTFKKVWVAFAEFCVRN

SEQ ID NO: 2940925 - protein, 18 aa, Entamoeba invadens
HAQIPQFVPYIPKVLQFV

SEQ ID NO: 2940926 - protein, 28 aa, Entamoeba invadens
HARFSLSCSPSFFIKYLRAFDKEVRRFP

SEQ ID NO: 2940927 - protein, 23 aa, Entamoeba invadens
HARGLKLMLDFVPNHSACDAPTV

SEQ ID NO: 2940928 - protein, 24 aa, Entamoeba invadens
HARHPQFLNFCAGLLDLDPEKRLT

SEQ ID NO: 2940929 - protein, 23 aa, Entamoeba invadens
HATESTKGYGFLTFKTLSDAENI

SEQ ID NO: 2940930 - protein, 24 aa, Entamoeba invadens
HATIRYDKQLSFYVFVNEGTNGSI

SEQ ID NO: 2940931 - protein, 19 aa, Entamoeba invadens
HAVATILLMFIRELPEPLI

SEQ ID NO: 2940932 - protein, 24 aa, Entamoeba invadens
HAVDKRIGINVAIKESFGTQLAYL

SEQ ID NO: 2940933 - protein, 19 aa, Entamoeba invadens
HAVGHEITTYYGLAHGETL

SEQ ID NO: 2940934 - protein, 19 aa, Entamoeba invadens
HAYTKLTGENTFDYEEISK

SEQ ID NO: 2940935 - protein, 17 aa, Entamoeba invadens
HCADSIFNITEKTISNM

SEQ ID NO: 2940936 - protein, 26 aa, Entamoeba invadens
HCAEVNKWLLSNKIQSEWRDGTLLCE

SEQ ID NO: 2940937 - protein, 21 aa, Entamoeba invadens
HCATCAYNGVSSCLICSMGYY

SEQ ID NO: 2940938 - protein, 33 aa, Entamoeba invadens
HCATCAYNGVSSCLICSMGYYPLSGTCVACSAT

SEQ ID NO: 2940939 - protein, 24 aa, Entamoeba invadens
HCATEPKITIGSIFNLCDKNDTTQ

SEQ ID NO: 2940940 - protein, 17 aa, Entamoeba invadens
HCAYHKAGISTSVDVFN

SEQ ID NO: 2940941 - protein, 19 aa, Entamoeba invadens
HCDGLCIDIPRGSADDNTK

SEQ ID NO: 2940942 - protein, 25 aa, Entamoeba invadens
HCDPKRKPLYLVEQPIRAIIFGFNT

SEQ ID NO: 2940943 - protein, 19 aa, Entamoeba invadens
HCEGLCIDIPRGSTSDNVK

SEQ ID NO: 2940944 - protein, 18 aa, Entamoeba invadens
HCFAYCYSLESVFCESKE

SEQ ID NO: 2940945 - protein, 18 aa, Entamoeba invadens
HCFDGCSSLSNIVIPKSV

SEQ ID NO: 2940946 - protein, 21 aa, Entamoeba invadens
HCFEGCSKLGSISIPQSVQFI

SEQ ID NO: 2940947 - protein, 22 aa, Entamoeba invadens
HCGQELIPFWDALRDCLDSDGV

SEQ ID NO: 2940948 - protein, 20 aa, Entamoeba invadens
HCIKVCKKLEKSKWDVEKIR

SEQ ID NO: 2940949 - protein, 23 aa, Entamoeba invadens
HCILEMYPELPVSVKYLHAKIDS

SEQ ID NO: 2940950 - protein, 21 aa, Entamoeba invadens
HCINMLHAKLSVLINTRKNKE

SEQ ID NO: 2940951 - protein, 20 aa, Entamoeba invadens
HCKFEVFEIPDGVKEIEENT

SEQ ID NO: 2940952 - protein, 22 aa, Entamoeba invadens
HCKRIGVGVCKCVSVVWMDEIC

SEQ ID NO: 2940953 - protein, 23 aa, Entamoeba invadens
HCLNTLICWSHPTTSSTSASCLT

SEQ ID NO: 2940954 - protein, 17 aa, Entamoeba invadens
HCLSCRLGFAPNLSSPP

SEQ ID NO: 2940955 - protein, 17 aa, Entamoeba invadens
HCLSCRRGFAPILSSPP

SEQ ID NO: 2940956 - protein, 21 aa, Entamoeba invadens
HCNKLKSCQHFVCGTKCGHFI

SEQ ID NO: 2940957 - protein, 18 aa, Entamoeba invadens
HCNKLSSIIIPLSVTSIG

SEQ ID NO: 2940958 - protein, 21 aa, Entamoeba invadens
HCPHGQYSPVFHQFIECVFIL

SEQ ID NO: 2940959 - protein, 20 aa, Entamoeba invadens
HCPHLLKTLVTSFCLYPKCQ

SEQ ID NO: 2940960 - protein, 22 aa, Entamoeba invadens
HCPLNAKTKYLFGTSAFLKMKK

SEQ ID NO: 2940961 - protein, 17 aa, Entamoeba invadens
HCPNGFNKWSNGTEKAN

SEQ ID NO: 2940962 - protein, 25 aa, Entamoeba invadens
HCPTGSFFPSPGFKIPCKQILHGVG

SEQ ID NO: 2940963 - protein, 26 aa, Entamoeba invadens
HCRAGRGRTGIVVCAVLLALGRAKTT

SEQ ID NO: 2940964 - protein, 24 aa, Entamoeba invadens
HCRLCKNEKCFICDNNFILNNENS

SEQ ID NO: 2940965 - protein, 19 aa, Entamoeba invadens
HCRMNCFEFQSFILDCYNA

SEQ ID NO: 2940966 - protein, 22 aa, Entamoeba invadens
HCSCPSLKELQAWVLNLLKLKK

SEQ ID NO: 2940967 - protein, 28 aa, Entamoeba invadens
HCSEEVPGKCLFCGERLEIIRKPEGYDE

SEQ ID NO: 2940968 - protein, 22 aa, Entamoeba invadens
HCSIYLVAKFGYFERLKEFATF

SEQ ID NO: 2940969 - protein, 25 aa, Entamoeba invadens
HCTTCTSFFPISHVLYTPKVPCRAP

SEQ ID NO: 2940970 - protein, 18 aa, Entamoeba invadens
HCVILKTKINEFSQDVIE

SEQ ID NO: 2940971 - protein, 22 aa, Entamoeba invadens
HCVQSSFDYRGFKYALCGDKRF

SEQ ID NO: 2940972 - protein, 21 aa, Entamoeba invadens
HCWCLFKTPAGELPWPSIVKR

SEQ ID NO: 2940973 - protein, 28 aa, Entamoeba invadens
HDCKFERLRRITGYLVGTLDRWNNAKQA

SEQ ID NO: 2940974 - protein, 23 aa, Entamoeba invadens
HDDCIKISGAFIEKIIPVYVREI

SEQ ID NO: 2940975 - protein, 23 aa, Entamoeba invadens
HDEMIKSQMTFEAALNLFNNNQN

SEQ ID NO: 2940976 - protein, 25 aa, Entamoeba invadens
HDEPLKQLVVDGGMKLSANKARAGS

SEQ ID NO: 2940977 - protein, 17 aa, Entamoeba invadens
HDFCSSMFYNGELQYAK

SEQ ID NO: 2940978 - protein, 20 aa, Entamoeba invadens
HDFITHVLPFFDVINRSSKI

SEQ ID NO: 2940979 - protein, 23 aa, Entamoeba invadens
HDFLELLPKLSKGEKVDHPVFEG

SEQ ID NO: 2940980 - protein, 24 aa, Entamoeba invadens
HDFPEYLAEYFVDYLEVIPYRLGQ

SEQ ID NO: 2940981 - protein, 21 aa, Entamoeba invadens
HDFPTLLQLLSSYTSIPTTLK

SEQ ID NO: 2940982 - protein, 17 aa, Entamoeba invadens
HDGHMEFSYVVALSKQL

SEQ ID NO: 2940983 - protein, 27 aa, Entamoeba invadens
HDHRELLSRFKINFAKELEMTQEKIEM

SEQ ID NO: 2940984 - protein, 22 aa, Entamoeba invadens
HDITLLLVLACCGIKCDKVINL

SEQ ID NO: 2940985 - protein, 22 aa, Entamoeba invadens
HDKLPFLFVDTMCELYSQISTL

SEQ ID NO: 2940986 - protein, 32 aa, Entamoeba invadens
HDKNISMYFVYQWLALLFKRDFGGEIYELWDA

SEQ ID NO: 2940987 - protein, 28 aa, Entamoeba invadens
HDKVVDVCNDFFKTFKMPETPILYQQQV

SEQ ID NO: 2940988 - protein, 20 aa, Entamoeba invadens
HDLKMIEAIVRKDTVSTEVQ

SEQ ID NO: 2940989 - protein, 18 aa, Entamoeba invadens
HDLLWGQVFDRLTLIIFE

SEQ ID NO: 2940990 - protein, 25 aa, Entamoeba invadens
HDLYPLGVCLYRLMTHKIPYGENET

SEQ ID NO: 2940991 - protein, 23 aa, Entamoeba invadens
HDLYVKLLHLIGGPRDLHLSLTL

SEQ ID NO: 2940992 - protein, 20 aa, Entamoeba invadens
HDMKDCLISFQYPTLTVTVK

SEQ ID NO: 2940993 - protein, 36 aa, Entamoeba invadens
HDMKLLIQYCEAFNCLNRVEFDLSLVRGLDYYTGVI

SEQ ID NO: 2940994 - protein, 17 aa, Entamoeba invadens
HDMKSEFNVLVNNIHPD

SEQ ID NO: 2940995 - protein, 25 aa, Entamoeba invadens
HDMNTPCWFDFGYGASRVYVHKPTS

SEQ ID NO: 2940996 - protein, 24 aa, Entamoeba invadens
HDNKELKKLIGVDVDDETEETTEL

SEQ ID NO: 2940997 - protein, 25 aa, Entamoeba invadens
HDNQCLKFVLKYVKLFDQSIFEKSI

SEQ ID NO: 2940998 - protein, 17 aa, Entamoeba invadens
HDNQHKFVIPEFGPESV

SEQ ID NO: 2940999 - protein, 22 aa, Entamoeba invadens
HDPHVYETLDLYDGLIEYLENF

SEQ ID NO: 2941000 - protein, 18 aa, Entamoeba invadens
HDPKSFEDVHTWIETARK

SEQ ID NO: 2941001 - protein, 24 aa, Entamoeba invadens
HDPTTCSFCLTGKPIDFEKKEQPK

SEQ ID NO: 2941002 - protein, 26 aa, Entamoeba invadens
HDPWRAFKCSCGGIIFPEPEGFICHT

SEQ ID NO: 2941003 - protein, 17 aa, Entamoeba invadens
HDQKMQFCIEFKTSSRK

SEQ ID NO: 2941004 - protein, 25 aa, Entamoeba invadens
HDSAELKVFFSQATFATRRRRERMF

SEQ ID NO: 2941005 - protein, 18 aa, Entamoeba invadens
HDSLKFVGQQAFEGLSNL

SEQ ID NO: 2941006 - protein, 27 aa, Entamoeba invadens
HDSTGFGQPGGWSYVIGIYLDDNLSKQ

SEQ ID NO: 2941007 - protein, 26 aa, Entamoeba invadens
HDTAFLVQGVMEFVTFFKTQGIIPLF

SEQ ID NO: 2941008 - protein, 24 aa, Entamoeba invadens
HDTTFKGERLFAGNQKLFQIRNFA

SEQ ID NO: 2941009 - protein, 20 aa, Entamoeba invadens
HDVRFVYSLCAVCYLLNDWS

SEQ ID NO: 2941010 - protein, 25 aa, Entamoeba invadens
HDYCKSSVFSPCYCGPLFPMETPYY

SEQ ID NO: 2941011 - protein, 17 aa, Entamoeba invadens
HDYKSRADFCLAATYAL

SEQ ID NO: 2941012 - protein, 28 aa, Entamoeba invadens
HEDKEFKSIIYIFSCPDGSHGTKSAPVR

SEQ ID NO: 2941013 - protein, 25 aa, Entamoeba invadens
HEDLPKIDFSYGVTPFFVDKKKYWK

SEQ ID NO: 2941014 - protein, 25 aa, Entamoeba invadens
HEDMLFKVLFKITSKTGEVLGNLFS
